United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 199

SEQ ID NO: 8272014 - DNA, 19 bp, Homo sapiens
ctgggctgaggtctgcctt

SEQ ID NO: 8272015 - DNA, 22 bp, Homo sapiens
atattatagacagagtcttctg

SEQ ID NO: 8272016 - DNA, 22 bp, Homo sapiens
ctggctgtgtgtcttcattcag

SEQ ID NO: 8272017 - DNA, 22 bp, Homo sapiens
ctggctgtttctcctttgtcta

SEQ ID NO: 8272018 - DNA, 19 bp, Homo sapiens
ctggcttcaagcagtcctc

SEQ ID NO: 8272019 - DNA, 22 bp, Homo sapiens
ctggcttccaccatggcccctg

SEQ ID NO: 8272020 - DNA, 22 bp, Homo sapiens
ctggcttccaccatggcccctg

SEQ ID NO: 8272021 - DNA, 22 bp, Homo sapiens
ctggcttcctcaggagcagtgg

SEQ ID NO: 8272022 - DNA, 22 bp, Homo sapiens
ctggctggccggagcgaggcgg

SEQ ID NO: 8272023 - DNA, 22 bp, Homo sapiens
ctggctggccggaggcatccct

SEQ ID NO: 8272024 - DNA, 22 bp, Homo sapiens
ctggctggcgttttccaaaagc

SEQ ID NO: 8272025 - DNA, 22 bp, Homo sapiens
ctggctggctcatttttcattg

SEQ ID NO: 8272026 - DNA, 22 bp, Homo sapiens
ctggctggctgtgcccctgccg

SEQ ID NO: 8272027 - DNA, 22 bp, Homo sapiens
ctggctgggagcgagctgctca

SEQ ID NO: 8272028 - DNA, 22 bp, Homo sapiens
ctggctgggaagtagagtaggt

SEQ ID NO: 8272029 - DNA, 22 bp, Homo sapiens
ctggctgtgtccacagagtaag

SEQ ID NO: 8272030 - DNA, 22 bp, Homo sapiens
atatttaaacagggtaccaata

SEQ ID NO: 8272031 - DNA, 22 bp, Homo sapiens
atattgtactagggttacatgt

SEQ ID NO: 8272032 - DNA, 22 bp, Homo sapiens
atattcttgtgattataaagta

SEQ ID NO: 8272033 - DNA, 22 bp, Homo sapiens
atattcttgtgattataaagta

SEQ ID NO: 8272034 - DNA, 22 bp, Homo sapiens
atatttactgctgtggtgaagg

SEQ ID NO: 8272035 - DNA, 22 bp, Homo sapiens
atattttggcaaatgtctagat

SEQ ID NO: 8272036 - DNA, 22 bp, Homo sapiens
atcaaagagcttgacaatccta

SEQ ID NO: 8272037 - DNA, 22 bp, Homo sapiens
atcagaacaaaagaacagttta

SEQ ID NO: 8272038 - DNA, 21 bp, Homo sapiens
atcagaaaatgtaatggagca

SEQ ID NO: 8272039 - DNA, 22 bp, Homo sapiens
atcaacttaaagaaaagatact

SEQ ID NO: 8272040 - DNA, 22 bp, Homo sapiens
atagcaatttgcccaattacct

SEQ ID NO: 8272041 - DNA, 22 bp, Homo sapiens
atagcagggatgtcagcaagta

SEQ ID NO: 8272042 - DNA, 22 bp, Homo sapiens
ctggctggcaagtagaacacaa

SEQ ID NO: 8272043 - DNA, 22 bp, Homo sapiens
ctggctggagtgcaggtgagtg

SEQ ID NO: 8272044 - DNA, 22 bp, Homo sapiens
ctggctggccatgtagagatga

SEQ ID NO: 8272045 - DNA, 22 bp, Homo sapiens
ctggctggccatgcagcgccag

SEQ ID NO: 8272046 - DNA, 22 bp, Homo sapiens
ctggctggcagatgctcttgct

SEQ ID NO: 8272047 - DNA, 22 bp, Homo sapiens
ctggctcccgaagccctcagtg

SEQ ID NO: 8272048 - DNA, 22 bp, Homo sapiens
ctggctccattactcagcatct

SEQ ID NO: 8272049 - DNA, 22 bp, Homo sapiens
ctggctccatctttgcttcctg

SEQ ID NO: 8272050 - DNA, 22 bp, Homo sapiens
ctggctccatccttgagctctg

SEQ ID NO: 8272051 - DNA, 22 bp, Homo sapiens
atactacacattgactatattt

SEQ ID NO: 8272052 - DNA, 22 bp, Homo sapiens
atactacatcacagccaagaag

SEQ ID NO: 8272053 - DNA, 23 bp, Homo sapiens
atagactgatttggatgtgaaag

SEQ ID NO: 8272054 - DNA, 22 bp, Homo sapiens
atagatttgaatttaagacttg

SEQ ID NO: 8272055 - DNA, 22 bp, Homo sapiens
atagcaaaaatgaacaaagctt

SEQ ID NO: 8272056 - DNA, 22 bp, Homo sapiens
ctggcccattgccttctctctc

SEQ ID NO: 8272057 - DNA, 22 bp, Homo sapiens
atagcaaagcctggcacaatga

SEQ ID NO: 8272058 - DNA, 22 bp, Homo sapiens
atagcaaaggacaatagtcagt

SEQ ID NO: 8272059 - DNA, 22 bp, Homo sapiens
atagcaaaagcatgtgcaatac

SEQ ID NO: 8272060 - DNA, 22 bp, Homo sapiens
atagcaaaaatgaacaaagctt

SEQ ID NO: 8272061 - DNA, 22 bp, Homo sapiens
ctggagaattctatgaaatatt

SEQ ID NO: 8272062 - DNA, 22 bp, Homo sapiens
ctggagaagaggtagtatgtag

SEQ ID NO: 8272063 - DNA, 22 bp, Homo sapiens
ctggagaagaggtagtatgtag

SEQ ID NO: 8272064 - DNA, 22 bp, Homo sapiens
ctgctgccaagggtgccacagg

SEQ ID NO: 8272065 - DNA, 22 bp, Homo sapiens
ctgctgcaggatgggcactctg

SEQ ID NO: 8272066 - DNA, 22 bp, Homo sapiens
ctggaatgggtttcaggcactg

SEQ ID NO: 8272067 - DNA, 22 bp, Homo sapiens
atacatagttctgtgaaaagta

SEQ ID NO: 8272068 - DNA, 22 bp, Homo sapiens
atacattcagcagtgctcatga

SEQ ID NO: 8272069 - DNA, 22 bp, Homo sapiens
ataccacaacatggctcagagg

SEQ ID NO: 8272070 - DNA, 22 bp, Homo sapiens
ataccatttccatgttacatta

SEQ ID NO: 8272071 - DNA, 22 bp, Homo sapiens
atacatacatgtacacataaat

SEQ ID NO: 8272072 - DNA, 22 bp, Homo sapiens
atacatacatgtatgcacatac

SEQ ID NO: 8272073 - DNA, 22 bp, Homo sapiens
atacatacgtacatacgtatgt

SEQ ID NO: 8272074 - DNA, 22 bp, Homo sapiens
ctgcctctgcgtcccacagagt

SEQ ID NO: 8272075 - DNA, 22 bp, Homo sapiens
ctgcctctccccagagtggccc

SEQ ID NO: 8272076 - DNA, 22 bp, Homo sapiens
ataaatgattcagcaggaaata

SEQ ID NO: 8272077 - DNA, 22 bp, Homo sapiens
ctgcctctcaggtccctgagat

SEQ ID NO: 8272078 - DNA, 22 bp, Homo sapiens
ctgcctctcagcctgaccgcca

SEQ ID NO: 8272079 - DNA, 22 bp, Homo sapiens
ctgcctctattcactgaggcag

SEQ ID NO: 8272080 - DNA, 20 bp, Homo sapiens
ctgccgaccacagccatgga

SEQ ID NO: 8272081 - DNA, 23 bp, Homo sapiens
ataaattactatctccctagagc

SEQ ID NO: 8272082 - DNA, 22 bp, Homo sapiens
ataaattaggatctggggttcc

SEQ ID NO: 8272083 - DNA, 22 bp, Homo sapiens
ataacatgacctgtgcttcaca

SEQ ID NO: 8272084 - DNA, 22 bp, Homo sapiens
ataacatggagtttgtcattta

SEQ ID NO: 8272085 - DNA, 22 bp, Homo sapiens
ataacattttgacaactggtga

SEQ ID NO: 8272086 - DNA, 22 bp, Homo sapiens
ctgctgaggggaggaaagacgg

SEQ ID NO: 8272087 - DNA, 22 bp, Homo sapiens
ctgctgaggctccggaccaagt

SEQ ID NO: 8272088 - DNA, 22 bp, Homo sapiens
atacaactgctctcagataagt

SEQ ID NO: 8272089 - DNA, 22 bp, Homo sapiens
atacaactgccttagaaggaaa

SEQ ID NO: 8272090 - DNA, 22 bp, Homo sapiens
ataacttcagggctgtgacaga

SEQ ID NO: 8272091 - DNA, 23 bp, Homo sapiens
ataagaaaacagtaggctcagag

SEQ ID NO: 8272092 - DNA, 22 bp, Homo sapiens
ataagaaacattattctttcca

SEQ ID NO: 8272093 - DNA, 21 bp, Homo sapiens
ataagcatgctgattacattt

SEQ ID NO: 8272094 - DNA, 22 bp, Homo sapiens
ctgcaagctggtaataagcaga

SEQ ID NO: 8272095 - DNA, 21 bp, Homo sapiens
ctgcaagacatgctgttcttg

SEQ ID NO: 8272096 - DNA, 22 bp, Homo sapiens
ctgcatggttcaaatgagctaa

SEQ ID NO: 8272097 - DNA, 22 bp, Homo sapiens
ctgcatggtagggataagatgg

SEQ ID NO: 8272098 - DNA, 21 bp, Homo sapiens
ctgcatctgagtcattatgcc

SEQ ID NO: 8272099 - DNA, 20 bp, Homo sapiens
ctgcatctgtgacttgcaaa

SEQ ID NO: 8272100 - DNA, 22 bp, Homo sapiens
ctgcagggtttcgccagttgtg

SEQ ID NO: 8272101 - DNA, 22 bp, Homo sapiens
ctgcatccatgttgctgcaaag

SEQ ID NO: 8272102 - DNA, 22 bp, Homo sapiens
ctgcagggtttcgccagttgtg

SEQ ID NO: 8272103 - DNA, 22 bp, Homo sapiens
ctgcagggtttcgccagttgtg

SEQ ID NO: 8272104 - DNA, 22 bp, Homo sapiens
ctgcagggttcggagagttccc

SEQ ID NO: 8272105 - DNA, 22 bp, Homo sapiens
ctgcagggttcggagagttccc

SEQ ID NO: 8272106 - DNA, 20 bp, Homo sapiens
ctgcagggttagaggctcca

SEQ ID NO: 8272107 - DNA, 20 bp, Homo sapiens
ctgcagggttagaggctcca

SEQ ID NO: 8272108 - DNA, 22 bp, Homo sapiens
ctgcagggagaggggacagcct

SEQ ID NO: 8272109 - DNA, 22 bp, Homo sapiens
ctgcagagcaagtaacatcctc

SEQ ID NO: 8272110 - DNA, 22 bp, Homo sapiens
ctgcagagatgaagaaggtggc

SEQ ID NO: 8272111 - DNA, 22 bp, Homo sapiens
ctgcagagaattgtggggcttc

SEQ ID NO: 8272112 - DNA, 23 bp, Homo sapiens
ctgcagagaactgagggacagcc

SEQ ID NO: 8272113 - DNA, 23 bp, Homo sapiens
ctgcagagaactgagggacagcc

SEQ ID NO: 8272114 - DNA, 22 bp, Homo sapiens
ctgcagagagtaactgaaatat

SEQ ID NO: 8272115 - DNA, 22 bp, Homo sapiens
ccaggagggaggagttcctgag

SEQ ID NO: 8272116 - DNA, 22 bp, Homo sapiens
ccaggaggtggaggttgcggtg

SEQ ID NO: 8272117 - DNA, 22 bp, Homo sapiens
ccaggaggtggagattgcagtg

SEQ ID NO: 8272118 - DNA, 22 bp, Homo sapiens
aggccctgctttccagagctca

SEQ ID NO: 8272119 - DNA, 21 bp, Homo sapiens
aggccctggaggtcagagaaa

SEQ ID NO: 8272120 - DNA, 22 bp, Homo sapiens
aggccctggacactcaagccgg

SEQ ID NO: 8272121 - DNA, 20 bp, Homo sapiens
ccactccaggtgattctgat

SEQ ID NO: 8272122 - DNA, 19 bp, Homo sapiens
ccagaggcagcttctgtaa

SEQ ID NO: 8272123 - DNA, 22 bp, Homo sapiens
ccagaggttccaggctagggag

SEQ ID NO: 8272124 - DNA, 19 bp, Homo sapiens
ccagaggtttgctgggcct

SEQ ID NO: 8272125 - DNA, 22 bp, Homo sapiens
ccagccctcggtagtcccatag

SEQ ID NO: 8272126 - DNA, 18 bp, Homo sapiens
ccagccctgcagcacctg

SEQ ID NO: 8272127 - DNA, 22 bp, Homo sapiens
aggccctgcggaaatgatcatt

SEQ ID NO: 8272128 - DNA, 22 bp, Homo sapiens
ccagccagccttgatctgagta

SEQ ID NO: 8272129 - DNA, 22 bp, Homo sapiens
ccagccagctgcccttggggcc

SEQ ID NO: 8272130 - DNA, 22 bp, Homo sapiens
ccagccagctggttggacgcct

SEQ ID NO: 8272131 - DNA, 22 bp, Homo sapiens
ccagccagtatattccaaagcc

SEQ ID NO: 8272132 - DNA, 22 bp, Homo sapiens
ccagagtcccttgcagctcagt

SEQ ID NO: 8272133 - DNA, 22 bp, Homo sapiens
ccagccagcaagctcccagttc

SEQ ID NO: 8272134 - DNA, 22 bp, Homo sapiens
ccagccagatgataagctctat

SEQ ID NO: 8272135 - DNA, 22 bp, Homo sapiens
ccagtgggtgctgggctctgcc

SEQ ID NO: 8272136 - DNA, 20 bp, Homo sapiens
aggctgccaggtctcacatc

SEQ ID NO: 8272137 - DNA, 22 bp, Homo sapiens
aggctgccatagggaactgcat

SEQ ID NO: 8272138 - DNA, 19 bp, Homo sapiens
aggctgcccagtctctgcc

SEQ ID NO: 8272139 - DNA, 22 bp, Homo sapiens
ccagtagttggacaaatagatt

SEQ ID NO: 8272140 - DNA, 22 bp, Homo sapiens
aggctgcagaggtgctgccaga

SEQ ID NO: 8272141 - DNA, 21 bp, Homo sapiens
aggctgcatgcatgagtgtgg

SEQ ID NO: 8272142 - DNA, 22 bp, Homo sapiens
aggctgcagtgcaggtaggatt

SEQ ID NO: 8272143 - DNA, 22 bp, Homo sapiens
aggctgccagaagccttcagga

SEQ ID NO: 8272144 - DNA, 22 bp, Homo sapiens
ccagtgtctactgtggcatatc

SEQ ID NO: 8272145 - DNA, 22 bp, Homo sapiens
cccagaggttccttagggacca

SEQ ID NO: 8272146 - DNA, 22 bp, Homo sapiens
cccagaggttccttagggacca

SEQ ID NO: 8272147 - DNA, 22 bp, Homo sapiens
aggctgtgggagttgagagtct

SEQ ID NO: 8272148 - DNA, 22 bp, Homo sapiens
aggctgtgggacagttaggaga

SEQ ID NO: 8272149 - DNA, 22 bp, Homo sapiens
cccacgtcgaacttgctccaga

SEQ ID NO: 8272150 - DNA, 22 bp, Homo sapiens
cccacgtcgaacttgctccaga

SEQ ID NO: 8272151 - DNA, 22 bp, Homo sapiens
cccactgctgcgccgggcgccg

SEQ ID NO: 8272152 - DNA, 22 bp, Homo sapiens
aggctgtgacagggtcatggag

SEQ ID NO: 8272153 - DNA, 22 bp, Homo sapiens
aggctctggttggcaagtaaag

SEQ ID NO: 8272154 - DNA, 22 bp, Homo sapiens
aggctctggttcatcatgatgg

SEQ ID NO: 8272155 - DNA, 22 bp, Homo sapiens
aggctctggtgcagctgtaact

SEQ ID NO: 8272156 - DNA, 22 bp, Homo sapiens
aggctctgggaagcagtgagtt

SEQ ID NO: 8272157 - DNA, 22 bp, Homo sapiens
aggctctgggaagcagtgagtt

SEQ ID NO: 8272158 - DNA, 22 bp, Homo sapiens
aggctctgggaacagacgggtg

SEQ ID NO: 8272159 - DNA, 22 bp, Homo sapiens
aggctctgggaacagacgggtg

SEQ ID NO: 8272160 - DNA, 20 bp, Homo sapiens
ccaggcctgggcctgctcta

SEQ ID NO: 8272161 - DNA, 22 bp, Homo sapiens
ccaggccttccagtacgcagaa

SEQ ID NO: 8272162 - DNA, 19 bp, Homo sapiens
aggctctgtaggagagggc

SEQ ID NO: 8272163 - DNA, 22 bp, Homo sapiens
aggctctgtcaggcggagcagc

SEQ ID NO: 8272164 - DNA, 22 bp, Homo sapiens
ccagggcagcagaattggggca

SEQ ID NO: 8272165 - DNA, 22 bp, Homo sapiens
ccaggtgcctccagtcacagtg

SEQ ID NO: 8272166 - DNA, 22 bp, Homo sapiens
ccagtaaaaagcgacaggaagt

SEQ ID NO: 8272167 - DNA, 22 bp, Homo sapiens
ccaggtggtgcctctgttcgca

SEQ ID NO: 8272168 - DNA, 22 bp, Homo sapiens
aggggctcctctctgagagtag

SEQ ID NO: 8272169 - DNA, 22 bp, Homo sapiens
aggggctcagttactttggcag

SEQ ID NO: 8272170 - DNA, 22 bp, Homo sapiens
aggggaaggccagcctgtagag

SEQ ID NO: 8272171 - DNA, 22 bp, Homo sapiens
cctcctggtgacaaggcaaagc

SEQ ID NO: 8272172 - DNA, 22 bp, Homo sapiens
cctccttctggggccttctgct

SEQ ID NO: 8272173 - DNA, 22 bp, Homo sapiens
aggggtcagtgaccattgagga

SEQ ID NO: 8272174 - DNA, 22 bp, Homo sapiens
ccctggcactagcgacggccat

SEQ ID NO: 8272175 - DNA, 22 bp, Homo sapiens
agggcccagtggagagctgagc

SEQ ID NO: 8272176 - DNA, 22 bp, Homo sapiens
agggcccatgtgggagcacttg

SEQ ID NO: 8272177 - DNA, 19 bp, Homo sapiens
ccctggcaggcaagcctgg

SEQ ID NO: 8272178 - DNA, 22 bp, Homo sapiens
agggctctttaggccgaggcca

SEQ ID NO: 8272179 - DNA, 22 bp, Homo sapiens
agggctcttcctttgcctctca

SEQ ID NO: 8272180 - DNA, 22 bp, Homo sapiens
agggctcttcctttgcctctca

SEQ ID NO: 8272181 - DNA, 22 bp, Homo sapiens
cctcaggtgtgggccagctgtc

SEQ ID NO: 8272182 - DNA, 22 bp, Homo sapiens
aggggaaaagtgttgtctctag

SEQ ID NO: 8272183 - DNA, 23 bp, Homo sapiens
cctcagggtctagcagagagaag

SEQ ID NO: 8272184 - DNA, 22 bp, Homo sapiens
cccaggaacagcacagaacagc

SEQ ID NO: 8272185 - DNA, 22 bp, Homo sapiens
cccaggaaatgggctcttgcct

SEQ ID NO: 8272186 - DNA, 22 bp, Homo sapiens
cccaggaaatgggctcttgcct

SEQ ID NO: 8272187 - DNA, 22 bp, Homo sapiens
cccaggaacagggctcagaccc

SEQ ID NO: 8272188 - DNA, 22 bp, Homo sapiens
cccaggaactccagagctcctc

SEQ ID NO: 8272189 - DNA, 22 bp, Homo sapiens
cccaggaagaaattctgatttg

SEQ ID NO: 8272190 - DNA, 23 bp, Homo sapiens
agggaaagtagtaatggcctttg

SEQ ID NO: 8272191 - DNA, 22 bp, Homo sapiens
agggaaagtaagcatttcatta

SEQ ID NO: 8272192 - DNA, 22 bp, Homo sapiens
cccaggaaatatgtttcttaac

SEQ ID NO: 8272193 - DNA, 22 bp, Homo sapiens
cccaggaaatcaggctttctag

SEQ ID NO: 8272194 - DNA, 22 bp, Homo sapiens
cccaggaagagtgagtggcatt

SEQ ID NO: 8272195 - DNA, 22 bp, Homo sapiens
cccaggaagaggggtcaggtgt

SEQ ID NO: 8272196 - DNA, 22 bp, Homo sapiens
cccaggaagttgagactgcagt

SEQ ID NO: 8272197 - DNA, 22 bp, Homo sapiens
cccaggaagttgatgcagagga

SEQ ID NO: 8272198 - DNA, 22 bp, Homo sapiens
cccaggaatgagcaggcagggg

SEQ ID NO: 8272199 - DNA, 22 bp, Homo sapiens
cccaggaaggtggtctgtggct

SEQ ID NO: 8272200 - DNA, 22 bp, Homo sapiens
cccaggaagtggaggttgcagt

SEQ ID NO: 8272201 - DNA, 21 bp, Homo sapiens
agggaaagaaaatgagctaat

SEQ ID NO: 8272202 - DNA, 22 bp, Homo sapiens
agggaaaggctgatgctgtggg

SEQ ID NO: 8272203 - DNA, 22 bp, Homo sapiens
agggaaaggtagtgaggtcaca

SEQ ID NO: 8272204 - DNA, 22 bp, Homo sapiens
aggctttgtacctggggtctta

SEQ ID NO: 8272205 - DNA, 21 bp, Homo sapiens
agggaaaaggctgagtgaggg

SEQ ID NO: 8272206 - DNA, 22 bp, Homo sapiens
agggagccttcctggctgtggt

SEQ ID NO: 8272207 - DNA, 20 bp, Homo sapiens
agggcacttttgctggagca

SEQ ID NO: 8272208 - DNA, 22 bp, Homo sapiens
agggcagaagtacagacactta

SEQ ID NO: 8272209 - DNA, 22 bp, Homo sapiens
agggcagactaggatggaagtg

SEQ ID NO: 8272210 - DNA, 22 bp, Homo sapiens
agggcagaccacgtgcaaggat

SEQ ID NO: 8272211 - DNA, 22 bp, Homo sapiens
agggccacctctctgggttccc

SEQ ID NO: 8272212 - DNA, 22 bp, Homo sapiens
ccctgaggggagtggtgaggtg

SEQ ID NO: 8272213 - DNA, 22 bp, Homo sapiens
caggtgggattttgctgcttga

SEQ ID NO: 8272214 - DNA, 22 bp, Homo sapiens
aggacacatgcacaccctgcgt

SEQ ID NO: 8272215 - DNA, 22 bp, Homo sapiens
aggacagatttttggccaccag

SEQ ID NO: 8272216 - DNA, 22 bp, Homo sapiens
cagtaacatgtctgttaagaaa

SEQ ID NO: 8272217 - DNA, 22 bp, Homo sapiens
cagtaatagaggctttgagtct

SEQ ID NO: 8272218 - DNA, 22 bp, Homo sapiens
cagtatttatggcttgagtatt

SEQ ID NO: 8272219 - DNA, 22 bp, Homo sapiens
cagtatttcattcagaattgtt

SEQ ID NO: 8272220 - DNA, 22 bp, Homo sapiens
agctttgaatcctggctctgtc

SEQ ID NO: 8272221 - DNA, 22 bp, Homo sapiens
agctttgaaattatgtttcaga

SEQ ID NO: 8272222 - DNA, 22 bp, Homo sapiens
agctttgaagtatttggtctcc

SEQ ID NO: 8272223 - DNA, 22 bp, Homo sapiens
agctttgaatcctggctctgtc

SEQ ID NO: 8272224 - DNA, 22 bp, Homo sapiens
agctttgaatctggtgtttgca

SEQ ID NO: 8272225 - DNA, 21 bp, Homo sapiens
agctttgaaagtgattcagtt

SEQ ID NO: 8272226 - DNA, 22 bp, Homo sapiens
agctttgaaaatccaaattaca

SEQ ID NO: 8272227 - DNA, 21 bp, Homo sapiens
agctttgaaagtgattcagtt

SEQ ID NO: 8272228 - DNA, 22 bp, Homo sapiens
agctttgaatgagtgcattgca

SEQ ID NO: 8272229 - DNA, 23 bp, Homo sapiens
agctttgaggactttaaaagata

SEQ ID NO: 8272230 - DNA, 21 bp, Homo sapiens
agctttgaggctctggggccc

SEQ ID NO: 8272231 - DNA, 21 bp, Homo sapiens
agctttgaggctctggggccc

SEQ ID NO: 8272232 - DNA, 22 bp, Homo sapiens
agctttgatagtacaggggctt

SEQ ID NO: 8272233 - DNA, 22 bp, Homo sapiens
agctttgcaacctgaggccagt

SEQ ID NO: 8272234 - DNA, 22 bp, Homo sapiens
agctttgcagactcttttatct

SEQ ID NO: 8272235 - DNA, 22 bp, Homo sapiens
agctttgcagctgtgggaggag

SEQ ID NO: 8272236 - DNA, 22 bp, Homo sapiens
agctttgcatactttgggctgt

SEQ ID NO: 8272237 - DNA, 22 bp, Homo sapiens
agctttgcattcaaactgatgt

SEQ ID NO: 8272238 - DNA, 19 bp, Homo sapiens
agctttgccaaaaacttag

SEQ ID NO: 8272239 - DNA, 22 bp, Homo sapiens
agctttgcaacctgaggccagt

SEQ ID NO: 8272240 - DNA, 22 bp, Homo sapiens
agctttgcactgagacagctca

SEQ ID NO: 8272241 - DNA, 22 bp, Homo sapiens
agctttggatgatctttgatac

SEQ ID NO: 8272242 - DNA, 22 bp, Homo sapiens
agctttggagctgggtgaaaga

SEQ ID NO: 8272243 - DNA, 22 bp, Homo sapiens
agctttgcttcttttccatagc

SEQ ID NO: 8272244 - DNA, 22 bp, Homo sapiens
agctttgcttctgggagccaag

SEQ ID NO: 8272245 - DNA, 21 bp, Homo sapiens
agctttgctttgtactcattt

SEQ ID NO: 8272246 - DNA, 22 bp, Homo sapiens
agctttgcacaacagagaggtg

SEQ ID NO: 8272247 - DNA, 22 bp, Homo sapiens
agctttgccaggaggcttggtc

SEQ ID NO: 8272248 - DNA, 22 bp, Homo sapiens
agctttgcctgctgacattctg

SEQ ID NO: 8272249 - DNA, 22 bp, Homo sapiens
agctttgctcgggtctcccgcc

SEQ ID NO: 8272250 - DNA, 22 bp, Homo sapiens
agctttgctgctggagaagggt

SEQ ID NO: 8272251 - DNA, 22 bp, Homo sapiens
agctttgggattcaggcaggaa

SEQ ID NO: 8272252 - DNA, 22 bp, Homo sapiens
cagggatgtgatgagctgagcc

SEQ ID NO: 8272253 - DNA, 22 bp, Homo sapiens
caggctcttccatcctgctgag

SEQ ID NO: 8272254 - DNA, 22 bp, Homo sapiens
caggctcttttggtggcaagga

SEQ ID NO: 8272255 - DNA, 22 bp, Homo sapiens
cagggcagggatgttgcggcag

SEQ ID NO: 8272256 - DNA, 22 bp, Homo sapiens
aggaagagcccgggtgacataa

SEQ ID NO: 8272257 - DNA, 22 bp, Homo sapiens
aggaagagcccgggtgacataa

SEQ ID NO: 8272258 - DNA, 22 bp, Homo sapiens
aggaaaggcctttgcatttggt

SEQ ID NO: 8272259 - DNA, 22 bp, Homo sapiens
aggaagaaaactaattagatgg

SEQ ID NO: 8272260 - DNA, 22 bp, Homo sapiens
aggaagaaaactaattagatgg

SEQ ID NO: 8272261 - DNA, 21 bp, Homo sapiens
aggaaaggccagcacgtaggg

SEQ ID NO: 8272262 - DNA, 22 bp, Homo sapiens
aggaaaggcctcagcagaaacc

SEQ ID NO: 8272263 - DNA, 19 bp, Homo sapiens
aggaaaggatcaaaatagc

SEQ ID NO: 8272264 - DNA, 22 bp, Homo sapiens
aggaaaggattggcttctctgt

SEQ ID NO: 8272265 - DNA, 22 bp, Homo sapiens
aggaaaggattggcttctctgt

SEQ ID NO: 8272266 - DNA, 22 bp, Homo sapiens
caggcagtgtcccaggaagcca

SEQ ID NO: 8272267 - DNA, 22 bp, Homo sapiens
caggcaggtcagtgaagaagga

SEQ ID NO: 8272268 - DNA, 22 bp, Homo sapiens
agctgtcctggctcaggctgtg

SEQ ID NO: 8272269 - DNA, 22 bp, Homo sapiens
caggcagcctgcggtctgcaca

SEQ ID NO: 8272270 - DNA, 22 bp, Homo sapiens
caggcagcgtcctgcttcctgt

SEQ ID NO: 8272271 - DNA, 22 bp, Homo sapiens
caggcagcgctcgtggcctggc

SEQ ID NO: 8272272 - DNA, 21 bp, Homo sapiens
caggctctgctagaggagcct

SEQ ID NO: 8272273 - DNA, 22 bp, Homo sapiens
caggctctgctgctacagctgt

SEQ ID NO: 8272274 - DNA, 22 bp, Homo sapiens
agcttcctgactggtgctctta

SEQ ID NO: 8272275 - DNA, 21 bp, Homo sapiens
agcttcctgcagtgggaggtc

SEQ ID NO: 8272276 - DNA, 22 bp, Homo sapiens
caggcccatgagggcagccaca

SEQ ID NO: 8272277 - DNA, 22 bp, Homo sapiens
agctgtctttaagtgagctttg

SEQ ID NO: 8272278 - DNA, 22 bp, Homo sapiens
agctgtctgtgaacacagcatt

SEQ ID NO: 8272279 - DNA, 22 bp, Homo sapiens
cagctggttatcagagaggcct

SEQ ID NO: 8272280 - DNA, 22 bp, Homo sapiens
cagctgtcacttctaagttttg

SEQ ID NO: 8272281 - DNA, 22 bp, Homo sapiens
cagctgtgtatgagagcatgct

SEQ ID NO: 8272282 - DNA, 22 bp, Homo sapiens
caggagaaacataattttctgg

SEQ ID NO: 8272283 - DNA, 22 bp, Homo sapiens
caggagaaatgtggctgctacc

SEQ ID NO: 8272284 - DNA, 22 bp, Homo sapiens
caggactggaagtctcaagaga

SEQ ID NO: 8272285 - DNA, 22 bp, Homo sapiens
caggactgatgttcctccagcc

SEQ ID NO: 8272286 - DNA, 20 bp, Homo sapiens
caggacagcgcaatcggagg

SEQ ID NO: 8272287 - DNA, 22 bp, Homo sapiens
caggacagagcccagactgtgt

SEQ ID NO: 8272288 - DNA, 22 bp, Homo sapiens
caggcacacagcacatggcctg

SEQ ID NO: 8272289 - DNA, 22 bp, Homo sapiens
caggagccagaggcggatggag

SEQ ID NO: 8272290 - DNA, 22 bp, Homo sapiens
caggagccacattccaccttga

SEQ ID NO: 8272291 - DNA, 22 bp, Homo sapiens
caggagcagagggtggtcagca

SEQ ID NO: 8272292 - DNA, 22 bp, Homo sapiens
caggagtgaaatgaggcccagg

SEQ ID NO: 8272293 - DNA, 22 bp, Homo sapiens
caggagtctgttcctcatttgt

SEQ ID NO: 8272294 - DNA, 22 bp, Homo sapiens
catctcctttggtctacttcca

SEQ ID NO: 8272295 - DNA, 20 bp, Homo sapiens
catctcctgcctccatgttc

SEQ ID NO: 8272296 - DNA, 22 bp, Homo sapiens
catctctgtgtccccagagctt

SEQ ID NO: 8272297 - DNA, 19 bp, Homo sapiens
catctctgcaaggagctgc

SEQ ID NO: 8272298 - DNA, 22 bp, Homo sapiens
catacatatgcatgtgtgtata

SEQ ID NO: 8272299 - DNA, 22 bp, Homo sapiens
catacataccactgctgtcttt

SEQ ID NO: 8272300 - DNA, 22 bp, Homo sapiens
catgagactgccttttcaaacc

SEQ ID NO: 8272301 - DNA, 22 bp, Homo sapiens
aggatgtgccaccagctttgca

SEQ ID NO: 8272302 - DNA, 22 bp, Homo sapiens
aggatggggtctgcagcctggt

SEQ ID NO: 8272303 - DNA, 23 bp, Homo sapiens
aggatgggtggcaatagaaagac

SEQ ID NO: 8272304 - DNA, 22 bp, Homo sapiens
aggatgggcctgggatatgctt

SEQ ID NO: 8272305 - DNA, 23 bp, Homo sapiens
aggagccaggtgcagcccttgtg

SEQ ID NO: 8272306 - DNA, 22 bp, Homo sapiens
cagtgtggtgtgcacagcttag

SEQ ID NO: 8272307 - DNA, 22 bp, Homo sapiens
cagtgtggctgagacagaggct

SEQ ID NO: 8272308 - DNA, 22 bp, Homo sapiens
cagtccagccagtagggtgtgg

SEQ ID NO: 8272309 - DNA, 22 bp, Homo sapiens
aggagccatccccatgagaggt

SEQ ID NO: 8272310 - DNA, 23 bp, Homo sapiens
catttctgggagatttataaaat

SEQ ID NO: 8272311 - DNA, 22 bp, Homo sapiens
aggcaggagcaagccctacaag

SEQ ID NO: 8272312 - DNA, 22 bp, Homo sapiens
ccacagtgcctggaattctgca

SEQ ID NO: 8272313 - DNA, 22 bp, Homo sapiens
aggcaggagtgaccctgacagg

SEQ ID NO: 8272314 - DNA, 22 bp, Homo sapiens
ccactcaggcctcctgctctcc

SEQ ID NO: 8272315 - DNA, 23 bp, Homo sapiens
ccactagcacctgttcaacttct

SEQ ID NO: 8272316 - DNA, 22 bp, Homo sapiens
ccacgagggaaccaggtggggt

SEQ ID NO: 8272317 - DNA, 22 bp, Homo sapiens
ccacggccacccgctcatgggc

SEQ ID NO: 8272318 - DNA, 22 bp, Homo sapiens
ccacgggcagatgtggttggtt

SEQ ID NO: 8272319 - DNA, 23 bp, Homo sapiens
ccacgtctgcactgtagctgttg

SEQ ID NO: 8272320 - DNA, 22 bp, Homo sapiens
ccacctggggcctctgagtctc

SEQ ID NO: 8272321 - DNA, 22 bp, Homo sapiens
ccacccagccagatgcaggaag

SEQ ID NO: 8272322 - DNA, 22 bp, Homo sapiens
ccacccagaccagggatctggg

SEQ ID NO: 8272323 - DNA, 22 bp, Homo sapiens
ccacccagccagatgcaggaag

SEQ ID NO: 8272324 - DNA, 22 bp, Homo sapiens
ccacccagcagaggaggcaaga

SEQ ID NO: 8272325 - DNA, 22 bp, Homo sapiens
ccacatctccctattgctcttt

SEQ ID NO: 8272326 - DNA, 21 bp, Homo sapiens
ccaccaggtcttctgctcggg

SEQ ID NO: 8272327 - DNA, 22 bp, Homo sapiens
ccacatacaaatggggtgctgt

SEQ ID NO: 8272328 - DNA, 22 bp, Homo sapiens
aggcaagattaggaccagaaga

SEQ ID NO: 8272329 - DNA, 22 bp, Homo sapiens
aggcaagccgtgcctgtctcaa

SEQ ID NO: 8272330 - DNA, 22 bp, Homo sapiens
aggcaaggaagaattctcccct

SEQ ID NO: 8272331 - DNA, 22 bp, Homo sapiens
aggcaagggggcgccaccttcc

SEQ ID NO: 8272332 - DNA, 17 bp, Homo sapiens
aggcaactagttccctc

SEQ ID NO: 8272333 - DNA, 22 bp, Homo sapiens
aggcaaggtgctcttgctctat

SEQ ID NO: 8272334 - DNA, 22 bp, Homo sapiens
aggcaatcccctgaggatactt

SEQ ID NO: 8272335 - DNA, 22 bp, Homo sapiens
aggcaatcccctgaggatactt

SEQ ID NO: 8272336 - DNA, 22 bp, Homo sapiens
cattgcacttctgcttttcctc

SEQ ID NO: 8272337 - DNA, 22 bp, Homo sapiens
cattggcacaagtagcttcatc

SEQ ID NO: 8272338 - DNA, 22 bp, Homo sapiens
cattggcacctcacaggataga

SEQ ID NO: 8272339 - DNA, 20 bp, Homo sapiens
cattggcattcacagaagct

SEQ ID NO: 8272340 - DNA, 22 bp, Homo sapiens
catttcaattatttgctcttct

SEQ ID NO: 8272341 - DNA, 22 bp, Homo sapiens
catttcaatacagtttgtaaat

SEQ ID NO: 8272342 - DNA, 22 bp, Homo sapiens
aggggaggagcttttcttgcct

SEQ ID NO: 8272343 - DNA, 22 bp, Homo sapiens
aggggagcttgaggcatggcct

SEQ ID NO: 8272344 - DNA, 22 bp, Homo sapiens
agggctcagagcaaaagggcac

SEQ ID NO: 8272345 - DNA, 22 bp, Homo sapiens
agggctcagccagcctgtgtgc

SEQ ID NO: 8272346 - DNA, 22 bp, Homo sapiens
agggtcagtgatgagggagccc

SEQ ID NO: 8272347 - DNA, 22 bp, Homo sapiens
aggggtgatttgggacaggaca

SEQ ID NO: 8272348 - DNA, 22 bp, Homo sapiens
acctcaagaatgtataacacag

SEQ ID NO: 8272349 - DNA, 22 bp, Homo sapiens
acctcaaggaaaatctagacag

SEQ ID NO: 8272350 - DNA, 22 bp, Homo sapiens
acctccagctttttagagacat

SEQ ID NO: 8272351 - DNA, 22 bp, Homo sapiens
acctcatctggtttgtaaggca

SEQ ID NO: 8272352 - DNA, 22 bp, Homo sapiens
aggggcctcgcaggaccgctcc

SEQ ID NO: 8272353 - DNA, 23 bp, Homo sapiens
agggcactgaagctggaattggg

SEQ ID NO: 8272354 - DNA, 22 bp, Homo sapiens
agggcactgaacagctgtagca

SEQ ID NO: 8272355 - DNA, 22 bp, Homo sapiens
agggccagttcagaggacatgg

SEQ ID NO: 8272356 - DNA, 22 bp, Homo sapiens
agggaggtaggagcttctagct

SEQ ID NO: 8272357 - DNA, 22 bp, Homo sapiens
agggaggcattagctactgcga

SEQ ID NO: 8272358 - DNA, 21 bp, Homo sapiens
agggcacccccgctgcctacc

SEQ ID NO: 8272359 - DNA, 22 bp, Homo sapiens
agggcacctgttttagcttggt

SEQ ID NO: 8272360 - DNA, 22 bp, Homo sapiens
agggcaccctctctgcagtacc

SEQ ID NO: 8272361 - DNA, 22 bp, Homo sapiens
accagagagagacagggttgtg

SEQ ID NO: 8272362 - DNA, 22 bp, Homo sapiens
accagagagcctaggctgggca

SEQ ID NO: 8272363 - DNA, 22 bp, Homo sapiens
aggctccagtctcctctggcag

SEQ ID NO: 8272364 - DNA, 22 bp, Homo sapiens
acatgttttgtgccttgactag

SEQ ID NO: 8272365 - DNA, 22 bp, Homo sapiens
aggctctgaagcaaccctttga

SEQ ID NO: 8272366 - DNA, 22 bp, Homo sapiens
aggctctcctccccaggaccat

SEQ ID NO: 8272367 - DNA, 22 bp, Homo sapiens
aggctctctagaaactgtgcct

SEQ ID NO: 8272368 - DNA, 22 bp, Homo sapiens
aggctctctctgccagccgtgc

SEQ ID NO: 8272369 - DNA, 22 bp, Homo sapiens
aggctctctctgccagccgtgc

SEQ ID NO: 8272370 - DNA, 22 bp, Homo sapiens
aggctctctctgcccctgggac

SEQ ID NO: 8272371 - DNA, 22 bp, Homo sapiens
aggctctccagagagctgcttt

SEQ ID NO: 8272372 - DNA, 22 bp, Homo sapiens
aggctctcaccctctgaccaga

SEQ ID NO: 8272373 - DNA, 22 bp, Homo sapiens
aggctctgacgtcacacgtggc

SEQ ID NO: 8272374 - DNA, 22 bp, Homo sapiens
aggctctgacgtcacacgtggc

SEQ ID NO: 8272375 - DNA, 22 bp, Homo sapiens
aggctctgacccatgggaccca

SEQ ID NO: 8272376 - DNA, 22 bp, Homo sapiens
aggctctgcttttctggatata

SEQ ID NO: 8272377 - DNA, 22 bp, Homo sapiens
aggctctggacagtgaggagtt

SEQ ID NO: 8272378 - DNA, 22 bp, Homo sapiens
acatgtctacacattctgcaat

SEQ ID NO: 8272379 - DNA, 22 bp, Homo sapiens
acatggctaaagcaagtctaga

SEQ ID NO: 8272380 - DNA, 22 bp, Homo sapiens
acatggctcagtctcatgacag

SEQ ID NO: 8272381 - DNA, 21 bp, Homo sapiens
acatgtctctaatctcagtga

SEQ ID NO: 8272382 - DNA, 22 bp, Homo sapiens
acatgtctcttgtggttttcaa

SEQ ID NO: 8272383 - DNA, 21 bp, Homo sapiens
acatgtctggtcatttttagc

SEQ ID NO: 8272384 - DNA, 21 bp, Homo sapiens
acatgtctggtcatttttagc

SEQ ID NO: 8272385 - DNA, 22 bp, Homo sapiens
acatgtcttttaaagtctaata

SEQ ID NO: 8272386 - DNA, 22 bp, Homo sapiens
acatgtcttgtggctttgatct

SEQ ID NO: 8272387 - DNA, 22 bp, Homo sapiens
acatgtctgtaattattttagg

SEQ ID NO: 8272388 - DNA, 22 bp, Homo sapiens
aggctctggagttagccaggca

SEQ ID NO: 8272389 - DNA, 22 bp, Homo sapiens
aggctctggcaacagctggtgt

SEQ ID NO: 8272390 - DNA, 17 bp, Homo sapiens
aggctgctgggccaggg

SEQ ID NO: 8272391 - DNA, 22 bp, Homo sapiens
accactgtctacacattgactc

SEQ ID NO: 8272392 - DNA, 22 bp, Homo sapiens
accactgtatctccagcacatt

SEQ ID NO: 8272393 - DNA, 22 bp, Homo sapiens
accactgtactatttgagtggc

SEQ ID NO: 8272394 - DNA, 22 bp, Homo sapiens
accacttcctttaggaccttgt

SEQ ID NO: 8272395 - DNA, 22 bp, Homo sapiens
accagacactgtgaagacaggc

SEQ ID NO: 8272396 - DNA, 22 bp, Homo sapiens
accacaggacccatgagtcagt

SEQ ID NO: 8272397 - DNA, 22 bp, Homo sapiens
accactggcctggtggggacca

SEQ ID NO: 8272398 - DNA, 19 bp, Homo sapiens
aggctgtgagggaggactc

SEQ ID NO: 8272399 - DNA, 19 bp, Homo sapiens
aggctgtgaggggaaggaa

SEQ ID NO: 8272400 - DNA, 22 bp, Homo sapiens
aggctgtgagaggtggctccca

SEQ ID NO: 8272401 - DNA, 22 bp, Homo sapiens
aggacaggtgtagtgggctctg

SEQ ID NO: 8272402 - DNA, 22 bp, Homo sapiens
aggacagtggtgttctggagtg

SEQ ID NO: 8272403 - DNA, 22 bp, Homo sapiens
acagggcctggctccaaaagat

SEQ ID NO: 8272404 - DNA, 22 bp, Homo sapiens
acagggcctcagccagggcaga

SEQ ID NO: 8272405 - DNA, 22 bp, Homo sapiens
acagggccattggaggattata

SEQ ID NO: 8272406 - DNA, 22 bp, Homo sapiens
acagggccttatatccagaagg

SEQ ID NO: 8272407 - DNA, 22 bp, Homo sapiens
aggacagggattcaaactccca

SEQ ID NO: 8272408 - DNA, 22 bp, Homo sapiens
aggacaggattgagctgaactg

SEQ ID NO: 8272409 - DNA, 22 bp, Homo sapiens
aggaaaggttcagtgattgaaa

SEQ ID NO: 8272410 - DNA, 19 bp, Homo sapiens
aggaaaggtggccttagca

SEQ ID NO: 8272411 - DNA, 22 bp, Homo sapiens
aggaaaggtgagagcggccgcg

SEQ ID NO: 8272412 - DNA, 22 bp, Homo sapiens
aggaaaggggtaggtgtggacg

SEQ ID NO: 8272413 - DNA, 22 bp, Homo sapiens
aggaaaggtagcgtgccagcag

SEQ ID NO: 8272414 - DNA, 22 bp, Homo sapiens
aggaaaggtgagagcggccgcg

SEQ ID NO: 8272415 - DNA, 22 bp, Homo sapiens
acaggactgtggaaggatctct

SEQ ID NO: 8272416 - DNA, 22 bp, Homo sapiens
acaggacaggctgggctagact

SEQ ID NO: 8272417 - DNA, 22 bp, Homo sapiens
acaggacaggctgggctagact

SEQ ID NO: 8272418 - DNA, 22 bp, Homo sapiens
agcttcttcttggtctttccca

SEQ ID NO: 8272419 - DNA, 22 bp, Homo sapiens
agcttcttgaccaagcctgtaa

SEQ ID NO: 8272420 - DNA, 22 bp, Homo sapiens
agcttcttctattttggggcca

SEQ ID NO: 8272421 - DNA, 22 bp, Homo sapiens
agcttcttctattttggggcca

SEQ ID NO: 8272422 - DNA, 22 bp, Homo sapiens
agcttcttcaaagcaggaggcc

SEQ ID NO: 8272423 - DNA, 22 bp, Homo sapiens
agcttctttaattcagcatgat

SEQ ID NO: 8272424 - DNA, 22 bp, Homo sapiens
agcttcttgtagaactcaaaag

SEQ ID NO: 8272425 - DNA, 22 bp, Homo sapiens
agcttctttgtgggctccagaa

SEQ ID NO: 8272426 - DNA, 22 bp, Homo sapiens
acaggatcgccctgttgcccag

SEQ ID NO: 8272427 - DNA, 22 bp, Homo sapiens
acaggcacaccttcctgcaggc

SEQ ID NO: 8272428 - DNA, 22 bp, Homo sapiens
acaggcacaccttcctgcaggc

SEQ ID NO: 8272429 - DNA, 22 bp, Homo sapiens
acagcagttaacgatcagactc

SEQ ID NO: 8272430 - DNA, 22 bp, Homo sapiens
acagcagtttagaggacagcca

SEQ ID NO: 8272431 - DNA, 22 bp, Homo sapiens
acagcatctagtacagtctagt

SEQ ID NO: 8272432 - DNA, 22 bp, Homo sapiens
acagcatccttctaaagtagct

SEQ ID NO: 8272433 - DNA, 22 bp, Homo sapiens
acagcatccctgaagataacca

SEQ ID NO: 8272434 - DNA, 22 bp, Homo sapiens
acagcagtttagaggacagcca

SEQ ID NO: 8272435 - DNA, 20 bp, Homo sapiens
acagccagaggaggcagaca

SEQ ID NO: 8272436 - DNA, 22 bp, Homo sapiens
acagcttcttgtttcccaggag

SEQ ID NO: 8272437 - DNA, 22 bp, Homo sapiens
acaggaagaaagtgcagtagat

SEQ ID NO: 8272438 - DNA, 22 bp, Homo sapiens
acaggaactgttatctcagatg

SEQ ID NO: 8272439 - DNA, 22 bp, Homo sapiens
acatctctccaaaggaaggtgc

SEQ ID NO: 8272440 - DNA, 22 bp, Homo sapiens
aggcaggtgggagtgattcctt

SEQ ID NO: 8272441 - DNA, 17 bp, Homo sapiens
acagtgagaagtcatct

SEQ ID NO: 8272442 - DNA, 22 bp, Homo sapiens
acagtgagatccaagggcaggc

SEQ ID NO: 8272443 - DNA, 22 bp, Homo sapiens
acagtgaatccaaattcctacc

SEQ ID NO: 8272444 - DNA, 22 bp, Homo sapiens
aggcactgaaaggtggccagag

SEQ ID NO: 8272445 - DNA, 22 bp, Homo sapiens
aggcaccaggatcagttagaga

SEQ ID NO: 8272446 - DNA, 22 bp, Homo sapiens
aggcaccagtaagagtagaact

SEQ ID NO: 8272447 - DNA, 22 bp, Homo sapiens
aggcaccaggttgtggtttgtc

SEQ ID NO: 8272448 - DNA, 22 bp, Homo sapiens
agtgagatactgagaacatctc

SEQ ID NO: 8272449 - DNA, 20 bp, Homo sapiens
agtgaggcagttcagtgggc

SEQ ID NO: 8272450 - DNA, 22 bp, Homo sapiens
agtgagcattcgtttggaaccc

SEQ ID NO: 8272451 - DNA, 22 bp, Homo sapiens
agtgagctatgatcatgttact

SEQ ID NO: 8272452 - DNA, 21 bp, Homo sapiens
agtgagcatccagagaggtgg

SEQ ID NO: 8272453 - DNA, 23 bp, Homo sapiens
agtgctgaattgaaagctccagg

SEQ ID NO: 8272454 - DNA, 22 bp, Homo sapiens
agtgatttggttcatacttcca

SEQ ID NO: 8272455 - DNA, 20 bp, Homo sapiens
agtgatttgttagtacattg

SEQ ID NO: 8272456 - DNA, 22 bp, Homo sapiens
agtgattttatcaatttactca

SEQ ID NO: 8272457 - DNA, 22 bp, Homo sapiens
agtgggaggaagtggtgatatt

SEQ ID NO: 8272458 - DNA, 23 bp, Homo sapiens
agtggctggacagactttcctgg

SEQ ID NO: 8272459 - DNA, 22 bp, Homo sapiens
agtggctggaattgcaggtgcg

SEQ ID NO: 8272460 - DNA, 22 bp, Homo sapiens
agtgtgtagcacatggtaagca

SEQ ID NO: 8272461 - DNA, 22 bp, Homo sapiens
agtgtggggtcaccggcccagg

SEQ ID NO: 8272462 - DNA, 22 bp, Homo sapiens
agtgtgggtgagggaggccctc

SEQ ID NO: 8272463 - DNA, 22 bp, Homo sapiens
agtgtgggttttatggagccct

SEQ ID NO: 8272464 - DNA, 22 bp, Homo sapiens
agttaataatggaaagacacat

SEQ ID NO: 8272465 - DNA, 22 bp, Homo sapiens
agttacaaacactatcagttct

SEQ ID NO: 8272466 - DNA, 22 bp, Homo sapiens
agttcaagcaatgctggaagaa

SEQ ID NO: 8272467 - DNA, 22 bp, Homo sapiens
agttcacaagcgtaggtgctga

SEQ ID NO: 8272468 - DNA, 21 bp, Homo sapiens
agttacaagtttattcagagg

SEQ ID NO: 8272469 - DNA, 22 bp, Homo sapiens
aggtggaaatggctttcctagg

SEQ ID NO: 8272470 - DNA, 22 bp, Homo sapiens
aggtgcatgatgcagagtgcag

SEQ ID NO: 8272471 - DNA, 22 bp, Homo sapiens
aggtgaggataggtggccaagg

SEQ ID NO: 8272472 - DNA, 22 bp, Homo sapiens
aggtgagaaaacgagggttgca

SEQ ID NO: 8272473 - DNA, 19 bp, Homo sapiens
aggtgaggggcaccatgtc

SEQ ID NO: 8272474 - DNA, 19 bp, Homo sapiens
aggtgcaggtcacagggga

SEQ ID NO: 8272475 - DNA, 21 bp, Homo sapiens
aggtgcaggcctcaagcccca

SEQ ID NO: 8272476 - DNA, 23 bp, Homo sapiens
agggtgagcaagctatggagacc

SEQ ID NO: 8272477 - DNA, 22 bp, Homo sapiens
agggtcccgtccctctgcaccc

SEQ ID NO: 8272478 - DNA, 22 bp, Homo sapiens
agggtcagtgatgagggagccc

SEQ ID NO: 8272479 - DNA, 22 bp, Homo sapiens
agggtccacttggacattgatc

SEQ ID NO: 8272480 - DNA, 22 bp, Homo sapiens
actcacagtccctgtaggagtg

SEQ ID NO: 8272481 - DNA, 22 bp, Homo sapiens
agtcctggtgacactcctcttc

SEQ ID NO: 8272482 - DNA, 22 bp, Homo sapiens
agtcctgggttctggtgttttg

SEQ ID NO: 8272483 - DNA, 22 bp, Homo sapiens
agtcctggttctgattctgaca

SEQ ID NO: 8272484 - DNA, 22 bp, Homo sapiens
agtcctgtaattgtgagttaac

SEQ ID NO: 8272485 - DNA, 22 bp, Homo sapiens
agtcctgtgaggggtgcagctt

SEQ ID NO: 8272486 - DNA, 22 bp, Homo sapiens
agtcctgggtgtgcaaggcaga

SEQ ID NO: 8272487 - DNA, 22 bp, Homo sapiens
actctggggtgatgtctctgag

SEQ ID NO: 8272488 - DNA, 22 bp, Homo sapiens
agtcagtgtagaaagcccaggc

SEQ ID NO: 8272489 - DNA, 21 bp, Homo sapiens
agtccaggaggaggccaggtt

SEQ ID NO: 8272490 - DNA, 22 bp, Homo sapiens
actcagcttcctacagctagaa

SEQ ID NO: 8272491 - DNA, 22 bp, Homo sapiens
agtaacatttagcttctcactg

SEQ ID NO: 8272492 - DNA, 22 bp, Homo sapiens
actcagctaaactcagtctatg

SEQ ID NO: 8272493 - DNA, 22 bp, Homo sapiens
actcagctgatgaagcacaagt

SEQ ID NO: 8272494 - DNA, 22 bp, Homo sapiens
agtcagggttgtaggctcaccc

SEQ ID NO: 8272495 - DNA, 22 bp, Homo sapiens
agtcactttatgagagaaccat

SEQ ID NO: 8272496 - DNA, 22 bp, Homo sapiens
agtcagtggctccgagcctggt

SEQ ID NO: 8272497 - DNA, 22 bp, Homo sapiens
agtcagtgggcttggcacagaa

SEQ ID NO: 8272498 - DNA, 22 bp, Homo sapiens
agtcagtgggagaagtgtgaag

SEQ ID NO: 8272499 - DNA, 22 bp, Homo sapiens
agtcagtggtatttaggggaat

SEQ ID NO: 8272500 - DNA, 22 bp, Homo sapiens
atagttattagagaagctggta

SEQ ID NO: 8272501 - DNA, 22 bp, Homo sapiens
atagttggtccatgaaaaaagt

SEQ ID NO: 8272502 - DNA, 22 bp, Homo sapiens
agaaaagaggctttctaagcat

SEQ ID NO: 8272503 - DNA, 22 bp, Homo sapiens
atagttataagaaaacgttgaa

SEQ ID NO: 8272504 - DNA, 22 bp, Homo sapiens
atagctttacagaagagtttag

SEQ ID NO: 8272505 - DNA, 22 bp, Homo sapiens
atacactggcctttgcagagcc

SEQ ID NO: 8272506 - DNA, 22 bp, Homo sapiens
atacactgttcactagatcttc

SEQ ID NO: 8272507 - DNA, 22 bp, Homo sapiens
actttacaggcacttcaagtat

SEQ ID NO: 8272508 - DNA, 22 bp, Homo sapiens
ataaattatgaatggccctttt

SEQ ID NO: 8272509 - DNA, 22 bp, Homo sapiens
agttgcagacgcagagatgttg

SEQ ID NO: 8272510 - DNA, 22 bp, Homo sapiens
agttcagccatttgttaactat

SEQ ID NO: 8272511 - DNA, 22 bp, Homo sapiens
agttcacagccatgttcatgtg

SEQ ID NO: 8272512 - DNA, 22 bp, Homo sapiens
agttcacaccaaagttaggtag

SEQ ID NO: 8272513 - DNA, 22 bp, Homo sapiens
agttcacaatagaagaggtggc

SEQ ID NO: 8272514 - DNA, 22 bp, Homo sapiens
agttcacagggaaggttattgt

SEQ ID NO: 8272515 - DNA, 21 bp, Homo sapiens
agttcacaggaacaagcaggg

SEQ ID NO: 8272516 - DNA, 20 bp, Homo sapiens
agttcacaggccaaatttct

SEQ ID NO: 8272517 - DNA, 22 bp, Homo sapiens
agttcacattccgaggtactgg

SEQ ID NO: 8272518 - DNA, 22 bp, Homo sapiens
agttcacatatctgttttattt

SEQ ID NO: 8272519 - DNA, 22 bp, Homo sapiens
ataaggcagtcccttaacaagg

SEQ ID NO: 8272520 - DNA, 22 bp, Homo sapiens
atacaagttgtgataatgtaaa

SEQ ID NO: 8272521 - DNA, 22 bp, Homo sapiens
atacaagttgtgataatgtaaa

SEQ ID NO: 8272522 - DNA, 22 bp, Homo sapiens
atacacctgtggagtgtctctc

SEQ ID NO: 8272523 - DNA, 22 bp, Homo sapiens
atacactgatctttttatgggg

SEQ ID NO: 8272524 - DNA, 22 bp, Homo sapiens
atacaatcatcattatattccc

SEQ ID NO: 8272525 - DNA, 18 bp, Homo sapiens
atcaaggaggggaaggtc

SEQ ID NO: 8272526 - DNA, 22 bp, Homo sapiens
agaaatcacttaatgaacgtag

SEQ ID NO: 8272527 - DNA, 19 bp, Homo sapiens
atatagcattattcaattt

SEQ ID NO: 8272528 - DNA, 22 bp, Homo sapiens
atatagaaggtgctatttacat

SEQ ID NO: 8272529 - DNA, 21 bp, Homo sapiens
agaaactgactcctagaggca

SEQ ID NO: 8272530 - DNA, 22 bp, Homo sapiens
agaaactgcagctcagagaagt

SEQ ID NO: 8272531 - DNA, 22 bp, Homo sapiens
atattaatgggatttagtcagg

SEQ ID NO: 8272532 - DNA, 22 bp, Homo sapiens
atattaattatttacacatgag

SEQ ID NO: 8272533 - DNA, 22 bp, Homo sapiens
atattaatgggatttagtcagg

SEQ ID NO: 8272534 - DNA, 17 bp, Homo sapiens
agaaagaggatccacag

SEQ ID NO: 8272535 - DNA, 22 bp, Homo sapiens
agaaagaacgcacttgtgctgc

SEQ ID NO: 8272536 - DNA, 22 bp, Homo sapiens
agaagccaaatgccagtgacct

SEQ ID NO: 8272537 - DNA, 22 bp, Homo sapiens
agaagccaaatgccagtgacct

SEQ ID NO: 8272538 - DNA, 22 bp, Homo sapiens
agaagccaaaggggccagatat

SEQ ID NO: 8272539 - DNA, 22 bp, Homo sapiens
agaagcagctttcaaggtgatt

SEQ ID NO: 8272540 - DNA, 22 bp, Homo sapiens
agaagcaggcagatttcagctc

SEQ ID NO: 8272541 - DNA, 22 bp, Homo sapiens
agaaatgtggatcgttttaaaa

SEQ ID NO: 8272542 - DNA, 22 bp, Homo sapiens
atcctgctgctgtggacttctc

SEQ ID NO: 8272543 - DNA, 22 bp, Homo sapiens
agaagccatggggtcaccagag

SEQ ID NO: 8272544 - DNA, 19 bp, Homo sapiens
agaagcccagatcccagcc

SEQ ID NO: 8272545 - DNA, 22 bp, Homo sapiens
agaagcccagcatggaaccagc

SEQ ID NO: 8272546 - DNA, 20 bp, Homo sapiens
agaagctgatactgatggaa

SEQ ID NO: 8272547 - DNA, 22 bp, Homo sapiens
cagcctttgaacttcagaggtt

SEQ ID NO: 8272548 - DNA, 22 bp, Homo sapiens
cagcctttcttgactgtgtgtt

SEQ ID NO: 8272549 - DNA, 22 bp, Homo sapiens
cagccttttccatgtattgttg

SEQ ID NO: 8272550 - DNA, 22 bp, Homo sapiens
cagccttttaggactatttgtg

SEQ ID NO: 8272551 - DNA, 22 bp, Homo sapiens
cagcctctgtggctgccacacc

SEQ ID NO: 8272552 - DNA, 22 bp, Homo sapiens
cagcctctctgtatctcaggat

SEQ ID NO: 8272553 - DNA, 22 bp, Homo sapiens
cagctgccatgacatgtcctgc

SEQ ID NO: 8272554 - DNA, 22 bp, Homo sapiens
agctctggcactggcgcgggat

SEQ ID NO: 8272555 - DNA, 20 bp, Homo sapiens
agctgaagatctggatgggg

SEQ ID NO: 8272556 - DNA, 22 bp, Homo sapiens
agctctgggagtagttccacct

SEQ ID NO: 8272557 - DNA, 22 bp, Homo sapiens
agctgaagacctcaagtaagag

SEQ ID NO: 8272558 - DNA, 22 bp, Homo sapiens
agctgaggacgtgaagggcggc

SEQ ID NO: 8272559 - DNA, 22 bp, Homo sapiens
agctgaggaataataacaaggt

SEQ ID NO: 8272560 - DNA, 22 bp, Homo sapiens
agctgagccagcagcaacagga

SEQ ID NO: 8272561 - DNA, 22 bp, Homo sapiens
agctgagccagcagcaacagga

SEQ ID NO: 8272562 - DNA, 21 bp, Homo sapiens
agctgagcccagaagactggt

SEQ ID NO: 8272563 - DNA, 22 bp, Homo sapiens
agctgagctcaggctgatgtaa

SEQ ID NO: 8272564 - DNA, 22 bp, Homo sapiens
agctgagctgcagatgactgta

SEQ ID NO: 8272565 - DNA, 22 bp, Homo sapiens
cagctgctttcagcaggaggga

SEQ ID NO: 8272566 - DNA, 20 bp, Homo sapiens
agctgaggcacctgaggtta

SEQ ID NO: 8272567 - DNA, 22 bp, Homo sapiens
cagctggacttttgatagaagt

SEQ ID NO: 8272568 - DNA, 22 bp, Homo sapiens
cagctggcaagtggagcagggt

SEQ ID NO: 8272569 - DNA, 22 bp, Homo sapiens
cagctgggtgatcttgggcagg

SEQ ID NO: 8272570 - DNA, 23 bp, Homo sapiens
cagcccaaagagagagctacttt

SEQ ID NO: 8272571 - DNA, 22 bp, Homo sapiens
cagccagtgtgaccgaggagga

SEQ ID NO: 8272572 - DNA, 22 bp, Homo sapiens
cagccctggtgaggttggctat

SEQ ID NO: 8272573 - DNA, 22 bp, Homo sapiens
cagcctctctgtatctcaggat

SEQ ID NO: 8272574 - DNA, 22 bp, Homo sapiens
cagcctctaagcacagcctctc

SEQ ID NO: 8272575 - DNA, 22 bp, Homo sapiens
cagcactgttcccagaccactg

SEQ ID NO: 8272576 - DNA, 22 bp, Homo sapiens
cagcactgcttcgcagccaggg

SEQ ID NO: 8272577 - DNA, 22 bp, Homo sapiens
cagcatggggatcactgtaggc

SEQ ID NO: 8272578 - DNA, 22 bp, Homo sapiens
cagcatggagacaaagtgggca

SEQ ID NO: 8272579 - DNA, 22 bp, Homo sapiens
cagcatggacccatcgctgagt

SEQ ID NO: 8272580 - DNA, 22 bp, Homo sapiens
cagcatcaccaacttgagcaat

SEQ ID NO: 8272581 - DNA, 22 bp, Homo sapiens
cagcatggggcttggagtcagc

SEQ ID NO: 8272582 - DNA, 22 bp, Homo sapiens
cagcatgggggcaattcaggtg

SEQ ID NO: 8272583 - DNA, 22 bp, Homo sapiens
cagcatggtggagctgctcttt

SEQ ID NO: 8272584 - DNA, 22 bp, Homo sapiens
agcgagggaggtctgaggacag

SEQ ID NO: 8272585 - DNA, 22 bp, Homo sapiens
agcgagggaggtctgaggacag

SEQ ID NO: 8272586 - DNA, 22 bp, Homo sapiens
agcgcaggaacacgtctgcctt

SEQ ID NO: 8272587 - DNA, 18 bp, Homo sapiens
cagagcagtatgaatgtt

SEQ ID NO: 8272588 - DNA, 22 bp, Homo sapiens
cagagcagtaaatctggggcac

SEQ ID NO: 8272589 - DNA, 22 bp, Homo sapiens
cagagcagtctggagatccagc

SEQ ID NO: 8272590 - DNA, 22 bp, Homo sapiens
cagagctgttactattcatgaa

SEQ ID NO: 8272591 - DNA, 22 bp, Homo sapiens
cagagctgttgcggggcttggc

SEQ ID NO: 8272592 - DNA, 22 bp, Homo sapiens
agccagggctgcaggttccttg

SEQ ID NO: 8272593 - DNA, 22 bp, Homo sapiens
agccagggctgcaggttccttg

SEQ ID NO: 8272594 - DNA, 22 bp, Homo sapiens
agccaggggagtcagctgctgg

SEQ ID NO: 8272595 - DNA, 22 bp, Homo sapiens
agccaggggagtcagctgctgg

SEQ ID NO: 8272596 - DNA, 22 bp, Homo sapiens
agccaggggagtcagctgctgg

SEQ ID NO: 8272597 - DNA, 22 bp, Homo sapiens
cagagcagggtgcaccttgggc

SEQ ID NO: 8272598 - DNA, 22 bp, Homo sapiens
agccagggatggcagtgcccag

SEQ ID NO: 8272599 - DNA, 22 bp, Homo sapiens
agccagggatggcagtgcccag

SEQ ID NO: 8272600 - DNA, 22 bp, Homo sapiens
agccagggaggattacacccca

SEQ ID NO: 8272601 - DNA, 22 bp, Homo sapiens
agccagggacgctgcaggctac

SEQ ID NO: 8272602 - DNA, 22 bp, Homo sapiens
agccagggaggtggaggttgca

SEQ ID NO: 8272603 - DNA, 22 bp, Homo sapiens
agccagggaggtggaggttgca

SEQ ID NO: 8272604 - DNA, 22 bp, Homo sapiens
agccagggaagaggcctacctc

SEQ ID NO: 8272605 - DNA, 22 bp, Homo sapiens
agccagggacgctgcaggctac

SEQ ID NO: 8272606 - DNA, 22 bp, Homo sapiens
agccaggctgcagttggctggc

SEQ ID NO: 8272607 - DNA, 22 bp, Homo sapiens
agccagggaagaggcctacctc

SEQ ID NO: 8272608 - DNA, 22 bp, Homo sapiens
agccaagaggagcctaaagcga

SEQ ID NO: 8272609 - DNA, 22 bp, Homo sapiens
agccaggctcaaggcctgctcc

SEQ ID NO: 8272610 - DNA, 22 bp, Homo sapiens
agccaggccttttctcaaggtt

SEQ ID NO: 8272611 - DNA, 21 bp, Homo sapiens
cagatcaatttacttgtccct

SEQ ID NO: 8272612 - DNA, 22 bp, Homo sapiens
agcctaggtctgggtctagcag

SEQ ID NO: 8272613 - DNA, 22 bp, Homo sapiens
agcctaggaggttggggctgca

SEQ ID NO: 8272614 - DNA, 22 bp, Homo sapiens
agccgagctctgagcagggcct

SEQ ID NO: 8272615 - DNA, 22 bp, Homo sapiens
agcccttggtattttccgatcc

SEQ ID NO: 8272616 - DNA, 22 bp, Homo sapiens
agcccttagtacatttctcaag

SEQ ID NO: 8272617 - DNA, 17 bp, Homo sapiens
cagaggagctttggggg

SEQ ID NO: 8272618 - DNA, 22 bp, Homo sapiens
cagagtgagggcctgcacctgc

SEQ ID NO: 8272619 - DNA, 20 bp, Homo sapiens
cagaggagtacatatgttca

SEQ ID NO: 8272620 - DNA, 22 bp, Homo sapiens
cagagtggagtttttcagcggg

SEQ ID NO: 8272621 - DNA, 22 bp, Homo sapiens
cagagtggcagtcccaggccca

SEQ ID NO: 8272622 - DNA, 22 bp, Homo sapiens
caaggaagttttaggagaggaa

SEQ ID NO: 8272623 - DNA, 21 bp, Homo sapiens
agcagacagcccaagaaaatc

SEQ ID NO: 8272624 - DNA, 22 bp, Homo sapiens
agcagagaagacacaggcttca

SEQ ID NO: 8272625 - DNA, 22 bp, Homo sapiens
caaggcattaccatggctagag

SEQ ID NO: 8272626 - DNA, 21 bp, Homo sapiens
agcaatttcatttggtttaac

SEQ ID NO: 8272627 - DNA, 22 bp, Homo sapiens
agcaatttcccatctcttctgc

SEQ ID NO: 8272628 - DNA, 22 bp, Homo sapiens
caagctgggtgcgggcagtata

SEQ ID NO: 8272629 - DNA, 22 bp, Homo sapiens
caagctggaggttggagctact

SEQ ID NO: 8272630 - DNA, 22 bp, Homo sapiens
caagctggctgggagaggcacg

SEQ ID NO: 8272631 - DNA, 22 bp, Homo sapiens
caagctgggtgcgggcagtata

SEQ ID NO: 8272632 - DNA, 22 bp, Homo sapiens
caagctggtatcagctagagcg

SEQ ID NO: 8272633 - DNA, 22 bp, Homo sapiens
caagctggtatcagctagagcg

SEQ ID NO: 8272634 - DNA, 21 bp, Homo sapiens
caattacagatggctcagggg

SEQ ID NO: 8272635 - DNA, 22 bp, Homo sapiens
caattatatttagaatgataca

SEQ ID NO: 8272636 - DNA, 22 bp, Homo sapiens
caattatatttagaatgataca

SEQ ID NO: 8272637 - DNA, 22 bp, Homo sapiens
caattacttttgcaccaatata

SEQ ID NO: 8272638 - DNA, 22 bp, Homo sapiens
caagtccttttcttggctcagg

SEQ ID NO: 8272639 - DNA, 22 bp, Homo sapiens
caatgatagattttacaaatta

SEQ ID NO: 8272640 - DNA, 22 bp, Homo sapiens
caagggctcacggtctgctggg

SEQ ID NO: 8272641 - DNA, 22 bp, Homo sapiens
caagtcccccaagaacagaacc

SEQ ID NO: 8272642 - DNA, 22 bp, Homo sapiens
caagtccatgttagatgctggc

SEQ ID NO: 8272643 - DNA, 22 bp, Homo sapiens
cacagaaatattgtgtcccttg

SEQ ID NO: 8272644 - DNA, 22 bp, Homo sapiens
cacagcagcgttcctccgtgtg

SEQ ID NO: 8272645 - DNA, 22 bp, Homo sapiens
cacagctgccatgcagtcagtg

SEQ ID NO: 8272646 - DNA, 22 bp, Homo sapiens
cacagctgcacagaggaggtgc

SEQ ID NO: 8272647 - DNA, 22 bp, Homo sapiens
cacagctgccatggctgcactt

SEQ ID NO: 8272648 - DNA, 22 bp, Homo sapiens
cacagctgccctactccatgtg

SEQ ID NO: 8272649 - DNA, 22 bp, Homo sapiens
cacagctggggaagctgaggcc

SEQ ID NO: 8272650 - DNA, 22 bp, Homo sapiens
cacaggaaatattaggagggat

SEQ ID NO: 8272651 - DNA, 22 bp, Homo sapiens
cacacatcttatcccagttatt

SEQ ID NO: 8272652 - DNA, 22 bp, Homo sapiens
caattttcaattccttcagata

SEQ ID NO: 8272653 - DNA, 22 bp, Homo sapiens
caattcaatggcaaagtattgt

SEQ ID NO: 8272654 - DNA, 22 bp, Homo sapiens
caatttgccctgttaaattttc

SEQ ID NO: 8272655 - DNA, 22 bp, Homo sapiens
caatttctggaactaattctga

SEQ ID NO: 8272656 - DNA, 22 bp, Homo sapiens
cacacatggtagcaggtacaag

SEQ ID NO: 8272657 - DNA, 22 bp, Homo sapiens
cacacatggtagcaggtacaag

SEQ ID NO: 8272658 - DNA, 22 bp, Homo sapiens
cacacatgaagttgctgagcta

SEQ ID NO: 8272659 - DNA, 22 bp, Homo sapiens
cacacatgtgggatccgcaggg

SEQ ID NO: 8272660 - DNA, 22 bp, Homo sapiens
agccaacacatgtaaatgcacc

SEQ ID NO: 8272661 - DNA, 22 bp, Homo sapiens
cagaaactagatttagacacaa

SEQ ID NO: 8272662 - DNA, 20 bp, Homo sapiens
cactttggacctgatgtatc

SEQ ID NO: 8272663 - DNA, 19 bp, Homo sapiens
cactttgctgaactcttct

SEQ ID NO: 8272664 - DNA, 22 bp, Homo sapiens
cactgcacttcagcctgggtga

SEQ ID NO: 8272665 - DNA, 22 bp, Homo sapiens
cactgcacttcagcctgggtga

SEQ ID NO: 8272666 - DNA, 22 bp, Homo sapiens
cactgcactccagcccgggcaa

SEQ ID NO: 8272667 - DNA, 22 bp, Homo sapiens
cactgcactccagcactccagc

SEQ ID NO: 8272668 - DNA, 22 bp, Homo sapiens
cactgcactccatcctgggaaa

SEQ ID NO: 8272669 - DNA, 22 bp, Homo sapiens
cactgcactccagcccgggcaa

SEQ ID NO: 8272670 - DNA, 22 bp, Homo sapiens
agcaggtggccacgaggaggag

SEQ ID NO: 8272671 - DNA, 22 bp, Homo sapiens
agcaggtggccacgaggaggag

SEQ ID NO: 8272672 - DNA, 22 bp, Homo sapiens
agcaggtgggatcaagctggca

SEQ ID NO: 8272673 - DNA, 22 bp, Homo sapiens
cactaaaactacattggaaaca

SEQ ID NO: 8272674 - DNA, 19 bp, Homo sapiens
agcaggctaggctgcctct

SEQ ID NO: 8272675 - DNA, 22 bp, Homo sapiens
cacaggctccggccttgcagcc

SEQ ID NO: 8272676 - DNA, 22 bp, Homo sapiens
cacatgaagagagtctagtaat

SEQ ID NO: 8272677 - DNA, 23 bp, Homo sapiens
cacatggattaaatgagaccaca

SEQ ID NO: 8272678 - DNA, 19 bp, Homo sapiens
agacagtggctaggactta

SEQ ID NO: 8272679 - DNA, 19 bp, Homo sapiens
agacagtggctaggactta

SEQ ID NO: 8272680 - DNA, 23 bp, Homo sapiens
agacagtggccgagaggtactag

SEQ ID NO: 8272681 - DNA, 22 bp, Homo sapiens
atgccatcttttattcttctag

SEQ ID NO: 8272682 - DNA, 22 bp, Homo sapiens
atgccatcttcattctcacact

SEQ ID NO: 8272683 - DNA, 22 bp, Homo sapiens
atgccatcttcattctcacact

SEQ ID NO: 8272684 - DNA, 22 bp, Homo sapiens
atgccatctgaaatctgtcata

SEQ ID NO: 8272685 - DNA, 22 bp, Homo sapiens
atgccagtaagtctcagctagg

SEQ ID NO: 8272686 - DNA, 22 bp, Homo sapiens
atgccatcctaattacgttgaa

SEQ ID NO: 8272687 - DNA, 22 bp, Homo sapiens
atgccatcacttttccttttgt

SEQ ID NO: 8272688 - DNA, 22 bp, Homo sapiens
atgccatcaatgacagagttag

SEQ ID NO: 8272689 - DNA, 22 bp, Homo sapiens
atgccatcgtgaagtaagacat

SEQ ID NO: 8272690 - DNA, 22 bp, Homo sapiens
atgccatctcttcattttatag

SEQ ID NO: 8272691 - DNA, 23 bp, Homo sapiens
atgccaggctgcctggccagcct

SEQ ID NO: 8272692 - DNA, 22 bp, Homo sapiens
atgccacttcattccagcctcg

SEQ ID NO: 8272693 - DNA, 22 bp, Homo sapiens
atgccactgcactccagcctag

SEQ ID NO: 8272694 - DNA, 22 bp, Homo sapiens
atgcttctgaagaagaaaagac

SEQ ID NO: 8272695 - DNA, 22 bp, Homo sapiens
atgcttctgctcatatttcatt

SEQ ID NO: 8272696 - DNA, 18 bp, Homo sapiens
atgcttctgatagaagca

SEQ ID NO: 8272697 - DNA, 22 bp, Homo sapiens
atgcttctgttgcttaggaggt

SEQ ID NO: 8272698 - DNA, 22 bp, Homo sapiens
atgcttctggtataagaaaaat

SEQ ID NO: 8272699 - DNA, 22 bp, Homo sapiens
agagaaaagccatcccagccaa

SEQ ID NO: 8272700 - DNA, 22 bp, Homo sapiens
agagaacacgtgcatctgcaat

SEQ ID NO: 8272701 - DNA, 22 bp, Homo sapiens
agagaacaaattaaaggtggtt

SEQ ID NO: 8272702 - DNA, 22 bp, Homo sapiens
atgctgattcctgggctccacc

SEQ ID NO: 8272703 - DNA, 22 bp, Homo sapiens
atgctgatgaggtcaggaagac

SEQ ID NO: 8272704 - DNA, 22 bp, Homo sapiens
atgctgcagtcaggccagattg

SEQ ID NO: 8272705 - DNA, 22 bp, Homo sapiens
atgacaatacttcaataagctg

SEQ ID NO: 8272706 - DNA, 22 bp, Homo sapiens
atgacaatatagctttgatttt

SEQ ID NO: 8272707 - DNA, 22 bp, Homo sapiens
atcttagggttctgtttttaag

SEQ ID NO: 8272708 - DNA, 22 bp, Homo sapiens
atcttagacccttggtagaaaa

SEQ ID NO: 8272709 - DNA, 22 bp, Homo sapiens
atcttagaagtttgataaaatc

SEQ ID NO: 8272710 - DNA, 22 bp, Homo sapiens
atctgggagacccttgcgggaa

SEQ ID NO: 8272711 - DNA, 22 bp, Homo sapiens
atctgggagtcttggctctgct

SEQ ID NO: 8272712 - DNA, 22 bp, Homo sapiens
atctgggagcggaggttgcagt

SEQ ID NO: 8272713 - DNA, 22 bp, Homo sapiens
atctgtttaattcattttcaca

SEQ ID NO: 8272714 - DNA, 22 bp, Homo sapiens
atctgggctcgaatcctagctc

SEQ ID NO: 8272715 - DNA, 20 bp, Homo sapiens
atgattcatgatgatgtctc

SEQ ID NO: 8272716 - DNA, 22 bp, Homo sapiens
atgattctggggcaaaagctgg

SEQ ID NO: 8272717 - DNA, 22 bp, Homo sapiens
atgattgaaaatgacattgcca

SEQ ID NO: 8272718 - DNA, 22 bp, Homo sapiens
atgatttaaagtcattgtgaac

SEQ ID NO: 8272719 - DNA, 22 bp, Homo sapiens
atgattgtctataaaggaaggg

SEQ ID NO: 8272720 - DNA, 22 bp, Homo sapiens
atgaggaggccagtaagagcct

SEQ ID NO: 8272721 - DNA, 22 bp, Homo sapiens
atgaggagaccaaggcctgatg

SEQ ID NO: 8272722 - DNA, 22 bp, Homo sapiens
atgtatatgcatgcattcaaag

SEQ ID NO: 8272723 - DNA, 22 bp, Homo sapiens
agagatggcgtctcagagcctg

SEQ ID NO: 8272724 - DNA, 22 bp, Homo sapiens
agagatgggaaggcagacttca

SEQ ID NO: 8272725 - DNA, 18 bp, Homo sapiens
agagatgggagttggaaa

SEQ ID NO: 8272726 - DNA, 20 bp, Homo sapiens
agagatggggtatcaccgta

SEQ ID NO: 8272727 - DNA, 22 bp, Homo sapiens
agagatgggcgggggcttctgc

SEQ ID NO: 8272728 - DNA, 22 bp, Homo sapiens
atgggccttgacacatggagtg

SEQ ID NO: 8272729 - DNA, 22 bp, Homo sapiens
agagactgcgtgtcagcgctgg

SEQ ID NO: 8272730 - DNA, 22 bp, Homo sapiens
atgtacatactgcattttcaaa

SEQ ID NO: 8272731 - DNA, 22 bp, Homo sapiens
atgtacatagcatcatctagga

SEQ ID NO: 8272732 - DNA, 22 bp, Homo sapiens
agagagaacaccctcggcatgg

SEQ ID NO: 8272733 - DNA, 22 bp, Homo sapiens
atgggaggcaggctcagaaccg

SEQ ID NO: 8272734 - DNA, 22 bp, Homo sapiens
atgggcagttaggaggccagga

SEQ ID NO: 8272735 - DNA, 22 bp, Homo sapiens
atgggcagtaacagtggcagtc

SEQ ID NO: 8272736 - DNA, 22 bp, Homo sapiens
agagaacagtgttttgaaggag

SEQ ID NO: 8272737 - DNA, 22 bp, Homo sapiens
agagaacatattttgtatgatt

SEQ ID NO: 8272738 - DNA, 22 bp, Homo sapiens
agagaacatgacgtaatagtgg

SEQ ID NO: 8272739 - DNA, 22 bp, Homo sapiens
agagaacagcctcctagagaaa

SEQ ID NO: 8272740 - DNA, 22 bp, Homo sapiens
agagaacattagcaaaaacagc

SEQ ID NO: 8272741 - DNA, 22 bp, Homo sapiens
atggaatgtttcctcttttatt

SEQ ID NO: 8272742 - DNA, 22 bp, Homo sapiens
atggaatttgcaataacaggat

SEQ ID NO: 8272743 - DNA, 22 bp, Homo sapiens
agagctccgtgcctggctgcca

SEQ ID NO: 8272744 - DNA, 22 bp, Homo sapiens
agagctccagggttttgtagtg

SEQ ID NO: 8272745 - DNA, 22 bp, Homo sapiens
attaagtgtattgctgagggta

SEQ ID NO: 8272746 - DNA, 22 bp, Homo sapiens
attaagtgactaaagtaatgct

SEQ ID NO: 8272747 - DNA, 21 bp, Homo sapiens
atgttcactgggtcaattaga

SEQ ID NO: 8272748 - DNA, 22 bp, Homo sapiens
atgttcacaaagactctgtaag

SEQ ID NO: 8272749 - DNA, 22 bp, Homo sapiens
atgttcatatccccattctgat

SEQ ID NO: 8272750 - DNA, 22 bp, Homo sapiens
agagcggggatagttaatattc

SEQ ID NO: 8272751 - DNA, 22 bp, Homo sapiens
agagcgcactgtctgcaggcaa

SEQ ID NO: 8272752 - DNA, 22 bp, Homo sapiens
agagccagcatttgggccctgc

SEQ ID NO: 8272753 - DNA, 22 bp, Homo sapiens
atgtgcagcttttctagagaag

SEQ ID NO: 8272754 - DNA, 22 bp, Homo sapiens
atgtgcaatggtgtcaccacat

SEQ ID NO: 8272755 - DNA, 22 bp, Homo sapiens
agagatggtagaacagtcataa

SEQ ID NO: 8272756 - DNA, 18 bp, Homo sapiens
agagatggtgtagagttt

SEQ ID NO: 8272757 - DNA, 22 bp, Homo sapiens
atgtgatcaagaatgtgggaga

SEQ ID NO: 8272758 - DNA, 22 bp, Homo sapiens
attgagaatgcaatctactatg

SEQ ID NO: 8272759 - DNA, 22 bp, Homo sapiens
attgagaatgaagggacatttt

SEQ ID NO: 8272760 - DNA, 22 bp, Homo sapiens
attgagaatattgtgacagtgt

SEQ ID NO: 8272761 - DNA, 22 bp, Homo sapiens
attgagaatatgatttagtata

SEQ ID NO: 8272762 - DNA, 22 bp, Homo sapiens
attgagaatctgagagcctagg

SEQ ID NO: 8272763 - DNA, 22 bp, Homo sapiens
attgagaagaaaatctaatata

SEQ ID NO: 8272764 - DNA, 23 bp, Homo sapiens
attgagaaggatacattgttctc

SEQ ID NO: 8272765 - DNA, 22 bp, Homo sapiens
attgagaaaattcgagcaagtt

SEQ ID NO: 8272766 - DNA, 22 bp, Homo sapiens
attgaaatacataaaattgcca

SEQ ID NO: 8272767 - DNA, 19 bp, Homo sapiens
attgtgtcaatggtgttca

SEQ ID NO: 8272768 - DNA, 22 bp, Homo sapiens
attgttaaagtaataaccatgg

SEQ ID NO: 8272769 - DNA, 22 bp, Homo sapiens
attgttaataactattacattg

SEQ ID NO: 8272770 - DNA, 22 bp, Homo sapiens
attgttaaactgaagcattact

SEQ ID NO: 8272771 - DNA, 22 bp, Homo sapiens
attgttaaactgaagcattact

SEQ ID NO: 8272772 - DNA, 22 bp, Homo sapiens
attgtgtcctcattgaccttca

SEQ ID NO: 8272773 - DNA, 22 bp, Homo sapiens
attgttaaaaaggtggaaatgc

SEQ ID NO: 8272774 - DNA, 22 bp, Homo sapiens
attgtatttccagcttgaatgt

SEQ ID NO: 8272775 - DNA, 22 bp, Homo sapiens
attgtatttgtacaagacatgt

SEQ ID NO: 8272776 - DNA, 22 bp, Homo sapiens
attgtgctttagatcacagtct

SEQ ID NO: 8272777 - DNA, 22 bp, Homo sapiens
attgtattagcacaatacaatt

SEQ ID NO: 8272778 - DNA, 22 bp, Homo sapiens
attgtattctgcacctttgtta

SEQ ID NO: 8272779 - DNA, 22 bp, Homo sapiens
attgtattcagttacaggtctt

SEQ ID NO: 8272780 - DNA, 22 bp, Homo sapiens
attgtattataattaggccaaa

SEQ ID NO: 8272781 - DNA, 22 bp, Homo sapiens
attgtatttaggagaaaagggt

SEQ ID NO: 8272782 - DNA, 22 bp, Homo sapiens
agatacaaaggcctacagagca

SEQ ID NO: 8272783 - DNA, 22 bp, Homo sapiens
agatacaaaaagggagaagatt

SEQ ID NO: 8272784 - DNA, 22 bp, Homo sapiens
attgttaataactattacattg

SEQ ID NO: 8272785 - DNA, 22 bp, Homo sapiens
attgttaataactattacattg

SEQ ID NO: 8272786 - DNA, 22 bp, Homo sapiens
agataaattcctaagatttcag

SEQ ID NO: 8272787 - DNA, 22 bp, Homo sapiens
agataaattcctaagatttcag

SEQ ID NO: 8272788 - DNA, 22 bp, Homo sapiens
agatacaagttaagagaaagga

SEQ ID NO: 8272789 - DNA, 22 bp, Homo sapiens
agatacaactgtttaaacatta

SEQ ID NO: 8272790 - DNA, 22 bp, Homo sapiens
attctctgtacagaaggtaccg

SEQ ID NO: 8272791 - DNA, 19 bp, Homo sapiens
attctctagtggtgcaatg

SEQ ID NO: 8272792 - DNA, 22 bp, Homo sapiens
attctaaagcttgtggagctta

SEQ ID NO: 8272793 - DNA, 22 bp, Homo sapiens
attctaaatcagagagctctgt

SEQ ID NO: 8272794 - DNA, 22 bp, Homo sapiens
attctaaatgtaatttagaatt

SEQ ID NO: 8272795 - DNA, 22 bp, Homo sapiens
attctaaatgtaatttagaatt

SEQ ID NO: 8272796 - DNA, 22 bp, Homo sapiens
attctaattagttctacatgtt

SEQ ID NO: 8272797 - DNA, 22 bp, Homo sapiens
attctaagtcttgttcacattc

SEQ ID NO: 8272798 - DNA, 22 bp, Homo sapiens
attctaagtcttgttcacattc

SEQ ID NO: 8272799 - DNA, 22 bp, Homo sapiens
attaataaaataccactttgtt

SEQ ID NO: 8272800 - DNA, 22 bp, Homo sapiens
attaatatacactgttagcatg

SEQ ID NO: 8272801 - DNA, 22 bp, Homo sapiens
agaggaaaatgagttccagaat

SEQ ID NO: 8272802 - DNA, 22 bp, Homo sapiens
agaggaaatggataaagggtga

SEQ ID NO: 8272803 - DNA, 22 bp, Homo sapiens
agaggaagccattgcttactga

SEQ ID NO: 8272804 - DNA, 22 bp, Homo sapiens
agaggccagggacactgctcaa

SEQ ID NO: 8272805 - DNA, 22 bp, Homo sapiens
agaggccggccgagcccatggg

SEQ ID NO: 8272806 - DNA, 22 bp, Homo sapiens
agaggccggccgagcccatggg

SEQ ID NO: 8272807 - DNA, 22 bp, Homo sapiens
agaggccctgggctggtgtgct

SEQ ID NO: 8272808 - DNA, 22 bp, Homo sapiens
agaggcctccgaaaggtgggct

SEQ ID NO: 8272809 - DNA, 22 bp, Homo sapiens
agaggcctccctcccagctggt

SEQ ID NO: 8272810 - DNA, 19 bp, Homo sapiens
agaggcctcagcagctggc

SEQ ID NO: 8272811 - DNA, 22 bp, Homo sapiens
agaggcctccgaaaggtgggct

SEQ ID NO: 8272812 - DNA, 22 bp, Homo sapiens
agaggcctctttgcaagtaggt

SEQ ID NO: 8272813 - DNA, 22 bp, Homo sapiens
agattcattaggagacattcag

SEQ ID NO: 8272814 - DNA, 22 bp, Homo sapiens
agattggagatggaagaaaagt

SEQ ID NO: 8272815 - DNA, 22 bp, Homo sapiens
agattgtagaaactgtagcatt

SEQ ID NO: 8272816 - DNA, 22 bp, Homo sapiens
agattctaccagagctagtttg

SEQ ID NO: 8272817 - DNA, 20 bp, Homo sapiens
attttggtgaacacagcttc

SEQ ID NO: 8272818 - DNA, 22 bp, Homo sapiens
attttggctgtcagggtattat

SEQ ID NO: 8272819 - DNA, 22 bp, Homo sapiens
attttggcaacagccatgagcc

SEQ ID NO: 8272820 - DNA, 22 bp, Homo sapiens
attttggctgttgggaattatt

SEQ ID NO: 8272821 - DNA, 22 bp, Homo sapiens
attttggtggtatattaggatt

SEQ ID NO: 8272822 - DNA, 22 bp, Homo sapiens
agatttagcaaatcttactagc

SEQ ID NO: 8272823 - DNA, 22 bp, Homo sapiens
agatgacaatgaaggaaaatgt

SEQ ID NO: 8272824 - DNA, 22 bp, Homo sapiens
agatgacaatgaaggaaaatgt

SEQ ID NO: 8272825 - DNA, 22 bp, Homo sapiens
agatgacaagagcttgctgcag

SEQ ID NO: 8272826 - DNA, 22 bp, Homo sapiens
atttgaatgcaggtagctgagt

SEQ ID NO: 8272827 - DNA, 22 bp, Homo sapiens
agatgacagccaaggagatgaa

SEQ ID NO: 8272828 - DNA, 22 bp, Homo sapiens
agatgacagccaaggagatgaa

SEQ ID NO: 8272829 - DNA, 22 bp, Homo sapiens
agatgacaatgaggttgttatt

SEQ ID NO: 8272830 - DNA, 22 bp, Homo sapiens
agatgacacaccatttttactt

SEQ ID NO: 8272831 - DNA, 22 bp, Homo sapiens
agatgacacacacgcacccgga

SEQ ID NO: 8272832 - DNA, 22 bp, Homo sapiens
agatgacatgggagcaagcact

SEQ ID NO: 8272833 - DNA, 22 bp, Homo sapiens
agatgacatgggagcaagcact

SEQ ID NO: 8272834 - DNA, 22 bp, Homo sapiens
agatgacagtagctcccccatt

SEQ ID NO: 8272835 - DNA, 22 bp, Homo sapiens
agatgacaggtttttttggctt

SEQ ID NO: 8272836 - DNA, 22 bp, Homo sapiens
agatgacagctacgggatgaaa

SEQ ID NO: 8272837 - DNA, 22 bp, Homo sapiens
agatgacatggttcaagtttcc

SEQ ID NO: 8272838 - DNA, 23 bp, Homo sapiens
attttttgtctttgtaactagat

SEQ ID NO: 8272839 - DNA, 20 bp, Homo sapiens
agcaagagtgtacctggcca

SEQ ID NO: 8272840 - DNA, 22 bp, Homo sapiens
agcaagtgtaagaatgcagaat

SEQ ID NO: 8272841 - DNA, 22 bp, Homo sapiens
attttgttgaggtaattgtcaa

SEQ ID NO: 8272842 - DNA, 22 bp, Homo sapiens
attttgttatcagggctttgca

SEQ ID NO: 8272843 - DNA, 22 bp, Homo sapiens
caaacattgggggcttcaacac

SEQ ID NO: 8272844 - DNA, 22 bp, Homo sapiens
caaaggtagtatatatattgtt

SEQ ID NO: 8272845 - DNA, 22 bp, Homo sapiens
acctatttatgcaattatgaaa

SEQ ID NO: 8272846 - DNA, 22 bp, Homo sapiens
aagtcctgttcctcatacttcc

SEQ ID NO: 8272847 - DNA, 22 bp, Homo sapiens
aagtcctttaatatcacatagt

SEQ ID NO: 8272848 - DNA, 22 bp, Homo sapiens
acctgcctatcagctgcctgct

SEQ ID NO: 8272849 - DNA, 22 bp, Homo sapiens
aagtccctttaatcagtgcctt

SEQ ID NO: 8272850 - DNA, 22 bp, Homo sapiens
aagtcctgaagacacagaaaag

SEQ ID NO: 8272851 - DNA, 22 bp, Homo sapiens
aagtcctgaaacttctttctga

SEQ ID NO: 8272852 - DNA, 22 bp, Homo sapiens
aagtcctgaataggggccctgg

SEQ ID NO: 8272853 - DNA, 20 bp, Homo sapiens
aagtcctgacctagtctaaa

SEQ ID NO: 8272854 - DNA, 22 bp, Homo sapiens
aagtcctgagaccagaaaatgg

SEQ ID NO: 8272855 - DNA, 22 bp, Homo sapiens
aagtcctgccagcaaatgtata

SEQ ID NO: 8272856 - DNA, 22 bp, Homo sapiens
aagtcctgccacctataagcct

SEQ ID NO: 8272857 - DNA, 22 bp, Homo sapiens
aagtcctggatattaaattgat

SEQ ID NO: 8272858 - DNA, 22 bp, Homo sapiens
aagtcctgtgtgcttacacttg

SEQ ID NO: 8272859 - DNA, 22 bp, Homo sapiens
aagtcctgtgctagagacacct

SEQ ID NO: 8272860 - DNA, 22 bp, Homo sapiens
aagtcctgggtgagaactgtcc

SEQ ID NO: 8272861 - DNA, 22 bp, Homo sapiens
aagtcctgggcatttgaacagg

SEQ ID NO: 8272862 - DNA, 22 bp, Homo sapiens
aagtccctggttcctagcaaaa

SEQ ID NO: 8272863 - DNA, 22 bp, Homo sapiens
aagtcccatctgcctccatgta

SEQ ID NO: 8272864 - DNA, 17 bp, Homo sapiens
aagtcccagctaacaca

SEQ ID NO: 8272865 - DNA, 22 bp, Homo sapiens
aagtccagtgctttagattcca

SEQ ID NO: 8272866 - DNA, 22 bp, Homo sapiens
aagtccagtttttccaggtggt

SEQ ID NO: 8272867 - DNA, 22 bp, Homo sapiens
accagaggaagggaatctcaag

SEQ ID NO: 8272868 - DNA, 20 bp, Homo sapiens
accagaggaaagagcagtga

SEQ ID NO: 8272869 - DNA, 22 bp, Homo sapiens
aaggtacctaacatttgagtgt

SEQ ID NO: 8272870 - DNA, 22 bp, Homo sapiens
aaggtacagaaattaacaagga

SEQ ID NO: 8272871 - DNA, 22 bp, Homo sapiens
aaggtacaggcattgctgcagc

SEQ ID NO: 8272872 - DNA, 22 bp, Homo sapiens
aaggtacagggaaggagcaaga

SEQ ID NO: 8272873 - DNA, 22 bp, Homo sapiens
aaggtacaaagtattatttaaa

SEQ ID NO: 8272874 - DNA, 22 bp, Homo sapiens
aagggaggtaaagctatttaaa

SEQ ID NO: 8272875 - DNA, 22 bp, Homo sapiens
aagggctggatctctctgagca

SEQ ID NO: 8272876 - DNA, 22 bp, Homo sapiens
aagggctggagaggaaaggttg

SEQ ID NO: 8272877 - DNA, 22 bp, Homo sapiens
acatgacagtgcttagcaaact

SEQ ID NO: 8272878 - DNA, 22 bp, Homo sapiens
acatgacatagtagaaaagccc

SEQ ID NO: 8272879 - DNA, 17 bp, Homo sapiens
acatgactgcacaaagt

SEQ ID NO: 8272880 - DNA, 22 bp, Homo sapiens
acatgacatagtagaaaagccc

SEQ ID NO: 8272881 - DNA, 22 bp, Homo sapiens
acatgacacaggcctggccaat

SEQ ID NO: 8272882 - DNA, 22 bp, Homo sapiens
acatgacacctctggctgggtg

SEQ ID NO: 8272883 - DNA, 22 bp, Homo sapiens
acatgacaaggtttataaggct

SEQ ID NO: 8272884 - DNA, 19 bp, Homo sapiens
acatgacaacaggggaggc

SEQ ID NO: 8272885 - DNA, 22 bp, Homo sapiens
acatgacagtgcttagcaaact

SEQ ID NO: 8272886 - DNA, 22 bp, Homo sapiens
acatgacagggaatgaggtgaa

SEQ ID NO: 8272887 - DNA, 22 bp, Homo sapiens
acatgacagtgactttataaga

SEQ ID NO: 8272888 - DNA, 22 bp, Homo sapiens
acatgacaaaatgcacaggatt

SEQ ID NO: 8272889 - DNA, 22 bp, Homo sapiens
acatgaacactgcttgccacat

SEQ ID NO: 8272890 - DNA, 20 bp, Homo sapiens
acatgaacagggctacagca

SEQ ID NO: 8272891 - DNA, 22 bp, Homo sapiens
acatgaacattatatcagcaag

SEQ ID NO: 8272892 - DNA, 22 bp, Homo sapiens
acatgaacatgctcaaataact

SEQ ID NO: 8272893 - DNA, 22 bp, Homo sapiens
acatcccttgctcggggcccct

SEQ ID NO: 8272894 - DNA, 22 bp, Homo sapiens
acatccctcagtcagactgtaa

SEQ ID NO: 8272895 - DNA, 22 bp, Homo sapiens
acatcctgaagtcagtcatttg

SEQ ID NO: 8272896 - DNA, 22 bp, Homo sapiens
aaggccagcagtttgagaccag

SEQ ID NO: 8272897 - DNA, 22 bp, Homo sapiens
aaggccagagtactagaggctg

SEQ ID NO: 8272898 - DNA, 22 bp, Homo sapiens
aaggccagagcagactggagtt

SEQ ID NO: 8272899 - DNA, 22 bp, Homo sapiens
aaggcatgtgtcctcagagaga

SEQ ID NO: 8272900 - DNA, 17 bp, Homo sapiens
aaggcacagggcactgg

SEQ ID NO: 8272901 - DNA, 22 bp, Homo sapiens
aaggcacagaggcagggcactt

SEQ ID NO: 8272902 - DNA, 22 bp, Homo sapiens
aaggacaggagaaaacgggatc

SEQ ID NO: 8272903 - DNA, 22 bp, Homo sapiens
aaggacagaaacagattgctgg

SEQ ID NO: 8272904 - DNA, 22 bp, Homo sapiens
aaggacagagagccattccaga

SEQ ID NO: 8272905 - DNA, 22 bp, Homo sapiens
aaggaaggttcatagtcaaaga

SEQ ID NO: 8272906 - DNA, 22 bp, Homo sapiens
aaggaaggttcatagtcaaaga

SEQ ID NO: 8272907 - DNA, 22 bp, Homo sapiens
aaggaaggtactcagtgattct

SEQ ID NO: 8272908 - DNA, 22 bp, Homo sapiens
aaggaagggaaatagtgatgtc

SEQ ID NO: 8272909 - DNA, 22 bp, Homo sapiens
aaggaaggaattgatcatgcgc

SEQ ID NO: 8272910 - DNA, 22 bp, Homo sapiens
aaggaaggaattgatcatgcgc

SEQ ID NO: 8272911 - DNA, 22 bp, Homo sapiens
aaggaagggaaatagtgatgtc

SEQ ID NO: 8272912 - DNA, 22 bp, Homo sapiens
aaggaagcagccagagaccctc

SEQ ID NO: 8272913 - DNA, 22 bp, Homo sapiens
aagcttcttagaatgcatgtgc

SEQ ID NO: 8272914 - DNA, 22 bp, Homo sapiens
aagcttggaagtcttcctttca

SEQ ID NO: 8272915 - DNA, 21 bp, Homo sapiens
aagcttggctgatgttattgg

SEQ ID NO: 8272916 - DNA, 22 bp, Homo sapiens
aagcttgggaaccacggtaatc

SEQ ID NO: 8272917 - DNA, 22 bp, Homo sapiens
aagcttcatttcaactcagggg

SEQ ID NO: 8272918 - DNA, 22 bp, Homo sapiens
acagctggaggtctgtgagcac

SEQ ID NO: 8272919 - DNA, 22 bp, Homo sapiens
acagctggagccctatggctgg

SEQ ID NO: 8272920 - DNA, 22 bp, Homo sapiens
acagctggaggggctgcagagg

SEQ ID NO: 8272921 - DNA, 22 bp, Homo sapiens
aatgcctcttggaagaagactt

SEQ ID NO: 8272922 - DNA, 22 bp, Homo sapiens
aatgcctcgccttatttatttt

SEQ ID NO: 8272923 - DNA, 22 bp, Homo sapiens
aatgcctcagcagttattattc

SEQ ID NO: 8272924 - DNA, 22 bp, Homo sapiens
aatgcctaagtaattattttga

SEQ ID NO: 8272925 - DNA, 22 bp, Homo sapiens
aatgcctcttttctccagtcca

SEQ ID NO: 8272926 - DNA, 22 bp, Homo sapiens
aatgcctctttggagttatttc

SEQ ID NO: 8272927 - DNA, 22 bp, Homo sapiens
aatgccattttctataaaaaga

SEQ ID NO: 8272928 - DNA, 19 bp, Homo sapiens
aatgcctcagagacttaag

SEQ ID NO: 8272929 - DNA, 19 bp, Homo sapiens
aatgcctcaaattgggaga

SEQ ID NO: 8272930 - DNA, 22 bp, Homo sapiens
aatgccattttaggcatgtcct

SEQ ID NO: 8272931 - DNA, 16 bp, Homo sapiens
aatgccatttagaggt

SEQ ID NO: 8272932 - DNA, 22 bp, Homo sapiens
aatgccattccatcacacacct

SEQ ID NO: 8272933 - DNA, 22 bp, Homo sapiens
aatgccatgctaagggcttggt

SEQ ID NO: 8272934 - DNA, 22 bp, Homo sapiens
aatgccattgatttatatactt

SEQ ID NO: 8272935 - DNA, 23 bp, Homo sapiens
aatgccatattggatttcttcag

SEQ ID NO: 8272936 - DNA, 22 bp, Homo sapiens
aatgccatcagagaaaactctt

SEQ ID NO: 8272937 - DNA, 22 bp, Homo sapiens
aatgccatctggtgatgtatta

SEQ ID NO: 8272938 - DNA, 22 bp, Homo sapiens
aatgccatccctctgtcaccaa

SEQ ID NO: 8272939 - DNA, 22 bp, Homo sapiens
agaaggaagccaggagggtgca

SEQ ID NO: 8272940 - DNA, 22 bp, Homo sapiens
agaaggaaggataactgcatta

SEQ ID NO: 8272941 - DNA, 22 bp, Homo sapiens
aatgaagtgttatttagtttca

SEQ ID NO: 8272942 - DNA, 21 bp, Homo sapiens
aatgaagtggctattttgagg

SEQ ID NO: 8272943 - DNA, 22 bp, Homo sapiens
aatgaatgaaccacatataaca

SEQ ID NO: 8272944 - DNA, 22 bp, Homo sapiens
agaagaaactgtcggggatatt

SEQ ID NO: 8272945 - DNA, 22 bp, Homo sapiens
agaagaaagattgaaggttcct

SEQ ID NO: 8272946 - DNA, 22 bp, Homo sapiens
agaagaaagattgaaggttcct

SEQ ID NO: 8272947 - DNA, 22 bp, Homo sapiens
agaagaaatgaggccgttctgc

SEQ ID NO: 8272948 - DNA, 22 bp, Homo sapiens
aatgaacttcagtgatttctgg

SEQ ID NO: 8272949 - DNA, 19 bp, Homo sapiens
agaactgggtccatggctt

SEQ ID NO: 8272950 - DNA, 22 bp, Homo sapiens
agaacacactgggggaaacaag

SEQ ID NO: 8272951 - DNA, 22 bp, Homo sapiens
agaaaggaggaagaatgacctc

SEQ ID NO: 8272952 - DNA, 22 bp, Homo sapiens
agaaaggcaatattaactacac

SEQ ID NO: 8272953 - DNA, 22 bp, Homo sapiens
aatcacatagccatctctttga

SEQ ID NO: 8272954 - DNA, 17 bp, Homo sapiens
agaaaggcagttcctct

SEQ ID NO: 8272955 - DNA, 22 bp, Homo sapiens
agaaaggcagggatgaggattg

SEQ ID NO: 8272956 - DNA, 22 bp, Homo sapiens
aatctaaggacttagcattgct

SEQ ID NO: 8272957 - DNA, 22 bp, Homo sapiens
aatctaagggaaattggagatg

SEQ ID NO: 8272958 - DNA, 22 bp, Homo sapiens
aatctaagccaccagtagtttc

SEQ ID NO: 8272959 - DNA, 22 bp, Homo sapiens
aatagctgagggtgaggcccaa

SEQ ID NO: 8272960 - DNA, 17 bp, Homo sapiens
aatagctgctcagagag

SEQ ID NO: 8272961 - DNA, 22 bp, Homo sapiens
aataggaaaatatttaacaaga

SEQ ID NO: 8272962 - DNA, 22 bp, Homo sapiens
actttgttttcatgaaacagct

SEQ ID NO: 8272963 - DNA, 22 bp, Homo sapiens
actttgatagtttaatctagga

SEQ ID NO: 8272964 - DNA, 22 bp, Homo sapiens
actttgaatttttgtgggtagc

SEQ ID NO: 8272965 - DNA, 22 bp, Homo sapiens
actttgatcctttgaatatttg

SEQ ID NO: 8272966 - DNA, 22 bp, Homo sapiens
actttgcaaaaggaaatcacct

SEQ ID NO: 8272967 - DNA, 22 bp, Homo sapiens
actttgcaaaataatgctgatt

SEQ ID NO: 8272968 - DNA, 22 bp, Homo sapiens
actttgttgatgaaatagtttt

SEQ ID NO: 8272969 - DNA, 22 bp, Homo sapiens
actttgttgttccttgtctaaa

SEQ ID NO: 8272970 - DNA, 22 bp, Homo sapiens
actttgttgaagaatatgttag

SEQ ID NO: 8272971 - DNA, 22 bp, Homo sapiens
actctttacttaaactctaagt

SEQ ID NO: 8272972 - DNA, 22 bp, Homo sapiens
acctgcctatggagccacatgg

SEQ ID NO: 8272973 - DNA, 22 bp, Homo sapiens
acctgcctcagtgcagctggat

SEQ ID NO: 8272974 - DNA, 22 bp, Homo sapiens
aagtgtgggaagtaggtggcga

SEQ ID NO: 8272975 - DNA, 22 bp, Homo sapiens
aagtgtgggaagttgctaaaat

SEQ ID NO: 8272976 - DNA, 21 bp, Homo sapiens
aagtgtgtcccagcagccggg

SEQ ID NO: 8272977 - DNA, 19 bp, Homo sapiens
actgcagggaggaggtgtg

SEQ ID NO: 8272978 - DNA, 22 bp, Homo sapiens
actgcagggcatcctggccaag

SEQ ID NO: 8272979 - DNA, 22 bp, Homo sapiens
actgcaggccttggtgccagca

SEQ ID NO: 8272980 - DNA, 22 bp, Homo sapiens
actgcaggtggatggcacttta

SEQ ID NO: 8272981 - DNA, 22 bp, Homo sapiens
actgcagggcatcctggccaag

SEQ ID NO: 8272982 - DNA, 22 bp, Homo sapiens
actgcaggatgtgctcctattg

SEQ ID NO: 8272983 - DNA, 22 bp, Homo sapiens
actgcaggagacacagctgctg

SEQ ID NO: 8272984 - DNA, 18 bp, Homo sapiens
actgcaggagaggtgagg

SEQ ID NO: 8272985 - DNA, 22 bp, Homo sapiens
actgcaggagacacagctgctg

SEQ ID NO: 8272986 - DNA, 18 bp, Homo sapiens
actctttctgcccacagg

SEQ ID NO: 8272987 - DNA, 22 bp, Homo sapiens
actgaaaatgaattagaaacag

SEQ ID NO: 8272988 - DNA, 22 bp, Homo sapiens
actgtcctgaatactgcatgac

SEQ ID NO: 8272989 - DNA, 22 bp, Homo sapiens
actgtcctagaacctgcagctc

SEQ ID NO: 8272990 - DNA, 22 bp, Homo sapiens
aatagaatttaaatgcagtggc

SEQ ID NO: 8272991 - DNA, 22 bp, Homo sapiens
actgtacatatggattctaaga

SEQ ID NO: 8272992 - DNA, 22 bp, Homo sapiens
actgtacacagtggtgtactgt

SEQ ID NO: 8272993 - DNA, 22 bp, Homo sapiens
actgtccaagcatgcctggctt

SEQ ID NO: 8272994 - DNA, 22 bp, Homo sapiens
actgtacaaatattgcaaaata

SEQ ID NO: 8272995 - DNA, 22 bp, Homo sapiens
actgtaatggtggatccatgtc

SEQ ID NO: 8272996 - DNA, 22 bp, Homo sapiens
actgggcaaggatatgatgggt

SEQ ID NO: 8272997 - DNA, 22 bp, Homo sapiens
actgggcaaggatatgatgggt

SEQ ID NO: 8272998 - DNA, 22 bp, Homo sapiens
actgggcaccatcatgagatag

SEQ ID NO: 8272999 - DNA, 22 bp, Homo sapiens
actgggcaccatcatgagatgg

SEQ ID NO: 8273000 - DNA, 22 bp, Homo sapiens
aataagtgatgatgagtcactc

SEQ ID NO: 8273001 - DNA, 22 bp, Homo sapiens
aataatacatgagattaatgtt

SEQ ID NO: 8273002 - DNA, 22 bp, Homo sapiens
aataataagatactaagggagt

SEQ ID NO: 8273003 - DNA, 22 bp, Homo sapiens
aataataagatactaagggagt

SEQ ID NO: 8273004 - DNA, 22 bp, Homo sapiens
aagtttttggtagagaaaagta

SEQ ID NO: 8273005 - DNA, 22 bp, Homo sapiens
actgggaggcaaagagcaagga

SEQ ID NO: 8273006 - DNA, 22 bp, Homo sapiens
acagataattagcataaatgct

SEQ ID NO: 8273007 - DNA, 21 bp, Homo sapiens
agcgtcaatatcgtcaacagg

SEQ ID NO: 8273008 - DNA, 22 bp, Homo sapiens
agcgtgtggagaactaagcaga

SEQ ID NO: 8273009 - DNA, 22 bp, Homo sapiens
acagaatatttggcatgcgtct

SEQ ID NO: 8273010 - DNA, 22 bp, Homo sapiens
acagaggccatgagctgccacc

SEQ ID NO: 8273011 - DNA, 22 bp, Homo sapiens
acagaacttcctgctggagtgg

SEQ ID NO: 8273012 - DNA, 22 bp, Homo sapiens
acagaactttctgatcctgagc

SEQ ID NO: 8273013 - DNA, 22 bp, Homo sapiens
acagaataactcttgcttgagt

SEQ ID NO: 8273014 - DNA, 22 bp, Homo sapiens
acagatattatggtttctcctt

SEQ ID NO: 8273015 - DNA, 22 bp, Homo sapiens
acagatactcagctctatgctt

SEQ ID NO: 8273016 - DNA, 22 bp, Homo sapiens
acagatacaaatatacaaatac

SEQ ID NO: 8273017 - DNA, 22 bp, Homo sapiens
acagatactataatgtaaagtg

SEQ ID NO: 8273018 - DNA, 20 bp, Homo sapiens
acagataccagggacatggg

SEQ ID NO: 8273019 - DNA, 22 bp, Homo sapiens
acagcagagttgagtagttgca

SEQ ID NO: 8273020 - DNA, 20 bp, Homo sapiens
acagcagccttgctagaaac

SEQ ID NO: 8273021 - DNA, 17 bp, Homo sapiens
acagcaggcccggaggg

SEQ ID NO: 8273022 - DNA, 22 bp, Homo sapiens
acagcaggcccatactggaagg

SEQ ID NO: 8273023 - DNA, 22 bp, Homo sapiens
acagcaggcccatactggaagg

SEQ ID NO: 8273024 - DNA, 22 bp, Homo sapiens
acagcaggcatgaatgacactg

SEQ ID NO: 8273025 - DNA, 22 bp, Homo sapiens
acagcaggcatgaatgacactg

SEQ ID NO: 8273026 - DNA, 22 bp, Homo sapiens
acagcagggaatatgggaattg

SEQ ID NO: 8273027 - DNA, 19 bp, Homo sapiens
acagcagggatttttggag

SEQ ID NO: 8273028 - DNA, 17 bp, Homo sapiens
acagcagggaagtgttg

SEQ ID NO: 8273029 - DNA, 17 bp, Homo sapiens
acagcagggaagtgttg

SEQ ID NO: 8273030 - DNA, 22 bp, Homo sapiens
acagcaggttttaactttgaag

SEQ ID NO: 8273031 - DNA, 18 bp, Homo sapiens
acagcaggtttcattctt

SEQ ID NO: 8273032 - DNA, 22 bp, Homo sapiens
acagcaggttattgttatggca

SEQ ID NO: 8273033 - DNA, 18 bp, Homo sapiens
agctgaggggactgaaga

SEQ ID NO: 8273034 - DNA, 22 bp, Homo sapiens
agctgaggttagtataaatgtg

SEQ ID NO: 8273035 - DNA, 22 bp, Homo sapiens
agctgaggttgaagagtgaacg

SEQ ID NO: 8273036 - DNA, 22 bp, Homo sapiens
agctgatgtgtccggagcagct

SEQ ID NO: 8273037 - DNA, 21 bp, Homo sapiens
agctgaggtaaggcaagagag

SEQ ID NO: 8273038 - DNA, 21 bp, Homo sapiens
agctgaggtaaggcaagagag

SEQ ID NO: 8273039 - DNA, 23 bp, Homo sapiens
agctgaggtgcagatccaaagaa

SEQ ID NO: 8273040 - DNA, 22 bp, Homo sapiens
agcaggtgtcactttcactcca

SEQ ID NO: 8273041 - DNA, 22 bp, Homo sapiens
acacccagagcgccagtgccga

SEQ ID NO: 8273042 - DNA, 22 bp, Homo sapiens
acacccagattatgcacacaaa

SEQ ID NO: 8273043 - DNA, 22 bp, Homo sapiens
acaccattcaccatcagtacct

SEQ ID NO: 8273044 - DNA, 22 bp, Homo sapiens
agcaggtggtaggcagtcagca

SEQ ID NO: 8273045 - DNA, 22 bp, Homo sapiens
agcaggtggtaggcagtcagca

SEQ ID NO: 8273046 - DNA, 22 bp, Homo sapiens
agcaggtgtatataaggctgag

SEQ ID NO: 8273047 - DNA, 21 bp, Homo sapiens
agcaggtgtaaaggaggaaat

SEQ ID NO: 8273048 - DNA, 22 bp, Homo sapiens
agccaaggagtgcaggtggctt

SEQ ID NO: 8273049 - DNA, 22 bp, Homo sapiens
agccaagggtcagctgcacaga

SEQ ID NO: 8273050 - DNA, 22 bp, Homo sapiens
agccaagggtcagctgcacaga

SEQ ID NO: 8273051 - DNA, 22 bp, Homo sapiens
agccagaggccagcctgcctca

SEQ ID NO: 8273052 - DNA, 22 bp, Homo sapiens
agccagagggatctttctaaga

SEQ ID NO: 8273053 - DNA, 22 bp, Homo sapiens
agccagaggccagcctgcctca

SEQ ID NO: 8273054 - DNA, 22 bp, Homo sapiens
agccagaggccagcctgcctca

SEQ ID NO: 8273055 - DNA, 22 bp, Homo sapiens
agccagaggtcatgagcacagg

SEQ ID NO: 8273056 - DNA, 19 bp, Homo sapiens
agccagagtggcccagggg

SEQ ID NO: 8273057 - DNA, 19 bp, Homo sapiens
agccagagtggcccagggg

SEQ ID NO: 8273058 - DNA, 22 bp, Homo sapiens
agccagctgttctggggcagca

SEQ ID NO: 8273059 - DNA, 22 bp, Homo sapiens
agccaggaaccagctacagtct

SEQ ID NO: 8273060 - DNA, 22 bp, Homo sapiens
agccaggaagagaggcctcacc

SEQ ID NO: 8273061 - DNA, 22 bp, Homo sapiens
agccagctgtgggctcaggcgg

SEQ ID NO: 8273062 - DNA, 22 bp, Homo sapiens
agccagctgtgggctcaggcgg

SEQ ID NO: 8273063 - DNA, 22 bp, Homo sapiens
agccagagattgagatgcaggc

SEQ ID NO: 8273064 - DNA, 22 bp, Homo sapiens
agccagagctgatgtcattctc

SEQ ID NO: 8273065 - DNA, 22 bp, Homo sapiens
agccagaggaacttgatgactg

SEQ ID NO: 8273066 - DNA, 22 bp, Homo sapiens
agccagagctgatgtcattctc

SEQ ID NO: 8273067 - DNA, 22 bp, Homo sapiens
agccagaggaacttgatgactg

SEQ ID NO: 8273068 - DNA, 22 bp, Homo sapiens
agccagagatccatccctagga

SEQ ID NO: 8273069 - DNA, 22 bp, Homo sapiens
agccagagattgagatgcaggc

SEQ ID NO: 8273070 - DNA, 20 bp, Homo sapiens
acactgttcttcacacattt

SEQ ID NO: 8273071 - DNA, 22 bp, Homo sapiens
acactgttctttgcactgagaa

SEQ ID NO: 8273072 - DNA, 22 bp, Homo sapiens
acactgttccacactaagaagg

SEQ ID NO: 8273073 - DNA, 22 bp, Homo sapiens
acactgtgtttacatagagaat

SEQ ID NO: 8273074 - DNA, 22 bp, Homo sapiens
acacagtatgcatctagaaatt

SEQ ID NO: 8273075 - DNA, 22 bp, Homo sapiens
acacagtgtcttaggtagtgtc

SEQ ID NO: 8273076 - DNA, 22 bp, Homo sapiens
acacagtgtcagggcaggggcc

SEQ ID NO: 8273077 - DNA, 22 bp, Homo sapiens
acacagtattgtgactataact

SEQ ID NO: 8273078 - DNA, 22 bp, Homo sapiens
acacacaaatctattagtgaat

SEQ ID NO: 8273079 - DNA, 22 bp, Homo sapiens
acacacaattagttttatgctt

SEQ ID NO: 8273080 - DNA, 22 bp, Homo sapiens
acacacaactcattgtgtaata

SEQ ID NO: 8273081 - DNA, 22 bp, Homo sapiens
acacaatgtgcaggacacctgt

SEQ ID NO: 8273082 - DNA, 22 bp, Homo sapiens
acacaatttcataaacaccatg

SEQ ID NO: 8273083 - DNA, 22 bp, Homo sapiens
acacaatacagggctcaaaata

SEQ ID NO: 8273084 - DNA, 22 bp, Homo sapiens
acacaagtccctccatactctc

SEQ ID NO: 8273085 - DNA, 22 bp, Homo sapiens
acacatctatctctacacaagg

SEQ ID NO: 8273086 - DNA, 22 bp, Homo sapiens
agcaggtgagcacagccaggct

SEQ ID NO: 8273087 - DNA, 22 bp, Homo sapiens
acacatctatctctacacaagg

SEQ ID NO: 8273088 - DNA, 22 bp, Homo sapiens
acacatattcatatgtacttac

SEQ ID NO: 8273089 - DNA, 22 bp, Homo sapiens
acacatatgtggcaactgtaga

SEQ ID NO: 8273090 - DNA, 22 bp, Homo sapiens
agcagggaagcctccagaacct

SEQ ID NO: 8273091 - DNA, 22 bp, Homo sapiens
agcagggaatagcggaaagaat

SEQ ID NO: 8273092 - DNA, 22 bp, Homo sapiens
agcagggacatggcatctctcc

SEQ ID NO: 8273093 - DNA, 22 bp, Homo sapiens
agcagggacatggcatctctcc

SEQ ID NO: 8273094 - DNA, 19 bp, Homo sapiens
agcagggacatggaacttt

SEQ ID NO: 8273095 - DNA, 22 bp, Homo sapiens
agcagggactacgtgaaagtga

SEQ ID NO: 8273096 - DNA, 22 bp, Homo sapiens
agcagggactgagccagtggga

SEQ ID NO: 8273097 - DNA, 22 bp, Homo sapiens
agcaggcttggtccccagcctc

SEQ ID NO: 8273098 - DNA, 21 bp, Homo sapiens
agcaggctttggagtggggct

SEQ ID NO: 8273099 - DNA, 22 bp, Homo sapiens
aattccagctaggaaaagcttc

SEQ ID NO: 8273100 - DNA, 22 bp, Homo sapiens
agaggaagtaatcaggacctgc

SEQ ID NO: 8273101 - DNA, 22 bp, Homo sapiens
agagctgggtggtggtgactca

SEQ ID NO: 8273102 - DNA, 22 bp, Homo sapiens
agaggaaggatgcatatccaaa

SEQ ID NO: 8273103 - DNA, 22 bp, Homo sapiens
aattccacagatgtctatctgt

SEQ ID NO: 8273104 - DNA, 18 bp, Homo sapiens
aatttccatatgaattgc

SEQ ID NO: 8273105 - DNA, 22 bp, Homo sapiens
aatttcacagctggtctatggg

SEQ ID NO: 8273106 - DNA, 22 bp, Homo sapiens
aatttcacagtgaactttgagg

SEQ ID NO: 8273107 - DNA, 22 bp, Homo sapiens
aatttctaattgaatctctctt

SEQ ID NO: 8273108 - DNA, 22 bp, Homo sapiens
agaggcaaaaatctatggcaac

SEQ ID NO: 8273109 - DNA, 22 bp, Homo sapiens
agaggaggtccttttctgatgt

SEQ ID NO: 8273110 - DNA, 22 bp, Homo sapiens
agaggaggtggtgatgctttaa

SEQ ID NO: 8273111 - DNA, 18 bp, Homo sapiens
agaggatgcatctaagag

SEQ ID NO: 8273112 - DNA, 22 bp, Homo sapiens
aattaatatttgtggaattaat

SEQ ID NO: 8273113 - DNA, 22 bp, Homo sapiens
aattaagtcacacacctaaacc

SEQ ID NO: 8273114 - DNA, 22 bp, Homo sapiens
aattaagagagagttgaagcaa

SEQ ID NO: 8273115 - DNA, 22 bp, Homo sapiens
aattacaaatgtagactctcat

SEQ ID NO: 8273116 - DNA, 22 bp, Homo sapiens
aattacaaatgtagactctcat

SEQ ID NO: 8273117 - DNA, 23 bp, Homo sapiens
aattacaaccaagaactggaagg

SEQ ID NO: 8273118 - DNA, 21 bp, Homo sapiens
aattacagatggaattacaga

SEQ ID NO: 8273119 - DNA, 22 bp, Homo sapiens
agagctgcccacacagcagatt

SEQ ID NO: 8273120 - DNA, 22 bp, Homo sapiens
agagctgcaatttcatgtggtg

SEQ ID NO: 8273121 - DNA, 22 bp, Homo sapiens
aatgccttgcctgctacaactt

SEQ ID NO: 8273122 - DNA, 22 bp, Homo sapiens
aatgctaacattggtttatatc

SEQ ID NO: 8273123 - DNA, 22 bp, Homo sapiens
aatgctctgtctctgacagtgg

SEQ ID NO: 8273124 - DNA, 22 bp, Homo sapiens
aatgctgagggatgagagaggc

SEQ ID NO: 8273125 - DNA, 22 bp, Homo sapiens
aatgtattatacataatttgtg

SEQ ID NO: 8273126 - DNA, 22 bp, Homo sapiens
aatgtattatacataatttgtg

SEQ ID NO: 8273127 - DNA, 22 bp, Homo sapiens
agagaaggggtaaagagtcctg

SEQ ID NO: 8273128 - DNA, 22 bp, Homo sapiens
agagcaagtgacagaaacaggg

SEQ ID NO: 8273129 - DNA, 22 bp, Homo sapiens
agagcaaagggacatggaagag

SEQ ID NO: 8273130 - DNA, 22 bp, Homo sapiens
aatgtgtataagggagagctaa

SEQ ID NO: 8273131 - DNA, 22 bp, Homo sapiens
aatgtgtgttcggggcccagag

SEQ ID NO: 8273132 - DNA, 22 bp, Homo sapiens
acaaatagagattcaaataaag

SEQ ID NO: 8273133 - DNA, 22 bp, Homo sapiens
acaaagttattctttcagagga

SEQ ID NO: 8273134 - DNA, 22 bp, Homo sapiens
acaaagtgtgcggagcccaggg

SEQ ID NO: 8273135 - DNA, 22 bp, Homo sapiens
acaaagtttcttctaacatctg

SEQ ID NO: 8273136 - DNA, 22 bp, Homo sapiens
acaaagtttgtggtattccaag

SEQ ID NO: 8273137 - DNA, 22 bp, Homo sapiens
acaaagtctctaataatcttct

SEQ ID NO: 8273138 - DNA, 22 bp, Homo sapiens
agatgcctaaatctgggcaagg

SEQ ID NO: 8273139 - DNA, 22 bp, Homo sapiens
agatgccagcttacactgggaa

SEQ ID NO: 8273140 - DNA, 19 bp, Homo sapiens
agagttagctggctatctc

SEQ ID NO: 8273141 - DNA, 22 bp, Homo sapiens
agagtgggttataggcagactt

SEQ ID NO: 8273142 - DNA, 22 bp, Homo sapiens
agagtgggttataggcagactt

SEQ ID NO: 8273143 - DNA, 20 bp, Homo sapiens
agagtgggtgtcacaggctg

SEQ ID NO: 8273144 - DNA, 22 bp, Homo sapiens
aatttctgtatgaatagagaaa

SEQ ID NO: 8273145 - DNA, 22 bp, Homo sapiens
aatttcttcagctctaaaatgg

SEQ ID NO: 8273146 - DNA, 22 bp, Homo sapiens
aatttctccaagaatgcttaga

SEQ ID NO: 8273147 - DNA, 20 bp, Homo sapiens
aatttctcctgggtaacaga

SEQ ID NO: 8273148 - DNA, 22 bp, Homo sapiens
aatttctccagacagctgtgca

SEQ ID NO: 8273149 - DNA, 22 bp, Homo sapiens
aatttctcactctcttgatcac

SEQ ID NO: 8273150 - DNA, 22 bp, Homo sapiens
aatttctcaattgttacaggtg

SEQ ID NO: 8273151 - DNA, 22 bp, Homo sapiens
aatttctaattgaatctctctt

SEQ ID NO: 8273152 - DNA, 22 bp, Homo sapiens
agcaaagcttccataaagcagc

SEQ ID NO: 8273153 - DNA, 21 bp, Homo sapiens
agcaaaggcaggagaggtttc

SEQ ID NO: 8273154 - DNA, 22 bp, Homo sapiens
acaataacttctgtttccttgc

SEQ ID NO: 8273155 - DNA, 22 bp, Homo sapiens
acaatacttaccaatgtttttg

SEQ ID NO: 8273156 - DNA, 22 bp, Homo sapiens
acaatactcatgctctttttct

SEQ ID NO: 8273157 - DNA, 22 bp, Homo sapiens
agcacaagtttctggcagacag

SEQ ID NO: 8273158 - DNA, 22 bp, Homo sapiens
agcacacaggacttgattcatg

SEQ ID NO: 8273159 - DNA, 22 bp, Homo sapiens
agcacacaggccacctccactt

SEQ ID NO: 8273160 - DNA, 22 bp, Homo sapiens
agcacaggaacatggagatggg

SEQ ID NO: 8273161 - DNA, 22 bp, Homo sapiens
agcacaggaacatggagatggg

SEQ ID NO: 8273162 - DNA, 22 bp, Homo sapiens
agcacagggacaatgccaggtg

SEQ ID NO: 8273163 - DNA, 22 bp, Homo sapiens
agcacaggaccaaggaagctgt

SEQ ID NO: 8273164 - DNA, 22 bp, Homo sapiens
agcacaggaccaaggaagctgt

SEQ ID NO: 8273165 - DNA, 22 bp, Homo sapiens
agcacaggctttggtgtgaggg

SEQ ID NO: 8273166 - DNA, 22 bp, Homo sapiens
agcacaggacgtagagcttgga

SEQ ID NO: 8273167 - DNA, 22 bp, Homo sapiens
acacaaattgtaggataattgc

SEQ ID NO: 8273168 - DNA, 21 bp, Homo sapiens
acacaacaggcagtcattttc

SEQ ID NO: 8273169 - DNA, 22 bp, Homo sapiens
acacaagaagttaatgggcaaa

SEQ ID NO: 8273170 - DNA, 22 bp, Homo sapiens
acaattttccccataggttatc

SEQ ID NO: 8273171 - DNA, 22 bp, Homo sapiens
agcacaggtaatacagagtaac

SEQ ID NO: 8273172 - DNA, 22 bp, Homo sapiens
agcacaggtaatacagagtaac

SEQ ID NO: 8273173 - DNA, 22 bp, Homo sapiens
agcacagggcccagcctaggcc

SEQ ID NO: 8273174 - DNA, 22 bp, Homo sapiens
acaatttttcaaagaagcttat

SEQ ID NO: 8273175 - DNA, 22 bp, Homo sapiens
aaagtcacttccttctgtcagc

SEQ ID NO: 8273176 - DNA, 22 bp, Homo sapiens
aaagtacatgcaattcttctga

SEQ ID NO: 8273177 - DNA, 22 bp, Homo sapiens
aaagtacatgcaattcttctga

SEQ ID NO: 8273178 - DNA, 22 bp, Homo sapiens
aaagtacaaggaaaggatctga

SEQ ID NO: 8273179 - DNA, 22 bp, Homo sapiens
aaagtacaatattgagattgat

SEQ ID NO: 8273180 - DNA, 22 bp, Homo sapiens
aaagtacaggaaagcctagcca

SEQ ID NO: 8273181 - DNA, 22 bp, Homo sapiens
aaagtacagatggtgaggttgg

SEQ ID NO: 8273182 - DNA, 22 bp, Homo sapiens
aaataaactgaagcacagagag

SEQ ID NO: 8273183 - DNA, 22 bp, Homo sapiens
aaagccagggacagtgtgcatg

SEQ ID NO: 8273184 - DNA, 22 bp, Homo sapiens
aaaattttgccctatccttcat

SEQ ID NO: 8273185 - DNA, 22 bp, Homo sapiens
aaaggacatgtcaatatcaggc

SEQ ID NO: 8273186 - DNA, 22 bp, Homo sapiens
aaaggacacacaggaggtgtct

SEQ ID NO: 8273187 - DNA, 22 bp, Homo sapiens
aaatgtctttatctcatgtaac

SEQ ID NO: 8273188 - DNA, 22 bp, Homo sapiens
aaatgtctgttagtcatatcat

SEQ ID NO: 8273189 - DNA, 23 bp, Homo sapiens
aaacttcagtagtgtcatcagcc

SEQ ID NO: 8273190 - DNA, 22 bp, Homo sapiens
aaagacagatggcaaggatgat

SEQ ID NO: 8273191 - DNA, 22 bp, Homo sapiens
aaagacagtggattcaaaatcc

SEQ ID NO: 8273192 - DNA, 22 bp, Homo sapiens
aaagacagacggaaacctgagg

SEQ ID NO: 8273193 - DNA, 22 bp, Homo sapiens
aaagacagacggaaacctgagg

SEQ ID NO: 8273194 - DNA, 22 bp, Homo sapiens
aaagacagagctgtaggggaaa

SEQ ID NO: 8273195 - DNA, 22 bp, Homo sapiens
aaatgtctttgagtttttataa

SEQ ID NO: 8273196 - DNA, 23 bp, Homo sapiens
aaatgtgagggaaaatctttctg

SEQ ID NO: 8273197 - DNA, 22 bp, Homo sapiens
aaatacacgtacatgtgtaaaa

SEQ ID NO: 8273198 - DNA, 22 bp, Homo sapiens
aaataacagtcagggacaacat

SEQ ID NO: 8273199 - DNA, 22 bp, Homo sapiens
aaatacaatttcaggctgtaat

SEQ ID NO: 8273200 - DNA, 22 bp, Homo sapiens
aaatacaatttcaggctgtaat

SEQ ID NO: 8273201 - DNA, 22 bp, Homo sapiens
aaatacagatagatttaaccca

SEQ ID NO: 8273202 - DNA, 21 bp, Homo sapiens
aaatacagaaacttgttttca

SEQ ID NO: 8273203 - DNA, 21 bp, Homo sapiens
aaatgaatgtggtagtgcaag

SEQ ID NO: 8273204 - DNA, 22 bp, Homo sapiens
aaatgacactaggctttttgca

SEQ ID NO: 8273205 - DNA, 22 bp, Homo sapiens
aaatgacactaggctttttgca

SEQ ID NO: 8273206 - DNA, 22 bp, Homo sapiens
aaatgacaataaaagtccatgc

SEQ ID NO: 8273207 - DNA, 22 bp, Homo sapiens
aaatgacactcattcagtgtca

SEQ ID NO: 8273208 - DNA, 22 bp, Homo sapiens
aaactgtgagctagtaaatagg

SEQ ID NO: 8273209 - DNA, 22 bp, Homo sapiens
aaaagctttgttaataggtttg

SEQ ID NO: 8273210 - DNA, 22 bp, Homo sapiens
aaaatgagacacatgtgactcc

SEQ ID NO: 8273211 - DNA, 22 bp, Homo sapiens
aaaatgagatacagtttgaaag

SEQ ID NO: 8273212 - DNA, 22 bp, Homo sapiens
aaaatgagcatattgatccttt

SEQ ID NO: 8273213 - DNA, 22 bp, Homo sapiens
aaaatgaggaacggatcatggc

SEQ ID NO: 8273214 - DNA, 22 bp, Homo sapiens
aaaatgagccatgaaccaacca

SEQ ID NO: 8273215 - DNA, 22 bp, Homo sapiens
aaaatgcatgagaatgtgctcg

SEQ ID NO: 8273216 - DNA, 22 bp, Homo sapiens
aaaatgtaaagcttgagtgtag

SEQ ID NO: 8273217 - DNA, 22 bp, Homo sapiens
aaaatggatagtgcgtcttctc

SEQ ID NO: 8273218 - DNA, 22 bp, Homo sapiens
aaaatggatagtgcgtcttctc

SEQ ID NO: 8273219 - DNA, 22 bp, Homo sapiens
aaagcagggatgaggctagagg

SEQ ID NO: 8273220 - DNA, 22 bp, Homo sapiens
aaagcagggtccaaggagatgt

SEQ ID NO: 8273221 - DNA, 22 bp, Homo sapiens
aaagcagggatgaggctagagg

SEQ ID NO: 8273222 - DNA, 22 bp, Homo sapiens
aaagcagctttcggccctcggg

SEQ ID NO: 8273223 - DNA, 22 bp, Homo sapiens
aaagcaggcagcaggctggatt

SEQ ID NO: 8273224 - DNA, 22 bp, Homo sapiens
aaagcagctgctctggccttga

SEQ ID NO: 8273225 - DNA, 22 bp, Homo sapiens
aaagcagctgatagtctcatct

SEQ ID NO: 8273226 - DNA, 22 bp, Homo sapiens
aaagcagcctgctcatcctgga

SEQ ID NO: 8273227 - DNA, 22 bp, Homo sapiens
aaagcagcctgctcatcctgga

SEQ ID NO: 8273228 - DNA, 22 bp, Homo sapiens
aaagcagccactctctctgcct

SEQ ID NO: 8273229 - DNA, 22 bp, Homo sapiens
aaagcagcagcacctgcatttc

SEQ ID NO: 8273230 - DNA, 22 bp, Homo sapiens
aaagcagcagaatctctcaggg

SEQ ID NO: 8273231 - DNA, 22 bp, Homo sapiens
aaaaccaagttttccttagtct

SEQ ID NO: 8273232 - DNA, 22 bp, Homo sapiens
aaaagcaagaggctggattaaa

SEQ ID NO: 8273233 - DNA, 22 bp, Homo sapiens
aaaagatgaaatggtgtcttgg

SEQ ID NO: 8273234 - DNA, 22 bp, Homo sapiens
aaaagagtgtttcaactttggc

SEQ ID NO: 8273235 - DNA, 22 bp, Homo sapiens
aaaacacaagaagcagggtaca

SEQ ID NO: 8273236 - DNA, 22 bp, Homo sapiens
aaaaatttatggttcttctctg

SEQ ID NO: 8273237 - DNA, 22 bp, Homo sapiens
aaaacacaagaagcagggtaca

SEQ ID NO: 8273238 - DNA, 22 bp, Homo sapiens
aaaacaggtgtcagcaaactat

SEQ ID NO: 8273239 - DNA, 22 bp, Homo sapiens
aaaacaggagttttggtaggct

SEQ ID NO: 8273240 - DNA, 22 bp, Homo sapiens
aaaacaggagttttggtaggct

SEQ ID NO: 8273241 - DNA, 22 bp, Homo sapiens
aaaagagccacttatgacctca

SEQ ID NO: 8273242 - DNA, 23 bp, Homo sapiens
aaaacagcttcctccagtggctc

SEQ ID NO: 8273243 - DNA, 22 bp, Homo sapiens
aaaacagacagccagtgtagag

SEQ ID NO: 8273244 - DNA, 22 bp, Homo sapiens
aaaacactgcaaagctgattgg

SEQ ID NO: 8273245 - DNA, 22 bp, Homo sapiens
aaaacacactggaccaatttaa

SEQ ID NO: 8273246 - DNA, 22 bp, Homo sapiens
aaaacacactggaccaatttaa

SEQ ID NO: 8273247 - DNA, 22 bp, Homo sapiens
aaaagcagagactctggagcta

SEQ ID NO: 8273248 - DNA, 22 bp, Homo sapiens
aaaagcaattgcagttcttgcc

SEQ ID NO: 8273249 - DNA, 22 bp, Homo sapiens
aaaagcaagttgcctaggttga

SEQ ID NO: 8273250 - DNA, 22 bp, Homo sapiens
aaaggaggccacatggctagga

SEQ ID NO: 8273251 - DNA, 22 bp, Homo sapiens
aaaggattagagataccatgcc

SEQ ID NO: 8273252 - DNA, 20 bp, Homo sapiens
aaagcagtatgcaagtagag

SEQ ID NO: 8273253 - DNA, 22 bp, Homo sapiens
aaagcagcacatggatatcagt

SEQ ID NO: 8273254 - DNA, 22 bp, Homo sapiens
aaagcaggttgcaattacagtg

SEQ ID NO: 8273255 - DNA, 22 bp, Homo sapiens
aaattgtaggatcacatgacct

SEQ ID NO: 8273256 - DNA, 22 bp, Homo sapiens
aaattgtagagatcgctttgtg

SEQ ID NO: 8273257 - DNA, 22 bp, Homo sapiens
aaattggattttaaactgttgg

SEQ ID NO: 8273258 - DNA, 22 bp, Homo sapiens
aaattgtataatgttccagctg

SEQ ID NO: 8273259 - DNA, 22 bp, Homo sapiens
aaagcagcaagtatttgttact

SEQ ID NO: 8273260 - DNA, 22 bp, Homo sapiens
aaattccagaaactcagtatat

SEQ ID NO: 8273261 - DNA, 22 bp, Homo sapiens
aaattccaccagaatcagtaat

SEQ ID NO: 8273262 - DNA, 22 bp, Homo sapiens
aaattccattatgataatttcg

SEQ ID NO: 8273263 - DNA, 22 bp, Homo sapiens
aaattccattatgataatttcg

SEQ ID NO: 8273264 - DNA, 22 bp, Homo sapiens
aaattccagttcttttacctgc

SEQ ID NO: 8273265 - DNA, 22 bp, Homo sapiens
aaattccattttgtgactattc

SEQ ID NO: 8273266 - DNA, 22 bp, Homo sapiens
aaagggaagttgcacatgttcc

SEQ ID NO: 8273267 - DNA, 22 bp, Homo sapiens
aaaggcttttggtatataggag

SEQ ID NO: 8273268 - DNA, 22 bp, Homo sapiens
aaaggctttgagaagtcctgca

SEQ ID NO: 8273269 - DNA, 22 bp, Homo sapiens
aaaggctttccagcgcgcggac

SEQ ID NO: 8273270 - DNA, 22 bp, Homo sapiens
aaaggctttaaagaaccagaac

SEQ ID NO: 8273271 - DNA, 22 bp, Homo sapiens
aaaggcttctattggacgttgc

SEQ ID NO: 8273272 - DNA, 22 bp, Homo sapiens
aaaggcttctttgctccatgtc

SEQ ID NO: 8273273 - DNA, 22 bp, Homo sapiens
aaaggcttgcgattccttgtaa

SEQ ID NO: 8273274 - DNA, 22 bp, Homo sapiens
aaaggcttggtattttggagtt

SEQ ID NO: 8273275 - DNA, 22 bp, Homo sapiens
aaaggcttgactagaagggaga

SEQ ID NO: 8273276 - DNA, 22 bp, Homo sapiens
aaaggcttgagcatttgttgaa

SEQ ID NO: 8273277 - DNA, 22 bp, Homo sapiens
aaaggcttgtttgaggactggt

SEQ ID NO: 8273278 - DNA, 22 bp, Homo sapiens
aaaggctttaaaatgtacatat

SEQ ID NO: 8273279 - DNA, 22 bp, Homo sapiens
aaaggcttggttctttgatgac

SEQ ID NO: 8273280 - DNA, 22 bp, Homo sapiens
aaaggcttgtacagcagccttc

SEQ ID NO: 8273281 - DNA, 22 bp, Homo sapiens
aaaggcttgtccagtaagggga

SEQ ID NO: 8273282 - DNA, 22 bp, Homo sapiens
aaaggcttaatgttgttgtaat

SEQ ID NO: 8273283 - DNA, 22 bp, Homo sapiens
aaaggcttaacagaagaccttt

SEQ ID NO: 8273284 - DNA, 22 bp, Homo sapiens
aaaggcttagacacagaactgt

SEQ ID NO: 8273285 - DNA, 22 bp, Homo sapiens
aaaggcttcacttatttatttt

SEQ ID NO: 8273286 - DNA, 22 bp, Homo sapiens
aaaggcttcggatcagaaggta

SEQ ID NO: 8273287 - DNA, 22 bp, Homo sapiens
aaaggcttcagtgagtgggtat

SEQ ID NO: 8273288 - DNA, 22 bp, Homo sapiens
aaaggcttctcagaaaggcctt

SEQ ID NO: 8273289 - DNA, 19 bp, Homo sapiens
aacatgacagccactctgg

SEQ ID NO: 8273290 - DNA, 22 bp, Homo sapiens
aacatgatgacaaaggtatatt

SEQ ID NO: 8273291 - DNA, 22 bp, Homo sapiens
aaaggctgcaaagctgtaagtg

SEQ ID NO: 8273292 - DNA, 22 bp, Homo sapiens
aacttctgccaaacagctgtta

SEQ ID NO: 8273293 - DNA, 22 bp, Homo sapiens
aacttctggatgtttcaaatgt

SEQ ID NO: 8273294 - DNA, 22 bp, Homo sapiens
aacttctgacctcaagaactgt

SEQ ID NO: 8273295 - DNA, 22 bp, Homo sapiens
aaagtcctgttaactgttaaca

SEQ ID NO: 8273296 - DNA, 22 bp, Homo sapiens
aaagtcctttttgccatgcaag

SEQ ID NO: 8273297 - DNA, 20 bp, Homo sapiens
aaagtcccttagtgggagca

SEQ ID NO: 8273298 - DNA, 22 bp, Homo sapiens
aaagtccaggggctggaggcgg

SEQ ID NO: 8273299 - DNA, 22 bp, Homo sapiens
aaagtcctagcgatccacagaa

SEQ ID NO: 8273300 - DNA, 22 bp, Homo sapiens
aaagtccagggaaagagcgtct

SEQ ID NO: 8273301 - DNA, 22 bp, Homo sapiens
aaatggaactgttgtgcatttg

SEQ ID NO: 8273302 - DNA, 22 bp, Homo sapiens
aaatggaactgggctactaggt

SEQ ID NO: 8273303 - DNA, 22 bp, Homo sapiens
aaatggaactgggctactaggt

SEQ ID NO: 8273304 - DNA, 19 bp, Homo sapiens
aaatggaaaactttgggaa

SEQ ID NO: 8273305 - DNA, 22 bp, Homo sapiens
aaatggaaaatgctgttttggt

SEQ ID NO: 8273306 - DNA, 22 bp, Homo sapiens
aaatgatggtactcatgtttag

SEQ ID NO: 8273307 - DNA, 22 bp, Homo sapiens
aaatgcacaggagaaccaattc

SEQ ID NO: 8273308 - DNA, 23 bp, Homo sapiens
aaatgactaaatgttcttataga

SEQ ID NO: 8273309 - DNA, 22 bp, Homo sapiens
aaatgaccagaatacaggcttc

SEQ ID NO: 8273310 - DNA, 22 bp, Homo sapiens
aaatcagagtagaattgagcca

SEQ ID NO: 8273311 - DNA, 22 bp, Homo sapiens
aaatcaaggagggattatattt

SEQ ID NO: 8273312 - DNA, 22 bp, Homo sapiens
aaatcacagggtctctaagtat

SEQ ID NO: 8273313 - DNA, 22 bp, Homo sapiens
aaatattggtaggatgcttgtt

SEQ ID NO: 8273314 - DNA, 22 bp, Homo sapiens
aaatattgttttggtaagcttc

SEQ ID NO: 8273315 - DNA, 22 bp, Homo sapiens
aagagagagtgcgctcacagaa

SEQ ID NO: 8273316 - DNA, 22 bp, Homo sapiens
aagagagaccatgggggacagg

SEQ ID NO: 8273317 - DNA, 22 bp, Homo sapiens
aaatatacggtccctaacagtc

SEQ ID NO: 8273318 - DNA, 22 bp, Homo sapiens
aaatatacggtccctaacagtc

SEQ ID NO: 8273319 - DNA, 22 bp, Homo sapiens
aaatatagcaattatgcctact

SEQ ID NO: 8273320 - DNA, 22 bp, Homo sapiens
aaatagtaaagtggtagccatc

SEQ ID NO: 8273321 - DNA, 22 bp, Homo sapiens
aaatataccagttgcctgcatc

SEQ ID NO: 8273322 - DNA, 22 bp, Homo sapiens
aaatatacggtccctaacagtc

SEQ ID NO: 8273323 - DNA, 22 bp, Homo sapiens
aaatatagtaaatgcatagttc

SEQ ID NO: 8273324 - DNA, 22 bp, Homo sapiens
aagagagaactcccttcgccag

SEQ ID NO: 8273325 - DNA, 22 bp, Homo sapiens
aaatacagtgtgtgttctttga

SEQ ID NO: 8273326 - DNA, 22 bp, Homo sapiens
aaatacaaaaattagccaggca

SEQ ID NO: 8273327 - DNA, 19 bp, Homo sapiens
aaatacagcagctgtttcc

SEQ ID NO: 8273328 - DNA, 22 bp, Homo sapiens
aaatacaggagtttggacttct

SEQ ID NO: 8273329 - DNA, 22 bp, Homo sapiens
aagaaggaagtgtggacatcac

SEQ ID NO: 8273330 - DNA, 22 bp, Homo sapiens
aagaaggaagtgtggacatcac

SEQ ID NO: 8273331 - DNA, 22 bp, Homo sapiens
aagtcttaggaaatagcaaaga

SEQ ID NO: 8273332 - DNA, 22 bp, Homo sapiens
aagtgcattagatagaatgatg

SEQ ID NO: 8273333 - DNA, 22 bp, Homo sapiens
aagtgccatcatagcatggctg

SEQ ID NO: 8273334 - DNA, 17 bp, Homo sapiens
aacagtaagccctgttt

SEQ ID NO: 8273335 - DNA, 22 bp, Homo sapiens
aacagtaacgagatgtcctaac

SEQ ID NO: 8273336 - DNA, 22 bp, Homo sapiens
aacagtaagagatgttttatct

SEQ ID NO: 8273337 - DNA, 22 bp, Homo sapiens
aacagtaaagacagaatttatc

SEQ ID NO: 8273338 - DNA, 22 bp, Homo sapiens
aagggctgcatttgatgtgtca

SEQ ID NO: 8273339 - DNA, 22 bp, Homo sapiens
aagggctgctgtagaagcagag

SEQ ID NO: 8273340 - DNA, 22 bp, Homo sapiens
aagtaacaggtgcttagtttat

SEQ ID NO: 8273341 - DNA, 22 bp, Homo sapiens
aagtaatgatgtcatcacagag

SEQ ID NO: 8273342 - DNA, 22 bp, Homo sapiens
aagtccagtgaaatagaatgca

SEQ ID NO: 8273343 - DNA, 22 bp, Homo sapiens
aaggccctaatagagcacatat

SEQ ID NO: 8273344 - DNA, 22 bp, Homo sapiens
aaggccctcatgcgtcagagcc

SEQ ID NO: 8273345 - DNA, 22 bp, Homo sapiens
aaggcccttccaccagtcctcg

SEQ ID NO: 8273346 - DNA, 22 bp, Homo sapiens
aaggccctgtctccaaatacag

SEQ ID NO: 8273347 - DNA, 22 bp, Homo sapiens
aaggccctggccccagcttctt

SEQ ID NO: 8273348 - DNA, 22 bp, Homo sapiens
aaggccctggcaggaagcagga

SEQ ID NO: 8273349 - DNA, 18 bp, Homo sapiens
aaggccctgagcatatgc

SEQ ID NO: 8273350 - DNA, 22 bp, Homo sapiens
aaggccaggggctggcgcctcc

SEQ ID NO: 8273351 - DNA, 22 bp, Homo sapiens
aagggcaggaaaagatggatgt

SEQ ID NO: 8273352 - DNA, 22 bp, Homo sapiens
aagggcaggagaagacggatat

SEQ ID NO: 8273353 - DNA, 22 bp, Homo sapiens
aaggagtgatatatgggtgcta

SEQ ID NO: 8273354 - DNA, 22 bp, Homo sapiens
aaggataaaaaccacttctaat

SEQ ID NO: 8273355 - DNA, 22 bp, Homo sapiens
aaggatagaataactcttgact

SEQ ID NO: 8273356 - DNA, 22 bp, Homo sapiens
aaggagaagggtaatcaacaca

SEQ ID NO: 8273357 - DNA, 22 bp, Homo sapiens
aaatggaagaagtgcaatactg

SEQ ID NO: 8273358 - DNA, 22 bp, Homo sapiens
aaatggaactgttgtgcatttg

SEQ ID NO: 8273359 - DNA, 22 bp, Homo sapiens
aaatggaagctatttatgattc

SEQ ID NO: 8273360 - DNA, 22 bp, Homo sapiens
aaatggaagctatttatgattc

SEQ ID NO: 8273361 - DNA, 22 bp, Homo sapiens
aaatggaatgtgtttataattc

SEQ ID NO: 8273362 - DNA, 22 bp, Homo sapiens
aaatggaatgtgtttataattc

SEQ ID NO: 8273363 - DNA, 22 bp, Homo sapiens
aaatggaagtgtatttagtgtt

SEQ ID NO: 8273364 - DNA, 22 bp, Homo sapiens
aaatggatggaaagcaattttt

SEQ ID NO: 8273365 - DNA, 22 bp, Homo sapiens
aaatggatgcctgataacgtca

SEQ ID NO: 8273366 - DNA, 22 bp, Homo sapiens
aatgcaggcacgtgcaagcaag

SEQ ID NO: 8273367 - DNA, 22 bp, Homo sapiens
aatgcaggttcttgggccacat

SEQ ID NO: 8273368 - DNA, 22 bp, Homo sapiens
aacttgtaaaatagagtgtaca

SEQ ID NO: 8273369 - DNA, 22 bp, Homo sapiens
aatgtacaaaccttctttgtag

SEQ ID NO: 8273370 - DNA, 22 bp, Homo sapiens
aatgtacaaaccttctttgtag

SEQ ID NO: 8273371 - DNA, 22 bp, Homo sapiens
aatgtacaaaagtcagccaact

SEQ ID NO: 8273372 - DNA, 22 bp, Homo sapiens
aacttgtattgaaaatgggtaa

SEQ ID NO: 8273373 - DNA, 21 bp, Homo sapiens
aacttgtatttctccttattc

SEQ ID NO: 8273374 - DNA, 22 bp, Homo sapiens
aacttgtaatgaaaggcaatag

SEQ ID NO: 8273375 - DNA, 22 bp, Homo sapiens
aacttgtaggactgcactgtag

SEQ ID NO: 8273376 - DNA, 22 bp, Homo sapiens
aacttgtatatgttattcagag

SEQ ID NO: 8273377 - DNA, 22 bp, Homo sapiens
aactttaaaaaatatgtctgtt

SEQ ID NO: 8273378 - DNA, 22 bp, Homo sapiens
aactttaaggctataaattatg

SEQ ID NO: 8273379 - DNA, 22 bp, Homo sapiens
aactttaaggctataaattatg

SEQ ID NO: 8273380 - DNA, 22 bp, Homo sapiens
aatgcagattcttattctgtag

SEQ ID NO: 8273381 - DNA, 22 bp, Homo sapiens
aatctgtagggaacaactgtac

SEQ ID NO: 8273382 - DNA, 21 bp, Homo sapiens
aatacagtgaagaatttcttt

SEQ ID NO: 8273383 - DNA, 22 bp, Homo sapiens
aatacatatggaattccatgtt

SEQ ID NO: 8273384 - DNA, 22 bp, Homo sapiens
aatatcatctctcttttctgca

SEQ ID NO: 8273385 - DNA, 22 bp, Homo sapiens
aataatgagcttgtctaattgt

SEQ ID NO: 8273386 - DNA, 22 bp, Homo sapiens
aataatgagacagcttatttaa

SEQ ID NO: 8273387 - DNA, 22 bp, Homo sapiens
aataatctccctttttgtatgt

SEQ ID NO: 8273388 - DNA, 22 bp, Homo sapiens
aataatctcactttatgtggaa

SEQ ID NO: 8273389 - DNA, 22 bp, Homo sapiens
aatacagaggggtcacaattca

SEQ ID NO: 8273390 - DNA, 22 bp, Homo sapiens
aatacagaggggtcacaattca

SEQ ID NO: 8273391 - DNA, 22 bp, Homo sapiens
acacagctgtgcagttttttca

SEQ ID NO: 8273392 - DNA, 22 bp, Homo sapiens
aagatacaccaagagcctagta

SEQ ID NO: 8273393 - DNA, 22 bp, Homo sapiens
aagataatgttctagctgtcag

SEQ ID NO: 8273394 - DNA, 22 bp, Homo sapiens
aagataatgtgtctgtctttgc

SEQ ID NO: 8273395 - DNA, 22 bp, Homo sapiens
aagataatgtgtctgtctttgc

SEQ ID NO: 8273396 - DNA, 22 bp, Homo sapiens
aagataatattcattaactaga

SEQ ID NO: 8273397 - DNA, 22 bp, Homo sapiens
aagataatattcattaactaga

SEQ ID NO: 8273398 - DNA, 22 bp, Homo sapiens
aagataatattcattaactaga

SEQ ID NO: 8273399 - DNA, 22 bp, Homo sapiens
acacagagcaaatcatgacaga

SEQ ID NO: 8273400 - DNA, 22 bp, Homo sapiens
acacacatgcctttcctaagta

SEQ ID NO: 8273401 - DNA, 20 bp, Homo sapiens
acacagactcagcttggatg

SEQ ID NO: 8273402 - DNA, 17 bp, Homo sapiens
acacagacaggcagaca

SEQ ID NO: 8273403 - DNA, 20 bp, Homo sapiens
acacagactcagcttggatg

SEQ ID NO: 8273404 - DNA, 22 bp, Homo sapiens
acaaggcttcatattcttttta

SEQ ID NO: 8273405 - DNA, 22 bp, Homo sapiens
acaaggcttcacacagtatgaa

SEQ ID NO: 8273406 - DNA, 22 bp, Homo sapiens
acaaggcttatagttgcttttt

SEQ ID NO: 8273407 - DNA, 22 bp, Homo sapiens
acaaattgttgcttcatgaatg

SEQ ID NO: 8273408 - DNA, 22 bp, Homo sapiens
acaaatttcataggcaaatttt

SEQ ID NO: 8273409 - DNA, 22 bp, Homo sapiens
acaatgtagttgtcatgagaca

SEQ ID NO: 8273410 - DNA, 20 bp, Homo sapiens
acaatatgtagatgaatagc

SEQ ID NO: 8273411 - DNA, 22 bp, Homo sapiens
acaatatcagctcaagccctgt

SEQ ID NO: 8273412 - DNA, 22 bp, Homo sapiens
acaaagctagagaagagaattg

SEQ ID NO: 8273413 - DNA, 22 bp, Homo sapiens
acaaaagcactgcagagtaagc

SEQ ID NO: 8273414 - DNA, 22 bp, Homo sapiens
acaaaagaataagatgagtcat

SEQ ID NO: 8273415 - DNA, 22 bp, Homo sapiens
acaaaaccagaaaatctctacc

SEQ ID NO: 8273416 - DNA, 22 bp, Homo sapiens
acaaaactcttgctgggatttt

SEQ ID NO: 8273417 - DNA, 22 bp, Homo sapiens
acaaaagcactgcagagtaagc

SEQ ID NO: 8273418 - DNA, 22 bp, Homo sapiens
aagaatatctgttttatttagg

SEQ ID NO: 8273419 - DNA, 22 bp, Homo sapiens
aagaatatctgttttatttagg

SEQ ID NO: 8273420 - DNA, 22 bp, Homo sapiens
aagaatatagattttttgaagt

SEQ ID NO: 8273421 - DNA, 22 bp, Homo sapiens
aagaatcatctgaactttgagg

SEQ ID NO: 8273422 - DNA, 22 bp, Homo sapiens
aagaagaattattccctaatca

SEQ ID NO: 8273423 - DNA, 22 bp, Homo sapiens
aagaagaagtgttatttttaga

SEQ ID NO: 8273424 - DNA, 22 bp, Homo sapiens
aagaacctatatgctgatgaat

SEQ ID NO: 8273425 - DNA, 22 bp, Homo sapiens
aagaacattgatattgtctatg

SEQ ID NO: 8273426 - DNA, 22 bp, Homo sapiens
aagaacaggttctagaaccatt

SEQ ID NO: 8273427 - DNA, 22 bp, Homo sapiens
aatgtacaagggttccagtttt

SEQ ID NO: 8273428 - DNA, 22 bp, Homo sapiens
aatgtacaagggttccagtttt

SEQ ID NO: 8273429 - DNA, 22 bp, Homo sapiens
aagaacaggttctagaaccatt

SEQ ID NO: 8273430 - DNA, 22 bp, Homo sapiens
acagacatttaataaatgctga

SEQ ID NO: 8273431 - DNA, 23 bp, Homo sapiens
acagacaacactgatgagagaaa

SEQ ID NO: 8273432 - DNA, 22 bp, Homo sapiens
acagactggagtgagagaaata

SEQ ID NO: 8273433 - DNA, 23 bp, Homo sapiens
acagagatcttgacttgtatgga

SEQ ID NO: 8273434 - DNA, 22 bp, Homo sapiens
acagagatgaattagacagggt

SEQ ID NO: 8273435 - DNA, 22 bp, Homo sapiens
acagagatgaataatacaggtg

SEQ ID NO: 8273436 - DNA, 22 bp, Homo sapiens
acagagatgagtcaacacagct

SEQ ID NO: 8273437 - DNA, 22 bp, Homo sapiens
acagagatggcacagagaaggt

SEQ ID NO: 8273438 - DNA, 22 bp, Homo sapiens
acagagatgcaagtgtgtattt

SEQ ID NO: 8273439 - DNA, 22 bp, Homo sapiens
acagagatggcttttcagaggc

SEQ ID NO: 8273440 - DNA, 22 bp, Homo sapiens
acagagatgggaacattcaggt

SEQ ID NO: 8273441 - DNA, 22 bp, Homo sapiens
acagagatgtcagattggcagc

SEQ ID NO: 8273442 - DNA, 22 bp, Homo sapiens
acacttgtaatggagaacacta

SEQ ID NO: 8273443 - DNA, 22 bp, Homo sapiens
acacttgtgttgaaagctgtta

SEQ ID NO: 8273444 - DNA, 22 bp, Homo sapiens
acacttctcccatctcctgttg

SEQ ID NO: 8273445 - DNA, 22 bp, Homo sapiens
acacttctctttgaagaacaat

SEQ ID NO: 8273446 - DNA, 20 bp, Homo sapiens
acacatatagcagcataaac

SEQ ID NO: 8273447 - DNA, 17 bp, Homo sapiens
acacatacatgggccat

SEQ ID NO: 8273448 - DNA, 22 bp, Homo sapiens
acacatacatggggaagatgag

SEQ ID NO: 8273449 - DNA, 22 bp, Homo sapiens
acacatataccactgtaaatga

SEQ ID NO: 8273450 - DNA, 20 bp, Homo sapiens
acacatatagcagcataaac

SEQ ID NO: 8273451 - DNA, 20 bp, Homo sapiens
acacatatagcagcataaac

SEQ ID NO: 8273452 - DNA, 22 bp, Homo sapiens
aagatacacgttgtattgaata

SEQ ID NO: 8273453 - DNA, 22 bp, Homo sapiens
aagatacatatttgttctagtg

SEQ ID NO: 8273454 - DNA, 22 bp, Homo sapiens
aagcagttactatttactatta

SEQ ID NO: 8273455 - DNA, 22 bp, Homo sapiens
aagcataaaacgttacaacatg

SEQ ID NO: 8273456 - DNA, 22 bp, Homo sapiens
acagcaggaagctggagggaaa

SEQ ID NO: 8273457 - DNA, 22 bp, Homo sapiens
acagcaggtagctttgtgcctc

SEQ ID NO: 8273458 - DNA, 22 bp, Homo sapiens
acagcaggggtggaataaacgt

SEQ ID NO: 8273459 - DNA, 22 bp, Homo sapiens
acagcagggtcacattccctct

SEQ ID NO: 8273460 - DNA, 22 bp, Homo sapiens
acagcagggggagctgttggac

SEQ ID NO: 8273461 - DNA, 21 bp, Homo sapiens
acagcagggctggcatgacag

SEQ ID NO: 8273462 - DNA, 21 bp, Homo sapiens
acagcagggctggcatgacag

SEQ ID NO: 8273463 - DNA, 22 bp, Homo sapiens
aagcagggtttttccaccgcag

SEQ ID NO: 8273464 - DNA, 22 bp, Homo sapiens
aagcagggtgtcttgacccatg

SEQ ID NO: 8273465 - DNA, 22 bp, Homo sapiens
aagcagggtttttccaccgcag

SEQ ID NO: 8273466 - DNA, 22 bp, Homo sapiens
aagcagggtcttcctcagttgg

SEQ ID NO: 8273467 - DNA, 22 bp, Homo sapiens
aagcagggctttaagcggtttt

SEQ ID NO: 8273468 - DNA, 18 bp, Homo sapiens
aagcagggtccattgtgc

SEQ ID NO: 8273469 - DNA, 18 bp, Homo sapiens
aagcagggtccattgtgc

SEQ ID NO: 8273470 - DNA, 22 bp, Homo sapiens
aagcagggtcttcctcagttgg

SEQ ID NO: 8273471 - DNA, 22 bp, Homo sapiens
aagcagggctagaccaagaaga

SEQ ID NO: 8273472 - DNA, 22 bp, Homo sapiens
aagcagggctccctggggactc

SEQ ID NO: 8273473 - DNA, 21 bp, Homo sapiens
aagcagggactgcccaggtcc

SEQ ID NO: 8273474 - DNA, 22 bp, Homo sapiens
aagcagggagaaatttttcttc

SEQ ID NO: 8273475 - DNA, 23 bp, Homo sapiens
aagcagggagattcttagctgag

SEQ ID NO: 8273476 - DNA, 22 bp, Homo sapiens
aagcaggcttggtgtggccgct

SEQ ID NO: 8273477 - DNA, 22 bp, Homo sapiens
acagagcacagtcgggatggga

SEQ ID NO: 8273478 - DNA, 22 bp, Homo sapiens
aagcaggaaggagcccagggca

SEQ ID NO: 8273479 - DNA, 22 bp, Homo sapiens
aagcaggctagattgaagggct

SEQ ID NO: 8273480 - DNA, 21 bp, Homo sapiens
aagcaggacatatgatgccct

SEQ ID NO: 8273481 - DNA, 21 bp, Homo sapiens
acagctggaaattacttgccc

SEQ ID NO: 8273482 - DNA, 19 bp, Homo sapiens
aagcccggctgctgagagg

SEQ ID NO: 8273483 - DNA, 22 bp, Homo sapiens
aagcccctcgggtgcgcacgcg

SEQ ID NO: 8273484 - DNA, 22 bp, Homo sapiens
acagccagcttgatgggatccg

SEQ ID NO: 8273485 - DNA, 22 bp, Homo sapiens
acagccaggaattctggagaag

SEQ ID NO: 8273486 - DNA, 19 bp, Homo sapiens
acagcaggtgtggggataa

SEQ ID NO: 8273487 - DNA, 22 bp, Homo sapiens
acagcaggttacagtggcacag

SEQ ID NO: 8273488 - DNA, 22 bp, Homo sapiens
acagccagggacatacaatggt

SEQ ID NO: 8273489 - DNA, 22 bp, Homo sapiens
acagccaggcccagcacgcagg

SEQ ID NO: 8273490 - DNA, 23 bp, Homo sapiens
acagccaggatgggagcagaagc

SEQ ID NO: 8273491 - DNA, 23 bp, Homo sapiens
tccaggcatgagctctggatgga

SEQ ID NO: 8273492 - DNA, 22 bp, Homo sapiens
tccaggcatcccccaggacaga

SEQ ID NO: 8273493 - DNA, 22 bp, Homo sapiens
tccaggccacgacctcctggat

SEQ ID NO: 8273494 - DNA, 22 bp, Homo sapiens
tccaggccacatggatggcgat

SEQ ID NO: 8273495 - DNA, 22 bp, Homo sapiens
tccaggagggttttctgccttc

SEQ ID NO: 8273496 - DNA, 21 bp, Homo sapiens
tccaggagtggctgggcaggg

SEQ ID NO: 8273497 - DNA, 22 bp, Homo sapiens
tccaggagtttgacctgtgggc

SEQ ID NO: 8273498 - DNA, 20 bp, Homo sapiens
tccaggcagctcagagtgtc

SEQ ID NO: 8273499 - DNA, 22 bp, Homo sapiens
tcccacacagcccgctcaccgg

SEQ ID NO: 8273500 - DNA, 22 bp, Homo sapiens
tcccaagtgtcttggaccaggg

SEQ ID NO: 8273501 - DNA, 22 bp, Homo sapiens
tcccacagagtggctcacctag

SEQ ID NO: 8273502 - DNA, 22 bp, Homo sapiens
tcccaaggataagagagtctga

SEQ ID NO: 8273503 - DNA, 22 bp, Homo sapiens
tcccaaggccaggcatctagaa

SEQ ID NO: 8273504 - DNA, 22 bp, Homo sapiens
tcccaaggcctctagttgatta

SEQ ID NO: 8273505 - DNA, 22 bp, Homo sapiens
tcccaaggcctctagttgatta

SEQ ID NO: 8273506 - DNA, 22 bp, Homo sapiens
tcccaagccctggatgcctcag

SEQ ID NO: 8273507 - DNA, 20 bp, Homo sapiens
tccatgcaaatacagagttt

SEQ ID NO: 8273508 - DNA, 20 bp, Homo sapiens
tccatctggtataagctgat

SEQ ID NO: 8273509 - DNA, 20 bp, Homo sapiens
tccatcttgggcagaagcag

SEQ ID NO: 8273510 - DNA, 22 bp, Homo sapiens
tccagggcctgaggttgaagtg

SEQ ID NO: 8273511 - DNA, 22 bp, Homo sapiens
tccagggccttacctcttcaga

SEQ ID NO: 8273512 - DNA, 20 bp, Homo sapiens
tccagggctagggagctcat

SEQ ID NO: 8273513 - DNA, 22 bp, Homo sapiens
tccagggctccccaacatccag

SEQ ID NO: 8273514 - DNA, 22 bp, Homo sapiens
tccatcaccatttctgcgagct

SEQ ID NO: 8273515 - DNA, 22 bp, Homo sapiens
tccagggccagtccttgtctgt

SEQ ID NO: 8273516 - DNA, 22 bp, Homo sapiens
tccagggccacagaggatgcta

SEQ ID NO: 8273517 - DNA, 20 bp, Homo sapiens
tccagggccctggctcctct

SEQ ID NO: 8273518 - DNA, 19 bp, Homo sapiens
tccagggcaggaacatgta

SEQ ID NO: 8273519 - DNA, 22 bp, Homo sapiens
tccagcttttattggatgagga

SEQ ID NO: 8273520 - DNA, 22 bp, Homo sapiens
tccagcttttaccaaatgagca

SEQ ID NO: 8273521 - DNA, 22 bp, Homo sapiens
tccaggaggcctcatttcctgt

SEQ ID NO: 8273522 - DNA, 22 bp, Homo sapiens
tccagcttcttgacttggtggt

SEQ ID NO: 8273523 - DNA, 22 bp, Homo sapiens
tccagctgtgctccaggaggtg

SEQ ID NO: 8273524 - DNA, 20 bp, Homo sapiens
tccagctgttgagatctgag

SEQ ID NO: 8273525 - DNA, 21 bp, Homo sapiens
tccagctctcatagtgttcca

SEQ ID NO: 8273526 - DNA, 22 bp, Homo sapiens
tccagctctaacatgctgggcc

SEQ ID NO: 8273527 - DNA, 22 bp, Homo sapiens
tccagctcctgagttcactgct

SEQ ID NO: 8273528 - DNA, 22 bp, Homo sapiens
tccagctggggcagtggctggg

SEQ ID NO: 8273529 - DNA, 22 bp, Homo sapiens
tccagctctggcttggctagct

SEQ ID NO: 8273530 - DNA, 21 bp, Homo sapiens
tccagctcttatgttcatgaa

SEQ ID NO: 8273531 - DNA, 20 bp, Homo sapiens
tccagctgtctttcagagac

SEQ ID NO: 8273532 - DNA, 22 bp, Homo sapiens
tccagctcccactctcactgct

SEQ ID NO: 8273533 - DNA, 22 bp, Homo sapiens
tccagctcatctgtctccatta

SEQ ID NO: 8273534 - DNA, 22 bp, Homo sapiens
tccagctcctctacccgatgcg

SEQ ID NO: 8273535 - DNA, 20 bp, Homo sapiens
tccagctccgtgttcttcct

SEQ ID NO: 8273536 - DNA, 18 bp, Homo sapiens
tccagctcacagatgggc

SEQ ID NO: 8273537 - DNA, 22 bp, Homo sapiens
tccagctcagatgcagggatca

SEQ ID NO: 8273538 - DNA, 22 bp, Homo sapiens
tccagctcaaattcagcttcca

SEQ ID NO: 8273539 - DNA, 22 bp, Homo sapiens
tccagctcaaagtgctcctgtc

SEQ ID NO: 8273540 - DNA, 22 bp, Homo sapiens
tccagcaggttggtcaggtgca

SEQ ID NO: 8273541 - DNA, 22 bp, Homo sapiens
tccagcagtaaggaaagtacat

SEQ ID NO: 8273542 - DNA, 20 bp, Homo sapiens
tccagcagtatgctatactt

SEQ ID NO: 8273543 - DNA, 22 bp, Homo sapiens
tccagcagtccatgtgagacac

SEQ ID NO: 8273544 - DNA, 16 bp, Homo sapiens
tccagcagtctctgta

SEQ ID NO: 8273545 - DNA, 22 bp, Homo sapiens
tccagcagtgctcaggactcac

SEQ ID NO: 8273546 - DNA, 22 bp, Homo sapiens
tccagcagtgctctagagcgtg

SEQ ID NO: 8273547 - DNA, 19 bp, Homo sapiens
tccagcagtgcttgaaatc

SEQ ID NO: 8273548 - DNA, 22 bp, Homo sapiens
tccagccaatcagagctgaggc

SEQ ID NO: 8273549 - DNA, 22 bp, Homo sapiens
tccagccaatcagagctgaggc

SEQ ID NO: 8273550 - DNA, 23 bp, Homo sapiens
tccagccaaatctggctgacagt

SEQ ID NO: 8273551 - DNA, 17 bp, Homo sapiens
tccagagcacagagctc

SEQ ID NO: 8273552 - DNA, 18 bp, Homo sapiens
tccagagcagtctttggc

SEQ ID NO: 8273553 - DNA, 22 bp, Homo sapiens
tccagagccccaattcacctct

SEQ ID NO: 8273554 - DNA, 22 bp, Homo sapiens
tccagagccccagtctagtggg

SEQ ID NO: 8273555 - DNA, 22 bp, Homo sapiens
tccagagcaggtgtctacacag

SEQ ID NO: 8273556 - DNA, 22 bp, Homo sapiens
tccagagctaattcagcagctg

SEQ ID NO: 8273557 - DNA, 18 bp, Homo sapiens
tccagagctactgtggtg

SEQ ID NO: 8273558 - DNA, 22 bp, Homo sapiens
tccagagctacttgctcaactt

SEQ ID NO: 8273559 - DNA, 22 bp, Homo sapiens
tccagagcctgcgcactggctg

SEQ ID NO: 8273560 - DNA, 22 bp, Homo sapiens
tccagagccttcgataagaaga

SEQ ID NO: 8273561 - DNA, 22 bp, Homo sapiens
tccagcaggtgtttgccaactt

SEQ ID NO: 8273562 - DNA, 18 bp, Homo sapiens
tccagcaggtctgaggtg

SEQ ID NO: 8273563 - DNA, 22 bp, Homo sapiens
tccagcaggtccgagacaagtt

SEQ ID NO: 8273564 - DNA, 22 bp, Homo sapiens
tccagcagccacacctctggac

SEQ ID NO: 8273565 - DNA, 22 bp, Homo sapiens
tccagcagcctgacttccctct

SEQ ID NO: 8273566 - DNA, 22 bp, Homo sapiens
tccagcagggaattagtagtct

SEQ ID NO: 8273567 - DNA, 22 bp, Homo sapiens
tccagcagcccgaaggcccatc

SEQ ID NO: 8273568 - DNA, 23 bp, Homo sapiens
tccagcagagccttccaggaggg

SEQ ID NO: 8273569 - DNA, 22 bp, Homo sapiens
tccagcagactcatcagcaagg

SEQ ID NO: 8273570 - DNA, 22 bp, Homo sapiens
tccagcagaccatcaaggctca

SEQ ID NO: 8273571 - DNA, 23 bp, Homo sapiens
tccagcagccaagaagggtagaa

SEQ ID NO: 8273572 - DNA, 22 bp, Homo sapiens
tccagcagaggttgataatacc

SEQ ID NO: 8273573 - DNA, 18 bp, Homo sapiens
tccagcagcatagtttcc

SEQ ID NO: 8273574 - DNA, 22 bp, Homo sapiens
tccagcagagtctctgaggggg

SEQ ID NO: 8273575 - DNA, 22 bp, Homo sapiens
tccagagctgtcctactgtgag

SEQ ID NO: 8273576 - DNA, 22 bp, Homo sapiens
tccagagctgtatgattttttt

SEQ ID NO: 8273577 - DNA, 18 bp, Homo sapiens
tccagagctggtgcttct

SEQ ID NO: 8273578 - DNA, 18 bp, Homo sapiens
tccagagctggtgcttct

SEQ ID NO: 8273579 - DNA, 22 bp, Homo sapiens
tccagagctgggtctgtgctca

SEQ ID NO: 8273580 - DNA, 22 bp, Homo sapiens
tccagagctgagcagtcattct

SEQ ID NO: 8273581 - DNA, 22 bp, Homo sapiens
tccagagctctgggcatagctg

SEQ ID NO: 8273582 - DNA, 23 bp, Homo sapiens
tccagagctcatgctctcaacca

SEQ ID NO: 8273583 - DNA, 22 bp, Homo sapiens
tcccacagcttcgtgcttcccc

SEQ ID NO: 8273584 - DNA, 22 bp, Homo sapiens
tcccacagtctcacaatgcata

SEQ ID NO: 8273585 - DNA, 22 bp, Homo sapiens
tcccacaggtggagcttgcagt

SEQ ID NO: 8273586 - DNA, 22 bp, Homo sapiens
tcccatttcacaacaaaactgg

SEQ ID NO: 8273587 - DNA, 22 bp, Homo sapiens
tcccatttattaattagtttgc

SEQ ID NO: 8273588 - DNA, 22 bp, Homo sapiens
tcccatttatctagatgtcaga

SEQ ID NO: 8273589 - DNA, 22 bp, Homo sapiens
tcccatcactagcatctgcacc

SEQ ID NO: 8273590 - DNA, 22 bp, Homo sapiens
tcccatcactctggaatgggta

SEQ ID NO: 8273591 - DNA, 22 bp, Homo sapiens
tcccatcaatgtctgcagaaga

SEQ ID NO: 8273592 - DNA, 22 bp, Homo sapiens
tcccatcaatgtctgcagaaga

SEQ ID NO: 8273593 - DNA, 22 bp, Homo sapiens
tcccatatatgcaaaaatgtaa

SEQ ID NO: 8273594 - DNA, 22 bp, Homo sapiens
tccccaaagctttgtggtcagg

SEQ ID NO: 8273595 - DNA, 22 bp, Homo sapiens
tcccatttcttgcatccttgct

SEQ ID NO: 8273596 - DNA, 22 bp, Homo sapiens
tcccatttcatgctggctgtgg

SEQ ID NO: 8273597 - DNA, 22 bp, Homo sapiens
tcccattttggatgcggattgg

SEQ ID NO: 8273598 - DNA, 22 bp, Homo sapiens
tccccaggaaattctgattctt

SEQ ID NO: 8273599 - DNA, 22 bp, Homo sapiens
tccccagggtccctgcttccat

SEQ ID NO: 8273600 - DNA, 22 bp, Homo sapiens
tccccaggggcatctctctgct

SEQ ID NO: 8273601 - DNA, 22 bp, Homo sapiens
tcacaaaagcttttgaatttgg

SEQ ID NO: 8273602 - DNA, 22 bp, Homo sapiens
tcacaaacaatgctttggaatt

SEQ ID NO: 8273603 - DNA, 22 bp, Homo sapiens
tcacaaaaggccatgtggcttc

SEQ ID NO: 8273604 - DNA, 22 bp, Homo sapiens
tcaattttatgaaacaaagtga

SEQ ID NO: 8273605 - DNA, 22 bp, Homo sapiens
tcacaaaagcttttgaatttgg

SEQ ID NO: 8273606 - DNA, 22 bp, Homo sapiens
tcacaagggccctgcagtccac

SEQ ID NO: 8273607 - DNA, 19 bp, Homo sapiens
tcacaaggcctcttagtct

SEQ ID NO: 8273608 - DNA, 22 bp, Homo sapiens
tcacaagtttctcttgcatgcg

SEQ ID NO: 8273609 - DNA, 21 bp, Homo sapiens
tcacaagtactcatctctgcc

SEQ ID NO: 8273610 - DNA, 22 bp, Homo sapiens
tcacaaggttcactataaattg

SEQ ID NO: 8273611 - DNA, 22 bp, Homo sapiens
tcacagaagagatattgacaga

SEQ ID NO: 8273612 - DNA, 22 bp, Homo sapiens
tcacagctccagactgcaactc

SEQ ID NO: 8273613 - DNA, 22 bp, Homo sapiens
tcacaggctctccaccatgagg

SEQ ID NO: 8273614 - DNA, 22 bp, Homo sapiens
tcacaggctctagggattaaga

SEQ ID NO: 8273615 - DNA, 22 bp, Homo sapiens
tcaagtttaattgagatgttta

SEQ ID NO: 8273616 - DNA, 22 bp, Homo sapiens
tcaagtttctctcagattatgg

SEQ ID NO: 8273617 - DNA, 22 bp, Homo sapiens
tcaagtttctctcagattatgg

SEQ ID NO: 8273618 - DNA, 22 bp, Homo sapiens
tcaatttaaggtactactttgg

SEQ ID NO: 8273619 - DNA, 21 bp, Homo sapiens
tcaatacaggtgcatgtgtct

SEQ ID NO: 8273620 - DNA, 22 bp, Homo sapiens
tcaagtccaggaaagcacagtc

SEQ ID NO: 8273621 - DNA, 22 bp, Homo sapiens
tcaagtcatttgactgtgtgtt

SEQ ID NO: 8273622 - DNA, 22 bp, Homo sapiens
tcaaggtgctgtgctgtgctag

SEQ ID NO: 8273623 - DNA, 22 bp, Homo sapiens
tcaaggtgtgttatgtgtaata

SEQ ID NO: 8273624 - DNA, 22 bp, Homo sapiens
tcaaggtgatggtcttgttttc

SEQ ID NO: 8273625 - DNA, 22 bp, Homo sapiens
tcaaggctaaactttcagagta

SEQ ID NO: 8273626 - DNA, 22 bp, Homo sapiens
tcaaggctattaattctgtgag

SEQ ID NO: 8273627 - DNA, 19 bp, Homo sapiens
tcaaggctccctgagggat

SEQ ID NO: 8273628 - DNA, 22 bp, Homo sapiens
tcaaggcttttggttttccata

SEQ ID NO: 8273629 - DNA, 19 bp, Homo sapiens
tcaaggctgcctctccttt

SEQ ID NO: 8273630 - DNA, 22 bp, Homo sapiens
tcaagggcaaatgctacctata

SEQ ID NO: 8273631 - DNA, 22 bp, Homo sapiens
tcaaggaggtgcttggcttcac

SEQ ID NO: 8273632 - DNA, 22 bp, Homo sapiens
tcaagatgaaagatgtagccat

SEQ ID NO: 8273633 - DNA, 22 bp, Homo sapiens
tcaagagcatgtatctccctaa

SEQ ID NO: 8273634 - DNA, 22 bp, Homo sapiens
tcaagagacaggacgtgtttca

SEQ ID NO: 8273635 - DNA, 22 bp, Homo sapiens
tcaagagagtgctgcttggggt

SEQ ID NO: 8273636 - DNA, 22 bp, Homo sapiens
tatttctgtttatttgtacatc

SEQ ID NO: 8273637 - DNA, 22 bp, Homo sapiens
tcacattttcatattctctgag

SEQ ID NO: 8273638 - DNA, 22 bp, Homo sapiens
tcacagtataacctcatatagg

SEQ ID NO: 8273639 - DNA, 22 bp, Homo sapiens
tcacagtagccatttcatgagt

SEQ ID NO: 8273640 - DNA, 22 bp, Homo sapiens
tcaccagatctctctgtaatgg

SEQ ID NO: 8273641 - DNA, 23 bp, Homo sapiens
tcaccagaaggggtcaataaaga

SEQ ID NO: 8273642 - DNA, 22 bp, Homo sapiens
tcaccactgaggccacgtggct

SEQ ID NO: 8273643 - DNA, 22 bp, Homo sapiens
tcactctgagaggtcactggaa

SEQ ID NO: 8273644 - DNA, 22 bp, Homo sapiens
tcacccaggatattgaagtcag

SEQ ID NO: 8273645 - DNA, 22 bp, Homo sapiens
tcacccagcgggcgcacactcg

SEQ ID NO: 8273646 - DNA, 22 bp, Homo sapiens
tcacccaggctggagtgcagtg

SEQ ID NO: 8273647 - DNA, 22 bp, Homo sapiens
tcacccaggctggagtgtagtg

SEQ ID NO: 8273648 - DNA, 22 bp, Homo sapiens
tcactacaacctccgcctcctg

SEQ ID NO: 8273649 - DNA, 22 bp, Homo sapiens
tcacccaggctggtatgcagtg

SEQ ID NO: 8273650 - DNA, 22 bp, Homo sapiens
tcactgaaccagggatctctag

SEQ ID NO: 8273651 - DNA, 22 bp, Homo sapiens
tcactctgtgtttgaactcaag

SEQ ID NO: 8273652 - DNA, 22 bp, Homo sapiens
tcactgacgtggggctacttga

SEQ ID NO: 8273653 - DNA, 22 bp, Homo sapiens
tcactgatgcttatgaaagtgt

SEQ ID NO: 8273654 - DNA, 19 bp, Homo sapiens
tcacttctgttagcatgga

SEQ ID NO: 8273655 - DNA, 22 bp, Homo sapiens
tcactgtgtcctttctgcgtag

SEQ ID NO: 8273656 - DNA, 22 bp, Homo sapiens
tcacttcttcccttgcacatat

SEQ ID NO: 8273657 - DNA, 22 bp, Homo sapiens
tcactttacctcattcaggcag

SEQ ID NO: 8273658 - DNA, 22 bp, Homo sapiens
tcactttgaattccttgatttt

SEQ ID NO: 8273659 - DNA, 22 bp, Homo sapiens
tcagacagattttgacacttgc

SEQ ID NO: 8273660 - DNA, 22 bp, Homo sapiens
tcagacagggcttctcaaactt

SEQ ID NO: 8273661 - DNA, 22 bp, Homo sapiens
tcagacagggagtcagaaaata

SEQ ID NO: 8273662 - DNA, 22 bp, Homo sapiens
tcagagaagacatcattgtgaa

SEQ ID NO: 8273663 - DNA, 22 bp, Homo sapiens
tcagacagtttgcagtgtgcct

SEQ ID NO: 8273664 - DNA, 23 bp, Homo sapiens
tcagagaactcgggcagatgacc

SEQ ID NO: 8273665 - DNA, 22 bp, Homo sapiens
tcagagctaaggggagagcaaa

SEQ ID NO: 8273666 - DNA, 22 bp, Homo sapiens
tcagcaagtggaccatcctggg

SEQ ID NO: 8273667 - DNA, 22 bp, Homo sapiens
tcagcacaggtcttgcaaaaca

SEQ ID NO: 8273668 - DNA, 22 bp, Homo sapiens
tcagcaccagttatcctcaggg

SEQ ID NO: 8273669 - DNA, 22 bp, Homo sapiens
tcagcaagtattttctgaatgc

SEQ ID NO: 8273670 - DNA, 16 bp, Homo sapiens
tcagctatagggattg

SEQ ID NO: 8273671 - DNA, 22 bp, Homo sapiens
tcagctatctgagaataaccct

SEQ ID NO: 8273672 - DNA, 22 bp, Homo sapiens
tcagctattgagggtggtgagt

SEQ ID NO: 8273673 - DNA, 22 bp, Homo sapiens
tcagctatgttttggaacaggg

SEQ ID NO: 8273674 - DNA, 22 bp, Homo sapiens
tcagctatgttaatagccttct

SEQ ID NO: 8273675 - DNA, 22 bp, Homo sapiens
tcagctatgaggtggtggttct

SEQ ID NO: 8273676 - DNA, 15 bp, Homo sapiens
tcagctatcatttta

SEQ ID NO: 8273677 - DNA, 22 bp, Homo sapiens
tcagctctacctgggagctgtc

SEQ ID NO: 8273678 - DNA, 21 bp, Homo sapiens
tcagcagcttttgcagtccct

SEQ ID NO: 8273679 - DNA, 22 bp, Homo sapiens
tcagcaggcacaccaaaaactg

SEQ ID NO: 8273680 - DNA, 22 bp, Homo sapiens
tcagcagaaaggcactagatga

SEQ ID NO: 8273681 - DNA, 22 bp, Homo sapiens
tcagcaggcacggacaggctgc

SEQ ID NO: 8273682 - DNA, 22 bp, Homo sapiens
tcagcaggcacggacaggctgc

SEQ ID NO: 8273683 - DNA, 22 bp, Homo sapiens
tcagcaggcaccggaagtgttt

SEQ ID NO: 8273684 - DNA, 21 bp, Homo sapiens
tcagcaggcaccagaaggctg

SEQ ID NO: 8273685 - DNA, 21 bp, Homo sapiens
tcagcaggcaccagaaggctg

SEQ ID NO: 8273686 - DNA, 22 bp, Homo sapiens
tcaggaaggcttcacacgagtg

SEQ ID NO: 8273687 - DNA, 22 bp, Homo sapiens
tcaggaacatttaaccacaggg

SEQ ID NO: 8273688 - DNA, 22 bp, Homo sapiens
tcaggcctgcaggcttcctgga

SEQ ID NO: 8273689 - DNA, 22 bp, Homo sapiens
tcagggaaattcaagggagatt

SEQ ID NO: 8273690 - DNA, 22 bp, Homo sapiens
tcaggctggaatgcagtggggc

SEQ ID NO: 8273691 - DNA, 20 bp, Homo sapiens
tcatggaatctcactctagt

SEQ ID NO: 8273692 - DNA, 22 bp, Homo sapiens
tcattcaggttgggcaagtgtc

SEQ ID NO: 8273693 - DNA, 22 bp, Homo sapiens
tcattatcttggctcatttctg

SEQ ID NO: 8273694 - DNA, 22 bp, Homo sapiens
tcatgctgaggggattttaaat

SEQ ID NO: 8273695 - DNA, 22 bp, Homo sapiens
tcatgctggcccagaatggagg

SEQ ID NO: 8273696 - DNA, 21 bp, Homo sapiens
tcatatttctcttgctattgt

SEQ ID NO: 8273697 - DNA, 21 bp, Homo sapiens
tcatatttctcttgctattgt

SEQ ID NO: 8273698 - DNA, 22 bp, Homo sapiens
tcatatatttagttgtgcaaca

SEQ ID NO: 8273699 - DNA, 22 bp, Homo sapiens
tcatataagtttaaaactatct

SEQ ID NO: 8273700 - DNA, 22 bp, Homo sapiens
tcagggaatgatgcacacagtt

SEQ ID NO: 8273701 - DNA, 22 bp, Homo sapiens
tcagtgtgttactttctcctat

SEQ ID NO: 8273702 - DNA, 19 bp, Homo sapiens
tcagtgtccctgttaatat

SEQ ID NO: 8273703 - DNA, 22 bp, Homo sapiens
tcagtctttaaaagctcaggaa

SEQ ID NO: 8273704 - DNA, 22 bp, Homo sapiens
tcagtcttttgccctgaggagt

SEQ ID NO: 8273705 - DNA, 22 bp, Homo sapiens
tcagtgactgggtattaaatca

SEQ ID NO: 8273706 - DNA, 22 bp, Homo sapiens
tcagtgacaactatgaatattt

SEQ ID NO: 8273707 - DNA, 22 bp, Homo sapiens
gtgctccctccttcctcaagga

SEQ ID NO: 8273708 - DNA, 22 bp, Homo sapiens
gtgctccaggtcgctcagagag

SEQ ID NO: 8273709 - DNA, 22 bp, Homo sapiens
gtgctccaacattagtgtgctt

SEQ ID NO: 8273710 - DNA, 22 bp, Homo sapiens
gttaatctgctttcaaaatgca

SEQ ID NO: 8273711 - DNA, 18 bp, Homo sapiens
gtgtggctgagatgaggc

SEQ ID NO: 8273712 - DNA, 22 bp, Homo sapiens
gtgtggctgaaatcaaggcagg

SEQ ID NO: 8273713 - DNA, 22 bp, Homo sapiens
gtgtggctacctcagaggagca

SEQ ID NO: 8273714 - DNA, 22 bp, Homo sapiens
gtgtggcttgggtgaggcgcct

SEQ ID NO: 8273715 - DNA, 22 bp, Homo sapiens
gttgctctgggaaatggattca

SEQ ID NO: 8273716 - DNA, 22 bp, Homo sapiens
gttgctcaggcaggagtacagt

SEQ ID NO: 8273717 - DNA, 22 bp, Homo sapiens
gttgcacagttcctcaagcagg

SEQ ID NO: 8273718 - DNA, 22 bp, Homo sapiens
gttgatatttgcagagtgtacc

SEQ ID NO: 8273719 - DNA, 22 bp, Homo sapiens
gttggtgtctgtcttgttcatt

SEQ ID NO: 8273720 - DNA, 22 bp, Homo sapiens
gttggtggatgtgggcagagca

SEQ ID NO: 8273721 - DNA, 22 bp, Homo sapiens
gttcagtcacgtgcccaagttc

SEQ ID NO: 8273722 - DNA, 22 bp, Homo sapiens
gttgagtgggttaggatgctga

SEQ ID NO: 8273723 - DNA, 22 bp, Homo sapiens
gttgaggtgatgccagccctgc

SEQ ID NO: 8273724 - DNA, 21 bp, Homo sapiens
gttcaatagctctttgaatgc

SEQ ID NO: 8273725 - DNA, 21 bp, Homo sapiens
gttcaagtgatcctcctgtct

SEQ ID NO: 8273726 - DNA, 22 bp, Homo sapiens
gttcaagtgtcaagtgttggaa

SEQ ID NO: 8273727 - DNA, 22 bp, Homo sapiens
gttcaagttcatatctcttaac

SEQ ID NO: 8273728 - DNA, 22 bp, Homo sapiens
gttcagatttgactggtttctc

SEQ ID NO: 8273729 - DNA, 22 bp, Homo sapiens
gttcagcttacaaaatacacct

SEQ ID NO: 8273730 - DNA, 22 bp, Homo sapiens
gttcagctcaagcaataatttt

SEQ ID NO: 8273731 - DNA, 22 bp, Homo sapiens
gttcagctaggaatggagatgc

SEQ ID NO: 8273732 - DNA, 22 bp, Homo sapiens
taaaatttgtccctgagtgttg

SEQ ID NO: 8273733 - DNA, 22 bp, Homo sapiens
taaaatggtaactttcatttgc

SEQ ID NO: 8273734 - DNA, 22 bp, Homo sapiens
gttttctttgaatgcttctaga

SEQ ID NO: 8273735 - DNA, 22 bp, Homo sapiens
gttttgttgctgcagagctcaa

SEQ ID NO: 8273736 - DNA, 22 bp, Homo sapiens
gtttccagctcttagcaaaggc

SEQ ID NO: 8273737 - DNA, 23 bp, Homo sapiens
taaatttcttgattcttatgtga

SEQ ID NO: 8273738 - DNA, 22 bp, Homo sapiens
taaattgaaaatctacagaaca

SEQ ID NO: 8273739 - DNA, 22 bp, Homo sapiens
taaattctgatcaagttccttc

SEQ ID NO: 8273740 - DNA, 20 bp, Homo sapiens
taaattagccttgaagatta

SEQ ID NO: 8273741 - DNA, 22 bp, Homo sapiens
taaattaaagattggagaagga

SEQ ID NO: 8273742 - DNA, 22 bp, Homo sapiens
taaattatgtcacatgactctg

SEQ ID NO: 8273743 - DNA, 22 bp, Homo sapiens
taaaggtacgaagtgagggatt

SEQ ID NO: 8273744 - DNA, 22 bp, Homo sapiens
taaagtataagcattggagtat

SEQ ID NO: 8273745 - DNA, 22 bp, Homo sapiens
taaagtcaaaatatgggtaggc

SEQ ID NO: 8273746 - DNA, 22 bp, Homo sapiens
taaagtatccagttattcttct

SEQ ID NO: 8273747 - DNA, 22 bp, Homo sapiens
taaagtatattttttctcaata

SEQ ID NO: 8273748 - DNA, 23 bp, Homo sapiens
tacagaaggagtagtcactaaga

SEQ ID NO: 8273749 - DNA, 22 bp, Homo sapiens
tacagagtggttgtccaactct

SEQ ID NO: 8273750 - DNA, 22 bp, Homo sapiens
tacagagtggtgagatcttttg

SEQ ID NO: 8273751 - DNA, 22 bp, Homo sapiens
tacagagttttcctgccaagaa

SEQ ID NO: 8273752 - DNA, 22 bp, Homo sapiens
tacagaagtaaataccaaaagc

SEQ ID NO: 8273753 - DNA, 22 bp, Homo sapiens
tacagcaatggttctaagagtc

SEQ ID NO: 8273754 - DNA, 22 bp, Homo sapiens
tacagcaatgctacaagatgac

SEQ ID NO: 8273755 - DNA, 22 bp, Homo sapiens
tacagatatagagatttataga

SEQ ID NO: 8273756 - DNA, 22 bp, Homo sapiens
tacagattgaggtttttaatat

SEQ ID NO: 8273757 - DNA, 22 bp, Homo sapiens
tacagatattgtacagttatag

SEQ ID NO: 8273758 - DNA, 22 bp, Homo sapiens
tacaaagtcccattgccatgga

SEQ ID NO: 8273759 - DNA, 22 bp, Homo sapiens
tacaaagtgacaagctctgctg

SEQ ID NO: 8273760 - DNA, 22 bp, Homo sapiens
tacaaagtgagcaacctctttt

SEQ ID NO: 8273761 - DNA, 22 bp, Homo sapiens
tacaaagtttgagaatgctttc

SEQ ID NO: 8273762 - DNA, 22 bp, Homo sapiens
tacaaagtgtgcccatgctgag

SEQ ID NO: 8273763 - DNA, 22 bp, Homo sapiens
tacaaagtgctttagaaatgaa

SEQ ID NO: 8273764 - DNA, 22 bp, Homo sapiens
tacaacaatttccacattagaa

SEQ ID NO: 8273765 - DNA, 22 bp, Homo sapiens
tacactgaaagagaggattgaa

SEQ ID NO: 8273766 - DNA, 22 bp, Homo sapiens
tacattctggtggagaaagtaa

SEQ ID NO: 8273767 - DNA, 22 bp, Homo sapiens
tacattctgaaataaatggttt

SEQ ID NO: 8273768 - DNA, 22 bp, Homo sapiens
tacattctggaaaggcacagac

SEQ ID NO: 8273769 - DNA, 22 bp, Homo sapiens
tacattctggaaaggcacagac

SEQ ID NO: 8273770 - DNA, 22 bp, Homo sapiens
tacatctagccttacaattatt

SEQ ID NO: 8273771 - DNA, 22 bp, Homo sapiens
tacatcattttggagatgagca

SEQ ID NO: 8273772 - DNA, 22 bp, Homo sapiens
tacatcatgtaagcagaatcat

SEQ ID NO: 8273773 - DNA, 22 bp, Homo sapiens
tacatcatggcttcatgctgca

SEQ ID NO: 8273774 - DNA, 22 bp, Homo sapiens
tacatcatggtgagcaggaggc

SEQ ID NO: 8273775 - DNA, 22 bp, Homo sapiens
tacatagtattcacattgtttt

SEQ ID NO: 8273776 - DNA, 17 bp, Homo sapiens
tacaggagagcaggaac

SEQ ID NO: 8273777 - DNA, 22 bp, Homo sapiens
tacagtaactggaattcttctt

SEQ ID NO: 8273778 - DNA, 22 bp, Homo sapiens
tacagtaagatgaaatagcaat

SEQ ID NO: 8273779 - DNA, 22 bp, Homo sapiens
tacagtaagatgaaatagcaat

SEQ ID NO: 8273780 - DNA, 22 bp, Homo sapiens
tacagtaataaaatgagctaca

SEQ ID NO: 8273781 - DNA, 22 bp, Homo sapiens
tacagtaataaaatgagctaca

SEQ ID NO: 8273782 - DNA, 21 bp, Homo sapiens
tacagtaagttgggtggtcct

SEQ ID NO: 8273783 - DNA, 22 bp, Homo sapiens
tacagtaatctggacatgattt

SEQ ID NO: 8273784 - DNA, 22 bp, Homo sapiens
tacagtaatctggacatgattt

SEQ ID NO: 8273785 - DNA, 22 bp, Homo sapiens
tacagtaatgtgtccctgcagg

SEQ ID NO: 8273786 - DNA, 22 bp, Homo sapiens
tacatactccataatgacagca

SEQ ID NO: 8273787 - DNA, 22 bp, Homo sapiens
tacaaaaaattgatactgacga

SEQ ID NO: 8273788 - DNA, 22 bp, Homo sapiens
tacaaactgtccagcccagagg

SEQ ID NO: 8273789 - DNA, 22 bp, Homo sapiens
taattatagccgctattttgct

SEQ ID NO: 8273790 - DNA, 22 bp, Homo sapiens
tacaaagagtttggtctctaga

SEQ ID NO: 8273791 - DNA, 22 bp, Homo sapiens
tacaaaggagtagagaaggctt

SEQ ID NO: 8273792 - DNA, 22 bp, Homo sapiens
tacaaagtatatttctagctgt

SEQ ID NO: 8273793 - DNA, 22 bp, Homo sapiens
tacaaagtcaccagcttcttgc

SEQ ID NO: 8273794 - DNA, 22 bp, Homo sapiens
tacaaagcttgtactgtgtgac

SEQ ID NO: 8273795 - DNA, 22 bp, Homo sapiens
tacaaagcctggtagatatctg

SEQ ID NO: 8273796 - DNA, 22 bp, Homo sapiens
tacaaagcagttccaacacgaa

SEQ ID NO: 8273797 - DNA, 22 bp, Homo sapiens
tacaaagatggaaggttatgtt

SEQ ID NO: 8273798 - DNA, 22 bp, Homo sapiens
tacaaagcaaatcatctaagag

SEQ ID NO: 8273799 - DNA, 22 bp, Homo sapiens
taatggtttttctatactgtcc

SEQ ID NO: 8273800 - DNA, 22 bp, Homo sapiens
taattataacatgctttctggc

SEQ ID NO: 8273801 - DNA, 22 bp, Homo sapiens
taattatagcattggagtggcc

SEQ ID NO: 8273802 - DNA, 22 bp, Homo sapiens
taattatacaaaaaggcatgca

SEQ ID NO: 8273803 - DNA, 22 bp, Homo sapiens
taattatagccgctattttgct

SEQ ID NO: 8273804 - DNA, 22 bp, Homo sapiens
taattatacaaaaaggcatgca

SEQ ID NO: 8273805 - DNA, 22 bp, Homo sapiens
taattataacagttacatctta

SEQ ID NO: 8273806 - DNA, 22 bp, Homo sapiens
taattataacagttacatctta

SEQ ID NO: 8273807 - DNA, 22 bp, Homo sapiens
taattataaactgcagtaggta

SEQ ID NO: 8273808 - DNA, 22 bp, Homo sapiens
taattataacagttacatctta

SEQ ID NO: 8273809 - DNA, 22 bp, Homo sapiens
taattacaggtccaaaacaatc

SEQ ID NO: 8273810 - DNA, 22 bp, Homo sapiens
taattacagaggtttgccagtt

SEQ ID NO: 8273811 - DNA, 22 bp, Homo sapiens
taataatagcagtagctgccac

SEQ ID NO: 8273812 - DNA, 22 bp, Homo sapiens
taatacagggcactttgagtga

SEQ ID NO: 8273813 - DNA, 22 bp, Homo sapiens
taagtaaatttataatgtgatt

SEQ ID NO: 8273814 - DNA, 22 bp, Homo sapiens
taagtgagccctcagagtatgg

SEQ ID NO: 8273815 - DNA, 22 bp, Homo sapiens
taaggtagattacttgtttgga

SEQ ID NO: 8273816 - DNA, 22 bp, Homo sapiens
taaggccaccgttatagaacca

SEQ ID NO: 8273817 - DNA, 19 bp, Homo sapiens
taaggccaaaagtaagtgt

SEQ ID NO: 8273818 - DNA, 22 bp, Homo sapiens
taaggcataaggccagaggcta

SEQ ID NO: 8273819 - DNA, 22 bp, Homo sapiens
taactgcagaggaaatgcatct

SEQ ID NO: 8273820 - DNA, 22 bp, Homo sapiens
tatagcaattcagaatacatgt

SEQ ID NO: 8273821 - DNA, 22 bp, Homo sapiens
tataggtgaataaatgagttta

SEQ ID NO: 8273822 - DNA, 22 bp, Homo sapiens
tatagtacacttaggtacttca

SEQ ID NO: 8273823 - DNA, 22 bp, Homo sapiens
tatatctaagtgtatgtaagag

SEQ ID NO: 8273824 - DNA, 22 bp, Homo sapiens
tatatcatggagattaacattc

SEQ ID NO: 8273825 - DNA, 22 bp, Homo sapiens
tatatattcttaagtagtgtag

SEQ ID NO: 8273826 - DNA, 22 bp, Homo sapiens
tatgacattatgtattacatgt

SEQ ID NO: 8273827 - DNA, 22 bp, Homo sapiens
tatgacattgctttttagaact

SEQ ID NO: 8273828 - DNA, 22 bp, Homo sapiens
tatgacatgtgatctcaagagg

SEQ ID NO: 8273829 - DNA, 22 bp, Homo sapiens
tatgacatcagaagactttaaa

SEQ ID NO: 8273830 - DNA, 22 bp, Homo sapiens
tatgacattataaaggattatt

SEQ ID NO: 8273831 - DNA, 22 bp, Homo sapiens
tatgacattggccaagttctgt

SEQ ID NO: 8273832 - DNA, 22 bp, Homo sapiens
tatgacattgctttttagaact

SEQ ID NO: 8273833 - DNA, 22 bp, Homo sapiens
tatgacatttctctgatttgtg

SEQ ID NO: 8273834 - DNA, 22 bp, Homo sapiens
tatgacattttcccagatttat

SEQ ID NO: 8273835 - DNA, 22 bp, Homo sapiens
tatgacattttttgtggccttc

SEQ ID NO: 8273836 - DNA, 22 bp, Homo sapiens
tatgacattttgccagcattgc

SEQ ID NO: 8273837 - DNA, 22 bp, Homo sapiens
tatctaaaggatttaatttagt

SEQ ID NO: 8273838 - DNA, 20 bp, Homo sapiens
tatctaaatgcttacattac

SEQ ID NO: 8273839 - DNA, 19 bp, Homo sapiens
tatgacaagtactagttct

SEQ ID NO: 8273840 - DNA, 22 bp, Homo sapiens
taggtgagtttggggaagatag

SEQ ID NO: 8273841 - DNA, 22 bp, Homo sapiens
taggtgcagtggctcatgcctg

SEQ ID NO: 8273842 - DNA, 22 bp, Homo sapiens
taggtgagggagcattgtgaga

SEQ ID NO: 8273843 - DNA, 20 bp, Homo sapiens
taggtgagggcagatagagg

SEQ ID NO: 8273844 - DNA, 20 bp, Homo sapiens
tataaattcagagctttggt

SEQ ID NO: 8273845 - DNA, 22 bp, Homo sapiens
tataaattattaggctgctaaa

SEQ ID NO: 8273846 - DNA, 22 bp, Homo sapiens
tataaattaatgtgcccatgag

SEQ ID NO: 8273847 - DNA, 22 bp, Homo sapiens
tataaatgcacttttgaaatat

SEQ ID NO: 8273848 - DNA, 23 bp, Homo sapiens
tatacacatgtggcagtatagtg

SEQ ID NO: 8273849 - DNA, 22 bp, Homo sapiens
tatacaatgagtacattctggg

SEQ ID NO: 8273850 - DNA, 22 bp, Homo sapiens
tataattttaagtggtaaatta

SEQ ID NO: 8273851 - DNA, 22 bp, Homo sapiens
tatacaatggctgaatcatcca

SEQ ID NO: 8273852 - DNA, 22 bp, Homo sapiens
tattactgaggttttatggagt

SEQ ID NO: 8273853 - DNA, 22 bp, Homo sapiens
tattactgaaaaggcaaagtag

SEQ ID NO: 8273854 - DNA, 22 bp, Homo sapiens
tattactgttacttcacactgt

SEQ ID NO: 8273855 - DNA, 22 bp, Homo sapiens
tattactgtcaatatcacagaa

SEQ ID NO: 8273856 - DNA, 20 bp, Homo sapiens
tattacacacaatgagcagt

SEQ ID NO: 8273857 - DNA, 22 bp, Homo sapiens
tattacacagtgaaagcatgga

SEQ ID NO: 8273858 - DNA, 22 bp, Homo sapiens
tattacactttcttcttcaagc

SEQ ID NO: 8273859 - DNA, 22 bp, Homo sapiens
tattacagaatcaggcataact

SEQ ID NO: 8273860 - DNA, 20 bp, Homo sapiens
tatgtgcagtttggtttatc

SEQ ID NO: 8273861 - DNA, 22 bp, Homo sapiens
tatgtgatcaaaaaagtttgga

SEQ ID NO: 8273862 - DNA, 22 bp, Homo sapiens
tatgtgatataggctatttgat

SEQ ID NO: 8273863 - DNA, 22 bp, Homo sapiens
tatgtgataggcattttactga

SEQ ID NO: 8273864 - DNA, 22 bp, Homo sapiens
tatgtgatagagttactttata

SEQ ID NO: 8273865 - DNA, 22 bp, Homo sapiens
tatgtgcagcacttgccattac

SEQ ID NO: 8273866 - DNA, 22 bp, Homo sapiens
tatgagtgtgtgtagaaggtac

SEQ ID NO: 8273867 - DNA, 22 bp, Homo sapiens
tatgagtggttgaatggtaaac

SEQ ID NO: 8273868 - DNA, 22 bp, Homo sapiens
tatgtacaatcagcagttcata

SEQ ID NO: 8273869 - DNA, 22 bp, Homo sapiens
tatgtacaatttgttgtatgtc

SEQ ID NO: 8273870 - DNA, 22 bp, Homo sapiens
tatgtacaagcacacatgtgac

SEQ ID NO: 8273871 - DNA, 22 bp, Homo sapiens
tatgtctagacccaagaatatg

SEQ ID NO: 8273872 - DNA, 22 bp, Homo sapiens
tatgtcctgctactctctcatg

SEQ ID NO: 8273873 - DNA, 22 bp, Homo sapiens
tatgtacataacatgaaatgca

SEQ ID NO: 8273874 - DNA, 22 bp, Homo sapiens
tatgtacagtccttaacttaaa

SEQ ID NO: 8273875 - DNA, 22 bp, Homo sapiens
tatgtacagggatagaacttga

SEQ ID NO: 8273876 - DNA, 22 bp, Homo sapiens
tatgtacaccaaggattgaaaa

SEQ ID NO: 8273877 - DNA, 22 bp, Homo sapiens
tatgtacacatacacttgtaat

SEQ ID NO: 8273878 - DNA, 22 bp, Homo sapiens
tatgtacacacacatgcatgta

SEQ ID NO: 8273879 - DNA, 22 bp, Homo sapiens
tatgtacaccggggaaggtggg

SEQ ID NO: 8273880 - DNA, 22 bp, Homo sapiens
tatgtacacggtggctctgaag

SEQ ID NO: 8273881 - DNA, 22 bp, Homo sapiens
tatgtacacttaagtttgagaa

SEQ ID NO: 8273882 - DNA, 22 bp, Homo sapiens
tattctgggtaccaaacttcaa

SEQ ID NO: 8273883 - DNA, 22 bp, Homo sapiens
tattctgatttcaagtgagagt

SEQ ID NO: 8273884 - DNA, 22 bp, Homo sapiens
tattgaattagaccctaaaatg

SEQ ID NO: 8273885 - DNA, 19 bp, Homo sapiens
tattatttgtagcaaggcc

SEQ ID NO: 8273886 - DNA, 22 bp, Homo sapiens
tattatttttattcgagggaaa

SEQ ID NO: 8273887 - DNA, 22 bp, Homo sapiens
tattattgaatcagttctttga

SEQ ID NO: 8273888 - DNA, 22 bp, Homo sapiens
tatttattcattcagcaagcat

SEQ ID NO: 8273889 - DNA, 21 bp, Homo sapiens
tatttattaatttgtaaggct

SEQ ID NO: 8273890 - DNA, 22 bp, Homo sapiens
tatttattcattcagcaagcat

SEQ ID NO: 8273891 - DNA, 22 bp, Homo sapiens
tatttattggacagtgttgctg

SEQ ID NO: 8273892 - DNA, 22 bp, Homo sapiens
tatttattctttgtactgcctt

SEQ ID NO: 8273893 - DNA, 22 bp, Homo sapiens
tatttctaagctgtaagtctga

SEQ ID NO: 8273894 - DNA, 22 bp, Homo sapiens
tatttctgagaaccaacttacc

SEQ ID NO: 8273895 - DNA, 22 bp, Homo sapiens
tatttataatctgccaaagaga

SEQ ID NO: 8273896 - DNA, 22 bp, Homo sapiens
tatttataccaggtgatcggag

SEQ ID NO: 8273897 - DNA, 22 bp, Homo sapiens
tatttatattctgccttctgct

SEQ ID NO: 8273898 - DNA, 22 bp, Homo sapiens
tatttataatctgccaaagaga

SEQ ID NO: 8273899 - DNA, 22 bp, Homo sapiens
tatttaatttgctcattgtgat

SEQ ID NO: 8273900 - DNA, 19 bp, Homo sapiens
tagaatgcccacttaaaaa

SEQ ID NO: 8273901 - DNA, 22 bp, Homo sapiens
tagaatctttaaaattcatagt

SEQ ID NO: 8273902 - DNA, 22 bp, Homo sapiens
tagaaatggagaacagattaat

SEQ ID NO: 8273903 - DNA, 20 bp, Homo sapiens
tagaatctgttctgattcat

SEQ ID NO: 8273904 - DNA, 22 bp, Homo sapiens
tagacaaaagggggcagatatg

SEQ ID NO: 8273905 - DNA, 22 bp, Homo sapiens
tagacaatatttgaaagtagtg

SEQ ID NO: 8273906 - DNA, 22 bp, Homo sapiens
tagacaactggagatagtctga

SEQ ID NO: 8273907 - DNA, 22 bp, Homo sapiens
tagacacaaatctcagtgacac

SEQ ID NO: 8273908 - DNA, 22 bp, Homo sapiens
tagacacaggggaatgtgaggt

SEQ ID NO: 8273909 - DNA, 22 bp, Homo sapiens
tagacacaagagaagggtataa

SEQ ID NO: 8273910 - DNA, 22 bp, Homo sapiens
tagacacatcttcatccacaat

SEQ ID NO: 8273911 - DNA, 22 bp, Homo sapiens
tagacactagggatttagtact

SEQ ID NO: 8273912 - DNA, 23 bp, Homo sapiens
tagacactcctttgtctgtcctt

SEQ ID NO: 8273913 - DNA, 22 bp, Homo sapiens
tagacacatcaagtatagttaa

SEQ ID NO: 8273914 - DNA, 22 bp, Homo sapiens
tagacacatcaaggatcagttt

SEQ ID NO: 8273915 - DNA, 22 bp, Homo sapiens
tagacacatacccttgcccaaa

SEQ ID NO: 8273916 - DNA, 22 bp, Homo sapiens
tagacacatccgtggaagcttc

SEQ ID NO: 8273917 - DNA, 22 bp, Homo sapiens
tagacactttagaagtaagggt

SEQ ID NO: 8273918 - DNA, 22 bp, Homo sapiens
tagacagagtgaagacaagtgg

SEQ ID NO: 8273919 - DNA, 22 bp, Homo sapiens
tagaggctactagaggcacctg

SEQ ID NO: 8273920 - DNA, 22 bp, Homo sapiens
tagaggccctgctcaccctccc

SEQ ID NO: 8273921 - DNA, 22 bp, Homo sapiens
tagaggccaaaatacccggcga

SEQ ID NO: 8273922 - DNA, 22 bp, Homo sapiens
tagaaagcgttaaatctacaga

SEQ ID NO: 8273923 - DNA, 22 bp, Homo sapiens
tagaaaggaagctacttagggg

SEQ ID NO: 8273924 - DNA, 22 bp, Homo sapiens
tagaaaggagcattttagacta

SEQ ID NO: 8273925 - DNA, 22 bp, Homo sapiens
tagaaagctgagtaatacattt

SEQ ID NO: 8273926 - DNA, 20 bp, Homo sapiens
tagaaatcttataaaagact

SEQ ID NO: 8273927 - DNA, 22 bp, Homo sapiens
tagaaataaatctgcagctggg

SEQ ID NO: 8273928 - DNA, 22 bp, Homo sapiens
tagaaaactaatacatgcttga

SEQ ID NO: 8273929 - DNA, 22 bp, Homo sapiens
tagaaaagaagtctggccggga

SEQ ID NO: 8273930 - DNA, 22 bp, Homo sapiens
tactttttgtctctttgaatgt

SEQ ID NO: 8273931 - DNA, 22 bp, Homo sapiens
tactttgagatgatgctgatcg

SEQ ID NO: 8273932 - DNA, 22 bp, Homo sapiens
tactttgacgccggtgggaata

SEQ ID NO: 8273933 - DNA, 22 bp, Homo sapiens
tagaaacattcagttgcagtcc

SEQ ID NO: 8273934 - DNA, 22 bp, Homo sapiens
tagaaactcaggatactcttcc

SEQ ID NO: 8273935 - DNA, 22 bp, Homo sapiens
tagaaactgatagtcttgtgct

SEQ ID NO: 8273936 - DNA, 22 bp, Homo sapiens
tagaaacatatgtttgagacat

SEQ ID NO: 8273937 - DNA, 22 bp, Homo sapiens
tagaaacatgttctgttctgtt

SEQ ID NO: 8273938 - DNA, 22 bp, Homo sapiens
tagaaacatgagagaaactctt

SEQ ID NO: 8273939 - DNA, 22 bp, Homo sapiens
tagaaacatataggatggcagg

SEQ ID NO: 8273940 - DNA, 22 bp, Homo sapiens
tagaaacagatgtttttgaaga

SEQ ID NO: 8273941 - DNA, 22 bp, Homo sapiens
tagaaacagaatatgagtgaga

SEQ ID NO: 8273942 - DNA, 22 bp, Homo sapiens
tagaaacacagagagacccatg

SEQ ID NO: 8273943 - DNA, 22 bp, Homo sapiens
tagaaaagccccagctggaggg

SEQ ID NO: 8273944 - DNA, 22 bp, Homo sapiens
tagggcaatatttcccagaaaa

SEQ ID NO: 8273945 - DNA, 22 bp, Homo sapiens
taggagggttagagggaaatat

SEQ ID NO: 8273946 - DNA, 22 bp, Homo sapiens
taggagtgcataaaactatatt

SEQ ID NO: 8273947 - DNA, 22 bp, Homo sapiens
taggaaacaaagcttagcagga

SEQ ID NO: 8273948 - DNA, 22 bp, Homo sapiens
taggacaggtgaggggctgtgg

SEQ ID NO: 8273949 - DNA, 22 bp, Homo sapiens
taggacagtagctggtgcacag

SEQ ID NO: 8273950 - DNA, 22 bp, Homo sapiens
taggacagtggagataaccaga

SEQ ID NO: 8273951 - DNA, 22 bp, Homo sapiens
taggacagttatgggttttatt

SEQ ID NO: 8273952 - DNA, 22 bp, Homo sapiens
taggacagtttactttggttac

SEQ ID NO: 8273953 - DNA, 22 bp, Homo sapiens
taggagggccctgaaaatggca

SEQ ID NO: 8273954 - DNA, 22 bp, Homo sapiens
taggagggggaacaaggcatac

SEQ ID NO: 8273955 - DNA, 22 bp, Homo sapiens
tagctttaggcacgtttgaatt

SEQ ID NO: 8273956 - DNA, 22 bp, Homo sapiens
tagctttgaacttctgggctca

SEQ ID NO: 8273957 - DNA, 22 bp, Homo sapiens
tagctttgaagttatttaacag

SEQ ID NO: 8273958 - DNA, 22 bp, Homo sapiens
tagctttgaacttctgggctca

SEQ ID NO: 8273959 - DNA, 22 bp, Homo sapiens
tagctttgaagttatttaacag

SEQ ID NO: 8273960 - DNA, 22 bp, Homo sapiens
tagctttgacagttgcaggcag

SEQ ID NO: 8273961 - DNA, 22 bp, Homo sapiens
tagctttgaccaacgactggtc

SEQ ID NO: 8273962 - DNA, 22 bp, Homo sapiens
tagctttgacagttgcaggcag

SEQ ID NO: 8273963 - DNA, 22 bp, Homo sapiens
tagctttgcaaaggaagtttta

SEQ ID NO: 8273964 - DNA, 22 bp, Homo sapiens
tagctttgcaaaggaagtttta

SEQ ID NO: 8273965 - DNA, 22 bp, Homo sapiens
tagctttgccacacatgtagat

SEQ ID NO: 8273966 - DNA, 22 bp, Homo sapiens
tagctttgccacacatgtagat

SEQ ID NO: 8273967 - DNA, 22 bp, Homo sapiens
tagctttgcccgtgctggattt

SEQ ID NO: 8273968 - DNA, 22 bp, Homo sapiens
tagctttgccatctgtcacata

SEQ ID NO: 8273969 - DNA, 22 bp, Homo sapiens
tagctttgccatctgtcacata

SEQ ID NO: 8273970 - DNA, 22 bp, Homo sapiens
tagctttgctggcaagcatgtc

SEQ ID NO: 8273971 - DNA, 22 bp, Homo sapiens
tagctttgctggcaagcatgtc

SEQ ID NO: 8273972 - DNA, 22 bp, Homo sapiens
tagctttgcctgttaatcacaa

SEQ ID NO: 8273973 - DNA, 22 bp, Homo sapiens
tagctttggattctttggggaa

SEQ ID NO: 8273974 - DNA, 22 bp, Homo sapiens
tagctttggattctttggggaa

SEQ ID NO: 8273975 - DNA, 22 bp, Homo sapiens
tagctttgggaatgctctcctg

SEQ ID NO: 8273976 - DNA, 22 bp, Homo sapiens
tagctttgtattatcagcattg

SEQ ID NO: 8273977 - DNA, 22 bp, Homo sapiens
tagctttgcctgaagtaatcag

SEQ ID NO: 8273978 - DNA, 22 bp, Homo sapiens
tagctttgaccaacgactggtc

SEQ ID NO: 8273979 - DNA, 22 bp, Homo sapiens
tagctttgcctgttaatcacaa

SEQ ID NO: 8273980 - DNA, 22 bp, Homo sapiens
tagctttgcccgtgctggattt

SEQ ID NO: 8273981 - DNA, 22 bp, Homo sapiens
tagctttgcctgaagtaatcag

SEQ ID NO: 8273982 - DNA, 22 bp, Homo sapiens
tagctttgtttatcaaggggca

SEQ ID NO: 8273983 - DNA, 16 bp, Homo sapiens
tagctttgtgttgtgg

SEQ ID NO: 8273984 - DNA, 22 bp, Homo sapiens
tagctttgtttatcaaggggca

SEQ ID NO: 8273985 - DNA, 22 bp, Homo sapiens
tagctttgtgaagtttacagac

SEQ ID NO: 8273986 - DNA, 22 bp, Homo sapiens
tagctttgtcctccaccctcag

SEQ ID NO: 8273987 - DNA, 22 bp, Homo sapiens
tagctttgtattatcagcattg

SEQ ID NO: 8273988 - DNA, 22 bp, Homo sapiens
tagctttgggaatgctctcctg

SEQ ID NO: 8273989 - DNA, 22 bp, Homo sapiens
tagctttgtcctccaccctcag

SEQ ID NO: 8273990 - DNA, 22 bp, Homo sapiens
tagctttgtgtatgatgtctgt

SEQ ID NO: 8273991 - DNA, 22 bp, Homo sapiens
tagctttgtgaagtttacagac

SEQ ID NO: 8273992 - DNA, 22 bp, Homo sapiens
tagctttgtgtatgatgtctgt

SEQ ID NO: 8273993 - DNA, 22 bp, Homo sapiens
tagctttgttagaatgtcttca

SEQ ID NO: 8273994 - DNA, 22 bp, Homo sapiens
tagctttgtgtcctgatttagc

SEQ ID NO: 8273995 - DNA, 22 bp, Homo sapiens
tagctttgtgtcctgatttagc

SEQ ID NO: 8273996 - DNA, 16 bp, Homo sapiens
tagctttgtgttgtgg

SEQ ID NO: 8273997 - DNA, 22 bp, Homo sapiens
tagctttgttagaatgtcttca

SEQ ID NO: 8273998 - DNA, 22 bp, Homo sapiens
tagcccctgcctttgaacctgg

SEQ ID NO: 8273999 - DNA, 22 bp, Homo sapiens
tagcccctgcctttgaacctgg

SEQ ID NO: 8274000 - DNA, 22 bp, Homo sapiens
tagcccctgcctttgaacctgg

SEQ ID NO: 8274001 - DNA, 22 bp, Homo sapiens
tagcagaggctgtctgacttaa

SEQ ID NO: 8274002 - DNA, 22 bp, Homo sapiens
tagcagaggctactgctccttg

SEQ ID NO: 8274003 - DNA, 20 bp, Homo sapiens
tagaggggacaatcattgcc

SEQ ID NO: 8274004 - DNA, 22 bp, Homo sapiens
gcctctggtccctcatgctgtg

SEQ ID NO: 8274005 - DNA, 22 bp, Homo sapiens
gcctctgggggctcagacctgt

SEQ ID NO: 8274006 - DNA, 18 bp, Homo sapiens
gcctctgttgcttgcctg

SEQ ID NO: 8274007 - DNA, 21 bp, Homo sapiens
gcctgagcatgtcttcaggtc

SEQ ID NO: 8274008 - DNA, 22 bp, Homo sapiens
gccttggccttcctaggcctga

SEQ ID NO: 8274009 - DNA, 22 bp, Homo sapiens
gcggtatttgtgtgggtgtcga

SEQ ID NO: 8274010 - DNA, 22 bp, Homo sapiens
gcgtgggctggactgggatgaa

SEQ ID NO: 8274011 - DNA, 22 bp, Homo sapiens
gcctttggatatattcagggat

SEQ ID NO: 8274012 - DNA, 22 bp, Homo sapiens
gcctttatattacatttggaag

SEQ ID NO: 8274013 - DNA, 22 bp, Homo sapiens
gcctttatgtctgaaaatcagc

SEQ ID NO: 8274014 - DNA, 22 bp, Homo sapiens
gcctttattgtttattcagtgc

SEQ ID NO: 8274015 - DNA, 22 bp, Homo sapiens
gctaccaagaaaatctaggaga

SEQ ID NO: 8274016 - DNA, 19 bp, Homo sapiens
gctcagagtccccctgcgg

SEQ ID NO: 8274017 - DNA, 22 bp, Homo sapiens
gctcagcgtggacctggagctt

SEQ ID NO: 8274018 - DNA, 19 bp, Homo sapiens
gctcagcagacccagtgct

SEQ ID NO: 8274019 - DNA, 22 bp, Homo sapiens
gctccagggtggatgacaattc

SEQ ID NO: 8274020 - DNA, 22 bp, Homo sapiens
gctccctggtattgctgccact

SEQ ID NO: 8274021 - DNA, 22 bp, Homo sapiens
gctccctggtattgctgccact

SEQ ID NO: 8274022 - DNA, 22 bp, Homo sapiens
gctcccagaaccaaggctgggg

SEQ ID NO: 8274023 - DNA, 22 bp, Homo sapiens
gctccaggtggcttatttgtat

SEQ ID NO: 8274024 - DNA, 22 bp, Homo sapiens
gctgctgtgttggccactgctt

SEQ ID NO: 8274025 - DNA, 22 bp, Homo sapiens
gctgctccagctgtgctgcaga

SEQ ID NO: 8274026 - DNA, 22 bp, Homo sapiens
gctgctccgcagagtgtgtgtg

SEQ ID NO: 8274027 - DNA, 22 bp, Homo sapiens
gctgcccaatggtagtgtcttt

SEQ ID NO: 8274028 - DNA, 22 bp, Homo sapiens
gctgcccagttctgctgctgcc

SEQ ID NO: 8274029 - DNA, 22 bp, Homo sapiens
gctgcccaggaagcctggggtt

SEQ ID NO: 8274030 - DNA, 22 bp, Homo sapiens
gctgcccacaaccccgtgtcta

SEQ ID NO: 8274031 - DNA, 22 bp, Homo sapiens
gctgcctcactccagcccaata

SEQ ID NO: 8274032 - DNA, 22 bp, Homo sapiens
gctgcctcaggcacctcctggc

SEQ ID NO: 8274033 - DNA, 22 bp, Homo sapiens
gctgccctgtggtagagggtgg

SEQ ID NO: 8274034 - DNA, 22 bp, Homo sapiens
gctgccctgtctgcagcaggac

SEQ ID NO: 8274035 - DNA, 22 bp, Homo sapiens
gctgcccattccactggatggt

SEQ ID NO: 8274036 - DNA, 22 bp, Homo sapiens
gctgcccattgcacgttgtggc

SEQ ID NO: 8274037 - DNA, 22 bp, Homo sapiens
gctctggggatgcttctgccgt

SEQ ID NO: 8274038 - DNA, 22 bp, Homo sapiens
gctctgggctgccctctggaca

SEQ ID NO: 8274039 - DNA, 22 bp, Homo sapiens
gctctgggccgggcaccagcct

SEQ ID NO: 8274040 - DNA, 22 bp, Homo sapiens
gctctgggccatcctggccggg

SEQ ID NO: 8274041 - DNA, 20 bp, Homo sapiens
gctctgggagggatgtgatg

SEQ ID NO: 8274042 - DNA, 22 bp, Homo sapiens
gctccgccacgcccactcctac

SEQ ID NO: 8274043 - DNA, 22 bp, Homo sapiens
gctcctctattccccacatttt

SEQ ID NO: 8274044 - DNA, 22 bp, Homo sapiens
gctcctctattccccacatttt

SEQ ID NO: 8274045 - DNA, 22 bp, Homo sapiens
gctctgggaactgactgccttc

SEQ ID NO: 8274046 - DNA, 22 bp, Homo sapiens
gctgaggctgggagcagcctgt

SEQ ID NO: 8274047 - DNA, 22 bp, Homo sapiens
gctgaggcctcagaaggctgag

SEQ ID NO: 8274048 - DNA, 22 bp, Homo sapiens
gctgaggccaggccccaccgga

SEQ ID NO: 8274049 - DNA, 22 bp, Homo sapiens
gctggggaggcagcagagaaca

SEQ ID NO: 8274050 - DNA, 22 bp, Homo sapiens
gctgggcttggtttccctgctt

SEQ ID NO: 8274051 - DNA, 19 bp, Homo sapiens
gctgtgcctctctcctgct

SEQ ID NO: 8274052 - DNA, 20 bp, Homo sapiens
gctgtgcctccagctggtgg

SEQ ID NO: 8274053 - DNA, 22 bp, Homo sapiens
gctgtggcttgcagctggggct

SEQ ID NO: 8274054 - DNA, 22 bp, Homo sapiens
gctgtggctgaccaccaggggg

SEQ ID NO: 8274055 - DNA, 22 bp, Homo sapiens
gctgtggctgtacagagaccat

SEQ ID NO: 8274056 - DNA, 19 bp, Homo sapiens
gctgtgggacagcagggtg

SEQ ID NO: 8274057 - DNA, 22 bp, Homo sapiens
gctgtggctgaagatgcaggga

SEQ ID NO: 8274058 - DNA, 22 bp, Homo sapiens
gctgtggcggcagcagctggtg

SEQ ID NO: 8274059 - DNA, 22 bp, Homo sapiens
gctgtggctccaatggtgagcc

SEQ ID NO: 8274060 - DNA, 22 bp, Homo sapiens
gctgtggctctcacaagcaaat

SEQ ID NO: 8274061 - DNA, 22 bp, Homo sapiens
gctgtgtgaaaactgggcctgg

SEQ ID NO: 8274062 - DNA, 18 bp, Homo sapiens
gctttatttcttggggaa

SEQ ID NO: 8274063 - DNA, 22 bp, Homo sapiens
gcttgcttatttgcccttctcc

SEQ ID NO: 8274064 - DNA, 22 bp, Homo sapiens
gctggagagataggcatggggt

SEQ ID NO: 8274065 - DNA, 22 bp, Homo sapiens
gctggagaaacaggaggaggaa

SEQ ID NO: 8274066 - DNA, 22 bp, Homo sapiens
gctggctggcgggtgcgtcctc

SEQ ID NO: 8274067 - DNA, 22 bp, Homo sapiens
gctgggaaatggagtttggctt

SEQ ID NO: 8274068 - DNA, 22 bp, Homo sapiens
gctggcttttgaagtctagcta

SEQ ID NO: 8274069 - DNA, 22 bp, Homo sapiens
gctggctttgtggtctctcctc

SEQ ID NO: 8274070 - DNA, 22 bp, Homo sapiens
gctggctttgcactgggtgcat

SEQ ID NO: 8274071 - DNA, 21 bp, Homo sapiens
gctggctttcctggatgtgca

SEQ ID NO: 8274072 - DNA, 22 bp, Homo sapiens
gctggctttgatcttcccatct

SEQ ID NO: 8274073 - DNA, 22 bp, Homo sapiens
gctggctttgtcaagggcagca

SEQ ID NO: 8274074 - DNA, 22 bp, Homo sapiens
gctggctttatggggcttgtgg

SEQ ID NO: 8274075 - DNA, 22 bp, Homo sapiens
gctggctttatcgtcagactcc

SEQ ID NO: 8274076 - DNA, 20 bp, Homo sapiens
gctggctttcctaaactgct

SEQ ID NO: 8274077 - DNA, 21 bp, Homo sapiens
gctggctttattctgcgtttg

SEQ ID NO: 8274078 - DNA, 22 bp, Homo sapiens
gctggctgtgttccttctgcca

SEQ ID NO: 8274079 - DNA, 22 bp, Homo sapiens
gctggctgtgtttcatctctga

SEQ ID NO: 8274080 - DNA, 22 bp, Homo sapiens
gctggcttgtaataggaatttc

SEQ ID NO: 8274081 - DNA, 18 bp, Homo sapiens
gctggcttgctgggtttg

SEQ ID NO: 8274082 - DNA, 22 bp, Homo sapiens
gctggcttgtcccaggacaaag

SEQ ID NO: 8274083 - DNA, 22 bp, Homo sapiens
gctggcttgatagtttctgctt

SEQ ID NO: 8274084 - DNA, 22 bp, Homo sapiens
gctggcttccttctgcagctag

SEQ ID NO: 8274085 - DNA, 22 bp, Homo sapiens
gctggcttgacagaggcctggg

SEQ ID NO: 8274086 - DNA, 17 bp, Homo sapiens
gctggcttctccttgct

SEQ ID NO: 8274087 - DNA, 22 bp, Homo sapiens
gctggcttaatagggatgggct

SEQ ID NO: 8274088 - DNA, 22 bp, Homo sapiens
gctggcttaatgtagctaaaaa

SEQ ID NO: 8274089 - DNA, 22 bp, Homo sapiens
gctggcttccatcagagggtga

SEQ ID NO: 8274090 - DNA, 22 bp, Homo sapiens
gctggcttccatgcggacatca

SEQ ID NO: 8274091 - DNA, 21 bp, Homo sapiens
gctggcttcctgagggctgag

SEQ ID NO: 8274092 - DNA, 22 bp, Homo sapiens
gctggcttccctacctgcacct

SEQ ID NO: 8274093 - DNA, 22 bp, Homo sapiens
ggaagacaagcagtggctgagc

SEQ ID NO: 8274094 - DNA, 22 bp, Homo sapiens
ggaagaggaggagccaggcttt

SEQ ID NO: 8274095 - DNA, 22 bp, Homo sapiens
ggaagaggaggagccaggcttt

SEQ ID NO: 8274096 - DNA, 22 bp, Homo sapiens
ggaagaggctctcattgagggc

SEQ ID NO: 8274097 - DNA, 22 bp, Homo sapiens
ggaagaggctgagccaggtccc

SEQ ID NO: 8274098 - DNA, 22 bp, Homo sapiens
gctttgctgggtgcttcatgta

SEQ ID NO: 8274099 - DNA, 22 bp, Homo sapiens
gctttcagggtcactgtcaaca

SEQ ID NO: 8274100 - DNA, 22 bp, Homo sapiens
gctttattttgtgagggattac

SEQ ID NO: 8274101 - DNA, 22 bp, Homo sapiens
ggaatcctcattacatcagggt

SEQ ID NO: 8274102 - DNA, 22 bp, Homo sapiens
ggaatccttgggtctgaacgtg

SEQ ID NO: 8274103 - DNA, 22 bp, Homo sapiens
ggaatcctgtgagggctgagag

SEQ ID NO: 8274104 - DNA, 22 bp, Homo sapiens
ggaatcctgccagctctgcccc

SEQ ID NO: 8274105 - DNA, 22 bp, Homo sapiens
ggaatcctggtgttttctgcct

SEQ ID NO: 8274106 - DNA, 22 bp, Homo sapiens
ggaagcagcctgaagccaaggg

SEQ ID NO: 8274107 - DNA, 21 bp, Homo sapiens
ggaattgcaggctgtcttttg

SEQ ID NO: 8274108 - DNA, 22 bp, Homo sapiens
ggaattcagggaagtcaaaaag

SEQ ID NO: 8274109 - DNA, 22 bp, Homo sapiens
ggacaaaatccaaacttcttag

SEQ ID NO: 8274110 - DNA, 22 bp, Homo sapiens
ggacaaaaatcagccatctcta

SEQ ID NO: 8274111 - DNA, 22 bp, Homo sapiens
ggacacagctgcagccacaccc

SEQ ID NO: 8274112 - DNA, 22 bp, Homo sapiens
ggaatgcactgaaaattgtgct

SEQ ID NO: 8274113 - DNA, 22 bp, Homo sapiens
ggaatgcaattttacaattctg

SEQ ID NO: 8274114 - DNA, 22 bp, Homo sapiens
ggacacagtggaagacagcttg

SEQ ID NO: 8274115 - DNA, 23 bp, Homo sapiens
ggacacaggccttgtctgcgcct

SEQ ID NO: 8274116 - DNA, 19 bp, Homo sapiens
ggaccaggtcctgggcagc

SEQ ID NO: 8274117 - DNA, 22 bp, Homo sapiens
ggagacagtatggcttgtagct

SEQ ID NO: 8274118 - DNA, 22 bp, Homo sapiens
ggagacagtatggcttgtagct

SEQ ID NO: 8274119 - DNA, 22 bp, Homo sapiens
ggagagaccctggagaaggtcc

SEQ ID NO: 8274120 - DNA, 22 bp, Homo sapiens
ggagagaccctggagaaggtcc

SEQ ID NO: 8274121 - DNA, 22 bp, Homo sapiens
ggagagagacctccatgcccag

SEQ ID NO: 8274122 - DNA, 22 bp, Homo sapiens
ggagagagagattgtgtttatt

SEQ ID NO: 8274123 - DNA, 22 bp, Homo sapiens
ggagcagggaattacagcgcag

SEQ ID NO: 8274124 - DNA, 22 bp, Homo sapiens
ggagccagagcactggggagcc

SEQ ID NO: 8274125 - DNA, 22 bp, Homo sapiens
ggagacagtggtagggcctaag

SEQ ID NO: 8274126 - DNA, 22 bp, Homo sapiens
ggagacagtggtagggcctaag

SEQ ID NO: 8274127 - DNA, 22 bp, Homo sapiens
ggagacagtgacttagagactg

SEQ ID NO: 8274128 - DNA, 22 bp, Homo sapiens
ggagagaattccatggacatgt

SEQ ID NO: 8274129 - DNA, 22 bp, Homo sapiens
gcagatggatcacctgaggtcg

SEQ ID NO: 8274130 - DNA, 21 bp, Homo sapiens
gcagatgggaagagacgaggc

SEQ ID NO: 8274131 - DNA, 22 bp, Homo sapiens
gcagatggtggaggcaagaggc

SEQ ID NO: 8274132 - DNA, 22 bp, Homo sapiens
gcagatggtggggcaggaaaat

SEQ ID NO: 8274133 - DNA, 22 bp, Homo sapiens
gcagcccaggtgtagctctttg

SEQ ID NO: 8274134 - DNA, 22 bp, Homo sapiens
gcaggacaaaatttccagggtg

SEQ ID NO: 8274135 - DNA, 22 bp, Homo sapiens
gcaggaagggaaaggttgactc

SEQ ID NO: 8274136 - DNA, 22 bp, Homo sapiens
gcaggaagcatagaagaatgcc

SEQ ID NO: 8274137 - DNA, 22 bp, Homo sapiens
gcagctttgtggagaggcccat

SEQ ID NO: 8274138 - DNA, 18 bp, Homo sapiens
gcagcttttgattcaccc

SEQ ID NO: 8274139 - DNA, 22 bp, Homo sapiens
gcagctttgtcacggagtgtcg

SEQ ID NO: 8274140 - DNA, 22 bp, Homo sapiens
gcagctttgaagacttatttgc

SEQ ID NO: 8274141 - DNA, 22 bp, Homo sapiens
gcagctttttggatgtcagtta

SEQ ID NO: 8274142 - DNA, 22 bp, Homo sapiens
gcaggaagaggctcgaagcccc

SEQ ID NO: 8274143 - DNA, 22 bp, Homo sapiens
gcagctttctgcaatgtcatcc

SEQ ID NO: 8274144 - DNA, 22 bp, Homo sapiens
gcagctttctacttcctacagc

SEQ ID NO: 8274145 - DNA, 22 bp, Homo sapiens
gcagctttcttgccctaatctt

SEQ ID NO: 8274146 - DNA, 22 bp, Homo sapiens
gcagctttggaggtggaactct

SEQ ID NO: 8274147 - DNA, 22 bp, Homo sapiens
gcagctttgtaaagtatgaagc

SEQ ID NO: 8274148 - DNA, 22 bp, Homo sapiens
gcagctttggaggtggaactct

SEQ ID NO: 8274149 - DNA, 22 bp, Homo sapiens
gcagctttctgggacagaaagg

SEQ ID NO: 8274150 - DNA, 22 bp, Homo sapiens
gcagctttctttttgcatgtct

SEQ ID NO: 8274151 - DNA, 21 bp, Homo sapiens
gcagggacaaagcttcaggag

SEQ ID NO: 8274152 - DNA, 22 bp, Homo sapiens
gcagggaagatcttggagctgc

SEQ ID NO: 8274153 - DNA, 22 bp, Homo sapiens
gcaggcagatcacctgtcagga

SEQ ID NO: 8274154 - DNA, 22 bp, Homo sapiens
gcaggcagatcacctgtcagga

SEQ ID NO: 8274155 - DNA, 22 bp, Homo sapiens
gcagggacatctttgtctagta

SEQ ID NO: 8274156 - DNA, 22 bp, Homo sapiens
gcagggacatcttcagatcact

SEQ ID NO: 8274157 - DNA, 22 bp, Homo sapiens
gcagggacagggcagggccttt

SEQ ID NO: 8274158 - DNA, 18 bp, Homo sapiens
gcagggacacagggtcac

SEQ ID NO: 8274159 - DNA, 22 bp, Homo sapiens
gcagggacaaggcaggtgttct

SEQ ID NO: 8274160 - DNA, 22 bp, Homo sapiens
gcagggacaactgtgcacctga

SEQ ID NO: 8274161 - DNA, 21 bp, Homo sapiens
gcagggaccgcgacttctggg

SEQ ID NO: 8274162 - DNA, 22 bp, Homo sapiens
gcagggaccaaaagaggcagta

SEQ ID NO: 8274163 - DNA, 22 bp, Homo sapiens
gcagggacctgccactgctgtc

SEQ ID NO: 8274164 - DNA, 22 bp, Homo sapiens
gcagggacctcactacccccag

SEQ ID NO: 8274165 - DNA, 22 bp, Homo sapiens
gcagggacctatgacgatggaa

SEQ ID NO: 8274166 - DNA, 22 bp, Homo sapiens
gcagggctgggtcctgtctcat

SEQ ID NO: 8274167 - DNA, 22 bp, Homo sapiens
gcagggctgggtgggagacaga

SEQ ID NO: 8274168 - DNA, 22 bp, Homo sapiens
gcagggctgttcaggagggtgg

SEQ ID NO: 8274169 - DNA, 22 bp, Homo sapiens
gcaaagtgaaatggggcagaga

SEQ ID NO: 8274170 - DNA, 22 bp, Homo sapiens
gcaaagtgcttcagtgggagct

SEQ ID NO: 8274171 - DNA, 22 bp, Homo sapiens
gcaaataaatgctcactgctgt

SEQ ID NO: 8274172 - DNA, 22 bp, Homo sapiens
gcaaataaatgctcactgctgt

SEQ ID NO: 8274173 - DNA, 22 bp, Homo sapiens
gcaaagcaagattcagatgtag

SEQ ID NO: 8274174 - DNA, 22 bp, Homo sapiens
gaggcccagcagcgcaggtctt

SEQ ID NO: 8274175 - DNA, 23 bp, Homo sapiens
gcaaagactctgccaaaaactgc

SEQ ID NO: 8274176 - DNA, 22 bp, Homo sapiens
gcaaagacaaattagaactcct

SEQ ID NO: 8274177 - DNA, 22 bp, Homo sapiens
gcacacatgcatgcacaggagt

SEQ ID NO: 8274178 - DNA, 22 bp, Homo sapiens
gcacacatgcatgtgtgcatcc

SEQ ID NO: 8274179 - DNA, 22 bp, Homo sapiens
gcacacagtatatgctcattaa

SEQ ID NO: 8274180 - DNA, 19 bp, Homo sapiens
gcacacagtagggctggca

SEQ ID NO: 8274181 - DNA, 22 bp, Homo sapiens
gcacacagaatcagtgggcata

SEQ ID NO: 8274182 - DNA, 22 bp, Homo sapiens
gcacacagtactatatgctaca

SEQ ID NO: 8274183 - DNA, 22 bp, Homo sapiens
gcacacagaacatttggatcct

SEQ ID NO: 8274184 - DNA, 22 bp, Homo sapiens
gcacagggctgccaggcggctt

SEQ ID NO: 8274185 - DNA, 22 bp, Homo sapiens
gcacaggttgtacttgggcacc

SEQ ID NO: 8274186 - DNA, 22 bp, Homo sapiens
gcacactcctggatcctagaga

SEQ ID NO: 8274187 - DNA, 22 bp, Homo sapiens
gcagaggtgagaagggcctccc

SEQ ID NO: 8274188 - DNA, 22 bp, Homo sapiens
gcagaggtcctagccaggagtc

SEQ ID NO: 8274189 - DNA, 22 bp, Homo sapiens
gcagagggtcctgtgccagcag

SEQ ID NO: 8274190 - DNA, 23 bp, Homo sapiens
gcacatactacacagaaaatggc

SEQ ID NO: 8274191 - DNA, 22 bp, Homo sapiens
gcacatacccactgtcaagcac

SEQ ID NO: 8274192 - DNA, 22 bp, Homo sapiens
gcacataccccaggaatggtag

SEQ ID NO: 8274193 - DNA, 22 bp, Homo sapiens
gcacatacgtcagtggctgtca

SEQ ID NO: 8274194 - DNA, 22 bp, Homo sapiens
gcacatacatattagtgtcaca

SEQ ID NO: 8274195 - DNA, 22 bp, Homo sapiens
gcacagtgtaccacagtcccta

SEQ ID NO: 8274196 - DNA, 21 bp, Homo sapiens
gcacagtgccaggcacacagt

SEQ ID NO: 8274197 - DNA, 22 bp, Homo sapiens
gcagagcaccctgcagtggtat

SEQ ID NO: 8274198 - DNA, 22 bp, Homo sapiens
gcagagatttcagtaacagcag

SEQ ID NO: 8274199 - DNA, 22 bp, Homo sapiens
gcagagattgtaatgatacctg

SEQ ID NO: 8274200 - DNA, 22 bp, Homo sapiens
gcagactgcgagcgtgctggtg

SEQ ID NO: 8274201 - DNA, 22 bp, Homo sapiens
gcccagcctccaagctccaagg

SEQ ID NO: 8274202 - DNA, 22 bp, Homo sapiens
gccccaccgagggtgcagtcct

SEQ ID NO: 8274203 - DNA, 22 bp, Homo sapiens
gcccaggagaggccagggctga

SEQ ID NO: 8274204 - DNA, 22 bp, Homo sapiens
gcccaggaaataaaagtgggct

SEQ ID NO: 8274205 - DNA, 17 bp, Homo sapiens
gcccaggaaggacggcc

SEQ ID NO: 8274206 - DNA, 22 bp, Homo sapiens
gcccaggaagttgaggctgccg

SEQ ID NO: 8274207 - DNA, 22 bp, Homo sapiens
gccccagcctcccgagtagctg

SEQ ID NO: 8274208 - DNA, 22 bp, Homo sapiens
gccccagccctgtggaccatgg

SEQ ID NO: 8274209 - DNA, 22 bp, Homo sapiens
gccccaggggaggtgccctgca

SEQ ID NO: 8274210 - DNA, 22 bp, Homo sapiens
gccctgtggacccaggaactct

SEQ ID NO: 8274211 - DNA, 22 bp, Homo sapiens
gccctgtggacccaggaactct

SEQ ID NO: 8274212 - DNA, 22 bp, Homo sapiens
gccctgtggattaatgagcagg

SEQ ID NO: 8274213 - DNA, 22 bp, Homo sapiens
gccctgtgctataggttagggc

SEQ ID NO: 8274214 - DNA, 22 bp, Homo sapiens
gccctgtgctcatgggaacatc

SEQ ID NO: 8274215 - DNA, 22 bp, Homo sapiens
gccctgtggacagtgagaagtg

SEQ ID NO: 8274216 - DNA, 22 bp, Homo sapiens
gccctgtgctcatgggaacatc

SEQ ID NO: 8274217 - DNA, 22 bp, Homo sapiens
gccctgtgcgactctagaggtt

SEQ ID NO: 8274218 - DNA, 22 bp, Homo sapiens
gcctctgggctctgcccctggc

SEQ ID NO: 8274219 - DNA, 22 bp, Homo sapiens
gccctgtggttccaggaagcaa

SEQ ID NO: 8274220 - DNA, 22 bp, Homo sapiens
gccctgtgtgatcacatgaaca

SEQ ID NO: 8274221 - DNA, 22 bp, Homo sapiens
gcctcccttggtgtctcccggg

SEQ ID NO: 8274222 - DNA, 22 bp, Homo sapiens
gcctcctcacaatgtacccacg

SEQ ID NO: 8274223 - DNA, 23 bp, Homo sapiens
gccagccttgctctcctgcagcc

SEQ ID NO: 8274224 - DNA, 23 bp, Homo sapiens
gccagccttgctctcctgcagcc

SEQ ID NO: 8274225 - DNA, 18 bp, Homo sapiens
gccagccctccaacctcc

SEQ ID NO: 8274226 - DNA, 22 bp, Homo sapiens
gccaccccataggtgttaggtg

SEQ ID NO: 8274227 - DNA, 22 bp, Homo sapiens
gccagctgaatttccaactgtt

SEQ ID NO: 8274228 - DNA, 22 bp, Homo sapiens
gccagctcagatgcaggaagga

SEQ ID NO: 8274229 - DNA, 22 bp, Homo sapiens
gccagctcagtttcaaagtagg

SEQ ID NO: 8274230 - DNA, 22 bp, Homo sapiens
gccagctcttgatgggtgggta

SEQ ID NO: 8274231 - DNA, 22 bp, Homo sapiens
gccagctctcattgtataggct

SEQ ID NO: 8274232 - DNA, 22 bp, Homo sapiens
gccaggcagctgggagggtgcc

SEQ ID NO: 8274233 - DNA, 22 bp, Homo sapiens
gccaggcagatatgtgagctta

SEQ ID NO: 8274234 - DNA, 22 bp, Homo sapiens
gccaggcagagccccgtgcagc

SEQ ID NO: 8274235 - DNA, 21 bp, Homo sapiens
gccagggaagagagttggctg

SEQ ID NO: 8274236 - DNA, 17 bp, Homo sapiens
gccagggagaggaagcc

SEQ ID NO: 8274237 - DNA, 22 bp, Homo sapiens
gccagggctcgcggtccctcgt

SEQ ID NO: 8274238 - DNA, 22 bp, Homo sapiens
gccagggcaggggagcatctgc

SEQ ID NO: 8274239 - DNA, 22 bp, Homo sapiens
gcagtgggaaggttggcacatg

SEQ ID NO: 8274240 - DNA, 22 bp, Homo sapiens
gcagtggcatgatgtgggctca

SEQ ID NO: 8274241 - DNA, 22 bp, Homo sapiens
gcagtggcagagacagcaccaa

SEQ ID NO: 8274242 - DNA, 22 bp, Homo sapiens
gcagtggcaccgctggctctgg

SEQ ID NO: 8274243 - DNA, 22 bp, Homo sapiens
gcagtgaatctggcaagaattt

SEQ ID NO: 8274244 - DNA, 22 bp, Homo sapiens
gcaggggagtggatgatggatt

SEQ ID NO: 8274245 - DNA, 22 bp, Homo sapiens
gccacaggcttaggagggaggt

SEQ ID NO: 8274246 - DNA, 22 bp, Homo sapiens
gccaccagggggctccagtgag

SEQ ID NO: 8274247 - DNA, 22 bp, Homo sapiens
gccaccaggagcccagtccaaa

SEQ ID NO: 8274248 - DNA, 22 bp, Homo sapiens
gccaccagccccatgcgctgtg

SEQ ID NO: 8274249 - DNA, 22 bp, Homo sapiens
gccaccagccccatgcgctgtg

SEQ ID NO: 8274250 - DNA, 22 bp, Homo sapiens
gccaccagcagaaaaggggcca

SEQ ID NO: 8274251 - DNA, 22 bp, Homo sapiens
gccaccagggggtgcaaggtcc

SEQ ID NO: 8274252 - DNA, 22 bp, Homo sapiens
gccaccaggttagatccagcct

SEQ ID NO: 8274253 - DNA, 22 bp, Homo sapiens
gccaccagtgggggcctgggca

SEQ ID NO: 8274254 - DNA, 22 bp, Homo sapiens
gccaccagtgggggcctgggca

SEQ ID NO: 8274255 - DNA, 22 bp, Homo sapiens
gccaccaggttctgggttaagc

SEQ ID NO: 8274256 - DNA, 22 bp, Homo sapiens
gccaccagtagctaacaacagt

SEQ ID NO: 8274257 - DNA, 22 bp, Homo sapiens
gcatgcatgatgttggcagtgg

SEQ ID NO: 8274258 - DNA, 22 bp, Homo sapiens
gcatgctgagcccacgcctggg

SEQ ID NO: 8274259 - DNA, 22 bp, Homo sapiens
gcatgctgcagggaatgcttgt

SEQ ID NO: 8274260 - DNA, 22 bp, Homo sapiens
gcatgctgcaccagagcctctc

SEQ ID NO: 8274261 - DNA, 22 bp, Homo sapiens
gcatggctattatgaggcagaa

SEQ ID NO: 8274262 - DNA, 20 bp, Homo sapiens
gcatggctaatctgtactga

SEQ ID NO: 8274263 - DNA, 22 bp, Homo sapiens
gcatggctcctgtcttactccc

SEQ ID NO: 8274264 - DNA, 22 bp, Homo sapiens
gcatggcttacagaggctgcag

SEQ ID NO: 8274265 - DNA, 22 bp, Homo sapiens
ggcaagaggtccaagaggtctc

SEQ ID NO: 8274266 - DNA, 22 bp, Homo sapiens
ggcaagaggtccaagaggtctc

SEQ ID NO: 8274267 - DNA, 22 bp, Homo sapiens
ggcaagatccaaggggctagga

SEQ ID NO: 8274268 - DNA, 22 bp, Homo sapiens
ggcaaaggaaaacgtctcagct

SEQ ID NO: 8274269 - DNA, 22 bp, Homo sapiens
ggcaaattgctgcaattactta

SEQ ID NO: 8274270 - DNA, 18 bp, Homo sapiens
ggcaaatgcaattcaaag

SEQ ID NO: 8274271 - DNA, 22 bp, Homo sapiens
ggcaaatgtggtggcttttctg

SEQ ID NO: 8274272 - DNA, 22 bp, Homo sapiens
ggagtgagtactggagtagctg

SEQ ID NO: 8274273 - DNA, 22 bp, Homo sapiens
ggagccagaggctgctgctgtg

SEQ ID NO: 8274274 - DNA, 19 bp, Homo sapiens
ggagccagctgtggaaggc

SEQ ID NO: 8274275 - DNA, 23 bp, Homo sapiens
ggagccagcctgtggggagcggg

SEQ ID NO: 8274276 - DNA, 22 bp, Homo sapiens
ggcaggcaatgaggatgggaag

SEQ ID NO: 8274277 - DNA, 22 bp, Homo sapiens
ggcaggcaaggcagcctggtga

SEQ ID NO: 8274278 - DNA, 22 bp, Homo sapiens
ggcaggcactgtgctaggcgct

SEQ ID NO: 8274279 - DNA, 22 bp, Homo sapiens
ggcaggcacatttgggggccgt

SEQ ID NO: 8274280 - DNA, 20 bp, Homo sapiens
ggcagagggcctgggagaag

SEQ ID NO: 8274281 - DNA, 22 bp, Homo sapiens
ggcagaggtagctggaaccagg

SEQ ID NO: 8274282 - DNA, 22 bp, Homo sapiens
ggcagaggtagctggaaccagg

SEQ ID NO: 8274283 - DNA, 22 bp, Homo sapiens
ggcaccaggatcagtctgtcat

SEQ ID NO: 8274284 - DNA, 22 bp, Homo sapiens
ggcagaggaagctggaagtggg

SEQ ID NO: 8274285 - DNA, 22 bp, Homo sapiens
ggcagaggagctggaaacatgg

SEQ ID NO: 8274286 - DNA, 17 bp, Homo sapiens
ggcaccagacggagagt

SEQ ID NO: 8274287 - DNA, 22 bp, Homo sapiens
ggcacaggagctagtcaaagcc

SEQ ID NO: 8274288 - DNA, 22 bp, Homo sapiens
ggcacaggaatctgtgaagtgc

SEQ ID NO: 8274289 - DNA, 22 bp, Homo sapiens
ggcacagctgatgcagacacac

SEQ ID NO: 8274290 - DNA, 22 bp, Homo sapiens
ggcacagccactttggagaact

SEQ ID NO: 8274291 - DNA, 22 bp, Homo sapiens
ggcacagcgactaccatcgaaa

SEQ ID NO: 8274292 - DNA, 22 bp, Homo sapiens
ggcctctgtttggagccaggat

SEQ ID NO: 8274293 - DNA, 22 bp, Homo sapiens
ggcctcttagagttaactgctt

SEQ ID NO: 8274294 - DNA, 21 bp, Homo sapiens
ggcctgagtataggacaggcc

SEQ ID NO: 8274295 - DNA, 17 bp, Homo sapiens
ggcctgcacctcctgct

SEQ ID NO: 8274296 - DNA, 22 bp, Homo sapiens
ggcctcttctgctcatactttc

SEQ ID NO: 8274297 - DNA, 22 bp, Homo sapiens
ggcctcttatctggctcctgca

SEQ ID NO: 8274298 - DNA, 22 bp, Homo sapiens
ggccttgggtataggtgggtat

SEQ ID NO: 8274299 - DNA, 22 bp, Homo sapiens
ggccttggtgccatggccagtt

SEQ ID NO: 8274300 - DNA, 22 bp, Homo sapiens
ggccttggtaaagggatgcatg

SEQ ID NO: 8274301 - DNA, 22 bp, Homo sapiens
ggccttggtaatgggggactgt

SEQ ID NO: 8274302 - DNA, 22 bp, Homo sapiens
ggccttggttccaaagcaggca

SEQ ID NO: 8274303 - DNA, 22 bp, Homo sapiens
ggcaggtggcactgctgctccc

SEQ ID NO: 8274304 - DNA, 22 bp, Homo sapiens
ggccagtgtgcaggtcagagat

SEQ ID NO: 8274305 - DNA, 22 bp, Homo sapiens
ggccatgagaatgtgcaggtcc

SEQ ID NO: 8274306 - DNA, 22 bp, Homo sapiens
ggccagtggctctgtgcttggg

SEQ ID NO: 8274307 - DNA, 22 bp, Homo sapiens
ggccacaacttgctcctagccc

SEQ ID NO: 8274308 - DNA, 22 bp, Homo sapiens
ggcatgtgcctgaggtcacaca

SEQ ID NO: 8274309 - DNA, 22 bp, Homo sapiens
ggccaaggctcttgagggctga

SEQ ID NO: 8274310 - DNA, 22 bp, Homo sapiens
ggcttctgccttgccagttctt

SEQ ID NO: 8274311 - DNA, 22 bp, Homo sapiens
ggcttctgccttgccagttctt

SEQ ID NO: 8274312 - DNA, 22 bp, Homo sapiens
ggcttctgctcagcctgcacgc

SEQ ID NO: 8274313 - DNA, 22 bp, Homo sapiens
ggcttctgagtgctctgctgtt

SEQ ID NO: 8274314 - DNA, 22 bp, Homo sapiens
ggcttctgaaatctctgtgcgt

SEQ ID NO: 8274315 - DNA, 22 bp, Homo sapiens
ggcttctgaaatctctgtgcgt

SEQ ID NO: 8274316 - DNA, 22 bp, Homo sapiens
ggctgggctgctgggtcagagc

SEQ ID NO: 8274317 - DNA, 22 bp, Homo sapiens
ggctgggctgctgggtcagagc

SEQ ID NO: 8274318 - DNA, 22 bp, Homo sapiens
ggcttctcccctttgagtcttc

SEQ ID NO: 8274319 - DNA, 22 bp, Homo sapiens
ggcttctcctggaagtacagag

SEQ ID NO: 8274320 - DNA, 22 bp, Homo sapiens
ggctgggcaggtctgcacaggg

SEQ ID NO: 8274321 - DNA, 22 bp, Homo sapiens
ggctgggctccgggagcatgcg

SEQ ID NO: 8274322 - DNA, 22 bp, Homo sapiens
ggctgggctcgctgattggctg

SEQ ID NO: 8274323 - DNA, 22 bp, Homo sapiens
ggctgggctccgggagcatgcg

SEQ ID NO: 8274324 - DNA, 22 bp, Homo sapiens
ggctgggaggccgtgctgacct

SEQ ID NO: 8274325 - DNA, 22 bp, Homo sapiens
ggctgggcaaacaagactcttc

SEQ ID NO: 8274326 - DNA, 22 bp, Homo sapiens
ggctgctggcattgaggtaggt

SEQ ID NO: 8274327 - DNA, 22 bp, Homo sapiens
ggctgctggattgtgtatctgt

SEQ ID NO: 8274328 - DNA, 22 bp, Homo sapiens
ggctgctggagttgggtctctc

SEQ ID NO: 8274329 - DNA, 22 bp, Homo sapiens
ggctgctggagttgggtctctc

SEQ ID NO: 8274330 - DNA, 22 bp, Homo sapiens
ggctgctgggaatatgccagct

SEQ ID NO: 8274331 - DNA, 22 bp, Homo sapiens
ggctgctgggaatatgccagct

SEQ ID NO: 8274332 - DNA, 22 bp, Homo sapiens
ggctgctggccagcctaggagt

SEQ ID NO: 8274333 - DNA, 22 bp, Homo sapiens
ggctgctggccagcctaggagt

SEQ ID NO: 8274334 - DNA, 22 bp, Homo sapiens
ggctgctggcctctccccggcc

SEQ ID NO: 8274335 - DNA, 22 bp, Homo sapiens
ggctgctgcccacccctgcatg

SEQ ID NO: 8274336 - DNA, 22 bp, Homo sapiens
ggctgctgacttcatccagctt

SEQ ID NO: 8274337 - DNA, 22 bp, Homo sapiens
ggctgctgagttggccaggaga

SEQ ID NO: 8274338 - DNA, 22 bp, Homo sapiens
ggctgctggaagactgaacaag

SEQ ID NO: 8274339 - DNA, 22 bp, Homo sapiens
ggctgctgctgtgtaggcctgt

SEQ ID NO: 8274340 - DNA, 22 bp, Homo sapiens
ggctgctgccctcctaagtgca

SEQ ID NO: 8274341 - DNA, 22 bp, Homo sapiens
ggctgctgcccacccctgcatg

SEQ ID NO: 8274342 - DNA, 22 bp, Homo sapiens
ggctgctgaagtgtggcaatct

SEQ ID NO: 8274343 - DNA, 19 bp, Homo sapiens
ggctgctgaagagaattac

SEQ ID NO: 8274344 - DNA, 22 bp, Homo sapiens
ggctgctgacaaacatgatcat

SEQ ID NO: 8274345 - DNA, 22 bp, Homo sapiens
ggctgctgaagtgtggcaatct

SEQ ID NO: 8274346 - DNA, 22 bp, Homo sapiens
ggctgctgacaaacatgatcat

SEQ ID NO: 8274347 - DNA, 22 bp, Homo sapiens
ggctgctgacttcatccagctt

SEQ ID NO: 8274348 - DNA, 22 bp, Homo sapiens
ggctgagcactttaggcaggag

SEQ ID NO: 8274349 - DNA, 22 bp, Homo sapiens
ggctccaggagatgctgggcag

SEQ ID NO: 8274350 - DNA, 22 bp, Homo sapiens
ggctctgctgcacccttggctc

SEQ ID NO: 8274351 - DNA, 22 bp, Homo sapiens
ggctctgctcacagcccgcagc

SEQ ID NO: 8274352 - DNA, 22 bp, Homo sapiens
ggctctgctgcaagtcttcctc

SEQ ID NO: 8274353 - DNA, 22 bp, Homo sapiens
ggctccagccctggctcttcac

SEQ ID NO: 8274354 - DNA, 22 bp, Homo sapiens
ggctccagctaatggtttctat

SEQ ID NO: 8274355 - DNA, 22 bp, Homo sapiens
ggcgggaagttcttgcccactt

SEQ ID NO: 8274356 - DNA, 22 bp, Homo sapiens
gggagaggttacccgagcaact

SEQ ID NO: 8274357 - DNA, 22 bp, Homo sapiens
gggacaggcaaaggtatgcttc

SEQ ID NO: 8274358 - DNA, 22 bp, Homo sapiens
ggcttggctgtagctttagcgc

SEQ ID NO: 8274359 - DNA, 22 bp, Homo sapiens
ggcttggctacaagccatgggc

SEQ ID NO: 8274360 - DNA, 22 bp, Homo sapiens
ggcttcttaatcatgagagtga

SEQ ID NO: 8274361 - DNA, 20 bp, Homo sapiens
ggcttgtctgagtccctggc

SEQ ID NO: 8274362 - DNA, 22 bp, Homo sapiens
gggacaggctgagacttgagct

SEQ ID NO: 8274363 - DNA, 22 bp, Homo sapiens
gggacaggcccctcgctagctt

SEQ ID NO: 8274364 - DNA, 22 bp, Homo sapiens
gggacattgtcaatggtggtag

SEQ ID NO: 8274365 - DNA, 22 bp, Homo sapiens
gggaccagaagaaggatggtga

SEQ ID NO: 8274366 - DNA, 22 bp, Homo sapiens
gggacattgagatacctccaaa

SEQ ID NO: 8274367 - DNA, 22 bp, Homo sapiens
gggcagctctttggtatccttc

SEQ ID NO: 8274368 - DNA, 22 bp, Homo sapiens
gggcagctctcacagcagccaa

SEQ ID NO: 8274369 - DNA, 22 bp, Homo sapiens
gggcagctgccagaggccatgg

SEQ ID NO: 8274370 - DNA, 22 bp, Homo sapiens
gggcagctgcagggatggtgac

SEQ ID NO: 8274371 - DNA, 22 bp, Homo sapiens
gggcagctgtatctgagcttat

SEQ ID NO: 8274372 - DNA, 22 bp, Homo sapiens
gggcagctgcccctctctgggc

SEQ ID NO: 8274373 - DNA, 20 bp, Homo sapiens
gggcaaattgctatttcttt

SEQ ID NO: 8274374 - DNA, 19 bp, Homo sapiens
gggcaaatcccttctttct

SEQ ID NO: 8274375 - DNA, 22 bp, Homo sapiens
gggcaaagtggtggaggcagtt

SEQ ID NO: 8274376 - DNA, 22 bp, Homo sapiens
gggcaagaagctggaagcattc

SEQ ID NO: 8274377 - DNA, 22 bp, Homo sapiens
gggcaaaggcagaaagcggtgt

SEQ ID NO: 8274378 - DNA, 22 bp, Homo sapiens
gggatggggagctggaaagggg

SEQ ID NO: 8274379 - DNA, 22 bp, Homo sapiens
gggatggggagctggaaagggg

SEQ ID NO: 8274380 - DNA, 22 bp, Homo sapiens
gggaggaaatgtgcagcgaatt

SEQ ID NO: 8274381 - DNA, 22 bp, Homo sapiens
gggagcttaagacagttccaat

SEQ ID NO: 8274382 - DNA, 22 bp, Homo sapiens
ggtggctctcaggcttctcgga

SEQ ID NO: 8274383 - DNA, 22 bp, Homo sapiens
ggtggctctcaggcttctcgga

SEQ ID NO: 8274384 - DNA, 22 bp, Homo sapiens
ggtgtggcagtggacctgtgaa

SEQ ID NO: 8274385 - DNA, 22 bp, Homo sapiens
ggtgttgtacattctgtggatt

SEQ ID NO: 8274386 - DNA, 22 bp, Homo sapiens
ggtggctcatttgatcttcata

SEQ ID NO: 8274387 - DNA, 22 bp, Homo sapiens
ggtctctgtttggggctggcaa

SEQ ID NO: 8274388 - DNA, 22 bp, Homo sapiens
gggtggccttcatagctcaggg

SEQ ID NO: 8274389 - DNA, 22 bp, Homo sapiens
gggtggcacaggtgcagagggt

SEQ ID NO: 8274390 - DNA, 22 bp, Homo sapiens
ggtcagaggtcacaagctggca

SEQ ID NO: 8274391 - DNA, 22 bp, Homo sapiens
ggtcagcagccatgccatgaat

SEQ ID NO: 8274392 - DNA, 22 bp, Homo sapiens
ggtccttggcgaatcattccag

SEQ ID NO: 8274393 - DNA, 22 bp, Homo sapiens
ggtcgagtcacttgttgccttt

SEQ ID NO: 8274394 - DNA, 22 bp, Homo sapiens
ggtctccaaagcttaggactac

SEQ ID NO: 8274395 - DNA, 22 bp, Homo sapiens
ggtctctctgctttcccccaga

SEQ ID NO: 8274396 - DNA, 22 bp, Homo sapiens
ggtctctgtcactgagtggccc

SEQ ID NO: 8274397 - DNA, 22 bp, Homo sapiens
ggggcggggctctgagaagcat

SEQ ID NO: 8274398 - DNA, 22 bp, Homo sapiens
ggggctgctcgccgcgcgtttc

SEQ ID NO: 8274399 - DNA, 22 bp, Homo sapiens
ggggctgctcccacccctgagg

SEQ ID NO: 8274400 - DNA, 22 bp, Homo sapiens
gggtggagcttggacaccagta

SEQ ID NO: 8274401 - DNA, 22 bp, Homo sapiens
ggggtgtggacggctgtgccag

SEQ ID NO: 8274402 - DNA, 22 bp, Homo sapiens
ggggtgggcgtgcagggacacc

SEQ ID NO: 8274403 - DNA, 22 bp, Homo sapiens
ggggtgggcgtgcagggacacc

SEQ ID NO: 8274404 - DNA, 22 bp, Homo sapiens
gggcatgttttcgtaaactcag

SEQ ID NO: 8274405 - DNA, 22 bp, Homo sapiens
gggctgagctaagctgggttga

SEQ ID NO: 8274406 - DNA, 22 bp, Homo sapiens
gggctgagagctggaatctgag

SEQ ID NO: 8274407 - DNA, 22 bp, Homo sapiens
gggctgagagctggaatctgag

SEQ ID NO: 8274408 - DNA, 22 bp, Homo sapiens
gggcttcttgagctgccggccc

SEQ ID NO: 8274409 - DNA, 22 bp, Homo sapiens
gggcttcttgcaggggcaacat

SEQ ID NO: 8274410 - DNA, 22 bp, Homo sapiens
gggcttcttgccatggggacgg

SEQ ID NO: 8274411 - DNA, 22 bp, Homo sapiens
gggcttggctggggccaccaga

SEQ ID NO: 8274412 - DNA, 22 bp, Homo sapiens
gtgaaactgctttgtaaactgt

SEQ ID NO: 8274413 - DNA, 22 bp, Homo sapiens
gtgaaatgaatctggaaatatt

SEQ ID NO: 8274414 - DNA, 22 bp, Homo sapiens
gtgaagccacagagccacgccg

SEQ ID NO: 8274415 - DNA, 22 bp, Homo sapiens
gtgaagccacagagccacgccg

SEQ ID NO: 8274416 - DNA, 22 bp, Homo sapiens
gtctgctggcacgtcacagata

SEQ ID NO: 8274417 - DNA, 22 bp, Homo sapiens
gtctgctgtgccttggggaaaa

SEQ ID NO: 8274418 - DNA, 22 bp, Homo sapiens
gtctgcccttggctcagccata

SEQ ID NO: 8274419 - DNA, 22 bp, Homo sapiens
gtctgcctgggacgctgggagt

SEQ ID NO: 8274420 - DNA, 18 bp, Homo sapiens
gtctgccttctcccttcc

SEQ ID NO: 8274421 - DNA, 22 bp, Homo sapiens
gtctgccctcacgccagctggg

SEQ ID NO: 8274422 - DNA, 22 bp, Homo sapiens
gtctgccctgcagacatgcctc

SEQ ID NO: 8274423 - DNA, 22 bp, Homo sapiens
gtctgcccgcctgcaaagtgtt

SEQ ID NO: 8274424 - DNA, 22 bp, Homo sapiens
gtgagacatcttgggaagtgat

SEQ ID NO: 8274425 - DNA, 22 bp, Homo sapiens
gtgcacagagcccagggccgcg

SEQ ID NO: 8274426 - DNA, 22 bp, Homo sapiens
gtgcagagaaatgagaagtcga

SEQ ID NO: 8274427 - DNA, 22 bp, Homo sapiens
gtgcagagaaggagcagtagtt

SEQ ID NO: 8274428 - DNA, 22 bp, Homo sapiens
gtgcagagaggtggagggactt

SEQ ID NO: 8274429 - DNA, 22 bp, Homo sapiens
gtgcagagaggaccttggggag

SEQ ID NO: 8274430 - DNA, 22 bp, Homo sapiens
gtgcacgtggctaatgacagtt

SEQ ID NO: 8274431 - DNA, 22 bp, Homo sapiens
gtgcagttgatagttttagtga

SEQ ID NO: 8274432 - DNA, 22 bp, Homo sapiens
gtgcagtgagcagtgcagcacc

SEQ ID NO: 8274433 - DNA, 22 bp, Homo sapiens
gtgcagtgaccctggagagctg

SEQ ID NO: 8274434 - DNA, 22 bp, Homo sapiens
gtgcagagtgctacattttatt

SEQ ID NO: 8274435 - DNA, 22 bp, Homo sapiens
gtgcagagtgtctgtggactga

SEQ ID NO: 8274436 - DNA, 22 bp, Homo sapiens
gtgcagaggtcacaaaagtgaa

SEQ ID NO: 8274437 - DNA, 22 bp, Homo sapiens
gtgcagagcaagggctgagggc

SEQ ID NO: 8274438 - DNA, 21 bp, Homo sapiens
gtgcagaggaatgtagggggc

SEQ ID NO: 8274439 - DNA, 16 bp, Homo sapiens
gtgcagagcaattcac

SEQ ID NO: 8274440 - DNA, 22 bp, Homo sapiens
gtgcagaggacgtggcggcctc

SEQ ID NO: 8274441 - DNA, 20 bp, Homo sapiens
gtgcagaggcagcctgtggg

SEQ ID NO: 8274442 - DNA, 22 bp, Homo sapiens
gtccagaagcagtgcacatcac

SEQ ID NO: 8274443 - DNA, 22 bp, Homo sapiens
gtcccattcatctccctaggga

SEQ ID NO: 8274444 - DNA, 22 bp, Homo sapiens
gtcccattgttctgggcttggc

SEQ ID NO: 8274445 - DNA, 22 bp, Homo sapiens
gtcccatttcaagaaattcatg

SEQ ID NO: 8274446 - DNA, 22 bp, Homo sapiens
gtcccattgctcattagctttc

SEQ ID NO: 8274447 - DNA, 22 bp, Homo sapiens
gtcccattccctgtatcttaga

SEQ ID NO: 8274448 - DNA, 22 bp, Homo sapiens
gtcccattttctactatggaat

SEQ ID NO: 8274449 - DNA, 22 bp, Homo sapiens
gtcccattttgcagatagagca

SEQ ID NO: 8274450 - DNA, 22 bp, Homo sapiens
gtccacagctctgaggtctccc

SEQ ID NO: 8274451 - DNA, 19 bp, Homo sapiens
gtatttcaggacaagacgt

SEQ ID NO: 8274452 - DNA, 22 bp, Homo sapiens
gtccaaaagagccagccgggcg

SEQ ID NO: 8274453 - DNA, 22 bp, Homo sapiens
gtccaagagggagctacagagc

SEQ ID NO: 8274454 - DNA, 22 bp, Homo sapiens
gtccctagtggaaagacatgat

SEQ ID NO: 8274455 - DNA, 22 bp, Homo sapiens
gtccctctcaaatttatatgct

SEQ ID NO: 8274456 - DNA, 22 bp, Homo sapiens
gtccctctgcctgtggttctct

SEQ ID NO: 8274457 - DNA, 22 bp, Homo sapiens
gtccctctgtgtccctgcagtc

SEQ ID NO: 8274458 - DNA, 22 bp, Homo sapiens
gtccctctgggccatcaggtcc

SEQ ID NO: 8274459 - DNA, 22 bp, Homo sapiens
gtccctctgggccatcaggtcc

SEQ ID NO: 8274460 - DNA, 22 bp, Homo sapiens
gtccctctgctctagagagcca

SEQ ID NO: 8274461 - DNA, 22 bp, Homo sapiens
gtccctgacacccgggtggagg

SEQ ID NO: 8274462 - DNA, 22 bp, Homo sapiens
gtccctctgtgtccctgcagtc

SEQ ID NO: 8274463 - DNA, 22 bp, Homo sapiens
gtcccctcaaaattcatatgtt

SEQ ID NO: 8274464 - DNA, 21 bp, Homo sapiens
gtattgcagagttatgtgctc

SEQ ID NO: 8274465 - DNA, 22 bp, Homo sapiens
gtattgcattttaatatgtgca

SEQ ID NO: 8274466 - DNA, 22 bp, Homo sapiens
gtatttaattctgtgcttctag

SEQ ID NO: 8274467 - DNA, 22 bp, Homo sapiens
gtattgtatatttgcaaataca

SEQ ID NO: 8274468 - DNA, 22 bp, Homo sapiens
gtattgtatttatttatgtgac

SEQ ID NO: 8274469 - DNA, 22 bp, Homo sapiens
gtattcacatggtggtagattg

SEQ ID NO: 8274470 - DNA, 22 bp, Homo sapiens
gtattcacctaaatgtagtttg

SEQ ID NO: 8274471 - DNA, 22 bp, Homo sapiens
gtacattttgaggttaaaacaa

SEQ ID NO: 8274472 - DNA, 22 bp, Homo sapiens
gtacccaggcacgccttgctga

SEQ ID NO: 8274473 - DNA, 22 bp, Homo sapiens
gtacccagtgattccttcttca

SEQ ID NO: 8274474 - DNA, 22 bp, Homo sapiens
gtacatttctcccaacactaaa

SEQ ID NO: 8274475 - DNA, 22 bp, Homo sapiens
gtacatttctcttgttcttatt

SEQ ID NO: 8274476 - DNA, 20 bp, Homo sapiens
gtacattttcaggaggggat

SEQ ID NO: 8274477 - DNA, 22 bp, Homo sapiens
gtacattttactttgtttgaat

SEQ ID NO: 8274478 - DNA, 22 bp, Homo sapiens
gtacatttaggattcattgaaa

SEQ ID NO: 8274479 - DNA, 22 bp, Homo sapiens
gtacatttcagtttccttaaga

SEQ ID NO: 8274480 - DNA, 22 bp, Homo sapiens
gtacatttatttttgcagcata

SEQ ID NO: 8274481 - DNA, 22 bp, Homo sapiens
gtacatttcatttaaatgatgt

SEQ ID NO: 8274482 - DNA, 22 bp, Homo sapiens
ggttttggctagaaatgcttaa

SEQ ID NO: 8274483 - DNA, 18 bp, Homo sapiens
ggttttggcatgtgtgcc

SEQ ID NO: 8274484 - DNA, 22 bp, Homo sapiens
ggttttggagcatggagagcct

SEQ ID NO: 8274485 - DNA, 22 bp, Homo sapiens
ggttttggaagtgtgtctgcag

SEQ ID NO: 8274486 - DNA, 22 bp, Homo sapiens
ggtttgacagcttggggctgtc

SEQ ID NO: 8274487 - DNA, 22 bp, Homo sapiens
ggtttctctgggtgtgggtgct

SEQ ID NO: 8274488 - DNA, 22 bp, Homo sapiens
cttgtattgcaaactggccagg

SEQ ID NO: 8274489 - DNA, 22 bp, Homo sapiens
cttgtattgctgttttgcatct

SEQ ID NO: 8274490 - DNA, 22 bp, Homo sapiens
cttgtattcttccacttaagat

SEQ ID NO: 8274491 - DNA, 22 bp, Homo sapiens
cttgtattctgcctaaccttca

SEQ ID NO: 8274492 - DNA, 22 bp, Homo sapiens
cttgtattcagcatcttaacta

SEQ ID NO: 8274493 - DNA, 22 bp, Homo sapiens
cttgtcttgcacacggttgcca

SEQ ID NO: 8274494 - DNA, 22 bp, Homo sapiens
cttgtagaattgaaatggtctc

SEQ ID NO: 8274495 - DNA, 22 bp, Homo sapiens
cttgtacactcagtacttctag

SEQ ID NO: 8274496 - DNA, 20 bp, Homo sapiens
cttgcccagggtctcctgcc

SEQ ID NO: 8274497 - DNA, 22 bp, Homo sapiens
cttgatctacatagtgaaaccc

SEQ ID NO: 8274498 - DNA, 22 bp, Homo sapiens
cttgatttcagccttgtgatat

SEQ ID NO: 8274499 - DNA, 22 bp, Homo sapiens
cttgcacacgtgtatgtacatg

SEQ ID NO: 8274500 - DNA, 22 bp, Homo sapiens
cttgcacaggatctgaagtggg

SEQ ID NO: 8274501 - DNA, 22 bp, Homo sapiens
cttgcacaaagtcacctagtca

SEQ ID NO: 8274502 - DNA, 23 bp, Homo sapiens
cttgcaggaagcagatggcacac

SEQ ID NO: 8274503 - DNA, 22 bp, Homo sapiens
cttgcacatgttttactctcca

SEQ ID NO: 8274504 - DNA, 22 bp, Homo sapiens
cttgcacatttcacacaatagg

SEQ ID NO: 8274505 - DNA, 22 bp, Homo sapiens
cttcctggcaaagcaatcagag

SEQ ID NO: 8274506 - DNA, 22 bp, Homo sapiens
cttcctgaggtgctgagcacag

SEQ ID NO: 8274507 - DNA, 18 bp, Homo sapiens
cttcctgactagctctgg

SEQ ID NO: 8274508 - DNA, 22 bp, Homo sapiens
cttcctgggccctgcttaagca

SEQ ID NO: 8274509 - DNA, 22 bp, Homo sapiens
cttcctgggcaatgttctgctt

SEQ ID NO: 8274510 - DNA, 22 bp, Homo sapiens
cttcctggctcggtgcctcacc

SEQ ID NO: 8274511 - DNA, 22 bp, Homo sapiens
cttgacacaatgaacatctgta

SEQ ID NO: 8274512 - DNA, 22 bp, Homo sapiens
cttcagaagagttaagtgtgag

SEQ ID NO: 8274513 - DNA, 22 bp, Homo sapiens
ctgttgtgaaatgtccatcaac

SEQ ID NO: 8274514 - DNA, 17 bp, Homo sapiens
ctgttggttggaaaatt

SEQ ID NO: 8274515 - DNA, 22 bp, Homo sapiens
ctgttggtgttgattaaatagt

SEQ ID NO: 8274516 - DNA, 22 bp, Homo sapiens
cttcagtgacattccttccctc

SEQ ID NO: 8274517 - DNA, 22 bp, Homo sapiens
cttcctgaacaatgccatcaat

SEQ ID NO: 8274518 - DNA, 22 bp, Homo sapiens
cttcctctgtggccagagtgta

SEQ ID NO: 8274519 - DNA, 22 bp, Homo sapiens
cttcagtggtcatttgtgataa

SEQ ID NO: 8274520 - DNA, 22 bp, Homo sapiens
cttcctctgcctcccgtgctca

SEQ ID NO: 8274521 - DNA, 22 bp, Homo sapiens
cttcctctgcctcccgtgctca

SEQ ID NO: 8274522 - DNA, 22 bp, Homo sapiens
cttccgtaagagagggagatga

SEQ ID NO: 8274523 - DNA, 22 bp, Homo sapiens
ctgggtgattcctgtccaggca

SEQ ID NO: 8274524 - DNA, 22 bp, Homo sapiens
ctgggtgagttgatgaaggaga

SEQ ID NO: 8274525 - DNA, 23 bp, Homo sapiens
ctgtcctgccatccacagcggcc

SEQ ID NO: 8274526 - DNA, 22 bp, Homo sapiens
ctgtgagtcttcagcaagtgtt

SEQ ID NO: 8274527 - DNA, 22 bp, Homo sapiens
ctgtgcagtggcagcgtgtggg

SEQ ID NO: 8274528 - DNA, 22 bp, Homo sapiens
ctgtgccactgccccaggcctc

SEQ ID NO: 8274529 - DNA, 22 bp, Homo sapiens
ctgtgccctctttgctggcctt

SEQ ID NO: 8274530 - DNA, 19 bp, Homo sapiens
ctgtgccctatgacttgta

SEQ ID NO: 8274531 - DNA, 22 bp, Homo sapiens
ctgtgcccataatctggtattt

SEQ ID NO: 8274532 - DNA, 22 bp, Homo sapiens
ctgtggccagagcgccgttgac

SEQ ID NO: 8274533 - DNA, 22 bp, Homo sapiens
ctgtggccagtcccacacctcc

SEQ ID NO: 8274534 - DNA, 22 bp, Homo sapiens
ctgtgcccacctggctctgagg

SEQ ID NO: 8274535 - DNA, 22 bp, Homo sapiens
ctgtgcccagctccctgactgc

SEQ ID NO: 8274536 - DNA, 22 bp, Homo sapiens
ctgttgctccagggaacacaga

SEQ ID NO: 8274537 - DNA, 22 bp, Homo sapiens
ctgttcagatggcacattcagt

SEQ ID NO: 8274538 - DNA, 22 bp, Homo sapiens
ctgttcagaaaaaatcttcatg

SEQ ID NO: 8274539 - DNA, 22 bp, Homo sapiens
ctgttcagcgttggcgttaggg

SEQ ID NO: 8274540 - DNA, 18 bp, Homo sapiens
ctgttcagctgaactaca

SEQ ID NO: 8274541 - DNA, 22 bp, Homo sapiens
ctgttctccggccagtccagag

SEQ ID NO: 8274542 - DNA, 22 bp, Homo sapiens
ctgttctctggcggtggctgtt

SEQ ID NO: 8274543 - DNA, 22 bp, Homo sapiens
ctgtgtcttcaatgtactggga

SEQ ID NO: 8274544 - DNA, 22 bp, Homo sapiens
ctgttacaagagagagacatga

SEQ ID NO: 8274545 - DNA, 22 bp, Homo sapiens
ctgttaattgtgaattttacat

SEQ ID NO: 8274546 - DNA, 17 bp, Homo sapiens
ctgttaattcatttccc

SEQ ID NO: 8274547 - DNA, 23 bp, Homo sapiens
ctgttaaattccttaagagcagg

SEQ ID NO: 8274548 - DNA, 22 bp, Homo sapiens
ctgtgtctaatcaggtcagtca

SEQ ID NO: 8274549 - DNA, 22 bp, Homo sapiens
ctgtgtcctgtctcctaaggtg

SEQ ID NO: 8274550 - DNA, 22 bp, Homo sapiens
ctgtgtctaatcaggtcagtca

SEQ ID NO: 8274551 - DNA, 22 bp, Homo sapiens
ctgtggctgtctctttcccatg

SEQ ID NO: 8274552 - DNA, 22 bp, Homo sapiens
ctgtggctctgcagtcccaaca

SEQ ID NO: 8274553 - DNA, 22 bp, Homo sapiens
ctgccacttactaggcatggtg

SEQ ID NO: 8274554 - DNA, 22 bp, Homo sapiens
ctgccacaagctggccctgtgt

SEQ ID NO: 8274555 - DNA, 22 bp, Homo sapiens
ctggccagcctcccaggtaccc

SEQ ID NO: 8274556 - DNA, 22 bp, Homo sapiens
ctggccagcatggctgaagtac

SEQ ID NO: 8274557 - DNA, 22 bp, Homo sapiens
ctggccagagttggagggtgtg

SEQ ID NO: 8274558 - DNA, 22 bp, Homo sapiens
ctggccagctgacagcagggct

SEQ ID NO: 8274559 - DNA, 22 bp, Homo sapiens
ctggccagctgacagcagggct

SEQ ID NO: 8274560 - DNA, 22 bp, Homo sapiens
ctggctggagcaggcatcttgt

SEQ ID NO: 8274561 - DNA, 22 bp, Homo sapiens
ctggctggacttgtgcatgtca

SEQ ID NO: 8274562 - DNA, 22 bp, Homo sapiens
ctggctggaagttagagaactt

SEQ ID NO: 8274563 - DNA, 22 bp, Homo sapiens
ctggctggagaaatgaaattct

SEQ ID NO: 8274564 - DNA, 16 bp, Homo sapiens
ctggctggaagcctgg

SEQ ID NO: 8274565 - DNA, 22 bp, Homo sapiens
ctggctggaacgccgaggcggc

SEQ ID NO: 8274566 - DNA, 20 bp, Homo sapiens
ctggctggaaacttagcctt

SEQ ID NO: 8274567 - DNA, 22 bp, Homo sapiens
ctggctcatgtgatgagggcaa

SEQ ID NO: 8274568 - DNA, 22 bp, Homo sapiens
ctggctcagacagctgtgcagt

SEQ ID NO: 8274569 - DNA, 22 bp, Homo sapiens
ctggctcacctccgctccagca

SEQ ID NO: 8274570 - DNA, 22 bp, Homo sapiens
ctggccaggccccttgcagggc

SEQ ID NO: 8274571 - DNA, 19 bp, Homo sapiens
ctggccaggccaggggccc

SEQ ID NO: 8274572 - DNA, 22 bp, Homo sapiens
ctgggaggcagaggttgcagtg

SEQ ID NO: 8274573 - DNA, 22 bp, Homo sapiens
ctggcttgcagctcatcataaa

SEQ ID NO: 8274574 - DNA, 22 bp, Homo sapiens
ctggctttgaaatgcatttcag

SEQ ID NO: 8274575 - DNA, 22 bp, Homo sapiens
ctggcttttcaaactgttcagt

SEQ ID NO: 8274576 - DNA, 22 bp, Homo sapiens
ctggcttttggaaacaggctca

SEQ ID NO: 8274577 - DNA, 22 bp, Homo sapiens
ctgggaacgtgcttagctgact

SEQ ID NO: 8274578 - DNA, 22 bp, Homo sapiens
ctgggaacaggcactgctgtca

SEQ ID NO: 8274579 - DNA, 22 bp, Homo sapiens
ctgggctgcttgctgaaggggt

SEQ ID NO: 8274580 - DNA, 20 bp, Homo sapiens
ctggggagctgctcccacga

SEQ ID NO: 8274581 - DNA, 22 bp, Homo sapiens
ctgggctgcggttctctgaagc

SEQ ID NO: 8274582 - DNA, 22 bp, Homo sapiens
ctgggctgccaggtaggcacac

SEQ ID NO: 8274583 - DNA, 22 bp, Homo sapiens
ctggggcattgggagaggcctg

SEQ ID NO: 8274584 - DNA, 22 bp, Homo sapiens
ctgggtctggaggccaagggtg

SEQ ID NO: 8274585 - DNA, 22 bp, Homo sapiens
ctggggctgcggtggaggagcc

SEQ ID NO: 8274586 - DNA, 22 bp, Homo sapiens
ctggggctgcagcgatcttcat

SEQ ID NO: 8274587 - DNA, 22 bp, Homo sapiens
gaagccaggggcctgacaggca

SEQ ID NO: 8274588 - DNA, 22 bp, Homo sapiens
gaagccagattatcacaagcca

SEQ ID NO: 8274589 - DNA, 22 bp, Homo sapiens
gaagccagattatcacaagcca

SEQ ID NO: 8274590 - DNA, 22 bp, Homo sapiens
gaagcaaaatgtctgcacatat

SEQ ID NO: 8274591 - DNA, 22 bp, Homo sapiens
gaagcaaaatgtctgcacatat

SEQ ID NO: 8274592 - DNA, 22 bp, Homo sapiens
gaagatgggaatgatgagtggg

SEQ ID NO: 8274593 - DNA, 22 bp, Homo sapiens
gaagattgaaggctgggaatta

SEQ ID NO: 8274594 - DNA, 22 bp, Homo sapiens
gaagagaagcatcaataggtaa

SEQ ID NO: 8274595 - DNA, 22 bp, Homo sapiens
gaagagaagcatcaataggtaa

SEQ ID NO: 8274596 - DNA, 22 bp, Homo sapiens
gaagagaaaggcaaggagtttt

SEQ ID NO: 8274597 - DNA, 22 bp, Homo sapiens
gaagaggactgtggcatcctag

SEQ ID NO: 8274598 - DNA, 22 bp, Homo sapiens
gaacagggttgggtgagagagg

SEQ ID NO: 8274599 - DNA, 22 bp, Homo sapiens
gaacagggttgggtgagagagg

SEQ ID NO: 8274600 - DNA, 22 bp, Homo sapiens
gaaatatttctcttgagcccct

SEQ ID NO: 8274601 - DNA, 22 bp, Homo sapiens
ctttcattcttagatattagtg

SEQ ID NO: 8274602 - DNA, 22 bp, Homo sapiens
ctttcacagccttcgttctgaa

SEQ ID NO: 8274603 - DNA, 22 bp, Homo sapiens
ctttcacagtcctgactgagcg

SEQ ID NO: 8274604 - DNA, 22 bp, Homo sapiens
ctttcacagtcatatgatgaat

SEQ ID NO: 8274605 - DNA, 22 bp, Homo sapiens
ctttatgtgctgggcattaagg

SEQ ID NO: 8274606 - DNA, 22 bp, Homo sapiens
ctttcacaagatttgagatgct

SEQ ID NO: 8274607 - DNA, 22 bp, Homo sapiens
gaatatctgtctggttgaggaa

SEQ ID NO: 8274608 - DNA, 22 bp, Homo sapiens
gaatatctgggagtgggaagct

SEQ ID NO: 8274609 - DNA, 22 bp, Homo sapiens
gacaacaggcagacgtcagaaa

SEQ ID NO: 8274610 - DNA, 22 bp, Homo sapiens
gaatacaagcctgccacctgga

SEQ ID NO: 8274611 - DNA, 22 bp, Homo sapiens
gaaggaagattctgttggaatc

SEQ ID NO: 8274612 - DNA, 22 bp, Homo sapiens
gacagtaagaccttaccagcct

SEQ ID NO: 8274613 - DNA, 22 bp, Homo sapiens
gacagtaagagtgtctgggttc

SEQ ID NO: 8274614 - DNA, 22 bp, Homo sapiens
gacagtaactgagagatgtaat

SEQ ID NO: 8274615 - DNA, 22 bp, Homo sapiens
gacagtagtaaagctaggacca

SEQ ID NO: 8274616 - DNA, 22 bp, Homo sapiens
gacagtaagtcagagacttggt

SEQ ID NO: 8274617 - DNA, 22 bp, Homo sapiens
gacagtaaggtggcttcttctt

SEQ ID NO: 8274618 - DNA, 22 bp, Homo sapiens
gaccctgtttctacaaataatt

SEQ ID NO: 8274619 - DNA, 22 bp, Homo sapiens
gacaggtgctaagggacctggc

SEQ ID NO: 8274620 - DNA, 20 bp, Homo sapiens
gacaggtgctaaagaggggc

SEQ ID NO: 8274621 - DNA, 22 bp, Homo sapiens
gacaggtgggtacctttatgga

SEQ ID NO: 8274622 - DNA, 18 bp, Homo sapiens
gacaggtgggtgagacca

SEQ ID NO: 8274623 - DNA, 22 bp, Homo sapiens
gacaggtggggaaactaaggta

SEQ ID NO: 8274624 - DNA, 22 bp, Homo sapiens
gacaggtgtgatgatttaggct

SEQ ID NO: 8274625 - DNA, 22 bp, Homo sapiens
gacaggtgggttctcgtatctg

SEQ ID NO: 8274626 - DNA, 22 bp, Homo sapiens
gacaggtgggttctcgtatctg

SEQ ID NO: 8274627 - DNA, 18 bp, Homo sapiens
gacaggtgggtgagacca

SEQ ID NO: 8274628 - DNA, 22 bp, Homo sapiens
gacaggtgtgtgtatattaggg

SEQ ID NO: 8274629 - DNA, 18 bp, Homo sapiens
gacagtaaacttccccat

SEQ ID NO: 8274630 - DNA, 22 bp, Homo sapiens
gacagtaaatgcagtctagcac

SEQ ID NO: 8274631 - DNA, 22 bp, Homo sapiens
gacagtaactacagttctgtgg

SEQ ID NO: 8274632 - DNA, 22 bp, Homo sapiens
gacaggtgaaacagcaaggtaa

SEQ ID NO: 8274633 - DNA, 22 bp, Homo sapiens
gacaggtgaaacagcaaggtaa

SEQ ID NO: 8274634 - DNA, 22 bp, Homo sapiens
gacaggtatttgagagctggga

SEQ ID NO: 8274635 - DNA, 22 bp, Homo sapiens
gacaggtactatgtgcagacac

SEQ ID NO: 8274636 - DNA, 22 bp, Homo sapiens
gacaggtgagatgaggaacacc

SEQ ID NO: 8274637 - DNA, 21 bp, Homo sapiens
gacaggtgattcagagcaggg

SEQ ID NO: 8274638 - DNA, 22 bp, Homo sapiens
gacaggtaccggtcagactacg

SEQ ID NO: 8274639 - DNA, 23 bp, Homo sapiens
gacaggtaagggttgggagaatc

SEQ ID NO: 8274640 - DNA, 22 bp, Homo sapiens
gacaggtaaagatggtggcagg

SEQ ID NO: 8274641 - DNA, 22 bp, Homo sapiens
gacaggtaaagtactgggtttt

SEQ ID NO: 8274642 - DNA, 22 bp, Homo sapiens
gacaggctaggttgctgtcctc

SEQ ID NO: 8274643 - DNA, 22 bp, Homo sapiens
gacacagaatgggtgctcagta

SEQ ID NO: 8274644 - DNA, 22 bp, Homo sapiens
gacaaggcaaccagggaggctt

SEQ ID NO: 8274645 - DNA, 22 bp, Homo sapiens
gacaaggaaattactagctgga

SEQ ID NO: 8274646 - DNA, 22 bp, Homo sapiens
gacaagtcatctggggcctgtg

SEQ ID NO: 8274647 - DNA, 22 bp, Homo sapiens
gacagggacacagccagtgagg

SEQ ID NO: 8274648 - DNA, 23 bp, Homo sapiens
gacagggctgacttggcagctgc

SEQ ID NO: 8274649 - DNA, 17 bp, Homo sapiens
gacaggctcagtgacga

SEQ ID NO: 8274650 - DNA, 22 bp, Homo sapiens
gacaggcttcatcctcagagtt

SEQ ID NO: 8274651 - DNA, 22 bp, Homo sapiens
gacaggcttcatcctcagagtt

SEQ ID NO: 8274652 - DNA, 22 bp, Homo sapiens
gacaggctttgagtcccagaac

SEQ ID NO: 8274653 - DNA, 22 bp, Homo sapiens
gacaggctttctcaggatgagc

SEQ ID NO: 8274654 - DNA, 22 bp, Homo sapiens
gacagggaaacattgaagtgtc

SEQ ID NO: 8274655 - DNA, 22 bp, Homo sapiens
gaggcagaagttgcagtgagca

SEQ ID NO: 8274656 - DNA, 22 bp, Homo sapiens
gaggcaccagacatggcctcat

SEQ ID NO: 8274657 - DNA, 22 bp, Homo sapiens
gaggcagaggttgcagtgagct

SEQ ID NO: 8274658 - DNA, 22 bp, Homo sapiens
gaggccagcccctcttgaaggc

SEQ ID NO: 8274659 - DNA, 22 bp, Homo sapiens
gaggccagctagtccaggaagt

SEQ ID NO: 8274660 - DNA, 19 bp, Homo sapiens
gaggaggaaaactagtgta

SEQ ID NO: 8274661 - DNA, 22 bp, Homo sapiens
gaggaggaaaccctgttcctct

SEQ ID NO: 8274662 - DNA, 22 bp, Homo sapiens
gaggaggaagttctctgtaggc

SEQ ID NO: 8274663 - DNA, 22 bp, Homo sapiens
gaggaggaggaagtggaaccca

SEQ ID NO: 8274664 - DNA, 22 bp, Homo sapiens
gaggaggaggaagtggaaccca

SEQ ID NO: 8274665 - DNA, 22 bp, Homo sapiens
gaggaaaatattcagggaggtt

SEQ ID NO: 8274666 - DNA, 22 bp, Homo sapiens
gaggaaaataacaactaagggc

SEQ ID NO: 8274667 - DNA, 20 bp, Homo sapiens
gaggaaaagctgccaggcct

SEQ ID NO: 8274668 - DNA, 22 bp, Homo sapiens
gagcctcgtggcggccactgcg

SEQ ID NO: 8274669 - DNA, 22 bp, Homo sapiens
gagccaggtttgaatctcagtc

SEQ ID NO: 8274670 - DNA, 22 bp, Homo sapiens
gagctctctggggagatgggat

SEQ ID NO: 8274671 - DNA, 22 bp, Homo sapiens
gagctattgattactgaatcaa

SEQ ID NO: 8274672 - DNA, 22 bp, Homo sapiens
gagctaggttgagactcactta

SEQ ID NO: 8274673 - DNA, 22 bp, Homo sapiens
gagctaggggtagtcaggagac

SEQ ID NO: 8274674 - DNA, 22 bp, Homo sapiens
gagctaggctagggggagtcgc

SEQ ID NO: 8274675 - DNA, 22 bp, Homo sapiens
gagctaggatatcatgagggta

SEQ ID NO: 8274676 - DNA, 22 bp, Homo sapiens
gagcgggggctgccgggatttg

SEQ ID NO: 8274677 - DNA, 22 bp, Homo sapiens
gagctgaattgaagcaaggagc

SEQ ID NO: 8274678 - DNA, 22 bp, Homo sapiens
gagcttcagctgccatgactgt

SEQ ID NO: 8274679 - DNA, 22 bp, Homo sapiens
gagcttcatgattgctttgctt

SEQ ID NO: 8274680 - DNA, 22 bp, Homo sapiens
gagcttccagagacatcagagt

SEQ ID NO: 8274681 - DNA, 22 bp, Homo sapiens
gagcttggcagtgtcactaggg

SEQ ID NO: 8274682 - DNA, 22 bp, Homo sapiens
gagcttggatgtcttttgttca

SEQ ID NO: 8274683 - DNA, 22 bp, Homo sapiens
gagcttggacaagctctgaagg

SEQ ID NO: 8274684 - DNA, 22 bp, Homo sapiens
gagcttggcctcttgaacgtgg

SEQ ID NO: 8274685 - DNA, 18 bp, Homo sapiens
gagcttgaaatggctttt

SEQ ID NO: 8274686 - DNA, 22 bp, Homo sapiens
gagaaggatgtggctcatagct

SEQ ID NO: 8274687 - DNA, 22 bp, Homo sapiens
gagaagggatatggcttcttga

SEQ ID NO: 8274688 - DNA, 22 bp, Homo sapiens
gagaatctgggttttggctatc

SEQ ID NO: 8274689 - DNA, 22 bp, Homo sapiens
gacctctgttggacccctgggg

SEQ ID NO: 8274690 - DNA, 22 bp, Homo sapiens
gagaaggactacacatctggcc

SEQ ID NO: 8274691 - DNA, 22 bp, Homo sapiens
gagaaggaggcgaagcgtgtgc

SEQ ID NO: 8274692 - DNA, 22 bp, Homo sapiens
gagaaggaggcgaagcgtgtgc

SEQ ID NO: 8274693 - DNA, 22 bp, Homo sapiens
gagaaggaggcgaagcgtgtgc

SEQ ID NO: 8274694 - DNA, 22 bp, Homo sapiens
gagaaggagctccttggggtct

SEQ ID NO: 8274695 - DNA, 22 bp, Homo sapiens
gagaaggagctcaaatatggct

SEQ ID NO: 8274696 - DNA, 22 bp, Homo sapiens
gagaaggatgaggaaatggtat

SEQ ID NO: 8274697 - DNA, 22 bp, Homo sapiens
gagaaggagtagctgacctggg

SEQ ID NO: 8274698 - DNA, 22 bp, Homo sapiens
gagaggccaaaatccctgcccc

SEQ ID NO: 8274699 - DNA, 22 bp, Homo sapiens
gagacacaaacatttattccac

SEQ ID NO: 8274700 - DNA, 22 bp, Homo sapiens
gagacacaaacacatttagagg

SEQ ID NO: 8274701 - DNA, 22 bp, Homo sapiens
gagacacaaacacatttagagg

SEQ ID NO: 8274702 - DNA, 18 bp, Homo sapiens
gagaggcccggctgtgcc

SEQ ID NO: 8274703 - DNA, 22 bp, Homo sapiens
gagaggccggcgtcgctgcggc

SEQ ID NO: 8274704 - DNA, 22 bp, Homo sapiens
gagaggccctgtggtcccagct

SEQ ID NO: 8274705 - DNA, 21 bp, Homo sapiens
gagaggcctgggcccgtgagc

SEQ ID NO: 8274706 - DNA, 22 bp, Homo sapiens
gagaggcttaagggctgtgaag

SEQ ID NO: 8274707 - DNA, 22 bp, Homo sapiens
gagaggctggtaaagtctgaac

SEQ ID NO: 8274708 - DNA, 22 bp, Homo sapiens
gagattctgtagtcaggcatct

SEQ ID NO: 8274709 - DNA, 22 bp, Homo sapiens
gagccaggggtcagctccgagg

SEQ ID NO: 8274710 - DNA, 22 bp, Homo sapiens
gagccaggggtcagctccgagg

SEQ ID NO: 8274711 - DNA, 22 bp, Homo sapiens
gagccaggtcgggccgcggcga

SEQ ID NO: 8274712 - DNA, 22 bp, Homo sapiens
gagccaggttggaggctgcagt

SEQ ID NO: 8274713 - DNA, 22 bp, Homo sapiens
gagccagattttatgcaagaca

SEQ ID NO: 8274714 - DNA, 22 bp, Homo sapiens
gagccagacaggctagagcggg

SEQ ID NO: 8274715 - DNA, 22 bp, Homo sapiens
gagccagactgcctgaagctca

SEQ ID NO: 8274716 - DNA, 22 bp, Homo sapiens
gagccagagatccaggatggct

SEQ ID NO: 8274717 - DNA, 22 bp, Homo sapiens
gagccaaatgtgcagacattgt

SEQ ID NO: 8274718 - DNA, 22 bp, Homo sapiens
cgtaccagcataaactgaaggt

SEQ ID NO: 8274719 - DNA, 22 bp, Homo sapiens
cgtatttagaaggctgctgaaa

SEQ ID NO: 8274720 - DNA, 22 bp, Homo sapiens
ttcatcttgatggcttcctaat

SEQ ID NO: 8274721 - DNA, 22 bp, Homo sapiens
ctaaataatccctctggtctta

SEQ ID NO: 8274722 - DNA, 22 bp, Homo sapiens
ctaaagaagctagcaatctata

SEQ ID NO: 8274723 - DNA, 22 bp, Homo sapiens
ttcatgaatgttccatgtgagt

SEQ ID NO: 8274724 - DNA, 22 bp, Homo sapiens
ttcacaccaggtatttatattt

SEQ ID NO: 8274725 - DNA, 22 bp, Homo sapiens
ttcacagaattgtcttgactgg

SEQ ID NO: 8274726 - DNA, 20 bp, Homo sapiens
ttcagaggtgaagttgtggt

SEQ ID NO: 8274727 - DNA, 22 bp, Homo sapiens
ttcagataaactacaaataatt

SEQ ID NO: 8274728 - DNA, 22 bp, Homo sapiens
ttcagcaaaatatctcagatag

SEQ ID NO: 8274729 - DNA, 22 bp, Homo sapiens
ttaggctgttcttgtgttgtta

SEQ ID NO: 8274730 - DNA, 22 bp, Homo sapiens
ttaggctgttcttgtgttgtta

SEQ ID NO: 8274731 - DNA, 22 bp, Homo sapiens
ttaggaatcaaattccgaaagg

SEQ ID NO: 8274732 - DNA, 17 bp, Homo sapiens
cctttctctttcatctc

SEQ ID NO: 8274733 - DNA, 22 bp, Homo sapiens
ttcaagtttactttgaagttta

SEQ ID NO: 8274734 - DNA, 22 bp, Homo sapiens
ttcaagtttgcatgcccaagca

SEQ ID NO: 8274735 - DNA, 22 bp, Homo sapiens
ttcaagttgtgttttccgggct

SEQ ID NO: 8274736 - DNA, 22 bp, Homo sapiens
ttcaagtttcgcaaggacatat

SEQ ID NO: 8274737 - DNA, 22 bp, Homo sapiens
ttcaagtttgtatttctgtatt

SEQ ID NO: 8274738 - DNA, 22 bp, Homo sapiens
ttcaagtttgtatttctgtatt

SEQ ID NO: 8274739 - DNA, 22 bp, Homo sapiens
ttcaagtttgcatgcccaagca

SEQ ID NO: 8274740 - DNA, 22 bp, Homo sapiens
ttcaagttttatattgaagcaa

SEQ ID NO: 8274741 - DNA, 22 bp, Homo sapiens
ttcaagttttcagaatagccac

SEQ ID NO: 8274742 - DNA, 22 bp, Homo sapiens
ttcaagtttttaaaggcagtta

SEQ ID NO: 8274743 - DNA, 22 bp, Homo sapiens
ttcaagttttgcctccccatcc

SEQ ID NO: 8274744 - DNA, 22 bp, Homo sapiens
ttcaagttttgcctccccatcc

SEQ ID NO: 8274745 - DNA, 22 bp, Homo sapiens
ttcaagttttatatccatggct

SEQ ID NO: 8274746 - DNA, 22 bp, Homo sapiens
ttcaagttttcagaatagccac

SEQ ID NO: 8274747 - DNA, 22 bp, Homo sapiens
ttcaagttctagtgttcacttc

SEQ ID NO: 8274748 - DNA, 22 bp, Homo sapiens
ttcaagttctagtgttcacttc

SEQ ID NO: 8274749 - DNA, 22 bp, Homo sapiens
ttcaagttctgtggagagctgt

SEQ ID NO: 8274750 - DNA, 22 bp, Homo sapiens
ttcaagttctgtggagagctgt

SEQ ID NO: 8274751 - DNA, 20 bp, Homo sapiens
ttcaagttgggtctctggct

SEQ ID NO: 8274752 - DNA, 22 bp, Homo sapiens
ttcaagttagagatatatttag

SEQ ID NO: 8274753 - DNA, 22 bp, Homo sapiens
ttcaagttaatgattctggttt

SEQ ID NO: 8274754 - DNA, 22 bp, Homo sapiens
ttcaagttagagatatatttag

SEQ ID NO: 8274755 - DNA, 22 bp, Homo sapiens
ttcaagttcatgtgtagtcagt

SEQ ID NO: 8274756 - DNA, 22 bp, Homo sapiens
ttcaagttaactctccttgtac

SEQ ID NO: 8274757 - DNA, 22 bp, Homo sapiens
ttcaagttacctttaaacagct

SEQ ID NO: 8274758 - DNA, 22 bp, Homo sapiens
ttcaagttacctttaaacagct

SEQ ID NO: 8274759 - DNA, 22 bp, Homo sapiens
ttcaagttttgacttagtcctt

SEQ ID NO: 8274760 - DNA, 22 bp, Homo sapiens
ctagcacagtatggtatcagat

SEQ ID NO: 8274761 - DNA, 22 bp, Homo sapiens
ctagcagggattgggcactggg

SEQ ID NO: 8274762 - DNA, 22 bp, Homo sapiens
ctagcaggtcaaaccagctgat

SEQ ID NO: 8274763 - DNA, 22 bp, Homo sapiens
ctatgtaccatgcctgatgtta

SEQ ID NO: 8274764 - DNA, 22 bp, Homo sapiens
ctatgtactggattagctccca

SEQ ID NO: 8274765 - DNA, 22 bp, Homo sapiens
ctcacacttcccaccctcctgg

SEQ ID NO: 8274766 - DNA, 22 bp, Homo sapiens
ctcacagagcctctgtgtcttc

SEQ ID NO: 8274767 - DNA, 22 bp, Homo sapiens
ctcacagagctcatactgggag

SEQ ID NO: 8274768 - DNA, 22 bp, Homo sapiens
ctcacaggagaaagtcatggtc

SEQ ID NO: 8274769 - DNA, 22 bp, Homo sapiens
ctattactgacttctgtattta

SEQ ID NO: 8274770 - DNA, 17 bp, Homo sapiens
ctattactcccaagtaa

SEQ ID NO: 8274771 - DNA, 22 bp, Homo sapiens
ctcaaaatccataaaatcaggt

SEQ ID NO: 8274772 - DNA, 22 bp, Homo sapiens
ctattattatcctaatttctgt

SEQ ID NO: 8274773 - DNA, 22 bp, Homo sapiens
ctattattatgttaactggact

SEQ ID NO: 8274774 - DNA, 22 bp, Homo sapiens
ctcaagatcacacagctgagaa

SEQ ID NO: 8274775 - DNA, 22 bp, Homo sapiens
ctcaagatattccagctctcaa

SEQ ID NO: 8274776 - DNA, 22 bp, Homo sapiens
ctcaagatgtcagggcacctgc

SEQ ID NO: 8274777 - DNA, 22 bp, Homo sapiens
ctcaagatcatcaatataccaa

SEQ ID NO: 8274778 - DNA, 22 bp, Homo sapiens
ctcaagagatataaaaatgtgg

SEQ ID NO: 8274779 - DNA, 22 bp, Homo sapiens
ctcaagataatgacaaaaagag

SEQ ID NO: 8274780 - DNA, 22 bp, Homo sapiens
ctcaagaggatatgtccagaaa

SEQ ID NO: 8274781 - DNA, 22 bp, Homo sapiens
ctagaaactccatctcactaca

SEQ ID NO: 8274782 - DNA, 22 bp, Homo sapiens
ctagaaacgcctttagcacaac

SEQ ID NO: 8274783 - DNA, 22 bp, Homo sapiens
ctagaaacattacatgtgttaa

SEQ ID NO: 8274784 - DNA, 22 bp, Homo sapiens
ttctctggactatttgcactcc

SEQ ID NO: 8274785 - DNA, 22 bp, Homo sapiens
ttctctggagagtatcttctta

SEQ ID NO: 8274786 - DNA, 19 bp, Homo sapiens
ctactttataatatgcctc

SEQ ID NO: 8274787 - DNA, 22 bp, Homo sapiens
ctactctcccatgattctctgt

SEQ ID NO: 8274788 - DNA, 22 bp, Homo sapiens
ctacatttcatccagggagagc

SEQ ID NO: 8274789 - DNA, 22 bp, Homo sapiens
ttcctggcttcatactttgtac

SEQ ID NO: 8274790 - DNA, 22 bp, Homo sapiens
tgttaatcaatcaacagtatta

SEQ ID NO: 8274791 - DNA, 22 bp, Homo sapiens
cctggtgtcatggatgtcacat

SEQ ID NO: 8274792 - DNA, 20 bp, Homo sapiens
cctggtgtatttcctggggt

SEQ ID NO: 8274793 - DNA, 22 bp, Homo sapiens
cctggtgtctgtttacagcagc

SEQ ID NO: 8274794 - DNA, 22 bp, Homo sapiens
cctggtgtggctgtcacagagg

SEQ ID NO: 8274795 - DNA, 22 bp, Homo sapiens
cctggtgtggccctgtgacatg

SEQ ID NO: 8274796 - DNA, 22 bp, Homo sapiens
cctggtgttgtgaagtagccgt

SEQ ID NO: 8274797 - DNA, 22 bp, Homo sapiens
cctggtgttatcataggtcatg

SEQ ID NO: 8274798 - DNA, 22 bp, Homo sapiens
cctggtgttgccaatctgtgcc

SEQ ID NO: 8274799 - DNA, 22 bp, Homo sapiens
tgttacaggaaatagaattacc

SEQ ID NO: 8274800 - DNA, 22 bp, Homo sapiens
tgttacacagcagaatagcaag

SEQ ID NO: 8274801 - DNA, 22 bp, Homo sapiens
tgttcagcatcaggaaagcttt

SEQ ID NO: 8274802 - DNA, 22 bp, Homo sapiens
tgtgtattaatgtttgtatatg

SEQ ID NO: 8274803 - DNA, 22 bp, Homo sapiens
tgtgtatacatacatacacacg

SEQ ID NO: 8274804 - DNA, 22 bp, Homo sapiens
cctgggcaaatgccagagacaa

SEQ ID NO: 8274805 - DNA, 19 bp, Homo sapiens
ccttccccttcagcctctg

SEQ ID NO: 8274806 - DNA, 22 bp, Homo sapiens
ccttcctggctgtccgcctgat

SEQ ID NO: 8274807 - DNA, 22 bp, Homo sapiens
ccttcctggagcccatgcagat

SEQ ID NO: 8274808 - DNA, 19 bp, Homo sapiens
ccttcctccccagggccat

SEQ ID NO: 8274809 - DNA, 22 bp, Homo sapiens
ccttcccatgcagcctgtctga

SEQ ID NO: 8274810 - DNA, 22 bp, Homo sapiens
ccttcccacattccttacatgc

SEQ ID NO: 8274811 - DNA, 22 bp, Homo sapiens
ccttcccaggctagaccaacat

SEQ ID NO: 8274812 - DNA, 20 bp, Homo sapiens
cctgtgtggccagctgaggc

SEQ ID NO: 8274813 - DNA, 19 bp, Homo sapiens
cctgtgtggggtagagatc

SEQ ID NO: 8274814 - DNA, 22 bp, Homo sapiens
cctgtgtgctgatgacgacaga

SEQ ID NO: 8274815 - DNA, 22 bp, Homo sapiens
ttagaaaaaacgtcttctagtg

SEQ ID NO: 8274816 - DNA, 22 bp, Homo sapiens
ttacttttgcaccaaactaata

SEQ ID NO: 8274817 - DNA, 22 bp, Homo sapiens
ttagaagtcatctagtctaaaa

SEQ ID NO: 8274818 - DNA, 22 bp, Homo sapiens
ttagaagtacatttagaacata

SEQ ID NO: 8274819 - DNA, 22 bp, Homo sapiens
ttagaaaaaggctgtggtctta

SEQ ID NO: 8274820 - DNA, 22 bp, Homo sapiens
ttagaagttcaggtctgtaatc

SEQ ID NO: 8274821 - DNA, 22 bp, Homo sapiens
ttagacaatctgttggtaaggt

SEQ ID NO: 8274822 - DNA, 23 bp, Homo sapiens
ttagacaatcctcaaaaggtaat

SEQ ID NO: 8274823 - DNA, 23 bp, Homo sapiens
ttagacaatcctcaaaaggtaat

SEQ ID NO: 8274824 - DNA, 22 bp, Homo sapiens
ttagacaagggctccttaaaag

SEQ ID NO: 8274825 - DNA, 22 bp, Homo sapiens
cctgtgggagcccaggcagata

SEQ ID NO: 8274826 - DNA, 22 bp, Homo sapiens
cctgtgcttcactcaacaagcc

SEQ ID NO: 8274827 - DNA, 19 bp, Homo sapiens
cctgtgctaggagctgacc

SEQ ID NO: 8274828 - DNA, 22 bp, Homo sapiens
cctgtgcctgcctgtgagttct

SEQ ID NO: 8274829 - DNA, 22 bp, Homo sapiens
cctgtgccttaaccctttaggc

SEQ ID NO: 8274830 - DNA, 22 bp, Homo sapiens
cctgtcagccccacttctgcct

SEQ ID NO: 8274831 - DNA, 22 bp, Homo sapiens
cctgtgccatcctgagcatccc

SEQ ID NO: 8274832 - DNA, 22 bp, Homo sapiens
ttttaatactgctattgtagga

SEQ ID NO: 8274833 - DNA, 22 bp, Homo sapiens
ttttagattgggaaatgtaaag

SEQ ID NO: 8274834 - DNA, 22 bp, Homo sapiens
ttttagcacactttctttagcg

SEQ ID NO: 8274835 - DNA, 22 bp, Homo sapiens
ttttagatagtttaactgcact

SEQ ID NO: 8274836 - DNA, 22 bp, Homo sapiens
ttttagacttgtatgtaaagcc

SEQ ID NO: 8274837 - DNA, 22 bp, Homo sapiens
ttttagactccatctgattcag

SEQ ID NO: 8274838 - DNA, 23 bp, Homo sapiens
tttgtacagaattttgccttcag

SEQ ID NO: 8274839 - DNA, 22 bp, Homo sapiens
tttgtacagtgatgttgtatgc

SEQ ID NO: 8274840 - DNA, 22 bp, Homo sapiens
tttgtacactgtctactatgaa

SEQ ID NO: 8274841 - DNA, 22 bp, Homo sapiens
ttttaagaggaggctgtttgaa

SEQ ID NO: 8274842 - DNA, 22 bp, Homo sapiens
tttgtacatataaatcttgtat

SEQ ID NO: 8274843 - DNA, 22 bp, Homo sapiens
ctctttaaagtaaaatttgtct

SEQ ID NO: 8274844 - DNA, 20 bp, Homo sapiens
tttgcgaggccaaggcgggc

SEQ ID NO: 8274845 - DNA, 22 bp, Homo sapiens
tttgccctcaggtttttatgtg

SEQ ID NO: 8274846 - DNA, 22 bp, Homo sapiens
tttgccattgcctgtcagttgt

SEQ ID NO: 8274847 - DNA, 18 bp, Homo sapiens
tttgggatcctcttttct

SEQ ID NO: 8274848 - DNA, 19 bp, Homo sapiens
tttgggaagcccagagtgt

SEQ ID NO: 8274849 - DNA, 19 bp, Homo sapiens
tttgggaagcccagagtgt

SEQ ID NO: 8274850 - DNA, 22 bp, Homo sapiens
tttgggaaggcagacatcccac

SEQ ID NO: 8274851 - DNA, 17 bp, Homo sapiens
tttggaatttaaaggca

SEQ ID NO: 8274852 - DNA, 22 bp, Homo sapiens
tttggaattggcattctattct

SEQ ID NO: 8274853 - DNA, 22 bp, Homo sapiens
tttgggaaataaacctagagga

SEQ ID NO: 8274854 - DNA, 22 bp, Homo sapiens
tttgggaaatagtagaaaatgt

SEQ ID NO: 8274855 - DNA, 22 bp, Homo sapiens
tttgggaaatattgtgttcaag

SEQ ID NO: 8274856 - DNA, 22 bp, Homo sapiens
tttgggaacaatgaggatctga

SEQ ID NO: 8274857 - DNA, 22 bp, Homo sapiens
tttgggaaccagaagttcaaaa

SEQ ID NO: 8274858 - DNA, 20 bp, Homo sapiens
tttgggaaatgcaggtttca

SEQ ID NO: 8274859 - DNA, 22 bp, Homo sapiens
ctctgccaggcagaacggcttt

SEQ ID NO: 8274860 - DNA, 19 bp, Homo sapiens
ctctgccatttgctgcctg

SEQ ID NO: 8274861 - DNA, 22 bp, Homo sapiens
ctctgcagaggcccaaggctga

SEQ ID NO: 8274862 - DNA, 20 bp, Homo sapiens
ctctgcagcaaggcctgggt

SEQ ID NO: 8274863 - DNA, 22 bp, Homo sapiens
tttgcattttgataagatcact

SEQ ID NO: 8274864 - DNA, 19 bp, Homo sapiens
ctctgcctccctcctgggt

SEQ ID NO: 8274865 - DNA, 22 bp, Homo sapiens
ctctgcccgcggatgccacgtc

SEQ ID NO: 8274866 - DNA, 21 bp, Homo sapiens
ctctgcccagggcctcctgcc

SEQ ID NO: 8274867 - DNA, 18 bp, Homo sapiens
ctctttctttggcacaaa

SEQ ID NO: 8274868 - DNA, 22 bp, Homo sapiens
ctctttctgattcgctgggacc

SEQ ID NO: 8274869 - DNA, 22 bp, Homo sapiens
ctctttctcattgtcagcagaa

SEQ ID NO: 8274870 - DNA, 22 bp, Homo sapiens
ctctttctcgccgcccgcagtc

SEQ ID NO: 8274871 - DNA, 22 bp, Homo sapiens
ctgaatcatgccattttgctta

SEQ ID NO: 8274872 - DNA, 22 bp, Homo sapiens
ctgacaggctgagatccctggt

SEQ ID NO: 8274873 - DNA, 22 bp, Homo sapiens
ctgacagggtagacagagggca

SEQ ID NO: 8274874 - DNA, 20 bp, Homo sapiens
ctgaccagcagcctgtctcc

SEQ ID NO: 8274875 - DNA, 22 bp, Homo sapiens
ctgacagtaactaatgtggaga

SEQ ID NO: 8274876 - DNA, 22 bp, Homo sapiens
ctgacaggttggtagctttgga

SEQ ID NO: 8274877 - DNA, 22 bp, Homo sapiens
ctgacatgtataagctttaagt

SEQ ID NO: 8274878 - DNA, 22 bp, Homo sapiens
ctgagccatgggtctaagcact

SEQ ID NO: 8274879 - DNA, 22 bp, Homo sapiens
ctgagccagtagtcagggacaa

SEQ ID NO: 8274880 - DNA, 22 bp, Homo sapiens
ctgagccaaccacagcaggagc

SEQ ID NO: 8274881 - DNA, 22 bp, Homo sapiens
ctgcactgagcatctaacctta

SEQ ID NO: 8274882 - DNA, 22 bp, Homo sapiens
ctgcactgagaccctctttgct

SEQ ID NO: 8274883 - DNA, 22 bp, Homo sapiens
ctgcacgtataatcagtctgtt

SEQ ID NO: 8274884 - DNA, 18 bp, Homo sapiens
ctgcactcccgcctgggc

SEQ ID NO: 8274885 - DNA, 22 bp, Homo sapiens
ctgcaccgtgtctcgggctgcc

SEQ ID NO: 8274886 - DNA, 22 bp, Homo sapiens
ctgcactgtgtattccttggct

SEQ ID NO: 8274887 - DNA, 22 bp, Homo sapiens
ctgcagggagcagatggcgtgt

SEQ ID NO: 8274888 - DNA, 22 bp, Homo sapiens
ctgcagggccatgggttctata

SEQ ID NO: 8274889 - DNA, 22 bp, Homo sapiens
ctgcagggcccgcctgagccct

SEQ ID NO: 8274890 - DNA, 22 bp, Homo sapiens
ctgcagggcccgcctgagccct

SEQ ID NO: 8274891 - DNA, 22 bp, Homo sapiens
ctgcaggggaccaaagtctgac

SEQ ID NO: 8274892 - DNA, 22 bp, Homo sapiens
ctgcagggattgcttctgtata

SEQ ID NO: 8274893 - DNA, 18 bp, Homo sapiens
ctgaggccaactacactg

SEQ ID NO: 8274894 - DNA, 22 bp, Homo sapiens
ctgaggccagctgcagagctct

SEQ ID NO: 8274895 - DNA, 22 bp, Homo sapiens
ctgaggccagctgcagagctct

SEQ ID NO: 8274896 - DNA, 18 bp, Homo sapiens
ctgaggcccagagagggc

SEQ ID NO: 8274897 - DNA, 22 bp, Homo sapiens
ctgaggccagctgcagagctct

SEQ ID NO: 8274898 - DNA, 22 bp, Homo sapiens
ctgaggcccctcttgtgagcat

SEQ ID NO: 8274899 - DNA, 22 bp, Homo sapiens
ctgaggccggagcactgaagag

SEQ ID NO: 8274900 - DNA, 22 bp, Homo sapiens
ctgaggcccctcttgtgagcat

SEQ ID NO: 8274901 - DNA, 22 bp, Homo sapiens
ctgcacagagcagggcagacac

SEQ ID NO: 8274902 - DNA, 22 bp, Homo sapiens
ctgcacagtggacagtgaagat

SEQ ID NO: 8274903 - DNA, 22 bp, Homo sapiens
ttgaaatactgcattgttcagt

SEQ ID NO: 8274904 - DNA, 22 bp, Homo sapiens
ctcatctggcttcagtaacagt

SEQ ID NO: 8274905 - DNA, 22 bp, Homo sapiens
ttgaaagtagaatgtatgtgga

SEQ ID NO: 8274906 - DNA, 21 bp, Homo sapiens
ctcatttatttttgtgtccaa

SEQ ID NO: 8274907 - DNA, 22 bp, Homo sapiens
ctcatttatgtaatgattaagg

SEQ ID NO: 8274908 - DNA, 22 bp, Homo sapiens
ctccaaatacaatattgttgtt

SEQ ID NO: 8274909 - DNA, 22 bp, Homo sapiens
ctccaaatataatcacattgga

SEQ ID NO: 8274910 - DNA, 22 bp, Homo sapiens
ctccaaattcagtcacagtctg

SEQ ID NO: 8274911 - DNA, 23 bp, Homo sapiens
ctccaaatactcccaattgtttt

SEQ ID NO: 8274912 - DNA, 22 bp, Homo sapiens
ctccaaatacagtcatcttggg

SEQ ID NO: 8274913 - DNA, 19 bp, Homo sapiens
ctccaaatacttttccctt

SEQ ID NO: 8274914 - DNA, 22 bp, Homo sapiens
ctcatttatccaaaagccagtt

SEQ ID NO: 8274915 - DNA, 22 bp, Homo sapiens
ctcatttactcatctgcaaaac

SEQ ID NO: 8274916 - DNA, 22 bp, Homo sapiens
ttctttcttagcaatctatggt

SEQ ID NO: 8274917 - DNA, 20 bp, Homo sapiens
ctccaaattcctgaggataa

SEQ ID NO: 8274918 - DNA, 23 bp, Homo sapiens
ctccaaggcccaactgtctaggc

SEQ ID NO: 8274919 - DNA, 20 bp, Homo sapiens
ctccaaggcttgcaggaggc

SEQ ID NO: 8274920 - DNA, 22 bp, Homo sapiens
ctccaagggttgtgggtggtca

SEQ ID NO: 8274921 - DNA, 22 bp, Homo sapiens
ctccaagggctcccagacgtct

SEQ ID NO: 8274922 - DNA, 18 bp, Homo sapiens
ctccaaggtctctggctt

SEQ ID NO: 8274923 - DNA, 18 bp, Homo sapiens
ctccaaggtctctggctt

SEQ ID NO: 8274924 - DNA, 22 bp, Homo sapiens
ctccacaggtgtactgtacctt

SEQ ID NO: 8274925 - DNA, 22 bp, Homo sapiens
ctccacaggtggtgtttgcttc

SEQ ID NO: 8274926 - DNA, 22 bp, Homo sapiens
ctccaaggtggttatttgagat

SEQ ID NO: 8274927 - DNA, 22 bp, Homo sapiens
ttggtcacttgctatgtgccaa

SEQ ID NO: 8274928 - DNA, 22 bp, Homo sapiens
ttgtaattagtttttgatctgg

SEQ ID NO: 8274929 - DNA, 22 bp, Homo sapiens
ttgtaattactccaggggtaaa

SEQ ID NO: 8274930 - DNA, 22 bp, Homo sapiens
ttgtaattaatggcagcaatta

SEQ ID NO: 8274931 - DNA, 22 bp, Homo sapiens
ttgtaattaatggcagcaatta

SEQ ID NO: 8274932 - DNA, 22 bp, Homo sapiens
ttgtaatttttcatggtatcac

SEQ ID NO: 8274933 - DNA, 22 bp, Homo sapiens
ttgtaatttttcatggtatcac

SEQ ID NO: 8274934 - DNA, 22 bp, Homo sapiens
ttgtaatttgttcccaagcaga

SEQ ID NO: 8274935 - DNA, 22 bp, Homo sapiens
ttgtaatttgcaaatgtattgt

SEQ ID NO: 8274936 - DNA, 22 bp, Homo sapiens
ttgtaatttgcaaatgtattgt

SEQ ID NO: 8274937 - DNA, 22 bp, Homo sapiens
ttgtaatttgcaaatgtattgt

SEQ ID NO: 8274938 - DNA, 22 bp, Homo sapiens
ttgtaattgggtggtttgggac

SEQ ID NO: 8274939 - DNA, 22 bp, Homo sapiens
ttgtaattggacagccatcagg

SEQ ID NO: 8274940 - DNA, 22 bp, Homo sapiens
ttgtaattgaacccttaggctt

SEQ ID NO: 8274941 - DNA, 22 bp, Homo sapiens
ttgtaattagtttttgatctgg

SEQ ID NO: 8274942 - DNA, 23 bp, Homo sapiens
ttgtatttttagtagagacaggg

SEQ ID NO: 8274943 - DNA, 22 bp, Homo sapiens
ctccagccagagtgcctctgtt

SEQ ID NO: 8274944 - DNA, 22 bp, Homo sapiens
ttgtctgtgaaatggaaatagt

SEQ ID NO: 8274945 - DNA, 22 bp, Homo sapiens
ttgtcttttgtgggaaatatgg

SEQ ID NO: 8274946 - DNA, 22 bp, Homo sapiens
ctcccagccttcgccagtctga

SEQ ID NO: 8274947 - DNA, 22 bp, Homo sapiens
ctcccaggactcagaggagaag

SEQ ID NO: 8274948 - DNA, 22 bp, Homo sapiens
ctcccagagaccaagctgagaa

SEQ ID NO: 8274949 - DNA, 22 bp, Homo sapiens
ctcccagacatgtgcctccttg

SEQ ID NO: 8274950 - DNA, 22 bp, Homo sapiens
ctcccagaaaattctcagacaa

SEQ ID NO: 8274951 - DNA, 22 bp, Homo sapiens
ctcccactcctggctcaccaca

SEQ ID NO: 8274952 - DNA, 22 bp, Homo sapiens
ctcccaagataaataaggcagt

SEQ ID NO: 8274953 - DNA, 22 bp, Homo sapiens
tttaagttccttttcaacaact

SEQ ID NO: 8274954 - DNA, 22 bp, Homo sapiens
ctcccaggccatgctctagcca

SEQ ID NO: 8274955 - DNA, 22 bp, Homo sapiens
ctcccaggccatgctctagcca

SEQ ID NO: 8274956 - DNA, 22 bp, Homo sapiens
tttaatatttctttcctgaagc

SEQ ID NO: 8274957 - DNA, 22 bp, Homo sapiens
tttattgttgttagtcataagt

SEQ ID NO: 8274958 - DNA, 23 bp, Homo sapiens
ctccccagtgtcctcatgcatct

SEQ ID NO: 8274959 - DNA, 20 bp, Homo sapiens
ctcccctctacagagggctg

SEQ ID NO: 8274960 - DNA, 22 bp, Homo sapiens
tttagacatttgtggtttgcaa

SEQ ID NO: 8274961 - DNA, 22 bp, Homo sapiens
tttagacatggcttgctcactt

SEQ ID NO: 8274962 - DNA, 19 bp, Homo sapiens
tttagacattgtctggtat

SEQ ID NO: 8274963 - DNA, 19 bp, Homo sapiens
tttagacattgtctggtat

SEQ ID NO: 8274964 - DNA, 22 bp, Homo sapiens
tttagtatgtatttaatggact

SEQ ID NO: 8274965 - DNA, 22 bp, Homo sapiens
tttaggttttttcacgtggcta

SEQ ID NO: 8274966 - DNA, 22 bp, Homo sapiens
tttaggcatgcagttctattta

SEQ ID NO: 8274967 - DNA, 22 bp, Homo sapiens
tttagtatataaaaagagaagt

SEQ ID NO: 8274968 - DNA, 22 bp, Homo sapiens
tttcacagttagcatgaggact

SEQ ID NO: 8274969 - DNA, 22 bp, Homo sapiens
tttcacagtagaaatcattatg

SEQ ID NO: 8274970 - DNA, 22 bp, Homo sapiens
tttcacagtcaatttggagtca

SEQ ID NO: 8274971 - DNA, 22 bp, Homo sapiens
tttcctagagtctctagaagaa

SEQ ID NO: 8274972 - DNA, 22 bp, Homo sapiens
tttcctaaggctcattttaaaa

SEQ ID NO: 8274973 - DNA, 22 bp, Homo sapiens
tttcaattaggatgtttccatg

SEQ ID NO: 8274974 - DNA, 22 bp, Homo sapiens
tttcacaaagcatagcacttta

SEQ ID NO: 8274975 - DNA, 22 bp, Homo sapiens
ctctctcttgtgttgctgcaga

SEQ ID NO: 8274976 - DNA, 22 bp, Homo sapiens
ctctctctttagaagcgtctgg

SEQ ID NO: 8274977 - DNA, 23 bp, Homo sapiens
ctctctctaccatgtgaggacac

SEQ ID NO: 8274978 - DNA, 22 bp, Homo sapiens
ctctctctatgcgttgttccta

SEQ ID NO: 8274979 - DNA, 20 bp, Homo sapiens
ctctctctccattcccaggg

SEQ ID NO: 8274980 - DNA, 22 bp, Homo sapiens
ctctccagggcatgagttccac

SEQ ID NO: 8274981 - DNA, 22 bp, Homo sapiens
ctctccagggaagcagtgtact

SEQ ID NO: 8274982 - DNA, 22 bp, Homo sapiens
ctctccaggggtagatgccttc

SEQ ID NO: 8274983 - DNA, 21 bp, Homo sapiens
ctctccaggtaggataaatgt

SEQ ID NO: 8274984 - DNA, 22 bp, Homo sapiens
ctctccaggggaacattgttcc

SEQ ID NO: 8274985 - DNA, 22 bp, Homo sapiens
ctctccaggggtagatgccttc

SEQ ID NO: 8274986 - DNA, 22 bp, Homo sapiens
ctctccaggttagagcacttat

SEQ ID NO: 8274987 - DNA, 22 bp, Homo sapiens
ctctccagtcaggaactctgac

SEQ ID NO: 8274988 - DNA, 22 bp, Homo sapiens
ctctccagtcatattctcagtc

SEQ ID NO: 8274989 - DNA, 22 bp, Homo sapiens
ctctccaggcgaggtcctactg

SEQ ID NO: 8274990 - DNA, 22 bp, Homo sapiens
ctctccaggctgggacaggacc

SEQ ID NO: 8274991 - DNA, 22 bp, Homo sapiens
ctctccaggctgggacaggacc

SEQ ID NO: 8274992 - DNA, 22 bp, Homo sapiens
ctctccagggaagcagtgtact

SEQ ID NO: 8274993 - DNA, 22 bp, Homo sapiens
ctctccaggctgggacaggacc

SEQ ID NO: 8274994 - DNA, 22 bp, Homo sapiens
ctctccaggagctcagagtcta

SEQ ID NO: 8274995 - DNA, 22 bp, Homo sapiens
ctctccaggagctcagagtcta

SEQ ID NO: 8274996 - DNA, 22 bp, Homo sapiens
ctctccaggagctcagagtcta

SEQ ID NO: 8274997 - DNA, 22 bp, Homo sapiens
tttcctaaggtagtgataattt

SEQ ID NO: 8274998 - DNA, 22 bp, Homo sapiens
tttcctcactcatgtcatcagt

SEQ ID NO: 8274999 - DNA, 22 bp, Homo sapiens
catggcaggaaggacatgcact

SEQ ID NO: 8275000 - DNA, 22 bp, Homo sapiens
catggcattgcataacggggct

SEQ ID NO: 8275001 - DNA, 22 bp, Homo sapiens
catggcagtgattcagcctttg

SEQ ID NO: 8275002 - DNA, 20 bp, Homo sapiens
tccagctgggaacagctgat

SEQ ID NO: 8275003 - DNA, 22 bp, Homo sapiens
catgcagttgaagcacagagag

SEQ ID NO: 8275004 - DNA, 22 bp, Homo sapiens
catgcaggtgaccaggtgtggg

SEQ ID NO: 8275005 - DNA, 22 bp, Homo sapiens
catgcagggactagagaacagg

SEQ ID NO: 8275006 - DNA, 22 bp, Homo sapiens
catgcagggagcagaggagaca

SEQ ID NO: 8275007 - DNA, 22 bp, Homo sapiens
catgcaggtctggagcttgggg

SEQ ID NO: 8275008 - DNA, 22 bp, Homo sapiens
catgacattttaaaaagaacat

SEQ ID NO: 8275009 - DNA, 22 bp, Homo sapiens
catgacatctgcttagtatgaa

SEQ ID NO: 8275010 - DNA, 22 bp, Homo sapiens
catgacattttaaaaagaacat

SEQ ID NO: 8275011 - DNA, 20 bp, Homo sapiens
catgacactgttcctctgcc

SEQ ID NO: 8275012 - DNA, 22 bp, Homo sapiens
catgacatcctgaagctgcaca

SEQ ID NO: 8275013 - DNA, 22 bp, Homo sapiens
catgaaggaattaaggtaagga

SEQ ID NO: 8275014 - DNA, 22 bp, Homo sapiens
catgaacatttgtttacatctg

SEQ ID NO: 8275015 - DNA, 22 bp, Homo sapiens
catgaacattgcagggatgtga

SEQ ID NO: 8275016 - DNA, 22 bp, Homo sapiens
catgaacaatttgctcactgat

SEQ ID NO: 8275017 - DNA, 22 bp, Homo sapiens
catctggggctgtctgctaatc

SEQ ID NO: 8275018 - DNA, 19 bp, Homo sapiens
catctggatgattctcctg

SEQ ID NO: 8275019 - DNA, 22 bp, Homo sapiens
tcagggattgcaaaattcatcc

SEQ ID NO: 8275020 - DNA, 22 bp, Homo sapiens
tcagggagtgttggcaggatca

SEQ ID NO: 8275021 - DNA, 22 bp, Homo sapiens
tcagggagtagtttgtgctatg

SEQ ID NO: 8275022 - DNA, 22 bp, Homo sapiens
tcagggaggtgtctgccagaga

SEQ ID NO: 8275023 - DNA, 23 bp, Homo sapiens
tcagtcccaacagcttctcctgg

SEQ ID NO: 8275024 - DNA, 22 bp, Homo sapiens
tcagtcccaaggtcctgaggtg

SEQ ID NO: 8275025 - DNA, 22 bp, Homo sapiens
tcagtccccagatgtgtgctgt

SEQ ID NO: 8275026 - DNA, 22 bp, Homo sapiens
tcagtccctaaggatatgggct

SEQ ID NO: 8275027 - DNA, 22 bp, Homo sapiens
tcagtcccttctccaggtcagc

SEQ ID NO: 8275028 - DNA, 22 bp, Homo sapiens
tcagtcccttaaaggtggcagc

SEQ ID NO: 8275029 - DNA, 21 bp, Homo sapiens
tcagtccctgggtgtgtccca

SEQ ID NO: 8275030 - DNA, 22 bp, Homo sapiens
tcagtccctcgcaccctgccat

SEQ ID NO: 8275031 - DNA, 22 bp, Homo sapiens
cagttttggtcctttctaggta

SEQ ID NO: 8275032 - DNA, 22 bp, Homo sapiens
tcagagtttgtactgacaggag

SEQ ID NO: 8275033 - DNA, 22 bp, Homo sapiens
tcagagtttcaggatacaaata

SEQ ID NO: 8275034 - DNA, 22 bp, Homo sapiens
tcagagattgaaaacatatcca

SEQ ID NO: 8275035 - DNA, 23 bp, Homo sapiens
tcagagatggaaagcagaccacg

SEQ ID NO: 8275036 - DNA, 22 bp, Homo sapiens
tcagagatggagttagcagtga

SEQ ID NO: 8275037 - DNA, 22 bp, Homo sapiens
tcagagattcacgtcagtccca

SEQ ID NO: 8275038 - DNA, 22 bp, Homo sapiens
tcagagattcacgtcagtccca

SEQ ID NO: 8275039 - DNA, 22 bp, Homo sapiens
tcagagatcttcaggatgggac

SEQ ID NO: 8275040 - DNA, 22 bp, Homo sapiens
tcagagatctggagtacaactg

SEQ ID NO: 8275041 - DNA, 22 bp, Homo sapiens
cagttataagactaagctattc

SEQ ID NO: 8275042 - DNA, 22 bp, Homo sapiens
tcaatcacgtgttccatgttct

SEQ ID NO: 8275043 - DNA, 22 bp, Homo sapiens
tcaatcaatgtgtcagttccca

SEQ ID NO: 8275044 - DNA, 22 bp, Homo sapiens
tcaatagcaatcaagccttcca

SEQ ID NO: 8275045 - DNA, 22 bp, Homo sapiens
tcaatatttttatgagcataga

SEQ ID NO: 8275046 - DNA, 22 bp, Homo sapiens
tcaatattcttctttagtagga

SEQ ID NO: 8275047 - DNA, 22 bp, Homo sapiens
catagaaactgagacaaggatt

SEQ ID NO: 8275048 - DNA, 22 bp, Homo sapiens
tcagcaggtggtgggcaggtga

SEQ ID NO: 8275049 - DNA, 17 bp, Homo sapiens
tcagcagtaatggtggg

SEQ ID NO: 8275050 - DNA, 22 bp, Homo sapiens
tcagcaggtgctttgtttactc

SEQ ID NO: 8275051 - DNA, 22 bp, Homo sapiens
tcagcaggtgcctcagattctt

SEQ ID NO: 8275052 - DNA, 22 bp, Homo sapiens
tcagcaggtgaacatcatgcca

SEQ ID NO: 8275053 - DNA, 22 bp, Homo sapiens
tcagcaggtctgaggcggggcc

SEQ ID NO: 8275054 - DNA, 22 bp, Homo sapiens
tcagcagggtttgacttctaat

SEQ ID NO: 8275055 - DNA, 22 bp, Homo sapiens
tcagcagtcacatgttgtccca

SEQ ID NO: 8275056 - DNA, 22 bp, Homo sapiens
tcagcagtcaaagagaatctct

SEQ ID NO: 8275057 - DNA, 22 bp, Homo sapiens
tcagcagtagagggggcacagt

SEQ ID NO: 8275058 - DNA, 22 bp, Homo sapiens
tctaatcctatggtggggaggg

SEQ ID NO: 8275059 - DNA, 22 bp, Homo sapiens
ccagacaggggctgttcctgct

SEQ ID NO: 8275060 - DNA, 22 bp, Homo sapiens
ccagacaggggctgttcctgct

SEQ ID NO: 8275061 - DNA, 22 bp, Homo sapiens
ccactgtattttggaagcagat

SEQ ID NO: 8275062 - DNA, 22 bp, Homo sapiens
ccactgtatcttccttgaattt

SEQ ID NO: 8275063 - DNA, 21 bp, Homo sapiens
ccactgtagactcattctgag

SEQ ID NO: 8275064 - DNA, 22 bp, Homo sapiens
ccactgtagagatttgaatgcc

SEQ ID NO: 8275065 - DNA, 22 bp, Homo sapiens
ccactgtatagccactgccggt

SEQ ID NO: 8275066 - DNA, 22 bp, Homo sapiens
ccactgtagttatgatgaagtt

SEQ ID NO: 8275067 - DNA, 22 bp, Homo sapiens
ccactgctaacttgctgcagct

SEQ ID NO: 8275068 - DNA, 22 bp, Homo sapiens
ccactgtaaccattatcaccat

SEQ ID NO: 8275069 - DNA, 22 bp, Homo sapiens
ccactgttaccagtcaatcaca

SEQ ID NO: 8275070 - DNA, 22 bp, Homo sapiens
tctaagaatactcatatcttct

SEQ ID NO: 8275071 - DNA, 22 bp, Homo sapiens
tccttggggacgctgacatcgt

SEQ ID NO: 8275072 - DNA, 22 bp, Homo sapiens
tccttcctgctctaacattcag

SEQ ID NO: 8275073 - DNA, 22 bp, Homo sapiens
ccacactccccgcaggcgtagg

SEQ ID NO: 8275074 - DNA, 22 bp, Homo sapiens
ccacactgcctgttatctccca

SEQ ID NO: 8275075 - DNA, 21 bp, Homo sapiens
tcctggcaggcccaggaccct

SEQ ID NO: 8275076 - DNA, 18 bp, Homo sapiens
ccaaggcccctgctgggg

SEQ ID NO: 8275077 - DNA, 17 bp, Homo sapiens
ccaaggctatttgtagt

SEQ ID NO: 8275078 - DNA, 22 bp, Homo sapiens
ccaaggctcctcagctggtctt

SEQ ID NO: 8275079 - DNA, 17 bp, Homo sapiens
ccaaggctatttgtagt

SEQ ID NO: 8275080 - DNA, 22 bp, Homo sapiens
ccaaggctgtcattcagtagct

SEQ ID NO: 8275081 - DNA, 22 bp, Homo sapiens
ccaaggctggagtgcagtggcg

SEQ ID NO: 8275082 - DNA, 22 bp, Homo sapiens
ccaaggctggagtgcagtggcg

SEQ ID NO: 8275083 - DNA, 22 bp, Homo sapiens
ccaaggctgtggggctgtgcag

SEQ ID NO: 8275084 - DNA, 22 bp, Homo sapiens
ccaaggctggagggcttatgta

SEQ ID NO: 8275085 - DNA, 22 bp, Homo sapiens
ccaaggctggagggcttatgta

SEQ ID NO: 8275086 - DNA, 22 bp, Homo sapiens
ccaaggctgaggtttccagttg

SEQ ID NO: 8275087 - DNA, 22 bp, Homo sapiens
ccaaggctgaggtttccagttg

SEQ ID NO: 8275088 - DNA, 22 bp, Homo sapiens
ccaaggctcctcagctggtctt

SEQ ID NO: 8275089 - DNA, 22 bp, Homo sapiens
tcctggaggagatccaatctga

SEQ ID NO: 8275090 - DNA, 22 bp, Homo sapiens
ccaaggcttcccagagatgctc

SEQ ID NO: 8275091 - DNA, 22 bp, Homo sapiens
ccaaggctgtcattcagtagct

SEQ ID NO: 8275092 - DNA, 22 bp, Homo sapiens
ccaaggctgtggggctgtgcag

SEQ ID NO: 8275093 - DNA, 22 bp, Homo sapiens
ccaaggcttcctgacctacatg

SEQ ID NO: 8275094 - DNA, 22 bp, Homo sapiens
ccaaggcttcccagagatgctc

SEQ ID NO: 8275095 - DNA, 22 bp, Homo sapiens
ccaagaggttgtgaggcaggca

SEQ ID NO: 8275096 - DNA, 22 bp, Homo sapiens
tcccacccatcctgcatctctt

SEQ ID NO: 8275097 - DNA, 22 bp, Homo sapiens
tcccaccccctccaaggaggaa

SEQ ID NO: 8275098 - DNA, 22 bp, Homo sapiens
tcccaccccggtcaagggctga

SEQ ID NO: 8275099 - DNA, 22 bp, Homo sapiens
tcccaccccttgactctttaag

SEQ ID NO: 8275100 - DNA, 22 bp, Homo sapiens
cattctctctacttgttttcaa

SEQ ID NO: 8275101 - DNA, 22 bp, Homo sapiens
cattctcttgacaggacagccc

SEQ ID NO: 8275102 - DNA, 22 bp, Homo sapiens
cattctctgatcttcacatacc

SEQ ID NO: 8275103 - DNA, 22 bp, Homo sapiens
cattctctacactcctgccctg

SEQ ID NO: 8275104 - DNA, 22 bp, Homo sapiens
cattagcagtcattactgtgct

SEQ ID NO: 8275105 - DNA, 22 bp, Homo sapiens
cattagcattcagtgacttgta

SEQ ID NO: 8275106 - DNA, 22 bp, Homo sapiens
cattagaactaagatgtccagg

SEQ ID NO: 8275107 - DNA, 23 bp, Homo sapiens
catgggagtgagaatgccagctc

SEQ ID NO: 8275108 - DNA, 22 bp, Homo sapiens
tccaggagatacactgcaccag

SEQ ID NO: 8275109 - DNA, 22 bp, Homo sapiens
tccaggagaggcctgaccaggt

SEQ ID NO: 8275110 - DNA, 23 bp, Homo sapiens
tccaggagaattccagggcccgg

SEQ ID NO: 8275111 - DNA, 22 bp, Homo sapiens
catgggccatggtgaagccagg

SEQ ID NO: 8275112 - DNA, 22 bp, Homo sapiens
catgggcccgtgagaggcaggg

SEQ ID NO: 8275113 - DNA, 22 bp, Homo sapiens
catgggcagttggcagggctca

SEQ ID NO: 8275114 - DNA, 22 bp, Homo sapiens
catgggccagagctcctctggg

SEQ ID NO: 8275115 - DNA, 22 bp, Homo sapiens
tccatttgaaatgaaagtgata

SEQ ID NO: 8275116 - DNA, 22 bp, Homo sapiens
tccatttaggttccactagtta

SEQ ID NO: 8275117 - DNA, 22 bp, Homo sapiens
cattgtcctttggctttgcaaa

SEQ ID NO: 8275118 - DNA, 22 bp, Homo sapiens
cattgtcctctgatgccttccc

SEQ ID NO: 8275119 - DNA, 22 bp, Homo sapiens
cattgcactccatcttgggcaa

SEQ ID NO: 8275120 - DNA, 22 bp, Homo sapiens
tcccactcccaggcaggcctct

SEQ ID NO: 8275121 - DNA, 22 bp, Homo sapiens
tcccactcactgtctctgacac

SEQ ID NO: 8275122 - DNA, 22 bp, Homo sapiens
cattgcactccaccctaggcaa

SEQ ID NO: 8275123 - DNA, 22 bp, Homo sapiens
cattgcactccagcttgggcaa

SEQ ID NO: 8275124 - DNA, 22 bp, Homo sapiens
cattgcactccagccttggcaa

SEQ ID NO: 8275125 - DNA, 22 bp, Homo sapiens
cattgcactccagcctaggcaa

SEQ ID NO: 8275126 - DNA, 22 bp, Homo sapiens
cattgtttctggagggatctgt

SEQ ID NO: 8275127 - DNA, 22 bp, Homo sapiens
catttattcagctcagtcggtt

SEQ ID NO: 8275128 - DNA, 22 bp, Homo sapiens
tccctctccctattgcctggag

SEQ ID NO: 8275129 - DNA, 22 bp, Homo sapiens
tattttatctgccagagtggag

SEQ ID NO: 8275130 - DNA, 22 bp, Homo sapiens
tattttaggtaatatccattgt

SEQ ID NO: 8275131 - DNA, 22 bp, Homo sapiens
tattttactttaaagcgagaga

SEQ ID NO: 8275132 - DNA, 22 bp, Homo sapiens
tattttacatgatccagagttg

SEQ ID NO: 8275133 - DNA, 22 bp, Homo sapiens
tattttacatgatccagagttg

SEQ ID NO: 8275134 - DNA, 22 bp, Homo sapiens
tcaagcagggtagcaagctggt

SEQ ID NO: 8275135 - DNA, 22 bp, Homo sapiens
tcaagatgtgatgtaacttttg

SEQ ID NO: 8275136 - DNA, 22 bp, Homo sapiens
tcaagatgtccagtgcctataa

SEQ ID NO: 8275137 - DNA, 22 bp, Homo sapiens
tcaagcaaatgtccttttgttc

SEQ ID NO: 8275138 - DNA, 22 bp, Homo sapiens
tcaagatgaaccaggacattca

SEQ ID NO: 8275139 - DNA, 20 bp, Homo sapiens
tcaagatgaggtcatactgg

SEQ ID NO: 8275140 - DNA, 19 bp, Homo sapiens
tcaagatggatggctccca

SEQ ID NO: 8275141 - DNA, 22 bp, Homo sapiens
tcaagatgcatgggtggcataa

SEQ ID NO: 8275142 - DNA, 22 bp, Homo sapiens
tcaagatgattgcttcaggccc

SEQ ID NO: 8275143 - DNA, 22 bp, Homo sapiens
caggtgggtgtatgaatgcaaa

SEQ ID NO: 8275144 - DNA, 21 bp, Homo sapiens
cagtattttaagcagtgagtt

SEQ ID NO: 8275145 - DNA, 22 bp, Homo sapiens
cagtattttcaggatttggaag

SEQ ID NO: 8275146 - DNA, 22 bp, Homo sapiens
cagtcaccttgaggactcagac

SEQ ID NO: 8275147 - DNA, 22 bp, Homo sapiens
cagtcaggggtgggatcaaggc

SEQ ID NO: 8275148 - DNA, 22 bp, Homo sapiens
tattttaaagactgccagccta

SEQ ID NO: 8275149 - DNA, 22 bp, Homo sapiens
tattttaaagtgaagggtcttg

SEQ ID NO: 8275150 - DNA, 22 bp, Homo sapiens
tatttgaagattcttctgatgt

SEQ ID NO: 8275151 - DNA, 22 bp, Homo sapiens
caggtgggtacatcacagagac

SEQ ID NO: 8275152 - DNA, 22 bp, Homo sapiens
tattattaaatggcagaatttt

SEQ ID NO: 8275153 - DNA, 18 bp, Homo sapiens
caggtgggtctcctgccc

SEQ ID NO: 8275154 - DNA, 22 bp, Homo sapiens
caggtgggtacatcacagagac

SEQ ID NO: 8275155 - DNA, 22 bp, Homo sapiens
tattatcatgttaattagtggg

SEQ ID NO: 8275156 - DNA, 23 bp, Homo sapiens
caggtggctccacgaggggtggg

SEQ ID NO: 8275157 - DNA, 22 bp, Homo sapiens
caggtggatctctaaggactga

SEQ ID NO: 8275158 - DNA, 22 bp, Homo sapiens
caggtggccagtactcaaggat

SEQ ID NO: 8275159 - DNA, 22 bp, Homo sapiens
caggtgcccagctcctgctgtg

SEQ ID NO: 8275160 - DNA, 22 bp, Homo sapiens
caggtcagctggtgccccaggt

SEQ ID NO: 8275161 - DNA, 22 bp, Homo sapiens
caggtgacaagacaggtaatat

SEQ ID NO: 8275162 - DNA, 22 bp, Homo sapiens
caggtaaggtcacattctgaag

SEQ ID NO: 8275163 - DNA, 22 bp, Homo sapiens
caggtaagaccgtttaggcagt

SEQ ID NO: 8275164 - DNA, 22 bp, Homo sapiens
caggtacaaagctactgcctga

SEQ ID NO: 8275165 - DNA, 22 bp, Homo sapiens
caggtacactcccttgtgctga

SEQ ID NO: 8275166 - DNA, 22 bp, Homo sapiens
cagggtttcaccatgttagcag

SEQ ID NO: 8275167 - DNA, 22 bp, Homo sapiens
caggtaagaccgtttaggcagt

SEQ ID NO: 8275168 - DNA, 22 bp, Homo sapiens
caggtacccaggctctttccaa

SEQ ID NO: 8275169 - DNA, 22 bp, Homo sapiens
caggtaggggagagctccaaca

SEQ ID NO: 8275170 - DNA, 22 bp, Homo sapiens
caggtaggtatggtgcagtctt

SEQ ID NO: 8275171 - DNA, 22 bp, Homo sapiens
caggtcagaggcgcagccccca

SEQ ID NO: 8275172 - DNA, 22 bp, Homo sapiens
tagcttcatgcttcaccacgct

SEQ ID NO: 8275173 - DNA, 22 bp, Homo sapiens
tagcttctggagtgtttgaaaa

SEQ ID NO: 8275174 - DNA, 22 bp, Homo sapiens
tagcttggaataaaatgagaat

SEQ ID NO: 8275175 - DNA, 22 bp, Homo sapiens
cagggcccaggccactgggttg

SEQ ID NO: 8275176 - DNA, 22 bp, Homo sapiens
cagggcccagtccctgctgtca

SEQ ID NO: 8275177 - DNA, 22 bp, Homo sapiens
cagggcccaggccactgggttg

SEQ ID NO: 8275178 - DNA, 22 bp, Homo sapiens
tagatttgatgcaattggattg

SEQ ID NO: 8275179 - DNA, 22 bp, Homo sapiens
cagggagcactgcgagcggcag

SEQ ID NO: 8275180 - DNA, 22 bp, Homo sapiens
cagggagatcttggctcctggt

SEQ ID NO: 8275181 - DNA, 22 bp, Homo sapiens
cagggagcagcgctggggcctc

SEQ ID NO: 8275182 - DNA, 22 bp, Homo sapiens
cagggagcagcccctagaagta

SEQ ID NO: 8275183 - DNA, 22 bp, Homo sapiens
cagggccagggacacgctgtca

SEQ ID NO: 8275184 - DNA, 22 bp, Homo sapiens
cagggccactgcatgaggttca

SEQ ID NO: 8275185 - DNA, 22 bp, Homo sapiens
cagggagcctccaaagctttca

SEQ ID NO: 8275186 - DNA, 22 bp, Homo sapiens
cagggagcaggctctgtccatc

SEQ ID NO: 8275187 - DNA, 22 bp, Homo sapiens
cagggagccccaattccatgcc

SEQ ID NO: 8275188 - DNA, 22 bp, Homo sapiens
cagggtagggcaagggaacctg

SEQ ID NO: 8275189 - DNA, 22 bp, Homo sapiens
cagggtcccaggagctgctttc

SEQ ID NO: 8275190 - DNA, 22 bp, Homo sapiens
cagggtccggctgcctggctgt

SEQ ID NO: 8275191 - DNA, 22 bp, Homo sapiens
caggggcctgtcctggcttctg

SEQ ID NO: 8275192 - DNA, 22 bp, Homo sapiens
cagggctgtggctttgtgctgt

SEQ ID NO: 8275193 - DNA, 17 bp, Homo sapiens
cagggctgtctgcctag

SEQ ID NO: 8275194 - DNA, 22 bp, Homo sapiens
caggggcctgtcctggcttctg

SEQ ID NO: 8275195 - DNA, 22 bp, Homo sapiens
tagggaaaagacttcactgttt

SEQ ID NO: 8275196 - DNA, 22 bp, Homo sapiens
taatgtgtcctgaaagcttctg

SEQ ID NO: 8275197 - DNA, 22 bp, Homo sapiens
taatgtgaagacataaatcaga

SEQ ID NO: 8275198 - DNA, 22 bp, Homo sapiens
taatccacaatagagattatct

SEQ ID NO: 8275199 - DNA, 22 bp, Homo sapiens
tacaaaaaattgatactgacga

SEQ ID NO: 8275200 - DNA, 22 bp, Homo sapiens
tacaaaacagtgctctggtcct

SEQ ID NO: 8275201 - DNA, 22 bp, Homo sapiens
tacaaaaggaagagggatctta

SEQ ID NO: 8275202 - DNA, 22 bp, Homo sapiens
caggccagagcgcgtggttggg

SEQ ID NO: 8275203 - DNA, 22 bp, Homo sapiens
caggcccaagactgatgagtct

SEQ ID NO: 8275204 - DNA, 22 bp, Homo sapiens
caggccagtgtgcttcccaggc

SEQ ID NO: 8275205 - DNA, 22 bp, Homo sapiens
taagtcctaatggcagaagtct

SEQ ID NO: 8275206 - DNA, 22 bp, Homo sapiens
taagtcctagatgattcacaga

SEQ ID NO: 8275207 - DNA, 22 bp, Homo sapiens
taagtcccccacttgccacagg

SEQ ID NO: 8275208 - DNA, 22 bp, Homo sapiens
taagtcctaacagactgggggc

SEQ ID NO: 8275209 - DNA, 22 bp, Homo sapiens
taagtctctcgtttgattcatt

SEQ ID NO: 8275210 - DNA, 22 bp, Homo sapiens
taagtcctagctttggtaggaa

SEQ ID NO: 8275211 - DNA, 17 bp, Homo sapiens
taagtcctagttatttt

SEQ ID NO: 8275212 - DNA, 22 bp, Homo sapiens
taagtcctggctggtttgaagc

SEQ ID NO: 8275213 - DNA, 22 bp, Homo sapiens
taagtcctattccaggtctctc

SEQ ID NO: 8275214 - DNA, 22 bp, Homo sapiens
taagtccttcacctaatcctca

SEQ ID NO: 8275215 - DNA, 23 bp, Homo sapiens
cagctcagcacataggaggtact

SEQ ID NO: 8275216 - DNA, 23 bp, Homo sapiens
cagctcagagtgtgtcctgtttc

SEQ ID NO: 8275217 - DNA, 22 bp, Homo sapiens
taagtattggcctatagctaga

SEQ ID NO: 8275218 - DNA, 22 bp, Homo sapiens
taaggcagctgagcttctaaca

SEQ ID NO: 8275219 - DNA, 22 bp, Homo sapiens
taagtcacttattccacaagat

SEQ ID NO: 8275220 - DNA, 22 bp, Homo sapiens
gtgcttctctgctctacccggc

SEQ ID NO: 8275221 - DNA, 22 bp, Homo sapiens
gtgcttcctgtattgattccat

SEQ ID NO: 8275222 - DNA, 22 bp, Homo sapiens
gtgcttaaggcagtctgtcaaa

SEQ ID NO: 8275223 - DNA, 22 bp, Homo sapiens
gtgcttaacctagtttctagta

SEQ ID NO: 8275224 - DNA, 22 bp, Homo sapiens
cagctcagacgcaggtcgagca

SEQ ID NO: 8275225 - DNA, 22 bp, Homo sapiens
cagctcagacgcaggtcgagca

SEQ ID NO: 8275226 - DNA, 22 bp, Homo sapiens
cagctattttgcctatcatggt

SEQ ID NO: 8275227 - DNA, 22 bp, Homo sapiens
cagctattttctcattaaggat

SEQ ID NO: 8275228 - DNA, 22 bp, Homo sapiens
cagctatttgtaggaaaactgt

SEQ ID NO: 8275229 - DNA, 22 bp, Homo sapiens
cagctatttatctttcatgata

SEQ ID NO: 8275230 - DNA, 22 bp, Homo sapiens
cagctattgttctgtataatga

SEQ ID NO: 8275231 - DNA, 22 bp, Homo sapiens
cagctattggtccacaggtatg

SEQ ID NO: 8275232 - DNA, 22 bp, Homo sapiens
cagctattggcaagaagtggtg

SEQ ID NO: 8275233 - DNA, 22 bp, Homo sapiens
cagctattgataaatgttgggg

SEQ ID NO: 8275234 - DNA, 22 bp, Homo sapiens
caggcacccagcccagtcgcac

SEQ ID NO: 8275235 - DNA, 22 bp, Homo sapiens
caggcacctcacgtgggtccca

SEQ ID NO: 8275236 - DNA, 22 bp, Homo sapiens
caggcacctgtgtgtctcaggg

SEQ ID NO: 8275237 - DNA, 22 bp, Homo sapiens
caggcaccccaggtgagcactg

SEQ ID NO: 8275238 - DNA, 22 bp, Homo sapiens
caggcagcagaggagtgtggga

SEQ ID NO: 8275239 - DNA, 21 bp, Homo sapiens
taataattccactacagagta

SEQ ID NO: 8275240 - DNA, 22 bp, Homo sapiens
tacttgttcatgaggtagtaaa

SEQ ID NO: 8275241 - DNA, 22 bp, Homo sapiens
tacttgttttgtgttcctaaac

SEQ ID NO: 8275242 - DNA, 22 bp, Homo sapiens
tactttaaaaactgataattca

SEQ ID NO: 8275243 - DNA, 22 bp, Homo sapiens
tacttgttatcatcttttcctt

SEQ ID NO: 8275244 - DNA, 22 bp, Homo sapiens
caggctacatttgctctgagaa

SEQ ID NO: 8275245 - DNA, 22 bp, Homo sapiens
tactttattgtaaatgctgatg

SEQ ID NO: 8275246 - DNA, 22 bp, Homo sapiens
tactttaaagaggtgtaatgag

SEQ ID NO: 8275247 - DNA, 22 bp, Homo sapiens
caggcggccatgatctggcagg

SEQ ID NO: 8275248 - DNA, 22 bp, Homo sapiens
caggcctttcttggggcttaga

SEQ ID NO: 8275249 - DNA, 18 bp, Homo sapiens
caggcctcttgatcttcc

SEQ ID NO: 8275250 - DNA, 19 bp, Homo sapiens
caggcctcttaccctctct

SEQ ID NO: 8275251 - DNA, 22 bp, Homo sapiens
tacatgttcaaatttgtctttc

SEQ ID NO: 8275252 - DNA, 22 bp, Homo sapiens
caggcctcgaggagacagctac

SEQ ID NO: 8275253 - DNA, 22 bp, Homo sapiens
caggcctctatggtcagctgag

SEQ ID NO: 8275254 - DNA, 22 bp, Homo sapiens
caggcccagcccttagccaggt

SEQ ID NO: 8275255 - DNA, 22 bp, Homo sapiens
caggcctcgaggagacagctac

SEQ ID NO: 8275256 - DNA, 22 bp, Homo sapiens
caggcccagggagggagaccaa

SEQ ID NO: 8275257 - DNA, 20 bp, Homo sapiens
cagggacagcagtgggtttt

SEQ ID NO: 8275258 - DNA, 22 bp, Homo sapiens
cagggaagagccgatgctgcag

SEQ ID NO: 8275259 - DNA, 22 bp, Homo sapiens
caggcttttatgaatttcagtg

SEQ ID NO: 8275260 - DNA, 22 bp, Homo sapiens
caggctgccgtgaagcaggcct

SEQ ID NO: 8275261 - DNA, 22 bp, Homo sapiens
caggctgccgaggctgcagaat

SEQ ID NO: 8275262 - DNA, 22 bp, Homo sapiens
caggctgccgaggctgcagaat

SEQ ID NO: 8275263 - DNA, 22 bp, Homo sapiens
caggctggcaatgcgtcaagca

SEQ ID NO: 8275264 - DNA, 22 bp, Homo sapiens
tagaaaagtatgggactgacat

SEQ ID NO: 8275265 - DNA, 22 bp, Homo sapiens
tagaaaatggccaagcaggact

SEQ ID NO: 8275266 - DNA, 22 bp, Homo sapiens
tagaaaatggccaagcaggact

SEQ ID NO: 8275267 - DNA, 22 bp, Homo sapiens
cccaggggttctgagcagcagc

SEQ ID NO: 8275268 - DNA, 22 bp, Homo sapiens
cccagggtaatcatgtgaagcc

SEQ ID NO: 8275269 - DNA, 23 bp, Homo sapiens
cccaggtagccctctagagcctg

SEQ ID NO: 8275270 - DNA, 22 bp, Homo sapiens
cccagggttgcctgcctctgct

SEQ ID NO: 8275271 - DNA, 22 bp, Homo sapiens
cccaggctggatttcggtggca

SEQ ID NO: 8275272 - DNA, 22 bp, Homo sapiens
cccaggctggagtgcaatggca

SEQ ID NO: 8275273 - DNA, 22 bp, Homo sapiens
cccaggctggagtgcaatggca

SEQ ID NO: 8275274 - DNA, 22 bp, Homo sapiens
cccaggctggagtgcaatggtg

SEQ ID NO: 8275275 - DNA, 22 bp, Homo sapiens
cccaggctggagtgcaatggtg

SEQ ID NO: 8275276 - DNA, 22 bp, Homo sapiens
cccaggctggagtgcagtggcg

SEQ ID NO: 8275277 - DNA, 22 bp, Homo sapiens
cccaggagacctagatctgttt

SEQ ID NO: 8275278 - DNA, 22 bp, Homo sapiens
cccaggagacctgtgaaaggac

SEQ ID NO: 8275279 - DNA, 22 bp, Homo sapiens
cccaggagacctgtgaaaggac

SEQ ID NO: 8275280 - DNA, 22 bp, Homo sapiens
tgccaggagtcaggccaggcag

SEQ ID NO: 8275281 - DNA, 22 bp, Homo sapiens
cccaggagacctagatctgttt

SEQ ID NO: 8275282 - DNA, 22 bp, Homo sapiens
cccaggagacatatagaaggac

SEQ ID NO: 8275283 - DNA, 22 bp, Homo sapiens
tgccagtgaaacatggaagaat

SEQ ID NO: 8275284 - DNA, 22 bp, Homo sapiens
tgccagtgagccctgggatgtg

SEQ ID NO: 8275285 - DNA, 22 bp, Homo sapiens
cccaggagagaggccagttggc

SEQ ID NO: 8275286 - DNA, 22 bp, Homo sapiens
cccaggagagggaaccaaatgt

SEQ ID NO: 8275287 - DNA, 22 bp, Homo sapiens
tgccaggagagtgcatgcaggg

SEQ ID NO: 8275288 - DNA, 19 bp, Homo sapiens
tgccaggaatactccagaa

SEQ ID NO: 8275289 - DNA, 22 bp, Homo sapiens
tgccagctccgaggagctgcag

SEQ ID NO: 8275290 - DNA, 22 bp, Homo sapiens
tgccacagaggtgaagcccact

SEQ ID NO: 8275291 - DNA, 19 bp, Homo sapiens
tgccacagataaaaactga

SEQ ID NO: 8275292 - DNA, 22 bp, Homo sapiens
tgcacagatctggtggcaagga

SEQ ID NO: 8275293 - DNA, 22 bp, Homo sapiens
cccaggctcccaggtgggacaa

SEQ ID NO: 8275294 - DNA, 22 bp, Homo sapiens
cccaggctagaaaggccaacaa

SEQ ID NO: 8275295 - DNA, 22 bp, Homo sapiens
cccaggctcagactggcttgtt

SEQ ID NO: 8275296 - DNA, 22 bp, Homo sapiens
cccaggcagtgtgtgcatgcgt

SEQ ID NO: 8275297 - DNA, 22 bp, Homo sapiens
tgcccagccagtttatggtaat

SEQ ID NO: 8275298 - DNA, 22 bp, Homo sapiens
tgcccagccaatttgttatgtt

SEQ ID NO: 8275299 - DNA, 22 bp, Homo sapiens
tgccatcacacggaacccgatt

SEQ ID NO: 8275300 - DNA, 22 bp, Homo sapiens
tgccagtgtggaactaggaaga

SEQ ID NO: 8275301 - DNA, 22 bp, Homo sapiens
tgccagtgggtgtgcagagact

SEQ ID NO: 8275302 - DNA, 22 bp, Homo sapiens
tggaatgtcataccataaaaga

SEQ ID NO: 8275303 - DNA, 22 bp, Homo sapiens
tgctgtggttcccagagtggat

SEQ ID NO: 8275304 - DNA, 22 bp, Homo sapiens
tgctgttatacttagctggtta

SEQ ID NO: 8275305 - DNA, 22 bp, Homo sapiens
tgctgtgttaaatacaagcatg

SEQ ID NO: 8275306 - DNA, 22 bp, Homo sapiens
ccctctcagtcagagccagata

SEQ ID NO: 8275307 - DNA, 22 bp, Homo sapiens
ccctcttgctgactcttaaagg

SEQ ID NO: 8275308 - DNA, 22 bp, Homo sapiens
ccccacactctttacattcata

SEQ ID NO: 8275309 - DNA, 22 bp, Homo sapiens
ccccacaactcatgttgaaact

SEQ ID NO: 8275310 - DNA, 22 bp, Homo sapiens
ccccacaggtgtctgaggcagg

SEQ ID NO: 8275311 - DNA, 22 bp, Homo sapiens
ccccacagccgccagcagggag

SEQ ID NO: 8275312 - DNA, 22 bp, Homo sapiens
ccccacagcttgtggagagaat

SEQ ID NO: 8275313 - DNA, 22 bp, Homo sapiens
ccccacagcttgtggagagaat

SEQ ID NO: 8275314 - DNA, 22 bp, Homo sapiens
ccccaccctcgctccatttcgg

SEQ ID NO: 8275315 - DNA, 22 bp, Homo sapiens
ccccacccacctaagagaaact

SEQ ID NO: 8275316 - DNA, 22 bp, Homo sapiens
ccccaccatgtagaaactgaga

SEQ ID NO: 8275317 - DNA, 22 bp, Homo sapiens
cccatttgtccaaagtataaaa

SEQ ID NO: 8275318 - DNA, 22 bp, Homo sapiens
cccatttgtatagagccttata

SEQ ID NO: 8275319 - DNA, 23 bp, Homo sapiens
cccatttgctcacaggacagcag

SEQ ID NO: 8275320 - DNA, 22 bp, Homo sapiens
cccattcatcctcgcttccttc

SEQ ID NO: 8275321 - DNA, 22 bp, Homo sapiens
cccggccccgtggcaggtaacg

SEQ ID NO: 8275322 - DNA, 22 bp, Homo sapiens
cccggacagaggggcagagtgt

SEQ ID NO: 8275323 - DNA, 22 bp, Homo sapiens
ccccttctgtgtcctgtcagcc

SEQ ID NO: 8275324 - DNA, 22 bp, Homo sapiens
tgctggctttttgtgtcaaaga

SEQ ID NO: 8275325 - DNA, 22 bp, Homo sapiens
tggagcaggccggaagtggctt

SEQ ID NO: 8275326 - DNA, 22 bp, Homo sapiens
ccctgcaggggacctgcagcct

SEQ ID NO: 8275327 - DNA, 22 bp, Homo sapiens
cccttctgtaaatgctgactgg

SEQ ID NO: 8275328 - DNA, 18 bp, Homo sapiens
tggcaggtagactcaggt

SEQ ID NO: 8275329 - DNA, 22 bp, Homo sapiens
cctcagtttatcctctgtaaca

SEQ ID NO: 8275330 - DNA, 22 bp, Homo sapiens
cctcatgatttttagcccattg

SEQ ID NO: 8275331 - DNA, 22 bp, Homo sapiens
cctcatgagaactgggctcctg

SEQ ID NO: 8275332 - DNA, 22 bp, Homo sapiens
cctcatttatagccaaagtaaa

SEQ ID NO: 8275333 - DNA, 22 bp, Homo sapiens
tggctctggtaacattgggtag

SEQ ID NO: 8275334 - DNA, 22 bp, Homo sapiens
tggctctgtcaaactgcacaca

SEQ ID NO: 8275335 - DNA, 17 bp, Homo sapiens
cctcttcctctcagctg

SEQ ID NO: 8275336 - DNA, 22 bp, Homo sapiens
cctcttccttctcactgtggaa

SEQ ID NO: 8275337 - DNA, 22 bp, Homo sapiens
cctcttctaggacgtccttgtg

SEQ ID NO: 8275338 - DNA, 22 bp, Homo sapiens
tgggagtggggcatagaaggta

SEQ ID NO: 8275339 - DNA, 22 bp, Homo sapiens
tgggagtgttcttggcttgctt

SEQ ID NO: 8275340 - DNA, 22 bp, Homo sapiens
tgggccatttttggaagactgg

SEQ ID NO: 8275341 - DNA, 22 bp, Homo sapiens
cctgagcctgcagccgagcaga

SEQ ID NO: 8275342 - DNA, 22 bp, Homo sapiens
cctgagcctggctcatgcactc

SEQ ID NO: 8275343 - DNA, 22 bp, Homo sapiens
tgggcccaggtcctgggagaag

SEQ ID NO: 8275344 - DNA, 22 bp, Homo sapiens
tgggccctgacttcaagcatcc

SEQ ID NO: 8275345 - DNA, 22 bp, Homo sapiens
tgggctgctgttacaggggctg

SEQ ID NO: 8275346 - DNA, 22 bp, Homo sapiens
cctcttcctcaccatctacaac

SEQ ID NO: 8275347 - DNA, 22 bp, Homo sapiens
tgggaagctgcattttaacaag

SEQ ID NO: 8275348 - DNA, 21 bp, Homo sapiens
cctctgctcgggcatgcgttt

SEQ ID NO: 8275349 - DNA, 22 bp, Homo sapiens
cctctgcctgcacatcatcctg

SEQ ID NO: 8275350 - DNA, 20 bp, Homo sapiens
cctctgcctttctagtctga

SEQ ID NO: 8275351 - DNA, 22 bp, Homo sapiens
cctctgcccttttcctgtatca

SEQ ID NO: 8275352 - DNA, 22 bp, Homo sapiens
cctctgcccttttcctgtatca

SEQ ID NO: 8275353 - DNA, 19 bp, Homo sapiens
tggcttccatctctctcat

SEQ ID NO: 8275354 - DNA, 19 bp, Homo sapiens
tggcttccatctctctcat

SEQ ID NO: 8275355 - DNA, 22 bp, Homo sapiens
tggcttccagaactgagcaaca

SEQ ID NO: 8275356 - DNA, 22 bp, Homo sapiens
tggcttccactgtgtgccccct

SEQ ID NO: 8275357 - DNA, 22 bp, Homo sapiens
tggcttccagagctgctccacc

SEQ ID NO: 8275358 - DNA, 22 bp, Homo sapiens
tggcttccagtaatcaggattt

SEQ ID NO: 8275359 - DNA, 22 bp, Homo sapiens
tggcttccagagctgctccacc

SEQ ID NO: 8275360 - DNA, 22 bp, Homo sapiens
tggctggctgtcaaggaaagcc

SEQ ID NO: 8275361 - DNA, 20 bp, Homo sapiens
tggctggcttgtatttcctt

SEQ ID NO: 8275362 - DNA, 22 bp, Homo sapiens
tggcttccaaattatccctaga

SEQ ID NO: 8275363 - DNA, 22 bp, Homo sapiens
tggctggctagtgggcaggatt

SEQ ID NO: 8275364 - DNA, 22 bp, Homo sapiens
tggctgctcaagggaggaggct

SEQ ID NO: 8275365 - DNA, 22 bp, Homo sapiens
tggctgctagccagagcttcag

SEQ ID NO: 8275366 - DNA, 17 bp, Homo sapiens
tggctctgtcctcagct

SEQ ID NO: 8275367 - DNA, 20 bp, Homo sapiens
ccaggcaactatcctgtctc

SEQ ID NO: 8275368 - DNA, 22 bp, Homo sapiens
ccaggatactgctctctgctgc

SEQ ID NO: 8275369 - DNA, 22 bp, Homo sapiens
ccaggcaaatccctctggcaga

SEQ ID NO: 8275370 - DNA, 22 bp, Homo sapiens
ccaggaggttgaggctgcagtg

SEQ ID NO: 8275371 - DNA, 22 bp, Homo sapiens
ccaggaggttgaggctgcagtg

SEQ ID NO: 8275372 - DNA, 22 bp, Homo sapiens
ccaggagtctggatgaggtgtc

SEQ ID NO: 8275373 - DNA, 19 bp, Homo sapiens
ccaggagtggtggggtgag

SEQ ID NO: 8275374 - DNA, 22 bp, Homo sapiens
ccaggagtggctggtgaccttc

SEQ ID NO: 8275375 - DNA, 22 bp, Homo sapiens
ccaggaggttgaggctgcagtg

SEQ ID NO: 8275376 - DNA, 22 bp, Homo sapiens
tcttcccactgcccatgggcag

SEQ ID NO: 8275377 - DNA, 22 bp, Homo sapiens
tcttcccactgcccatgggcag

SEQ ID NO: 8275378 - DNA, 22 bp, Homo sapiens
tcttcccaatgcaaagtaggac

SEQ ID NO: 8275379 - DNA, 22 bp, Homo sapiens
tcttcccagctgctgcgatgcc

SEQ ID NO: 8275380 - DNA, 22 bp, Homo sapiens
tcttcccagctgctgcgatgcc

SEQ ID NO: 8275381 - DNA, 22 bp, Homo sapiens
tcttcccagaggaggtgccagc

SEQ ID NO: 8275382 - DNA, 22 bp, Homo sapiens
tcttcccagctgctgcgatgcc

SEQ ID NO: 8275383 - DNA, 22 bp, Homo sapiens
tcttcccagaccttacatgtga

SEQ ID NO: 8275384 - DNA, 22 bp, Homo sapiens
tcttcccagaccttacatgtga

SEQ ID NO: 8275385 - DNA, 22 bp, Homo sapiens
tcttcccagaggaggtgccagc

SEQ ID NO: 8275386 - DNA, 20 bp, Homo sapiens
tcttccaggtacagtctgca

SEQ ID NO: 8275387 - DNA, 22 bp, Homo sapiens
tcttcagaggaagtcagtcttt

SEQ ID NO: 8275388 - DNA, 22 bp, Homo sapiens
tcttcactgtgaatttgttctt

SEQ ID NO: 8275389 - DNA, 21 bp, Homo sapiens
tcttcccattatgttccaatt

SEQ ID NO: 8275390 - DNA, 22 bp, Homo sapiens
tcttccctaatcaccatcttca

SEQ ID NO: 8275391 - DNA, 22 bp, Homo sapiens
tctttcttcctggagcccaaca

SEQ ID NO: 8275392 - DNA, 22 bp, Homo sapiens
tctttcttcagccctgtaagat

SEQ ID NO: 8275393 - DNA, 22 bp, Homo sapiens
tctttcttgcaaggatgcagga

SEQ ID NO: 8275394 - DNA, 22 bp, Homo sapiens
ccaggccccagggctggctttc

SEQ ID NO: 8275395 - DNA, 22 bp, Homo sapiens
ccaggcccccgagcagaagaca

SEQ ID NO: 8275396 - DNA, 22 bp, Homo sapiens
ccaggcccagggtactgaccaa

SEQ ID NO: 8275397 - DNA, 22 bp, Homo sapiens
ccaggcccaccttggccactta

SEQ ID NO: 8275398 - DNA, 22 bp, Homo sapiens
ccaggcctggacgggtggcctg

SEQ ID NO: 8275399 - DNA, 22 bp, Homo sapiens
ccaggctctgtctggtcagaag

SEQ ID NO: 8275400 - DNA, 22 bp, Homo sapiens
ccaggctctgtctggtcagaag

SEQ ID NO: 8275401 - DNA, 22 bp, Homo sapiens
tctgggagcagctcagcagatt

SEQ ID NO: 8275402 - DNA, 22 bp, Homo sapiens
tctgggagcacacgcagtgatc

SEQ ID NO: 8275403 - DNA, 22 bp, Homo sapiens
tctgggagatccaagcagaact

SEQ ID NO: 8275404 - DNA, 19 bp, Homo sapiens
ccaggacctttccagggtc

SEQ ID NO: 8275405 - DNA, 22 bp, Homo sapiens
tctggctcaaaatacgtactct

SEQ ID NO: 8275406 - DNA, 22 bp, Homo sapiens
tctggctcacttcaggcttcac

SEQ ID NO: 8275407 - DNA, 22 bp, Homo sapiens
tctggctcacttcaggcttcac

SEQ ID NO: 8275408 - DNA, 22 bp, Homo sapiens
tctggctcagggctctgaggga

SEQ ID NO: 8275409 - DNA, 21 bp, Homo sapiens
tctggcaggaagacggatggg

SEQ ID NO: 8275410 - DNA, 22 bp, Homo sapiens
tctggcaggggttctgcacttg

SEQ ID NO: 8275411 - DNA, 22 bp, Homo sapiens
tctgcttgtgtctgtccagcct

SEQ ID NO: 8275412 - DNA, 22 bp, Homo sapiens
tctgcttgcgttctgctccctc

SEQ ID NO: 8275413 - DNA, 22 bp, Homo sapiens
ccagctctcagcgggagactca

SEQ ID NO: 8275414 - DNA, 22 bp, Homo sapiens
ccagagagaaaatggagggcca

SEQ ID NO: 8275415 - DNA, 22 bp, Homo sapiens
ccagagagaaaatggagggcca

SEQ ID NO: 8275416 - DNA, 22 bp, Homo sapiens
tctcagaagtgatcaggatgtt

SEQ ID NO: 8275417 - DNA, 22 bp, Homo sapiens
ccagctctgccaagcgtcagct

SEQ ID NO: 8275418 - DNA, 22 bp, Homo sapiens
ccagctctgattttgacctcca

SEQ ID NO: 8275419 - DNA, 22 bp, Homo sapiens
ccagctctgattttgacctcca

SEQ ID NO: 8275420 - DNA, 22 bp, Homo sapiens
ccagctgctgtgcagggaggct

SEQ ID NO: 8275421 - DNA, 22 bp, Homo sapiens
ccagctgctgtgaggaccacag

SEQ ID NO: 8275422 - DNA, 22 bp, Homo sapiens
tgagacagttctgcagctgggt

SEQ ID NO: 8275423 - DNA, 22 bp, Homo sapiens
tgagacagttggtgaaatctaa

SEQ ID NO: 8275424 - DNA, 22 bp, Homo sapiens
tgaggcagaaaatagcagttca

SEQ ID NO: 8275425 - DNA, 22 bp, Homo sapiens
tgaggcagaaattcctgttttc

SEQ ID NO: 8275426 - DNA, 20 bp, Homo sapiens
tgagaaggggtcagctgtac

SEQ ID NO: 8275427 - DNA, 22 bp, Homo sapiens
ccaggggctgcagatccatggt

SEQ ID NO: 8275428 - DNA, 22 bp, Homo sapiens
ccaggtggaaggtctgtgctct

SEQ ID NO: 8275429 - DNA, 21 bp, Homo sapiens
ccagggtccagctgccatggt

SEQ ID NO: 8275430 - DNA, 22 bp, Homo sapiens
ccaggggctggtgctgagctgg

SEQ ID NO: 8275431 - DNA, 22 bp, Homo sapiens
ccaggggctggtgctgagctgg

SEQ ID NO: 8275432 - DNA, 22 bp, Homo sapiens
tgaatgatggtgtgttcttgcc

SEQ ID NO: 8275433 - DNA, 22 bp, Homo sapiens
tgaatgatgtataatattgaga

SEQ ID NO: 8275434 - DNA, 22 bp, Homo sapiens
tgaatgatctccgattagtcct

SEQ ID NO: 8275435 - DNA, 22 bp, Homo sapiens
tgaatgatgcagtataatgata

SEQ ID NO: 8275436 - DNA, 22 bp, Homo sapiens
tgaatgatctagttttgtagac

SEQ ID NO: 8275437 - DNA, 22 bp, Homo sapiens
tgaatgatacagaattatgtag

SEQ ID NO: 8275438 - DNA, 22 bp, Homo sapiens
ccaggctggagtgcagtggcac

SEQ ID NO: 8275439 - DNA, 22 bp, Homo sapiens
tgacaatagcgatttatcttgc

SEQ ID NO: 8275440 - DNA, 22 bp, Homo sapiens
tgacatcagggcaggggttgag

SEQ ID NO: 8275441 - DNA, 22 bp, Homo sapiens
tgacatcagaatggcatagaaa

SEQ ID NO: 8275442 - DNA, 22 bp, Homo sapiens
tgacatcacaagccatctgcag

SEQ ID NO: 8275443 - DNA, 22 bp, Homo sapiens
tgacatcacgtcctttcagaga

SEQ ID NO: 8275444 - DNA, 22 bp, Homo sapiens
tgacataagttggtagaaagga

SEQ ID NO: 8275445 - DNA, 22 bp, Homo sapiens
tgacatcattggccattgggga

SEQ ID NO: 8275446 - DNA, 22 bp, Homo sapiens
tgacatccggccactagactcc

SEQ ID NO: 8275447 - DNA, 22 bp, Homo sapiens
tgacatcattagtaacatagct

SEQ ID NO: 8275448 - DNA, 22 bp, Homo sapiens
tgacagtgtcagtttcctaata

SEQ ID NO: 8275449 - DNA, 21 bp, Homo sapiens
tgacagtgtggcatggaaggt

SEQ ID NO: 8275450 - DNA, 22 bp, Homo sapiens
tgacataaatctaaaggaaagg

SEQ ID NO: 8275451 - DNA, 22 bp, Homo sapiens
ccatgtgggattttggtgtctg

SEQ ID NO: 8275452 - DNA, 22 bp, Homo sapiens
tgagggcacctgggattaatgg

SEQ ID NO: 8275453 - DNA, 22 bp, Homo sapiens
tgagggcaaagtggtgctgagg

SEQ ID NO: 8275454 - DNA, 22 bp, Homo sapiens
tgagggatccagaggcagtggt

SEQ ID NO: 8275455 - DNA, 22 bp, Homo sapiens
tgagggctccccgctgctgtgt

SEQ ID NO: 8275456 - DNA, 20 bp, Homo sapiens
tgagggctaaccagactctg

SEQ ID NO: 8275457 - DNA, 22 bp, Homo sapiens
cccagacattgcagggactggt

SEQ ID NO: 8275458 - DNA, 22 bp, Homo sapiens
cccagacagtcaagaggcctgc

SEQ ID NO: 8275459 - DNA, 22 bp, Homo sapiens
cccagaaggtcgaggctgcagt

SEQ ID NO: 8275460 - DNA, 22 bp, Homo sapiens
cccagactcatccctgggagct

SEQ ID NO: 8275461 - DNA, 22 bp, Homo sapiens
tgatttcttccttgtcattaga

SEQ ID NO: 8275462 - DNA, 22 bp, Homo sapiens
ccattgtaaattctgtggaagt

SEQ ID NO: 8275463 - DNA, 22 bp, Homo sapiens
tgatttgaggtacataaatcca

SEQ ID NO: 8275464 - DNA, 23 bp, Homo sapiens
tgattttaaaaagtaagttatca

SEQ ID NO: 8275465 - DNA, 23 bp, Homo sapiens
tgattttaaaaagtaagttatca

SEQ ID NO: 8275466 - DNA, 22 bp, Homo sapiens
tgattttacttagcatgatgtt

SEQ ID NO: 8275467 - DNA, 22 bp, Homo sapiens
ccattcactgaacaaggctaaa

SEQ ID NO: 8275468 - DNA, 22 bp, Homo sapiens
tgtggcagtaaaattgggcaac

SEQ ID NO: 8275469 - DNA, 22 bp, Homo sapiens
tgtggcagtctcactggagggc

SEQ ID NO: 8275470 - DNA, 22 bp, Homo sapiens
tgtggccaccagagctgctatt

SEQ ID NO: 8275471 - DNA, 22 bp, Homo sapiens
tgtggccagaggtactatttta

SEQ ID NO: 8275472 - DNA, 20 bp, Homo sapiens
tgtggccagctctctactgg

SEQ ID NO: 8275473 - DNA, 22 bp, Homo sapiens
tgtggccagcaggtggctgtgt

SEQ ID NO: 8275474 - DNA, 22 bp, Homo sapiens
tgtggccaggcccctgatggtg

SEQ ID NO: 8275475 - DNA, 22 bp, Homo sapiens
tgtggaggattctgatgccagc

SEQ ID NO: 8275476 - DNA, 22 bp, Homo sapiens
tgtggcaaagaccatttctttc

SEQ ID NO: 8275477 - DNA, 22 bp, Homo sapiens
tcccctctggaggctgcagggg

SEQ ID NO: 8275478 - DNA, 22 bp, Homo sapiens
tgtggacagagcagaaggtcat

SEQ ID NO: 8275479 - DNA, 22 bp, Homo sapiens
tgtggacatagaagcatgtgga

SEQ ID NO: 8275480 - DNA, 18 bp, Homo sapiens
tgtggacatggctcttca

SEQ ID NO: 8275481 - DNA, 22 bp, Homo sapiens
tccccaggtcctgtcggctcct

SEQ ID NO: 8275482 - DNA, 22 bp, Homo sapiens
tgtgtccactgaatgtgtatta

SEQ ID NO: 8275483 - DNA, 22 bp, Homo sapiens
tgtgtcattgccatgaaaaggc

SEQ ID NO: 8275484 - DNA, 22 bp, Homo sapiens
tgtgtcatctgtgttacataat

SEQ ID NO: 8275485 - DNA, 23 bp, Homo sapiens
tgtgtcataaaattaaaacttca

SEQ ID NO: 8275486 - DNA, 22 bp, Homo sapiens
tgtgtcatagagagcacaaatc

SEQ ID NO: 8275487 - DNA, 19 bp, Homo sapiens
tgtggggagtcagggggct

SEQ ID NO: 8275488 - DNA, 22 bp, Homo sapiens
tgtggtcccaaggcaactggaa

SEQ ID NO: 8275489 - DNA, 22 bp, Homo sapiens
tgtgtaatatttcgtggcatgt

SEQ ID NO: 8275490 - DNA, 20 bp, Homo sapiens
tgtgtcaggccctgattaaa

SEQ ID NO: 8275491 - DNA, 22 bp, Homo sapiens
tgtgtcaggccttatcggtggc

SEQ ID NO: 8275492 - DNA, 22 bp, Homo sapiens
tgtttgaactgaataacatagt

SEQ ID NO: 8275493 - DNA, 22 bp, Homo sapiens
tgtttacatggaggttttcagc

SEQ ID NO: 8275494 - DNA, 22 bp, Homo sapiens
tgtttacatagtagctgccctg

SEQ ID NO: 8275495 - DNA, 22 bp, Homo sapiens
tgttctctctccttttgaagtg

SEQ ID NO: 8275496 - DNA, 22 bp, Homo sapiens
tgttcctgtttctgcgtagttt

SEQ ID NO: 8275497 - DNA, 22 bp, Homo sapiens
tgtttaataattctatgatagt

SEQ ID NO: 8275498 - DNA, 22 bp, Homo sapiens
tgttctgtgcatctagccagta

SEQ ID NO: 8275499 - DNA, 21 bp, Homo sapiens
tgtgtgcatatgcatgtacat

SEQ ID NO: 8275500 - DNA, 22 bp, Homo sapiens
tgtgtgcagctgaaaagcgctg

SEQ ID NO: 8275501 - DNA, 22 bp, Homo sapiens
tgtgttttccagaatggtgttt

SEQ ID NO: 8275502 - DNA, 22 bp, Homo sapiens
tgtgttttggaaggaacatgca

SEQ ID NO: 8275503 - DNA, 22 bp, Homo sapiens
tgttatactatttagaggtaca

SEQ ID NO: 8275504 - DNA, 22 bp, Homo sapiens
tgttatttgggaaagttgtaca

SEQ ID NO: 8275505 - DNA, 22 bp, Homo sapiens
tgttcacaaggtgatgctttga

SEQ ID NO: 8275506 - DNA, 22 bp, Homo sapiens
tgttcagaacaaaggtaaatga

SEQ ID NO: 8275507 - DNA, 22 bp, Homo sapiens
tgttcagaacaaaggtaaatga

SEQ ID NO: 8275508 - DNA, 22 bp, Homo sapiens
tgttcagaacaaaggtaaatga

SEQ ID NO: 8275509 - DNA, 22 bp, Homo sapiens
ttagaaagaactttagatatca

SEQ ID NO: 8275510 - DNA, 22 bp, Homo sapiens
ttagacatcaagaagccaatgt

SEQ ID NO: 8275511 - DNA, 20 bp, Homo sapiens
ttagaagggccagatgaagg

SEQ ID NO: 8275512 - DNA, 22 bp, Homo sapiens
ttagaggggctgctgaatggga

SEQ ID NO: 8275513 - DNA, 22 bp, Homo sapiens
ttagagaagctgtaattattca

SEQ ID NO: 8275514 - DNA, 22 bp, Homo sapiens
ttagagaagttttacttaagaa

SEQ ID NO: 8275515 - DNA, 22 bp, Homo sapiens
ttagagagaaccatcaggatct

SEQ ID NO: 8275516 - DNA, 22 bp, Homo sapiens
ttactttagatcatactgtgtg

SEQ ID NO: 8275517 - DNA, 18 bp, Homo sapiens
ttactgttatcaaaacag

SEQ ID NO: 8275518 - DNA, 22 bp, Homo sapiens
ttactgaattgcactccagcgt

SEQ ID NO: 8275519 - DNA, 22 bp, Homo sapiens
ttactgaaccctacttttacag

SEQ ID NO: 8275520 - DNA, 22 bp, Homo sapiens
ttactgaaataatgaaacacat

SEQ ID NO: 8275521 - DNA, 22 bp, Homo sapiens
ttactgaaggtggatagtgagt

SEQ ID NO: 8275522 - DNA, 22 bp, Homo sapiens
ttacattttggggtaaggataa

SEQ ID NO: 8275523 - DNA, 22 bp, Homo sapiens
ttactagcaggattcagattct

SEQ ID NO: 8275524 - DNA, 22 bp, Homo sapiens
ttactgaaaattcttcaggatt

SEQ ID NO: 8275525 - DNA, 22 bp, Homo sapiens
ttactgaaagtatacatttctg

SEQ ID NO: 8275526 - DNA, 22 bp, Homo sapiens
ttacacaaagttagctcttgca

SEQ ID NO: 8275527 - DNA, 22 bp, Homo sapiens
ttaattttgatgaggttcagtt

SEQ ID NO: 8275528 - DNA, 22 bp, Homo sapiens
ttaatttttatgtatagtgtgt

SEQ ID NO: 8275529 - DNA, 22 bp, Homo sapiens
ttaatttgaccataaatatctt

SEQ ID NO: 8275530 - DNA, 22 bp, Homo sapiens
ttaattttctcatctgtgaaat

SEQ ID NO: 8275531 - DNA, 22 bp, Homo sapiens
ttaattttaacctgtttgtgtc

SEQ ID NO: 8275532 - DNA, 22 bp, Homo sapiens
ttacacagatggttagtagagg

SEQ ID NO: 8275533 - DNA, 21 bp, Homo sapiens
ttacacactgcttctagaatg

SEQ ID NO: 8275534 - DNA, 22 bp, Homo sapiens
ttacacacaattagcatagtaa

SEQ ID NO: 8275535 - DNA, 22 bp, Homo sapiens
ttacacatgaaggtccaatgtt

SEQ ID NO: 8275536 - DNA, 22 bp, Homo sapiens
ttacacctcagtgagaagatct

SEQ ID NO: 8275537 - DNA, 22 bp, Homo sapiens
ttacatattatccaaaactgct

SEQ ID NO: 8275538 - DNA, 22 bp, Homo sapiens
ttaacagaggacacatcaaact

SEQ ID NO: 8275539 - DNA, 22 bp, Homo sapiens
ttaacatttcttttccactcat

SEQ ID NO: 8275540 - DNA, 22 bp, Homo sapiens
ttaacatttagtgtacccctgt

SEQ ID NO: 8275541 - DNA, 22 bp, Homo sapiens
ttaacattgtccttagcagatt

SEQ ID NO: 8275542 - DNA, 22 bp, Homo sapiens
ttaacattgtccttagcagatt

SEQ ID NO: 8275543 - DNA, 22 bp, Homo sapiens
ttaacatgtcttgacttcatct

SEQ ID NO: 8275544 - DNA, 22 bp, Homo sapiens
ttaacatgtcttgacttcatct

SEQ ID NO: 8275545 - DNA, 22 bp, Homo sapiens
ttaacattaaaagcagcatttt

SEQ ID NO: 8275546 - DNA, 22 bp, Homo sapiens
ttaactgctaccattattttcc

SEQ ID NO: 8275547 - DNA, 22 bp, Homo sapiens
ttaacatttgtgaagcatttag

SEQ ID NO: 8275548 - DNA, 22 bp, Homo sapiens
ttaagacatttttggagattat

SEQ ID NO: 8275549 - DNA, 22 bp, Homo sapiens
ttaagacagtgtatttgttttc

SEQ ID NO: 8275550 - DNA, 20 bp, Homo sapiens
ttaagaaaagcacatcctgc

SEQ ID NO: 8275551 - DNA, 22 bp, Homo sapiens
ttaattgatataaagaacttca

SEQ ID NO: 8275552 - DNA, 22 bp, Homo sapiens
ttaattatgcaaaaggccccat

SEQ ID NO: 8275553 - DNA, 22 bp, Homo sapiens
ttaattgagccagaaagtatct

SEQ ID NO: 8275554 - DNA, 22 bp, Homo sapiens
ttaatttatacataatcacagg

SEQ ID NO: 8275555 - DNA, 22 bp, Homo sapiens
ttaataaacaggtgcagctgaa

SEQ ID NO: 8275556 - DNA, 22 bp, Homo sapiens
ttaataaacaggtgcagctgaa

SEQ ID NO: 8275557 - DNA, 22 bp, Homo sapiens
ttaattatgagaaagggaaaag

SEQ ID NO: 8275558 - DNA, 22 bp, Homo sapiens
ttaagtaacttgtccaaatgag

SEQ ID NO: 8275559 - DNA, 22 bp, Homo sapiens
ttaagtgtcataatttccaaga

SEQ ID NO: 8275560 - DNA, 22 bp, Homo sapiens
tgttttcttctgtaccgtgcca

SEQ ID NO: 8275561 - DNA, 22 bp, Homo sapiens
tgttttgggtcactttccttgg

SEQ ID NO: 8275562 - DNA, 22 bp, Homo sapiens
tgtttttatctctgtgtacaac

SEQ ID NO: 8275563 - DNA, 22 bp, Homo sapiens
tgtttttaaataatgatagaaa

SEQ ID NO: 8275564 - DNA, 22 bp, Homo sapiens
tgtttttaaaatgtcctggtta

SEQ ID NO: 8275565 - DNA, 22 bp, Homo sapiens
ttaacaatagagtttcttcagg

SEQ ID NO: 8275566 - DNA, 22 bp, Homo sapiens
ttaacacagggggagacaaagt

SEQ ID NO: 8275567 - DNA, 22 bp, Homo sapiens
ttaacaaggtgactgcattaaa

SEQ ID NO: 8275568 - DNA, 22 bp, Homo sapiens
ttaacaatagagtttcttcagg

SEQ ID NO: 8275569 - DNA, 22 bp, Homo sapiens
ttaaattaggactctagttctg

SEQ ID NO: 8275570 - DNA, 22 bp, Homo sapiens
ttaaatgtgatttcatttatgt

SEQ ID NO: 8275571 - DNA, 22 bp, Homo sapiens
ttaaatgaacgagatatgcaac

SEQ ID NO: 8275572 - DNA, 22 bp, Homo sapiens
ttaaatgaggctgatgtagatt

SEQ ID NO: 8275573 - DNA, 22 bp, Homo sapiens
ttaaatgctcacataaaggtag

SEQ ID NO: 8275574 - DNA, 18 bp, Homo sapiens
ttctttaattcagtttga

SEQ ID NO: 8275575 - DNA, 22 bp, Homo sapiens
ttctttaccagtgaaatgttat

SEQ ID NO: 8275576 - DNA, 22 bp, Homo sapiens
ttctttaaatgaattctctgta

SEQ ID NO: 8275577 - DNA, 22 bp, Homo sapiens
ttctttaaaatagtgagaaaga

SEQ ID NO: 8275578 - DNA, 22 bp, Homo sapiens
ttcttctttcctataattaatt

SEQ ID NO: 8275579 - DNA, 22 bp, Homo sapiens
ttcttgaaggggatataaatag

SEQ ID NO: 8275580 - DNA, 22 bp, Homo sapiens
ttctgggctgtccagagggtga

SEQ ID NO: 8275581 - DNA, 21 bp, Homo sapiens
ttctgggccggagaaggggcg

SEQ ID NO: 8275582 - DNA, 22 bp, Homo sapiens
ttctgagattgttaggcactaa

SEQ ID NO: 8275583 - DNA, 21 bp, Homo sapiens
ttctgagcactcatcactgtc

SEQ ID NO: 8275584 - DNA, 22 bp, Homo sapiens
ttctgagatgaggaggaaaaag

SEQ ID NO: 8275585 - DNA, 22 bp, Homo sapiens
ttctgagagttgtagtgtatcc

SEQ ID NO: 8275586 - DNA, 22 bp, Homo sapiens
ttctgacctcaggtgatccgtc

SEQ ID NO: 8275587 - DNA, 20 bp, Homo sapiens
ttctatacatatcactgaaa

SEQ ID NO: 8275588 - DNA, 20 bp, Homo sapiens
ttctagtttggagttattaa

SEQ ID NO: 8275589 - DNA, 22 bp, Homo sapiens
ttctagttaaagtatgtattag

SEQ ID NO: 8275590 - DNA, 22 bp, Homo sapiens
ttgagatgtcttttggcattat

SEQ ID NO: 8275591 - DNA, 22 bp, Homo sapiens
ttgaggagttgtgacagatact

SEQ ID NO: 8275592 - DNA, 22 bp, Homo sapiens
ttgagcccaggaggcctgggtg

SEQ ID NO: 8275593 - DNA, 22 bp, Homo sapiens
ttgagcccaggaggcctgggtg

SEQ ID NO: 8275594 - DNA, 20 bp, Homo sapiens
ttgaatgaatgtctggctca

SEQ ID NO: 8275595 - DNA, 22 bp, Homo sapiens
ttgaatgaatggtccatataga

SEQ ID NO: 8275596 - DNA, 22 bp, Homo sapiens
ttgaatgaatagttgctagaag

SEQ ID NO: 8275597 - DNA, 22 bp, Homo sapiens
ttgaatgaagtccctttttact

SEQ ID NO: 8275598 - DNA, 16 bp, Homo sapiens
ttgaatgactgtgtgc

SEQ ID NO: 8275599 - DNA, 22 bp, Homo sapiens
ttgaatgagaagttattgccat

SEQ ID NO: 8275600 - DNA, 22 bp, Homo sapiens
ttgaatgattaaagtcatctga

SEQ ID NO: 8275601 - DNA, 22 bp, Homo sapiens
ttgaatgatcctatctagcaca

SEQ ID NO: 8275602 - DNA, 22 bp, Homo sapiens
ttgagatgacttaaatttggga

SEQ ID NO: 8275603 - DNA, 22 bp, Homo sapiens
ttgatcatttttctggtaaaat

SEQ ID NO: 8275604 - DNA, 22 bp, Homo sapiens
ttgatcatcttgtgctgacggc

SEQ ID NO: 8275605 - DNA, 22 bp, Homo sapiens
ttgattatagactcactaatct

SEQ ID NO: 8275606 - DNA, 22 bp, Homo sapiens
ttgcaaatgtggttagggcttt

SEQ ID NO: 8275607 - DNA, 22 bp, Homo sapiens
ttgcaaatgtttcataacagta

SEQ ID NO: 8275608 - DNA, 22 bp, Homo sapiens
ttgcaaataaacaagtatacat

SEQ ID NO: 8275609 - DNA, 22 bp, Homo sapiens
ttgcaaagagtcatgtaagtca

SEQ ID NO: 8275610 - DNA, 22 bp, Homo sapiens
ttgcaaataaacaagtatacat

SEQ ID NO: 8275611 - DNA, 21 bp, Homo sapiens
ttgattttaggaagtttgtca

SEQ ID NO: 8275612 - DNA, 22 bp, Homo sapiens
ttcctgtggccttacatctgtg

SEQ ID NO: 8275613 - DNA, 22 bp, Homo sapiens
ttcctctttgcatcctcaactc

SEQ ID NO: 8275614 - DNA, 22 bp, Homo sapiens
ttcctgtattctaaagggaaag

SEQ ID NO: 8275615 - DNA, 22 bp, Homo sapiens
ttcctgtatgtcagtgaagagc

SEQ ID NO: 8275616 - DNA, 23 bp, Homo sapiens
ttccttaactgttaagattgtct

SEQ ID NO: 8275617 - DNA, 22 bp, Homo sapiens
ttccttctccagaacttctagg

SEQ ID NO: 8275618 - DNA, 22 bp, Homo sapiens
ttccttctattcagctccaaga

SEQ ID NO: 8275619 - DNA, 22 bp, Homo sapiens
ttctacaatatgaataatgaag

SEQ ID NO: 8275620 - DNA, 22 bp, Homo sapiens
ttctagaaacacatgcaaacag

SEQ ID NO: 8275621 - DNA, 22 bp, Homo sapiens
ttctagaaactggagcaaacag

SEQ ID NO: 8275622 - DNA, 22 bp, Homo sapiens
ttctaatacacggtatgacttt

SEQ ID NO: 8275623 - DNA, 22 bp, Homo sapiens
ttctagaatccttgtctacttt

SEQ ID NO: 8275624 - DNA, 19 bp, Homo sapiens
ttctagaactgttctctca

SEQ ID NO: 8275625 - DNA, 22 bp, Homo sapiens
ttctagaaccatgacttcaggg

SEQ ID NO: 8275626 - DNA, 22 bp, Homo sapiens
ttctagatgcttataggcatat

SEQ ID NO: 8275627 - DNA, 22 bp, Homo sapiens
ttccacattccttacattcata

SEQ ID NO: 8275628 - DNA, 22 bp, Homo sapiens
ttccacaaggccttgtcctgct

SEQ ID NO: 8275629 - DNA, 22 bp, Homo sapiens
ttccctggccctggcacgctct

SEQ ID NO: 8275630 - DNA, 22 bp, Homo sapiens
ttccctggctcttctacatcgt

SEQ ID NO: 8275631 - DNA, 22 bp, Homo sapiens
ttccagagagagaaaatttgat

SEQ ID NO: 8275632 - DNA, 21 bp, Homo sapiens
ttccagagattgtttcacctg

SEQ ID NO: 8275633 - DNA, 22 bp, Homo sapiens
ttccagagcctagaatcttgat

SEQ ID NO: 8275634 - DNA, 22 bp, Homo sapiens
ttccagagcccatgctctaggc

SEQ ID NO: 8275635 - DNA, 22 bp, Homo sapiens
ttccagagaggctcatgttccc

SEQ ID NO: 8275636 - DNA, 22 bp, Homo sapiens
ttccagagagttattcccctgg

SEQ ID NO: 8275637 - DNA, 22 bp, Homo sapiens
ttcctagggcagagccgctggg

SEQ ID NO: 8275638 - DNA, 20 bp, Homo sapiens
ttcctcacaagtccctcggc

SEQ ID NO: 8275639 - DNA, 22 bp, Homo sapiens
ttcctcacactcccccattcga

SEQ ID NO: 8275640 - DNA, 22 bp, Homo sapiens
ttcctctggggccaggccaaca

SEQ ID NO: 8275641 - DNA, 22 bp, Homo sapiens
ttcctctggaggctctaggaga

SEQ ID NO: 8275642 - DNA, 22 bp, Homo sapiens
ttcctccagaagctgtagggga

SEQ ID NO: 8275643 - DNA, 22 bp, Homo sapiens
ttcctcatctgtgcacctcact

SEQ ID NO: 8275644 - DNA, 22 bp, Homo sapiens
ttcatggtattggagtatgagg

SEQ ID NO: 8275645 - DNA, 22 bp, Homo sapiens
ttcatgttggcatgtttttagg

SEQ ID NO: 8275646 - DNA, 22 bp, Homo sapiens
ttcatgtgtttgatagcccaga

SEQ ID NO: 8275647 - DNA, 22 bp, Homo sapiens
ttcagtgtcaatttttaaatat

SEQ ID NO: 8275648 - DNA, 22 bp, Homo sapiens
ttcatggagttgagaaggctaa

SEQ ID NO: 8275649 - DNA, 22 bp, Homo sapiens
ttcagtatgttggacgttatgt

SEQ ID NO: 8275650 - DNA, 22 bp, Homo sapiens
ttcagtatgctgaatgattttt

SEQ ID NO: 8275651 - DNA, 22 bp, Homo sapiens
ttcagtaaggataataaacaga

SEQ ID NO: 8275652 - DNA, 22 bp, Homo sapiens
ttcagtaaaacactgcaatgtc

SEQ ID NO: 8275653 - DNA, 22 bp, Homo sapiens
ttcagtaagcacttctagagct

SEQ ID NO: 8275654 - DNA, 22 bp, Homo sapiens
ttcagtaaggataataaacaga

SEQ ID NO: 8275655 - DNA, 21 bp, Homo sapiens
ttcaggtgagatcatgttgac

SEQ ID NO: 8275656 - DNA, 22 bp, Homo sapiens
ttcacattataatcagttctgc

SEQ ID NO: 8275657 - DNA, 22 bp, Homo sapiens
ttcacattatcaggattgtttc

SEQ ID NO: 8275658 - DNA, 22 bp, Homo sapiens
ttcacattgaaggtgctttctt

SEQ ID NO: 8275659 - DNA, 22 bp, Homo sapiens
ttcacattagtggttctatata

SEQ ID NO: 8275660 - DNA, 22 bp, Homo sapiens
ttcaacaacttggttcaaatgg

SEQ ID NO: 8275661 - DNA, 22 bp, Homo sapiens
ttcaacaacttggttcaaatgg

SEQ ID NO: 8275662 - DNA, 22 bp, Homo sapiens
ttcaacaaggctgtcaaaagtt

SEQ ID NO: 8275663 - DNA, 22 bp, Homo sapiens
ttcaacaaaatatatttttcca

SEQ ID NO: 8275664 - DNA, 22 bp, Homo sapiens
ttcaactttaggcaaagaaaac

SEQ ID NO: 8275665 - DNA, 21 bp, Homo sapiens
ttcaacagcataatgtaggaa

SEQ ID NO: 8275666 - DNA, 22 bp, Homo sapiens
ttcacaaagctggagcatttcc

SEQ ID NO: 8275667 - DNA, 22 bp, Homo sapiens
ttcacaagtcattagctgcata

SEQ ID NO: 8275668 - DNA, 22 bp, Homo sapiens
ttcaattttgcagaggaatgca

SEQ ID NO: 8275669 - DNA, 22 bp, Homo sapiens
ttcacaaaacactattttctgg

SEQ ID NO: 8275670 - DNA, 22 bp, Homo sapiens
ttcaatgtctatgtacatttta

SEQ ID NO: 8275671 - DNA, 22 bp, Homo sapiens
ttcaatgtggttataataacta

SEQ ID NO: 8275672 - DNA, 22 bp, Homo sapiens
ttcaatgttaagaagaatatgt

SEQ ID NO: 8275673 - DNA, 22 bp, Homo sapiens
ttgcaaggtcatcatgcattgg

SEQ ID NO: 8275674 - DNA, 22 bp, Homo sapiens
ttgcaagaggtgattttattga

SEQ ID NO: 8275675 - DNA, 22 bp, Homo sapiens
ttgcaagagagtctgaaaaatg

SEQ ID NO: 8275676 - DNA, 22 bp, Homo sapiens
ttgcaagttttacttacctgga

SEQ ID NO: 8275677 - DNA, 22 bp, Homo sapiens
ttgcaatcaaaaagaagtacag

SEQ ID NO: 8275678 - DNA, 22 bp, Homo sapiens
ttgcaatcagcagtgttttcac

SEQ ID NO: 8275679 - DNA, 22 bp, Homo sapiens
ttgcaatctgcaaagctgtgga

SEQ ID NO: 8275680 - DNA, 23 bp, Homo sapiens
ttgcaaatttcagttagttcatg

SEQ ID NO: 8275681 - DNA, 22 bp, Homo sapiens
ttgcaaattccaatccaatatt

SEQ ID NO: 8275682 - DNA, 22 bp, Homo sapiens
ttgtctatacatcaataatgat

SEQ ID NO: 8275683 - DNA, 22 bp, Homo sapiens
ttgtgaatagtgccgcaataaa

SEQ ID NO: 8275684 - DNA, 22 bp, Homo sapiens
ttgtctaatgagctccacttca

SEQ ID NO: 8275685 - DNA, 22 bp, Homo sapiens
ttggtttagagagtgtggttac

SEQ ID NO: 8275686 - DNA, 22 bp, Homo sapiens
ttgtgaatggtgccgcaataaa

SEQ ID NO: 8275687 - DNA, 22 bp, Homo sapiens
ttgtgttaaggtgcatctagtg

SEQ ID NO: 8275688 - DNA, 21 bp, Homo sapiens
ttgtgtttccccagtcacttt

SEQ ID NO: 8275689 - DNA, 22 bp, Homo sapiens
ttgtgtttgatgctgacacgca

SEQ ID NO: 8275690 - DNA, 22 bp, Homo sapiens
ttgtgtttctgtgatatgtaaa

SEQ ID NO: 8275691 - DNA, 20 bp, Homo sapiens
ttgttagaggaatgccatag

SEQ ID NO: 8275692 - DNA, 22 bp, Homo sapiens
ttgtgttttcttatggcataaa

SEQ ID NO: 8275693 - DNA, 22 bp, Homo sapiens
ttgtttttaaacatgtgactga

SEQ ID NO: 8275694 - DNA, 22 bp, Homo sapiens
ttgttttgctaaagggtcatca

SEQ ID NO: 8275695 - DNA, 22 bp, Homo sapiens
ttgttttgagccctggacttgc

SEQ ID NO: 8275696 - DNA, 22 bp, Homo sapiens
ttgtttgtcataatatcattac

SEQ ID NO: 8275697 - DNA, 22 bp, Homo sapiens
tttagttttgatgaaaatgcca

SEQ ID NO: 8275698 - DNA, 22 bp, Homo sapiens
tttagttttgatgaaaatgcca

SEQ ID NO: 8275699 - DNA, 22 bp, Homo sapiens
tttattaatgtagcatccatgg

SEQ ID NO: 8275700 - DNA, 22 bp, Homo sapiens
tttattaatgtagcatccatgg

SEQ ID NO: 8275701 - DNA, 22 bp, Homo sapiens
tttattaagatgcgaatgctga

SEQ ID NO: 8275702 - DNA, 22 bp, Homo sapiens
tttattaagatgcgaatgctga

SEQ ID NO: 8275703 - DNA, 21 bp, Homo sapiens
tttattaacaactgtggacgt

SEQ ID NO: 8275704 - DNA, 21 bp, Homo sapiens
tttattaacaactgtggacgt

SEQ ID NO: 8275705 - DNA, 22 bp, Homo sapiens
tttattaaaactgttggctctg

SEQ ID NO: 8275706 - DNA, 22 bp, Homo sapiens
tttattaaaactgttggctctg

SEQ ID NO: 8275707 - DNA, 22 bp, Homo sapiens
tttattaattagtgacccaatg

SEQ ID NO: 8275708 - DNA, 22 bp, Homo sapiens
tttattaattagtgacccaatg

SEQ ID NO: 8275709 - DNA, 22 bp, Homo sapiens
tttattaagatgcgaatgctga

SEQ ID NO: 8275710 - DNA, 22 bp, Homo sapiens
tttattattctctggagaatgt

SEQ ID NO: 8275711 - DNA, 22 bp, Homo sapiens
tttattatgtacaggcactata

SEQ ID NO: 8275712 - DNA, 22 bp, Homo sapiens
tttatttgtcttgccatttagt

SEQ ID NO: 8275713 - DNA, 22 bp, Homo sapiens
ttgtttttatgaacatccagga

SEQ ID NO: 8275714 - DNA, 23 bp, Homo sapiens
tttaaaagttgtaatgtaggctt

SEQ ID NO: 8275715 - DNA, 22 bp, Homo sapiens
tttaaaagttatcatctgtcca

SEQ ID NO: 8275716 - DNA, 22 bp, Homo sapiens
tttaaaagttatcatctgtcca

SEQ ID NO: 8275717 - DNA, 22 bp, Homo sapiens
tttaatgttaaatttgtagatg

SEQ ID NO: 8275718 - DNA, 22 bp, Homo sapiens
tttaattaggaaatgggcaggg

SEQ ID NO: 8275719 - DNA, 22 bp, Homo sapiens
tttaattagcaagccagagagc

SEQ ID NO: 8275720 - DNA, 22 bp, Homo sapiens
tttaattagcaagccagagagc

SEQ ID NO: 8275721 - DNA, 22 bp, Homo sapiens
tttaattatgttaagccactga

SEQ ID NO: 8275722 - DNA, 22 bp, Homo sapiens
tttaattatatctgggcagtta

SEQ ID NO: 8275723 - DNA, 22 bp, Homo sapiens
tttacaacataggccccaagaa

SEQ ID NO: 8275724 - DNA, 22 bp, Homo sapiens
tttacaacccaagtccagagag

SEQ ID NO: 8275725 - DNA, 22 bp, Homo sapiens
tttaatttgtatttctagaggg

SEQ ID NO: 8275726 - DNA, 22 bp, Homo sapiens
tttagaaattgcagagtgggtg

SEQ ID NO: 8275727 - DNA, 22 bp, Homo sapiens
tttactgaatttggtatattcc

SEQ ID NO: 8275728 - DNA, 22 bp, Homo sapiens
tttactgtctcagagagacaaa

SEQ ID NO: 8275729 - DNA, 22 bp, Homo sapiens
tttacaactttctgttctgtat

SEQ ID NO: 8275730 - DNA, 22 bp, Homo sapiens
tttacaacgttcctggtgctaa

SEQ ID NO: 8275731 - DNA, 22 bp, Homo sapiens
tttacaacctcatattctgatg

SEQ ID NO: 8275732 - DNA, 22 bp, Homo sapiens
tttcctcttctggcaggcaggg

SEQ ID NO: 8275733 - DNA, 22 bp, Homo sapiens
tttcattttggttatgccataa

SEQ ID NO: 8275734 - DNA, 22 bp, Homo sapiens
tttcagagttgtcttcttgacc

SEQ ID NO: 8275735 - DNA, 22 bp, Homo sapiens
tttcaggagagaccagaaatga

SEQ ID NO: 8275736 - DNA, 22 bp, Homo sapiens
tttcaaagagttgtaaattact

SEQ ID NO: 8275737 - DNA, 22 bp, Homo sapiens
tttcctgttgccatcaagaatg

SEQ ID NO: 8275738 - DNA, 22 bp, Homo sapiens
tttcctggaagttattcctcat

SEQ ID NO: 8275739 - DNA, 22 bp, Homo sapiens
tttcctggaccaactgagattg

SEQ ID NO: 8275740 - DNA, 22 bp, Homo sapiens
tttctccacttctcttgccaac

SEQ ID NO: 8275741 - DNA, 22 bp, Homo sapiens
tttctctttcaatctgcagtac

SEQ ID NO: 8275742 - DNA, 22 bp, Homo sapiens
tttctcttaatgtctctgtgct

SEQ ID NO: 8275743 - DNA, 22 bp, Homo sapiens
tttctctagctattcattaaat

SEQ ID NO: 8275744 - DNA, 22 bp, Homo sapiens
tttctgtacacccactattcat

SEQ ID NO: 8275745 - DNA, 22 bp, Homo sapiens
tttctgtaattggccaagtcac

SEQ ID NO: 8275746 - DNA, 21 bp, Homo sapiens
tttctgggtggctgcatagtg

SEQ ID NO: 8275747 - DNA, 22 bp, Homo sapiens
tttctggcagcgggacaggggt

SEQ ID NO: 8275748 - DNA, 22 bp, Homo sapiens
tttctgagaaattaaacacttt

SEQ ID NO: 8275749 - DNA, 22 bp, Homo sapiens
tttcttctctgattaaggctca

SEQ ID NO: 8275750 - DNA, 22 bp, Homo sapiens
tttcttgtgcctaattttgggc

SEQ ID NO: 8275751 - DNA, 22 bp, Homo sapiens
tttctttaattctcacagcaat

SEQ ID NO: 8275752 - DNA, 22 bp, Homo sapiens
tttctttaaaggaactctgttt

SEQ ID NO: 8275753 - DNA, 22 bp, Homo sapiens
tttctttatcatagcatctttg

SEQ ID NO: 8275754 - DNA, 22 bp, Homo sapiens
tttctttaggctgtgttgccaa

SEQ ID NO: 8275755 - DNA, 22 bp, Homo sapiens
tttctttaggctgtgttgccaa

SEQ ID NO: 8275756 - DNA, 22 bp, Homo sapiens
tttcttcacagggtattgggtg

SEQ ID NO: 8275757 - DNA, 22 bp, Homo sapiens
tttctgtatttaaaagatctgg

SEQ ID NO: 8275758 - DNA, 22 bp, Homo sapiens
tttctgtatttaggacaggtgg

SEQ ID NO: 8275759 - DNA, 22 bp, Homo sapiens
tttctgttgtacttaaactagg

SEQ ID NO: 8275760 - DNA, 21 bp, Homo sapiens
tttcttatctgtaaagtggga

SEQ ID NO: 8275761 - DNA, 22 bp, Homo sapiens
ttttggcagccacatgcacttg

SEQ ID NO: 8275762 - DNA, 22 bp, Homo sapiens
ttttggcatcacttgccatcta

SEQ ID NO: 8275763 - DNA, 22 bp, Homo sapiens
ttttggcagcaggtatggggca

SEQ ID NO: 8275764 - DNA, 22 bp, Homo sapiens
ttttggcaggatatgcaccagc

SEQ ID NO: 8275765 - DNA, 22 bp, Homo sapiens
ttttggcagattacttaatatg

SEQ ID NO: 8275766 - DNA, 22 bp, Homo sapiens
ttttggcactttgtctgattct

SEQ ID NO: 8275767 - DNA, 22 bp, Homo sapiens
ttttggcactgcgtctacatgg

SEQ ID NO: 8275768 - DNA, 21 bp, Homo sapiens
ttttggcaaggtgcatgtttc

SEQ ID NO: 8275769 - DNA, 22 bp, Homo sapiens
tttttcccatatagaaagccaa

SEQ ID NO: 8275770 - DNA, 22 bp, Homo sapiens
ttttggcaaaggcattctcttt

SEQ ID NO: 8275771 - DNA, 22 bp, Homo sapiens
ttttggcaagctgggagatatt

SEQ ID NO: 8275772 - DNA, 22 bp, Homo sapiens
ttttggcaaagagatagcatga

SEQ ID NO: 8275773 - DNA, 22 bp, Homo sapiens
ttttgcaaagtacattatcagg

SEQ ID NO: 8275774 - DNA, 22 bp, Homo sapiens
ttttgcaacacaggctacttca

SEQ ID NO: 8275775 - DNA, 22 bp, Homo sapiens
ttttgcaaagtacattatcagg

SEQ ID NO: 8275776 - DNA, 22 bp, Homo sapiens
ttttcttctacctgctgtccaa

SEQ ID NO: 8275777 - DNA, 22 bp, Homo sapiens
ttttgaaagagtcctgctacag

SEQ ID NO: 8275778 - DNA, 22 bp, Homo sapiens
ttttctttaatctggtggggtg

SEQ ID NO: 8275779 - DNA, 22 bp, Homo sapiens
ttttcctttggaagatgcatat

SEQ ID NO: 8275780 - DNA, 23 bp, Homo sapiens
ttttcctttggacaggctgtatt

SEQ ID NO: 8275781 - DNA, 22 bp, Homo sapiens
ttttatgaagataattttctga

SEQ ID NO: 8275782 - DNA, 22 bp, Homo sapiens
ttttatctgcttcattagttga

SEQ ID NO: 8275783 - DNA, 22 bp, Homo sapiens
ttttatctgcttcattagttga

SEQ ID NO: 8275784 - DNA, 22 bp, Homo sapiens
tttttgattcctagtctaggca

SEQ ID NO: 8275785 - DNA, 22 bp, Homo sapiens
tttttgggtccaggctgtatct

SEQ ID NO: 8275786 - DNA, 22 bp, Homo sapiens
tttttgaaggctgatgtgatta

SEQ ID NO: 8275787 - DNA, 22 bp, Homo sapiens
tttttgatactcaagaggggta

SEQ ID NO: 8275788 - DNA, 22 bp, Homo sapiens
tttttgatctgagcagttggag

SEQ ID NO: 8275789 - DNA, 22 bp, Homo sapiens
tttggcaccatttttattctct

SEQ ID NO: 8275790 - DNA, 22 bp, Homo sapiens
tttggcacagtactttttggct

SEQ ID NO: 8275791 - DNA, 22 bp, Homo sapiens
tttggcaatttgactgtatagg

SEQ ID NO: 8275792 - DNA, 22 bp, Homo sapiens
tttggcaagtgggaaattagta

SEQ ID NO: 8275793 - DNA, 22 bp, Homo sapiens
tttggcaatggatggtcatcta

SEQ ID NO: 8275794 - DNA, 22 bp, Homo sapiens
tttggcaatatctgaattatag

SEQ ID NO: 8275795 - DNA, 22 bp, Homo sapiens
tttggcaatgactgcatccatg

SEQ ID NO: 8275796 - DNA, 22 bp, Homo sapiens
tttggcaagcgtgccttgtcgg

SEQ ID NO: 8275797 - DNA, 22 bp, Homo sapiens
tttggcaacggagaacttactc

SEQ ID NO: 8275798 - DNA, 22 bp, Homo sapiens
tttggcaagcgagtactttctg

SEQ ID NO: 8275799 - DNA, 22 bp, Homo sapiens
tttggcaagaaaatgtgattga

SEQ ID NO: 8275800 - DNA, 19 bp, Homo sapiens
tttggcagcattaatatca

SEQ ID NO: 8275801 - DNA, 22 bp, Homo sapiens
tttgtacatcctaattctgagt

SEQ ID NO: 8275802 - DNA, 22 bp, Homo sapiens
tttgtacacaacctgtggtagt

SEQ ID NO: 8275803 - DNA, 22 bp, Homo sapiens
tttggcaaacataagcctttct

SEQ ID NO: 8275804 - DNA, 22 bp, Homo sapiens
tttggcaaacttttaggacttt

SEQ ID NO: 8275805 - DNA, 22 bp, Homo sapiens
tttggcaaagatcaacatgtta

SEQ ID NO: 8275806 - DNA, 22 bp, Homo sapiens
tttggcaaagatggctagctgt

SEQ ID NO: 8275807 - DNA, 22 bp, Homo sapiens
tttggcaaattcttggtagtat

SEQ ID NO: 8275808 - DNA, 22 bp, Homo sapiens
tttggcaacctcaatggctcta

SEQ ID NO: 8275809 - DNA, 22 bp, Homo sapiens
tttggcaaaggtcagagactcc

SEQ ID NO: 8275810 - DNA, 22 bp, Homo sapiens
tttggcaaaactgtgtctatct

SEQ ID NO: 8275811 - DNA, 22 bp, Homo sapiens
tttggacacattatttatcttc

SEQ ID NO: 8275812 - DNA, 22 bp, Homo sapiens
tttggacatgagtctttaatct

SEQ ID NO: 8275813 - DNA, 22 bp, Homo sapiens
tttggaagtaaatgagtgtttt

SEQ ID NO: 8275814 - DNA, 22 bp, Homo sapiens
tttggaagatagttcggcagtt

SEQ ID NO: 8275815 - DNA, 22 bp, Homo sapiens
tttggaagggaaccaaaacatg

SEQ ID NO: 8275816 - DNA, 22 bp, Homo sapiens
tttgcagtagacatcttatttt

SEQ ID NO: 8275817 - DNA, 22 bp, Homo sapiens
tttgcagtcaaatttgctaaat

SEQ ID NO: 8275818 - DNA, 22 bp, Homo sapiens
tttgcagtctggcctgctttgg

SEQ ID NO: 8275819 - DNA, 22 bp, Homo sapiens
tttggaacaagacaaaacatta

SEQ ID NO: 8275820 - DNA, 22 bp, Homo sapiens
tttgcaatagtcctggcctgta

SEQ ID NO: 8275821 - DNA, 22 bp, Homo sapiens
tttgcaatggtagttgttgctc

SEQ ID NO: 8275822 - DNA, 22 bp, Homo sapiens
tttgcaattttctgtccttgta

SEQ ID NO: 8275823 - DNA, 22 bp, Homo sapiens
tttgcactagcatttgtccatg

SEQ ID NO: 8275824 - DNA, 22 bp, Homo sapiens
tttgcacttaacttatttgaaa

SEQ ID NO: 8275825 - DNA, 22 bp, Homo sapiens
tttgcacttaaatttacaacac

SEQ ID NO: 8275826 - DNA, 22 bp, Homo sapiens
tttgcacacattcttagaaatg

SEQ ID NO: 8275827 - DNA, 22 bp, Homo sapiens
tttgcaatttgtgctgcaaatg

SEQ ID NO: 8275828 - DNA, 20 bp, Homo sapiens
tttgatttcacaaggccagt

SEQ ID NO: 8275829 - DNA, 22 bp, Homo sapiens
tttgcaaataaataagtgctcg

SEQ ID NO: 8275830 - DNA, 22 bp, Homo sapiens
tttctttccatacatattgcta

SEQ ID NO: 8275831 - DNA, 22 bp, Homo sapiens
tttctttatcctcctttgcaca

SEQ ID NO: 8275832 - DNA, 22 bp, Homo sapiens
tttctttccagagtgattggca

SEQ ID NO: 8275833 - DNA, 22 bp, Homo sapiens
ttttatcaatcattaagacatt

SEQ ID NO: 8275834 - DNA, 22 bp, Homo sapiens
ttttagaatcaggttgtctggg

SEQ ID NO: 8275835 - DNA, 22 bp, Homo sapiens
ttttataagcaagaaagggaaa

SEQ ID NO: 8275836 - DNA, 22 bp, Homo sapiens
ttttatagctgaatagtattcc

SEQ ID NO: 8275837 - DNA, 22 bp, Homo sapiens
ttttatatggcacattggttgg

SEQ ID NO: 8275838 - DNA, 22 bp, Homo sapiens
tttgttttcaatgtgtcattca

SEQ ID NO: 8275839 - DNA, 22 bp, Homo sapiens
tttgtttggcaacttggtaaag

SEQ ID NO: 8275840 - DNA, 22 bp, Homo sapiens
tttgtttagatggtaaatcagt

SEQ ID NO: 8275841 - DNA, 22 bp, Homo sapiens
tttgtttagaaagagattggtg

SEQ ID NO: 8275842 - DNA, 22 bp, Homo sapiens
tttgttttctgtaggcctttcc

SEQ ID NO: 8275843 - DNA, 22 bp, Homo sapiens
tttgttttctgtaggcctttcc

SEQ ID NO: 8275844 - DNA, 22 bp, Homo sapiens
tttgtattccatatcatgccat

SEQ ID NO: 8275845 - DNA, 22 bp, Homo sapiens
tttgtattacaaagtcacagta

SEQ ID NO: 8275846 - DNA, 22 bp, Homo sapiens
tttgtatttttcccagctagct

SEQ ID NO: 8275847 - DNA, 20 bp, Homo sapiens
tttgtcaactgcatccagca

SEQ ID NO: 8275848 - DNA, 22 bp, Homo sapiens
caccaggaagctgcaatttgag

SEQ ID NO: 8275849 - DNA, 22 bp, Homo sapiens
caccaggacttaacacattccc

SEQ ID NO: 8275850 - DNA, 22 bp, Homo sapiens
caccagctctccaccaggtttc

SEQ ID NO: 8275851 - DNA, 22 bp, Homo sapiens
cacattctgtccttgaactgca

SEQ ID NO: 8275852 - DNA, 22 bp, Homo sapiens
ggcagaggtgacagtgtctttt

SEQ ID NO: 8275853 - DNA, 22 bp, Homo sapiens
ggcagagtgctctgggcagggg

SEQ ID NO: 8275854 - DNA, 22 bp, Homo sapiens
ggcaagttgctattctttaatg

SEQ ID NO: 8275855 - DNA, 22 bp, Homo sapiens
ggcaatttgcagtttgtcttat

SEQ ID NO: 8275856 - DNA, 22 bp, Homo sapiens
ggcaatttggtcatttgtattg

SEQ ID NO: 8275857 - DNA, 22 bp, Homo sapiens
ggcaattttcatgaattattga

SEQ ID NO: 8275858 - DNA, 22 bp, Homo sapiens
ggcaattttaggcatgaatgaa

SEQ ID NO: 8275859 - DNA, 22 bp, Homo sapiens
ggcaattcataatcggttaacc

SEQ ID NO: 8275860 - DNA, 22 bp, Homo sapiens
ggcaatttcatgtggtttaaac

SEQ ID NO: 8275861 - DNA, 22 bp, Homo sapiens
cacatgaaggctggggtcgtga

SEQ ID NO: 8275862 - DNA, 22 bp, Homo sapiens
cacatgaaggctggggtcgtga

SEQ ID NO: 8275863 - DNA, 22 bp, Homo sapiens
cacatgactctggctacccaga

SEQ ID NO: 8275864 - DNA, 22 bp, Homo sapiens
cacatgaccactctttacttct

SEQ ID NO: 8275865 - DNA, 22 bp, Homo sapiens
cacatgacactattttgttcta

SEQ ID NO: 8275866 - DNA, 19 bp, Homo sapiens
cacatgagggctgagggac

SEQ ID NO: 8275867 - DNA, 22 bp, Homo sapiens
cacagtaaccccaggactggga

SEQ ID NO: 8275868 - DNA, 22 bp, Homo sapiens
cacagtaactcctgacccctcg

SEQ ID NO: 8275869 - DNA, 22 bp, Homo sapiens
cacagtaactggcgtgtagtaa

SEQ ID NO: 8275870 - DNA, 22 bp, Homo sapiens
cacagtaaggtatcccagtgaa

SEQ ID NO: 8275871 - DNA, 22 bp, Homo sapiens
cacagtaagaaatgaagaggta

SEQ ID NO: 8275872 - DNA, 22 bp, Homo sapiens
cacagtacccagcactactgag

SEQ ID NO: 8275873 - DNA, 22 bp, Homo sapiens
cacaggttagcagcttgaaact

SEQ ID NO: 8275874 - DNA, 22 bp, Homo sapiens
cacaggtgttcttgcagtgaaa

SEQ ID NO: 8275875 - DNA, 22 bp, Homo sapiens
ggcaaggtgatgaatgtctaca

SEQ ID NO: 8275876 - DNA, 22 bp, Homo sapiens
ggcaaggtactctagagcacat

SEQ ID NO: 8275877 - DNA, 22 bp, Homo sapiens
cacaggcaggaggttctccagt

SEQ ID NO: 8275878 - DNA, 22 bp, Homo sapiens
cacaggccaataccctctctct

SEQ ID NO: 8275879 - DNA, 22 bp, Homo sapiens
cacagggcaggtactctcagag

SEQ ID NO: 8275880 - DNA, 22 bp, Homo sapiens
cacaggtaatagcctaggctat

SEQ ID NO: 8275881 - DNA, 22 bp, Homo sapiens
cacaggtattatcggtgctgca

SEQ ID NO: 8275882 - DNA, 22 bp, Homo sapiens
cacaggtatatgtgtatatact

SEQ ID NO: 8275883 - DNA, 22 bp, Homo sapiens
cacaggtagatgccatgcagca

SEQ ID NO: 8275884 - DNA, 22 bp, Homo sapiens
cacaggtagaattttagggaaa

SEQ ID NO: 8275885 - DNA, 22 bp, Homo sapiens
cacaggtacatccttatcccca

SEQ ID NO: 8275886 - DNA, 17 bp, Homo sapiens
cacttgctggtctacct

SEQ ID NO: 8275887 - DNA, 17 bp, Homo sapiens
ggctgctgtgctggtgc

SEQ ID NO: 8275888 - DNA, 21 bp, Homo sapiens
cactttaaaaatatctttata

SEQ ID NO: 8275889 - DNA, 21 bp, Homo sapiens
cactttaaaaatatctttata

SEQ ID NO: 8275890 - DNA, 22 bp, Homo sapiens
cacttgttggtggtgaaatcac

SEQ ID NO: 8275891 - DNA, 21 bp, Homo sapiens
cactgtatagcaggagaaaac

SEQ ID NO: 8275892 - DNA, 22 bp, Homo sapiens
ggctctgcttcagaaggctcat

SEQ ID NO: 8275893 - DNA, 22 bp, Homo sapiens
ggctctgctggattgaggccag

SEQ ID NO: 8275894 - DNA, 22 bp, Homo sapiens
ggctctgcttgaggccagcctg

SEQ ID NO: 8275895 - DNA, 22 bp, Homo sapiens
ggctctgcttctcacctgttcc

SEQ ID NO: 8275896 - DNA, 22 bp, Homo sapiens
cactgtactgggttgaaggacg

SEQ ID NO: 8275897 - DNA, 22 bp, Homo sapiens
cactgtacccatttaaataaat

SEQ ID NO: 8275898 - DNA, 22 bp, Homo sapiens
cactgcactccagcctgggtga

SEQ ID NO: 8275899 - DNA, 22 bp, Homo sapiens
cactgcactccagcctgggtca

SEQ ID NO: 8275900 - DNA, 22 bp, Homo sapiens
cactgcactccagcctgggtca

SEQ ID NO: 8275901 - DNA, 22 bp, Homo sapiens
cactgcactccagcctgggtga

SEQ ID NO: 8275902 - DNA, 22 bp, Homo sapiens
caccaggataaaacctctagat

SEQ ID NO: 8275903 - DNA, 22 bp, Homo sapiens
caccaggcacagctctcctgct

SEQ ID NO: 8275904 - DNA, 22 bp, Homo sapiens
caccaggctgagcctctcatct

SEQ ID NO: 8275905 - DNA, 22 bp, Homo sapiens
caccaggctgaaccagagggga

SEQ ID NO: 8275906 - DNA, 22 bp, Homo sapiens
cacctgcctgcaggggctccac

SEQ ID NO: 8275907 - DNA, 22 bp, Homo sapiens
ggccaggctgctgggaccccgc

SEQ ID NO: 8275908 - DNA, 22 bp, Homo sapiens
ggccaggctggtctcagacttc

SEQ ID NO: 8275909 - DNA, 22 bp, Homo sapiens
cacctgggctaaactatgcagg

SEQ ID NO: 8275910 - DNA, 21 bp, Homo sapiens
cactctcccaatccttgctga

SEQ ID NO: 8275911 - DNA, 22 bp, Homo sapiens
cactgcaacctccacctcctgg

SEQ ID NO: 8275912 - DNA, 22 bp, Homo sapiens
cactgcactccagcctggcctg

SEQ ID NO: 8275913 - DNA, 22 bp, Homo sapiens
cactgcactccagcctgggaga

SEQ ID NO: 8275914 - DNA, 22 bp, Homo sapiens
cactgcactccagcctgcgcaa

SEQ ID NO: 8275915 - DNA, 22 bp, Homo sapiens
cactgcactccagcctgggaga

SEQ ID NO: 8275916 - DNA, 22 bp, Homo sapiens
cactctccagcacaccccattt

SEQ ID NO: 8275917 - DNA, 22 bp, Homo sapiens
cactccaggtcccagttcctgg

SEQ ID NO: 8275918 - DNA, 22 bp, Homo sapiens
cactccctctagttgcattctg

SEQ ID NO: 8275919 - DNA, 22 bp, Homo sapiens
cactccaagacctactttctct

SEQ ID NO: 8275920 - DNA, 22 bp, Homo sapiens
caattgacaatgacagtgtcaa

SEQ ID NO: 8275921 - DNA, 22 bp, Homo sapiens
caatttcaatgaggccacaggg

SEQ ID NO: 8275922 - DNA, 22 bp, Homo sapiens
caatttcaatacaaaatacatt

SEQ ID NO: 8275923 - DNA, 22 bp, Homo sapiens
caatttcagtgctgtggagagg

SEQ ID NO: 8275924 - DNA, 22 bp, Homo sapiens
caatttcactaatgatgtgggg

SEQ ID NO: 8275925 - DNA, 22 bp, Homo sapiens
caatttcattaatagatataga

SEQ ID NO: 8275926 - DNA, 22 bp, Homo sapiens
caatttcattaatagatataga

SEQ ID NO: 8275927 - DNA, 22 bp, Homo sapiens
caatttcatggataaaagatgt

SEQ ID NO: 8275928 - DNA, 22 bp, Homo sapiens
caaggctaagctttggctttct

SEQ ID NO: 8275929 - DNA, 22 bp, Homo sapiens
gctggggagcaagagtagtgag

SEQ ID NO: 8275930 - DNA, 22 bp, Homo sapiens
caaggctataatgttgctggaa

SEQ ID NO: 8275931 - DNA, 22 bp, Homo sapiens
caaggctctgcttctatcacat

SEQ ID NO: 8275932 - DNA, 22 bp, Homo sapiens
caaggcttagtcagagggtgct

SEQ ID NO: 8275933 - DNA, 20 bp, Homo sapiens
cacaactgtccacatgctcc

SEQ ID NO: 8275934 - DNA, 22 bp, Homo sapiens
ggacattgaagctggaaaggga

SEQ ID NO: 8275935 - DNA, 22 bp, Homo sapiens
ggacatggagctccatggaggc

SEQ ID NO: 8275936 - DNA, 23 bp, Homo sapiens
ggaagctcacgtagtcctgcact

SEQ ID NO: 8275937 - DNA, 22 bp, Homo sapiens
ggaagctccccaagcctgccct

SEQ ID NO: 8275938 - DNA, 22 bp, Homo sapiens
ggaagctggtaattgttgggac

SEQ ID NO: 8275939 - DNA, 22 bp, Homo sapiens
cacacagtagtatgaggcaaaa

SEQ ID NO: 8275940 - DNA, 22 bp, Homo sapiens
cacacaggagagtgctggaggt

SEQ ID NO: 8275941 - DNA, 22 bp, Homo sapiens
ggagagaggagcccactgctgt

SEQ ID NO: 8275942 - DNA, 22 bp, Homo sapiens
ggagaagggccaattccatgta

SEQ ID NO: 8275943 - DNA, 22 bp, Homo sapiens
ggagaagggtatgtgtggcgga

SEQ ID NO: 8275944 - DNA, 22 bp, Homo sapiens
caagcctcagaatcttctccat

SEQ ID NO: 8275945 - DNA, 22 bp, Homo sapiens
gctggctgagttctgtcgtctg

SEQ ID NO: 8275946 - DNA, 22 bp, Homo sapiens
gctggctgaggtctagctcttt

SEQ ID NO: 8275947 - DNA, 22 bp, Homo sapiens
gctggctctttttgccgggctc

SEQ ID NO: 8275948 - DNA, 22 bp, Homo sapiens
gctggctcttcagtggagatag

SEQ ID NO: 8275949 - DNA, 17 bp, Homo sapiens
gctggctgacccatgcc

SEQ ID NO: 8275950 - DNA, 22 bp, Homo sapiens
caagctccttacatccacaggg

SEQ ID NO: 8275951 - DNA, 22 bp, Homo sapiens
gctggaagaatgagtgcctcgt

SEQ ID NO: 8275952 - DNA, 22 bp, Homo sapiens
gctgctggccgcccagcttctc

SEQ ID NO: 8275953 - DNA, 22 bp, Homo sapiens
gctggacatccatcctgtagaa

SEQ ID NO: 8275954 - DNA, 22 bp, Homo sapiens
caagaagaggtgattggtaagt

SEQ ID NO: 8275955 - DNA, 22 bp, Homo sapiens
caagaatagctacctcccatat

SEQ ID NO: 8275956 - DNA, 22 bp, Homo sapiens
caagaatataaatactttcaaa

SEQ ID NO: 8275957 - DNA, 22 bp, Homo sapiens
caagaatatatatggagtggag

SEQ ID NO: 8275958 - DNA, 22 bp, Homo sapiens
caagaataaaatacatgttgat

SEQ ID NO: 8275959 - DNA, 22 bp, Homo sapiens
caagaataaccagacaatagca

SEQ ID NO: 8275960 - DNA, 22 bp, Homo sapiens
gctctggatccggctgggtctg

SEQ ID NO: 8275961 - DNA, 22 bp, Homo sapiens
caaagtcctagaacagtgcttg

SEQ ID NO: 8275962 - DNA, 22 bp, Homo sapiens
caaagtccatagtttacaatag

SEQ ID NO: 8275963 - DNA, 22 bp, Homo sapiens
caaagtcttggtgatcaacttt

SEQ ID NO: 8275964 - DNA, 22 bp, Homo sapiens
caaagtcataaaacttgtaagt

SEQ ID NO: 8275965 - DNA, 22 bp, Homo sapiens
gctgccctctctggccccacac

SEQ ID NO: 8275966 - DNA, 18 bp, Homo sapiens
gctgccctagctcccctc

SEQ ID NO: 8275967 - DNA, 22 bp, Homo sapiens
gctgccctccagttcccacagt

SEQ ID NO: 8275968 - DNA, 22 bp, Homo sapiens
gctgcctgatgtccagcaggac

SEQ ID NO: 8275969 - DNA, 22 bp, Homo sapiens
caagaaactttattctgccata

SEQ ID NO: 8275970 - DNA, 22 bp, Homo sapiens
caagaaacaccaatgactgctg

SEQ ID NO: 8275971 - DNA, 22 bp, Homo sapiens
caacttttctgtgaatttaagt

SEQ ID NO: 8275972 - DNA, 22 bp, Homo sapiens
gctgccctgtccggctctcctg

SEQ ID NO: 8275973 - DNA, 22 bp, Homo sapiens
caacaagtgggtactttacagg

SEQ ID NO: 8275974 - DNA, 22 bp, Homo sapiens
caacaatatgccagactcaatt

SEQ ID NO: 8275975 - DNA, 22 bp, Homo sapiens
caacacattgaagctatgatga

SEQ ID NO: 8275976 - DNA, 18 bp, Homo sapiens
gtgagcagagagcatcac

SEQ ID NO: 8275977 - DNA, 22 bp, Homo sapiens
cagccctcctaccctgccaggc

SEQ ID NO: 8275978 - DNA, 22 bp, Homo sapiens
cagccctcctaccctgccaggc

SEQ ID NO: 8275979 - DNA, 22 bp, Homo sapiens
gtcctggttttcacagaccttt

SEQ ID NO: 8275980 - DNA, 22 bp, Homo sapiens
gtcctggtgccacctgcgggat

SEQ ID NO: 8275981 - DNA, 22 bp, Homo sapiens
gtcctggtgctggtcattgtcg

SEQ ID NO: 8275982 - DNA, 17 bp, Homo sapiens
gtcctggtgtgtgagga

SEQ ID NO: 8275983 - DNA, 22 bp, Homo sapiens
gtcctggtggagtctctgggga

SEQ ID NO: 8275984 - DNA, 22 bp, Homo sapiens
gtcctggtgggacaatggacat

SEQ ID NO: 8275985 - DNA, 22 bp, Homo sapiens
gtcctggtgaggtagtgggagg

SEQ ID NO: 8275986 - DNA, 22 bp, Homo sapiens
gtcctggtcctgcctccccatg

SEQ ID NO: 8275987 - DNA, 22 bp, Homo sapiens
gtcctggtataattgtttaaaa

SEQ ID NO: 8275988 - DNA, 22 bp, Homo sapiens
gtgagagattgattgtagcggc

SEQ ID NO: 8275989 - DNA, 22 bp, Homo sapiens
gtgagagggctgggctcatgat

SEQ ID NO: 8275990 - DNA, 22 bp, Homo sapiens
cagccctgtctatgactgatga

SEQ ID NO: 8275991 - DNA, 22 bp, Homo sapiens
cagccctgtccagcagagggtg

SEQ ID NO: 8275992 - DNA, 22 bp, Homo sapiens
cagccctgtccctgagggacct

SEQ ID NO: 8275993 - DNA, 22 bp, Homo sapiens
cagccctgtccaatgtctgctc

SEQ ID NO: 8275994 - DNA, 22 bp, Homo sapiens
gtacacataggttactgattaa

SEQ ID NO: 8275995 - DNA, 22 bp, Homo sapiens
cagcagcctagaagctctacca

SEQ ID NO: 8275996 - DNA, 22 bp, Homo sapiens
gtactgaaaagttttctaatct

SEQ ID NO: 8275997 - DNA, 22 bp, Homo sapiens
gtactttaaatcaatgtagatt

SEQ ID NO: 8275998 - DNA, 22 bp, Homo sapiens
gtactttaaatcaatgtagatt

SEQ ID NO: 8275999 - DNA, 22 bp, Homo sapiens
gtactttagagtaaaatagacc

SEQ ID NO: 8276000 - DNA, 22 bp, Homo sapiens
gtactttagagtaaaatagacc

SEQ ID NO: 8276001 - DNA, 22 bp, Homo sapiens
cagcagccactagagggctcac

SEQ ID NO: 8276002 - DNA, 22 bp, Homo sapiens
cagcaaaggggatgcgtcctaa

SEQ ID NO: 8276003 - DNA, 22 bp, Homo sapiens
cagcaaagcaggctcctagaac

SEQ ID NO: 8276004 - DNA, 20 bp, Homo sapiens
cagcagccattctagtagta

SEQ ID NO: 8276005 - DNA, 22 bp, Homo sapiens
cagcagccagacaagatacatc

SEQ ID NO: 8276006 - DNA, 19 bp, Homo sapiens
cagcagccagggggcccct

SEQ ID NO: 8276007 - DNA, 22 bp, Homo sapiens
cagcagcctacaatgcacagaa

SEQ ID NO: 8276008 - DNA, 22 bp, Homo sapiens
cagcagccgagagggggctctg

SEQ ID NO: 8276009 - DNA, 22 bp, Homo sapiens
cagattctgaagtctagctgct

SEQ ID NO: 8276010 - DNA, 22 bp, Homo sapiens
cagattaagtgctcaacagtgt

SEQ ID NO: 8276011 - DNA, 22 bp, Homo sapiens
gtattttatggcatgcagtggc

SEQ ID NO: 8276012 - DNA, 22 bp, Homo sapiens
gtcacagaggctgccagggttg

SEQ ID NO: 8276013 - DNA, 17 bp, Homo sapiens
gtcagcagcttgcttgt

SEQ ID NO: 8276014 - DNA, 22 bp, Homo sapiens
gtcagcagtggcagctcccggg

SEQ ID NO: 8276015 - DNA, 22 bp, Homo sapiens
gtccagagggctgcaggatgct

SEQ ID NO: 8276016 - DNA, 22 bp, Homo sapiens
gtccagagggctgcaggatgct

SEQ ID NO: 8276017 - DNA, 22 bp, Homo sapiens
gtccagaggtccaggatcaagg

SEQ ID NO: 8276018 - DNA, 22 bp, Homo sapiens
gtccagagaggcaggaggctac

SEQ ID NO: 8276019 - DNA, 22 bp, Homo sapiens
gtccagagatggacgagcagat

SEQ ID NO: 8276020 - DNA, 22 bp, Homo sapiens
cagccaggagctccccctgctc

SEQ ID NO: 8276021 - DNA, 22 bp, Homo sapiens
cagccaggagctccccctgctc

SEQ ID NO: 8276022 - DNA, 22 bp, Homo sapiens
cagccaggagctccccctgctc

SEQ ID NO: 8276023 - DNA, 22 bp, Homo sapiens
cagccaggagcctctgcaacta

SEQ ID NO: 8276024 - DNA, 22 bp, Homo sapiens
cagccaggagcctctgcaacta

SEQ ID NO: 8276025 - DNA, 22 bp, Homo sapiens
cagccaggagcctctgcaacta

SEQ ID NO: 8276026 - DNA, 22 bp, Homo sapiens
cagccaggcccagatcatgctg

SEQ ID NO: 8276027 - DNA, 22 bp, Homo sapiens
cagccaggcccagatcatgctg

SEQ ID NO: 8276028 - DNA, 22 bp, Homo sapiens
cagccaggcccagatcatgctg

SEQ ID NO: 8276029 - DNA, 22 bp, Homo sapiens
cagccaggatggagaactgttg

SEQ ID NO: 8276030 - DNA, 22 bp, Homo sapiens
cagccaggatggagaactgttg

SEQ ID NO: 8276031 - DNA, 22 bp, Homo sapiens
gtccagagtagtcgagtattct

SEQ ID NO: 8276032 - DNA, 22 bp, Homo sapiens
gtccagagtattcaagtaactt

SEQ ID NO: 8276033 - DNA, 22 bp, Homo sapiens
gtccagagttagaaatgaatat

SEQ ID NO: 8276034 - DNA, 22 bp, Homo sapiens
cagccagctgtcccaagtgcct

SEQ ID NO: 8276035 - DNA, 22 bp, Homo sapiens
gggtaccaagctgcttgggggc

SEQ ID NO: 8276036 - DNA, 22 bp, Homo sapiens
gggtagccagacaaggggatgc

SEQ ID NO: 8276037 - DNA, 22 bp, Homo sapiens
gggtaggaaatccagaggtggc

SEQ ID NO: 8276038 - DNA, 22 bp, Homo sapiens
gggtccagtagttggtggccgt

SEQ ID NO: 8276039 - DNA, 20 bp, Homo sapiens
gggtccctccggcctgctat

SEQ ID NO: 8276040 - DNA, 20 bp, Homo sapiens
gggtcctgacttggtctcct

SEQ ID NO: 8276041 - DNA, 22 bp, Homo sapiens
ggtattcaatcagtgttcattc

SEQ ID NO: 8276042 - DNA, 22 bp, Homo sapiens
ggtattcacaatatttaaagag

SEQ ID NO: 8276043 - DNA, 22 bp, Homo sapiens
gggtgggatctgtggagcctca

SEQ ID NO: 8276044 - DNA, 22 bp, Homo sapiens
ggtcctaagtggcagctggtat

SEQ ID NO: 8276045 - DNA, 22 bp, Homo sapiens
cagatgcacattctcatcagca

SEQ ID NO: 8276046 - DNA, 22 bp, Homo sapiens
ggtatttactgagagccactct

SEQ ID NO: 8276047 - DNA, 22 bp, Homo sapiens
ggtcaagacgggctctgccctt

SEQ ID NO: 8276048 - DNA, 22 bp, Homo sapiens
gggtacagttcttccagtgtca

SEQ ID NO: 8276049 - DNA, 22 bp, Homo sapiens
gggtaaatctcttttcatggct

SEQ ID NO: 8276050 - DNA, 22 bp, Homo sapiens
ggggccttggatctgtgccccg

SEQ ID NO: 8276051 - DNA, 22 bp, Homo sapiens
ggggaggaagctctcagttcca

SEQ ID NO: 8276052 - DNA, 22 bp, Homo sapiens
ggggcagagaataaaaacctaa

SEQ ID NO: 8276053 - DNA, 22 bp, Homo sapiens
ggggcagagcatagctccaatt

SEQ ID NO: 8276054 - DNA, 22 bp, Homo sapiens
ggggcagagcatagctccaatt

SEQ ID NO: 8276055 - DNA, 22 bp, Homo sapiens
ggggcagagagaaggaagcttg

SEQ ID NO: 8276056 - DNA, 21 bp, Homo sapiens
ggggcagagctaggccctgca

SEQ ID NO: 8276057 - DNA, 22 bp, Homo sapiens
ggggcctcgccgccgcctctgc

SEQ ID NO: 8276058 - DNA, 22 bp, Homo sapiens
ggggcctctgcagtcacgctgg

SEQ ID NO: 8276059 - DNA, 22 bp, Homo sapiens
ggggcagatggaacagagcaca

SEQ ID NO: 8276060 - DNA, 22 bp, Homo sapiens
gggctggaggaccggcctcgga

SEQ ID NO: 8276061 - DNA, 22 bp, Homo sapiens
gggctggaggagatccagaggc

SEQ ID NO: 8276062 - DNA, 22 bp, Homo sapiens
gggctggatctcacgtgagacc

SEQ ID NO: 8276063 - DNA, 18 bp, Homo sapiens
gggctgtgagatgggaag

SEQ ID NO: 8276064 - DNA, 22 bp, Homo sapiens
gggctgtgctgagtaggaggtg

SEQ ID NO: 8276065 - DNA, 22 bp, Homo sapiens
gggctgtggagccgcgagggct

SEQ ID NO: 8276066 - DNA, 22 bp, Homo sapiens
cagacacagcaattctgtgttg

SEQ ID NO: 8276067 - DNA, 22 bp, Homo sapiens
cagacacacaagcaatctaagt

SEQ ID NO: 8276068 - DNA, 22 bp, Homo sapiens
cagacacaccaggcccattctg

SEQ ID NO: 8276069 - DNA, 22 bp, Homo sapiens
cagacacacaccctggcctagc

SEQ ID NO: 8276070 - DNA, 22 bp, Homo sapiens
cagacacagatatgcatatggc

SEQ ID NO: 8276071 - DNA, 22 bp, Homo sapiens
gggagccaaggagagaggcctt

SEQ ID NO: 8276072 - DNA, 22 bp, Homo sapiens
gggagccacagtagcagctact

SEQ ID NO: 8276073 - DNA, 22 bp, Homo sapiens
gggaggcagtgctggaggctgg

SEQ ID NO: 8276074 - DNA, 22 bp, Homo sapiens
cagacacacaagcaatctaagt

SEQ ID NO: 8276075 - DNA, 22 bp, Homo sapiens
cagaaacagacatgacgcagta

SEQ ID NO: 8276076 - DNA, 22 bp, Homo sapiens
cagaaacaggcaacgtgtgcac

SEQ ID NO: 8276077 - DNA, 22 bp, Homo sapiens
cagaaaatagagtttctctgag

SEQ ID NO: 8276078 - DNA, 22 bp, Homo sapiens
cagaaacacttgtagagaagtt

SEQ ID NO: 8276079 - DNA, 22 bp, Homo sapiens
cagaaacacttgtagagaagtt

SEQ ID NO: 8276080 - DNA, 22 bp, Homo sapiens
ggctggcaagtgtctgctcatg

SEQ ID NO: 8276081 - DNA, 22 bp, Homo sapiens
ggctggcacctgccctccgctg

SEQ ID NO: 8276082 - DNA, 22 bp, Homo sapiens
ggctggcacgaagccctgctgg

SEQ ID NO: 8276083 - DNA, 22 bp, Homo sapiens
cagagcagaaacctgggtgatt

SEQ ID NO: 8276084 - DNA, 22 bp, Homo sapiens
cagactgtgtctgaacctggtc

SEQ ID NO: 8276085 - DNA, 22 bp, Homo sapiens
cagagacaacctggtagagaaa

SEQ ID NO: 8276086 - DNA, 22 bp, Homo sapiens
cagagacaacctggtagagaaa

SEQ ID NO: 8276087 - DNA, 22 bp, Homo sapiens
cagagcaggcccactgccctcc

SEQ ID NO: 8276088 - DNA, 22 bp, Homo sapiens
cagagcaggcccactgccctcc

SEQ ID NO: 8276089 - DNA, 22 bp, Homo sapiens
gggcaggggtagcattccaagt

SEQ ID NO: 8276090 - DNA, 22 bp, Homo sapiens
cagagcagacgttgagattaag

SEQ ID NO: 8276091 - DNA, 22 bp, Homo sapiens
cagagcagtggagagtaggtct

SEQ ID NO: 8276092 - DNA, 22 bp, Homo sapiens
cagagcagtggagagtaggtct

SEQ ID NO: 8276093 - DNA, 22 bp, Homo sapiens
cagagcagtgaggagttgtgta

SEQ ID NO: 8276094 - DNA, 22 bp, Homo sapiens
cagagcataattgacatgaggt

SEQ ID NO: 8276095 - DNA, 19 bp, Homo sapiens
cagagcagtggttcctgaa

SEQ ID NO: 8276096 - DNA, 22 bp, Homo sapiens
cagagcatcgcgcagagagcct

SEQ ID NO: 8276097 - DNA, 22 bp, Homo sapiens
cagagcagtggggttggtcaga

SEQ ID NO: 8276098 - DNA, 21 bp, Homo sapiens
atgggcagaggcagagaggct

SEQ ID NO: 8276099 - DNA, 19 bp, Homo sapiens
gagccctctccatggccac

SEQ ID NO: 8276100 - DNA, 22 bp, Homo sapiens
gagccctccatggagccaggca

SEQ ID NO: 8276101 - DNA, 20 bp, Homo sapiens
atggctctgattctgagccc

SEQ ID NO: 8276102 - DNA, 22 bp, Homo sapiens
atggctctttattctgctgcat

SEQ ID NO: 8276103 - DNA, 22 bp, Homo sapiens
atggctccagctggtagagatt

SEQ ID NO: 8276104 - DNA, 22 bp, Homo sapiens
atggctccagcttggcttcacc

SEQ ID NO: 8276105 - DNA, 22 bp, Homo sapiens
atggctccttctgtgcagtttt

SEQ ID NO: 8276106 - DNA, 22 bp, Homo sapiens
atggctccatcctgttgctagt

SEQ ID NO: 8276107 - DNA, 18 bp, Homo sapiens
atggctccagtgtcttcc

SEQ ID NO: 8276108 - DNA, 22 bp, Homo sapiens
atggctccaagatggagagcca

SEQ ID NO: 8276109 - DNA, 22 bp, Homo sapiens
atggccgcctgtccttcccgcc

SEQ ID NO: 8276110 - DNA, 18 bp, Homo sapiens
atgggaggggccaagaga

SEQ ID NO: 8276111 - DNA, 22 bp, Homo sapiens
atgctgtgaaaaagaaggctga

SEQ ID NO: 8276112 - DNA, 22 bp, Homo sapiens
atgctgtgagtgtgccgcagag

SEQ ID NO: 8276113 - DNA, 22 bp, Homo sapiens
atgctgtggaagttcctgaagc

SEQ ID NO: 8276114 - DNA, 23 bp, Homo sapiens
gagaacagccacagagagctgtg

SEQ ID NO: 8276115 - DNA, 22 bp, Homo sapiens
gagacaggatttaaccaaagct

SEQ ID NO: 8276116 - DNA, 22 bp, Homo sapiens
gagacaggccaggtggtactta

SEQ ID NO: 8276117 - DNA, 22 bp, Homo sapiens
atggcaccaaatatgtctcatt

SEQ ID NO: 8276118 - DNA, 22 bp, Homo sapiens
atggatgagtccttgagacaca

SEQ ID NO: 8276119 - DNA, 22 bp, Homo sapiens
atggattataaatattttaagg

SEQ ID NO: 8276120 - DNA, 22 bp, Homo sapiens
atggcaatgtggcttatttgga

SEQ ID NO: 8276121 - DNA, 22 bp, Homo sapiens
atggcaatgaatgactttatgt

SEQ ID NO: 8276122 - DNA, 22 bp, Homo sapiens
atggcaaaaactgcagttacct

SEQ ID NO: 8276123 - DNA, 22 bp, Homo sapiens
atgttagaatctctgaatgtgg

SEQ ID NO: 8276124 - DNA, 22 bp, Homo sapiens
atgtggctgatcgcagagctct

SEQ ID NO: 8276125 - DNA, 21 bp, Homo sapiens
atgtggctcccttcctcagga

SEQ ID NO: 8276126 - DNA, 22 bp, Homo sapiens
atgttaaaagtctgagtgggag

SEQ ID NO: 8276127 - DNA, 22 bp, Homo sapiens
atgtggctcagcaggctcccgt

SEQ ID NO: 8276128 - DNA, 23 bp, Homo sapiens
atgtggctagtgagaccaagaaa

SEQ ID NO: 8276129 - DNA, 22 bp, Homo sapiens
atgtggctagtgcaactgagaa

SEQ ID NO: 8276130 - DNA, 22 bp, Homo sapiens
gaggttagtgatttgtcattga

SEQ ID NO: 8276131 - DNA, 22 bp, Homo sapiens
gaggttagaggtcagtgcagtc

SEQ ID NO: 8276132 - DNA, 22 bp, Homo sapiens
gaggttaggtgacttgttcaga

SEQ ID NO: 8276133 - DNA, 22 bp, Homo sapiens
gaggttagcagtatcttctagt

SEQ ID NO: 8276134 - DNA, 22 bp, Homo sapiens
atgttataaatagagacactgg

SEQ ID NO: 8276135 - DNA, 22 bp, Homo sapiens
gaggttcagtaaggaatactga

SEQ ID NO: 8276136 - DNA, 22 bp, Homo sapiens
gaggttcagctgctgcctggta

SEQ ID NO: 8276137 - DNA, 22 bp, Homo sapiens
gaggttcaggaaatgggcaaag

SEQ ID NO: 8276138 - DNA, 22 bp, Homo sapiens
gaggttcaggacatttctgggg

SEQ ID NO: 8276139 - DNA, 22 bp, Homo sapiens
gaggttcagtaaggaatactga

SEQ ID NO: 8276140 - DNA, 22 bp, Homo sapiens
gaggttcagtcctgctctgtca

SEQ ID NO: 8276141 - DNA, 22 bp, Homo sapiens
gaggttcacttcctggatcctt

SEQ ID NO: 8276142 - DNA, 19 bp, Homo sapiens
gaggttcacgcgctggatg

SEQ ID NO: 8276143 - DNA, 22 bp, Homo sapiens
gaggttcacttcctgaaatagc

SEQ ID NO: 8276144 - DNA, 22 bp, Homo sapiens
gaggttcacaggctatcacagt

SEQ ID NO: 8276145 - DNA, 22 bp, Homo sapiens
atgtgctaagcactacttgtca

SEQ ID NO: 8276146 - DNA, 22 bp, Homo sapiens
atgtcactccagggacacaggt

SEQ ID NO: 8276147 - DNA, 22 bp, Homo sapiens
atgtcagtagtttctttgagtt

SEQ ID NO: 8276148 - DNA, 22 bp, Homo sapiens
gaggaggggacagtacttgtgc

SEQ ID NO: 8276149 - DNA, 23 bp, Homo sapiens
gaggagggtcgtgctgtgttcct

SEQ ID NO: 8276150 - DNA, 22 bp, Homo sapiens
gaggaggggcacttgtctccta

SEQ ID NO: 8276151 - DNA, 22 bp, Homo sapiens
gaggaggggcacttgtctccta

SEQ ID NO: 8276152 - DNA, 22 bp, Homo sapiens
gaggcacaatacatgtctcaag

SEQ ID NO: 8276153 - DNA, 22 bp, Homo sapiens
gaggcacagtcccgaggcaagg

SEQ ID NO: 8276154 - DNA, 22 bp, Homo sapiens
gaggcacagtgtttggtcagtg

SEQ ID NO: 8276155 - DNA, 22 bp, Homo sapiens
atgggcaggcactggctctcag

SEQ ID NO: 8276156 - DNA, 22 bp, Homo sapiens
atgggcagagtggggacaggaa

SEQ ID NO: 8276157 - DNA, 22 bp, Homo sapiens
gaggagggcctggtgtcccttc

SEQ ID NO: 8276158 - DNA, 22 bp, Homo sapiens
gaggagggctttgttgatgtta

SEQ ID NO: 8276159 - DNA, 22 bp, Homo sapiens
gaggagggcagttcctctttta

SEQ ID NO: 8276160 - DNA, 22 bp, Homo sapiens
gaggagggagctggaagctctt

SEQ ID NO: 8276161 - DNA, 22 bp, Homo sapiens
gaggagggagctggaagctctt

SEQ ID NO: 8276162 - DNA, 23 bp, Homo sapiens
atgtatttaaatttcagtgatga

SEQ ID NO: 8276163 - DNA, 23 bp, Homo sapiens
atgtatttaaatttcagtgatga

SEQ ID NO: 8276164 - DNA, 22 bp, Homo sapiens
atgtatttctatgtagtgaaga

SEQ ID NO: 8276165 - DNA, 22 bp, Homo sapiens
gaggctccagcgacacctaggc

SEQ ID NO: 8276166 - DNA, 22 bp, Homo sapiens
atgtatttctatgtagtgaaga

SEQ ID NO: 8276167 - DNA, 22 bp, Homo sapiens
gaggctcctcattcagtatgct

SEQ ID NO: 8276168 - DNA, 22 bp, Homo sapiens
atgtattcaagccacatacatt

SEQ ID NO: 8276169 - DNA, 22 bp, Homo sapiens
atgtatgttagtgtattatcta

SEQ ID NO: 8276170 - DNA, 22 bp, Homo sapiens
gacaggaaacaagaaggcagga

SEQ ID NO: 8276171 - DNA, 22 bp, Homo sapiens
atgcctggactgtatcccagat

SEQ ID NO: 8276172 - DNA, 22 bp, Homo sapiens
atgcctggatttgggactcaaa

SEQ ID NO: 8276173 - DNA, 22 bp, Homo sapiens
atgcctggactgacatgcactg

SEQ ID NO: 8276174 - DNA, 19 bp, Homo sapiens
gaattttaggacttcagca

SEQ ID NO: 8276175 - DNA, 19 bp, Homo sapiens
gaattttaggacttcagca

SEQ ID NO: 8276176 - DNA, 17 bp, Homo sapiens
gaatttcttggtcaaaa

SEQ ID NO: 8276177 - DNA, 22 bp, Homo sapiens
gaatttcctctaaacccctgag

SEQ ID NO: 8276178 - DNA, 22 bp, Homo sapiens
atgcatttgacgggatatattt

SEQ ID NO: 8276179 - DNA, 22 bp, Homo sapiens
gaagtccagaatactgctctga

SEQ ID NO: 8276180 - DNA, 22 bp, Homo sapiens
gaagtacaggttgtgagagaat

SEQ ID NO: 8276181 - DNA, 22 bp, Homo sapiens
gaagtacactactccttgagtc

SEQ ID NO: 8276182 - DNA, 22 bp, Homo sapiens
atgccactgcactccagcctgg

SEQ ID NO: 8276183 - DNA, 22 bp, Homo sapiens
atgccactgcactccagcctag

SEQ ID NO: 8276184 - DNA, 22 bp, Homo sapiens
atgccactgcactccagcctgg

SEQ ID NO: 8276185 - DNA, 22 bp, Homo sapiens
atgccactgcacttcagcttgg

SEQ ID NO: 8276186 - DNA, 22 bp, Homo sapiens
gaaggaggtgtcagttggactg

SEQ ID NO: 8276187 - DNA, 22 bp, Homo sapiens
gaaggaggtctgcattctacag

SEQ ID NO: 8276188 - DNA, 22 bp, Homo sapiens
gaaggaggtctgatacaatatg

SEQ ID NO: 8276189 - DNA, 22 bp, Homo sapiens
gaaggagggtgcggatctgagc

SEQ ID NO: 8276190 - DNA, 22 bp, Homo sapiens
gaaggagggagcggcgcggatt

SEQ ID NO: 8276191 - DNA, 22 bp, Homo sapiens
gaaggaggctccccaaagtctg

SEQ ID NO: 8276192 - DNA, 22 bp, Homo sapiens
gaagctgggtcgctgggatcct

SEQ ID NO: 8276193 - DNA, 22 bp, Homo sapiens
gaaggaggcgttagccctagga

SEQ ID NO: 8276194 - DNA, 22 bp, Homo sapiens
gaagcgtgcaggtccgtatact

SEQ ID NO: 8276195 - DNA, 22 bp, Homo sapiens
gaagccttgaactgcaaacccc

SEQ ID NO: 8276196 - DNA, 22 bp, Homo sapiens
gaagccttgaactgcaaacccc

SEQ ID NO: 8276197 - DNA, 23 bp, Homo sapiens
atgagcatttttaatttctgtgg

SEQ ID NO: 8276198 - DNA, 22 bp, Homo sapiens
atgagctgtaaggtggcttcct

SEQ ID NO: 8276199 - DNA, 22 bp, Homo sapiens
atgagcccagggaattcctttc

SEQ ID NO: 8276200 - DNA, 22 bp, Homo sapiens
atgagccctggaggcatttttt

SEQ ID NO: 8276201 - DNA, 19 bp, Homo sapiens
atgagctggcatttcaggt

SEQ ID NO: 8276202 - DNA, 22 bp, Homo sapiens
gaagagagaacattacataaac

SEQ ID NO: 8276203 - DNA, 22 bp, Homo sapiens
atgagctgtgggattccagagg

SEQ ID NO: 8276204 - DNA, 22 bp, Homo sapiens
gaagaaagggaattaacttgag

SEQ ID NO: 8276205 - DNA, 22 bp, Homo sapiens
gaagagagcagcaaactggagt

SEQ ID NO: 8276206 - DNA, 22 bp, Homo sapiens
gaagagagagtggggttctgcg

SEQ ID NO: 8276207 - DNA, 22 bp, Homo sapiens
atgacatgattgccatttgata

SEQ ID NO: 8276208 - DNA, 22 bp, Homo sapiens
atgacatgttgggaaccctgct

SEQ ID NO: 8276209 - DNA, 22 bp, Homo sapiens
atgacatgttccctttttctca

SEQ ID NO: 8276210 - DNA, 22 bp, Homo sapiens
atgacatgtcctagttggtcta

SEQ ID NO: 8276211 - DNA, 22 bp, Homo sapiens
atgacatgtactgctctctcat

SEQ ID NO: 8276212 - DNA, 22 bp, Homo sapiens
atgacatggtgcagacagtgtc

SEQ ID NO: 8276213 - DNA, 22 bp, Homo sapiens
atgacatgcgaatgtactggag

SEQ ID NO: 8276214 - DNA, 22 bp, Homo sapiens
atgacagatagtcttcatttgc

SEQ ID NO: 8276215 - DNA, 22 bp, Homo sapiens
atgagcagatatggattttaga

SEQ ID NO: 8276216 - DNA, 22 bp, Homo sapiens
ctttggcattagcctgtataga

SEQ ID NO: 8276217 - DNA, 22 bp, Homo sapiens
ctttggaacaagaagaaatggc

SEQ ID NO: 8276218 - DNA, 22 bp, Homo sapiens
ctttggaaagtaagcagctaga

SEQ ID NO: 8276219 - DNA, 22 bp, Homo sapiens
ctttggaaaaagtgactggctc

SEQ ID NO: 8276220 - DNA, 22 bp, Homo sapiens
ctttggaaaaatacctggcata

SEQ ID NO: 8276221 - DNA, 22 bp, Homo sapiens
ctttgccatgggcttgataggt

SEQ ID NO: 8276222 - DNA, 22 bp, Homo sapiens
ctttgctagtgatttgtttagg

SEQ ID NO: 8276223 - DNA, 22 bp, Homo sapiens
ctttgctaatgttgcattttca

SEQ ID NO: 8276224 - DNA, 22 bp, Homo sapiens
ctttgcctcctagagcacgttc

SEQ ID NO: 8276225 - DNA, 22 bp, Homo sapiens
ctttgccaaaagctgcaggtgg

SEQ ID NO: 8276226 - DNA, 22 bp, Homo sapiens
atgacacaattttagagctgaa

SEQ ID NO: 8276227 - DNA, 22 bp, Homo sapiens
atgacacatttgtgctgttgaa

SEQ ID NO: 8276228 - DNA, 22 bp, Homo sapiens
atcttggctgcatttctattcc

SEQ ID NO: 8276229 - DNA, 22 bp, Homo sapiens
cttctccagccacgcccactcc

SEQ ID NO: 8276230 - DNA, 22 bp, Homo sapiens
cttctcccaagtatgcagtttg

SEQ ID NO: 8276231 - DNA, 18 bp, Homo sapiens
cttctcccatcttggcca

SEQ ID NO: 8276232 - DNA, 18 bp, Homo sapiens
cttctcccatcttggcca

SEQ ID NO: 8276233 - DNA, 22 bp, Homo sapiens
cttctccccagaaaagatttct

SEQ ID NO: 8276234 - DNA, 22 bp, Homo sapiens
cttctccctggcttctgcacac

SEQ ID NO: 8276235 - DNA, 22 bp, Homo sapiens
cttctcctctgagtcctgggag

SEQ ID NO: 8276236 - DNA, 22 bp, Homo sapiens
ctttattagatgtagactttct

SEQ ID NO: 8276237 - DNA, 22 bp, Homo sapiens
ctttaccacaaggacagaactt

SEQ ID NO: 8276238 - DNA, 22 bp, Homo sapiens
ctttattagatgtagactttct

SEQ ID NO: 8276239 - DNA, 22 bp, Homo sapiens
ctttatgttggggtgtcttagt

SEQ ID NO: 8276240 - DNA, 22 bp, Homo sapiens
ctttacacaatgattttcttta

SEQ ID NO: 8276241 - DNA, 17 bp, Homo sapiens
cttgttttccactggga

SEQ ID NO: 8276242 - DNA, 22 bp, Homo sapiens
attcatctgtacttcaatatct

SEQ ID NO: 8276243 - DNA, 20 bp, Homo sapiens
attcacaaagccagtgttgc

SEQ ID NO: 8276244 - DNA, 22 bp, Homo sapiens
attccacacagtaatactcaat

SEQ ID NO: 8276245 - DNA, 22 bp, Homo sapiens
attctgatatcttattctagct

SEQ ID NO: 8276246 - DNA, 22 bp, Homo sapiens
attctgagtagaaattattctt

SEQ ID NO: 8276247 - DNA, 22 bp, Homo sapiens
attctgagtggaaactatcaat

SEQ ID NO: 8276248 - DNA, 22 bp, Homo sapiens
attctgaggacagagtctagca

SEQ ID NO: 8276249 - DNA, 17 bp, Homo sapiens
attctcagtgtacagtg

SEQ ID NO: 8276250 - DNA, 22 bp, Homo sapiens
attctcatttttatagatgaga

SEQ ID NO: 8276251 - DNA, 22 bp, Homo sapiens
attctgcatgtaggtttgctca

SEQ ID NO: 8276252 - DNA, 22 bp, Homo sapiens
gcagggcagtaagagctagagt

SEQ ID NO: 8276253 - DNA, 22 bp, Homo sapiens
gcagggattgtgcagggggcta

SEQ ID NO: 8276254 - DNA, 22 bp, Homo sapiens
attctttccagacactgattgc

SEQ ID NO: 8276255 - DNA, 22 bp, Homo sapiens
gcagggcatccctgagcgggtg

SEQ ID NO: 8276256 - DNA, 22 bp, Homo sapiens
gcagggcatccctgagcgggtg

SEQ ID NO: 8276257 - DNA, 22 bp, Homo sapiens
attgcacggactaaatttacag

SEQ ID NO: 8276258 - DNA, 22 bp, Homo sapiens
gcaggtgtgggtggctgccagg

SEQ ID NO: 8276259 - DNA, 22 bp, Homo sapiens
gcacacagccagctgagggcta

SEQ ID NO: 8276260 - DNA, 22 bp, Homo sapiens
gcacacagagaggtggtatgtc

SEQ ID NO: 8276261 - DNA, 22 bp, Homo sapiens
gcacacagattaggaaacagaa

SEQ ID NO: 8276262 - DNA, 22 bp, Homo sapiens
gcaccaggcagctgagcaggcc

SEQ ID NO: 8276263 - DNA, 22 bp, Homo sapiens
attaagatcattgtagaagatt

SEQ ID NO: 8276264 - DNA, 22 bp, Homo sapiens
attaagaatcacacggctgtgt

SEQ ID NO: 8276265 - DNA, 22 bp, Homo sapiens
attatcacatggactttgcttt

SEQ ID NO: 8276266 - DNA, 22 bp, Homo sapiens
gcagagaccccgcagtgaggcc

SEQ ID NO: 8276267 - DNA, 22 bp, Homo sapiens
gcagagatggctgcctctgagt

SEQ ID NO: 8276268 - DNA, 19 bp, Homo sapiens
gcagagatgtggtagcttg

SEQ ID NO: 8276269 - DNA, 22 bp, Homo sapiens
gcagagatgatgataagcctgc

SEQ ID NO: 8276270 - DNA, 22 bp, Homo sapiens
gcagagatgaggcactcatccc

SEQ ID NO: 8276271 - DNA, 22 bp, Homo sapiens
gcagagatgagctatcaggaca

SEQ ID NO: 8276272 - DNA, 22 bp, Homo sapiens
gcagagatctgagaaggctgcc

SEQ ID NO: 8276273 - DNA, 22 bp, Homo sapiens
gcagagatcggacactcagtaa

SEQ ID NO: 8276274 - DNA, 22 bp, Homo sapiens
gcagagatccttgctggatgac

SEQ ID NO: 8276275 - DNA, 22 bp, Homo sapiens
gcagagatattgatatagattt

SEQ ID NO: 8276276 - DNA, 22 bp, Homo sapiens
gcagagataagtagacaggatg

SEQ ID NO: 8276277 - DNA, 22 bp, Homo sapiens
attcaagttcttctgtctttgc

SEQ ID NO: 8276278 - DNA, 22 bp, Homo sapiens
attcaagtggctgctatgttaa

SEQ ID NO: 8276279 - DNA, 22 bp, Homo sapiens
attcaagtccagcttctctaca

SEQ ID NO: 8276280 - DNA, 22 bp, Homo sapiens
gcagagattggtgcactgatga

SEQ ID NO: 8276281 - DNA, 22 bp, Homo sapiens
gcagagattggaagatgaattt

SEQ ID NO: 8276282 - DNA, 22 bp, Homo sapiens
gcagagattatgccatggaaag

SEQ ID NO: 8276283 - DNA, 22 bp, Homo sapiens
gcacccagaataaggacaggac

SEQ ID NO: 8276284 - DNA, 22 bp, Homo sapiens
attatgcatatacatttgacta

SEQ ID NO: 8276285 - DNA, 22 bp, Homo sapiens
attattaaaatgtgtttctctt

SEQ ID NO: 8276286 - DNA, 22 bp, Homo sapiens
gatggcagtcaaccaggtgagg

SEQ ID NO: 8276287 - DNA, 22 bp, Homo sapiens
gatgatgggatccagcaatgta

SEQ ID NO: 8276288 - DNA, 22 bp, Homo sapiens
atgttatttattgaaacacttt

SEQ ID NO: 8276289 - DNA, 22 bp, Homo sapiens
atgttatttctgaaagatcatt

SEQ ID NO: 8276290 - DNA, 22 bp, Homo sapiens
atgttatgtctgggaaggggta

SEQ ID NO: 8276291 - DNA, 22 bp, Homo sapiens
gagtggggcccactgctgggtg

SEQ ID NO: 8276292 - DNA, 23 bp, Homo sapiens
atgttattattagcagtcttgcc

SEQ ID NO: 8276293 - DNA, 23 bp, Homo sapiens
gagtggggagaaattggttaaac

SEQ ID NO: 8276294 - DNA, 22 bp, Homo sapiens
gagtgggcaccgtgggcacact

SEQ ID NO: 8276295 - DNA, 20 bp, Homo sapiens
gagtgggccatggagtgaga

SEQ ID NO: 8276296 - DNA, 20 bp, Homo sapiens
gagtgggccatggagtgaga

SEQ ID NO: 8276297 - DNA, 22 bp, Homo sapiens
gatggccacatacatggctggg

SEQ ID NO: 8276298 - DNA, 22 bp, Homo sapiens
attaacatgcagccagacacac

SEQ ID NO: 8276299 - DNA, 19 bp, Homo sapiens
attaacatcagtgttggcc

SEQ ID NO: 8276300 - DNA, 22 bp, Homo sapiens
attaacatgagttggagatagg

SEQ ID NO: 8276301 - DNA, 22 bp, Homo sapiens
attaaattggatctgcatagtt

SEQ ID NO: 8276302 - DNA, 22 bp, Homo sapiens
gattctggattgtctgcttgaa

SEQ ID NO: 8276303 - DNA, 18 bp, Homo sapiens
gattctgattctggaggc

SEQ ID NO: 8276304 - DNA, 22 bp, Homo sapiens
gattctgaggccttgctcaaga

SEQ ID NO: 8276305 - DNA, 22 bp, Homo sapiens
gattctgatctatagtgttata

SEQ ID NO: 8276306 - DNA, 22 bp, Homo sapiens
gattctctgctatctatcacct

SEQ ID NO: 8276307 - DNA, 22 bp, Homo sapiens
gattctcttggatgtaggcata

SEQ ID NO: 8276308 - DNA, 22 bp, Homo sapiens
gattctctctggatcccatgga

SEQ ID NO: 8276309 - DNA, 22 bp, Homo sapiens
gccttccttacacctgctcagc

SEQ ID NO: 8276310 - DNA, 22 bp, Homo sapiens
atttggtagtgattgaaattat

SEQ ID NO: 8276311 - DNA, 22 bp, Homo sapiens
atttggtctccatactggttag

SEQ ID NO: 8276312 - DNA, 22 bp, Homo sapiens
atttggtgttcatcttttagtg

SEQ ID NO: 8276313 - DNA, 22 bp, Homo sapiens
atttgtaaagtgcttaaaagta

SEQ ID NO: 8276314 - DNA, 22 bp, Homo sapiens
attttagatttaagaataaggt

SEQ ID NO: 8276315 - DNA, 22 bp, Homo sapiens
atttgtatcaatctcaatatat

SEQ ID NO: 8276316 - DNA, 22 bp, Homo sapiens
atttgtatcaatctcaatatat

SEQ ID NO: 8276317 - DNA, 22 bp, Homo sapiens
atttgtatcttctaatattatc

SEQ ID NO: 8276318 - DNA, 22 bp, Homo sapiens
atttgtatcttctaatattatc

SEQ ID NO: 8276319 - DNA, 22 bp, Homo sapiens
gctctgctgtggaatcctctcc

SEQ ID NO: 8276320 - DNA, 22 bp, Homo sapiens
caaagaagagatttacagagct

SEQ ID NO: 8276321 - DNA, 22 bp, Homo sapiens
caaagaaggaactataatccca

SEQ ID NO: 8276322 - DNA, 22 bp, Homo sapiens
caaagaatgagtgagtacataa

SEQ ID NO: 8276323 - DNA, 22 bp, Homo sapiens
caaagacacgggaaacaacgtt

SEQ ID NO: 8276324 - DNA, 22 bp, Homo sapiens
gctcccagggacactggccact

SEQ ID NO: 8276325 - DNA, 22 bp, Homo sapiens
gctcccagggacactggccact

SEQ ID NO: 8276326 - DNA, 22 bp, Homo sapiens
gctcccaggcatggaggtaatt

SEQ ID NO: 8276327 - DNA, 22 bp, Homo sapiens
gctccagggacccaagagaaaa

SEQ ID NO: 8276328 - DNA, 22 bp, Homo sapiens
gctcccaggatgaggagccagg

SEQ ID NO: 8276329 - DNA, 22 bp, Homo sapiens
gctccccagcttagccctggct

SEQ ID NO: 8276330 - DNA, 22 bp, Homo sapiens
gctccccagcttagccctggct

SEQ ID NO: 8276331 - DNA, 22 bp, Homo sapiens
gctcccagtctgatggaggaga

SEQ ID NO: 8276332 - DNA, 22 bp, Homo sapiens
gctcccagggcagcgcagaaga

SEQ ID NO: 8276333 - DNA, 22 bp, Homo sapiens
gctcccagggaccgcagggcag

SEQ ID NO: 8276334 - DNA, 22 bp, Homo sapiens
gctcccaggttcttgggccttg

SEQ ID NO: 8276335 - DNA, 22 bp, Homo sapiens
gctcagagaaaactggggcttg

SEQ ID NO: 8276336 - DNA, 22 bp, Homo sapiens
attttgcacactatgcagcttt

SEQ ID NO: 8276337 - DNA, 22 bp, Homo sapiens
attttgcacactatgcagcttt

SEQ ID NO: 8276338 - DNA, 22 bp, Homo sapiens
attttgatgtatctttgtagct

SEQ ID NO: 8276339 - DNA, 17 bp, Homo sapiens
gccttccttcctccaca

SEQ ID NO: 8276340 - DNA, 22 bp, Homo sapiens
gccttccttttaccaccagcca

SEQ ID NO: 8276341 - DNA, 22 bp, Homo sapiens
attttgataatcatgttagaga

SEQ ID NO: 8276342 - DNA, 22 bp, Homo sapiens
gccctgtgatggagactagagg

SEQ ID NO: 8276343 - DNA, 22 bp, Homo sapiens
gccctgtgagattagaacagca

SEQ ID NO: 8276344 - DNA, 22 bp, Homo sapiens
gccctgtgagtcatgcggcaga

SEQ ID NO: 8276345 - DNA, 22 bp, Homo sapiens
gccctggttttagaggagcagg

SEQ ID NO: 8276346 - DNA, 22 bp, Homo sapiens
atttcaaggactacttttcaat

SEQ ID NO: 8276347 - DNA, 22 bp, Homo sapiens
atttcaaggctattaatataaa

SEQ ID NO: 8276348 - DNA, 22 bp, Homo sapiens
atttcaaggctacagaaacctt

SEQ ID NO: 8276349 - DNA, 22 bp, Homo sapiens
atttcaagaaggcagcagtggt

SEQ ID NO: 8276350 - DNA, 22 bp, Homo sapiens
atttcaagtgttgagctcataa

SEQ ID NO: 8276351 - DNA, 22 bp, Homo sapiens
atttcaagtccaagtcttgggt

SEQ ID NO: 8276352 - DNA, 22 bp, Homo sapiens
atttcaaggggtccttgcttgg

SEQ ID NO: 8276353 - DNA, 22 bp, Homo sapiens
gccatgcatttcgctgggaggg

SEQ ID NO: 8276354 - DNA, 22 bp, Homo sapiens
gccatgcttggtatgctgtgag

SEQ ID NO: 8276355 - DNA, 21 bp, Homo sapiens
gccatcttgcaagatgagaaa

SEQ ID NO: 8276356 - DNA, 22 bp, Homo sapiens
gccatcttcaacatcagaagtt

SEQ ID NO: 8276357 - DNA, 22 bp, Homo sapiens
gccagctggagactggcagggg

SEQ ID NO: 8276358 - DNA, 22 bp, Homo sapiens
gccagctgcttctccagaattt

SEQ ID NO: 8276359 - DNA, 22 bp, Homo sapiens
gccagctggagtgagagtgggc

SEQ ID NO: 8276360 - DNA, 22 bp, Homo sapiens
atttattacctcggagtttctg

SEQ ID NO: 8276361 - DNA, 22 bp, Homo sapiens
atttattacctcggagtttctg

SEQ ID NO: 8276362 - DNA, 22 bp, Homo sapiens
gccatcatatcccctgtgacct

SEQ ID NO: 8276363 - DNA, 22 bp, Homo sapiens
atttattaagcatctgctatgt

SEQ ID NO: 8276364 - DNA, 22 bp, Homo sapiens
gccagccacaagggaggcttgt

SEQ ID NO: 8276365 - DNA, 22 bp, Homo sapiens
gccagaggttcaacaactgtct

SEQ ID NO: 8276366 - DNA, 22 bp, Homo sapiens
gccagagtgccatcagtgccat

SEQ ID NO: 8276367 - DNA, 22 bp, Homo sapiens
attgtactacaccatagtactg

SEQ ID NO: 8276368 - DNA, 22 bp, Homo sapiens
attgtactggtaaagaagtggg

SEQ ID NO: 8276369 - DNA, 22 bp, Homo sapiens
attgtactctagcctctgggca

SEQ ID NO: 8276370 - DNA, 20 bp, Homo sapiens
attgtacttcagtgtgaagc

SEQ ID NO: 8276371 - DNA, 20 bp, Homo sapiens
attgtacttctgttgatggt

SEQ ID NO: 8276372 - DNA, 22 bp, Homo sapiens
attgtactcacaaaacatgagt

SEQ ID NO: 8276373 - DNA, 22 bp, Homo sapiens
attgtactccagcctgggtgac

SEQ ID NO: 8276374 - DNA, 22 bp, Homo sapiens
attgtactccctctcctgcccg

SEQ ID NO: 8276375 - DNA, 22 bp, Homo sapiens
attgtactagaaattgtattca

SEQ ID NO: 8276376 - DNA, 22 bp, Homo sapiens
gccagccagtttgctgatggct

SEQ ID NO: 8276377 - DNA, 20 bp, Homo sapiens
gccagctgcccttccaccct

SEQ ID NO: 8276378 - DNA, 22 bp, Homo sapiens
gccagccacttcccagactggc

SEQ ID NO: 8276379 - DNA, 23 bp, Homo sapiens
gccagccagaatttctccactgt

SEQ ID NO: 8276380 - DNA, 23 bp, Homo sapiens
gccagccagaatttctccactgt

SEQ ID NO: 8276381 - DNA, 22 bp, Homo sapiens
ccctttctccagaactgtctga

SEQ ID NO: 8276382 - DNA, 22 bp, Homo sapiens
ccctttctgggacccctgtctc

SEQ ID NO: 8276383 - DNA, 22 bp, Homo sapiens
cccttcagtgcgtgagaatgag

SEQ ID NO: 8276384 - DNA, 22 bp, Homo sapiens
ccgcaaggcagaggttgcagtg

SEQ ID NO: 8276385 - DNA, 22 bp, Homo sapiens
agggctctggggtggcagagat

SEQ ID NO: 8276386 - DNA, 22 bp, Homo sapiens
agggctctgtgactatcactgc

SEQ ID NO: 8276387 - DNA, 22 bp, Homo sapiens
agggctcttcctttgcctctca

SEQ ID NO: 8276388 - DNA, 22 bp, Homo sapiens
agggctctcttcttggtttgca

SEQ ID NO: 8276389 - DNA, 18 bp, Homo sapiens
agggctctctgctgggtt

SEQ ID NO: 8276390 - DNA, 23 bp, Homo sapiens
agggcctcaggagggctgcatgg

SEQ ID NO: 8276391 - DNA, 22 bp, Homo sapiens
agggctcccgcggtgtccggga

SEQ ID NO: 8276392 - DNA, 22 bp, Homo sapiens
cctcctgcacttgctttccttc

SEQ ID NO: 8276393 - DNA, 22 bp, Homo sapiens
cctctgggcggagatctgctgc

SEQ ID NO: 8276394 - DNA, 22 bp, Homo sapiens
cctctgggccagcctggaccct

SEQ ID NO: 8276395 - DNA, 16 bp, Homo sapiens
cctctgggcctgcaag

SEQ ID NO: 8276396 - DNA, 22 bp, Homo sapiens
cctctgggaagccagtcctgct

SEQ ID NO: 8276397 - DNA, 19 bp, Homo sapiens
cctctgccagcccgcctct

SEQ ID NO: 8276398 - DNA, 19 bp, Homo sapiens
cctctgccagcccgcctct

SEQ ID NO: 8276399 - DNA, 22 bp, Homo sapiens
cctgaggcaaggacttggtggc

SEQ ID NO: 8276400 - DNA, 22 bp, Homo sapiens
aggggagactggaatctaacat

SEQ ID NO: 8276401 - DNA, 22 bp, Homo sapiens
aggggagagaacataaggaagt

SEQ ID NO: 8276402 - DNA, 22 bp, Homo sapiens
aggggagaatttcaactcaggt

SEQ ID NO: 8276403 - DNA, 22 bp, Homo sapiens
aggggagaaaaatgccttctgt

SEQ ID NO: 8276404 - DNA, 17 bp, Homo sapiens
aggggagagtgggaaga

SEQ ID NO: 8276405 - DNA, 22 bp, Homo sapiens
aggggagaggtgagcaacttct

SEQ ID NO: 8276406 - DNA, 22 bp, Homo sapiens
cctgagagtggtgtacaggaga

SEQ ID NO: 8276407 - DNA, 22 bp, Homo sapiens
cctgagagtgcgtgcctcctta

SEQ ID NO: 8276408 - DNA, 22 bp, Homo sapiens
aggcttctctgcaagatgttaa

SEQ ID NO: 8276409 - DNA, 22 bp, Homo sapiens
aggcttctgggattcccttggt

SEQ ID NO: 8276410 - DNA, 22 bp, Homo sapiens
aggcttctcaataggtttgaag

SEQ ID NO: 8276411 - DNA, 22 bp, Homo sapiens
aggcttcttagattggctggag

SEQ ID NO: 8276412 - DNA, 21 bp, Homo sapiens
aggcttggatctagacaggcc

SEQ ID NO: 8276413 - DNA, 22 bp, Homo sapiens
cccaggaggtggagcttgcagt

SEQ ID NO: 8276414 - DNA, 23 bp, Homo sapiens
cccaggagtttcactgcaaaggt

SEQ ID NO: 8276415 - DNA, 22 bp, Homo sapiens
cccaggagttggaggctgcagt

SEQ ID NO: 8276416 - DNA, 23 bp, Homo sapiens
cccaggagtttcactgcaaaggt

SEQ ID NO: 8276417 - DNA, 22 bp, Homo sapiens
agggaaattaatgtgagcaatg

SEQ ID NO: 8276418 - DNA, 23 bp, Homo sapiens
agggaagaaacatgaagggctgt

SEQ ID NO: 8276419 - DNA, 20 bp, Homo sapiens
ccctctgctacactgggagc

SEQ ID NO: 8276420 - DNA, 22 bp, Homo sapiens
ccctctggctcttctcaggccg

SEQ ID NO: 8276421 - DNA, 22 bp, Homo sapiens
ccctctcttagaagaaacacag

SEQ ID NO: 8276422 - DNA, 22 bp, Homo sapiens
agggcagagagatgaatgggat

SEQ ID NO: 8276423 - DNA, 22 bp, Homo sapiens
agggcagagatctgagtgggca

SEQ ID NO: 8276424 - DNA, 20 bp, Homo sapiens
agggcagagggattacaggc

SEQ ID NO: 8276425 - DNA, 22 bp, Homo sapiens
agggcagagcactgaattggga

SEQ ID NO: 8276426 - DNA, 22 bp, Homo sapiens
agggcagaggcggacacggaag

SEQ ID NO: 8276427 - DNA, 22 bp, Homo sapiens
agggatggaagacttgaagacc

SEQ ID NO: 8276428 - DNA, 22 bp, Homo sapiens
agggagtgtaaatggtgctcag

SEQ ID NO: 8276429 - DNA, 22 bp, Homo sapiens
agggagaaggtccatgcctgtc

SEQ ID NO: 8276430 - DNA, 22 bp, Homo sapiens
agggacttgtgtcctatgtatg

SEQ ID NO: 8276431 - DNA, 22 bp, Homo sapiens
agggacttggcagcaatatgga

SEQ ID NO: 8276432 - DNA, 22 bp, Homo sapiens
agggagaaaattggatgcacaa

SEQ ID NO: 8276433 - DNA, 22 bp, Homo sapiens
agggagaacagttgcagcagac

SEQ ID NO: 8276434 - DNA, 22 bp, Homo sapiens
aggctccaccccgccagacctt

SEQ ID NO: 8276435 - DNA, 22 bp, Homo sapiens
aggctccaccctacagagctcc

SEQ ID NO: 8276436 - DNA, 22 bp, Homo sapiens
aggctccaaattaccaagctct

SEQ ID NO: 8276437 - DNA, 22 bp, Homo sapiens
ccaggagctggagggtgcagtg

SEQ ID NO: 8276438 - DNA, 17 bp, Homo sapiens
ccaggagcgtgggtctc

SEQ ID NO: 8276439 - DNA, 17 bp, Homo sapiens
ccaggagcgtgggtctc

SEQ ID NO: 8276440 - DNA, 17 bp, Homo sapiens
ccaggagcgtgggtctc

SEQ ID NO: 8276441 - DNA, 22 bp, Homo sapiens
ccaggagctggcatgtggagag

SEQ ID NO: 8276442 - DNA, 22 bp, Homo sapiens
ccaggagctggcatgtggagag

SEQ ID NO: 8276443 - DNA, 22 bp, Homo sapiens
aggctcctcggggctgacggcg

SEQ ID NO: 8276444 - DNA, 20 bp, Homo sapiens
aggctcctgtacctgaggaa

SEQ ID NO: 8276445 - DNA, 22 bp, Homo sapiens
aggctccttcacagcactcgcc

SEQ ID NO: 8276446 - DNA, 22 bp, Homo sapiens
aggctctgtgactaaagaggat

SEQ ID NO: 8276447 - DNA, 22 bp, Homo sapiens
aggctctgtgatccacaatgag

SEQ ID NO: 8276448 - DNA, 22 bp, Homo sapiens
aggctctgtgatgtgccaggca

SEQ ID NO: 8276449 - DNA, 22 bp, Homo sapiens
aggctctgtgacaatcaagctg

SEQ ID NO: 8276450 - DNA, 22 bp, Homo sapiens
aggctctgtgactaaagaggat

SEQ ID NO: 8276451 - DNA, 22 bp, Homo sapiens
aggctctgtgcatcctccccaa

SEQ ID NO: 8276452 - DNA, 22 bp, Homo sapiens
aggctctgtgcagcctgcatct

SEQ ID NO: 8276453 - DNA, 22 bp, Homo sapiens
ccatggctcttaccttgttata

SEQ ID NO: 8276454 - DNA, 22 bp, Homo sapiens
ccatggctttctttcattgtaa

SEQ ID NO: 8276455 - DNA, 22 bp, Homo sapiens
ccatggctaagtatctgtagaa

SEQ ID NO: 8276456 - DNA, 20 bp, Homo sapiens
aggctgcctaaggctctgca

SEQ ID NO: 8276457 - DNA, 22 bp, Homo sapiens
aggctgcctaggttcaacacct

SEQ ID NO: 8276458 - DNA, 19 bp, Homo sapiens
aggctgcctcaccctccct

SEQ ID NO: 8276459 - DNA, 22 bp, Homo sapiens
ccatggcttttgagtctcaaga

SEQ ID NO: 8276460 - DNA, 18 bp, Homo sapiens
cccactgtccccacaggc

SEQ ID NO: 8276461 - DNA, 22 bp, Homo sapiens
aggctgctcacctccctgtctg

SEQ ID NO: 8276462 - DNA, 22 bp, Homo sapiens
cccactgctgctctccatggca

SEQ ID NO: 8276463 - DNA, 22 bp, Homo sapiens
aggctgctcacctccctgtctg

SEQ ID NO: 8276464 - DNA, 22 bp, Homo sapiens
aggctgcctcgtgagctcgctg

SEQ ID NO: 8276465 - DNA, 22 bp, Homo sapiens
aggctgcctcttttgagagggt

SEQ ID NO: 8276466 - DNA, 22 bp, Homo sapiens
cccagagccggtggtgctcaca

SEQ ID NO: 8276467 - DNA, 20 bp, Homo sapiens
cccagagccatagccagaca

SEQ ID NO: 8276468 - DNA, 22 bp, Homo sapiens
cccagagccgctcccctacttc

SEQ ID NO: 8276469 - DNA, 23 bp, Homo sapiens
cccagagcacagcctccagatgc

SEQ ID NO: 8276470 - DNA, 22 bp, Homo sapiens
ccagcttctctgttccagcccc

SEQ ID NO: 8276471 - DNA, 22 bp, Homo sapiens
ccagcttctctctgatgcagct

SEQ ID NO: 8276472 - DNA, 21 bp, Homo sapiens
ccagctttcccaagtcccttt

SEQ ID NO: 8276473 - DNA, 22 bp, Homo sapiens
ccagctttatagcttcaaagga

SEQ ID NO: 8276474 - DNA, 22 bp, Homo sapiens
ccagctttccagggttgactgg

SEQ ID NO: 8276475 - DNA, 22 bp, Homo sapiens
ccagctttcatatcatgaggta

SEQ ID NO: 8276476 - DNA, 22 bp, Homo sapiens
ccagctttcatatcatgaggta

SEQ ID NO: 8276477 - DNA, 22 bp, Homo sapiens
ccagctttatcaagtctgagct

SEQ ID NO: 8276478 - DNA, 22 bp, Homo sapiens
ccagctttaggttgcctgccag

SEQ ID NO: 8276479 - DNA, 22 bp, Homo sapiens
ccagcttggagtaacaaatggt

SEQ ID NO: 8276480 - DNA, 22 bp, Homo sapiens
ccagcctccatgtagatagctg

SEQ ID NO: 8276481 - DNA, 19 bp, Homo sapiens
ccagcctctcttccacccc

SEQ ID NO: 8276482 - DNA, 22 bp, Homo sapiens
ccagccctgccagagagagctg

SEQ ID NO: 8276483 - DNA, 22 bp, Homo sapiens
ccaggagagcagaagcccaggc

SEQ ID NO: 8276484 - DNA, 22 bp, Homo sapiens
ccaggagagcaggcgtgcagct

SEQ ID NO: 8276485 - DNA, 22 bp, Homo sapiens
ccaggagatgggagcatctaaa

SEQ ID NO: 8276486 - DNA, 22 bp, Homo sapiens
ccaggagcaaagatcactggga

SEQ ID NO: 8276487 - DNA, 22 bp, Homo sapiens
aggccctgggttagggcccact

SEQ ID NO: 8276488 - DNA, 22 bp, Homo sapiens
aggccctgggagcagagatgca

SEQ ID NO: 8276489 - DNA, 22 bp, Homo sapiens
ccagcttttcttatcattataa

SEQ ID NO: 8276490 - DNA, 22 bp, Homo sapiens
ccagcttttagtgggcttatta

SEQ ID NO: 8276491 - DNA, 22 bp, Homo sapiens
ccagcttttcagaatctgcctg

SEQ ID NO: 8276492 - DNA, 22 bp, Homo sapiens
ccagcttttcctctcattgctt

SEQ ID NO: 8276493 - DNA, 22 bp, Homo sapiens
ccagctttctcagaggcttcta

SEQ ID NO: 8276494 - DNA, 22 bp, Homo sapiens
ccagctttctgggtggtttctg

SEQ ID NO: 8276495 - DNA, 22 bp, Homo sapiens
ccagctttggagtgttgttgct

SEQ ID NO: 8276496 - DNA, 20 bp, Homo sapiens
ccagctttccctgcagcatc

SEQ ID NO: 8276497 - DNA, 22 bp, Homo sapiens
ccagctttcctgcgagttgatt

SEQ ID NO: 8276498 - DNA, 22 bp, Homo sapiens
ccagcttttgcactggactggg

SEQ ID NO: 8276499 - DNA, 22 bp, Homo sapiens
ccagcttttggggtgacaattt

SEQ ID NO: 8276500 - DNA, 22 bp, Homo sapiens
aggccctggcccccagagattc

SEQ ID NO: 8276501 - DNA, 22 bp, Homo sapiens
aggccagacagctagaaacagg

SEQ ID NO: 8276502 - DNA, 22 bp, Homo sapiens
aggcatggatgtagcagtgacc

SEQ ID NO: 8276503 - DNA, 22 bp, Homo sapiens
aggcatggcactgagcagcttc

SEQ ID NO: 8276504 - DNA, 22 bp, Homo sapiens
ccagagcaattctcacagaact

SEQ ID NO: 8276505 - DNA, 22 bp, Homo sapiens
ccagagatgctcagggtttgca

SEQ ID NO: 8276506 - DNA, 22 bp, Homo sapiens
ccagagatggacagggaatttg

SEQ ID NO: 8276507 - DNA, 23 bp, Homo sapiens
ccagagattgttacacagtaggc

SEQ ID NO: 8276508 - DNA, 22 bp, Homo sapiens
ccagagatgttcacattctaat

SEQ ID NO: 8276509 - DNA, 22 bp, Homo sapiens
ccagagagtatcatggagagta

SEQ ID NO: 8276510 - DNA, 22 bp, Homo sapiens
ccagagagtcgatgggggacac

SEQ ID NO: 8276511 - DNA, 22 bp, Homo sapiens
ccacaggacggaggtctggccg

SEQ ID NO: 8276512 - DNA, 22 bp, Homo sapiens
ccacaggaggaacaattagatg

SEQ ID NO: 8276513 - DNA, 23 bp, Homo sapiens
ccacaggagggttcatttattca

SEQ ID NO: 8276514 - DNA, 22 bp, Homo sapiens
ccacagctgaccgcaggtgagc

SEQ ID NO: 8276515 - DNA, 22 bp, Homo sapiens
ccacaggacagttaatgtgcag

SEQ ID NO: 8276516 - DNA, 22 bp, Homo sapiens
caggcactggggatgctgggat

SEQ ID NO: 8276517 - DNA, 22 bp, Homo sapiens
caggcactgtgcctcgctccct

SEQ ID NO: 8276518 - DNA, 22 bp, Homo sapiens
agctgctgccggtggccaccct

SEQ ID NO: 8276519 - DNA, 22 bp, Homo sapiens
agctgctgggaccccagatcca

SEQ ID NO: 8276520 - DNA, 22 bp, Homo sapiens
caggcacactgtctacactgag

SEQ ID NO: 8276521 - DNA, 22 bp, Homo sapiens
agctgggcttggccaggtcgct

SEQ ID NO: 8276522 - DNA, 19 bp, Homo sapiens
agctgggctgtcacagtga

SEQ ID NO: 8276523 - DNA, 22 bp, Homo sapiens
agctgggctgggctgagctgag

SEQ ID NO: 8276524 - DNA, 22 bp, Homo sapiens
agctgggctggagctccaagcg

SEQ ID NO: 8276525 - DNA, 22 bp, Homo sapiens
cagctctgtaaattccttcatc

SEQ ID NO: 8276526 - DNA, 22 bp, Homo sapiens
cagctctgtaaattccttcatc

SEQ ID NO: 8276527 - DNA, 22 bp, Homo sapiens
cagctctgtaaattccttcatc

SEQ ID NO: 8276528 - DNA, 22 bp, Homo sapiens
cagctctggttcctgggcccag

SEQ ID NO: 8276529 - DNA, 22 bp, Homo sapiens
cagctctggtccagggagggca

SEQ ID NO: 8276530 - DNA, 22 bp, Homo sapiens
cagctctgggtgacaggagggc

SEQ ID NO: 8276531 - DNA, 22 bp, Homo sapiens
cagctctgggtgacaggagggc

SEQ ID NO: 8276532 - DNA, 22 bp, Homo sapiens
cagctctggggcagagtgacta

SEQ ID NO: 8276533 - DNA, 23 bp, Homo sapiens
agctgaggctgtgggtgtcagag

SEQ ID NO: 8276534 - DNA, 22 bp, Homo sapiens
caggaaggcccacctgtcctgt

SEQ ID NO: 8276535 - DNA, 22 bp, Homo sapiens
caggaaggaccgtccagatcag

SEQ ID NO: 8276536 - DNA, 22 bp, Homo sapiens
caggaagagaacatggaggctg

SEQ ID NO: 8276537 - DNA, 22 bp, Homo sapiens
agctgcagattctatctagaag

SEQ ID NO: 8276538 - DNA, 22 bp, Homo sapiens
agctgcagagaaaagaggctgg

SEQ ID NO: 8276539 - DNA, 19 bp, Homo sapiens
caggaaggggcgaatctgg

SEQ ID NO: 8276540 - DNA, 22 bp, Homo sapiens
caggaaggggctcactctggcc

SEQ ID NO: 8276541 - DNA, 22 bp, Homo sapiens
caggaaggggctcactctggcc

SEQ ID NO: 8276542 - DNA, 22 bp, Homo sapiens
caggaaggcccacctgtcctgt

SEQ ID NO: 8276543 - DNA, 22 bp, Homo sapiens
caggaaggcgcggctgtgcctg

SEQ ID NO: 8276544 - DNA, 22 bp, Homo sapiens
caggaagggggatccttggaag

SEQ ID NO: 8276545 - DNA, 22 bp, Homo sapiens
agctgcagtcaagctgggccac

SEQ ID NO: 8276546 - DNA, 22 bp, Homo sapiens
cagggagcggagtcccatgcct

SEQ ID NO: 8276547 - DNA, 22 bp, Homo sapiens
cagggagctggtgccagccgac

SEQ ID NO: 8276548 - DNA, 22 bp, Homo sapiens
cagggagctggctggctgtgcc

SEQ ID NO: 8276549 - DNA, 22 bp, Homo sapiens
cagggagctggctggcgtgagt

SEQ ID NO: 8276550 - DNA, 22 bp, Homo sapiens
cagggagctattagggttagtg

SEQ ID NO: 8276551 - DNA, 22 bp, Homo sapiens
cagggagctggagttggagtac

SEQ ID NO: 8276552 - DNA, 22 bp, Homo sapiens
cagggagctgacaaccaaggag

SEQ ID NO: 8276553 - DNA, 22 bp, Homo sapiens
agctgtggagtagggggttgga

SEQ ID NO: 8276554 - DNA, 22 bp, Homo sapiens
agctgtggaagactgtcagggt

SEQ ID NO: 8276555 - DNA, 19 bp, Homo sapiens
agctgtggatgtgggattt

SEQ ID NO: 8276556 - DNA, 22 bp, Homo sapiens
agctgtggcaaccttgtcagac

SEQ ID NO: 8276557 - DNA, 22 bp, Homo sapiens
agctgtggaaatcaggcaatga

SEQ ID NO: 8276558 - DNA, 22 bp, Homo sapiens
agctgtgaattttatgctagtg

SEQ ID NO: 8276559 - DNA, 22 bp, Homo sapiens
caggctccactgtaggcagctc

SEQ ID NO: 8276560 - DNA, 22 bp, Homo sapiens
caggctccactgtaggcagctc

SEQ ID NO: 8276561 - DNA, 22 bp, Homo sapiens
caggctccacaggggaatccgg

SEQ ID NO: 8276562 - DNA, 22 bp, Homo sapiens
caggctccaagccctctgatgt

SEQ ID NO: 8276563 - DNA, 22 bp, Homo sapiens
cagggctcgctcgctcgctcgc

SEQ ID NO: 8276564 - DNA, 22 bp, Homo sapiens
cagggctcgctcgctcgctcgc

SEQ ID NO: 8276565 - DNA, 22 bp, Homo sapiens
cagggctcgctgccagcttcag

SEQ ID NO: 8276566 - DNA, 22 bp, Homo sapiens
caggtgagctctatctagggag

SEQ ID NO: 8276567 - DNA, 20 bp, Homo sapiens
caggtgagcagatctgggtg

SEQ ID NO: 8276568 - DNA, 22 bp, Homo sapiens
caggtgagctctatctagggag

SEQ ID NO: 8276569 - DNA, 20 bp, Homo sapiens
caggtgagcagatctgggtg

SEQ ID NO: 8276570 - DNA, 20 bp, Homo sapiens
caggtgattccctggggaat

SEQ ID NO: 8276571 - DNA, 22 bp, Homo sapiens
caggtgagttttcctccttggt

SEQ ID NO: 8276572 - DNA, 22 bp, Homo sapiens
caggtgagtaacaatgggtgat

SEQ ID NO: 8276573 - DNA, 22 bp, Homo sapiens
caggtgaggctgaacagatgaa

SEQ ID NO: 8276574 - DNA, 22 bp, Homo sapiens
caggtgagtaacaatgggtgat

SEQ ID NO: 8276575 - DNA, 22 bp, Homo sapiens
cagtggctcatgcctataatcc

SEQ ID NO: 8276576 - DNA, 22 bp, Homo sapiens
cagtggctcatgcctataatcc

SEQ ID NO: 8276577 - DNA, 22 bp, Homo sapiens
catacattacctaacttaatgc

SEQ ID NO: 8276578 - DNA, 22 bp, Homo sapiens
catagtaagtgcataataaatg

SEQ ID NO: 8276579 - DNA, 22 bp, Homo sapiens
catattctgttggtcacataga

SEQ ID NO: 8276580 - DNA, 22 bp, Homo sapiens
caggtgggagccacagcgtaca

SEQ ID NO: 8276581 - DNA, 22 bp, Homo sapiens
caggtgggagccacagcgtaca

SEQ ID NO: 8276582 - DNA, 22 bp, Homo sapiens
caggtggcttctctgcagcctt

SEQ ID NO: 8276583 - DNA, 22 bp, Homo sapiens
caggtgcacttgctttgtgttt

SEQ ID NO: 8276584 - DNA, 22 bp, Homo sapiens
caggtgcacattactgtgttgg

SEQ ID NO: 8276585 - DNA, 22 bp, Homo sapiens
aggacaggattccttgccttgc

SEQ ID NO: 8276586 - DNA, 22 bp, Homo sapiens
caggtgggagcgaggagctact

SEQ ID NO: 8276587 - DNA, 22 bp, Homo sapiens
caggtgggattttgctgcttga

SEQ ID NO: 8276588 - DNA, 22 bp, Homo sapiens
cagtgcctcaggccagcctgca

SEQ ID NO: 8276589 - DNA, 18 bp, Homo sapiens
aggactctgctaccgtat

SEQ ID NO: 8276590 - DNA, 20 bp, Homo sapiens
cagtgcctgccccttgggtt

SEQ ID NO: 8276591 - DNA, 22 bp, Homo sapiens
cagtgcctgccttttattttgt

SEQ ID NO: 8276592 - DNA, 22 bp, Homo sapiens
aggagaagccaagttgtgagca

SEQ ID NO: 8276593 - DNA, 19 bp, Homo sapiens
aggagaagtagcagaaatt

SEQ ID NO: 8276594 - DNA, 22 bp, Homo sapiens
aggagaagtaaggctagatgat

SEQ ID NO: 8276595 - DNA, 19 bp, Homo sapiens
cagtggcctggaggtctct

SEQ ID NO: 8276596 - DNA, 22 bp, Homo sapiens
cagtggccgcggggctgtgggt

SEQ ID NO: 8276597 - DNA, 22 bp, Homo sapiens
cagtggccatggtggcaggggt

SEQ ID NO: 8276598 - DNA, 22 bp, Homo sapiens
cattaaattccttgttctcaaa

SEQ ID NO: 8276599 - DNA, 22 bp, Homo sapiens
cattaaacaaccttgaatcaat

SEQ ID NO: 8276600 - DNA, 23 bp, Homo sapiens
catgtttttctatctcagcgtgt

SEQ ID NO: 8276601 - DNA, 20 bp, Homo sapiens
catttgttagctttctactg

SEQ ID NO: 8276602 - DNA, 22 bp, Homo sapiens
catttgttaagaaggaaaaagg

SEQ ID NO: 8276603 - DNA, 22 bp, Homo sapiens
cattttaaatgatttaagccaa

SEQ ID NO: 8276604 - DNA, 21 bp, Homo sapiens
aggcagcaggatccagggaca

SEQ ID NO: 8276605 - DNA, 19 bp, Homo sapiens
aggcagcaggccagggatg

SEQ ID NO: 8276606 - DNA, 22 bp, Homo sapiens
ccaagggctctgacttgcctgc

SEQ ID NO: 8276607 - DNA, 22 bp, Homo sapiens
ccaaaggccaagctcaggtaaa

SEQ ID NO: 8276608 - DNA, 23 bp, Homo sapiens
aggcagcaggttgtccagggtga

SEQ ID NO: 8276609 - DNA, 22 bp, Homo sapiens
catggacatatgagacctttcc

SEQ ID NO: 8276610 - DNA, 22 bp, Homo sapiens
catgctaaccagagacataaag

SEQ ID NO: 8276611 - DNA, 22 bp, Homo sapiens
catggacagtgggacagtgtgt

SEQ ID NO: 8276612 - DNA, 22 bp, Homo sapiens
catggacaacctccattcgagt

SEQ ID NO: 8276613 - DNA, 22 bp, Homo sapiens
catggcaacaactctttattcc

SEQ ID NO: 8276614 - DNA, 22 bp, Homo sapiens
catggatatattgtacagtagc

SEQ ID NO: 8276615 - DNA, 22 bp, Homo sapiens
aggattgtgcctccagtcagaa

SEQ ID NO: 8276616 - DNA, 22 bp, Homo sapiens
aggattctgatctgagctgttt

SEQ ID NO: 8276617 - DNA, 16 bp, Homo sapiens
aggaggggaattagga

SEQ ID NO: 8276618 - DNA, 20 bp, Homo sapiens
aggaggggatagaatcaaag

SEQ ID NO: 8276619 - DNA, 22 bp, Homo sapiens
aggaggggcaatgatagtctgg

SEQ ID NO: 8276620 - DNA, 22 bp, Homo sapiens
aggagggcaggctggctgccta

SEQ ID NO: 8276621 - DNA, 22 bp, Homo sapiens
aggagggcaggctggctgccta

SEQ ID NO: 8276622 - DNA, 23 bp, Homo sapiens
catggggagcagtgctcctgacc

SEQ ID NO: 8276623 - DNA, 22 bp, Homo sapiens
aggattgtgcctccagtcagaa

SEQ ID NO: 8276624 - DNA, 19 bp, Homo sapiens
catggtgaaaccccgtctc

SEQ ID NO: 8276625 - DNA, 22 bp, Homo sapiens
catgtataggtccatagtgaat

SEQ ID NO: 8276626 - DNA, 22 bp, Homo sapiens
catgtacattctgtagatggag

SEQ ID NO: 8276627 - DNA, 22 bp, Homo sapiens
agtggctgtcttccaaaatctg

SEQ ID NO: 8276628 - DNA, 21 bp, Homo sapiens
agtggctgtcaagggggcctt

SEQ ID NO: 8276629 - DNA, 22 bp, Homo sapiens
agtggctgtcctggctctaact

SEQ ID NO: 8276630 - DNA, 22 bp, Homo sapiens
agtggctgtaggctatgagaga

SEQ ID NO: 8276631 - DNA, 22 bp, Homo sapiens
agtggctgtatcagtcaaccct

SEQ ID NO: 8276632 - DNA, 22 bp, Homo sapiens
agtggctggtctaaggtcacag

SEQ ID NO: 8276633 - DNA, 22 bp, Homo sapiens
agtggctgtactattttttcat

SEQ ID NO: 8276634 - DNA, 19 bp, Homo sapiens
agtggctgggcagaagcaa

SEQ ID NO: 8276635 - DNA, 22 bp, Homo sapiens
agtggctggtagttactgagca

SEQ ID NO: 8276636 - DNA, 22 bp, Homo sapiens
agtgggccggacagcccaggcc

SEQ ID NO: 8276637 - DNA, 22 bp, Homo sapiens
agtgggctggtggcagggagaa

SEQ ID NO: 8276638 - DNA, 22 bp, Homo sapiens
agtgggctggtggcagggagaa

SEQ ID NO: 8276639 - DNA, 19 bp, Homo sapiens
agtgggcaaggaagatgac

SEQ ID NO: 8276640 - DNA, 22 bp, Homo sapiens
agtgggcaaaacagctcagagc

SEQ ID NO: 8276641 - DNA, 22 bp, Homo sapiens
agtgggagggccatatggtgaa

SEQ ID NO: 8276642 - DNA, 22 bp, Homo sapiens
agtgcaggccccaggccaggcc

SEQ ID NO: 8276643 - DNA, 22 bp, Homo sapiens
ctctctccttagctgcagacca

SEQ ID NO: 8276644 - DNA, 22 bp, Homo sapiens
agtggctggcataggaacagac

SEQ ID NO: 8276645 - DNA, 22 bp, Homo sapiens
agtggctggagccccaggctgg

SEQ ID NO: 8276646 - DNA, 22 bp, Homo sapiens
agtggctggacgacaagggtga

SEQ ID NO: 8276647 - DNA, 22 bp, Homo sapiens
agtggctgaatatattttacta

SEQ ID NO: 8276648 - DNA, 22 bp, Homo sapiens
agtggctgacaactgggttaac

SEQ ID NO: 8276649 - DNA, 22 bp, Homo sapiens
agtggctgaagcatcaaaggca

SEQ ID NO: 8276650 - DNA, 22 bp, Homo sapiens
ctgaagccagtttgctgccctt

SEQ ID NO: 8276651 - DNA, 22 bp, Homo sapiens
ctgaagctgggcacttcctttt

SEQ ID NO: 8276652 - DNA, 22 bp, Homo sapiens
agtgtgggggctttggtgtcac

SEQ ID NO: 8276653 - DNA, 22 bp, Homo sapiens
ctgaagcagatgtggctgagat

SEQ ID NO: 8276654 - DNA, 22 bp, Homo sapiens
agtgtgttctcaatgaaaagaa

SEQ ID NO: 8276655 - DNA, 20 bp, Homo sapiens
agtgtgttcctcttactgtg

SEQ ID NO: 8276656 - DNA, 22 bp, Homo sapiens
agtgtgttctggtctaccttgg

SEQ ID NO: 8276657 - DNA, 21 bp, Homo sapiens
agtgtgttcttggcattacct

SEQ ID NO: 8276658 - DNA, 22 bp, Homo sapiens
agtgtgtttggagcgagggagg

SEQ ID NO: 8276659 - DNA, 22 bp, Homo sapiens
agtgtgttgtaggctcaaatgg

SEQ ID NO: 8276660 - DNA, 22 bp, Homo sapiens
agtgtgtttaggctgcgggttg

SEQ ID NO: 8276661 - DNA, 22 bp, Homo sapiens
ctcttaaataacatcattgctt

SEQ ID NO: 8276662 - DNA, 22 bp, Homo sapiens
agtggggaagagcatgggccct

SEQ ID NO: 8276663 - DNA, 23 bp, Homo sapiens
agtggggaatcaacagattcttt

SEQ ID NO: 8276664 - DNA, 22 bp, Homo sapiens
agtggggacaatgagagcaggt

SEQ ID NO: 8276665 - DNA, 20 bp, Homo sapiens
agtggggagtcaggagtgcc

SEQ ID NO: 8276666 - DNA, 22 bp, Homo sapiens
agtggggaggtccaggccaccc

SEQ ID NO: 8276667 - DNA, 22 bp, Homo sapiens
agtggggaggtccaggccaccc

SEQ ID NO: 8276668 - DNA, 22 bp, Homo sapiens
agtctgagtatctctgagccag

SEQ ID NO: 8276669 - DNA, 22 bp, Homo sapiens
agtccaaagcagatgagggcca

SEQ ID NO: 8276670 - DNA, 22 bp, Homo sapiens
agtccaaagcagatgagggcca

SEQ ID NO: 8276671 - DNA, 22 bp, Homo sapiens
ctcaggattgtgcctagggaga

SEQ ID NO: 8276672 - DNA, 22 bp, Homo sapiens
ctcaggatgtcggtgactattg

SEQ ID NO: 8276673 - DNA, 22 bp, Homo sapiens
agtctgcttttgtgaagagctg

SEQ ID NO: 8276674 - DNA, 22 bp, Homo sapiens
agtctgcttcctggagaactca

SEQ ID NO: 8276675 - DNA, 22 bp, Homo sapiens
agtctgtctttggcttcaccac

SEQ ID NO: 8276676 - DNA, 19 bp, Homo sapiens
agtctgtctgctttccctc

SEQ ID NO: 8276677 - DNA, 22 bp, Homo sapiens
agtgactgggcagggcagggcc

SEQ ID NO: 8276678 - DNA, 22 bp, Homo sapiens
agtgactggttttgacaggaat

SEQ ID NO: 8276679 - DNA, 22 bp, Homo sapiens
agtgaccaacaatgctgagaag

SEQ ID NO: 8276680 - DNA, 22 bp, Homo sapiens
agtgaccacaccctgcagacct

SEQ ID NO: 8276681 - DNA, 22 bp, Homo sapiens
agtgcagaggctgggaaatgct

SEQ ID NO: 8276682 - DNA, 22 bp, Homo sapiens
agtgcagagagcaatactctac

SEQ ID NO: 8276683 - DNA, 22 bp, Homo sapiens
agtgcagactgaaatgaccttc

SEQ ID NO: 8276684 - DNA, 22 bp, Homo sapiens
agtgcagagacctggtcaggca

SEQ ID NO: 8276685 - DNA, 22 bp, Homo sapiens
agtgcagagtacatttgtggca

SEQ ID NO: 8276686 - DNA, 22 bp, Homo sapiens
agtgcagatttttagtcagctt

SEQ ID NO: 8276687 - DNA, 22 bp, Homo sapiens
agtgcacttttccacatccata

SEQ ID NO: 8276688 - DNA, 22 bp, Homo sapiens
agtgatttgcagtatttactaa

SEQ ID NO: 8276689 - DNA, 22 bp, Homo sapiens
agtgacattaaggattcttcaa

SEQ ID NO: 8276690 - DNA, 22 bp, Homo sapiens
agtgacagtctcagagatcagg

SEQ ID NO: 8276691 - DNA, 22 bp, Homo sapiens
ctccagtgggggtgagcctaga

SEQ ID NO: 8276692 - DNA, 22 bp, Homo sapiens
ctccagtgtctcagagcagatg

SEQ ID NO: 8276693 - DNA, 22 bp, Homo sapiens
ctcctcctggacacaggctgtg

SEQ ID NO: 8276694 - DNA, 22 bp, Homo sapiens
ctcctctcaaaagtaggttgac

SEQ ID NO: 8276695 - DNA, 22 bp, Homo sapiens
ctcctctcaaaagtaggttgac

SEQ ID NO: 8276696 - DNA, 22 bp, Homo sapiens
ctcctctcaggctggatggcgc

SEQ ID NO: 8276697 - DNA, 22 bp, Homo sapiens
ctcctccctctttgccacacat

SEQ ID NO: 8276698 - DNA, 22 bp, Homo sapiens
ctcctccctctttgccacacat

SEQ ID NO: 8276699 - DNA, 22 bp, Homo sapiens
ctcctccctgcgattgctctgc

SEQ ID NO: 8276700 - DNA, 22 bp, Homo sapiens
ctcctccctgggaggctggcat

SEQ ID NO: 8276701 - DNA, 22 bp, Homo sapiens
ctcccagggtctaggctgctgg

SEQ ID NO: 8276702 - DNA, 22 bp, Homo sapiens
ctcccaggggagtcatctgctt

SEQ ID NO: 8276703 - DNA, 22 bp, Homo sapiens
ctcccaggggagtcatctgctt

SEQ ID NO: 8276704 - DNA, 21 bp, Homo sapiens
ctcccagggtgactgttcaac

SEQ ID NO: 8276705 - DNA, 22 bp, Homo sapiens
ctcccaggttacatctgagcct

SEQ ID NO: 8276706 - DNA, 22 bp, Homo sapiens
ctcccaggtgtcccttctgcca

SEQ ID NO: 8276707 - DNA, 22 bp, Homo sapiens
ctcccaggtgtcccttctgcca

SEQ ID NO: 8276708 - DNA, 22 bp, Homo sapiens
ctcccaggttacatctgagcct

SEQ ID NO: 8276709 - DNA, 22 bp, Homo sapiens
ctcccaggttccgacgcctctt

SEQ ID NO: 8276710 - DNA, 22 bp, Homo sapiens
aggttcaggctgcacacctgag

SEQ ID NO: 8276711 - DNA, 22 bp, Homo sapiens
aggttcaggcacttgcccaaca

SEQ ID NO: 8276712 - DNA, 22 bp, Homo sapiens
aggttcagtgcctggaacaggg

SEQ ID NO: 8276713 - DNA, 22 bp, Homo sapiens
aggttcagtctttggacccctc

SEQ ID NO: 8276714 - DNA, 22 bp, Homo sapiens
aggttcagtaaatgttagttga

SEQ ID NO: 8276715 - DNA, 17 bp, Homo sapiens
aggttcaggttacattc

SEQ ID NO: 8276716 - DNA, 17 bp, Homo sapiens
aggttcaggttacattc

SEQ ID NO: 8276717 - DNA, 22 bp, Homo sapiens
aggttcaaatgcaagagatgct

SEQ ID NO: 8276718 - DNA, 23 bp, Homo sapiens
aggttcagctttcttactctggg

SEQ ID NO: 8276719 - DNA, 23 bp, Homo sapiens
aggttcaggagatggaggaacaa

SEQ ID NO: 8276720 - DNA, 22 bp, Homo sapiens
aggttcagacgcataataggca

SEQ ID NO: 8276721 - DNA, 22 bp, Homo sapiens
aggttcagatgacttttatgct

SEQ ID NO: 8276722 - DNA, 22 bp, Homo sapiens
aggttcagagttgttgatgttt

SEQ ID NO: 8276723 - DNA, 22 bp, Homo sapiens
aggttatcatcagttgagcact

SEQ ID NO: 8276724 - DNA, 21 bp, Homo sapiens
agtacaaaaattcctttctca

SEQ ID NO: 8276725 - DNA, 22 bp, Homo sapiens
agtaatgccctctgctttggag

SEQ ID NO: 8276726 - DNA, 22 bp, Homo sapiens
agtaatgcttctagaactattt

SEQ ID NO: 8276727 - DNA, 22 bp, Homo sapiens
agtaatgcggtggggaaaacaa

SEQ ID NO: 8276728 - DNA, 22 bp, Homo sapiens
agtacaaattatagcgcttgga

SEQ ID NO: 8276729 - DNA, 22 bp, Homo sapiens
agtacaaatgcagccagagtag

SEQ ID NO: 8276730 - DNA, 22 bp, Homo sapiens
agtacaaactgtttcaaagtag

SEQ ID NO: 8276731 - DNA, 22 bp, Homo sapiens
agtacaaactgtttcaaagtag

SEQ ID NO: 8276732 - DNA, 22 bp, Homo sapiens
cctttattcaattagtcctaat

SEQ ID NO: 8276733 - DNA, 20 bp, Homo sapiens
cctttattatttgtatgatg

SEQ ID NO: 8276734 - DNA, 21 bp, Homo sapiens
aggtttatttcaacttcagga

SEQ ID NO: 8276735 - DNA, 22 bp, Homo sapiens
cgtggctggggcgactccacgg

SEQ ID NO: 8276736 - DNA, 17 bp, Homo sapiens
cgtggctgagccataga

SEQ ID NO: 8276737 - DNA, 22 bp, Homo sapiens
cgtggctggggaggtcagccag

SEQ ID NO: 8276738 - DNA, 22 bp, Homo sapiens
cgtgccactgcactctagcctg

SEQ ID NO: 8276739 - DNA, 17 bp, Homo sapiens
cgtgagcagcaggtgcc

SEQ ID NO: 8276740 - DNA, 22 bp, Homo sapiens
cgtgagcagctctgtgtctctg

SEQ ID NO: 8276741 - DNA, 22 bp, Homo sapiens
agtcagggcctggcctgctgaa

SEQ ID NO: 8276742 - DNA, 22 bp, Homo sapiens
agtcaggctgacaggctaggag

SEQ ID NO: 8276743 - DNA, 22 bp, Homo sapiens
ctacaagtcattccaggtactt

SEQ ID NO: 8276744 - DNA, 22 bp, Homo sapiens
agtcacatttgggggtgtcaaa

SEQ ID NO: 8276745 - DNA, 22 bp, Homo sapiens
cctggtcagagcagtcaggatc

SEQ ID NO: 8276746 - DNA, 22 bp, Homo sapiens
cctggtcacccctctctctgca

SEQ ID NO: 8276747 - DNA, 22 bp, Homo sapiens
aggtgcacctgagggtgtcatc

SEQ ID NO: 8276748 - DNA, 22 bp, Homo sapiens
aggtgagggtgccagtgcatgg

SEQ ID NO: 8276749 - DNA, 19 bp, Homo sapiens
aggtgaggggcaccatgtc

SEQ ID NO: 8276750 - DNA, 22 bp, Homo sapiens
aggtattattagcatctctatt

SEQ ID NO: 8276751 - DNA, 22 bp, Homo sapiens
aggtctcttgctgtctctgggc

SEQ ID NO: 8276752 - DNA, 22 bp, Homo sapiens
cctggagcatcaggaggaaggg

SEQ ID NO: 8276753 - DNA, 22 bp, Homo sapiens
cctggagcccaaggcagtgaga

SEQ ID NO: 8276754 - DNA, 22 bp, Homo sapiens
cctggagcaggagctgcagagg

SEQ ID NO: 8276755 - DNA, 22 bp, Homo sapiens
cctggagcaggagctgcagagg

SEQ ID NO: 8276756 - DNA, 22 bp, Homo sapiens
cctggactaaaatcttttctta

SEQ ID NO: 8276757 - DNA, 22 bp, Homo sapiens
agggtggaagatggcactatct

SEQ ID NO: 8276758 - DNA, 19 bp, Homo sapiens
agggtggcaaaggagggtg

SEQ ID NO: 8276759 - DNA, 22 bp, Homo sapiens
agggtggcactggtggctctat

SEQ ID NO: 8276760 - DNA, 20 bp, Homo sapiens
agggtggcaagttagtgaca

SEQ ID NO: 8276761 - DNA, 22 bp, Homo sapiens
cctggctcaggcacgcatggct

SEQ ID NO: 8276762 - DNA, 22 bp, Homo sapiens
aggtatatgctattacttctgc

SEQ ID NO: 8276763 - DNA, 22 bp, Homo sapiens
cctggctcaaggcgaggactcc

SEQ ID NO: 8276764 - DNA, 22 bp, Homo sapiens
cctggagcccctctggccagcc

SEQ ID NO: 8276765 - DNA, 22 bp, Homo sapiens
cctggagcccctctggccagcc

SEQ ID NO: 8276766 - DNA, 22 bp, Homo sapiens
agggtggcagttactggagcaa

SEQ ID NO: 8276767 - DNA, 22 bp, Homo sapiens
agggtggccatgagggagagat

SEQ ID NO: 8276768 - DNA, 22 bp, Homo sapiens
cctggccagccagggctggggt

SEQ ID NO: 8276769 - DNA, 22 bp, Homo sapiens
ctggggaggatgctacgacctg

SEQ ID NO: 8276770 - DNA, 20 bp, Homo sapiens
ctggggaggaggatgtgttc

SEQ ID NO: 8276771 - DNA, 22 bp, Homo sapiens
ctggggagtgaaggtaattaca

SEQ ID NO: 8276772 - DNA, 22 bp, Homo sapiens
ctggggagtgaaattcttaaat

SEQ ID NO: 8276773 - DNA, 22 bp, Homo sapiens
ctggggaggcagggctgcccct

SEQ ID NO: 8276774 - DNA, 22 bp, Homo sapiens
atattttgaagttaataatgtg

SEQ ID NO: 8276775 - DNA, 22 bp, Homo sapiens
ctgtatctgtgttggatgagtt

SEQ ID NO: 8276776 - DNA, 22 bp, Homo sapiens
ctgtatctgtgttggatgagtt

SEQ ID NO: 8276777 - DNA, 22 bp, Homo sapiens
atatttgttagagtctatgtgt

SEQ ID NO: 8276778 - DNA, 22 bp, Homo sapiens
atattttcactgaaccaaagta

SEQ ID NO: 8276779 - DNA, 22 bp, Homo sapiens
ctgtattcaaagtgaggatgta

SEQ ID NO: 8276780 - DNA, 22 bp, Homo sapiens
ctgtattctgggcagggaagga

SEQ ID NO: 8276781 - DNA, 22 bp, Homo sapiens
ctgtattcaagcttctgcccaa

SEQ ID NO: 8276782 - DNA, 22 bp, Homo sapiens
ctgtatttagttaaaatgctaa

SEQ ID NO: 8276783 - DNA, 22 bp, Homo sapiens
ctgtatttcttggacagttgct

SEQ ID NO: 8276784 - DNA, 22 bp, Homo sapiens
ctgtccacatggagaacctggt

SEQ ID NO: 8276785 - DNA, 19 bp, Homo sapiens
ctgtccacacactcgcttc

SEQ ID NO: 8276786 - DNA, 16 bp, Homo sapiens
ctgtccagcatctgcc

SEQ ID NO: 8276787 - DNA, 22 bp, Homo sapiens
atatattttgcggtcacgtggc

SEQ ID NO: 8276788 - DNA, 22 bp, Homo sapiens
atatattttgcggtcacgtggc

SEQ ID NO: 8276789 - DNA, 22 bp, Homo sapiens
atagtcactctgttaggtgttt

SEQ ID NO: 8276790 - DNA, 22 bp, Homo sapiens
atatattttttgagacagagtc

SEQ ID NO: 8276791 - DNA, 22 bp, Homo sapiens
atatcacaggtgtttacctgat

SEQ ID NO: 8276792 - DNA, 20 bp, Homo sapiens
ctgggctgggctacagggtc

SEQ ID NO: 8276793 - DNA, 22 bp, Homo sapiens
cttcagagtgcagaagattggg

SEQ ID NO: 8276794 - DNA, 23 bp, Homo sapiens
cttcacaatcaaaatcagttctg

SEQ ID NO: 8276795 - DNA, 22 bp, Homo sapiens
ctgtttcaagtgaagtcagaca

SEQ ID NO: 8276796 - DNA, 19 bp, Homo sapiens
cttcagcatctccggagct

SEQ ID NO: 8276797 - DNA, 22 bp, Homo sapiens
cttcagcacctcagctggagag

SEQ ID NO: 8276798 - DNA, 22 bp, Homo sapiens
cttcagcaccatagctccttct

SEQ ID NO: 8276799 - DNA, 21 bp, Homo sapiens
cttcagcaaatacttggcagg

SEQ ID NO: 8276800 - DNA, 22 bp, Homo sapiens
cttcagcaactttggaatgttt

SEQ ID NO: 8276801 - DNA, 22 bp, Homo sapiens
cttcagcagatgtgctagagat

SEQ ID NO: 8276802 - DNA, 22 bp, Homo sapiens
cttcataatctgaaatttgtaa

SEQ ID NO: 8276803 - DNA, 22 bp, Homo sapiens
atctggaagccagatactcagt

SEQ ID NO: 8276804 - DNA, 22 bp, Homo sapiens
atctggaagattgaaggggagt

SEQ ID NO: 8276805 - DNA, 22 bp, Homo sapiens
atctcccagccacagcattctt

SEQ ID NO: 8276806 - DNA, 22 bp, Homo sapiens
atctcccacaggctgctacttc

SEQ ID NO: 8276807 - DNA, 22 bp, Homo sapiens
atctcccaaattagcctcttga

SEQ ID NO: 8276808 - DNA, 22 bp, Homo sapiens
atctcccaattccctgataaat

SEQ ID NO: 8276809 - DNA, 22 bp, Homo sapiens
atctccagtatcctagtattgt

SEQ ID NO: 8276810 - DNA, 22 bp, Homo sapiens
atctccaggttgtgcctgcgtc

SEQ ID NO: 8276811 - DNA, 22 bp, Homo sapiens
atctccagggtgcccttgttct

SEQ ID NO: 8276812 - DNA, 22 bp, Homo sapiens
atctccaggcatttcaagagac

SEQ ID NO: 8276813 - DNA, 22 bp, Homo sapiens
atctccaggattttcacactca

SEQ ID NO: 8276814 - DNA, 22 bp, Homo sapiens
atctccagtgcccaaaggaaat

SEQ ID NO: 8276815 - DNA, 22 bp, Homo sapiens
atctccagttagcagtactgat

SEQ ID NO: 8276816 - DNA, 22 bp, Homo sapiens
atctcccaaactcatttcttca

SEQ ID NO: 8276817 - DNA, 22 bp, Homo sapiens
atctccagtcctggtttcctgg

SEQ ID NO: 8276818 - DNA, 22 bp, Homo sapiens
atctccagtgaggcagattctg

SEQ ID NO: 8276819 - DNA, 22 bp, Homo sapiens
atctccaggaagtgtcatttac

SEQ ID NO: 8276820 - DNA, 22 bp, Homo sapiens
atctccagctggctgtgataaa

SEQ ID NO: 8276821 - DNA, 22 bp, Homo sapiens
atctccagctcgcagagctcct

SEQ ID NO: 8276822 - DNA, 22 bp, Homo sapiens
atctccagcaatggggagctct

SEQ ID NO: 8276823 - DNA, 22 bp, Homo sapiens
atctccagcagtgcttttgagc

SEQ ID NO: 8276824 - DNA, 22 bp, Homo sapiens
atctccagatgcctggaaatga

SEQ ID NO: 8276825 - DNA, 22 bp, Homo sapiens
atctccagaggagtcatggtct

SEQ ID NO: 8276826 - DNA, 22 bp, Homo sapiens
atctccagattgtgatcatcag

SEQ ID NO: 8276827 - DNA, 22 bp, Homo sapiens
atctccagaacatttataaacg

SEQ ID NO: 8276828 - DNA, 22 bp, Homo sapiens
atctccagaatggcttgttaat

SEQ ID NO: 8276829 - DNA, 23 bp, Homo sapiens
ctgttatattctagggagctgca

SEQ ID NO: 8276830 - DNA, 22 bp, Homo sapiens
ctgttactcctttggcagatta

SEQ ID NO: 8276831 - DNA, 22 bp, Homo sapiens
ctgtttcaaagggtactgtgag

SEQ ID NO: 8276832 - DNA, 23 bp, Homo sapiens
atcattaacagtgcaggggtagg

SEQ ID NO: 8276833 - DNA, 22 bp, Homo sapiens
atcattaaatataagcttcaca

SEQ ID NO: 8276834 - DNA, 21 bp, Homo sapiens
atcattaattgctgagtgaca

SEQ ID NO: 8276835 - DNA, 22 bp, Homo sapiens
atcattaaatataagcttcaca

SEQ ID NO: 8276836 - DNA, 22 bp, Homo sapiens
ctgtgtcccttgtcccagagcc

SEQ ID NO: 8276837 - DNA, 22 bp, Homo sapiens
atcattataatggtatagttgt

SEQ ID NO: 8276838 - DNA, 21 bp, Homo sapiens
ctgtccagtaattcctggcac

SEQ ID NO: 8276839 - DNA, 18 bp, Homo sapiens
ctgtccagtagactctgc

SEQ ID NO: 8276840 - DNA, 22 bp, Homo sapiens
ctgtgccctttgtcctcgtctc

SEQ ID NO: 8276841 - DNA, 22 bp, Homo sapiens
ctgtgccctttcgctgcactgt

SEQ ID NO: 8276842 - DNA, 22 bp, Homo sapiens
atcaggccagcaatccctgggc

SEQ ID NO: 8276843 - DNA, 22 bp, Homo sapiens
ctgtgggagcacatgacagata

SEQ ID NO: 8276844 - DNA, 22 bp, Homo sapiens
agtttcatgtagccatatttac

SEQ ID NO: 8276845 - DNA, 22 bp, Homo sapiens
agtttcatgagacagattttca

SEQ ID NO: 8276846 - DNA, 22 bp, Homo sapiens
agtttctctttgacaccaaaat

SEQ ID NO: 8276847 - DNA, 22 bp, Homo sapiens
agtttcttattcttagttatgt

SEQ ID NO: 8276848 - DNA, 22 bp, Homo sapiens
agttttattaaatccacagaag

SEQ ID NO: 8276849 - DNA, 22 bp, Homo sapiens
ctgagtggaacataggatgata

SEQ ID NO: 8276850 - DNA, 22 bp, Homo sapiens
ctgagtgaggggagcttgatgg

SEQ ID NO: 8276851 - DNA, 22 bp, Homo sapiens
ctgagttctgcccaaggtctgg

SEQ ID NO: 8276852 - DNA, 22 bp, Homo sapiens
ctgagttctaggctgccacctt

SEQ ID NO: 8276853 - DNA, 22 bp, Homo sapiens
agtgttagtgaaaggtgtttat

SEQ ID NO: 8276854 - DNA, 22 bp, Homo sapiens
agtttacaacagtagctatgga

SEQ ID NO: 8276855 - DNA, 22 bp, Homo sapiens
agtttattctctggtcttagta

SEQ ID NO: 8276856 - DNA, 21 bp, Homo sapiens
agttttctgagttataaaata

SEQ ID NO: 8276857 - DNA, 18 bp, Homo sapiens
ctgccccttctctgagat

SEQ ID NO: 8276858 - DNA, 22 bp, Homo sapiens
ctgccctgacctgcctcagagt

SEQ ID NO: 8276859 - DNA, 22 bp, Homo sapiens
ctgccctgacctgcctcagagt

SEQ ID NO: 8276860 - DNA, 22 bp, Homo sapiens
ataagtgactgcagggaattca

SEQ ID NO: 8276861 - DNA, 22 bp, Homo sapiens
ctgccctgtttggacagcccgg

SEQ ID NO: 8276862 - DNA, 22 bp, Homo sapiens
ctgccctgtggctctgagtcat

SEQ ID NO: 8276863 - DNA, 22 bp, Homo sapiens
ctgccctgtagctgttctagca

SEQ ID NO: 8276864 - DNA, 18 bp, Homo sapiens
ctgcctgctctccagctt

SEQ ID NO: 8276865 - DNA, 22 bp, Homo sapiens
ataataacacctgaataggaaa

SEQ ID NO: 8276866 - DNA, 22 bp, Homo sapiens
ataataaaccaggatgggtctg

SEQ ID NO: 8276867 - DNA, 22 bp, Homo sapiens
ataataaaccaggatgggtctg

SEQ ID NO: 8276868 - DNA, 22 bp, Homo sapiens
ataataacaatgccagatgcct

SEQ ID NO: 8276869 - DNA, 21 bp, Homo sapiens
atacagaacattgatccaaga

SEQ ID NO: 8276870 - DNA, 22 bp, Homo sapiens
atacagaaaatgatgcagagtt

SEQ ID NO: 8276871 - DNA, 20 bp, Homo sapiens
ataattatttacttttgtgc

SEQ ID NO: 8276872 - DNA, 22 bp, Homo sapiens
ataattatctcagacacttgtt

SEQ ID NO: 8276873 - DNA, 22 bp, Homo sapiens
ataatgtgaagataatgcaaga

SEQ ID NO: 8276874 - DNA, 22 bp, Homo sapiens
ctggaaatcactactagtcaat

SEQ ID NO: 8276875 - DNA, 21 bp, Homo sapiens
atacagaaggtggcaaagtac

SEQ ID NO: 8276876 - DNA, 22 bp, Homo sapiens
atacatgactcacacattctgc

SEQ ID NO: 8276877 - DNA, 22 bp, Homo sapiens
ctggagctgccagggctgccgc

SEQ ID NO: 8276878 - DNA, 22 bp, Homo sapiens
ataggtgtgtggttcatggccc

SEQ ID NO: 8276879 - DNA, 22 bp, Homo sapiens
atagaatttgcactaaatctgc

SEQ ID NO: 8276880 - DNA, 20 bp, Homo sapiens
atagacaaagacatgccaga

SEQ ID NO: 8276881 - DNA, 22 bp, Homo sapiens
atagacatatggctttgtttct

SEQ ID NO: 8276882 - DNA, 22 bp, Homo sapiens
atagacatggtcttttgtcatt

SEQ ID NO: 8276883 - DNA, 22 bp, Homo sapiens
atagacatgcaacactttttac

SEQ ID NO: 8276884 - DNA, 22 bp, Homo sapiens
atagacactgaaatccctgcca

SEQ ID NO: 8276885 - DNA, 22 bp, Homo sapiens
atagaaaggtctttggcagaca

SEQ ID NO: 8276886 - DNA, 22 bp, Homo sapiens
atagaaacagggaagcaaagca

SEQ ID NO: 8276887 - DNA, 22 bp, Homo sapiens
ctggccaggcttgggacagaca

SEQ ID NO: 8276888 - DNA, 22 bp, Homo sapiens
ctggccaggttttgaacagttg

SEQ ID NO: 8276889 - DNA, 22 bp, Homo sapiens
atacaggatgctgaacatctct

SEQ ID NO: 8276890 - DNA, 22 bp, Homo sapiens
atacagggacatccagtttttc

SEQ ID NO: 8276891 - DNA, 19 bp, Homo sapiens
acttctgaggaactgcaca

SEQ ID NO: 8276892 - DNA, 22 bp, Homo sapiens
acttctgagaaatttaaggaca

SEQ ID NO: 8276893 - DNA, 22 bp, Homo sapiens
acttctgattaaggatgaatgc

SEQ ID NO: 8276894 - DNA, 22 bp, Homo sapiens
atacagatgttgaatgttatat

SEQ ID NO: 8276895 - DNA, 22 bp, Homo sapiens
ataatggactcagtaatagtga

SEQ ID NO: 8276896 - DNA, 22 bp, Homo sapiens
ataatggaaaagatcatttcct

SEQ ID NO: 8276897 - DNA, 22 bp, Homo sapiens
ataatgcatttagaataattca

SEQ ID NO: 8276898 - DNA, 22 bp, Homo sapiens
atactgaattaggtaaagcata

SEQ ID NO: 8276899 - DNA, 23 bp, Homo sapiens
atactgaaactgttgtttatctg

SEQ ID NO: 8276900 - DNA, 22 bp, Homo sapiens
acttcttgatgaaaatggtact

SEQ ID NO: 8276901 - DNA, 22 bp, Homo sapiens
acttctgtatgtcctgcattca

SEQ ID NO: 8276902 - DNA, 22 bp, Homo sapiens
acttctgtaaagggaagacagt

SEQ ID NO: 8276903 - DNA, 22 bp, Homo sapiens
atacattagtgaacaaaagaga

SEQ ID NO: 8276904 - DNA, 22 bp, Homo sapiens
actgtcactgacagaatcaaca

SEQ ID NO: 8276905 - DNA, 22 bp, Homo sapiens
actgtcactactatgtgtttgt

SEQ ID NO: 8276906 - DNA, 22 bp, Homo sapiens
actgtcacttgcaactgtgagg

SEQ ID NO: 8276907 - DNA, 22 bp, Homo sapiens
actgtcagggatcatgaaagct

SEQ ID NO: 8276908 - DNA, 19 bp, Homo sapiens
actgtcacataaaggaagg

SEQ ID NO: 8276909 - DNA, 22 bp, Homo sapiens
actgtagagaatctgagaaaaa

SEQ ID NO: 8276910 - DNA, 22 bp, Homo sapiens
actgggaaatgaagtctggtgg

SEQ ID NO: 8276911 - DNA, 22 bp, Homo sapiens
actgggaacctgtgctaggagg

SEQ ID NO: 8276912 - DNA, 22 bp, Homo sapiens
actgggaacaaggtgctcagcg

SEQ ID NO: 8276913 - DNA, 22 bp, Homo sapiens
actgggaaagtgctgcctgcag

SEQ ID NO: 8276914 - DNA, 22 bp, Homo sapiens
actgggaagctgttttgctttt

SEQ ID NO: 8276915 - DNA, 22 bp, Homo sapiens
actgggaagagagaattctgtc

SEQ ID NO: 8276916 - DNA, 22 bp, Homo sapiens
actgggaatctcaggaacatgg

SEQ ID NO: 8276917 - DNA, 22 bp, Homo sapiens
actgggaatggagcctgggcct

SEQ ID NO: 8276918 - DNA, 22 bp, Homo sapiens
ataatgaatgcagagttatttt

SEQ ID NO: 8276919 - DNA, 22 bp, Homo sapiens
ataaaatttgctactgttaaat

SEQ ID NO: 8276920 - DNA, 22 bp, Homo sapiens
agaaagggttctctgaggtgct

SEQ ID NO: 8276921 - DNA, 22 bp, Homo sapiens
agaaagtacagatgagacactt

SEQ ID NO: 8276922 - DNA, 22 bp, Homo sapiens
agaacagatgtgggcagacctg

SEQ ID NO: 8276923 - DNA, 22 bp, Homo sapiens
atctaaaaggagctctttatct

SEQ ID NO: 8276924 - DNA, 22 bp, Homo sapiens
atcgtattacctttgggattag

SEQ ID NO: 8276925 - DNA, 22 bp, Homo sapiens
atctaaagtgtcataagtagct

SEQ ID NO: 8276926 - DNA, 22 bp, Homo sapiens
atctaacactgtaaactgtctt

SEQ ID NO: 8276927 - DNA, 21 bp, Homo sapiens
atctcacagcccagagaagcc

SEQ ID NO: 8276928 - DNA, 22 bp, Homo sapiens
atcatctgtcccaaataagaga

SEQ ID NO: 8276929 - DNA, 22 bp, Homo sapiens
agaacaggaggaagccagctcc

SEQ ID NO: 8276930 - DNA, 22 bp, Homo sapiens
agaacaggcagttggttggatt

SEQ ID NO: 8276931 - DNA, 20 bp, Homo sapiens
atcggcttgcctggaaacaa

SEQ ID NO: 8276932 - DNA, 22 bp, Homo sapiens
atattccagttatatcaaatca

SEQ ID NO: 8276933 - DNA, 22 bp, Homo sapiens
atattctagccaaagtgtgagc

SEQ ID NO: 8276934 - DNA, 22 bp, Homo sapiens
atattctataagcagttggaag

SEQ ID NO: 8276935 - DNA, 22 bp, Homo sapiens
atattcatcgtgtagaaatact

SEQ ID NO: 8276936 - DNA, 21 bp, Homo sapiens
agaaaagtatttgaatcaaga

SEQ ID NO: 8276937 - DNA, 22 bp, Homo sapiens
atattcttatccttttctctgt

SEQ ID NO: 8276938 - DNA, 21 bp, Homo sapiens
atatttctcataaggttatgg

SEQ ID NO: 8276939 - DNA, 22 bp, Homo sapiens
actttccacaccattttgtggt

SEQ ID NO: 8276940 - DNA, 22 bp, Homo sapiens
actttcaatttgcactaaccta

SEQ ID NO: 8276941 - DNA, 22 bp, Homo sapiens
atatggaatggtaatctacaat

SEQ ID NO: 8276942 - DNA, 22 bp, Homo sapiens
atatggatgagataatgagcca

SEQ ID NO: 8276943 - DNA, 19 bp, Homo sapiens
actttctccaggacctgtt

SEQ ID NO: 8276944 - DNA, 22 bp, Homo sapiens
agtgtattagcaagctctccag

SEQ ID NO: 8276945 - DNA, 22 bp, Homo sapiens
actggaattggaatctggagct

SEQ ID NO: 8276946 - DNA, 22 bp, Homo sapiens
actggaaaaccactgaaatgag

SEQ ID NO: 8276947 - DNA, 22 bp, Homo sapiens
actggaaaggctctgaatggga

SEQ ID NO: 8276948 - DNA, 22 bp, Homo sapiens
actggaaatgagatgatatcag

SEQ ID NO: 8276949 - DNA, 21 bp, Homo sapiens
actggcttggctctggctgaa

SEQ ID NO: 8276950 - DNA, 18 bp, Homo sapiens
actggctttagcatcaga

SEQ ID NO: 8276951 - DNA, 22 bp, Homo sapiens
actggctttgagggaatagcta

SEQ ID NO: 8276952 - DNA, 21 bp, Homo sapiens
actggcttgtatttggtaagc

SEQ ID NO: 8276953 - DNA, 22 bp, Homo sapiens
actggcttgtgagacaatgcct

SEQ ID NO: 8276954 - DNA, 22 bp, Homo sapiens
actggctttgcctctgcctctc

SEQ ID NO: 8276955 - DNA, 23 bp, Homo sapiens
actggctttgatccagatagatt

SEQ ID NO: 8276956 - DNA, 22 bp, Homo sapiens
actggctttgggttgccgcaga

SEQ ID NO: 8276957 - DNA, 22 bp, Homo sapiens
actgggaaaaactgctttgagg

SEQ ID NO: 8276958 - DNA, 22 bp, Homo sapiens
actggctttggcttcagatgag

SEQ ID NO: 8276959 - DNA, 22 bp, Homo sapiens
agtgtacaagaccttattgttg

SEQ ID NO: 8276960 - DNA, 22 bp, Homo sapiens
agtgtacagtttgtagtactac

SEQ ID NO: 8276961 - DNA, 22 bp, Homo sapiens
actgcagaggtggggtgcagag

SEQ ID NO: 8276962 - DNA, 22 bp, Homo sapiens
actgaggggttggagagtgagg

SEQ ID NO: 8276963 - DNA, 21 bp, Homo sapiens
actgagggccagagaggacct

SEQ ID NO: 8276964 - DNA, 22 bp, Homo sapiens
actgaggggctttcaggcccag

SEQ ID NO: 8276965 - DNA, 22 bp, Homo sapiens
agtcttggctatgcatagagct

SEQ ID NO: 8276966 - DNA, 22 bp, Homo sapiens
actctgtacgcaagagatggag

SEQ ID NO: 8276967 - DNA, 22 bp, Homo sapiens
actctgtactctagaggaagtg

SEQ ID NO: 8276968 - DNA, 22 bp, Homo sapiens
agtctgtcattaaacttcccaa

SEQ ID NO: 8276969 - DNA, 22 bp, Homo sapiens
agtcttctgtttttcagcagct

SEQ ID NO: 8276970 - DNA, 22 bp, Homo sapiens
agtcttgctcttgcatctgctt

SEQ ID NO: 8276971 - DNA, 22 bp, Homo sapiens
agtcccatgccaaatgcatcct

SEQ ID NO: 8276972 - DNA, 22 bp, Homo sapiens
agtcccatgaggaatggggacg

SEQ ID NO: 8276973 - DNA, 18 bp, Homo sapiens
agtcccatcttcagctct

SEQ ID NO: 8276974 - DNA, 21 bp, Homo sapiens
agtcccatccggtaagcaagc

SEQ ID NO: 8276975 - DNA, 22 bp, Homo sapiens
agtcccatcagatgatatgaga

SEQ ID NO: 8276976 - DNA, 22 bp, Homo sapiens
agtcccatatccgggttcaggg

SEQ ID NO: 8276977 - DNA, 21 bp, Homo sapiens
agtcccaggggtgagtgatgt

SEQ ID NO: 8276978 - DNA, 19 bp, Homo sapiens
agtcccaggcccgaaagag

SEQ ID NO: 8276979 - DNA, 22 bp, Homo sapiens
actctgtgtttagtgctgccat

SEQ ID NO: 8276980 - DNA, 22 bp, Homo sapiens
actctgtgtgagtagagcctgt

SEQ ID NO: 8276981 - DNA, 22 bp, Homo sapiens
actctgtgccaggcactttggg

SEQ ID NO: 8276982 - DNA, 22 bp, Homo sapiens
actctgtgggtgagcctggaca

SEQ ID NO: 8276983 - DNA, 22 bp, Homo sapiens
actctgtagatgtggaaatgcg

SEQ ID NO: 8276984 - DNA, 22 bp, Homo sapiens
actctgtagatgtggaaatgcg

SEQ ID NO: 8276985 - DNA, 20 bp, Homo sapiens
actctgtaggtaatgagact

SEQ ID NO: 8276986 - DNA, 22 bp, Homo sapiens
agtgcagtaaatgggcattatg

SEQ ID NO: 8276987 - DNA, 22 bp, Homo sapiens
agtgcatgtatctacagtcaca

SEQ ID NO: 8276988 - DNA, 22 bp, Homo sapiens
agtgcatgaaagcatacaaggc

SEQ ID NO: 8276989 - DNA, 22 bp, Homo sapiens
agtgcatacccttctaaaaagt

SEQ ID NO: 8276990 - DNA, 22 bp, Homo sapiens
aggtggctcctcccatggctgg

SEQ ID NO: 8276991 - DNA, 22 bp, Homo sapiens
aggtcctgtcttatctctgtaa

SEQ ID NO: 8276992 - DNA, 22 bp, Homo sapiens
aggtctcaagagaaaagtggtg

SEQ ID NO: 8276993 - DNA, 22 bp, Homo sapiens
aggtctctgagtactgctggac

SEQ ID NO: 8276994 - DNA, 22 bp, Homo sapiens
acctggagtcatttgaggagta

SEQ ID NO: 8276995 - DNA, 22 bp, Homo sapiens
acctcctccaaggagccatagg

SEQ ID NO: 8276996 - DNA, 22 bp, Homo sapiens
accctccaggctgcagctcctg

SEQ ID NO: 8276997 - DNA, 20 bp, Homo sapiens
accctctgaatagtatctgg

SEQ ID NO: 8276998 - DNA, 22 bp, Homo sapiens
agtaaacactaaaatgactgcg

SEQ ID NO: 8276999 - DNA, 22 bp, Homo sapiens
agtaaacaatgtatgaggacag

SEQ ID NO: 8277000 - DNA, 22 bp, Homo sapiens
acgcctgtaatcccagcacttt

SEQ ID NO: 8277001 - DNA, 22 bp, Homo sapiens
acgcctgtaatcccagcacttt

SEQ ID NO: 8277002 - DNA, 22 bp, Homo sapiens
acgcctgtaatcccagcacttt

SEQ ID NO: 8277003 - DNA, 22 bp, Homo sapiens
acgctgtccggccactgctgca

SEQ ID NO: 8277004 - DNA, 22 bp, Homo sapiens
acgcggtgcggcaagttcatgg

SEQ ID NO: 8277005 - DNA, 17 bp, Homo sapiens
acggaacagagggtgcc

SEQ ID NO: 8277006 - DNA, 22 bp, Homo sapiens
actcagcttgcacacatcaatg

SEQ ID NO: 8277007 - DNA, 23 bp, Homo sapiens
actcagctttgggagatgactca

SEQ ID NO: 8277008 - DNA, 22 bp, Homo sapiens
agtcaaagatgaccgagttcct

SEQ ID NO: 8277009 - DNA, 22 bp, Homo sapiens
agtatttgttgattgatatgaa

SEQ ID NO: 8277010 - DNA, 22 bp, Homo sapiens
aggaagaacagataatggacgc

SEQ ID NO: 8277011 - DNA, 22 bp, Homo sapiens
aggaagaaatgtgacttcaaac

SEQ ID NO: 8277012 - DNA, 22 bp, Homo sapiens
acagggagatgggtgaaagcgg

SEQ ID NO: 8277013 - DNA, 22 bp, Homo sapiens
aggaagaaactgagctctgaca

SEQ ID NO: 8277014 - DNA, 22 bp, Homo sapiens
aggaagaatgtttacatatcaa

SEQ ID NO: 8277015 - DNA, 22 bp, Homo sapiens
acagggcttttaatcagtagtt

SEQ ID NO: 8277016 - DNA, 22 bp, Homo sapiens
acagggagatatcttcaatatc

SEQ ID NO: 8277017 - DNA, 22 bp, Homo sapiens
acaggcaggcttcggccagagc

SEQ ID NO: 8277018 - DNA, 22 bp, Homo sapiens
acaggcagccctctccctggtt

SEQ ID NO: 8277019 - DNA, 22 bp, Homo sapiens
acagctggtgaatgttctctgt

SEQ ID NO: 8277020 - DNA, 22 bp, Homo sapiens
acagctgggtgctgctcagagc

SEQ ID NO: 8277021 - DNA, 21 bp, Homo sapiens
acagctgcctgccatgggggt

SEQ ID NO: 8277022 - DNA, 22 bp, Homo sapiens
acagctgctcacctgtgagccc

SEQ ID NO: 8277023 - DNA, 22 bp, Homo sapiens
agctgaagcactgggatggaag

SEQ ID NO: 8277024 - DNA, 22 bp, Homo sapiens
agctgaagcagtcagttcagct

SEQ ID NO: 8277025 - DNA, 22 bp, Homo sapiens
agctctggtactgctgaccgaa

SEQ ID NO: 8277026 - DNA, 22 bp, Homo sapiens
agctctggggtggagcccagga

SEQ ID NO: 8277027 - DNA, 22 bp, Homo sapiens
agctctgggtcacggctgccga

SEQ ID NO: 8277028 - DNA, 22 bp, Homo sapiens
agctgactcactcactcacaat

SEQ ID NO: 8277029 - DNA, 22 bp, Homo sapiens
agctgaagttcagtccagagaa

SEQ ID NO: 8277030 - DNA, 22 bp, Homo sapiens
agctgaagttcagtccagagaa

SEQ ID NO: 8277031 - DNA, 22 bp, Homo sapiens
agctgaagtcctcgcggtgcta

SEQ ID NO: 8277032 - DNA, 22 bp, Homo sapiens
agctgaatctcaggcatccttt

SEQ ID NO: 8277033 - DNA, 23 bp, Homo sapiens
acaggaggggacaggtggccgtg

SEQ ID NO: 8277034 - DNA, 22 bp, Homo sapiens
acaggaggggcatgaaagacgg

SEQ ID NO: 8277035 - DNA, 21 bp, Homo sapiens
acaggcaccatgcctgtgcct

SEQ ID NO: 8277036 - DNA, 22 bp, Homo sapiens
acagtgggatgaggctggcccc

SEQ ID NO: 8277037 - DNA, 22 bp, Homo sapiens
acagtctgcctctcagagcagc

SEQ ID NO: 8277038 - DNA, 22 bp, Homo sapiens
acagtgggacagtgacggggga

SEQ ID NO: 8277039 - DNA, 22 bp, Homo sapiens
acagtgtggtttgagcactggg

SEQ ID NO: 8277040 - DNA, 23 bp, Homo sapiens
acagtgtggtggacaaggagcag

SEQ ID NO: 8277041 - DNA, 22 bp, Homo sapiens
acagtacagctaatgtcattag

SEQ ID NO: 8277042 - DNA, 22 bp, Homo sapiens
aggagcagaatttaatgtgcag

SEQ ID NO: 8277043 - DNA, 22 bp, Homo sapiens
aggagcactgagccagcatggg

SEQ ID NO: 8277044 - DNA, 22 bp, Homo sapiens
aggagattgtactgtcatcact

SEQ ID NO: 8277045 - DNA, 22 bp, Homo sapiens
aggatgaggctggcaggtcttg

SEQ ID NO: 8277046 - DNA, 22 bp, Homo sapiens
acatagaaggaggctggcagct

SEQ ID NO: 8277047 - DNA, 22 bp, Homo sapiens
acatagaacttcccagtgagca

SEQ ID NO: 8277048 - DNA, 21 bp, Homo sapiens
acatacattatctttttaaaa

SEQ ID NO: 8277049 - DNA, 22 bp, Homo sapiens
aggcagctggaaaactccaggc

SEQ ID NO: 8277050 - DNA, 22 bp, Homo sapiens
aggcagctggaaaactccaggc

SEQ ID NO: 8277051 - DNA, 21 bp, Homo sapiens
aggcagctcaggcccagagag

SEQ ID NO: 8277052 - DNA, 22 bp, Homo sapiens
acatatttccatgcagcatgtc

SEQ ID NO: 8277053 - DNA, 22 bp, Homo sapiens
acatattgagctctaaaagtac

SEQ ID NO: 8277054 - DNA, 22 bp, Homo sapiens
aggctctggctactacagagct

SEQ ID NO: 8277055 - DNA, 22 bp, Homo sapiens
aggctctttccactctggtgca

SEQ ID NO: 8277056 - DNA, 22 bp, Homo sapiens
aggctctttgagactacctgga

SEQ ID NO: 8277057 - DNA, 22 bp, Homo sapiens
acattgtagttgttctgcagca

SEQ ID NO: 8277058 - DNA, 22 bp, Homo sapiens
acattgtactcttagcgttgtt

SEQ ID NO: 8277059 - DNA, 22 bp, Homo sapiens
acatttgaaatgccatgtgagg

SEQ ID NO: 8277060 - DNA, 22 bp, Homo sapiens
acatcagtaactgtaaaacagg

SEQ ID NO: 8277061 - DNA, 22 bp, Homo sapiens
acatcagtaattaagtctcaag

SEQ ID NO: 8277062 - DNA, 22 bp, Homo sapiens
acatcagtgctcttggttcttg

SEQ ID NO: 8277063 - DNA, 22 bp, Homo sapiens
acatcagtccaccactgcagtt

SEQ ID NO: 8277064 - DNA, 18 bp, Homo sapiens
acatcagttaccaggcca

SEQ ID NO: 8277065 - DNA, 22 bp, Homo sapiens
acatcagtcttttgcatacata

SEQ ID NO: 8277066 - DNA, 22 bp, Homo sapiens
acatgctggatgaattacctac

SEQ ID NO: 8277067 - DNA, 22 bp, Homo sapiens
acatgttagggacagagtatgt

SEQ ID NO: 8277068 - DNA, 22 bp, Homo sapiens
acatgttcatgcatgcacaggt

SEQ ID NO: 8277069 - DNA, 22 bp, Homo sapiens
acatgtttaagtttaatgaaaa

SEQ ID NO: 8277070 - DNA, 22 bp, Homo sapiens
acatgtttaagtttaatgaaaa

SEQ ID NO: 8277071 - DNA, 22 bp, Homo sapiens
acatgtttggctctatgctata

SEQ ID NO: 8277072 - DNA, 22 bp, Homo sapiens
acatgtttgataaatatttggg

SEQ ID NO: 8277073 - DNA, 22 bp, Homo sapiens
acatgtttgcctgcaggcttag

SEQ ID NO: 8277074 - DNA, 19 bp, Homo sapiens
acatgttttgcagaacagc

SEQ ID NO: 8277075 - DNA, 19 bp, Homo sapiens
acatgttttgcagaacagc

SEQ ID NO: 8277076 - DNA, 22 bp, Homo sapiens
acatgtttaagtttaatgaaaa

SEQ ID NO: 8277077 - DNA, 22 bp, Homo sapiens
acatgtttacattaggtgatat

SEQ ID NO: 8277078 - DNA, 22 bp, Homo sapiens
acatgtttaagtttgttatatg

SEQ ID NO: 8277079 - DNA, 20 bp, Homo sapiens
aggcctcttcatgacagctg

SEQ ID NO: 8277080 - DNA, 22 bp, Homo sapiens
accagccagccacagtggctcc

SEQ ID NO: 8277081 - DNA, 22 bp, Homo sapiens
accagccaagactgcctggaat

SEQ ID NO: 8277082 - DNA, 22 bp, Homo sapiens
accagcaggccaggggcactgc

SEQ ID NO: 8277083 - DNA, 22 bp, Homo sapiens
accagcagggctgggccaatgg

SEQ ID NO: 8277084 - DNA, 22 bp, Homo sapiens
accagcagttatgaggccagga

SEQ ID NO: 8277085 - DNA, 22 bp, Homo sapiens
accagcaggtggcagtatgtat

SEQ ID NO: 8277086 - DNA, 22 bp, Homo sapiens
accagcagctgccagagtggag

SEQ ID NO: 8277087 - DNA, 21 bp, Homo sapiens
accagcaggagatcagaagga

SEQ ID NO: 8277088 - DNA, 22 bp, Homo sapiens
accagcagctgcgggccactgc

SEQ ID NO: 8277089 - DNA, 22 bp, Homo sapiens
accagcagcctagagcgttctt

SEQ ID NO: 8277090 - DNA, 22 bp, Homo sapiens
accagcagagttgaggaggaca

SEQ ID NO: 8277091 - DNA, 22 bp, Homo sapiens
agggagacaaaagcagctgcca

SEQ ID NO: 8277092 - DNA, 22 bp, Homo sapiens
agggagacacatgaggaagtca

SEQ ID NO: 8277093 - DNA, 22 bp, Homo sapiens
aggctttaattatctacaggag

SEQ ID NO: 8277094 - DNA, 22 bp, Homo sapiens
aggctttacgtcttcccctggg

SEQ ID NO: 8277095 - DNA, 21 bp, Homo sapiens
aggctttacctctgggtaggt

SEQ ID NO: 8277096 - DNA, 22 bp, Homo sapiens
aggctttaagtggcctacagct

SEQ ID NO: 8277097 - DNA, 23 bp, Homo sapiens
aggctttaatctgatattcagat

SEQ ID NO: 8277098 - DNA, 22 bp, Homo sapiens
aggctttaagcaagcatattgt

SEQ ID NO: 8277099 - DNA, 19 bp, Homo sapiens
aggcttggttgcagcaagc

SEQ ID NO: 8277100 - DNA, 22 bp, Homo sapiens
agggcacttgaggctgggcctg

SEQ ID NO: 8277101 - DNA, 22 bp, Homo sapiens
agggcacttcctctgggtccct

SEQ ID NO: 8277102 - DNA, 22 bp, Homo sapiens
agggcacttcagtcagactgag

SEQ ID NO: 8277103 - DNA, 22 bp, Homo sapiens
accagctcagagcaggctcctg

SEQ ID NO: 8277104 - DNA, 22 bp, Homo sapiens
accagccctcaggtcagatact

SEQ ID NO: 8277105 - DNA, 22 bp, Homo sapiens
acccagccacagcattgaggga

SEQ ID NO: 8277106 - DNA, 22 bp, Homo sapiens
acccagcctacaaagctcacct

SEQ ID NO: 8277107 - DNA, 22 bp, Homo sapiens
acccaggagacggaggtgcagt

SEQ ID NO: 8277108 - DNA, 22 bp, Homo sapiens
acccaggagacaggttgcagtg

SEQ ID NO: 8277109 - DNA, 22 bp, Homo sapiens
acccaggagacaggttgcagtg

SEQ ID NO: 8277110 - DNA, 22 bp, Homo sapiens
agggctgcccagtgtgagagct

SEQ ID NO: 8277111 - DNA, 22 bp, Homo sapiens
agggctgcccagtgtgagagct

SEQ ID NO: 8277112 - DNA, 22 bp, Homo sapiens
acccaggacacagagatgaccc

SEQ ID NO: 8277113 - DNA, 22 bp, Homo sapiens
acccagctggatgcatggaggc

SEQ ID NO: 8277114 - DNA, 22 bp, Homo sapiens
agggggcaggagagacctgctg

SEQ ID NO: 8277115 - DNA, 22 bp, Homo sapiens
agggggcattatgaggcttttc

SEQ ID NO: 8277116 - DNA, 22 bp, Homo sapiens
caagagcatttagttagctggt

SEQ ID NO: 8277117 - DNA, 17 bp, Homo sapiens
caagagagatgactgga

SEQ ID NO: 8277118 - DNA, 20 bp, Homo sapiens
agcagcagatgttggaggtg

SEQ ID NO: 8277119 - DNA, 22 bp, Homo sapiens
agcagcaggctgggatgagtct

SEQ ID NO: 8277120 - DNA, 22 bp, Homo sapiens
agcagcaggctgtgtggactga

SEQ ID NO: 8277121 - DNA, 22 bp, Homo sapiens
agcagcaggctagggaactgct

SEQ ID NO: 8277122 - DNA, 22 bp, Homo sapiens
agcagccaattggaggatgaag

SEQ ID NO: 8277123 - DNA, 22 bp, Homo sapiens
agcagccacccagctgctcatt

SEQ ID NO: 8277124 - DNA, 22 bp, Homo sapiens
cacaaggaggtcctgaggaagc

SEQ ID NO: 8277125 - DNA, 22 bp, Homo sapiens
cacaaggactggatggagtggg

SEQ ID NO: 8277126 - DNA, 22 bp, Homo sapiens
cacaaggaggtcctgaggaagc

SEQ ID NO: 8277127 - DNA, 22 bp, Homo sapiens
cacaaggacctcagatggatga

SEQ ID NO: 8277128 - DNA, 20 bp, Homo sapiens
cacaagagaatacacactgg

SEQ ID NO: 8277129 - DNA, 22 bp, Homo sapiens
caattttttccatgctcttaca

SEQ ID NO: 8277130 - DNA, 21 bp, Homo sapiens
agcagcagggaagcctcatcc

SEQ ID NO: 8277131 - DNA, 21 bp, Homo sapiens
agcagcagggaagcctcatcc

SEQ ID NO: 8277132 - DNA, 22 bp, Homo sapiens
agcagcaggcttaaggaaaagt

SEQ ID NO: 8277133 - DNA, 22 bp, Homo sapiens
agcagcagggtcattgctcttt

SEQ ID NO: 8277134 - DNA, 22 bp, Homo sapiens
agcacatttaagtatgaaatat

SEQ ID NO: 8277135 - DNA, 22 bp, Homo sapiens
agcacattcccacctgtacttc

SEQ ID NO: 8277136 - DNA, 22 bp, Homo sapiens
agcaccagcgtgggggccgttg

SEQ ID NO: 8277137 - DNA, 22 bp, Homo sapiens
agcaccagcaactatgggctgc

SEQ ID NO: 8277138 - DNA, 22 bp, Homo sapiens
agcaccaggaaagaaggggcca

SEQ ID NO: 8277139 - DNA, 22 bp, Homo sapiens
agcaccagctcaaggtgcacct

SEQ ID NO: 8277140 - DNA, 22 bp, Homo sapiens
agcaccaggccatggggtccct

SEQ ID NO: 8277141 - DNA, 22 bp, Homo sapiens
caacagaaggtgtactactgaa

SEQ ID NO: 8277142 - DNA, 22 bp, Homo sapiens
caaatagtttttcatgtattat

SEQ ID NO: 8277143 - DNA, 22 bp, Homo sapiens
caaatagtgtcacattgtgagg

SEQ ID NO: 8277144 - DNA, 22 bp, Homo sapiens
caaattaccctcaacatctaga

SEQ ID NO: 8277145 - DNA, 22 bp, Homo sapiens
caacagaaatcaattttcccat

SEQ ID NO: 8277146 - DNA, 22 bp, Homo sapiens
agcacaggtgaaacagtcaggt

SEQ ID NO: 8277147 - DNA, 21 bp, Homo sapiens
agcaggcaaaggtgaagtctt

SEQ ID NO: 8277148 - DNA, 22 bp, Homo sapiens
agcagctgcagggagggtctgc

SEQ ID NO: 8277149 - DNA, 22 bp, Homo sapiens
agcagctgcagagggctccccc

SEQ ID NO: 8277150 - DNA, 22 bp, Homo sapiens
agcagctgccactggaatagga

SEQ ID NO: 8277151 - DNA, 21 bp, Homo sapiens
agcagctgcagtttctatctg

SEQ ID NO: 8277152 - DNA, 22 bp, Homo sapiens
cacacaattatgtgtgcacaat

SEQ ID NO: 8277153 - DNA, 22 bp, Homo sapiens
agcagctgctccacttgcttaa

SEQ ID NO: 8277154 - DNA, 22 bp, Homo sapiens
cacagtttctataggtcagaat

SEQ ID NO: 8277155 - DNA, 22 bp, Homo sapiens
agcaggctccaggctggccatc

SEQ ID NO: 8277156 - DNA, 17 bp, Homo sapiens
agcaggctgcagaggcc

SEQ ID NO: 8277157 - DNA, 22 bp, Homo sapiens
agcaggctgatgggcatgcttg

SEQ ID NO: 8277158 - DNA, 22 bp, Homo sapiens
agcaggcaggaggctactaagg

SEQ ID NO: 8277159 - DNA, 22 bp, Homo sapiens
cacagttaagggatgtcatgtt

SEQ ID NO: 8277160 - DNA, 22 bp, Homo sapiens
agcaggcagcatgggaccctcc

SEQ ID NO: 8277161 - DNA, 17 bp, Homo sapiens
agcaggcacgtcagcac

SEQ ID NO: 8277162 - DNA, 22 bp, Homo sapiens
agcatacaccctaaactgctta

SEQ ID NO: 8277163 - DNA, 22 bp, Homo sapiens
agcatacattggtatgtggttt

SEQ ID NO: 8277164 - DNA, 20 bp, Homo sapiens
agcatacatcataagaaacc

SEQ ID NO: 8277165 - DNA, 22 bp, Homo sapiens
agcatacaggtctgaaacagct

SEQ ID NO: 8277166 - DNA, 22 bp, Homo sapiens
cactgctattattagacaatgt

SEQ ID NO: 8277167 - DNA, 22 bp, Homo sapiens
cactgctagtctgaagtactgg

SEQ ID NO: 8277168 - DNA, 23 bp, Homo sapiens
agcaggctgcttctccacagctg

SEQ ID NO: 8277169 - DNA, 22 bp, Homo sapiens
agcagggctttgtctctgtgaa

SEQ ID NO: 8277170 - DNA, 22 bp, Homo sapiens
agcaggggctcctccacagcca

SEQ ID NO: 8277171 - DNA, 22 bp, Homo sapiens
agcagggggccacagtcacagc

SEQ ID NO: 8277172 - DNA, 22 bp, Homo sapiens
agcaggggtggaaggtagcttt

SEQ ID NO: 8277173 - DNA, 22 bp, Homo sapiens
agcaggggtctctgctaatgaa

SEQ ID NO: 8277174 - DNA, 22 bp, Homo sapiens
agcagggttccaggagttgcag

SEQ ID NO: 8277175 - DNA, 22 bp, Homo sapiens
agcagggttctcagttggtgct

SEQ ID NO: 8277176 - DNA, 22 bp, Homo sapiens
agcagggtatgttagagctgta

SEQ ID NO: 8277177 - DNA, 22 bp, Homo sapiens
cacccaggctggagagcagtgg

SEQ ID NO: 8277178 - DNA, 22 bp, Homo sapiens
agcagggtttggggattggcac

SEQ ID NO: 8277179 - DNA, 22 bp, Homo sapiens
cagaaggagggggcaagccctg

SEQ ID NO: 8277180 - DNA, 22 bp, Homo sapiens
cagaaatatttattgagtgaca

SEQ ID NO: 8277181 - DNA, 22 bp, Homo sapiens
agccactggcctgggcagctct

SEQ ID NO: 8277182 - DNA, 22 bp, Homo sapiens
cagaaatatcacctggactcta

SEQ ID NO: 8277183 - DNA, 22 bp, Homo sapiens
agccaccttctccaaggcctag

SEQ ID NO: 8277184 - DNA, 20 bp, Homo sapiens
agccacctcatttccctacc

SEQ ID NO: 8277185 - DNA, 16 bp, Homo sapiens
agccacctcagaggac

SEQ ID NO: 8277186 - DNA, 22 bp, Homo sapiens
agccactttactttcatatttt

SEQ ID NO: 8277187 - DNA, 22 bp, Homo sapiens
agccactgtgagaggaccaggg

SEQ ID NO: 8277188 - DNA, 22 bp, Homo sapiens
agccagagagccccaggttcta

SEQ ID NO: 8277189 - DNA, 22 bp, Homo sapiens
agccagagactttacctgtgca

SEQ ID NO: 8277190 - DNA, 22 bp, Homo sapiens
agccagagagtgttggagatgt

SEQ ID NO: 8277191 - DNA, 22 bp, Homo sapiens
cagacagggttttggtctttgg

SEQ ID NO: 8277192 - DNA, 22 bp, Homo sapiens
agccagagactgtgtctgtaat

SEQ ID NO: 8277193 - DNA, 22 bp, Homo sapiens
cagacagtttatcctaaataac

SEQ ID NO: 8277194 - DNA, 22 bp, Homo sapiens
cagacagtgttagagtcaagct

SEQ ID NO: 8277195 - DNA, 23 bp, Homo sapiens
agcccagcagagaacctaggtcc

SEQ ID NO: 8277196 - DNA, 22 bp, Homo sapiens
agcccagcactgggggcccagc

SEQ ID NO: 8277197 - DNA, 22 bp, Homo sapiens
agcccagagacaatgctcagta

SEQ ID NO: 8277198 - DNA, 22 bp, Homo sapiens
cagagaaaaaatcctgctctca

SEQ ID NO: 8277199 - DNA, 22 bp, Homo sapiens
cagagaaaaaatcctgctctca

SEQ ID NO: 8277200 - DNA, 22 bp, Homo sapiens
agcccaagctatgaggtgacct

SEQ ID NO: 8277201 - DNA, 22 bp, Homo sapiens
agcccaagaagagctttcttgc

SEQ ID NO: 8277202 - DNA, 22 bp, Homo sapiens
agccatcatttctgtcactggc

SEQ ID NO: 8277203 - DNA, 22 bp, Homo sapiens
cagagggagccctccaggagca

SEQ ID NO: 8277204 - DNA, 22 bp, Homo sapiens
cagagggacagtgtaatgcata

SEQ ID NO: 8277205 - DNA, 22 bp, Homo sapiens
agcccagggaaccaggaagtgg

SEQ ID NO: 8277206 - DNA, 21 bp, Homo sapiens
cagaggcaggctctgtgtgtg

SEQ ID NO: 8277207 - DNA, 21 bp, Homo sapiens
cagaggcaggtcctgggacgg

SEQ ID NO: 8277208 - DNA, 22 bp, Homo sapiens
cagaggcagtggggttgctcct

SEQ ID NO: 8277209 - DNA, 22 bp, Homo sapiens
agcccaggcagagggatgcttg

SEQ ID NO: 8277210 - DNA, 22 bp, Homo sapiens
cagcagggcccccgggtgcgcc

SEQ ID NO: 8277211 - DNA, 22 bp, Homo sapiens
cagcaggggaactgtgggccag

SEQ ID NO: 8277212 - DNA, 22 bp, Homo sapiens
cagcagggctgtgctaccccat

SEQ ID NO: 8277213 - DNA, 22 bp, Homo sapiens
cagcagggcccccgggtgcgcc

SEQ ID NO: 8277214 - DNA, 22 bp, Homo sapiens
cagcaggatatggtggagagag

SEQ ID NO: 8277215 - DNA, 22 bp, Homo sapiens
cagcagggaagctgtgctgttt

SEQ ID NO: 8277216 - DNA, 22 bp, Homo sapiens
cagcagctgaggcgctggcgtg

SEQ ID NO: 8277217 - DNA, 22 bp, Homo sapiens
agcctcttccagctcctttcta

SEQ ID NO: 8277218 - DNA, 22 bp, Homo sapiens
cagcagctcaggctccttccca

SEQ ID NO: 8277219 - DNA, 22 bp, Homo sapiens
cagaggtgcatacaggtcatta

SEQ ID NO: 8277220 - DNA, 22 bp, Homo sapiens
cagagggcactcggagtgacat

SEQ ID NO: 8277221 - DNA, 22 bp, Homo sapiens
cagagggcactcggagtgacat

SEQ ID NO: 8277222 - DNA, 22 bp, Homo sapiens
agcctctgatggctcccaagga

SEQ ID NO: 8277223 - DNA, 22 bp, Homo sapiens
agcctctgcacgggcacgggtg

SEQ ID NO: 8277224 - DNA, 18 bp, Homo sapiens
agcctctggcagagagaa

SEQ ID NO: 8277225 - DNA, 22 bp, Homo sapiens
agcctctgctggccctggcact

SEQ ID NO: 8277226 - DNA, 22 bp, Homo sapiens
cagctcagtctggagagatgca

SEQ ID NO: 8277227 - DNA, 22 bp, Homo sapiens
cagctcaggctctccatgctcc

SEQ ID NO: 8277228 - DNA, 22 bp, Homo sapiens
cagctcaggcactggcgcggga

SEQ ID NO: 8277229 - DNA, 22 bp, Homo sapiens
cagctcaggcactggcgcggga

SEQ ID NO: 8277230 - DNA, 19 bp, Homo sapiens
cagctcaggactcagcccc

SEQ ID NO: 8277231 - DNA, 19 bp, Homo sapiens
cagctcaggactcagcccc

SEQ ID NO: 8277232 - DNA, 22 bp, Homo sapiens
cagctcaggaaggaaggccggc

SEQ ID NO: 8277233 - DNA, 22 bp, Homo sapiens
cagctaagaatgtctgagatca

SEQ ID NO: 8277234 - DNA, 22 bp, Homo sapiens
cagctaagccacactcagatgg

SEQ ID NO: 8277235 - DNA, 22 bp, Homo sapiens
cagctaagccacactcagatgg

SEQ ID NO: 8277236 - DNA, 22 bp, Homo sapiens
agctcaggcaactctgggcccc

SEQ ID NO: 8277237 - DNA, 21 bp, Homo sapiens
agctcagcaagatggaggctc

SEQ ID NO: 8277238 - DNA, 22 bp, Homo sapiens
agctcagccctcctgtgcagct

SEQ ID NO: 8277239 - DNA, 22 bp, Homo sapiens
cagctcagtgatgccttcacag

SEQ ID NO: 8277240 - DNA, 22 bp, Homo sapiens
cagctcagtcttgaagcactgg

SEQ ID NO: 8277241 - DNA, 22 bp, Homo sapiens
cagctcagtgatgccttcacag

SEQ ID NO: 8277242 - DNA, 22 bp, Homo sapiens
cagctcagtgatgccttcacag

SEQ ID NO: 8277243 - DNA, 22 bp, Homo sapiens
cagctcatgacctttgttatct

SEQ ID NO: 8277244 - DNA, 22 bp, Homo sapiens
cagcatcaacattctcagctct

SEQ ID NO: 8277245 - DNA, 22 bp, Homo sapiens
cagccctgagaaggaggatctc

SEQ ID NO: 8277246 - DNA, 22 bp, Homo sapiens
cagccctgagttagcccacgga

SEQ ID NO: 8277247 - DNA, 16 bp, Homo sapiens
cagccctgaggaagaa

SEQ ID NO: 8277248 - DNA, 22 bp, Homo sapiens
cagccctgcacgctgcctccgc

SEQ ID NO: 8277249 - DNA, 22 bp, Homo sapiens
cagccctgcagagggcgctcct

SEQ ID NO: 8277250 - DNA, 22 bp, Homo sapiens
cagcatactgcatcaaatgagg

SEQ ID NO: 8277251 - DNA, 22 bp, Homo sapiens
cagcagtgtggaagctgagggg

SEQ ID NO: 8277252 - DNA, 22 bp, Homo sapiens
cagcagggtatacagggaattt

SEQ ID NO: 8277253 - DNA, 22 bp, Homo sapiens
cagcagggtaggttgtatcagt

SEQ ID NO: 8277254 - DNA, 22 bp, Homo sapiens
cagcaggggaactgtgggccag

SEQ ID NO: 8277255 - DNA, 22 bp, Homo sapiens
cagcaggggaactgtgggccag

SEQ ID NO: 8277256 - DNA, 22 bp, Homo sapiens
cagcagggggcagcgcagatca

SEQ ID NO: 8277257 - DNA, 22 bp, Homo sapiens
cagcaggggtgtcattgtagtt

SEQ ID NO: 8277258 - DNA, 22 bp, Homo sapiens
cagcagggggcagcgcagatca

SEQ ID NO: 8277259 - DNA, 22 bp, Homo sapiens
cagcagggggcagcgcagatca

SEQ ID NO: 8277260 - DNA, 22 bp, Homo sapiens
agacagcatgatacatgatgct

SEQ ID NO: 8277261 - DNA, 22 bp, Homo sapiens
agacagcatgagcctgctgatg

SEQ ID NO: 8277262 - DNA, 22 bp, Homo sapiens
agacagcatgatacatgatgct

SEQ ID NO: 8277263 - DNA, 22 bp, Homo sapiens
agacagcagggagcaggattca

SEQ ID NO: 8277264 - DNA, 22 bp, Homo sapiens
agacaggatgcatactcttggt

SEQ ID NO: 8277265 - DNA, 22 bp, Homo sapiens
agacagctgggagtgtccttct

SEQ ID NO: 8277266 - DNA, 22 bp, Homo sapiens
atgcacatgtggctttatgtat

SEQ ID NO: 8277267 - DNA, 22 bp, Homo sapiens
atgcactgtaggtgccatctgc

SEQ ID NO: 8277268 - DNA, 22 bp, Homo sapiens
atgcactgtaagactagccatg

SEQ ID NO: 8277269 - DNA, 22 bp, Homo sapiens
atgcactgggccacagtatgac

SEQ ID NO: 8277270 - DNA, 22 bp, Homo sapiens
atgacaaaattcacaggtgtga

SEQ ID NO: 8277271 - DNA, 22 bp, Homo sapiens
atgaaactaaactacataagtt

SEQ ID NO: 8277272 - DNA, 22 bp, Homo sapiens
atgaaactctagctttcagcac

SEQ ID NO: 8277273 - DNA, 22 bp, Homo sapiens
agaagtgaggaaatcctcttta

SEQ ID NO: 8277274 - DNA, 22 bp, Homo sapiens
agaagtctattgatggcagtcc

SEQ ID NO: 8277275 - DNA, 22 bp, Homo sapiens
agacaaaccttgttttatgatg

SEQ ID NO: 8277276 - DNA, 23 bp, Homo sapiens
agacaaacttccttcactgcacc

SEQ ID NO: 8277277 - DNA, 23 bp, Homo sapiens
agacaaacttccttcactgcacc

SEQ ID NO: 8277278 - DNA, 22 bp, Homo sapiens
atgaacaatctggcaagaactt

SEQ ID NO: 8277279 - DNA, 22 bp, Homo sapiens
atgaacaatctggcaagaactt

SEQ ID NO: 8277280 - DNA, 22 bp, Homo sapiens
agacaaatggtaattatgtcta

SEQ ID NO: 8277281 - DNA, 22 bp, Homo sapiens
agacaaatgaacaaatatgtga

SEQ ID NO: 8277282 - DNA, 22 bp, Homo sapiens
agacaaataactttttatgtcc

SEQ ID NO: 8277283 - DNA, 22 bp, Homo sapiens
agacaaaggattaatgatgatg

SEQ ID NO: 8277284 - DNA, 22 bp, Homo sapiens
atgaaagatgatttaaagtact

SEQ ID NO: 8277285 - DNA, 22 bp, Homo sapiens
atgaaatttgctgctaagttcc

SEQ ID NO: 8277286 - DNA, 22 bp, Homo sapiens
atgaaattttaattatacctct

SEQ ID NO: 8277287 - DNA, 22 bp, Homo sapiens
atgaacaaaaacaaggcctgtt

SEQ ID NO: 8277288 - DNA, 22 bp, Homo sapiens
atgaaattgatcttgaactttt

SEQ ID NO: 8277289 - DNA, 22 bp, Homo sapiens
atgaaatttgaccaattattta

SEQ ID NO: 8277290 - DNA, 22 bp, Homo sapiens
agagaagagtcttgtcaaatta

SEQ ID NO: 8277291 - DNA, 22 bp, Homo sapiens
agagaagattcttatatgtctt

SEQ ID NO: 8277292 - DNA, 22 bp, Homo sapiens
agagacagggttttgtcgtgtt

SEQ ID NO: 8277293 - DNA, 22 bp, Homo sapiens
agagacatggagaggcaaagtt

SEQ ID NO: 8277294 - DNA, 23 bp, Homo sapiens
agagacatttggatacagaaaca

SEQ ID NO: 8277295 - DNA, 22 bp, Homo sapiens
agagagttgtatgtttctaaaa

SEQ ID NO: 8277296 - DNA, 22 bp, Homo sapiens
agacattttacattcttccatt

SEQ ID NO: 8277297 - DNA, 23 bp, Homo sapiens
agacccagagactggctctgctc

SEQ ID NO: 8277298 - DNA, 22 bp, Homo sapiens
atggccagcaagttcagaattt

SEQ ID NO: 8277299 - DNA, 22 bp, Homo sapiens
agagaagagcaatgataaattt

SEQ ID NO: 8277300 - DNA, 22 bp, Homo sapiens
atggccagggtggcactgtggt

SEQ ID NO: 8277301 - DNA, 22 bp, Homo sapiens
agagcagcctgtgatgatgcac

SEQ ID NO: 8277302 - DNA, 22 bp, Homo sapiens
agagccagaccattgccgtgca

SEQ ID NO: 8277303 - DNA, 22 bp, Homo sapiens
agagccagagacctgggttcac

SEQ ID NO: 8277304 - DNA, 22 bp, Homo sapiens
agagatggccttaggtgggaat

SEQ ID NO: 8277305 - DNA, 22 bp, Homo sapiens
agagatggatgttattatgggt

SEQ ID NO: 8277306 - DNA, 22 bp, Homo sapiens
agagatggagagcactggggct

SEQ ID NO: 8277307 - DNA, 22 bp, Homo sapiens
agagatgaatcttgagactctg

SEQ ID NO: 8277308 - DNA, 22 bp, Homo sapiens
atgtattttgccagactgtctc

SEQ ID NO: 8277309 - DNA, 22 bp, Homo sapiens
atgtattttaagatttgcctca

SEQ ID NO: 8277310 - DNA, 22 bp, Homo sapiens
atgtatttgcttgttatggatt

SEQ ID NO: 8277311 - DNA, 22 bp, Homo sapiens
agagcctgggcagctcctctgg

SEQ ID NO: 8277312 - DNA, 22 bp, Homo sapiens
atgtatttgcttgttatggatt

SEQ ID NO: 8277313 - DNA, 22 bp, Homo sapiens
atgtatttgcgtatggacatac

SEQ ID NO: 8277314 - DNA, 22 bp, Homo sapiens
agagcctgtacttttctgtgaa

SEQ ID NO: 8277315 - DNA, 22 bp, Homo sapiens
atttctcatcaagtgccaactc

SEQ ID NO: 8277316 - DNA, 22 bp, Homo sapiens
atttctcatctttgtgaatggt

SEQ ID NO: 8277317 - DNA, 22 bp, Homo sapiens
atttctcattttgcttcaaagg

SEQ ID NO: 8277318 - DNA, 22 bp, Homo sapiens
atttctcattaagatcttccaa

SEQ ID NO: 8277319 - DNA, 22 bp, Homo sapiens
atttctcatgtacaaaaacact

SEQ ID NO: 8277320 - DNA, 22 bp, Homo sapiens
atttcctgatctgtaaaatagc

SEQ ID NO: 8277321 - DNA, 22 bp, Homo sapiens
atttggcaacattaattgaatc

SEQ ID NO: 8277322 - DNA, 22 bp, Homo sapiens
atttggcagtataaattctggc

SEQ ID NO: 8277323 - DNA, 22 bp, Homo sapiens
atttggcacagcttttcctacc

SEQ ID NO: 8277324 - DNA, 20 bp, Homo sapiens
atttggcatagtttaagcaa

SEQ ID NO: 8277325 - DNA, 22 bp, Homo sapiens
atttggcatagagtatcattct

SEQ ID NO: 8277326 - DNA, 22 bp, Homo sapiens
attttaaccctcttatatatac

SEQ ID NO: 8277327 - DNA, 22 bp, Homo sapiens
caaaaaacacagatgtctgtgt

SEQ ID NO: 8277328 - DNA, 22 bp, Homo sapiens
agagttcttgccctagaaaatg

SEQ ID NO: 8277329 - DNA, 20 bp, Homo sapiens
agagtgggtgtcacaggctg

SEQ ID NO: 8277330 - DNA, 22 bp, Homo sapiens
attgctgaatctaaggcttcca

SEQ ID NO: 8277331 - DNA, 21 bp, Homo sapiens
atttcacaccctcctttttct

SEQ ID NO: 8277332 - DNA, 22 bp, Homo sapiens
atttcacagctgctgttcaggt

SEQ ID NO: 8277333 - DNA, 22 bp, Homo sapiens
agagtttgaattttgaaaagat

SEQ ID NO: 8277334 - DNA, 20 bp, Homo sapiens
agatacagtttaattactct

SEQ ID NO: 8277335 - DNA, 22 bp, Homo sapiens
atttattgaagcttattacgtt

SEQ ID NO: 8277336 - DNA, 22 bp, Homo sapiens
atttcacagctgtcagtgttac

SEQ ID NO: 8277337 - DNA, 22 bp, Homo sapiens
agaggcctttctgttgagtgaa

SEQ ID NO: 8277338 - DNA, 22 bp, Homo sapiens
agaggcctgtgtgctccagtgg

SEQ ID NO: 8277339 - DNA, 22 bp, Homo sapiens
attcatttaggtattcacttac

SEQ ID NO: 8277340 - DNA, 22 bp, Homo sapiens
attcagtagaagttagctatta

SEQ ID NO: 8277341 - DNA, 22 bp, Homo sapiens
attcagtaggtgtgaacttatt

SEQ ID NO: 8277342 - DNA, 22 bp, Homo sapiens
attccagagaaaggcctggctg

SEQ ID NO: 8277343 - DNA, 22 bp, Homo sapiens
attccagaataccggcaagatg

SEQ ID NO: 8277344 - DNA, 22 bp, Homo sapiens
agagggaaaaactcatgtcatt

SEQ ID NO: 8277345 - DNA, 22 bp, Homo sapiens
attccagtccaaatgttttcct

SEQ ID NO: 8277346 - DNA, 22 bp, Homo sapiens
attccagttctcctctctaaag

SEQ ID NO: 8277347 - DNA, 22 bp, Homo sapiens
attccagttgggttctaataca

SEQ ID NO: 8277348 - DNA, 22 bp, Homo sapiens
agaggacaaaatgagaagtgct

SEQ ID NO: 8277349 - DNA, 22 bp, Homo sapiens
agaggacaaaatgagaagtgct

SEQ ID NO: 8277350 - DNA, 22 bp, Homo sapiens
agaggagcctcagtttgcagcc

SEQ ID NO: 8277351 - DNA, 22 bp, Homo sapiens
agaggaggaagagctttaaaat

SEQ ID NO: 8277352 - DNA, 22 bp, Homo sapiens
agaggaggcagcttaactcagt

SEQ ID NO: 8277353 - DNA, 22 bp, Homo sapiens
agaggaggcagcttaactcagt

SEQ ID NO: 8277354 - DNA, 22 bp, Homo sapiens
agaggaggatttgtaaaggtct

SEQ ID NO: 8277355 - DNA, 22 bp, Homo sapiens
agaggaggccaggcccacacct

SEQ ID NO: 8277356 - DNA, 22 bp, Homo sapiens
attataggcttgagccaccgtg

SEQ ID NO: 8277357 - DNA, 22 bp, Homo sapiens
agaggaggctctgggatcgtcc

SEQ ID NO: 8277358 - DNA, 23 bp, Homo sapiens
attattaaggacatggactttgt

SEQ ID NO: 8277359 - DNA, 21 bp, Homo sapiens
attattatttctgtgtccagc

SEQ ID NO: 8277360 - DNA, 22 bp, Homo sapiens
aaaggtgcctcttacaaggctt

SEQ ID NO: 8277361 - DNA, 22 bp, Homo sapiens
aaaggtgctactgtgttcctca

SEQ ID NO: 8277362 - DNA, 22 bp, Homo sapiens
aaaggtcttttttctaacacca

SEQ ID NO: 8277363 - DNA, 22 bp, Homo sapiens
aaacctgtggccactaaatttg

SEQ ID NO: 8277364 - DNA, 22 bp, Homo sapiens
aaacctttctgctctcagcgta

SEQ ID NO: 8277365 - DNA, 22 bp, Homo sapiens
aaacctttgcctggaagggagt

SEQ ID NO: 8277366 - DNA, 22 bp, Homo sapiens
aaacctttaccagactagcaag

SEQ ID NO: 8277367 - DNA, 22 bp, Homo sapiens
aaacctttctcagtgctaaaat

SEQ ID NO: 8277368 - DNA, 22 bp, Homo sapiens
aaacctttgtgtgtctgtgcct

SEQ ID NO: 8277369 - DNA, 22 bp, Homo sapiens
aaacctgtagcagtttgttaca

SEQ ID NO: 8277370 - DNA, 21 bp, Homo sapiens
aaagttcatgctttaatattc

SEQ ID NO: 8277371 - DNA, 22 bp, Homo sapiens
aaactagagatggcaggtggaa

SEQ ID NO: 8277372 - DNA, 22 bp, Homo sapiens
aaaccttttcagctgaatggag

SEQ ID NO: 8277373 - DNA, 22 bp, Homo sapiens
aaacagtggccaattctggaga

SEQ ID NO: 8277374 - DNA, 22 bp, Homo sapiens
aaaggtagtacttctagaaggg

SEQ ID NO: 8277375 - DNA, 19 bp, Homo sapiens
aaaggtagtaacctctgat

SEQ ID NO: 8277376 - DNA, 22 bp, Homo sapiens
aaacaatgtacatttataatgc

SEQ ID NO: 8277377 - DNA, 22 bp, Homo sapiens
aaacaatgtacacatgaatgtt

SEQ ID NO: 8277378 - DNA, 22 bp, Homo sapiens
aaacaatgtacatttataatgc

SEQ ID NO: 8277379 - DNA, 17 bp, Homo sapiens
aaacaatgcagacaagc

SEQ ID NO: 8277380 - DNA, 22 bp, Homo sapiens
aaacaatgagcttttacacact

SEQ ID NO: 8277381 - DNA, 22 bp, Homo sapiens
aaacaatgacaacacagctgcg

SEQ ID NO: 8277382 - DNA, 22 bp, Homo sapiens
aaacaatgttgctgggtgcggt

SEQ ID NO: 8277383 - DNA, 22 bp, Homo sapiens
aaacaatgttgtctccaagagg

SEQ ID NO: 8277384 - DNA, 22 bp, Homo sapiens
aaacaatgttcctatattagag

SEQ ID NO: 8277385 - DNA, 22 bp, Homo sapiens
aaacaatgtagattaccattta

SEQ ID NO: 8277386 - DNA, 23 bp, Homo sapiens
aaacaatgtcatcaggacttggt

SEQ ID NO: 8277387 - DNA, 22 bp, Homo sapiens
aaacaatgtctaaggtgcacag

SEQ ID NO: 8277388 - DNA, 22 bp, Homo sapiens
aaacagctgtcattgttttaaa

SEQ ID NO: 8277389 - DNA, 22 bp, Homo sapiens
aaagaatgtctgaacagctggc

SEQ ID NO: 8277390 - DNA, 22 bp, Homo sapiens
aaagaatagcctttgtccaaat

SEQ ID NO: 8277391 - DNA, 22 bp, Homo sapiens
aaagaatactccttttgccttg

SEQ ID NO: 8277392 - DNA, 22 bp, Homo sapiens
aaagaatagttaagtttagggc

SEQ ID NO: 8277393 - DNA, 22 bp, Homo sapiens
aaactgataaaataagtacatt

SEQ ID NO: 8277394 - DNA, 22 bp, Homo sapiens
aaagaataccctgggtcataaa

SEQ ID NO: 8277395 - DNA, 22 bp, Homo sapiens
aaactgaattcccaagggcatg

SEQ ID NO: 8277396 - DNA, 22 bp, Homo sapiens
aaactgaagtagattctgaaat

SEQ ID NO: 8277397 - DNA, 21 bp, Homo sapiens
aaactgaagagacaggaactt

SEQ ID NO: 8277398 - DNA, 22 bp, Homo sapiens
aaactgaggaatgacagcatta

SEQ ID NO: 8277399 - DNA, 22 bp, Homo sapiens
aaactgaaacatcatcatgttg

SEQ ID NO: 8277400 - DNA, 17 bp, Homo sapiens
aaactgaaaaattcact

SEQ ID NO: 8277401 - DNA, 22 bp, Homo sapiens
aaattacagatcaccaatgcat

SEQ ID NO: 8277402 - DNA, 22 bp, Homo sapiens
aaattaagggtgagaagagttg

SEQ ID NO: 8277403 - DNA, 22 bp, Homo sapiens
aaattaagggtgagaagagttg

SEQ ID NO: 8277404 - DNA, 22 bp, Homo sapiens
aaagagttgttgtataacagga

SEQ ID NO: 8277405 - DNA, 22 bp, Homo sapiens
aaatgcagcagctaattgaaaa

SEQ ID NO: 8277406 - DNA, 22 bp, Homo sapiens
aaacacatcattcatgtcgtca

SEQ ID NO: 8277407 - DNA, 22 bp, Homo sapiens
aaaaatctatgactgcttctcc

SEQ ID NO: 8277408 - DNA, 22 bp, Homo sapiens
aaaaatcacttttataggcagc

SEQ ID NO: 8277409 - DNA, 22 bp, Homo sapiens
aaaaatcacttttataggcagc

SEQ ID NO: 8277410 - DNA, 22 bp, Homo sapiens
aaaaatagaaggattgactgag

SEQ ID NO: 8277411 - DNA, 22 bp, Homo sapiens
aaaatgaataagttaacccagg

SEQ ID NO: 8277412 - DNA, 22 bp, Homo sapiens
aaacactttagaaagggacttg

SEQ ID NO: 8277413 - DNA, 22 bp, Homo sapiens
aaacagaagggtaggtaaacat

SEQ ID NO: 8277414 - DNA, 22 bp, Homo sapiens
aaacagaaatttcctcatgctc

SEQ ID NO: 8277415 - DNA, 22 bp, Homo sapiens
aaacacttcttaggtcttaagt

SEQ ID NO: 8277416 - DNA, 22 bp, Homo sapiens
aaacacttcctgtaacatgaca

SEQ ID NO: 8277417 - DNA, 22 bp, Homo sapiens
aaacagactgaagagttgaagc

SEQ ID NO: 8277418 - DNA, 22 bp, Homo sapiens
aaacagaagggtaggtaaacat

SEQ ID NO: 8277419 - DNA, 23 bp, Homo sapiens
aaaaaaccatgtaggcactcagt

SEQ ID NO: 8277420 - DNA, 22 bp, Homo sapiens
aaaaaattccattctgtgcctt

SEQ ID NO: 8277421 - DNA, 22 bp, Homo sapiens
aaaaacacaagtggcttggtct

SEQ ID NO: 8277422 - DNA, 22 bp, Homo sapiens
aaaaacacaagtggcttggtct

SEQ ID NO: 8277423 - DNA, 22 bp, Homo sapiens
aaaaacacaactgtctttctct

SEQ ID NO: 8277424 - DNA, 22 bp, Homo sapiens
aaaaacacaactgtctttctct

SEQ ID NO: 8277425 - DNA, 22 bp, Homo sapiens
aaaaacactgggctgggagtca

SEQ ID NO: 8277426 - DNA, 22 bp, Homo sapiens
aaaaacactgggctgggagtca

SEQ ID NO: 8277427 - DNA, 22 bp, Homo sapiens
aaaaacctttcccatactaaga

SEQ ID NO: 8277428 - DNA, 22 bp, Homo sapiens
aaaaaccattgtcttcagtctc

SEQ ID NO: 8277429 - DNA, 22 bp, Homo sapiens
aaaatgaacagaacaatgggga

SEQ ID NO: 8277430 - DNA, 22 bp, Homo sapiens
aaacaaacaattagttgtgtgg

SEQ ID NO: 8277431 - DNA, 22 bp, Homo sapiens
aaacaagagtcttgctccacct

SEQ ID NO: 8277432 - DNA, 22 bp, Homo sapiens
aaacaaggaaatgtttggttgc

SEQ ID NO: 8277433 - DNA, 22 bp, Homo sapiens
aaacaatgaaatatttttatgg

SEQ ID NO: 8277434 - DNA, 22 bp, Homo sapiens
aaacaatgaaattcattcttca

SEQ ID NO: 8277435 - DNA, 22 bp, Homo sapiens
aaagacatggcaagagatgggg

SEQ ID NO: 8277436 - DNA, 22 bp, Homo sapiens
aaactcctgggctcaagcagtt

SEQ ID NO: 8277437 - DNA, 22 bp, Homo sapiens
aaaagtatagggtttggagtca

SEQ ID NO: 8277438 - DNA, 22 bp, Homo sapiens
aaagaaggggtctacatccaat

SEQ ID NO: 8277439 - DNA, 22 bp, Homo sapiens
aaagaaggggtctacatccaat

SEQ ID NO: 8277440 - DNA, 22 bp, Homo sapiens
aaactagattaccactgctaga

SEQ ID NO: 8277441 - DNA, 22 bp, Homo sapiens
aaagccagggtccaggcctgcc

SEQ ID NO: 8277442 - DNA, 22 bp, Homo sapiens
aaagccaggttgtgtgcaggaa

SEQ ID NO: 8277443 - DNA, 22 bp, Homo sapiens
aaagccagtggtatgagagaaa

SEQ ID NO: 8277444 - DNA, 22 bp, Homo sapiens
aaagccagtttgtctctttaaa

SEQ ID NO: 8277445 - DNA, 22 bp, Homo sapiens
aaagccagttcttagagaaagc

SEQ ID NO: 8277446 - DNA, 22 bp, Homo sapiens
aaattttcctggtaaagatgga

SEQ ID NO: 8277447 - DNA, 22 bp, Homo sapiens
aaagagtttggagacaagatca

SEQ ID NO: 8277448 - DNA, 22 bp, Homo sapiens
aacaaaacatttgtcttgtttc

SEQ ID NO: 8277449 - DNA, 22 bp, Homo sapiens
aacaaacaaacattttgtcatc

SEQ ID NO: 8277450 - DNA, 22 bp, Homo sapiens
aaagctgcccagctgcctgttt

SEQ ID NO: 8277451 - DNA, 22 bp, Homo sapiens
aaagctgccctacacggaagca

SEQ ID NO: 8277452 - DNA, 22 bp, Homo sapiens
aaagcttaaggtaggtacagag

SEQ ID NO: 8277453 - DNA, 22 bp, Homo sapiens
aaagctgttgtatggcccttgg

SEQ ID NO: 8277454 - DNA, 22 bp, Homo sapiens
aacagatttgtgaagctactca

SEQ ID NO: 8277455 - DNA, 22 bp, Homo sapiens
aaagtattcttgactgtttttc

SEQ ID NO: 8277456 - DNA, 22 bp, Homo sapiens
aaagtattcaaaaatatttggt

SEQ ID NO: 8277457 - DNA, 22 bp, Homo sapiens
aaagtattcaaaaatatttggt

SEQ ID NO: 8277458 - DNA, 22 bp, Homo sapiens
aaagtatttgtgatttttacca

SEQ ID NO: 8277459 - DNA, 21 bp, Homo sapiens
aaagtggtaaggattattttg

SEQ ID NO: 8277460 - DNA, 22 bp, Homo sapiens
aaagtggtttatgatattccaa

SEQ ID NO: 8277461 - DNA, 22 bp, Homo sapiens
aactaaaagtgtgtctcttgta

SEQ ID NO: 8277462 - DNA, 22 bp, Homo sapiens
aaaggaagatgccaggactctg

SEQ ID NO: 8277463 - DNA, 22 bp, Homo sapiens
aaagggctcccaggatcatctc

SEQ ID NO: 8277464 - DNA, 22 bp, Homo sapiens
aagcacagacacaaaaggcttt

SEQ ID NO: 8277465 - DNA, 22 bp, Homo sapiens
aagcacagaaaaggagcatgga

SEQ ID NO: 8277466 - DNA, 22 bp, Homo sapiens
aagcacagagaggtaaagtaac

SEQ ID NO: 8277467 - DNA, 22 bp, Homo sapiens
aagcacagactccctctgagtg

SEQ ID NO: 8277468 - DNA, 22 bp, Homo sapiens
aagcacagactccctctgagtg

SEQ ID NO: 8277469 - DNA, 22 bp, Homo sapiens
aaatgcacaggttttaaatcct

SEQ ID NO: 8277470 - DNA, 22 bp, Homo sapiens
aagcacagatgcaagggggacc

SEQ ID NO: 8277471 - DNA, 22 bp, Homo sapiens
aaatggtttaattatgtttaat

SEQ ID NO: 8277472 - DNA, 22 bp, Homo sapiens
aagctgaagacacagctccagt

SEQ ID NO: 8277473 - DNA, 22 bp, Homo sapiens
aaatgtactgatacttatttta

SEQ ID NO: 8277474 - DNA, 22 bp, Homo sapiens
aaatgtagttgaaaagttaagg

SEQ ID NO: 8277475 - DNA, 22 bp, Homo sapiens
aaatgtattgcataggatattt

SEQ ID NO: 8277476 - DNA, 22 bp, Homo sapiens
aaataacttggtttcatcagag

SEQ ID NO: 8277477 - DNA, 22 bp, Homo sapiens
aaataacttggtttcatcagag

SEQ ID NO: 8277478 - DNA, 22 bp, Homo sapiens
aaataattatagcgagtctatc

SEQ ID NO: 8277479 - DNA, 22 bp, Homo sapiens
aaagtgttatgcaaaactctgt

SEQ ID NO: 8277480 - DNA, 22 bp, Homo sapiens
aaatagatttcctagcattgga

SEQ ID NO: 8277481 - DNA, 22 bp, Homo sapiens
aaatagatttaacatccatccc

SEQ ID NO: 8277482 - DNA, 22 bp, Homo sapiens
aaatagagctgggttaaacttt

SEQ ID NO: 8277483 - DNA, 22 bp, Homo sapiens
aaataattatagcgagtctatc

SEQ ID NO: 8277484 - DNA, 22 bp, Homo sapiens
aaataattgagttggtcaatat

SEQ ID NO: 8277485 - DNA, 22 bp, Homo sapiens
aaatagctgaaagttcctagat

SEQ ID NO: 8277486 - DNA, 23 bp, Homo sapiens
aaataggagtatctggatcatga

SEQ ID NO: 8277487 - DNA, 18 bp, Homo sapiens
acacaggttattctctcc

SEQ ID NO: 8277488 - DNA, 22 bp, Homo sapiens
acacagtagtgtggaaaaacat

SEQ ID NO: 8277489 - DNA, 22 bp, Homo sapiens
acacagctttgtgttgctccac

SEQ ID NO: 8277490 - DNA, 22 bp, Homo sapiens
acacaggaaatggtttagtttt

SEQ ID NO: 8277491 - DNA, 22 bp, Homo sapiens
acacagggctgcgcctgacccc

SEQ ID NO: 8277492 - DNA, 22 bp, Homo sapiens
acacaggtacacatatgtacct

SEQ ID NO: 8277493 - DNA, 22 bp, Homo sapiens
acactgctcacttcttcccttg

SEQ ID NO: 8277494 - DNA, 22 bp, Homo sapiens
acactgctcacttcttcccttg

SEQ ID NO: 8277495 - DNA, 21 bp, Homo sapiens
acactgctgtagcatattggg

SEQ ID NO: 8277496 - DNA, 22 bp, Homo sapiens
acactggaggagagctgttgct

SEQ ID NO: 8277497 - DNA, 17 bp, Homo sapiens
aagatttcattagctga

SEQ ID NO: 8277498 - DNA, 22 bp, Homo sapiens
aagcacagggactcaggaccgg

SEQ ID NO: 8277499 - DNA, 21 bp, Homo sapiens
acactggtgcctgatgtcagg

SEQ ID NO: 8277500 - DNA, 22 bp, Homo sapiens
aagcacagggactcaggaccgg

SEQ ID NO: 8277501 - DNA, 22 bp, Homo sapiens
aagcacaggagacgcacagcca

SEQ ID NO: 8277502 - DNA, 22 bp, Homo sapiens
acagagtagcagcactgtgctt

SEQ ID NO: 8277503 - DNA, 22 bp, Homo sapiens
aagcagcattcagtgaaatgtg

SEQ ID NO: 8277504 - DNA, 22 bp, Homo sapiens
aagcagcatgtgggttatcggg

SEQ ID NO: 8277505 - DNA, 22 bp, Homo sapiens
aagcagcatgattgtaatacta

SEQ ID NO: 8277506 - DNA, 22 bp, Homo sapiens
aagcagcatgattgtaatacta

SEQ ID NO: 8277507 - DNA, 18 bp, Homo sapiens
acagacaaaatggaaatg

SEQ ID NO: 8277508 - DNA, 18 bp, Homo sapiens
acagacaaaatggaaatg

SEQ ID NO: 8277509 - DNA, 22 bp, Homo sapiens
aagcatgtgtataagctgggca

SEQ ID NO: 8277510 - DNA, 22 bp, Homo sapiens
aagcatgtgctggggctttttg

SEQ ID NO: 8277511 - DNA, 22 bp, Homo sapiens
aagcatgtcccttgtgattcaa

SEQ ID NO: 8277512 - DNA, 22 bp, Homo sapiens
aagcatgtacaatgagtgtctc

SEQ ID NO: 8277513 - DNA, 22 bp, Homo sapiens
aagccaggaagagagccttcac

SEQ ID NO: 8277514 - DNA, 22 bp, Homo sapiens
aagccaggaagggagctgtccc

SEQ ID NO: 8277515 - DNA, 22 bp, Homo sapiens
aagccaggcatgcttggacagt

SEQ ID NO: 8277516 - DNA, 22 bp, Homo sapiens
aagccaggaatggagtcttcgc

SEQ ID NO: 8277517 - DNA, 22 bp, Homo sapiens
aagccaggagcgaggcctcggc

SEQ ID NO: 8277518 - DNA, 21 bp, Homo sapiens
aagaaagataattaaggaccc

SEQ ID NO: 8277519 - DNA, 22 bp, Homo sapiens
aagaaagcattagacaggcatt

SEQ ID NO: 8277520 - DNA, 22 bp, Homo sapiens
aacttcaagcttcgtcccttcg

SEQ ID NO: 8277521 - DNA, 22 bp, Homo sapiens
aagaaatcatatcatttcttgg

SEQ ID NO: 8277522 - DNA, 22 bp, Homo sapiens
aagaaatattgggccttataaa

SEQ ID NO: 8277523 - DNA, 22 bp, Homo sapiens
aagaaatacatggtttttgagt

SEQ ID NO: 8277524 - DNA, 22 bp, Homo sapiens
aagaaagcattagacaggcatt

SEQ ID NO: 8277525 - DNA, 22 bp, Homo sapiens
aagaatacttcgtaagtaggat

SEQ ID NO: 8277526 - DNA, 22 bp, Homo sapiens
aagaataagaggatttagaaca

SEQ ID NO: 8277527 - DNA, 22 bp, Homo sapiens
aagaataagaggatttagaaca

SEQ ID NO: 8277528 - DNA, 22 bp, Homo sapiens
aagaataagaggatttagaaca

SEQ ID NO: 8277529 - DNA, 22 bp, Homo sapiens
aagaatacgtatcaacaatggt

SEQ ID NO: 8277530 - DNA, 23 bp, Homo sapiens
aagaataaatgacattaaaggtg

SEQ ID NO: 8277531 - DNA, 22 bp, Homo sapiens
aagaataaattaagatacttag

SEQ ID NO: 8277532 - DNA, 22 bp, Homo sapiens
aagaataacacttaggttttgc

SEQ ID NO: 8277533 - DNA, 22 bp, Homo sapiens
aagaataacacttaggttttgc

SEQ ID NO: 8277534 - DNA, 22 bp, Homo sapiens
aagacaggaaaagctccaggcc

SEQ ID NO: 8277535 - DNA, 22 bp, Homo sapiens
aagacaggaaaagctccaggcc

SEQ ID NO: 8277536 - DNA, 20 bp, Homo sapiens
aagacaccagtggcagcccc

SEQ ID NO: 8277537 - DNA, 22 bp, Homo sapiens
aattgtctttatcacagttcaa

SEQ ID NO: 8277538 - DNA, 22 bp, Homo sapiens
aattgtaactacattgagaaca

SEQ ID NO: 8277539 - DNA, 22 bp, Homo sapiens
aagaggaactgggggctgagtc

SEQ ID NO: 8277540 - DNA, 22 bp, Homo sapiens
acaaggcagtacaatgatgaca

SEQ ID NO: 8277541 - DNA, 22 bp, Homo sapiens
acaaggctctaatttcattgaa

SEQ ID NO: 8277542 - DNA, 22 bp, Homo sapiens
acaaggctaatttggaagatac

SEQ ID NO: 8277543 - DNA, 22 bp, Homo sapiens
acaaggctgaacagtgaagccg

SEQ ID NO: 8277544 - DNA, 23 bp, Homo sapiens
acaaggctctgttctgcagtttc

SEQ ID NO: 8277545 - DNA, 22 bp, Homo sapiens
acaaggctgctgtgattgggaa

SEQ ID NO: 8277546 - DNA, 22 bp, Homo sapiens
acaaggatctgtgtaggcaggc

SEQ ID NO: 8277547 - DNA, 22 bp, Homo sapiens
acaaggagaagaaattggtcat

SEQ ID NO: 8277548 - DNA, 20 bp, Homo sapiens
acaaggaaccaggaggtggc

SEQ ID NO: 8277549 - DNA, 22 bp, Homo sapiens
aagagattaaagtaacttgcct

SEQ ID NO: 8277550 - DNA, 22 bp, Homo sapiens
aagagattggttataagagatt

SEQ ID NO: 8277551 - DNA, 22 bp, Homo sapiens
aagagatgatggcagccagagg

SEQ ID NO: 8277552 - DNA, 17 bp, Homo sapiens
aagagaggctgagctgg

SEQ ID NO: 8277553 - DNA, 22 bp, Homo sapiens
aagagaggacatggtgaacctg

SEQ ID NO: 8277554 - DNA, 22 bp, Homo sapiens
aagagagggatttggtttattg

SEQ ID NO: 8277555 - DNA, 22 bp, Homo sapiens
aagagagggacttattaaagtc

SEQ ID NO: 8277556 - DNA, 22 bp, Homo sapiens
aagagaggggttgcatggaaat

SEQ ID NO: 8277557 - DNA, 22 bp, Homo sapiens
aagagaggggttgcatggaaat

SEQ ID NO: 8277558 - DNA, 22 bp, Homo sapiens
aagagagaacacagcttgggca

SEQ ID NO: 8277559 - DNA, 20 bp, Homo sapiens
acaaagactggaaaagcaag

SEQ ID NO: 8277560 - DNA, 22 bp, Homo sapiens
aacagtaaagacagaatttatc

SEQ ID NO: 8277561 - DNA, 22 bp, Homo sapiens
aacagtaaaaatcatttagttg

SEQ ID NO: 8277562 - DNA, 22 bp, Homo sapiens
aacaggtagggactctaacttg

SEQ ID NO: 8277563 - DNA, 22 bp, Homo sapiens
aacaggtagggttttccttaga

SEQ ID NO: 8277564 - DNA, 22 bp, Homo sapiens
aacaggtacagtttccctctgg

SEQ ID NO: 8277565 - DNA, 22 bp, Homo sapiens
aacatgcatgttatttatcagt

SEQ ID NO: 8277566 - DNA, 18 bp, Homo sapiens
aacatgcattagaactgc

SEQ ID NO: 8277567 - DNA, 22 bp, Homo sapiens
aacagggacaaggatagagaaa

SEQ ID NO: 8277568 - DNA, 22 bp, Homo sapiens
aacaggagaggggaatgtagag

SEQ ID NO: 8277569 - DNA, 22 bp, Homo sapiens
aaccagaaggaatctgagctga

SEQ ID NO: 8277570 - DNA, 22 bp, Homo sapiens
aacatggctcatgagagatttg

SEQ ID NO: 8277571 - DNA, 22 bp, Homo sapiens
aatataatgctgttttatgcca

SEQ ID NO: 8277572 - DNA, 20 bp, Homo sapiens
aatataattctctgaattta

SEQ ID NO: 8277573 - DNA, 22 bp, Homo sapiens
aactgctgtggcctagtactta

SEQ ID NO: 8277574 - DNA, 22 bp, Homo sapiens
aactgcttagtgatggatgacc

SEQ ID NO: 8277575 - DNA, 22 bp, Homo sapiens
aactgcctcaggtcatatatca

SEQ ID NO: 8277576 - DNA, 22 bp, Homo sapiens
aatgataccgccaatattacca

SEQ ID NO: 8277577 - DNA, 22 bp, Homo sapiens
aatgatacatatgtatcgttag

SEQ ID NO: 8277578 - DNA, 22 bp, Homo sapiens
aatgatatgcaaattatcatca

SEQ ID NO: 8277579 - DNA, 22 bp, Homo sapiens
aatgatatgcaaattatcatca

SEQ ID NO: 8277580 - DNA, 22 bp, Homo sapiens
aacttaatccaacacgggcatc

SEQ ID NO: 8277581 - DNA, 23 bp, Homo sapiens
aacttaatactgggataagatgc

SEQ ID NO: 8277582 - DNA, 23 bp, Homo sapiens
aacttaatactgggataagatgc

SEQ ID NO: 8277583 - DNA, 22 bp, Homo sapiens
aacttaagaggttaagggcttg

SEQ ID NO: 8277584 - DNA, 22 bp, Homo sapiens
aacagccactgatactgaatag

SEQ ID NO: 8277585 - DNA, 22 bp, Homo sapiens
aagtccagggatcaaagtaggc

SEQ ID NO: 8277586 - DNA, 22 bp, Homo sapiens
aagtccaggtccaggaggttcc

SEQ ID NO: 8277587 - DNA, 17 bp, Homo sapiens
aagtccagagttgagca

SEQ ID NO: 8277588 - DNA, 22 bp, Homo sapiens
aacagcagctttcaggatcatc

SEQ ID NO: 8277589 - DNA, 22 bp, Homo sapiens
aacagcatcaccccataacatt

SEQ ID NO: 8277590 - DNA, 22 bp, Homo sapiens
aaggtcacactcccagagctga

SEQ ID NO: 8277591 - DNA, 22 bp, Homo sapiens
aaggtcagagcaggaaggagtc

SEQ ID NO: 8277592 - DNA, 22 bp, Homo sapiens
aaggtcacttttattcctgaga

SEQ ID NO: 8277593 - DNA, 22 bp, Homo sapiens
aacactcaatttacaaactctg

SEQ ID NO: 8277594 - DNA, 22 bp, Homo sapiens
aacacatagacgtttgatatca

SEQ ID NO: 8277595 - DNA, 22 bp, Homo sapiens
aacacatagacgtttgatatca

SEQ ID NO: 8277596 - DNA, 22 bp, Homo sapiens
aagctgagccagtggcaagtgc

SEQ ID NO: 8277597 - DNA, 22 bp, Homo sapiens
aagctgaggtcaagtagctagt

SEQ ID NO: 8277598 - DNA, 22 bp, Homo sapiens
aaatgtctatctggcatattcc

SEQ ID NO: 8277599 - DNA, 22 bp, Homo sapiens
aaatgtgatactgttcttttta

SEQ ID NO: 8277600 - DNA, 22 bp, Homo sapiens
aaatgtgtcatattcaaagtca

SEQ ID NO: 8277601 - DNA, 22 bp, Homo sapiens
aaatgtgttcctttgctacaga

SEQ ID NO: 8277602 - DNA, 22 bp, Homo sapiens
aaattgaatgattaagtggtga

SEQ ID NO: 8277603 - DNA, 22 bp, Homo sapiens
aaattgaatttgggaaacattg

SEQ ID NO: 8277604 - DNA, 22 bp, Homo sapiens
aaattgcacaatatagacatga

SEQ ID NO: 8277605 - DNA, 22 bp, Homo sapiens
aaattctatgtcaatgtttatt

SEQ ID NO: 8277606 - DNA, 22 bp, Homo sapiens
aacaaagatgggtgggaaagag

SEQ ID NO: 8277607 - DNA, 22 bp, Homo sapiens
aacaaactcaaatggaagagtg

SEQ ID NO: 8277608 - DNA, 22 bp, Homo sapiens
aacaaactcaaatggaagagtg

SEQ ID NO: 8277609 - DNA, 20 bp, Homo sapiens
aacaaactacaaaattatgt

SEQ ID NO: 8277610 - DNA, 22 bp, Homo sapiens
aacaaacagttaagtgtggatg

SEQ ID NO: 8277611 - DNA, 22 bp, Homo sapiens
acagagatcagaggcataagca

SEQ ID NO: 8277612 - DNA, 22 bp, Homo sapiens
agcccagctgctatgtacctgg

SEQ ID NO: 8277613 - DNA, 22 bp, Homo sapiens
acagagagggagtgataaatcc

SEQ ID NO: 8277614 - DNA, 22 bp, Homo sapiens
agccatctctgaaatcaaagct

SEQ ID NO: 8277615 - DNA, 22 bp, Homo sapiens
agccagggtgggtgaatgctat

SEQ ID NO: 8277616 - DNA, 22 bp, Homo sapiens
agccagggtgggtgaatgctat

SEQ ID NO: 8277617 - DNA, 22 bp, Homo sapiens
acagagcagtaagaacacagct

SEQ ID NO: 8277618 - DNA, 22 bp, Homo sapiens
acagagcagttctggagctggc

SEQ ID NO: 8277619 - DNA, 22 bp, Homo sapiens
acagagcatataaagtgctttg

SEQ ID NO: 8277620 - DNA, 22 bp, Homo sapiens
acagagttaatggataggcagg

SEQ ID NO: 8277621 - DNA, 22 bp, Homo sapiens
acagagtcattcactgatgaag

SEQ ID NO: 8277622 - DNA, 22 bp, Homo sapiens
agcctgctggaccaagctcatg

SEQ ID NO: 8277623 - DNA, 22 bp, Homo sapiens
agcctgccttgggctgcttgag

SEQ ID NO: 8277624 - DNA, 22 bp, Homo sapiens
acagcaactcctgcttctgagt

SEQ ID NO: 8277625 - DNA, 22 bp, Homo sapiens
agcctgcctgtgaggctttgag

SEQ ID NO: 8277626 - DNA, 22 bp, Homo sapiens
agcctgccaggcgctgcctgga

SEQ ID NO: 8277627 - DNA, 22 bp, Homo sapiens
agcctgcacctgaccaacctgc

SEQ ID NO: 8277628 - DNA, 19 bp, Homo sapiens
agctagtgctcagctgtca

SEQ ID NO: 8277629 - DNA, 22 bp, Homo sapiens
agctagggctttcgtagacagt

SEQ ID NO: 8277630 - DNA, 22 bp, Homo sapiens
agctatgctgcagttgtggagt

SEQ ID NO: 8277631 - DNA, 22 bp, Homo sapiens
agctatggaacagagtggctgt

SEQ ID NO: 8277632 - DNA, 21 bp, Homo sapiens
acagcaagccttcctttcagg

SEQ ID NO: 8277633 - DNA, 22 bp, Homo sapiens
acagcaagccagcttgtcactg

SEQ ID NO: 8277634 - DNA, 22 bp, Homo sapiens
agctctccacacataggactag

SEQ ID NO: 8277635 - DNA, 18 bp, Homo sapiens
agctctggggagatgggc

SEQ ID NO: 8277636 - DNA, 22 bp, Homo sapiens
agctctgggctgacatgctccc

SEQ ID NO: 8277637 - DNA, 22 bp, Homo sapiens
agctctgggctgacatgctccc

SEQ ID NO: 8277638 - DNA, 22 bp, Homo sapiens
agctctggggcctgtcccacat

SEQ ID NO: 8277639 - DNA, 22 bp, Homo sapiens
agctctggggcctgtcccacat

SEQ ID NO: 8277640 - DNA, 22 bp, Homo sapiens
agctctggggtagggcccaaca

SEQ ID NO: 8277641 - DNA, 22 bp, Homo sapiens
agctcctgttctgagagcagga

SEQ ID NO: 8277642 - DNA, 20 bp, Homo sapiens
agctctcagcatgctgcctg

SEQ ID NO: 8277643 - DNA, 22 bp, Homo sapiens
acagcaggagccttcatatgct

SEQ ID NO: 8277644 - DNA, 22 bp, Homo sapiens
acagcaggaattaacatataag

SEQ ID NO: 8277645 - DNA, 22 bp, Homo sapiens
agctcaagcgtgggctgggcgc

SEQ ID NO: 8277646 - DNA, 22 bp, Homo sapiens
agctcaagagtagttcgagggg

SEQ ID NO: 8277647 - DNA, 22 bp, Homo sapiens
agctatgttcctcgatgctcag

SEQ ID NO: 8277648 - DNA, 22 bp, Homo sapiens
acagcaggcatgaagaaatgtt

SEQ ID NO: 8277649 - DNA, 22 bp, Homo sapiens
acagcaggcatgaagaaatgtt

SEQ ID NO: 8277650 - DNA, 22 bp, Homo sapiens
acagcaggcatgaagaaatgtt

SEQ ID NO: 8277651 - DNA, 22 bp, Homo sapiens
acagcaggatttggcgatgttg

SEQ ID NO: 8277652 - DNA, 22 bp, Homo sapiens
acagcaggcacacaaggataga

SEQ ID NO: 8277653 - DNA, 22 bp, Homo sapiens
acaatttatccattgtatagtt

SEQ ID NO: 8277654 - DNA, 22 bp, Homo sapiens
acaatttatccattgtatagtt

SEQ ID NO: 8277655 - DNA, 22 bp, Homo sapiens
acaattttccccataggttatc

SEQ ID NO: 8277656 - DNA, 22 bp, Homo sapiens
acaattttaagccagagtgggt

SEQ ID NO: 8277657 - DNA, 22 bp, Homo sapiens
acaatttctaatatagatctta

SEQ ID NO: 8277658 - DNA, 22 bp, Homo sapiens
acaatttcttatagttcaattc

SEQ ID NO: 8277659 - DNA, 22 bp, Homo sapiens
acacaggaactctgagaggtgg

SEQ ID NO: 8277660 - DNA, 22 bp, Homo sapiens
acacaggaagcaatttcagagc

SEQ ID NO: 8277661 - DNA, 22 bp, Homo sapiens
acaattttccccataggttatc

SEQ ID NO: 8277662 - DNA, 22 bp, Homo sapiens
acacaggaggaggatggtggtc

SEQ ID NO: 8277663 - DNA, 22 bp, Homo sapiens
acacaggcaagagtgcaggtct

SEQ ID NO: 8277664 - DNA, 22 bp, Homo sapiens
acacaggagatatgtaatggct

SEQ ID NO: 8277665 - DNA, 22 bp, Homo sapiens
acacaggagatatgtaatggct

SEQ ID NO: 8277666 - DNA, 22 bp, Homo sapiens
acacaggacagggatgtgtttt

SEQ ID NO: 8277667 - DNA, 22 bp, Homo sapiens
acacaggacagggatgtgtttt

SEQ ID NO: 8277668 - DNA, 22 bp, Homo sapiens
acacataagaaactacaaagag

SEQ ID NO: 8277669 - DNA, 22 bp, Homo sapiens
acacatatattatttgtggctc

SEQ ID NO: 8277670 - DNA, 22 bp, Homo sapiens
agcagcagtgtgtggtcatgtt

SEQ ID NO: 8277671 - DNA, 23 bp, Homo sapiens
agcagcagtgagaggtgtcttac

SEQ ID NO: 8277672 - DNA, 22 bp, Homo sapiens
agcagcaggtgacctcgatgcc

SEQ ID NO: 8277673 - DNA, 23 bp, Homo sapiens
acacatatattcagatacagatg

SEQ ID NO: 8277674 - DNA, 23 bp, Homo sapiens
acacatatattcagatacagatg

SEQ ID NO: 8277675 - DNA, 22 bp, Homo sapiens
acacatatctaagatagatgac

SEQ ID NO: 8277676 - DNA, 22 bp, Homo sapiens
acacatatgcagatcccccaca

SEQ ID NO: 8277677 - DNA, 22 bp, Homo sapiens
acacatatgccattacagcaaa

SEQ ID NO: 8277678 - DNA, 22 bp, Homo sapiens
agcagcttgggtctctcctgct

SEQ ID NO: 8277679 - DNA, 21 bp, Homo sapiens
agcagcttgagtctggagctc

SEQ ID NO: 8277680 - DNA, 22 bp, Homo sapiens
agcagctttaagtcactggtta

SEQ ID NO: 8277681 - DNA, 21 bp, Homo sapiens
agcagctttggttgaagcaga

SEQ ID NO: 8277682 - DNA, 18 bp, Homo sapiens
agcagctttgtgcttgat

SEQ ID NO: 8277683 - DNA, 22 bp, Homo sapiens
acagaaattcaaactggaattt

SEQ ID NO: 8277684 - DNA, 22 bp, Homo sapiens
agccacagggggtgagggacaa

SEQ ID NO: 8277685 - DNA, 22 bp, Homo sapiens
acagaaattgggcaaatggaag

SEQ ID NO: 8277686 - DNA, 22 bp, Homo sapiens
agcagtgttggtgggagcatct

SEQ ID NO: 8277687 - DNA, 20 bp, Homo sapiens
agcagtgtggggagactgtg

SEQ ID NO: 8277688 - DNA, 22 bp, Homo sapiens
agcagtggtgtgaggagggctc

SEQ ID NO: 8277689 - DNA, 22 bp, Homo sapiens
agcagggcagtgcttcagctct

SEQ ID NO: 8277690 - DNA, 22 bp, Homo sapiens
acaccacaagtaactcttttcc

SEQ ID NO: 8277691 - DNA, 22 bp, Homo sapiens
acaccaaagtagaattaatgta

SEQ ID NO: 8277692 - DNA, 22 bp, Homo sapiens
agcagggcccactaggggagat

SEQ ID NO: 8277693 - DNA, 22 bp, Homo sapiens
agcaagcagaattctgtcctct

SEQ ID NO: 8277694 - DNA, 18 bp, Homo sapiens
agcaagcagttttcatgt

SEQ ID NO: 8277695 - DNA, 22 bp, Homo sapiens
agcaaggaaactatggagagat

SEQ ID NO: 8277696 - DNA, 22 bp, Homo sapiens
agcacaggtacggagatgctac

SEQ ID NO: 8277697 - DNA, 21 bp, Homo sapiens
agcaccagttttatgccaggc

SEQ ID NO: 8277698 - DNA, 22 bp, Homo sapiens
agcaaggcagctttcactgctt

SEQ ID NO: 8277699 - DNA, 22 bp, Homo sapiens
agcaaggaaagtaggcacggaa

SEQ ID NO: 8277700 - DNA, 21 bp, Homo sapiens
agcaaggcagcctctcagcct

SEQ ID NO: 8277701 - DNA, 22 bp, Homo sapiens
agatggggctcagtgtggaggc

SEQ ID NO: 8277702 - DNA, 22 bp, Homo sapiens
acaagttaccaaaaaagattca

SEQ ID NO: 8277703 - DNA, 22 bp, Homo sapiens
acaagtgtgtgcagtttgtaaa

SEQ ID NO: 8277704 - DNA, 22 bp, Homo sapiens
acaagtctcaacagcagccagc

SEQ ID NO: 8277705 - DNA, 22 bp, Homo sapiens
acaagtctttttcatgtcttct

SEQ ID NO: 8277706 - DNA, 22 bp, Homo sapiens
acaagtaccaaatgctcaagta

SEQ ID NO: 8277707 - DNA, 22 bp, Homo sapiens
acaagtatttaaggttagtata

SEQ ID NO: 8277708 - DNA, 22 bp, Homo sapiens
acaagttaggttttaatccaaa

SEQ ID NO: 8277709 - DNA, 22 bp, Homo sapiens
agatggggcagaatggagccat

SEQ ID NO: 8277710 - DNA, 22 bp, Homo sapiens
acaagggattgttgagtagtct

SEQ ID NO: 8277711 - DNA, 22 bp, Homo sapiens
acaaggctttggagggttctta

SEQ ID NO: 8277712 - DNA, 22 bp, Homo sapiens
acaaggaacaagcatgtagttt

SEQ ID NO: 8277713 - DNA, 18 bp, Homo sapiens
acaaatgtgtcacaggaa

SEQ ID NO: 8277714 - DNA, 22 bp, Homo sapiens
acaaattatagaaaattgagct

SEQ ID NO: 8277715 - DNA, 22 bp, Homo sapiens
acaaattatagaaaattgagct

SEQ ID NO: 8277716 - DNA, 22 bp, Homo sapiens
acaaatggaacaatgaagactg

SEQ ID NO: 8277717 - DNA, 22 bp, Homo sapiens
acaaatggactctcatcttttg

SEQ ID NO: 8277718 - DNA, 22 bp, Homo sapiens
aattttcacagtgctgtgagat

SEQ ID NO: 8277719 - DNA, 22 bp, Homo sapiens
agagctggggctctgggtttaa

SEQ ID NO: 8277720 - DNA, 21 bp, Homo sapiens
agaggccctcggactgggcgt

SEQ ID NO: 8277721 - DNA, 22 bp, Homo sapiens
agaggccatgctagaggcctgg

SEQ ID NO: 8277722 - DNA, 22 bp, Homo sapiens
agaggccccaggtgagcatgcc

SEQ ID NO: 8277723 - DNA, 22 bp, Homo sapiens
aattttctgatgatgaagcacg

SEQ ID NO: 8277724 - DNA, 22 bp, Homo sapiens
aattttctaaggtgatgatctg

SEQ ID NO: 8277725 - DNA, 22 bp, Homo sapiens
aattttctgcctagcaaaaact

SEQ ID NO: 8277726 - DNA, 22 bp, Homo sapiens
agaggccatctgctctgtgggg

SEQ ID NO: 8277727 - DNA, 22 bp, Homo sapiens
agaggccatctgctctgtgggg

SEQ ID NO: 8277728 - DNA, 22 bp, Homo sapiens
acaaacagagttgaaaaatagg

SEQ ID NO: 8277729 - DNA, 22 bp, Homo sapiens
acaaacagagttgaaaaatagg

SEQ ID NO: 8277730 - DNA, 23 bp, Homo sapiens
acaaaatgttctgctgggaggtg

SEQ ID NO: 8277731 - DNA, 22 bp, Homo sapiens
acaaactacctacagatgttca

SEQ ID NO: 8277732 - DNA, 19 bp, Homo sapiens
acaaactgagtacacttgt

SEQ ID NO: 8277733 - DNA, 22 bp, Homo sapiens
acaaacttcccagacaagctcc

SEQ ID NO: 8277734 - DNA, 22 bp, Homo sapiens
acaaacttatgtttcatatgta

SEQ ID NO: 8277735 - DNA, 22 bp, Homo sapiens
aatgtttgagcatctacatgct

SEQ ID NO: 8277736 - DNA, 22 bp, Homo sapiens
aatgtttggactggaaggtccc

SEQ ID NO: 8277737 - DNA, 22 bp, Homo sapiens
aatgttcattagcattgttgac

SEQ ID NO: 8277738 - DNA, 22 bp, Homo sapiens
aatgttgcagagtgattgtcca

SEQ ID NO: 8277739 - DNA, 22 bp, Homo sapiens
aatgttcagctttcttacttaa

SEQ ID NO: 8277740 - DNA, 22 bp, Homo sapiens
aatgttcaaaagcatcagtgaa

SEQ ID NO: 8277741 - DNA, 22 bp, Homo sapiens
aatgttcaaacagatcacttag

SEQ ID NO: 8277742 - DNA, 22 bp, Homo sapiens
aatttacaggtgcactcgccat

SEQ ID NO: 8277743 - DNA, 22 bp, Homo sapiens
aatttatatgtaattaggcaca

SEQ ID NO: 8277744 - DNA, 22 bp, Homo sapiens
aatttatatgtaattaggcaca

SEQ ID NO: 8277745 - DNA, 22 bp, Homo sapiens
aatttataataaatagggcttt

SEQ ID NO: 8277746 - DNA, 22 bp, Homo sapiens
aattatatgttaatcttcaatt

SEQ ID NO: 8277747 - DNA, 22 bp, Homo sapiens
aattatatgttaatcttcaatt

SEQ ID NO: 8277748 - DNA, 20 bp, Homo sapiens
aattatataactccaacatt

SEQ ID NO: 8277749 - DNA, 22 bp, Homo sapiens
aattatacattgaacaatctag

SEQ ID NO: 8277750 - DNA, 22 bp, Homo sapiens
aattatacaattgtcaagttct

SEQ ID NO: 8277751 - DNA, 22 bp, Homo sapiens
aattatattgtggtgtgaatgt

SEQ ID NO: 8277752 - DNA, 22 bp, Homo sapiens
aattatattgtggtgtgaatgt

SEQ ID NO: 8277753 - DNA, 22 bp, Homo sapiens
aattggaaaaagacttaattgc

SEQ ID NO: 8277754 - DNA, 22 bp, Homo sapiens
agacagggccactcatcctcac

SEQ ID NO: 8277755 - DNA, 22 bp, Homo sapiens
agacagggagggagcgcggctg

SEQ ID NO: 8277756 - DNA, 22 bp, Homo sapiens
agacagggtgatcgcttgagcc

SEQ ID NO: 8277757 - DNA, 22 bp, Homo sapiens
agacagggtgatcgcttgagcc

SEQ ID NO: 8277758 - DNA, 22 bp, Homo sapiens
aatgtattctctttataagata

SEQ ID NO: 8277759 - DNA, 22 bp, Homo sapiens
aatgtctgcctgaactttatat

SEQ ID NO: 8277760 - DNA, 22 bp, Homo sapiens
aatgtctgccagaactgatcat

SEQ ID NO: 8277761 - DNA, 22 bp, Homo sapiens
aatgtctgagtctctgtatccc

SEQ ID NO: 8277762 - DNA, 22 bp, Homo sapiens
aatgtctgaggctcatctgagg

SEQ ID NO: 8277763 - DNA, 22 bp, Homo sapiens
aatgtctgaaaatcagactgca

SEQ ID NO: 8277764 - DNA, 22 bp, Homo sapiens
aatgtctagacatgttaatgca

SEQ ID NO: 8277765 - DNA, 23 bp, Homo sapiens
agacagaggctgaggctggccgc

SEQ ID NO: 8277766 - DNA, 22 bp, Homo sapiens
aatgcaatgcagcacctccttg

SEQ ID NO: 8277767 - DNA, 22 bp, Homo sapiens
aatgcaatgcagcacctccttg

SEQ ID NO: 8277768 - DNA, 22 bp, Homo sapiens
agaaggggagaagctaccagga

SEQ ID NO: 8277769 - DNA, 22 bp, Homo sapiens
aaggaaatgaggttgatggatg

SEQ ID NO: 8277770 - DNA, 22 bp, Homo sapiens
acagtagtctcaggaataggca

SEQ ID NO: 8277771 - DNA, 22 bp, Homo sapiens
acagttggttaacacaaatatt

SEQ ID NO: 8277772 - DNA, 22 bp, Homo sapiens
aaggcagcctttgtttgattga

SEQ ID NO: 8277773 - DNA, 22 bp, Homo sapiens
aagccaggttccatggaggagc

SEQ ID NO: 8277774 - DNA, 18 bp, Homo sapiens
aagccaggtcaagataag

SEQ ID NO: 8277775 - DNA, 22 bp, Homo sapiens
aagccaggtgtgcccaggatcc

SEQ ID NO: 8277776 - DNA, 22 bp, Homo sapiens
aagccaggtgtttaggccagcg

SEQ ID NO: 8277777 - DNA, 22 bp, Homo sapiens
aagccaggtgttgtggtaagag

SEQ ID NO: 8277778 - DNA, 22 bp, Homo sapiens
aagccagggtcaggggcctcct

SEQ ID NO: 8277779 - DNA, 22 bp, Homo sapiens
aagccagggatggaatgatagg

SEQ ID NO: 8277780 - DNA, 22 bp, Homo sapiens
aagccagggattcctgagggag

SEQ ID NO: 8277781 - DNA, 22 bp, Homo sapiens
aagccaggccattctctggttc

SEQ ID NO: 8277782 - DNA, 22 bp, Homo sapiens
aagccaggctgcacttgctggg

SEQ ID NO: 8277783 - DNA, 22 bp, Homo sapiens
aagctgcaggttgaatccaggt

SEQ ID NO: 8277784 - DNA, 23 bp, Homo sapiens
acagggctggcagctgcaagacc

SEQ ID NO: 8277785 - DNA, 22 bp, Homo sapiens
acagtacatagatctctaccct

SEQ ID NO: 8277786 - DNA, 22 bp, Homo sapiens
acagtacataatcctgagtctg

SEQ ID NO: 8277787 - DNA, 23 bp, Homo sapiens
aagcttgtcaccatttctttcag

SEQ ID NO: 8277788 - DNA, 22 bp, Homo sapiens
aaggaaagacatataaatgact

SEQ ID NO: 8277789 - DNA, 22 bp, Homo sapiens
aaggaaagattctctctctaga

SEQ ID NO: 8277790 - DNA, 22 bp, Homo sapiens
aaggaaatagatgcagatggta

SEQ ID NO: 8277791 - DNA, 22 bp, Homo sapiens
aaggtggcatgtcccctggcca

SEQ ID NO: 8277792 - DNA, 22 bp, Homo sapiens
aaggtgctcgttatggccagtg

SEQ ID NO: 8277793 - DNA, 22 bp, Homo sapiens
aaggtgggcagatcacaaggtc

SEQ ID NO: 8277794 - DNA, 22 bp, Homo sapiens
aaggtgggtggatcacgaggtc

SEQ ID NO: 8277795 - DNA, 22 bp, Homo sapiens
aaggtggggtcctgtcatctga

SEQ ID NO: 8277796 - DNA, 22 bp, Homo sapiens
accatgcatcagttaaaaggag

SEQ ID NO: 8277797 - DNA, 22 bp, Homo sapiens
accatgcacagctgttctatta

SEQ ID NO: 8277798 - DNA, 22 bp, Homo sapiens
accatgcatcaaagctaatata

SEQ ID NO: 8277799 - DNA, 22 bp, Homo sapiens
accatgcaggctattttcaaat

SEQ ID NO: 8277800 - DNA, 23 bp, Homo sapiens
aagtaacagggataatagcagtt

SEQ ID NO: 8277801 - DNA, 21 bp, Homo sapiens
aaggtagcatgggttgcagcc

SEQ ID NO: 8277802 - DNA, 22 bp, Homo sapiens
aaggtagcttgcttcctgagta

SEQ ID NO: 8277803 - DNA, 22 bp, Homo sapiens
aagggctgagcacagtgagcca

SEQ ID NO: 8277804 - DNA, 22 bp, Homo sapiens
aagggctgaatgaagggttgaa

SEQ ID NO: 8277805 - DNA, 22 bp, Homo sapiens
aagtatgaatcaaagactatct

SEQ ID NO: 8277806 - DNA, 22 bp, Homo sapiens
aagtcacaaagtgctgtacatg

SEQ ID NO: 8277807 - DNA, 22 bp, Homo sapiens
aagtcacaagcatatatgcatt

SEQ ID NO: 8277808 - DNA, 22 bp, Homo sapiens
aagtacatcaaatgtttggcta

SEQ ID NO: 8277809 - DNA, 23 bp, Homo sapiens
aagtacatatatttagatagtga

SEQ ID NO: 8277810 - DNA, 22 bp, Homo sapiens
aagtacatggaggatagctgct

SEQ ID NO: 8277811 - DNA, 22 bp, Homo sapiens
aaggcatgaaagcgaaatgaga

SEQ ID NO: 8277812 - DNA, 22 bp, Homo sapiens
aaggcatctggatggaggagga

SEQ ID NO: 8277813 - DNA, 22 bp, Homo sapiens
aaggcatgctgagtcctaaaag

SEQ ID NO: 8277814 - DNA, 22 bp, Homo sapiens
aaggcttgtgtgttcagtgagg

SEQ ID NO: 8277815 - DNA, 22 bp, Homo sapiens
aaggctttaaataaccgtaaag

SEQ ID NO: 8277816 - DNA, 22 bp, Homo sapiens
aaggctttatgactccagtgga

SEQ ID NO: 8277817 - DNA, 22 bp, Homo sapiens
aaggctgtcttttcctcttccc

SEQ ID NO: 8277818 - DNA, 22 bp, Homo sapiens
aagggccttgccaggtgaagag

SEQ ID NO: 8277819 - DNA, 22 bp, Homo sapiens
aagggccttcactgtctaagca

SEQ ID NO: 8277820 - DNA, 22 bp, Homo sapiens
aagggccacttactcctgctgt

SEQ ID NO: 8277821 - DNA, 22 bp, Homo sapiens
aaggctttgaaaaccaaaaggt

SEQ ID NO: 8277822 - DNA, 19 bp, Homo sapiens
aaggctttctgagtgaaaa

SEQ ID NO: 8277823 - DNA, 22 bp, Homo sapiens
aaggctttggcccgagggaaga

SEQ ID NO: 8277824 - DNA, 22 bp, Homo sapiens
aaggctttgtgctgagttgtcg

SEQ ID NO: 8277825 - DNA, 22 bp, Homo sapiens
aaggctttgattccattgccct

SEQ ID NO: 8277826 - DNA, 22 bp, Homo sapiens
aaggctttccagaaagtcttga

SEQ ID NO: 8277827 - DNA, 22 bp, Homo sapiens
aaggctttatgtgaccaaaaga

SEQ ID NO: 8277828 - DNA, 22 bp, Homo sapiens
aaggctttcagctaacttgatt

SEQ ID NO: 8277829 - DNA, 22 bp, Homo sapiens
aaggctttctcaggccctggaa

SEQ ID NO: 8277830 - DNA, 22 bp, Homo sapiens
aaggctttccttgggcggttac

SEQ ID NO: 8277831 - DNA, 22 bp, Homo sapiens
aaggctttcctgtaggaagaca

SEQ ID NO: 8277832 - DNA, 22 bp, Homo sapiens
aaggctttttcactggtgactc

SEQ ID NO: 8277833 - DNA, 22 bp, Homo sapiens
aaggcttttgttcctatttagt

SEQ ID NO: 8277834 - DNA, 22 bp, Homo sapiens
aaggcttttgggaattttcaac

SEQ ID NO: 8277835 - DNA, 22 bp, Homo sapiens
aaggcttttaaactgtcaagga

SEQ ID NO: 8277836 - DNA, 22 bp, Homo sapiens
aaggctttgtgggctgcaggca

SEQ ID NO: 8277837 - DNA, 22 bp, Homo sapiens
aaggcttttgacggttgcctct

SEQ ID NO: 8277838 - DNA, 22 bp, Homo sapiens
aaggcttttaatgagttagaga

SEQ ID NO: 8277839 - DNA, 22 bp, Homo sapiens
aaggcttttaactactgtttta

SEQ ID NO: 8277840 - DNA, 22 bp, Homo sapiens
aatgacatggagcatcttttca

SEQ ID NO: 8277841 - DNA, 22 bp, Homo sapiens
aatgactagtccacatttgtaa

SEQ ID NO: 8277842 - DNA, 20 bp, Homo sapiens
aatgactactatatccatgg

SEQ ID NO: 8277843 - DNA, 22 bp, Homo sapiens
aatgagatggcaatgacttaaa

SEQ ID NO: 8277844 - DNA, 22 bp, Homo sapiens
aatgagatgttgaattattgtt

SEQ ID NO: 8277845 - DNA, 20 bp, Homo sapiens
aatgagattccttatgatag

SEQ ID NO: 8277846 - DNA, 22 bp, Homo sapiens
agaagggagagaaagttggtta

SEQ ID NO: 8277847 - DNA, 22 bp, Homo sapiens
agaagggagagaaagttggtta

SEQ ID NO: 8277848 - DNA, 18 bp, Homo sapiens
agaaggagctatgggcag

SEQ ID NO: 8277849 - DNA, 22 bp, Homo sapiens
agaaaaatcttggcgcttgtct

SEQ ID NO: 8277850 - DNA, 22 bp, Homo sapiens
aatgaacaagagagagaacttt

SEQ ID NO: 8277851 - DNA, 22 bp, Homo sapiens
aatgaacatataaagagatctt

SEQ ID NO: 8277852 - DNA, 22 bp, Homo sapiens
aatccctactagagcataccgt

SEQ ID NO: 8277853 - DNA, 22 bp, Homo sapiens
aatcctgaggcaaagagatgag

SEQ ID NO: 8277854 - DNA, 22 bp, Homo sapiens
aatccattgctgtgctgccagg

SEQ ID NO: 8277855 - DNA, 20 bp, Homo sapiens
aatccattggtctatatgtc

SEQ ID NO: 8277856 - DNA, 22 bp, Homo sapiens
actttaaaaagagccttctaac

SEQ ID NO: 8277857 - DNA, 22 bp, Homo sapiens
acttgtaagtaacaagtgagaa

SEQ ID NO: 8277858 - DNA, 22 bp, Homo sapiens
acttgtaattcctggcccaggt

SEQ ID NO: 8277859 - DNA, 22 bp, Homo sapiens
acttgtaagctctgtatttgag

SEQ ID NO: 8277860 - DNA, 21 bp, Homo sapiens
acttgtaacttgaaggggcat

SEQ ID NO: 8277861 - DNA, 22 bp, Homo sapiens
acttgtaaacaaatctaatgta

SEQ ID NO: 8277862 - DNA, 22 bp, Homo sapiens
acttgacagaagtcagtacttt

SEQ ID NO: 8277863 - DNA, 22 bp, Homo sapiens
aatatatgaccaggaagttctg

SEQ ID NO: 8277864 - DNA, 22 bp, Homo sapiens
aatatatgagggagctatttga

SEQ ID NO: 8277865 - DNA, 22 bp, Homo sapiens
aatatatttgaatcaggaacaa

SEQ ID NO: 8277866 - DNA, 22 bp, Homo sapiens
acttgaattaggccttgagaga

SEQ ID NO: 8277867 - DNA, 22 bp, Homo sapiens
acttgaattatatttctagaga

SEQ ID NO: 8277868 - DNA, 22 bp, Homo sapiens
acttcctggattcccaagggct

SEQ ID NO: 8277869 - DNA, 22 bp, Homo sapiens
acttcctgctatgagcttctgt

SEQ ID NO: 8277870 - DNA, 22 bp, Homo sapiens
aatacaatcaaattcactagca

SEQ ID NO: 8277871 - DNA, 22 bp, Homo sapiens
aataagatcctgaagatatgtt

SEQ ID NO: 8277872 - DNA, 22 bp, Homo sapiens
aataagataagatttctgctct

SEQ ID NO: 8277873 - DNA, 22 bp, Homo sapiens
aagtttctattattacattcgt

SEQ ID NO: 8277874 - DNA, 22 bp, Homo sapiens
aagtttcatgatgtaattattg

SEQ ID NO: 8277875 - DNA, 22 bp, Homo sapiens
aagtttatgttggtaagatatc

SEQ ID NO: 8277876 - DNA, 22 bp, Homo sapiens
aagtttatgttggtaagatatc

SEQ ID NO: 8277877 - DNA, 20 bp, Homo sapiens
aagttggctcctcctagcaa

SEQ ID NO: 8277878 - DNA, 22 bp, Homo sapiens
aagttctactgtgggtaaaatg

SEQ ID NO: 8277879 - DNA, 22 bp, Homo sapiens
aataattagtgggacagagaac

SEQ ID NO: 8277880 - DNA, 22 bp, Homo sapiens
aataattatttgagagcagacc

SEQ ID NO: 8277881 - DNA, 22 bp, Homo sapiens
aataagattactggttgtctga

SEQ ID NO: 8277882 - DNA, 22 bp, Homo sapiens
aataagatcttaaaggttatat

SEQ ID NO: 8277883 - DNA, 22 bp, Homo sapiens
aataagatgtgcttgagtttgg

SEQ ID NO: 8277884 - DNA, 22 bp, Homo sapiens
actgccttagaacaaagcagga

SEQ ID NO: 8277885 - DNA, 22 bp, Homo sapiens
actgccttataatatgtcaaca

SEQ ID NO: 8277886 - DNA, 22 bp, Homo sapiens
actgccttatatgctgtgtgtg

SEQ ID NO: 8277887 - DNA, 22 bp, Homo sapiens
actacaaaagcactgggtatta

SEQ ID NO: 8277888 - DNA, 22 bp, Homo sapiens
actaatagagacaaacatagat

SEQ ID NO: 8277889 - DNA, 22 bp, Homo sapiens
aagttaggatgaatgccttagc

SEQ ID NO: 8277890 - DNA, 22 bp, Homo sapiens
aagttatctgatatctttgagg

SEQ ID NO: 8277891 - DNA, 22 bp, Homo sapiens
actccaggttttctctcaagtt

SEQ ID NO: 8277892 - DNA, 22 bp, Homo sapiens
actccaggttttctctcaagtt

SEQ ID NO: 8277893 - DNA, 22 bp, Homo sapiens
aagtcaggacttatgctacctg

SEQ ID NO: 8277894 - DNA, 22 bp, Homo sapiens
aagtcaggctggggtctggcag

SEQ ID NO: 8277895 - DNA, 22 bp, Homo sapiens
aagtggaagagaagttatctta

SEQ ID NO: 8277896 - DNA, 22 bp, Homo sapiens
aagtcactggaggaactctact

SEQ ID NO: 8277897 - DNA, 22 bp, Homo sapiens
aagtcactgaaggccatgaaca

SEQ ID NO: 8277898 - DNA, 22 bp, Homo sapiens
aagtcacagctaaatagctaag

SEQ ID NO: 8277899 - DNA, 22 bp, Homo sapiens
ggcagcagaactggccctgtat

SEQ ID NO: 8277900 - DNA, 22 bp, Homo sapiens
ggcagcagaactggccctgtat

SEQ ID NO: 8277901 - DNA, 22 bp, Homo sapiens
ggcagatgttgcagtgagcaga

SEQ ID NO: 8277902 - DNA, 22 bp, Homo sapiens
ggcactgagcgggctctgagcg

SEQ ID NO: 8277903 - DNA, 22 bp, Homo sapiens
ggcagaggtgaagttcacaagg

SEQ ID NO: 8277904 - DNA, 22 bp, Homo sapiens
ggcaccaggctgggcataggcc

SEQ ID NO: 8277905 - DNA, 22 bp, Homo sapiens
ggcaccagggaaggaaggctgg

SEQ ID NO: 8277906 - DNA, 22 bp, Homo sapiens
ggcaccagggaaggaaggctgg

SEQ ID NO: 8277907 - DNA, 22 bp, Homo sapiens
ggcaccagggacaatcctcttc

SEQ ID NO: 8277908 - DNA, 22 bp, Homo sapiens
ggcacctggatgtagcagtgaa

SEQ ID NO: 8277909 - DNA, 22 bp, Homo sapiens
ggaggaggggtgactgaatgct

SEQ ID NO: 8277910 - DNA, 22 bp, Homo sapiens
ggaggaggtgggttaagttgta

SEQ ID NO: 8277911 - DNA, 22 bp, Homo sapiens
ggaggaggggtttacattggaa

SEQ ID NO: 8277912 - DNA, 22 bp, Homo sapiens
ggaggatgagctacgaggagct

SEQ ID NO: 8277913 - DNA, 22 bp, Homo sapiens
ggcagggactttgcaaatcttt

SEQ ID NO: 8277914 - DNA, 22 bp, Homo sapiens
ggcagggactatgtttcatgga

SEQ ID NO: 8277915 - DNA, 22 bp, Homo sapiens
ggcagggacaggatagggtttt

SEQ ID NO: 8277916 - DNA, 22 bp, Homo sapiens
ggcagggaagctggcatcacgg

SEQ ID NO: 8277917 - DNA, 22 bp, Homo sapiens
ggcagggaaacagctgatccca

SEQ ID NO: 8277918 - DNA, 18 bp, Homo sapiens
ggcagggaaaagataggg

SEQ ID NO: 8277919 - DNA, 22 bp, Homo sapiens
ggcagtgagaggtctcctggtc

SEQ ID NO: 8277920 - DNA, 22 bp, Homo sapiens
ggcagtgagctggagggaagga

SEQ ID NO: 8277921 - DNA, 22 bp, Homo sapiens
ggcagtgcaaggcagcctggat

SEQ ID NO: 8277922 - DNA, 22 bp, Homo sapiens
ggcagtgagtcccggagaggcc

SEQ ID NO: 8277923 - DNA, 22 bp, Homo sapiens
ggcagtggcagagcttggtcta

SEQ ID NO: 8277924 - DNA, 17 bp, Homo sapiens
ggcagtggaggaagaga

SEQ ID NO: 8277925 - DNA, 22 bp, Homo sapiens
ggcagtgccactaagctctgct

SEQ ID NO: 8277926 - DNA, 22 bp, Homo sapiens
ggcagtgcctgatgctgcagga

SEQ ID NO: 8277927 - DNA, 18 bp, Homo sapiens
ggcagtgcagtctcaggg

SEQ ID NO: 8277928 - DNA, 22 bp, Homo sapiens
ggcaggctgttcacctgctttt

SEQ ID NO: 8277929 - DNA, 22 bp, Homo sapiens
ggcaggcttggtggcaccggtt

SEQ ID NO: 8277930 - DNA, 22 bp, Homo sapiens
ggcagccatgtcccagggcttc

SEQ ID NO: 8277931 - DNA, 22 bp, Homo sapiens
ggcctctggcaggcaggccctc

SEQ ID NO: 8277932 - DNA, 22 bp, Homo sapiens
ggcctctggttcacagggagga

SEQ ID NO: 8277933 - DNA, 22 bp, Homo sapiens
ggcctctggtcaagacaagcat

SEQ ID NO: 8277934 - DNA, 22 bp, Homo sapiens
ggctcactgcaacttccgcctc

SEQ ID NO: 8277935 - DNA, 22 bp, Homo sapiens
ggctcacgcaattatcccggcc

SEQ ID NO: 8277936 - DNA, 22 bp, Homo sapiens
ggctcactgcaaactgtgcctc

SEQ ID NO: 8277937 - DNA, 22 bp, Homo sapiens
ggctcactgcaacctctgcctc

SEQ ID NO: 8277938 - DNA, 22 bp, Homo sapiens
ggcctctcttgggacagctgtc

SEQ ID NO: 8277939 - DNA, 22 bp, Homo sapiens
ggcctctctggcatggctgccc

SEQ ID NO: 8277940 - DNA, 22 bp, Homo sapiens
ggcctctctgagagcagacgtt

SEQ ID NO: 8277941 - DNA, 22 bp, Homo sapiens
ggcctctgcaactggctgtggc

SEQ ID NO: 8277942 - DNA, 22 bp, Homo sapiens
ggctctgcaaaagtagatactt

SEQ ID NO: 8277943 - DNA, 22 bp, Homo sapiens
ggctctgcactcagagtcattc

SEQ ID NO: 8277944 - DNA, 22 bp, Homo sapiens
ggctctgaattattcctgagtc

SEQ ID NO: 8277945 - DNA, 22 bp, Homo sapiens
ggctctgcagtgacttgagggg

SEQ ID NO: 8277946 - DNA, 22 bp, Homo sapiens
ggctctgcagagggcccagctt

SEQ ID NO: 8277947 - DNA, 22 bp, Homo sapiens
ggctctgcctgcccagcagcac

SEQ ID NO: 8277948 - DNA, 22 bp, Homo sapiens
ggctctgcctgcctgagtgtcc

SEQ ID NO: 8277949 - DNA, 22 bp, Homo sapiens
ggctctgcgcctgcggggactt

SEQ ID NO: 8277950 - DNA, 22 bp, Homo sapiens
ggctctgcctctgaccctctgg

SEQ ID NO: 8277951 - DNA, 22 bp, Homo sapiens
ggctctgcctgcccagcagcac

SEQ ID NO: 8277952 - DNA, 22 bp, Homo sapiens
ggctctgccgtgtgctcacatg

SEQ ID NO: 8277953 - DNA, 22 bp, Homo sapiens
ggctctgccatttcctagctgc

SEQ ID NO: 8277954 - DNA, 20 bp, Homo sapiens
ggctctgccccaccccgtcc

SEQ ID NO: 8277955 - DNA, 17 bp, Homo sapiens
ggctctcttccagactt

SEQ ID NO: 8277956 - DNA, 22 bp, Homo sapiens
ggctctctccttggctttcaga

SEQ ID NO: 8277957 - DNA, 22 bp, Homo sapiens
ggctctctggaggagctcaccc

SEQ ID NO: 8277958 - DNA, 22 bp, Homo sapiens
ggctctctccttggctttcaga

SEQ ID NO: 8277959 - DNA, 22 bp, Homo sapiens
ggctctctggaggagctcaccc

SEQ ID NO: 8277960 - DNA, 22 bp, Homo sapiens
ggctctcttaactggccatcct

SEQ ID NO: 8277961 - DNA, 19 bp, Homo sapiens
ggctctcttaaagctgttt

SEQ ID NO: 8277962 - DNA, 22 bp, Homo sapiens
ggctcagaggccagcaggtaga

SEQ ID NO: 8277963 - DNA, 22 bp, Homo sapiens
ggctcactttggggtcagctgg

SEQ ID NO: 8277964 - DNA, 22 bp, Homo sapiens
ggcccagcgaggccacctacag

SEQ ID NO: 8277965 - DNA, 22 bp, Homo sapiens
ggcccagctctattgaattaca

SEQ ID NO: 8277966 - DNA, 22 bp, Homo sapiens
ggccagctggatgtgggtgacg

SEQ ID NO: 8277967 - DNA, 22 bp, Homo sapiens
ggccagctggatgtgggtgacg

SEQ ID NO: 8277968 - DNA, 22 bp, Homo sapiens
ggccagctgccaccagccctat

SEQ ID NO: 8277969 - DNA, 21 bp, Homo sapiens
ggccagctgcatatgtcactg

SEQ ID NO: 8277970 - DNA, 22 bp, Homo sapiens
ggccagctgagctgctgcacag

SEQ ID NO: 8277971 - DNA, 22 bp, Homo sapiens
ggccagctgctcagtgtctctg

SEQ ID NO: 8277972 - DNA, 22 bp, Homo sapiens
ggccagctgctcagtgtctctg

SEQ ID NO: 8277973 - DNA, 22 bp, Homo sapiens
ggccagctgctcagtgtctctg

SEQ ID NO: 8277974 - DNA, 22 bp, Homo sapiens
ggccagcatatagagtgaagta

SEQ ID NO: 8277975 - DNA, 22 bp, Homo sapiens
ggccagcatggcaagaccaact

SEQ ID NO: 8277976 - DNA, 22 bp, Homo sapiens
ggcccagctgtatattacagtt

SEQ ID NO: 8277977 - DNA, 22 bp, Homo sapiens
ggcccagctgtgcttccagccc

SEQ ID NO: 8277978 - DNA, 22 bp, Homo sapiens
ggccagagttgatggcatcttg

SEQ ID NO: 8277979 - DNA, 22 bp, Homo sapiens
ggccagagtctatatgcagaca

SEQ ID NO: 8277980 - DNA, 19 bp, Homo sapiens
ggccacctctcttcccagg

SEQ ID NO: 8277981 - DNA, 22 bp, Homo sapiens
ggccacctctgccctaccgagt

SEQ ID NO: 8277982 - DNA, 22 bp, Homo sapiens
ggccacctccgtgaaggaatga

SEQ ID NO: 8277983 - DNA, 19 bp, Homo sapiens
ggccacctctcttcccagg

SEQ ID NO: 8277984 - DNA, 22 bp, Homo sapiens
ggccaccagtcctctggcaggg

SEQ ID NO: 8277985 - DNA, 22 bp, Homo sapiens
ggccacctaggagccacagtga

SEQ ID NO: 8277986 - DNA, 22 bp, Homo sapiens
ggccaccagtcctctggcaggg

SEQ ID NO: 8277987 - DNA, 22 bp, Homo sapiens
ggccaccaaagtcctgtggctt

SEQ ID NO: 8277988 - DNA, 22 bp, Homo sapiens
ggccacagtctctggaaggatg

SEQ ID NO: 8277989 - DNA, 22 bp, Homo sapiens
ggccacagggctgaacgtggac

SEQ ID NO: 8277990 - DNA, 22 bp, Homo sapiens
ggcagtggctgtagtctcttgg

SEQ ID NO: 8277991 - DNA, 22 bp, Homo sapiens
ggcagtggctcctctctactcc

SEQ ID NO: 8277992 - DNA, 22 bp, Homo sapiens
gggaagatagtgttgagggccc

SEQ ID NO: 8277993 - DNA, 23 bp, Homo sapiens
gggagccaggacctcgcgcccca

SEQ ID NO: 8277994 - DNA, 23 bp, Homo sapiens
gggagatgggaaatgaaggctct

SEQ ID NO: 8277995 - DNA, 22 bp, Homo sapiens
gggagccacagtgaggtgcatg

SEQ ID NO: 8277996 - DNA, 23 bp, Homo sapiens
gggagatgggaaatgaaggctct

SEQ ID NO: 8277997 - DNA, 22 bp, Homo sapiens
ggctgtggcagctggaagtggt

SEQ ID NO: 8277998 - DNA, 22 bp, Homo sapiens
ggctgtggcattaggtgaggcc

SEQ ID NO: 8277999 - DNA, 22 bp, Homo sapiens
ggctgtggagctgcagagttgg

SEQ ID NO: 8278000 - DNA, 22 bp, Homo sapiens
ggctgtggagctgcagagttgg

SEQ ID NO: 8278001 - DNA, 22 bp, Homo sapiens
ggctgtgcgggcagccgtggga

SEQ ID NO: 8278002 - DNA, 22 bp, Homo sapiens
ggctgtggggccgggtacagtg

SEQ ID NO: 8278003 - DNA, 22 bp, Homo sapiens
ggctgtggggaccaacaggact

SEQ ID NO: 8278004 - DNA, 22 bp, Homo sapiens
ggctgtggggaccaacaggact

SEQ ID NO: 8278005 - DNA, 22 bp, Homo sapiens
ggctgtggccagcggggctgag

SEQ ID NO: 8278006 - DNA, 22 bp, Homo sapiens
ggctgtggtctgggtgctcccc

SEQ ID NO: 8278007 - DNA, 22 bp, Homo sapiens
ggctgtggtcattaggaggttg

SEQ ID NO: 8278008 - DNA, 22 bp, Homo sapiens
ggctggagtgggctccagagtt

SEQ ID NO: 8278009 - DNA, 22 bp, Homo sapiens
ggctgccaggagggaggccagt

SEQ ID NO: 8278010 - DNA, 22 bp, Homo sapiens
ggctgccagtgagtgcagaccg

SEQ ID NO: 8278011 - DNA, 21 bp, Homo sapiens
ggctgcagggagccctggggt

SEQ ID NO: 8278012 - DNA, 22 bp, Homo sapiens
ggctgcaggttggttggcagct

SEQ ID NO: 8278013 - DNA, 22 bp, Homo sapiens
gggccccttgctgctctgctgg

SEQ ID NO: 8278014 - DNA, 22 bp, Homo sapiens
gggccccttgtatctctggctc

SEQ ID NO: 8278015 - DNA, 22 bp, Homo sapiens
gggcaggtgcccagggccagag

SEQ ID NO: 8278016 - DNA, 22 bp, Homo sapiens
gggccgtagaccacgtccgggc

SEQ ID NO: 8278017 - DNA, 22 bp, Homo sapiens
gggcccttcatgtattattttt

SEQ ID NO: 8278018 - DNA, 22 bp, Homo sapiens
gggccctgccccgtggctctga

SEQ ID NO: 8278019 - DNA, 20 bp, Homo sapiens
gggagtggtggtagcctgtg

SEQ ID NO: 8278020 - DNA, 22 bp, Homo sapiens
gggagtgggtttggcctaggcc

SEQ ID NO: 8278021 - DNA, 22 bp, Homo sapiens
gggagtggttgatggtgaaaat

SEQ ID NO: 8278022 - DNA, 19 bp, Homo sapiens
gggatcagcccagggctct

SEQ ID NO: 8278023 - DNA, 22 bp, Homo sapiens
gggagctatttatagaggctga

SEQ ID NO: 8278024 - DNA, 21 bp, Homo sapiens
gggcagaggggcctcctgggt

SEQ ID NO: 8278025 - DNA, 22 bp, Homo sapiens
gggcagaggctctggcccatcc

SEQ ID NO: 8278026 - DNA, 21 bp, Homo sapiens
gggcaggtctctgatgtcaac

SEQ ID NO: 8278027 - DNA, 22 bp, Homo sapiens
gggcaggtctgggtcagcctga

SEQ ID NO: 8278028 - DNA, 22 bp, Homo sapiens
gggcagagactcagaaacagaa

SEQ ID NO: 8278029 - DNA, 22 bp, Homo sapiens
gggatcagttaaggagagtttt

SEQ ID NO: 8278030 - DNA, 20 bp, Homo sapiens
gggatcaggaaaggaggcta

SEQ ID NO: 8278031 - DNA, 22 bp, Homo sapiens
gggcagagagctggaactcctt

SEQ ID NO: 8278032 - DNA, 22 bp, Homo sapiens
gggcagagagctggaactcctt

SEQ ID NO: 8278033 - DNA, 22 bp, Homo sapiens
ggtggggccctggcactggtat

SEQ ID NO: 8278034 - DNA, 22 bp, Homo sapiens
ggtggggctaggacctcaggat

SEQ ID NO: 8278035 - DNA, 22 bp, Homo sapiens
ggtggggcctgctccagcggcc

SEQ ID NO: 8278036 - DNA, 22 bp, Homo sapiens
ggtgggtggaaacagcatgtac

SEQ ID NO: 8278037 - DNA, 22 bp, Homo sapiens
ggtgggcaggtcactctgcctc

SEQ ID NO: 8278038 - DNA, 22 bp, Homo sapiens
ggtggagctatacgggatggct

SEQ ID NO: 8278039 - DNA, 22 bp, Homo sapiens
ggtggagctggaccaggagagg

SEQ ID NO: 8278040 - DNA, 22 bp, Homo sapiens
ggtggatgctgactgttctgct

SEQ ID NO: 8278041 - DNA, 22 bp, Homo sapiens
ggtggcaccttgatcttggact

SEQ ID NO: 8278042 - DNA, 22 bp, Homo sapiens
ggtgggcaggcgaggcccaggt

SEQ ID NO: 8278043 - DNA, 22 bp, Homo sapiens
ggtgggcaggcgaggcccaggt

SEQ ID NO: 8278044 - DNA, 22 bp, Homo sapiens
ggttggtgcccaggccatactg

SEQ ID NO: 8278045 - DNA, 22 bp, Homo sapiens
ggttggtgctgcatttgcctca

SEQ ID NO: 8278046 - DNA, 22 bp, Homo sapiens
ggttggtgagtgcagggtgtta

SEQ ID NO: 8278047 - DNA, 17 bp, Homo sapiens
ggttcagttctgcattc

SEQ ID NO: 8278048 - DNA, 17 bp, Homo sapiens
ggttggcttatcccagg

SEQ ID NO: 8278049 - DNA, 22 bp, Homo sapiens
ggttcagcagcagccacaattc

SEQ ID NO: 8278050 - DNA, 19 bp, Homo sapiens
ggttcagcctgtgttttat

SEQ ID NO: 8278051 - DNA, 22 bp, Homo sapiens
ggttcagtggaatgtgttgacc

SEQ ID NO: 8278052 - DNA, 22 bp, Homo sapiens
gtaatttttagttcattctatc

SEQ ID NO: 8278053 - DNA, 21 bp, Homo sapiens
ggttggtgtgtccagtggcca

SEQ ID NO: 8278054 - DNA, 17 bp, Homo sapiens
gggttttgggagcagct

SEQ ID NO: 8278055 - DNA, 22 bp, Homo sapiens
ggtcccaggaagtgcggcggcg

SEQ ID NO: 8278056 - DNA, 22 bp, Homo sapiens
gggttgaggcggatgtcggcgg

SEQ ID NO: 8278057 - DNA, 18 bp, Homo sapiens
gggtggtgtgctcttcgc

SEQ ID NO: 8278058 - DNA, 22 bp, Homo sapiens
ggtcccaggttgacagggagac

SEQ ID NO: 8278059 - DNA, 22 bp, Homo sapiens
ggtcccaggttgacagggagac

SEQ ID NO: 8278060 - DNA, 22 bp, Homo sapiens
ggtcccaggctgcgggctggtg

SEQ ID NO: 8278061 - DNA, 22 bp, Homo sapiens
ggtcccaggctgcgggctggtg

SEQ ID NO: 8278062 - DNA, 22 bp, Homo sapiens
ggtcccaggagaataggtgcaa

SEQ ID NO: 8278063 - DNA, 22 bp, Homo sapiens
ggtcccatgaaagagggaggcc

SEQ ID NO: 8278064 - DNA, 21 bp, Homo sapiens
ggtcccattgtgaggcttgaa

SEQ ID NO: 8278065 - DNA, 22 bp, Homo sapiens
ggtccctagagtgggatgactt

SEQ ID NO: 8278066 - DNA, 22 bp, Homo sapiens
ggtgagggagtggaacgaggtg

SEQ ID NO: 8278067 - DNA, 22 bp, Homo sapiens
ggtgaggctaagtgacacaggg

SEQ ID NO: 8278068 - DNA, 22 bp, Homo sapiens
ggtgaggctggcttgccttctt

SEQ ID NO: 8278069 - DNA, 22 bp, Homo sapiens
ggtgaggcccagtgatctgtgt

SEQ ID NO: 8278070 - DNA, 22 bp, Homo sapiens
ggtgaggcaggtggctgctgag

SEQ ID NO: 8278071 - DNA, 22 bp, Homo sapiens
ggtgagcaaagcttcatctgta

SEQ ID NO: 8278072 - DNA, 22 bp, Homo sapiens
ggtgaggcagagggagtaacct

SEQ ID NO: 8278073 - DNA, 19 bp, Homo sapiens
ggtgagccctcgcctgcct

SEQ ID NO: 8278074 - DNA, 22 bp, Homo sapiens
ggtgagcagctgtctgtatgga

SEQ ID NO: 8278075 - DNA, 22 bp, Homo sapiens
ggtgagcactgccctgggtctc

SEQ ID NO: 8278076 - DNA, 22 bp, Homo sapiens
ggtgagccgaaaagggtcataa

SEQ ID NO: 8278077 - DNA, 22 bp, Homo sapiens
gggtgggtggtccgcagacata

SEQ ID NO: 8278078 - DNA, 22 bp, Homo sapiens
gggtggtggcggaggctccagg

SEQ ID NO: 8278079 - DNA, 22 bp, Homo sapiens
gggtggtctggcaggctggaaa

SEQ ID NO: 8278080 - DNA, 18 bp, Homo sapiens
gggtgctggggccccttg

SEQ ID NO: 8278081 - DNA, 22 bp, Homo sapiens
gggtgcagcagagctcctctgt

SEQ ID NO: 8278082 - DNA, 22 bp, Homo sapiens
gggtgaggccttgctgccatca

SEQ ID NO: 8278083 - DNA, 22 bp, Homo sapiens
ggggccagatatcactaaggtt

SEQ ID NO: 8278084 - DNA, 22 bp, Homo sapiens
ggggccaggtccagcttccaaa

SEQ ID NO: 8278085 - DNA, 22 bp, Homo sapiens
ggggcccttgtggctgcaggcc

SEQ ID NO: 8278086 - DNA, 22 bp, Homo sapiens
gggcttctattcaagtctgttt

SEQ ID NO: 8278087 - DNA, 22 bp, Homo sapiens
gggcttctagaccagcagtgag

SEQ ID NO: 8278088 - DNA, 22 bp, Homo sapiens
gggcttctagaatttctgatat

SEQ ID NO: 8278089 - DNA, 22 bp, Homo sapiens
gggcttctgctcttttggtgct

SEQ ID NO: 8278090 - DNA, 22 bp, Homo sapiens
gggcttctcttatgctaactgg

SEQ ID NO: 8278091 - DNA, 22 bp, Homo sapiens
gggcttctctttagtgagctga

SEQ ID NO: 8278092 - DNA, 22 bp, Homo sapiens
gggcttctctttagtgagctga

SEQ ID NO: 8278093 - DNA, 22 bp, Homo sapiens
gggcttctggctactgtatgag

SEQ ID NO: 8278094 - DNA, 22 bp, Homo sapiens
gggcttctctcaggggcatgag

SEQ ID NO: 8278095 - DNA, 22 bp, Homo sapiens
gggcttctctgggagtcctggt

SEQ ID NO: 8278096 - DNA, 22 bp, Homo sapiens
gggcttctcagagaggctttag

SEQ ID NO: 8278097 - DNA, 22 bp, Homo sapiens
gggctctggggtcagacagcct

SEQ ID NO: 8278098 - DNA, 18 bp, Homo sapiens
gggctgtgttcatgccca

SEQ ID NO: 8278099 - DNA, 22 bp, Homo sapiens
gggctggtgaggctgccctgca

SEQ ID NO: 8278100 - DNA, 22 bp, Homo sapiens
ggggcattgtgtctgggttcct

SEQ ID NO: 8278101 - DNA, 22 bp, Homo sapiens
ggggaggagccatgtaactagt

SEQ ID NO: 8278102 - DNA, 22 bp, Homo sapiens
ggggaggaagctggaacacggg

SEQ ID NO: 8278103 - DNA, 22 bp, Homo sapiens
ggggaggaagctggaacacggg

SEQ ID NO: 8278104 - DNA, 22 bp, Homo sapiens
ggggaggaagctggaacacggg

SEQ ID NO: 8278105 - DNA, 22 bp, Homo sapiens
ggggagaattaccaaaagcgct

SEQ ID NO: 8278106 - DNA, 22 bp, Homo sapiens
ggggaggaagctctcagttcca

SEQ ID NO: 8278107 - DNA, 22 bp, Homo sapiens
ggggagaataaatcagatttta

SEQ ID NO: 8278108 - DNA, 19 bp, Homo sapiens
ggggagaactagagacagc

SEQ ID NO: 8278109 - DNA, 22 bp, Homo sapiens
gggcttctgtacctacctggaa

SEQ ID NO: 8278110 - DNA, 22 bp, Homo sapiens
gtagtcttttcaatgattgtgt

SEQ ID NO: 8278111 - DNA, 22 bp, Homo sapiens
gtacaattatttaaatggtgaa

SEQ ID NO: 8278112 - DNA, 22 bp, Homo sapiens
gtacaattaagtgcacaaatag

SEQ ID NO: 8278113 - DNA, 22 bp, Homo sapiens
gtaggcagaccagtggatgggt

SEQ ID NO: 8278114 - DNA, 22 bp, Homo sapiens
gtacaataactagtcttatagt

SEQ ID NO: 8278115 - DNA, 22 bp, Homo sapiens
gtacaagtgctgtgagggaaaa

SEQ ID NO: 8278116 - DNA, 22 bp, Homo sapiens
gtacaaagtggacctgatagta

SEQ ID NO: 8278117 - DNA, 22 bp, Homo sapiens
gtacaaaggcagaattgggtag

SEQ ID NO: 8278118 - DNA, 22 bp, Homo sapiens
gtcaaaatgagctttgttattg

SEQ ID NO: 8278119 - DNA, 22 bp, Homo sapiens
gtcaaaatgagctttgttattg

SEQ ID NO: 8278120 - DNA, 22 bp, Homo sapiens
gtcaaatatactaagaggtaaa

SEQ ID NO: 8278121 - DNA, 22 bp, Homo sapiens
gtcaaatattatgcagcttgga

SEQ ID NO: 8278122 - DNA, 22 bp, Homo sapiens
gtcaaatatatgcaaaactatt

SEQ ID NO: 8278123 - DNA, 22 bp, Homo sapiens
gtatttttcagttaggagctta

SEQ ID NO: 8278124 - DNA, 22 bp, Homo sapiens
gtatttttcattccaagtgaga

SEQ ID NO: 8278125 - DNA, 22 bp, Homo sapiens
gtagttagttaagatgagttta

SEQ ID NO: 8278126 - DNA, 22 bp, Homo sapiens
gtagttagagttgtgctggaga

SEQ ID NO: 8278127 - DNA, 22 bp, Homo sapiens
gtagtgggtgaggaaggaagga

SEQ ID NO: 8278128 - DNA, 22 bp, Homo sapiens
gtatacaactattgttgggtaa

SEQ ID NO: 8278129 - DNA, 22 bp, Homo sapiens
gtcacttaccagagtattttat

SEQ ID NO: 8278130 - DNA, 22 bp, Homo sapiens
gtccagctccagggaggcaggc

SEQ ID NO: 8278131 - DNA, 22 bp, Homo sapiens
gtccagccctctgcctccaggt

SEQ ID NO: 8278132 - DNA, 22 bp, Homo sapiens
gtccagcccctgactcccaggc

SEQ ID NO: 8278133 - DNA, 22 bp, Homo sapiens
gtccagccaggctgcagcaccc

SEQ ID NO: 8278134 - DNA, 22 bp, Homo sapiens
gtccagaaggaggtcaagttgg

SEQ ID NO: 8278135 - DNA, 22 bp, Homo sapiens
gtccagagagatcttctgatag

SEQ ID NO: 8278136 - DNA, 21 bp, Homo sapiens
gtccagagagccggctcctga

SEQ ID NO: 8278137 - DNA, 22 bp, Homo sapiens
gtccaggctcaaaaggttgtta

SEQ ID NO: 8278138 - DNA, 22 bp, Homo sapiens
gtccaggcctgcctctgaggag

SEQ ID NO: 8278139 - DNA, 19 bp, Homo sapiens
gtccaggcattgggttggt

SEQ ID NO: 8278140 - DNA, 19 bp, Homo sapiens
gtccaggcattgggttggt

SEQ ID NO: 8278141 - DNA, 22 bp, Homo sapiens
gtccaggcacctcccttgtgct

SEQ ID NO: 8278142 - DNA, 22 bp, Homo sapiens
gtccaggagctcagggcttatt

SEQ ID NO: 8278143 - DNA, 22 bp, Homo sapiens
gtcctggagtggcatggcatgg

SEQ ID NO: 8278144 - DNA, 22 bp, Homo sapiens
gtctccagaattcttgggaggg

SEQ ID NO: 8278145 - DNA, 22 bp, Homo sapiens
gtctccagccattctctgatca

SEQ ID NO: 8278146 - DNA, 22 bp, Homo sapiens
gtctccagcccactctagatat

SEQ ID NO: 8278147 - DNA, 22 bp, Homo sapiens
gtctccagaggttacatcctgt

SEQ ID NO: 8278148 - DNA, 22 bp, Homo sapiens
gtctccagatatcctacacaac

SEQ ID NO: 8278149 - DNA, 22 bp, Homo sapiens
gtctatgtaaacgtctacatta

SEQ ID NO: 8278150 - DNA, 22 bp, Homo sapiens
gtcttgatctcctgaccttgtg

SEQ ID NO: 8278151 - DNA, 22 bp, Homo sapiens
gtctccagttacagcagccagg

SEQ ID NO: 8278152 - DNA, 22 bp, Homo sapiens
gtctcccaaactctgatggtcc

SEQ ID NO: 8278153 - DNA, 22 bp, Homo sapiens
gtctcccaacccctgtgcccag

SEQ ID NO: 8278154 - DNA, 22 bp, Homo sapiens
gtctcccaaactctgatggtcc

SEQ ID NO: 8278155 - DNA, 22 bp, Homo sapiens
gtctcccaacccctgtgcccag

SEQ ID NO: 8278156 - DNA, 22 bp, Homo sapiens
gtctccagtgttcaggtgactg

SEQ ID NO: 8278157 - DNA, 22 bp, Homo sapiens
gtctccagggacacactagccg

SEQ ID NO: 8278158 - DNA, 22 bp, Homo sapiens
gtctccagggacacactagccg

SEQ ID NO: 8278159 - DNA, 22 bp, Homo sapiens
gtctccagggctgctggcgcct

SEQ ID NO: 8278160 - DNA, 22 bp, Homo sapiens
gtcttgtcccagctctgccact

SEQ ID NO: 8278161 - DNA, 22 bp, Homo sapiens
gtcttgtcccagctctgccact

SEQ ID NO: 8278162 - DNA, 22 bp, Homo sapiens
gtctttaagggactgaatttgg

SEQ ID NO: 8278163 - DNA, 22 bp, Homo sapiens
gtctttttgtctggcagaggtc

SEQ ID NO: 8278164 - DNA, 22 bp, Homo sapiens
gtcttttttacaccttacatca

SEQ ID NO: 8278165 - DNA, 22 bp, Homo sapiens
gtctttttattatagagtggag

SEQ ID NO: 8278166 - DNA, 22 bp, Homo sapiens
gtctttttctacgatagcgcct

SEQ ID NO: 8278167 - DNA, 22 bp, Homo sapiens
gtgaggaagtctgagagccaca

SEQ ID NO: 8278168 - DNA, 22 bp, Homo sapiens
gtgagctgttttggacccatct

SEQ ID NO: 8278169 - DNA, 22 bp, Homo sapiens
gtgagcagttgtgagccccaaa

SEQ ID NO: 8278170 - DNA, 22 bp, Homo sapiens
gtgagctggaatagtggagaaa

SEQ ID NO: 8278171 - DNA, 22 bp, Homo sapiens
gtgagctgtctgagtctcttgg

SEQ ID NO: 8278172 - DNA, 22 bp, Homo sapiens
gtgcaggcaaaagggccaggcc

SEQ ID NO: 8278173 - DNA, 22 bp, Homo sapiens
gtgccagcagttatggtgattt

SEQ ID NO: 8278174 - DNA, 22 bp, Homo sapiens
gtgccagaggcagtgaggagtt

SEQ ID NO: 8278175 - DNA, 22 bp, Homo sapiens
gtgccagacagggcagtggtat

SEQ ID NO: 8278176 - DNA, 22 bp, Homo sapiens
gtgccagaatctttgaagagag

SEQ ID NO: 8278177 - DNA, 22 bp, Homo sapiens
gtgccaggtgctaagctgtgct

SEQ ID NO: 8278178 - DNA, 22 bp, Homo sapiens
gtgccaggtgctaagctgtgct

SEQ ID NO: 8278179 - DNA, 22 bp, Homo sapiens
gcttggttactgatggaaagga

SEQ ID NO: 8278180 - DNA, 22 bp, Homo sapiens
gctttacatgagatgaggacaa

SEQ ID NO: 8278181 - DNA, 22 bp, Homo sapiens
gctttacagggcacaaagggag

SEQ ID NO: 8278182 - DNA, 22 bp, Homo sapiens
gcttgtcattactggtttctcg

SEQ ID NO: 8278183 - DNA, 22 bp, Homo sapiens
gcttaaaagccacttagtctat

SEQ ID NO: 8278184 - DNA, 22 bp, Homo sapiens
gctgtgtgctcacgtagtggaa

SEQ ID NO: 8278185 - DNA, 22 bp, Homo sapiens
gctgtgtggctgtgccgtcacg

SEQ ID NO: 8278186 - DNA, 22 bp, Homo sapiens
gctgtttaaatttaagtgtttc

SEQ ID NO: 8278187 - DNA, 22 bp, Homo sapiens
gctgtgttgggaatcatgtggg

SEQ ID NO: 8278188 - DNA, 22 bp, Homo sapiens
gctgtgttggtgaagctgtagc

SEQ ID NO: 8278189 - DNA, 22 bp, Homo sapiens
gcttttggacctctgatgtttc

SEQ ID NO: 8278190 - DNA, 22 bp, Homo sapiens
gcttttgcctacatcttggtct

SEQ ID NO: 8278191 - DNA, 22 bp, Homo sapiens
gcttttttaggtaagacccagg

SEQ ID NO: 8278192 - DNA, 22 bp, Homo sapiens
gctttatgctacgatttctagt

SEQ ID NO: 8278193 - DNA, 22 bp, Homo sapiens
gctgtctagggaggctgtcacc

SEQ ID NO: 8278194 - DNA, 22 bp, Homo sapiens
gctgtccagcccttgttcacct

SEQ ID NO: 8278195 - DNA, 22 bp, Homo sapiens
gctgtccaggagtgcagagatt

SEQ ID NO: 8278196 - DNA, 22 bp, Homo sapiens
gctgtccaggttgtggagcaac

SEQ ID NO: 8278197 - DNA, 22 bp, Homo sapiens
gctgtccagctccagccagcca

SEQ ID NO: 8278198 - DNA, 22 bp, Homo sapiens
gctgtccaacctgcactcgcgt

SEQ ID NO: 8278199 - DNA, 22 bp, Homo sapiens
gctgtccacggggttggtagag

SEQ ID NO: 8278200 - DNA, 22 bp, Homo sapiens
gctgtccagagcatgggagcaa

SEQ ID NO: 8278201 - DNA, 22 bp, Homo sapiens
gctgtccacctccagagcctta

SEQ ID NO: 8278202 - DNA, 22 bp, Homo sapiens
gctgtccatccacttcccagcg

SEQ ID NO: 8278203 - DNA, 22 bp, Homo sapiens
gctgtccatgtctggcctcagt

SEQ ID NO: 8278204 - DNA, 22 bp, Homo sapiens
gctgtgtgccaggggaaggctg

SEQ ID NO: 8278205 - DNA, 22 bp, Homo sapiens
gctgtgtgctcacgtagtggaa

SEQ ID NO: 8278206 - DNA, 22 bp, Homo sapiens
gctgtatgtttatttgggaatt

SEQ ID NO: 8278207 - DNA, 22 bp, Homo sapiens
gctgtatgtgaggccacagtga

SEQ ID NO: 8278208 - DNA, 22 bp, Homo sapiens
gctggtcccaatgtgtttcctt

SEQ ID NO: 8278209 - DNA, 22 bp, Homo sapiens
gctggtcagagagaaaggaggc

SEQ ID NO: 8278210 - DNA, 17 bp, Homo sapiens
ggagccaggagcccacc

SEQ ID NO: 8278211 - DNA, 22 bp, Homo sapiens
ggagccaggcatatcggggcac

SEQ ID NO: 8278212 - DNA, 22 bp, Homo sapiens
ggagccaggcaatctgtacttt

SEQ ID NO: 8278213 - DNA, 22 bp, Homo sapiens
ggagccagtatttagtggtctt

SEQ ID NO: 8278214 - DNA, 22 bp, Homo sapiens
ggagccagtatttagtggtctt

SEQ ID NO: 8278215 - DNA, 22 bp, Homo sapiens
ggagccagggaagctgcttcct

SEQ ID NO: 8278216 - DNA, 22 bp, Homo sapiens
ggagccagggaagctgcttcct

SEQ ID NO: 8278217 - DNA, 18 bp, Homo sapiens
ggagccagtctgtctctg

SEQ ID NO: 8278218 - DNA, 18 bp, Homo sapiens
ggagccagtctgtctctg

SEQ ID NO: 8278219 - DNA, 22 bp, Homo sapiens
ggagccagtttagacctcagtt

SEQ ID NO: 8278220 - DNA, 22 bp, Homo sapiens
ggaggaggggcgctttgtctat

SEQ ID NO: 8278221 - DNA, 22 bp, Homo sapiens
ggaggaggcggcagaagttcct

SEQ ID NO: 8278222 - DNA, 22 bp, Homo sapiens
ggacagagggttgacagagtat

SEQ ID NO: 8278223 - DNA, 22 bp, Homo sapiens
ggaaggaggggcaaagcagttc

SEQ ID NO: 8278224 - DNA, 22 bp, Homo sapiens
ggaaggaggatgctctggcctt

SEQ ID NO: 8278225 - DNA, 22 bp, Homo sapiens
ggaaggagcatttgccagttta

SEQ ID NO: 8278226 - DNA, 22 bp, Homo sapiens
ggaaggagggcggcaatgatga

SEQ ID NO: 8278227 - DNA, 22 bp, Homo sapiens
ggaaggaggatgctctggcctt

SEQ ID NO: 8278228 - DNA, 22 bp, Homo sapiens
ggaaggagcatttgccagttta

SEQ ID NO: 8278229 - DNA, 19 bp, Homo sapiens
ggaaggagagaaatgcatg

SEQ ID NO: 8278230 - DNA, 22 bp, Homo sapiens
ggaaaaatagagtatactttaa

SEQ ID NO: 8278231 - DNA, 22 bp, Homo sapiens
ggaaaaatgacacatatctcaa

SEQ ID NO: 8278232 - DNA, 22 bp, Homo sapiens
ggagaaagaagacgaacattgt

SEQ ID NO: 8278233 - DNA, 22 bp, Homo sapiens
ggactttagctgtaatgtgtgt

SEQ ID NO: 8278234 - DNA, 22 bp, Homo sapiens
ggacttacagctgatcaccttt

SEQ ID NO: 8278235 - DNA, 22 bp, Homo sapiens
ggacaggggcgtggggattgtt

SEQ ID NO: 8278236 - DNA, 20 bp, Homo sapiens
gctcccagcctgcagtcccc

SEQ ID NO: 8278237 - DNA, 22 bp, Homo sapiens
gctccctcccaccagcctgcag

SEQ ID NO: 8278238 - DNA, 22 bp, Homo sapiens
gctctctgaggtgctggcagag

SEQ ID NO: 8278239 - DNA, 22 bp, Homo sapiens
gctctctcgtgaacaggtggtt

SEQ ID NO: 8278240 - DNA, 22 bp, Homo sapiens
gctctctccctaggcaagtgag

SEQ ID NO: 8278241 - DNA, 21 bp, Homo sapiens
gctctccagggccagcccagg

SEQ ID NO: 8278242 - DNA, 22 bp, Homo sapiens
gctctccaggggctcccaggat

SEQ ID NO: 8278243 - DNA, 22 bp, Homo sapiens
gctctccaggggctcccaggat

SEQ ID NO: 8278244 - DNA, 22 bp, Homo sapiens
gctctccaggtccaagaatcca

SEQ ID NO: 8278245 - DNA, 22 bp, Homo sapiens
gctctccaggtctcatgcactg

SEQ ID NO: 8278246 - DNA, 19 bp, Homo sapiens
gctctccctctcagttgag

SEQ ID NO: 8278247 - DNA, 22 bp, Homo sapiens
gctctcccgcagcctggtgggc

SEQ ID NO: 8278248 - DNA, 19 bp, Homo sapiens
gctctgtgatgctgagggg

SEQ ID NO: 8278249 - DNA, 19 bp, Homo sapiens
gctctgtgatgctgagggg

SEQ ID NO: 8278250 - DNA, 22 bp, Homo sapiens
gctctgtgcagttcagggacac

SEQ ID NO: 8278251 - DNA, 22 bp, Homo sapiens
gctctgtgcaaatagcacccct

SEQ ID NO: 8278252 - DNA, 22 bp, Homo sapiens
gctctgtgcagttcagggacac

SEQ ID NO: 8278253 - DNA, 22 bp, Homo sapiens
gctctgtgcagttcagggacac

SEQ ID NO: 8278254 - DNA, 22 bp, Homo sapiens
gctctgtgccacatgcagtgtt

SEQ ID NO: 8278255 - DNA, 22 bp, Homo sapiens
gctctgtgccacatgcagtgtt

SEQ ID NO: 8278256 - DNA, 22 bp, Homo sapiens
gctctgtgccacatgcagtgtt

SEQ ID NO: 8278257 - DNA, 22 bp, Homo sapiens
gctctgtggcattcatgggcag

SEQ ID NO: 8278258 - DNA, 20 bp, Homo sapiens
gctctgtgctggcggaggct

SEQ ID NO: 8278259 - DNA, 20 bp, Homo sapiens
gctctgtgctggcggaggct

SEQ ID NO: 8278260 - DNA, 22 bp, Homo sapiens
gctctgtgcccctgccgtggac

SEQ ID NO: 8278261 - DNA, 22 bp, Homo sapiens
gctctgtgccagggctgggcca

SEQ ID NO: 8278262 - DNA, 22 bp, Homo sapiens
gctctgtgccagggctgggcca

SEQ ID NO: 8278263 - DNA, 22 bp, Homo sapiens
gctctgtgctagaactaagaat

SEQ ID NO: 8278264 - DNA, 22 bp, Homo sapiens
gctctgtgaccttaggcaagtt

SEQ ID NO: 8278265 - DNA, 18 bp, Homo sapiens
gctctgtgaccttgagca

SEQ ID NO: 8278266 - DNA, 21 bp, Homo sapiens
gctctgtgaaatttcaccagg

SEQ ID NO: 8278267 - DNA, 22 bp, Homo sapiens
gctctgtgagccacttgatgta

SEQ ID NO: 8278268 - DNA, 22 bp, Homo sapiens
gctctctgccatatgaggatac

SEQ ID NO: 8278269 - DNA, 22 bp, Homo sapiens
gctctgggtagccactgcctgg

SEQ ID NO: 8278270 - DNA, 22 bp, Homo sapiens
gctagggcgggagtgctggaga

SEQ ID NO: 8278271 - DNA, 22 bp, Homo sapiens
gctagggatctgatttgctgtt

SEQ ID NO: 8278272 - DNA, 22 bp, Homo sapiens
gcctggcagcccctagacattt

SEQ ID NO: 8278273 - DNA, 22 bp, Homo sapiens
gcctggcagcctccaaccttca

SEQ ID NO: 8278274 - DNA, 22 bp, Homo sapiens
gcctggcaggaatctcagtgct

SEQ ID NO: 8278275 - DNA, 22 bp, Homo sapiens
gcctggcactcactgaagaggc

SEQ ID NO: 8278276 - DNA, 22 bp, Homo sapiens
gcctggcactcaatcatctgct

SEQ ID NO: 8278277 - DNA, 16 bp, Homo sapiens
gcctggcaccgtcggc

SEQ ID NO: 8278278 - DNA, 22 bp, Homo sapiens
gcctggcacgggctcggcccac

SEQ ID NO: 8278279 - DNA, 22 bp, Homo sapiens
gcctggcactgggctcctggcc

SEQ ID NO: 8278280 - DNA, 22 bp, Homo sapiens
gcctggcagattgacatagcca

SEQ ID NO: 8278281 - DNA, 22 bp, Homo sapiens
gcctggcaccacagcctttcag

SEQ ID NO: 8278282 - DNA, 20 bp, Homo sapiens
gcctggcacccggggctggc

SEQ ID NO: 8278283 - DNA, 22 bp, Homo sapiens
gctcccagcaattgaggcagcc

SEQ ID NO: 8278284 - DNA, 20 bp, Homo sapiens
gctcagggcctgggtctgga

SEQ ID NO: 8278285 - DNA, 22 bp, Homo sapiens
gctgctgcttgaaggctcggag

SEQ ID NO: 8278286 - DNA, 23 bp, Homo sapiens
gctgcctctgttggtcttcagtt

SEQ ID NO: 8278287 - DNA, 22 bp, Homo sapiens
gctgcctctgtagctttggacc

SEQ ID NO: 8278288 - DNA, 22 bp, Homo sapiens
gctgctggggtcacatggtaag

SEQ ID NO: 8278289 - DNA, 22 bp, Homo sapiens
gctggagcttgagaggacaggg

SEQ ID NO: 8278290 - DNA, 22 bp, Homo sapiens
gctggagctgcagcctgggcct

SEQ ID NO: 8278291 - DNA, 22 bp, Homo sapiens
gctgcaggcggccgtggtggcg

SEQ ID NO: 8278292 - DNA, 22 bp, Homo sapiens
gctgcaggcgcctgcggtctct

SEQ ID NO: 8278293 - DNA, 22 bp, Homo sapiens
gctgcaggctctgcaggaattg

SEQ ID NO: 8278294 - DNA, 22 bp, Homo sapiens
gctgcaggctctgcaggaattg

SEQ ID NO: 8278295 - DNA, 22 bp, Homo sapiens
gctgcagggaatgtatggattt

SEQ ID NO: 8278296 - DNA, 22 bp, Homo sapiens
gctgcaggctgtggcaggggag

SEQ ID NO: 8278297 - DNA, 22 bp, Homo sapiens
gctgcagggagctggaaggctc

SEQ ID NO: 8278298 - DNA, 22 bp, Homo sapiens
gctgcagggagctggaaggctc

SEQ ID NO: 8278299 - DNA, 21 bp, Homo sapiens
gctgcagggcccagggcaccc

SEQ ID NO: 8278300 - DNA, 21 bp, Homo sapiens
gctgcagggcccagggcaccc

SEQ ID NO: 8278301 - DNA, 22 bp, Homo sapiens
gctgcagggctctcacaggggg

SEQ ID NO: 8278302 - DNA, 22 bp, Homo sapiens
gctgcagggctctcacaggggg

SEQ ID NO: 8278303 - DNA, 22 bp, Homo sapiens
gctgcagggctctcacaggggg

SEQ ID NO: 8278304 - DNA, 22 bp, Homo sapiens
gctgcagggctctcacaggggg

SEQ ID NO: 8278305 - DNA, 22 bp, Homo sapiens
gctgcctccaatctgtgccccg

SEQ ID NO: 8278306 - DNA, 22 bp, Homo sapiens
gctgcaggggggtctggacttg

SEQ ID NO: 8278307 - DNA, 22 bp, Homo sapiens
gctgcagggctctcacaggggg

SEQ ID NO: 8278308 - DNA, 22 bp, Homo sapiens
gctgcctcctgaaagcgctctg

SEQ ID NO: 8278309 - DNA, 22 bp, Homo sapiens
gctgcctcctgagatttgggca

SEQ ID NO: 8278310 - DNA, 23 bp, Homo sapiens
gctgcctcctacaaaagcccagc

SEQ ID NO: 8278311 - DNA, 22 bp, Homo sapiens
gctgcctctgcgactctgggcg

SEQ ID NO: 8278312 - DNA, 22 bp, Homo sapiens
gctgcctctgcacagctcactc

SEQ ID NO: 8278313 - DNA, 22 bp, Homo sapiens
gctgcctctcctgagttgacag

SEQ ID NO: 8278314 - DNA, 22 bp, Homo sapiens
gctgcctcccccatggctggaa

SEQ ID NO: 8278315 - DNA, 22 bp, Homo sapiens
gctgcctccgccggctccacag

SEQ ID NO: 8278316 - DNA, 22 bp, Homo sapiens
gctgcctccactggctcccagt

SEQ ID NO: 8278317 - DNA, 22 bp, Homo sapiens
gctgcctcccagagccctgcag

SEQ ID NO: 8278318 - DNA, 18 bp, Homo sapiens
gctgcaggcgcctgcggt

SEQ ID NO: 8278319 - DNA, 22 bp, Homo sapiens
gctgcaggcattttcctgggca

SEQ ID NO: 8278320 - DNA, 18 bp, Homo sapiens
gctgcaggccctccgagg

SEQ ID NO: 8278321 - DNA, 18 bp, Homo sapiens
gctgcaggccctccgagg

SEQ ID NO: 8278322 - DNA, 22 bp, Homo sapiens
gctgagttgaaagcagaggata

SEQ ID NO: 8278323 - DNA, 22 bp, Homo sapiens
gctgcaggcagaatctcccaat

SEQ ID NO: 8278324 - DNA, 22 bp, Homo sapiens
gctgcaggatgaggctctgctc

SEQ ID NO: 8278325 - DNA, 22 bp, Homo sapiens
gctgcaggatgaggctctgctc

SEQ ID NO: 8278326 - DNA, 22 bp, Homo sapiens
gctgcaggcagaatctcccaat

SEQ ID NO: 8278327 - DNA, 22 bp, Homo sapiens
gctgcaggcagaatctcccaat

SEQ ID NO: 8278328 - DNA, 22 bp, Homo sapiens
gctgagtggagcagtcagcgct

SEQ ID NO: 8278329 - DNA, 22 bp, Homo sapiens
gctgagtggagcagtcagcgct

SEQ ID NO: 8278330 - DNA, 22 bp, Homo sapiens
gctgagtgtaatgatggcagag

SEQ ID NO: 8278331 - DNA, 22 bp, Homo sapiens
gctgagtgaggaaaaggttata

SEQ ID NO: 8278332 - DNA, 22 bp, Homo sapiens
gctgagtgaggctgtcaaaatg

SEQ ID NO: 8278333 - DNA, 22 bp, Homo sapiens
gctgagtgaggtccagagcttg

SEQ ID NO: 8278334 - DNA, 22 bp, Homo sapiens
gctgagtgattcatacgctgct

SEQ ID NO: 8278335 - DNA, 22 bp, Homo sapiens
gctgagtgaggtccagagcttg

SEQ ID NO: 8278336 - DNA, 22 bp, Homo sapiens
gctgagtgaggtccagagcttg

SEQ ID NO: 8278337 - DNA, 22 bp, Homo sapiens
gctgaggttttctgcctgctca

SEQ ID NO: 8278338 - DNA, 22 bp, Homo sapiens
gctgaggtttcaggagtggcag

SEQ ID NO: 8278339 - DNA, 18 bp, Homo sapiens
gctgaggtggtgtcagag

SEQ ID NO: 8278340 - DNA, 22 bp, Homo sapiens
gctctgtgtccacagctggaaa

SEQ ID NO: 8278341 - DNA, 22 bp, Homo sapiens
gctgagggctgtaacagcagag

SEQ ID NO: 8278342 - DNA, 23 bp, Homo sapiens
gctgaggtacatttacaggaaga

SEQ ID NO: 8278343 - DNA, 22 bp, Homo sapiens
gctctgtggtggggcagagttt

SEQ ID NO: 8278344 - DNA, 22 bp, Homo sapiens
gctctgtgggggaaatcctggg

SEQ ID NO: 8278345 - DNA, 22 bp, Homo sapiens
gctctgtgggggaaatcctggg

SEQ ID NO: 8278346 - DNA, 22 bp, Homo sapiens
gcagacagccagactgcactgg

SEQ ID NO: 8278347 - DNA, 23 bp, Homo sapiens
gcagacagagcagactaagacaa

SEQ ID NO: 8278348 - DNA, 22 bp, Homo sapiens
gcagacagatgagggtgctggg

SEQ ID NO: 8278349 - DNA, 22 bp, Homo sapiens
gcagacagatgagggtgctggg

SEQ ID NO: 8278350 - DNA, 22 bp, Homo sapiens
gcagacacttgaggtgggcttt

SEQ ID NO: 8278351 - DNA, 22 bp, Homo sapiens
gcagacacttcccactgcagcg

SEQ ID NO: 8278352 - DNA, 22 bp, Homo sapiens
gcacccagcccagggcgtgatg

SEQ ID NO: 8278353 - DNA, 20 bp, Homo sapiens
gcacccagcttcttgttcta

SEQ ID NO: 8278354 - DNA, 22 bp, Homo sapiens
gcagaaggatccgcaggtgcaa

SEQ ID NO: 8278355 - DNA, 22 bp, Homo sapiens
gcacccagccagcatctcagag

SEQ ID NO: 8278356 - DNA, 22 bp, Homo sapiens
gcacccagaggtcagcagtgct

SEQ ID NO: 8278357 - DNA, 22 bp, Homo sapiens
gcacccagaggtcagcagtgct

SEQ ID NO: 8278358 - DNA, 22 bp, Homo sapiens
gcaccagctgccttctgtgccc

SEQ ID NO: 8278359 - DNA, 22 bp, Homo sapiens
gcaccagctgcagggtggctga

SEQ ID NO: 8278360 - DNA, 22 bp, Homo sapiens
gcaccagagggggctctgcagg

SEQ ID NO: 8278361 - DNA, 22 bp, Homo sapiens
gcagagtgagccgaggctgctc

SEQ ID NO: 8278362 - DNA, 22 bp, Homo sapiens
gcagagtgggagcccagggctg

SEQ ID NO: 8278363 - DNA, 22 bp, Homo sapiens
gcagaggtgctcagtggcagaa

SEQ ID NO: 8278364 - DNA, 22 bp, Homo sapiens
gcagacagggctacagaggtac

SEQ ID NO: 8278365 - DNA, 22 bp, Homo sapiens
gcagagtatgagcatggcttta

SEQ ID NO: 8278366 - DNA, 22 bp, Homo sapiens
gcagaggtgtgggaggggccac

SEQ ID NO: 8278367 - DNA, 22 bp, Homo sapiens
gcacatgccccattcttgtcac

SEQ ID NO: 8278368 - DNA, 22 bp, Homo sapiens
gcacagagtcactagctaagca

SEQ ID NO: 8278369 - DNA, 22 bp, Homo sapiens
gcacagagaggctgtgagcgcc

SEQ ID NO: 8278370 - DNA, 17 bp, Homo sapiens
gcacagaggccaaagga

SEQ ID NO: 8278371 - DNA, 20 bp, Homo sapiens
gcacagagatgagcaaagta

SEQ ID NO: 8278372 - DNA, 22 bp, Homo sapiens
gcacagagagtcccgggtgccc

SEQ ID NO: 8278373 - DNA, 22 bp, Homo sapiens
gcacagacagaatccctactcc

SEQ ID NO: 8278374 - DNA, 20 bp, Homo sapiens
gcaaggctccaaggggtgtg

SEQ ID NO: 8278375 - DNA, 21 bp, Homo sapiens
gcaaggctcattcttgttgta

SEQ ID NO: 8278376 - DNA, 22 bp, Homo sapiens
gcaaggctcacattgaactgaa

SEQ ID NO: 8278377 - DNA, 22 bp, Homo sapiens
gcaataaataacatggaagaca

SEQ ID NO: 8278378 - DNA, 22 bp, Homo sapiens
gcaaggctcccgcagcccaggg

SEQ ID NO: 8278379 - DNA, 22 bp, Homo sapiens
gcaaggaggctggtggaggaag

SEQ ID NO: 8278380 - DNA, 22 bp, Homo sapiens
gcaaggagcctggaggtgagtg

SEQ ID NO: 8278381 - DNA, 22 bp, Homo sapiens
gcaaggaagagcaggtggtgct

SEQ ID NO: 8278382 - DNA, 22 bp, Homo sapiens
gcaaggactccctgggtcattc

SEQ ID NO: 8278383 - DNA, 22 bp, Homo sapiens
gcaaggaagcagagttgctatc

SEQ ID NO: 8278384 - DNA, 17 bp, Homo sapiens
gcaaggaagttctttgc

SEQ ID NO: 8278385 - DNA, 22 bp, Homo sapiens
gcagcactaatgggccccagaa

SEQ ID NO: 8278386 - DNA, 22 bp, Homo sapiens
gcagcaaggatgaagcacttgg

SEQ ID NO: 8278387 - DNA, 22 bp, Homo sapiens
gcagcaagtctagtttgtaggc

SEQ ID NO: 8278388 - DNA, 22 bp, Homo sapiens
gcagcagcccagggctctcaga

SEQ ID NO: 8278389 - DNA, 21 bp, Homo sapiens
gcagccagccgagaccatgcc

SEQ ID NO: 8278390 - DNA, 21 bp, Homo sapiens
gcagccagccgagaccatgcc

SEQ ID NO: 8278391 - DNA, 22 bp, Homo sapiens
gcagccagccctagtcccactt

SEQ ID NO: 8278392 - DNA, 21 bp, Homo sapiens
gcagccagccgagaccatgcc

SEQ ID NO: 8278393 - DNA, 22 bp, Homo sapiens
gcagccaggaaagctggaccct

SEQ ID NO: 8278394 - DNA, 21 bp, Homo sapiens
gcagccagacgggattcagtt

SEQ ID NO: 8278395 - DNA, 21 bp, Homo sapiens
gcagccagacgggattcagtt

SEQ ID NO: 8278396 - DNA, 22 bp, Homo sapiens
gcagccagaagactcagaacaa

SEQ ID NO: 8278397 - DNA, 22 bp, Homo sapiens
gcagccagcaggaagcgggaga

SEQ ID NO: 8278398 - DNA, 22 bp, Homo sapiens
gcagcccaagagactctgttga

SEQ ID NO: 8278399 - DNA, 23 bp, Homo sapiens
gcagccatgttcccgtctcagct

SEQ ID NO: 8278400 - DNA, 22 bp, Homo sapiens
gcagccagtgggatgagaaaga

SEQ ID NO: 8278401 - DNA, 17 bp, Homo sapiens
gcagccagtgcagcagg

SEQ ID NO: 8278402 - DNA, 22 bp, Homo sapiens
gcagccaggaagcccaggacac

SEQ ID NO: 8278403 - DNA, 22 bp, Homo sapiens
gcagccaggaagcccaggacac

SEQ ID NO: 8278404 - DNA, 22 bp, Homo sapiens
gcagccagtatcctctgagatt

SEQ ID NO: 8278405 - DNA, 17 bp, Homo sapiens
gcagccagtgcagcagg

SEQ ID NO: 8278406 - DNA, 22 bp, Homo sapiens
gcaggtctagaagctgcctctg

SEQ ID NO: 8278407 - DNA, 22 bp, Homo sapiens
gcaggtagtgatcgagggtgac

SEQ ID NO: 8278408 - DNA, 22 bp, Homo sapiens
gcaggtagcattttttgacaaa

SEQ ID NO: 8278409 - DNA, 19 bp, Homo sapiens
gcagggtgttgactgtccc

SEQ ID NO: 8278410 - DNA, 22 bp, Homo sapiens
gcaggtgatgtgatgtgagcat

SEQ ID NO: 8278411 - DNA, 22 bp, Homo sapiens
gcaggtgatgtgatgtgagcat

SEQ ID NO: 8278412 - DNA, 22 bp, Homo sapiens
gcaggtgaatgatggactagga

SEQ ID NO: 8278413 - DNA, 22 bp, Homo sapiens
gcaggtgatgtgatgtgagcat

SEQ ID NO: 8278414 - DNA, 22 bp, Homo sapiens
gcaggtgagggtgtctgaatag

SEQ ID NO: 8278415 - DNA, 22 bp, Homo sapiens
gcaggtgagggtgtctgaatag

SEQ ID NO: 8278416 - DNA, 22 bp, Homo sapiens
gcaggtgaaagtgagtagtgag

SEQ ID NO: 8278417 - DNA, 22 bp, Homo sapiens
gcaggtgaaagtgagtagtgag

SEQ ID NO: 8278418 - DNA, 22 bp, Homo sapiens
gcagggccaggtacaagaagca

SEQ ID NO: 8278419 - DNA, 22 bp, Homo sapiens
gcagggccagtgcagagaggaa

SEQ ID NO: 8278420 - DNA, 22 bp, Homo sapiens
gcagggccagggctcaggctgt

SEQ ID NO: 8278421 - DNA, 22 bp, Homo sapiens
gcagggcagctgaagctaggtg

SEQ ID NO: 8278422 - DNA, 22 bp, Homo sapiens
gcagggcagctgaagctaggtg

SEQ ID NO: 8278423 - DNA, 22 bp, Homo sapiens
gcaggccacagtggagtctctg

SEQ ID NO: 8278424 - DNA, 19 bp, Homo sapiens
gcaggccaggaggcggagg

SEQ ID NO: 8278425 - DNA, 22 bp, Homo sapiens
gccagctgggccttagggctgg

SEQ ID NO: 8278426 - DNA, 22 bp, Homo sapiens
gccagctgtctaagagagtaaa

SEQ ID NO: 8278427 - DNA, 22 bp, Homo sapiens
gccagaagcacatgagaggtga

SEQ ID NO: 8278428 - DNA, 22 bp, Homo sapiens
gccagctgaggccgtgcaggct

SEQ ID NO: 8278429 - DNA, 18 bp, Homo sapiens
gccaggaagaggaatgtg

SEQ ID NO: 8278430 - DNA, 22 bp, Homo sapiens
gccaggaagagagagccctcca

SEQ ID NO: 8278431 - DNA, 22 bp, Homo sapiens
gccaggaagttgggccagtcta

SEQ ID NO: 8278432 - DNA, 22 bp, Homo sapiens
gccaggcatgtcctctgcagaa

SEQ ID NO: 8278433 - DNA, 22 bp, Homo sapiens
gccaggaagtgcagccctgcca

SEQ ID NO: 8278434 - DNA, 22 bp, Homo sapiens
gccaggaagtcagccaagccca

SEQ ID NO: 8278435 - DNA, 22 bp, Homo sapiens
gccaggaaggctgaagccagaa

SEQ ID NO: 8278436 - DNA, 22 bp, Homo sapiens
gccaggaaaaaccggccctgct

SEQ ID NO: 8278437 - DNA, 22 bp, Homo sapiens
gccaggaaaaagggtggccaat

SEQ ID NO: 8278438 - DNA, 22 bp, Homo sapiens
gccagctgtttcagagcccagt

SEQ ID NO: 8278439 - DNA, 22 bp, Homo sapiens
gcccaagctggactgcagtggc

SEQ ID NO: 8278440 - DNA, 22 bp, Homo sapiens
gcagttttagagctttaagatg

SEQ ID NO: 8278441 - DNA, 22 bp, Homo sapiens
gcagtttagtagatgacattat

SEQ ID NO: 8278442 - DNA, 22 bp, Homo sapiens
gcaggtgattcaccctgggcct

SEQ ID NO: 8278443 - DNA, 22 bp, Homo sapiens
gcagtgtttttcaatgcttcca

SEQ ID NO: 8278444 - DNA, 22 bp, Homo sapiens
gcattggcatttctccagcgga

SEQ ID NO: 8278445 - DNA, 23 bp, Homo sapiens
gccacctcctggtcagaaagagg

SEQ ID NO: 8278446 - DNA, 20 bp, Homo sapiens
gccacctctctagcagtaga

SEQ ID NO: 8278447 - DNA, 22 bp, Homo sapiens
gccactgttcttctttgttcca

SEQ ID NO: 8278448 - DNA, 20 bp, Homo sapiens
gcccaaggtccagaaggggg

SEQ ID NO: 8278449 - DNA, 22 bp, Homo sapiens
gcccacagaggcaccaccaggc

SEQ ID NO: 8278450 - DNA, 22 bp, Homo sapiens
gcccacagctcgttcctctcct

SEQ ID NO: 8278451 - DNA, 22 bp, Homo sapiens
gcccctctcccttgaggcaggc

SEQ ID NO: 8278452 - DNA, 22 bp, Homo sapiens
gcccctggctggccagctcctc

SEQ ID NO: 8278453 - DNA, 22 bp, Homo sapiens
gccctcagaggacagctgactt

SEQ ID NO: 8278454 - DNA, 20 bp, Homo sapiens
gcctccacactcacccctta

SEQ ID NO: 8278455 - DNA, 18 bp, Homo sapiens
gcctccaccatggagggt

SEQ ID NO: 8278456 - DNA, 20 bp, Homo sapiens
gcctccaccccaggcttcag

SEQ ID NO: 8278457 - DNA, 20 bp, Homo sapiens
gcctccacactcacccctta

SEQ ID NO: 8278458 - DNA, 22 bp, Homo sapiens
gccctgcctgtctgctgggagg

SEQ ID NO: 8278459 - DNA, 22 bp, Homo sapiens
gcctgcagtgagtgcagaaggt

SEQ ID NO: 8278460 - DNA, 22 bp, Homo sapiens
gcctgcagggcctgggcctacc

SEQ ID NO: 8278461 - DNA, 20 bp, Homo sapiens
gcctgcagagaaggtcagag

SEQ ID NO: 8278462 - DNA, 22 bp, Homo sapiens
gcctgcagcctcaagggctgag

SEQ ID NO: 8278463 - DNA, 22 bp, Homo sapiens
gcctgcagcccctctgcagtag

SEQ ID NO: 8278464 - DNA, 22 bp, Homo sapiens
gcctgcagctgcttccacacac

SEQ ID NO: 8278465 - DNA, 22 bp, Homo sapiens
gcctccctccaccactgcaggt

SEQ ID NO: 8278466 - DNA, 22 bp, Homo sapiens
gcctccctccaccactgcaggt

SEQ ID NO: 8278467 - DNA, 22 bp, Homo sapiens
gcctccacccctggggagtgga

SEQ ID NO: 8278468 - DNA, 22 bp, Homo sapiens
gcctccaccgaacgctctcttg

SEQ ID NO: 8278469 - DNA, 22 bp, Homo sapiens
gcctccactgatcagacttgac

SEQ ID NO: 8278470 - DNA, 22 bp, Homo sapiens
gcctccacttctttagtatgac

SEQ ID NO: 8278471 - DNA, 22 bp, Homo sapiens
gcctccctgttcttccacaata

SEQ ID NO: 8278472 - DNA, 22 bp, Homo sapiens
gcctccctgtttcctgctccaa

SEQ ID NO: 8278473 - DNA, 22 bp, Homo sapiens
tccgtaaagtcttacaatgtct

SEQ ID NO: 8278474 - DNA, 22 bp, Homo sapiens
tccgtaaatggttggttaaggc

SEQ ID NO: 8278475 - DNA, 23 bp, Homo sapiens
tccctggaggcaggtccagggcc

SEQ ID NO: 8278476 - DNA, 23 bp, Homo sapiens
tccctggaggcaggtccagggcc

SEQ ID NO: 8278477 - DNA, 22 bp, Homo sapiens
tcctagttctctgccagtcgct

SEQ ID NO: 8278478 - DNA, 22 bp, Homo sapiens
tccctctgctagtgcttgagct

SEQ ID NO: 8278479 - DNA, 22 bp, Homo sapiens
tccctctgttctgttccaagtg

SEQ ID NO: 8278480 - DNA, 22 bp, Homo sapiens
tccctgaatctcgaactagcct

SEQ ID NO: 8278481 - DNA, 22 bp, Homo sapiens
tcccagggacaccaagctgttt

SEQ ID NO: 8278482 - DNA, 22 bp, Homo sapiens
tcccaggctggcaggcagcagt

SEQ ID NO: 8278483 - DNA, 22 bp, Homo sapiens
tcccaggctggcaggcagcagt

SEQ ID NO: 8278484 - DNA, 22 bp, Homo sapiens
tcccaggctaggcctctgcgtt

SEQ ID NO: 8278485 - DNA, 20 bp, Homo sapiens
tcccaggctgggctccagct

SEQ ID NO: 8278486 - DNA, 22 bp, Homo sapiens
tcccaggctgggggcctgaagt

SEQ ID NO: 8278487 - DNA, 22 bp, Homo sapiens
tccagggcttgacagggtgcct

SEQ ID NO: 8278488 - DNA, 18 bp, Homo sapiens
tccagggcttcctcctct

SEQ ID NO: 8278489 - DNA, 19 bp, Homo sapiens
tccagggctttatggcttt

SEQ ID NO: 8278490 - DNA, 21 bp, Homo sapiens
tccagggctttgattctctca

SEQ ID NO: 8278491 - DNA, 23 bp, Homo sapiens
tccagggctggccagacctcggt

SEQ ID NO: 8278492 - DNA, 22 bp, Homo sapiens
tccagggctgggttggctcagc

SEQ ID NO: 8278493 - DNA, 22 bp, Homo sapiens
tccagggacacagagtccttct

SEQ ID NO: 8278494 - DNA, 22 bp, Homo sapiens
tccagggctgacttgggagagg

SEQ ID NO: 8278495 - DNA, 22 bp, Homo sapiens
tccagggaagagcagaggctac

SEQ ID NO: 8278496 - DNA, 22 bp, Homo sapiens
tccagggaaggtgtgaggctgg

SEQ ID NO: 8278497 - DNA, 22 bp, Homo sapiens
tccagggaaggtgtgaggctgg

SEQ ID NO: 8278498 - DNA, 21 bp, Homo sapiens
tccagggaatttcaactttta

SEQ ID NO: 8278499 - DNA, 22 bp, Homo sapiens
tccaggcctctagccctctctt

SEQ ID NO: 8278500 - DNA, 18 bp, Homo sapiens
tccaggcctgaagtgtcc

SEQ ID NO: 8278501 - DNA, 22 bp, Homo sapiens
tccaggcctctagcccctatct

SEQ ID NO: 8278502 - DNA, 22 bp, Homo sapiens
tccacaaggcagctcctccagg

SEQ ID NO: 8278503 - DNA, 20 bp, Homo sapiens
tccaggccttgttctcagat

SEQ ID NO: 8278504 - DNA, 22 bp, Homo sapiens
tccaggcctggctccattcagt

SEQ ID NO: 8278505 - DNA, 22 bp, Homo sapiens
tccaggctagagtgcagtggcc

SEQ ID NO: 8278506 - DNA, 22 bp, Homo sapiens
tccaggctggagtgcagtggca

SEQ ID NO: 8278507 - DNA, 22 bp, Homo sapiens
tccaggctggagtgcagtggcg

SEQ ID NO: 8278508 - DNA, 22 bp, Homo sapiens
tcccagcctggaccctgccagt

SEQ ID NO: 8278509 - DNA, 22 bp, Homo sapiens
tcccagcataacaaactgcccg

SEQ ID NO: 8278510 - DNA, 22 bp, Homo sapiens
tcccagcattaatgcctgtcag

SEQ ID NO: 8278511 - DNA, 22 bp, Homo sapiens
tcccagaggtctctgctggttc

SEQ ID NO: 8278512 - DNA, 22 bp, Homo sapiens
tcccagaggtctctgctggttc

SEQ ID NO: 8278513 - DNA, 22 bp, Homo sapiens
tcccagaggcagttggtaactt

SEQ ID NO: 8278514 - DNA, 22 bp, Homo sapiens
tcccagaggctccagtctctat

SEQ ID NO: 8278515 - DNA, 22 bp, Homo sapiens
tcccagagccaagctatggatg

SEQ ID NO: 8278516 - DNA, 22 bp, Homo sapiens
tccatggagtttttatttggta

SEQ ID NO: 8278517 - DNA, 22 bp, Homo sapiens
tcccaaagaactgaatagtaat

SEQ ID NO: 8278518 - DNA, 22 bp, Homo sapiens
tccatttagctggcaaacaatg

SEQ ID NO: 8278519 - DNA, 22 bp, Homo sapiens
tccatttaactgtccccagcac

SEQ ID NO: 8278520 - DNA, 22 bp, Homo sapiens
tcccaagacctggcatccaagt

SEQ ID NO: 8278521 - DNA, 22 bp, Homo sapiens
tcccaaagtattagcatttcaa

SEQ ID NO: 8278522 - DNA, 22 bp, Homo sapiens
tcccagagaagagctggatgga

SEQ ID NO: 8278523 - DNA, 22 bp, Homo sapiens
tcccagagaagagctggatgga

SEQ ID NO: 8278524 - DNA, 22 bp, Homo sapiens
tcccagagcagtactccaggag

SEQ ID NO: 8278525 - DNA, 22 bp, Homo sapiens
tcctgagagcagagtccaggtg

SEQ ID NO: 8278526 - DNA, 22 bp, Homo sapiens
tcctgagagccttggcttcaga

SEQ ID NO: 8278527 - DNA, 22 bp, Homo sapiens
tcctctggtcctgcagcagatc

SEQ ID NO: 8278528 - DNA, 19 bp, Homo sapiens
tcctctggtaccacccttg

SEQ ID NO: 8278529 - DNA, 22 bp, Homo sapiens
tcctctggttatacttgcaccc

SEQ ID NO: 8278530 - DNA, 22 bp, Homo sapiens
tcctgagtgtttggccaggcca

SEQ ID NO: 8278531 - DNA, 22 bp, Homo sapiens
tcctgagataggagttgaaggc

SEQ ID NO: 8278532 - DNA, 22 bp, Homo sapiens
tcctgagcacctatgccatggc

SEQ ID NO: 8278533 - DNA, 22 bp, Homo sapiens
tcctgcaggcttgagtcctcag

SEQ ID NO: 8278534 - DNA, 22 bp, Homo sapiens
tcctgcagctgaagctcatgtg

SEQ ID NO: 8278535 - DNA, 22 bp, Homo sapiens
tcctgcagacctcagtcaggtc

SEQ ID NO: 8278536 - DNA, 19 bp, Homo sapiens
tcctgcagaccagacctgt

SEQ ID NO: 8278537 - DNA, 21 bp, Homo sapiens
tcctgcagaatgccttcctac

SEQ ID NO: 8278538 - DNA, 21 bp, Homo sapiens
tcctgcaccctccctgtggct

SEQ ID NO: 8278539 - DNA, 22 bp, Homo sapiens
tcctgcagcatccgtcgtctgt

SEQ ID NO: 8278540 - DNA, 22 bp, Homo sapiens
tcctgcagccactgcaggcaga

SEQ ID NO: 8278541 - DNA, 22 bp, Homo sapiens
tcctgcctcttttcttattcca

SEQ ID NO: 8278542 - DNA, 22 bp, Homo sapiens
tcctgcctctccatgctaacta

SEQ ID NO: 8278543 - DNA, 22 bp, Homo sapiens
tcagaacaattcctttataaca

SEQ ID NO: 8278544 - DNA, 22 bp, Homo sapiens
tcagaacagaagaaggaacacg

SEQ ID NO: 8278545 - DNA, 22 bp, Homo sapiens
tcacatttgtgttttattagag

SEQ ID NO: 8278546 - DNA, 22 bp, Homo sapiens
tcacatttgttcctctgcactt

SEQ ID NO: 8278547 - DNA, 22 bp, Homo sapiens
tcacatttgttcttgaatctaa

SEQ ID NO: 8278548 - DNA, 22 bp, Homo sapiens
tcactgcaacctccacctcccg

SEQ ID NO: 8278549 - DNA, 22 bp, Homo sapiens
tcacattttatctattttaagt

SEQ ID NO: 8278550 - DNA, 22 bp, Homo sapiens
tcactgcaacctccacctcccg

SEQ ID NO: 8278551 - DNA, 22 bp, Homo sapiens
tcactgctcgataacatgatta

SEQ ID NO: 8278552 - DNA, 22 bp, Homo sapiens
tcactgcaacctccacctcctg

SEQ ID NO: 8278553 - DNA, 22 bp, Homo sapiens
tcactgcaacctccacctcctg

SEQ ID NO: 8278554 - DNA, 22 bp, Homo sapiens
tcacatactgaaagtccagtga

SEQ ID NO: 8278555 - DNA, 18 bp, Homo sapiens
tcacatacttaggccctc

SEQ ID NO: 8278556 - DNA, 16 bp, Homo sapiens
tcacatacttccttgc

SEQ ID NO: 8278557 - DNA, 22 bp, Homo sapiens
tcacagttttaagtgtgatcca

SEQ ID NO: 8278558 - DNA, 22 bp, Homo sapiens
tcaaatgaggctgatgaatgtg

SEQ ID NO: 8278559 - DNA, 22 bp, Homo sapiens
tcaagaaatgtgcttggatata

SEQ ID NO: 8278560 - DNA, 22 bp, Homo sapiens
tcaagaaaatgacgccaacctt

SEQ ID NO: 8278561 - DNA, 22 bp, Homo sapiens
tcagccacttccctctggtcag

SEQ ID NO: 8278562 - DNA, 22 bp, Homo sapiens
tcagccagcatcagctaagtgc

SEQ ID NO: 8278563 - DNA, 22 bp, Homo sapiens
tcagccagccagctacaggctt

SEQ ID NO: 8278564 - DNA, 22 bp, Homo sapiens
tcagccagagggggcaaaggaa

SEQ ID NO: 8278565 - DNA, 22 bp, Homo sapiens
tcagcagttgccccctcccagc

SEQ ID NO: 8278566 - DNA, 22 bp, Homo sapiens
tcagcagttttatatgcagctt

SEQ ID NO: 8278567 - DNA, 22 bp, Homo sapiens
tcagcagtgtgcccagaggctg

SEQ ID NO: 8278568 - DNA, 22 bp, Homo sapiens
tcagcagtgtcagttcccagag

SEQ ID NO: 8278569 - DNA, 22 bp, Homo sapiens
tcagcagtgtcagttcccagag

SEQ ID NO: 8278570 - DNA, 22 bp, Homo sapiens
tcagcagttcaaccccgtcaga

SEQ ID NO: 8278571 - DNA, 22 bp, Homo sapiens
tcagcagttattcccctacaga

SEQ ID NO: 8278572 - DNA, 22 bp, Homo sapiens
tcagcagtgtgcttggaatgga

SEQ ID NO: 8278573 - DNA, 22 bp, Homo sapiens
tcagctgcctttcccatgctag

SEQ ID NO: 8278574 - DNA, 22 bp, Homo sapiens
tcagctgcctctccctggaaga

SEQ ID NO: 8278575 - DNA, 22 bp, Homo sapiens
tcagctgcgacaggggcctgag

SEQ ID NO: 8278576 - DNA, 22 bp, Homo sapiens
tcagctgccccgggcactgccc

SEQ ID NO: 8278577 - DNA, 22 bp, Homo sapiens
tcagctgccccatgtgttcact

SEQ ID NO: 8278578 - DNA, 22 bp, Homo sapiens
tcagctgctcaaatttatgtca

SEQ ID NO: 8278579 - DNA, 22 bp, Homo sapiens
tcagctgctctgttgagctgaa

SEQ ID NO: 8278580 - DNA, 23 bp, Homo sapiens
tcagctgcttcctcctgcctgcc

SEQ ID NO: 8278581 - DNA, 22 bp, Homo sapiens
tcagctgcttcatgttctgaat

SEQ ID NO: 8278582 - DNA, 22 bp, Homo sapiens
tcagctgctgtggtatgtacat

SEQ ID NO: 8278583 - DNA, 22 bp, Homo sapiens
tcagccagctgtgtgcttctgc

SEQ ID NO: 8278584 - DNA, 22 bp, Homo sapiens
tcagccagctcttggactctga

SEQ ID NO: 8278585 - DNA, 20 bp, Homo sapiens
tcagccagctaacatgggga

SEQ ID NO: 8278586 - DNA, 22 bp, Homo sapiens
tcagccaggcacaatggcagct

SEQ ID NO: 8278587 - DNA, 22 bp, Homo sapiens
tcagccaggccaccttcagctt

SEQ ID NO: 8278588 - DNA, 22 bp, Homo sapiens
tcagctctgcctgtggaggcac

SEQ ID NO: 8278589 - DNA, 22 bp, Homo sapiens
tcagctggagactgctcaatga

SEQ ID NO: 8278590 - DNA, 22 bp, Homo sapiens
tcagctggcagttcagaggctg

SEQ ID NO: 8278591 - DNA, 22 bp, Homo sapiens
tcagctgggaagttctcgcttg

SEQ ID NO: 8278592 - DNA, 22 bp, Homo sapiens
tcagctggtgaatggactcatc

SEQ ID NO: 8278593 - DNA, 22 bp, Homo sapiens
tcagacacagatgagacaagga

SEQ ID NO: 8278594 - DNA, 22 bp, Homo sapiens
tcagacagagaagtacaatgag

SEQ ID NO: 8278595 - DNA, 22 bp, Homo sapiens
tcagcagggccatgctctctct

SEQ ID NO: 8278596 - DNA, 22 bp, Homo sapiens
tcagcagggcctccttgtgcag

SEQ ID NO: 8278597 - DNA, 22 bp, Homo sapiens
tcagcagggcatactgagccta

SEQ ID NO: 8278598 - DNA, 22 bp, Homo sapiens
tcagcagggagaggagaatgca

SEQ ID NO: 8278599 - DNA, 22 bp, Homo sapiens
tcagcagggaggctctgtgccc

SEQ ID NO: 8278600 - DNA, 22 bp, Homo sapiens
tcagcagggaggctctgtgccc

SEQ ID NO: 8278601 - DNA, 17 bp, Homo sapiens
tcagcaggggccaagct

SEQ ID NO: 8278602 - DNA, 22 bp, Homo sapiens
tcagcagggctgtggtgtggct

SEQ ID NO: 8278603 - DNA, 22 bp, Homo sapiens
tcagcagtgtagtttatcattc

SEQ ID NO: 8278604 - DNA, 22 bp, Homo sapiens
tcagcaggggccgttgggtgga

SEQ ID NO: 8278605 - DNA, 22 bp, Homo sapiens
tcagcagtgggtcctgagggtg

SEQ ID NO: 8278606 - DNA, 22 bp, Homo sapiens
tcagcagggcctccttgtgcag

SEQ ID NO: 8278607 - DNA, 22 bp, Homo sapiens
tcagcagggctgggagctgtga

SEQ ID NO: 8278608 - DNA, 22 bp, Homo sapiens
tcagcaggcaggaggcatgcca

SEQ ID NO: 8278609 - DNA, 22 bp, Homo sapiens
tcagcaggcagtgggtcacaat

SEQ ID NO: 8278610 - DNA, 22 bp, Homo sapiens
tcagcaggcccatcctccaggc

SEQ ID NO: 8278611 - DNA, 22 bp, Homo sapiens
tcagcaggcccatcctccaggc

SEQ ID NO: 8278612 - DNA, 22 bp, Homo sapiens
tcagcaggctgtcagcaggggc

SEQ ID NO: 8278613 - DNA, 22 bp, Homo sapiens
tcagcaggcggttccttgtggg

SEQ ID NO: 8278614 - DNA, 22 bp, Homo sapiens
tcagcaggctctggttgaccat

SEQ ID NO: 8278615 - DNA, 22 bp, Homo sapiens
tcagcaggcagaaatctgcaga

SEQ ID NO: 8278616 - DNA, 22 bp, Homo sapiens
tcagcaggcagaaatctgcaga

SEQ ID NO: 8278617 - DNA, 22 bp, Homo sapiens
tcagcaagaagctgtgggcttc

SEQ ID NO: 8278618 - DNA, 22 bp, Homo sapiens
tcagcaacctgcttgaggaggc

SEQ ID NO: 8278619 - DNA, 22 bp, Homo sapiens
tcagcaaaggcaattcattatt

SEQ ID NO: 8278620 - DNA, 22 bp, Homo sapiens
tccaaagcatttggctcccacc

SEQ ID NO: 8278621 - DNA, 22 bp, Homo sapiens
tccaaagcatttggctcccacc

SEQ ID NO: 8278622 - DNA, 22 bp, Homo sapiens
tccaaagaacctggctactgtc

SEQ ID NO: 8278623 - DNA, 23 bp, Homo sapiens
tccaaatacctgtcaccttgtct

SEQ ID NO: 8278624 - DNA, 22 bp, Homo sapiens
tccaaatagctggatgatggtg

SEQ ID NO: 8278625 - DNA, 22 bp, Homo sapiens
tccaaataccagatgggctaat

SEQ ID NO: 8278626 - DNA, 22 bp, Homo sapiens
tccaaatagttctggaagactg

SEQ ID NO: 8278627 - DNA, 22 bp, Homo sapiens
tccaaatatacagaatctcctc

SEQ ID NO: 8278628 - DNA, 22 bp, Homo sapiens
tccaaatatagatgagttgtaa

SEQ ID NO: 8278629 - DNA, 22 bp, Homo sapiens
tccaaatataggatgtgatata

SEQ ID NO: 8278630 - DNA, 22 bp, Homo sapiens
tccaaatacatttactgtattt

SEQ ID NO: 8278631 - DNA, 22 bp, Homo sapiens
tccaaagtgttgggattatagg

SEQ ID NO: 8278632 - DNA, 22 bp, Homo sapiens
tccaaagccgactgacatctga

SEQ ID NO: 8278633 - DNA, 21 bp, Homo sapiens
tccaaaggagactgagtgtgt

SEQ ID NO: 8278634 - DNA, 22 bp, Homo sapiens
tccaaaggcaaaactgtggtgt

SEQ ID NO: 8278635 - DNA, 22 bp, Homo sapiens
tcatttttagcgcgcaaaagtt

SEQ ID NO: 8278636 - DNA, 22 bp, Homo sapiens
tccaaatattcggtctttctga

SEQ ID NO: 8278637 - DNA, 22 bp, Homo sapiens
tccaaatattcatctacttctg

SEQ ID NO: 8278638 - DNA, 22 bp, Homo sapiens
tccaaatatattcacgtcctag

SEQ ID NO: 8278639 - DNA, 22 bp, Homo sapiens
tccaaatatcttggtggttagg

SEQ ID NO: 8278640 - DNA, 22 bp, Homo sapiens
tccaaatattatgattatagga

SEQ ID NO: 8278641 - DNA, 22 bp, Homo sapiens
tccaagctactgaaggtttggg

SEQ ID NO: 8278642 - DNA, 22 bp, Homo sapiens
tccaaggctccggccctggcgt

SEQ ID NO: 8278643 - DNA, 22 bp, Homo sapiens
tccaaggccgcaggctgggcct

SEQ ID NO: 8278644 - DNA, 22 bp, Homo sapiens
tccaatatttctcatatatgga

SEQ ID NO: 8278645 - DNA, 22 bp, Homo sapiens
tcatttataaggatgcaattaa

SEQ ID NO: 8278646 - DNA, 22 bp, Homo sapiens
tcatttatcatttgtgctgtag

SEQ ID NO: 8278647 - DNA, 22 bp, Homo sapiens
tcatctttaccccttgcttcaa

SEQ ID NO: 8278648 - DNA, 22 bp, Homo sapiens
tcatctttcctcaaaagatcca

SEQ ID NO: 8278649 - DNA, 22 bp, Homo sapiens
tcatctgggagcttgttagaaa

SEQ ID NO: 8278650 - DNA, 22 bp, Homo sapiens
tcatctgaggcaccagagcata

SEQ ID NO: 8278651 - DNA, 22 bp, Homo sapiens
tcatctgaggtttgaggcagtt

SEQ ID NO: 8278652 - DNA, 22 bp, Homo sapiens
tcatacatctgtcctggagctc

SEQ ID NO: 8278653 - DNA, 22 bp, Homo sapiens
tcatacatgttgtgttcaaatg

SEQ ID NO: 8278654 - DNA, 22 bp, Homo sapiens
tcatacatcttgtatatctatc

SEQ ID NO: 8278655 - DNA, 18 bp, Homo sapiens
tcatagaagtgaatcaga

SEQ ID NO: 8278656 - DNA, 18 bp, Homo sapiens
tcatagaagtgaatcaga

SEQ ID NO: 8278657 - DNA, 22 bp, Homo sapiens
tcatagaaatggaaagtatatt

SEQ ID NO: 8278658 - DNA, 22 bp, Homo sapiens
tcatacattcagcagatatttg

SEQ ID NO: 8278659 - DNA, 22 bp, Homo sapiens
tcagtatgatgagagggaaatt

SEQ ID NO: 8278660 - DNA, 22 bp, Homo sapiens
tcagttaatggattctgtcaga

SEQ ID NO: 8278661 - DNA, 22 bp, Homo sapiens
tcagtaacttacttattcacct

SEQ ID NO: 8278662 - DNA, 22 bp, Homo sapiens
tcagtaactgggttgaagctag

SEQ ID NO: 8278663 - DNA, 22 bp, Homo sapiens
tcagtagcagaaagcaatgagt

SEQ ID NO: 8278664 - DNA, 22 bp, Homo sapiens
tcagtacacttcagtatttgtg

SEQ ID NO: 8278665 - DNA, 22 bp, Homo sapiens
tcagtacagcttagtcttctca

SEQ ID NO: 8278666 - DNA, 19 bp, Homo sapiens
tcagtatataattacacca

SEQ ID NO: 8278667 - DNA, 22 bp, Homo sapiens
tcagggccgccggggatctcgc

SEQ ID NO: 8278668 - DNA, 22 bp, Homo sapiens
tcagggccctggacaaccctcc

SEQ ID NO: 8278669 - DNA, 22 bp, Homo sapiens
tcaggctgtatatcttgcactc

SEQ ID NO: 8278670 - DNA, 18 bp, Homo sapiens
taacatgttttcattaag

SEQ ID NO: 8278671 - DNA, 18 bp, Homo sapiens
taacatgttttcattaag

SEQ ID NO: 8278672 - DNA, 18 bp, Homo sapiens
taacatgttttcattaag

SEQ ID NO: 8278673 - DNA, 22 bp, Homo sapiens
taacatgtttgtacactgaaac

SEQ ID NO: 8278674 - DNA, 22 bp, Homo sapiens
taacatgtgtattggtttccta

SEQ ID NO: 8278675 - DNA, 22 bp, Homo sapiens
taacatgttcagactacctgtg

SEQ ID NO: 8278676 - DNA, 22 bp, Homo sapiens
taacatgtccctgattctttgt

SEQ ID NO: 8278677 - DNA, 22 bp, Homo sapiens
taagagcattgtaaaataatct

SEQ ID NO: 8278678 - DNA, 22 bp, Homo sapiens
taagagaactggatagatagga

SEQ ID NO: 8278679 - DNA, 22 bp, Homo sapiens
taagagaactggatagatagga

SEQ ID NO: 8278680 - DNA, 22 bp, Homo sapiens
taacagcatttgaatgagtaac

SEQ ID NO: 8278681 - DNA, 20 bp, Homo sapiens
taacagtaagtgatgttaca

SEQ ID NO: 8278682 - DNA, 22 bp, Homo sapiens
taacagtattgaagataaacta

SEQ ID NO: 8278683 - DNA, 22 bp, Homo sapiens
taacagtatagcctaacatttc

SEQ ID NO: 8278684 - DNA, 22 bp, Homo sapiens
taaaaggcaatactagatgagt

SEQ ID NO: 8278685 - DNA, 22 bp, Homo sapiens
taaaaggcacttggatgctgag

SEQ ID NO: 8278686 - DNA, 22 bp, Homo sapiens
taaaagtatactttcaaaggag

SEQ ID NO: 8278687 - DNA, 22 bp, Homo sapiens
taaagacataggatcagggaga

SEQ ID NO: 8278688 - DNA, 23 bp, Homo sapiens
taaagacagccttcaggattctg

SEQ ID NO: 8278689 - DNA, 22 bp, Homo sapiens
taaaacttaactatccagatta

SEQ ID NO: 8278690 - DNA, 22 bp, Homo sapiens
taaaactgaatacatactgagg

SEQ ID NO: 8278691 - DNA, 22 bp, Homo sapiens
taaaactgaatacatactgagg

SEQ ID NO: 8278692 - DNA, 22 bp, Homo sapiens
taaaagattttataggaacaag

SEQ ID NO: 8278693 - DNA, 22 bp, Homo sapiens
taaatgcaaagcttggcgctta

SEQ ID NO: 8278694 - DNA, 22 bp, Homo sapiens
taaatgcaagggaaaggcaaga

SEQ ID NO: 8278695 - DNA, 22 bp, Homo sapiens
taaatgcaagtgctcctgggag

SEQ ID NO: 8278696 - DNA, 22 bp, Homo sapiens
taaatgcaatgtgctttaccag

SEQ ID NO: 8278697 - DNA, 20 bp, Homo sapiens
taaatgcatctgttcaactg

SEQ ID NO: 8278698 - DNA, 20 bp, Homo sapiens
taaatgcatgaatgtaaggc

SEQ ID NO: 8278699 - DNA, 18 bp, Homo sapiens
taaatgcatgttaataac

SEQ ID NO: 8278700 - DNA, 22 bp, Homo sapiens
taaatgcagcagtttctgttct

SEQ ID NO: 8278701 - DNA, 22 bp, Homo sapiens
taaatgcagattcctgagccta

SEQ ID NO: 8278702 - DNA, 22 bp, Homo sapiens
taaatgcagtacaaattgttct

SEQ ID NO: 8278703 - DNA, 22 bp, Homo sapiens
taaatgcagttagtacttgcca

SEQ ID NO: 8278704 - DNA, 22 bp, Homo sapiens
taaagattgctcaaaactgtga

SEQ ID NO: 8278705 - DNA, 22 bp, Homo sapiens
taaagatgttctcatttcatag

SEQ ID NO: 8278706 - DNA, 21 bp, Homo sapiens
gttatacattctatggatttg

SEQ ID NO: 8278707 - DNA, 22 bp, Homo sapiens
gttcttcagtcacatcacagaa

SEQ ID NO: 8278708 - DNA, 22 bp, Homo sapiens
gtgttgatgacattttagaaac

SEQ ID NO: 8278709 - DNA, 22 bp, Homo sapiens
gtgttcttgccaaggccaacat

SEQ ID NO: 8278710 - DNA, 22 bp, Homo sapiens
gtgttcttttgcttcacagaaa

SEQ ID NO: 8278711 - DNA, 22 bp, Homo sapiens
gtgttgatgacattttagaaac

SEQ ID NO: 8278712 - DNA, 22 bp, Homo sapiens
gtgttcaggcttccactgtatg

SEQ ID NO: 8278713 - DNA, 22 bp, Homo sapiens
gtgttcaggctgacttggagag

SEQ ID NO: 8278714 - DNA, 19 bp, Homo sapiens
gtgtttactgtgtgcagaa

SEQ ID NO: 8278715 - DNA, 22 bp, Homo sapiens
gttaacattcaattaaacagtc

SEQ ID NO: 8278716 - DNA, 22 bp, Homo sapiens
gttgaaatcctaaccccctagt

SEQ ID NO: 8278717 - DNA, 22 bp, Homo sapiens
gttgaagtaaggcagccacagg

SEQ ID NO: 8278718 - DNA, 22 bp, Homo sapiens
gttctttaaactgctgctctgt

SEQ ID NO: 8278719 - DNA, 22 bp, Homo sapiens
gttctttaagtggagaaggaaa

SEQ ID NO: 8278720 - DNA, 22 bp, Homo sapiens
gttctttaacctagtctcattt

SEQ ID NO: 8278721 - DNA, 22 bp, Homo sapiens
gtttgaatgcagtatgcatttt

SEQ ID NO: 8278722 - DNA, 22 bp, Homo sapiens
gtttcacagatggggagacacg

SEQ ID NO: 8278723 - DNA, 22 bp, Homo sapiens
gtttcacagatggtgttcatat

SEQ ID NO: 8278724 - DNA, 22 bp, Homo sapiens
gtttcaagggaactgttttggt

SEQ ID NO: 8278725 - DNA, 22 bp, Homo sapiens
gtttcaagtagctgctgattat

SEQ ID NO: 8278726 - DNA, 22 bp, Homo sapiens
gtttcttttaaaatatgtagac

SEQ ID NO: 8278727 - DNA, 22 bp, Homo sapiens
gtttctttctattgactgaaca

SEQ ID NO: 8278728 - DNA, 22 bp, Homo sapiens
tacacataggagggtaataaaa

SEQ ID NO: 8278729 - DNA, 22 bp, Homo sapiens
tacagacagtttttcagatatt

SEQ ID NO: 8278730 - DNA, 22 bp, Homo sapiens
tacacacagaggccatgggatt

SEQ ID NO: 8278731 - DNA, 22 bp, Homo sapiens
tacacataaaatgctcatggta

SEQ ID NO: 8278732 - DNA, 22 bp, Homo sapiens
tacacatacattgcttacaagg

SEQ ID NO: 8278733 - DNA, 22 bp, Homo sapiens
tacacatacaccaatgtggtca

SEQ ID NO: 8278734 - DNA, 22 bp, Homo sapiens
tacacaatctgtttttccattt

SEQ ID NO: 8278735 - DNA, 22 bp, Homo sapiens
taatttcaatagcttgcataat

SEQ ID NO: 8278736 - DNA, 22 bp, Homo sapiens
taatttatttcaactgccaagg

SEQ ID NO: 8278737 - DNA, 22 bp, Homo sapiens
tacaaccgtcttgattctttcg

SEQ ID NO: 8278738 - DNA, 22 bp, Homo sapiens
taattgaactaacatgcaaaca

SEQ ID NO: 8278739 - DNA, 22 bp, Homo sapiens
taatttatatggaattgttgct

SEQ ID NO: 8278740 - DNA, 22 bp, Homo sapiens
taatttatgatgcaaagaaaag

SEQ ID NO: 8278741 - DNA, 22 bp, Homo sapiens
taattctagattgacattttga

SEQ ID NO: 8278742 - DNA, 22 bp, Homo sapiens
taattatttgaagacattagag

SEQ ID NO: 8278743 - DNA, 22 bp, Homo sapiens
taattcagctgaacaactgtgt

SEQ ID NO: 8278744 - DNA, 22 bp, Homo sapiens
taaggaggctgctgtgaagaaa

SEQ ID NO: 8278745 - DNA, 22 bp, Homo sapiens
taaggaggcgaggtggtgagca

SEQ ID NO: 8278746 - DNA, 22 bp, Homo sapiens
taaggagggggaatgattggca

SEQ ID NO: 8278747 - DNA, 22 bp, Homo sapiens
taaggaggtgcccactctcagg

SEQ ID NO: 8278748 - DNA, 22 bp, Homo sapiens
taaggaggttggtgggttggat

SEQ ID NO: 8278749 - DNA, 22 bp, Homo sapiens
taaggaggcagtcattatcagg

SEQ ID NO: 8278750 - DNA, 22 bp, Homo sapiens
taaggacattggttttgagtaa

SEQ ID NO: 8278751 - DNA, 22 bp, Homo sapiens
taaggacattagaaatgatgct

SEQ ID NO: 8278752 - DNA, 22 bp, Homo sapiens
taaggacagcagctacttttcc

SEQ ID NO: 8278753 - DNA, 22 bp, Homo sapiens
taaggacaatttgtcgcttgca

SEQ ID NO: 8278754 - DNA, 22 bp, Homo sapiens
taaggacaatcaggttagtagc

SEQ ID NO: 8278755 - DNA, 22 bp, Homo sapiens
taatatacttcccatagtttga

SEQ ID NO: 8278756 - DNA, 22 bp, Homo sapiens
taatataccaaactgtaatttt

SEQ ID NO: 8278757 - DNA, 22 bp, Homo sapiens
taaggaagtcacaagaatcgct

SEQ ID NO: 8278758 - DNA, 22 bp, Homo sapiens
taaggaaggggaaagacatgtc

SEQ ID NO: 8278759 - DNA, 22 bp, Homo sapiens
taaggaagagcttggtaatagg

SEQ ID NO: 8278760 - DNA, 22 bp, Homo sapiens
taccagggaacagggatattaa

SEQ ID NO: 8278761 - DNA, 22 bp, Homo sapiens
taccatgctctgcatctcacaa

SEQ ID NO: 8278762 - DNA, 22 bp, Homo sapiens
taccatgcttgagatacagtga

SEQ ID NO: 8278763 - DNA, 22 bp, Homo sapiens
taccatgctggctcataatcag

SEQ ID NO: 8278764 - DNA, 22 bp, Homo sapiens
taccatttcagtaaaaacttag

SEQ ID NO: 8278765 - DNA, 22 bp, Homo sapiens
taccagcaatgtatgagtgttt

SEQ ID NO: 8278766 - DNA, 22 bp, Homo sapiens
taccagcctgaccctgtctgac

SEQ ID NO: 8278767 - DNA, 22 bp, Homo sapiens
taccaatgataagacagataat

SEQ ID NO: 8278768 - DNA, 22 bp, Homo sapiens
taccagcaactggaagtcagat

SEQ ID NO: 8278769 - DNA, 22 bp, Homo sapiens
taccagcaatgctagtcaactc

SEQ ID NO: 8278770 - DNA, 22 bp, Homo sapiens
taccactgataccttggagttc

SEQ ID NO: 8278771 - DNA, 22 bp, Homo sapiens
taccatttgagagagaacataa

SEQ ID NO: 8278772 - DNA, 22 bp, Homo sapiens
taccattttgaaacatttcatc

SEQ ID NO: 8278773 - DNA, 22 bp, Homo sapiens
tactacattaataaaacattca

SEQ ID NO: 8278774 - DNA, 17 bp, Homo sapiens
tactagaatagagacag

SEQ ID NO: 8278775 - DNA, 22 bp, Homo sapiens
tactgaaagaatacataatttc

SEQ ID NO: 8278776 - DNA, 22 bp, Homo sapiens
tactgtactcaacatgtgagtt

SEQ ID NO: 8278777 - DNA, 22 bp, Homo sapiens
tactgaaactcttgtaaatatc

SEQ ID NO: 8278778 - DNA, 22 bp, Homo sapiens
tactgaaaatcctgcctgtcct

SEQ ID NO: 8278779 - DNA, 22 bp, Homo sapiens
tactgaaacttttcttcaactg

SEQ ID NO: 8278780 - DNA, 22 bp, Homo sapiens
tactgaaaaagaatccagacct

SEQ ID NO: 8278781 - DNA, 22 bp, Homo sapiens
tactgaaaactgagtcttccgt

SEQ ID NO: 8278782 - DNA, 22 bp, Homo sapiens
tactgaaaagccacaaggacca

SEQ ID NO: 8278783 - DNA, 22 bp, Homo sapiens
tactcccaccatggctgatttc

SEQ ID NO: 8278784 - DNA, 22 bp, Homo sapiens
tactgttagagccagaaaccta

SEQ ID NO: 8278785 - DNA, 22 bp, Homo sapiens
tactgttagagcgatttgtcct

SEQ ID NO: 8278786 - DNA, 22 bp, Homo sapiens
tacatgacatttctttctgttc

SEQ ID NO: 8278787 - DNA, 22 bp, Homo sapiens
tacatgaacctttatgtgtgat

SEQ ID NO: 8278788 - DNA, 22 bp, Homo sapiens
tacatgaagatgaatgtatggc

SEQ ID NO: 8278789 - DNA, 22 bp, Homo sapiens
tacatgtacatgcataggtaga

SEQ ID NO: 8278790 - DNA, 22 bp, Homo sapiens
tacatgtaggtgacattttaat

SEQ ID NO: 8278791 - DNA, 22 bp, Homo sapiens
taccaagtgtattatgctttgt

SEQ ID NO: 8278792 - DNA, 22 bp, Homo sapiens
taccaaagttttctgagtgata

SEQ ID NO: 8278793 - DNA, 22 bp, Homo sapiens
tacagtggaaaactcagtgtgt

SEQ ID NO: 8278794 - DNA, 22 bp, Homo sapiens
tacagagatttattgctaaggc

SEQ ID NO: 8278795 - DNA, 20 bp, Homo sapiens
tacagacatgacaataatgg

SEQ ID NO: 8278796 - DNA, 22 bp, Homo sapiens
tagtttctaaactgaactgtca

SEQ ID NO: 8278797 - DNA, 22 bp, Homo sapiens
tagttttgattagtattgtctt

SEQ ID NO: 8278798 - DNA, 22 bp, Homo sapiens
tagtttttactgcgagttataa

SEQ ID NO: 8278799 - DNA, 22 bp, Homo sapiens
tagtttcatctccaccctgccc

SEQ ID NO: 8278800 - DNA, 22 bp, Homo sapiens
tagttaggggaaaaacgacagg

SEQ ID NO: 8278801 - DNA, 22 bp, Homo sapiens
tagttagggttctgcagagaca

SEQ ID NO: 8278802 - DNA, 22 bp, Homo sapiens
tagttaggaatagcagcgactc

SEQ ID NO: 8278803 - DNA, 22 bp, Homo sapiens
tagttatggagtaattttaagc

SEQ ID NO: 8278804 - DNA, 22 bp, Homo sapiens
tagttaggaaagtccagggagc

SEQ ID NO: 8278805 - DNA, 22 bp, Homo sapiens
tagtttaatggtcaactaatga

SEQ ID NO: 8278806 - DNA, 22 bp, Homo sapiens
taggggaggccaggaagtttta

SEQ ID NO: 8278807 - DNA, 22 bp, Homo sapiens
taggggaggggatcatgtgctg

SEQ ID NO: 8278808 - DNA, 22 bp, Homo sapiens
tagtgcagggttttaagcactg

SEQ ID NO: 8278809 - DNA, 22 bp, Homo sapiens
tagctggggctttcattcttgc

SEQ ID NO: 8278810 - DNA, 22 bp, Homo sapiens
tagctgggtctctgttttctca

SEQ ID NO: 8278811 - DNA, 22 bp, Homo sapiens
tagctggtcctcagctccagcc

SEQ ID NO: 8278812 - DNA, 22 bp, Homo sapiens
tagctgttaagttgtttggaaa

SEQ ID NO: 8278813 - DNA, 22 bp, Homo sapiens
tagctgtgtagacactcagagc

SEQ ID NO: 8278814 - DNA, 22 bp, Homo sapiens
tagggcagattcggtggagttt

SEQ ID NO: 8278815 - DNA, 22 bp, Homo sapiens
tagggcagagtccaggatgggc

SEQ ID NO: 8278816 - DNA, 22 bp, Homo sapiens
tagggcagccacccaggctgct

SEQ ID NO: 8278817 - DNA, 22 bp, Homo sapiens
tagggcagctgcatcaggcact

SEQ ID NO: 8278818 - DNA, 22 bp, Homo sapiens
tagagagagctgtggtggctct

SEQ ID NO: 8278819 - DNA, 22 bp, Homo sapiens
tagagaaaaccactggtgagct

SEQ ID NO: 8278820 - DNA, 22 bp, Homo sapiens
tagagaaaagcagggatcagga

SEQ ID NO: 8278821 - DNA, 22 bp, Homo sapiens
tagagaaacagaaccaacaggg

SEQ ID NO: 8278822 - DNA, 22 bp, Homo sapiens
tagatacatacattttaaaatg

SEQ ID NO: 8278823 - DNA, 22 bp, Homo sapiens
tagatacatttttctttcctgt

SEQ ID NO: 8278824 - DNA, 22 bp, Homo sapiens
tagatatgacagcagaacaagc

SEQ ID NO: 8278825 - DNA, 23 bp, Homo sapiens
tagactgcaggctccttgagggc

SEQ ID NO: 8278826 - DNA, 22 bp, Homo sapiens
tagcaaagaggagacctaggca

SEQ ID NO: 8278827 - DNA, 22 bp, Homo sapiens
tagcaaagaagatattattgca

SEQ ID NO: 8278828 - DNA, 21 bp, Homo sapiens
tagcaaagccagatgtatatt

SEQ ID NO: 8278829 - DNA, 22 bp, Homo sapiens
tagcaaagcccttgctgtgtaa

SEQ ID NO: 8278830 - DNA, 22 bp, Homo sapiens
tagatctgatacaattcatctg

SEQ ID NO: 8278831 - DNA, 22 bp, Homo sapiens
tagcaaaggtagagttttgaga

SEQ ID NO: 8278832 - DNA, 22 bp, Homo sapiens
tagcaaagctccgtagttattt

SEQ ID NO: 8278833 - DNA, 22 bp, Homo sapiens
tagcaaaggatgactatgtacc

SEQ ID NO: 8278834 - DNA, 22 bp, Homo sapiens
tagcaaatgcctggttaattag

SEQ ID NO: 8278835 - DNA, 22 bp, Homo sapiens
tagcaacaagtgactatctata

SEQ ID NO: 8278836 - DNA, 22 bp, Homo sapiens
tagcaacataagaaacattttg

SEQ ID NO: 8278837 - DNA, 22 bp, Homo sapiens
tagcaacatggttatcacatta

SEQ ID NO: 8278838 - DNA, 22 bp, Homo sapiens
tagcaacaatggaagtaacttc

SEQ ID NO: 8278839 - DNA, 22 bp, Homo sapiens
tagcaacagaaaataggagtgc

SEQ ID NO: 8278840 - DNA, 18 bp, Homo sapiens
tagcagggcttgtccttt

SEQ ID NO: 8278841 - DNA, 22 bp, Homo sapiens
tagcagggtaaatgtagatgga

SEQ ID NO: 8278842 - DNA, 22 bp, Homo sapiens
tagcaggggtagatagagtgtg

SEQ ID NO: 8278843 - DNA, 22 bp, Homo sapiens
tagcagggtccaatgtgaggca

SEQ ID NO: 8278844 - DNA, 22 bp, Homo sapiens
tagctgcacaggaagtaagatt

SEQ ID NO: 8278845 - DNA, 22 bp, Homo sapiens
tagcagggtctcaggagtcagg

SEQ ID NO: 8278846 - DNA, 22 bp, Homo sapiens
tagctgggaattatctggttgc

SEQ ID NO: 8278847 - DNA, 22 bp, Homo sapiens
tagctgggaattatctggttgc

SEQ ID NO: 8278848 - DNA, 22 bp, Homo sapiens
tagcagggatacaaggtcgcct

SEQ ID NO: 8278849 - DNA, 22 bp, Homo sapiens
tagcagggccaggctgggaacc

SEQ ID NO: 8278850 - DNA, 22 bp, Homo sapiens
tagcagggaagatgatcagaat

SEQ ID NO: 8278851 - DNA, 22 bp, Homo sapiens
tagcagggaaggtgtgctgagc

SEQ ID NO: 8278852 - DNA, 22 bp, Homo sapiens
tagcagggagggccagtgtcaa

SEQ ID NO: 8278853 - DNA, 22 bp, Homo sapiens
tatgaattctcttgtgtatagt

SEQ ID NO: 8278854 - DNA, 23 bp, Homo sapiens
tatctttttcaatgttggaaata

SEQ ID NO: 8278855 - DNA, 22 bp, Homo sapiens
tatctttgtgtcccttttgatg

SEQ ID NO: 8278856 - DNA, 22 bp, Homo sapiens
tatcatttagagtatttcttca

SEQ ID NO: 8278857 - DNA, 22 bp, Homo sapiens
tatcagcaactcagagcagtct

SEQ ID NO: 8278858 - DNA, 19 bp, Homo sapiens
tatcactgggcactgagga

SEQ ID NO: 8278859 - DNA, 19 bp, Homo sapiens
tatcactgggcactgagga

SEQ ID NO: 8278860 - DNA, 18 bp, Homo sapiens
tatcactgctgaacaaga

SEQ ID NO: 8278861 - DNA, 22 bp, Homo sapiens
tatcactacacctggctaatta

SEQ ID NO: 8278862 - DNA, 22 bp, Homo sapiens
tatgtttggcctggcaatttca

SEQ ID NO: 8278863 - DNA, 22 bp, Homo sapiens
tattaacacgtataaagtgttt

SEQ ID NO: 8278864 - DNA, 23 bp, Homo sapiens
tatgtcatgagcatattgaatgt

SEQ ID NO: 8278865 - DNA, 22 bp, Homo sapiens
tattaacattttatgaaaataa

SEQ ID NO: 8278866 - DNA, 22 bp, Homo sapiens
tattaacatgaactgacttttc

SEQ ID NO: 8278867 - DNA, 22 bp, Homo sapiens
tattaacattttatgaaaataa

SEQ ID NO: 8278868 - DNA, 22 bp, Homo sapiens
tattaattcttgccaattctcc

SEQ ID NO: 8278869 - DNA, 22 bp, Homo sapiens
tattaattcttgccaattctcc

SEQ ID NO: 8278870 - DNA, 22 bp, Homo sapiens
tatgtattattcatcagtggga

SEQ ID NO: 8278871 - DNA, 22 bp, Homo sapiens
tatgtattctcagatttactaa

SEQ ID NO: 8278872 - DNA, 22 bp, Homo sapiens
tatgtcaaaaaagattatgttt

SEQ ID NO: 8278873 - DNA, 22 bp, Homo sapiens
tatgtattctgagtacaagttc

SEQ ID NO: 8278874 - DNA, 22 bp, Homo sapiens
tatgtagacttcattgtttact

SEQ ID NO: 8278875 - DNA, 22 bp, Homo sapiens
tatggtcagaccaaactgttct

SEQ ID NO: 8278876 - DNA, 22 bp, Homo sapiens
tatgtactctaatttgtctcat

SEQ ID NO: 8278877 - DNA, 22 bp, Homo sapiens
tatgtacatatacacgtgtgtg

SEQ ID NO: 8278878 - DNA, 22 bp, Homo sapiens
tatgtacatacatgtgcatacg

SEQ ID NO: 8278879 - DNA, 22 bp, Homo sapiens
tatgctttgcaattggaaaagg

SEQ ID NO: 8278880 - DNA, 22 bp, Homo sapiens
tatggaaaaatgtatcttgtca

SEQ ID NO: 8278881 - DNA, 22 bp, Homo sapiens
tatggaaactaattcatttttc

SEQ ID NO: 8278882 - DNA, 22 bp, Homo sapiens
tattgtcacgtcttaattctag

SEQ ID NO: 8278883 - DNA, 22 bp, Homo sapiens
tattgtcaagaagtttatagtg

SEQ ID NO: 8278884 - DNA, 22 bp, Homo sapiens
tattacaaattataatgggaga

SEQ ID NO: 8278885 - DNA, 22 bp, Homo sapiens
tattacaagaaagggcatgaat

SEQ ID NO: 8278886 - DNA, 23 bp, Homo sapiens
tattacaattggtcttattaaga

SEQ ID NO: 8278887 - DNA, 22 bp, Homo sapiens
tatttaaaatagtgctccagca

SEQ ID NO: 8278888 - DNA, 22 bp, Homo sapiens
tatttaaccagttaaatttcca

SEQ ID NO: 8278889 - DNA, 22 bp, Homo sapiens
tatttggaaaggacatgtaagt

SEQ ID NO: 8278890 - DNA, 22 bp, Homo sapiens
tatttgcaggcttttgtcatgg

SEQ ID NO: 8278891 - DNA, 22 bp, Homo sapiens
tatttgcaggcttttgtcatgg

SEQ ID NO: 8278892 - DNA, 22 bp, Homo sapiens
tatttgcaggacatagatatgg

SEQ ID NO: 8278893 - DNA, 22 bp, Homo sapiens
tatttgcaggacatagatatgg

SEQ ID NO: 8278894 - DNA, 22 bp, Homo sapiens
tatttaattagtgattgtagag

SEQ ID NO: 8278895 - DNA, 22 bp, Homo sapiens
tatttgaccgtgaggaatatga

SEQ ID NO: 8278896 - DNA, 22 bp, Homo sapiens
tatttgactcttaggaagactc

SEQ ID NO: 8278897 - DNA, 22 bp, Homo sapiens
tatttgatagagataaatgata

SEQ ID NO: 8278898 - DNA, 22 bp, Homo sapiens
tattttggctgattcatcatgt

SEQ ID NO: 8278899 - DNA, 22 bp, Homo sapiens
tattttgaggtatttttgagct

SEQ ID NO: 8278900 - DNA, 22 bp, Homo sapiens
tcaaagatgatgctgaagttat

SEQ ID NO: 8278901 - DNA, 22 bp, Homo sapiens
tcaaagtaccagagtgaactga

SEQ ID NO: 8278902 - DNA, 22 bp, Homo sapiens
tcaaagtagccggatggaattt

SEQ ID NO: 8278903 - DNA, 22 bp, Homo sapiens
tcaaatattggctatttcacat

SEQ ID NO: 8278904 - DNA, 22 bp, Homo sapiens
tcaaatattggctatttcacat

SEQ ID NO: 8278905 - DNA, 22 bp, Homo sapiens
tcaaatagttgacattaacttg

SEQ ID NO: 8278906 - DNA, 22 bp, Homo sapiens
gaagaatatggctctcagcaat

SEQ ID NO: 8278907 - DNA, 22 bp, Homo sapiens
gaagaatatataatgattttgt

SEQ ID NO: 8278908 - DNA, 22 bp, Homo sapiens
gaagaatattcttgatcttaga

SEQ ID NO: 8278909 - DNA, 22 bp, Homo sapiens
gaagaaggtggcccaggggtag

SEQ ID NO: 8278910 - DNA, 22 bp, Homo sapiens
gaagaaggtgctacacagggca

SEQ ID NO: 8278911 - DNA, 22 bp, Homo sapiens
gaagaagggtaaggagtgttga

SEQ ID NO: 8278912 - DNA, 22 bp, Homo sapiens
gaatgctttgggaattcagaat

SEQ ID NO: 8278913 - DNA, 22 bp, Homo sapiens
gacaaaggatcagaggttggga

SEQ ID NO: 8278914 - DNA, 22 bp, Homo sapiens
gacaaagcagacaagataattc

SEQ ID NO: 8278915 - DNA, 18 bp, Homo sapiens
gacaaatgcaatttaaag

SEQ ID NO: 8278916 - DNA, 18 bp, Homo sapiens
gacagcagcttttgttct

SEQ ID NO: 8278917 - DNA, 22 bp, Homo sapiens
gacagcagccacagggagaggg

SEQ ID NO: 8278918 - DNA, 20 bp, Homo sapiens
gacaacagagtaccaggaag

SEQ ID NO: 8278919 - DNA, 22 bp, Homo sapiens
gacaacagcatatggactgtca

SEQ ID NO: 8278920 - DNA, 22 bp, Homo sapiens
gacaaaacacattagtttaaaa

SEQ ID NO: 8278921 - DNA, 22 bp, Homo sapiens
gaatttatctacgttaagtatg

SEQ ID NO: 8278922 - DNA, 20 bp, Homo sapiens
gaattttatgaacactacca

SEQ ID NO: 8278923 - DNA, 22 bp, Homo sapiens
gaatttatctacgttaagtatg

SEQ ID NO: 8278924 - DNA, 22 bp, Homo sapiens
gacaaaactgagatcacactgt

SEQ ID NO: 8278925 - DNA, 22 bp, Homo sapiens
gacaaaactgagatcacactgt

SEQ ID NO: 8278926 - DNA, 22 bp, Homo sapiens
gacaaagagaagtaacagtacc

SEQ ID NO: 8278927 - DNA, 21 bp, Homo sapiens
gacaaacatttcatagcttta

SEQ ID NO: 8278928 - DNA, 22 bp, Homo sapiens
gacagccatgcacttctgctgt

SEQ ID NO: 8278929 - DNA, 22 bp, Homo sapiens
gacagccatcagcacacgctgc

SEQ ID NO: 8278930 - DNA, 22 bp, Homo sapiens
gacagcagggacatgtaggaag

SEQ ID NO: 8278931 - DNA, 22 bp, Homo sapiens
gacagcaggtgcttgggaaagg

SEQ ID NO: 8278932 - DNA, 22 bp, Homo sapiens
gacatcaggaagacatgagagg

SEQ ID NO: 8278933 - DNA, 17 bp, Homo sapiens
gacatcagtacttacag

SEQ ID NO: 8278934 - DNA, 22 bp, Homo sapiens
gacatcaggcctgcagtctggg

SEQ ID NO: 8278935 - DNA, 22 bp, Homo sapiens
gaccttcttgctgtgtcctaac

SEQ ID NO: 8278936 - DNA, 22 bp, Homo sapiens
gaccttccaggctgaatggctg

SEQ ID NO: 8278937 - DNA, 22 bp, Homo sapiens
gacatgcaacaatttggcattt

SEQ ID NO: 8278938 - DNA, 22 bp, Homo sapiens
gacatgcatgaatgcaggtctc

SEQ ID NO: 8278939 - DNA, 22 bp, Homo sapiens
gacatgtttgctatagggattt

SEQ ID NO: 8278940 - DNA, 22 bp, Homo sapiens
gacatgttgaagaatatttgga

SEQ ID NO: 8278941 - DNA, 22 bp, Homo sapiens
gacatgttatctctggcttcaa

SEQ ID NO: 8278942 - DNA, 22 bp, Homo sapiens
gacatgttatctctggcttcaa

SEQ ID NO: 8278943 - DNA, 17 bp, Homo sapiens
gagagccctcagatgtc

SEQ ID NO: 8278944 - DNA, 22 bp, Homo sapiens
gagaggagaagcctgcgcttca

SEQ ID NO: 8278945 - DNA, 22 bp, Homo sapiens
gagaggagtaggctgatggtgc

SEQ ID NO: 8278946 - DNA, 22 bp, Homo sapiens
gagaggagtagacactttggtt

SEQ ID NO: 8278947 - DNA, 22 bp, Homo sapiens
gagaggaggtggctatgacagc

SEQ ID NO: 8278948 - DNA, 22 bp, Homo sapiens
gagaggaggtggctatgacagc

SEQ ID NO: 8278949 - DNA, 22 bp, Homo sapiens
gagagccagcagtaaagacatt

SEQ ID NO: 8278950 - DNA, 22 bp, Homo sapiens
gagagcaggaggcagcgggacg

SEQ ID NO: 8278951 - DNA, 22 bp, Homo sapiens
gagagagaaggcctgtgggtgt

SEQ ID NO: 8278952 - DNA, 22 bp, Homo sapiens
gagagagaaccccgtgcccttc

SEQ ID NO: 8278953 - DNA, 22 bp, Homo sapiens
gagagacagcacacagtgtggg

SEQ ID NO: 8278954 - DNA, 22 bp, Homo sapiens
gagagaagaaagccatggtcct

SEQ ID NO: 8278955 - DNA, 22 bp, Homo sapiens
gagaaggaagttgagccagcat

SEQ ID NO: 8278956 - DNA, 22 bp, Homo sapiens
gagaagaaatagaatcacattt

SEQ ID NO: 8278957 - DNA, 22 bp, Homo sapiens
gagaagaaatagaatcacattt

SEQ ID NO: 8278958 - DNA, 22 bp, Homo sapiens
gagaagaaaattccgtgaacac

SEQ ID NO: 8278959 - DNA, 19 bp, Homo sapiens
gactcaaggaagctctgat

SEQ ID NO: 8278960 - DNA, 22 bp, Homo sapiens
gagaacaggctctggagtcaga

SEQ ID NO: 8278961 - DNA, 20 bp, Homo sapiens
gagcacagtaatgactgcta

SEQ ID NO: 8278962 - DNA, 22 bp, Homo sapiens
gagcacattcctcctgtgaatt

SEQ ID NO: 8278963 - DNA, 22 bp, Homo sapiens
gagcagagcttctcaaagtaaa

SEQ ID NO: 8278964 - DNA, 22 bp, Homo sapiens
gagcaggacagcagcttcctgg

SEQ ID NO: 8278965 - DNA, 22 bp, Homo sapiens
gagcaggaaggccagaagggtc

SEQ ID NO: 8278966 - DNA, 22 bp, Homo sapiens
gagcaaggtagctctctggggc

SEQ ID NO: 8278967 - DNA, 22 bp, Homo sapiens
gagcaaggagggtggggccttt

SEQ ID NO: 8278968 - DNA, 22 bp, Homo sapiens
gagcaaggatgggtctatagta

SEQ ID NO: 8278969 - DNA, 22 bp, Homo sapiens
gagcaaaataaattctgacaaa

SEQ ID NO: 8278970 - DNA, 22 bp, Homo sapiens
gagcaaagcttttagggccttt

SEQ ID NO: 8278971 - DNA, 22 bp, Homo sapiens
gagaggagttactatttccgag

SEQ ID NO: 8278972 - DNA, 22 bp, Homo sapiens
gagtaatgctgttccatcttgg

SEQ ID NO: 8278973 - DNA, 22 bp, Homo sapiens
gagtaatgctcaaggtctgttt

SEQ ID NO: 8278974 - DNA, 22 bp, Homo sapiens
gagtaatggccgtaggttggga

SEQ ID NO: 8278975 - DNA, 22 bp, Homo sapiens
gagtaacaaatacttcagtagt

SEQ ID NO: 8278976 - DNA, 22 bp, Homo sapiens
gagtaacaaatacttcagtagt

SEQ ID NO: 8278977 - DNA, 22 bp, Homo sapiens
gaggtgagtggatcacgaggtc

SEQ ID NO: 8278978 - DNA, 22 bp, Homo sapiens
gaggtgagaagggggtcagatg

SEQ ID NO: 8278979 - DNA, 22 bp, Homo sapiens
gagggtggaagagctgctgaga

SEQ ID NO: 8278980 - DNA, 22 bp, Homo sapiens
gagggtggagctccagaatctg

SEQ ID NO: 8278981 - DNA, 22 bp, Homo sapiens
gagggtggagctccagaatctg

SEQ ID NO: 8278982 - DNA, 22 bp, Homo sapiens
gagggtggcctttagagcccat

SEQ ID NO: 8278983 - DNA, 20 bp, Homo sapiens
gagggtgggacttcctaggc

SEQ ID NO: 8278984 - DNA, 22 bp, Homo sapiens
gagggctgataacaggaataca

SEQ ID NO: 8278985 - DNA, 22 bp, Homo sapiens
gagggtctcttaatgccagggg

SEQ ID NO: 8278986 - DNA, 22 bp, Homo sapiens
gagggtgggtacaccagccctc

SEQ ID NO: 8278987 - DNA, 22 bp, Homo sapiens
gagggtgggctcctatctgggt

SEQ ID NO: 8278988 - DNA, 22 bp, Homo sapiens
gagggtgggccagatatgaggg

SEQ ID NO: 8278989 - DNA, 22 bp, Homo sapiens
gagggtggggaatagactgcta

SEQ ID NO: 8278990 - DNA, 22 bp, Homo sapiens
gagggtgggctttgttcctcca

SEQ ID NO: 8278991 - DNA, 22 bp, Homo sapiens
gaggtctggaccaagtcgcccc

SEQ ID NO: 8278992 - DNA, 22 bp, Homo sapiens
gaggtctgggatggggcctgaa

SEQ ID NO: 8278993 - DNA, 22 bp, Homo sapiens
gaggtctgggcttgggcctggt

SEQ ID NO: 8278994 - DNA, 22 bp, Homo sapiens
gagggtgggtttcttgcacgtc

SEQ ID NO: 8278995 - DNA, 22 bp, Homo sapiens
gagggaagagggtttgaattca

SEQ ID NO: 8278996 - DNA, 22 bp, Homo sapiens
gagggaagaggcctgacatttt

SEQ ID NO: 8278997 - DNA, 22 bp, Homo sapiens
gagggacagctaaagagaaatt

SEQ ID NO: 8278998 - DNA, 22 bp, Homo sapiens
gaggcctggtctatgagatgtt

SEQ ID NO: 8278999 - DNA, 22 bp, Homo sapiens
gaggcctgtagtcatggatgta

SEQ ID NO: 8279000 - DNA, 22 bp, Homo sapiens
gaggacagtgtgatctgccagc

SEQ ID NO: 8279001 - DNA, 17 bp, Homo sapiens
gaggacagggaagtagg

SEQ ID NO: 8279002 - DNA, 22 bp, Homo sapiens
gaggagagaacattcctccata

SEQ ID NO: 8279003 - DNA, 22 bp, Homo sapiens
gaggagagaacattcctccata

SEQ ID NO: 8279004 - DNA, 22 bp, Homo sapiens
gaggagaaagcagtgatttgtg

SEQ ID NO: 8279005 - DNA, 22 bp, Homo sapiens
gaggagtctttccctaagtcct

SEQ ID NO: 8279006 - DNA, 22 bp, Homo sapiens
gaggaggttccgggtggagaag

SEQ ID NO: 8279007 - DNA, 22 bp, Homo sapiens
gaggagtgggttagtgcttatt

SEQ ID NO: 8279008 - DNA, 22 bp, Homo sapiens
gaggatggtatgaggcaagcaa

SEQ ID NO: 8279009 - DNA, 22 bp, Homo sapiens
gaggatggaggtgtgagctatg

SEQ ID NO: 8279010 - DNA, 22 bp, Homo sapiens
gaggcctggaccagccacagag

SEQ ID NO: 8279011 - DNA, 22 bp, Homo sapiens
gaggacaggagactcactgttt

SEQ ID NO: 8279012 - DNA, 22 bp, Homo sapiens
gagctcctgaaacgttcctgcc

SEQ ID NO: 8279013 - DNA, 22 bp, Homo sapiens
gagctgggatttgaacctggga

SEQ ID NO: 8279014 - DNA, 22 bp, Homo sapiens
gagctgggattcatctatgtct

SEQ ID NO: 8279015 - DNA, 22 bp, Homo sapiens
gagcaggcattctagtggctga

SEQ ID NO: 8279016 - DNA, 22 bp, Homo sapiens
gagcaggatgggagctggggcc

SEQ ID NO: 8279017 - DNA, 22 bp, Homo sapiens
gagcaggacgtgggaatgggaa

SEQ ID NO: 8279018 - DNA, 22 bp, Homo sapiens
gagctcagcccaaagagcagtg

SEQ ID NO: 8279019 - DNA, 22 bp, Homo sapiens
gagctcaggagcatcagaagaa

SEQ ID NO: 8279020 - DNA, 22 bp, Homo sapiens
gagctcagaggcgtctttgtcc

SEQ ID NO: 8279021 - DNA, 22 bp, Homo sapiens
gagctcagcccaaagagcagtg

SEQ ID NO: 8279022 - DNA, 22 bp, Homo sapiens
gagctcagcaaaggtctgtgtg

SEQ ID NO: 8279023 - DNA, 22 bp, Homo sapiens
gagctcagggcattgagcaaga

SEQ ID NO: 8279024 - DNA, 22 bp, Homo sapiens
gagctcagggcattgagcaaga

SEQ ID NO: 8279025 - DNA, 22 bp, Homo sapiens
gagctcaggtggtcaaaacaat

SEQ ID NO: 8279026 - DNA, 22 bp, Homo sapiens
ctgtgacagagcttgagtgaga

SEQ ID NO: 8279027 - DNA, 22 bp, Homo sapiens
ctgtccctcagttctgggcaaa

SEQ ID NO: 8279028 - DNA, 22 bp, Homo sapiens
ctgtctgtgtggacacggctgc

SEQ ID NO: 8279029 - DNA, 22 bp, Homo sapiens
ctgtgagactgatagggaagag

SEQ ID NO: 8279030 - DNA, 22 bp, Homo sapiens
ctgtgactgggtgacagtcctc

SEQ ID NO: 8279031 - DNA, 22 bp, Homo sapiens
ctgtgagctgggtggccaggac

SEQ ID NO: 8279032 - DNA, 22 bp, Homo sapiens
ctggttttatgttatagatgga

SEQ ID NO: 8279033 - DNA, 22 bp, Homo sapiens
ctggttttggctggcaaggttg

SEQ ID NO: 8279034 - DNA, 22 bp, Homo sapiens
ctggttctgatgttcttggctt

SEQ ID NO: 8279035 - DNA, 22 bp, Homo sapiens
ctgtcccaggagctgtaagaca

SEQ ID NO: 8279036 - DNA, 22 bp, Homo sapiens
ctgtcccaggatcctgactcca

SEQ ID NO: 8279037 - DNA, 22 bp, Homo sapiens
ctgtcccagatgttctcagcac

SEQ ID NO: 8279038 - DNA, 19 bp, Homo sapiens
ctgtcccagactctgctct

SEQ ID NO: 8279039 - DNA, 19 bp, Homo sapiens
ctgtcccagactctgctct

SEQ ID NO: 8279040 - DNA, 22 bp, Homo sapiens
ctgtcccatccttactctaccc

SEQ ID NO: 8279041 - DNA, 18 bp, Homo sapiens
ctgtcccatcctcaggtt

SEQ ID NO: 8279042 - DNA, 22 bp, Homo sapiens
ctgtggcactcaagaagcctcc

SEQ ID NO: 8279043 - DNA, 22 bp, Homo sapiens
ctgtggcacatgtggcaaggcc

SEQ ID NO: 8279044 - DNA, 22 bp, Homo sapiens
ctgtggcaagtctgcctgtcac

SEQ ID NO: 8279045 - DNA, 23 bp, Homo sapiens
ctgtggcaagtcctgcacctgcc

SEQ ID NO: 8279046 - DNA, 22 bp, Homo sapiens
ctgtggcaggaagggactagca

SEQ ID NO: 8279047 - DNA, 22 bp, Homo sapiens
ctgtggcaggtgtctggggcag

SEQ ID NO: 8279048 - DNA, 20 bp, Homo sapiens
ctgtggcatctgtcatggtg

SEQ ID NO: 8279049 - DNA, 20 bp, Homo sapiens
ctgtggcatcttgaaggagg

SEQ ID NO: 8279050 - DNA, 19 bp, Homo sapiens
ctgtgggcggaggaggggc

SEQ ID NO: 8279051 - DNA, 22 bp, Homo sapiens
ctgtggggaaagggtcctgctc

SEQ ID NO: 8279052 - DNA, 22 bp, Homo sapiens
ctgtggggccaaattctcctct

SEQ ID NO: 8279053 - DNA, 22 bp, Homo sapiens
ctgtgtgtgagaagcaggttga

SEQ ID NO: 8279054 - DNA, 22 bp, Homo sapiens
ctggtgtttattacaggtgctc

SEQ ID NO: 8279055 - DNA, 22 bp, Homo sapiens
ctggtgtttatctgactgccta

SEQ ID NO: 8279056 - DNA, 22 bp, Homo sapiens
ctggtgttgtccgggtgagagt

SEQ ID NO: 8279057 - DNA, 22 bp, Homo sapiens
ctggtgttggagcaaatgcagg

SEQ ID NO: 8279058 - DNA, 22 bp, Homo sapiens
ctggtggttcaggagaatggct

SEQ ID NO: 8279059 - DNA, 22 bp, Homo sapiens
ctggtcaaggagagtctctgca

SEQ ID NO: 8279060 - DNA, 22 bp, Homo sapiens
ctggtcaagagctagcagagct

SEQ ID NO: 8279061 - DNA, 22 bp, Homo sapiens
ctggtgcctcctctcccaggtc

SEQ ID NO: 8279062 - DNA, 22 bp, Homo sapiens
ctggtgcctcctctcccaggtc

SEQ ID NO: 8279063 - DNA, 22 bp, Homo sapiens
ctggtacatagtaagaacacaa

SEQ ID NO: 8279064 - DNA, 22 bp, Homo sapiens
ctggagccttcaccaggggaaa

SEQ ID NO: 8279065 - DNA, 22 bp, Homo sapiens
ctgggaggcggaggttgcagtg

SEQ ID NO: 8279066 - DNA, 19 bp, Homo sapiens
ctgggatgtctcctcccag

SEQ ID NO: 8279067 - DNA, 22 bp, Homo sapiens
ctgggccagcaactgcaatgga

SEQ ID NO: 8279068 - DNA, 22 bp, Homo sapiens
cttttgttaggagaaaacatca

SEQ ID NO: 8279069 - DNA, 22 bp, Homo sapiens
ctttggcacagtctcatttgat

SEQ ID NO: 8279070 - DNA, 22 bp, Homo sapiens
ctttggcacagtgtttactagc

SEQ ID NO: 8279071 - DNA, 22 bp, Homo sapiens
ctttggcacagtctcatttgat

SEQ ID NO: 8279072 - DNA, 22 bp, Homo sapiens
ctttggcaatgtcattttcaat

SEQ ID NO: 8279073 - DNA, 22 bp, Homo sapiens
ctttggcaagggttttaattgt

SEQ ID NO: 8279074 - DNA, 22 bp, Homo sapiens
ctttggaagtaaagtcagcagg

SEQ ID NO: 8279075 - DNA, 22 bp, Homo sapiens
ctttttgtgtatgctacagttg

SEQ ID NO: 8279076 - DNA, 22 bp, Homo sapiens
gaaacagcacgtttggagagat

SEQ ID NO: 8279077 - DNA, 22 bp, Homo sapiens
gaaaacactttgatctgaaagt

SEQ ID NO: 8279078 - DNA, 22 bp, Homo sapiens
gaaaaatgctccaaatctgtgg

SEQ ID NO: 8279079 - DNA, 21 bp, Homo sapiens
gaaaccaggttatcaatcaca

SEQ ID NO: 8279080 - DNA, 22 bp, Homo sapiens
gaaacttgataattgaaacaga

SEQ ID NO: 8279081 - DNA, 22 bp, Homo sapiens
gaaacttgcctgaagtcaacca

SEQ ID NO: 8279082 - DNA, 22 bp, Homo sapiens
gaaagaatcaactatgtctctg

SEQ ID NO: 8279083 - DNA, 22 bp, Homo sapiens
gaaagaagctttagatggctat

SEQ ID NO: 8279084 - DNA, 22 bp, Homo sapiens
gaaagaatgctgggagccatct

SEQ ID NO: 8279085 - DNA, 22 bp, Homo sapiens
gaaagaatgagcatcatgactt

SEQ ID NO: 8279086 - DNA, 22 bp, Homo sapiens
gaaatacagaaagggctgaatg

SEQ ID NO: 8279087 - DNA, 22 bp, Homo sapiens
gaaatattcttgtcttgttttc

SEQ ID NO: 8279088 - DNA, 22 bp, Homo sapiens
gaaatattgtactggagatgtt

SEQ ID NO: 8279089 - DNA, 22 bp, Homo sapiens
gaaattaagcaggggtctgtgg

SEQ ID NO: 8279090 - DNA, 22 bp, Homo sapiens
gaaattaagcaggggtctgtgg

SEQ ID NO: 8279091 - DNA, 22 bp, Homo sapiens
gaaattaaccacctttggcttt

SEQ ID NO: 8279092 - DNA, 22 bp, Homo sapiens
gaaattaaccacctttggcttt

SEQ ID NO: 8279093 - DNA, 22 bp, Homo sapiens
gaagaactgaaagttgatgcac

SEQ ID NO: 8279094 - DNA, 22 bp, Homo sapiens
cttcttcataggcagtcctgtt

SEQ ID NO: 8279095 - DNA, 22 bp, Homo sapiens
cttccccaaccccgactgtgtg

SEQ ID NO: 8279096 - DNA, 22 bp, Homo sapiens
cttcccagttctgcttgagggg

SEQ ID NO: 8279097 - DNA, 22 bp, Homo sapiens
cttcccagaacaatgtaggctt

SEQ ID NO: 8279098 - DNA, 22 bp, Homo sapiens
cttcccagaccttagagtgcag

SEQ ID NO: 8279099 - DNA, 22 bp, Homo sapiens
cttccctgagctttctcaggct

SEQ ID NO: 8279100 - DNA, 22 bp, Homo sapiens
cttccctgagctttctcaggct

SEQ ID NO: 8279101 - DNA, 22 bp, Homo sapiens
cttcacagtaaatccagaagaa

SEQ ID NO: 8279102 - DNA, 22 bp, Homo sapiens
ctgttaaatgagaaagcagact

SEQ ID NO: 8279103 - DNA, 20 bp, Homo sapiens
ctgttaaaaggtatgaattc

SEQ ID NO: 8279104 - DNA, 22 bp, Homo sapiens
cttggaggaaggggctcttctg

SEQ ID NO: 8279105 - DNA, 22 bp, Homo sapiens
ctttccagacctccttgtagct

SEQ ID NO: 8279106 - DNA, 22 bp, Homo sapiens
ctttcctctggcactgtctggt

SEQ ID NO: 8279107 - DNA, 22 bp, Homo sapiens
cttggaatggggcagaaaatgg

SEQ ID NO: 8279108 - DNA, 22 bp, Homo sapiens
cttggagaccagtgacattgct

SEQ ID NO: 8279109 - DNA, 22 bp, Homo sapiens
cttgcttcattagtgtcttagt

SEQ ID NO: 8279110 - DNA, 22 bp, Homo sapiens
cttgcttctgctgcactatcct

SEQ ID NO: 8279111 - DNA, 22 bp, Homo sapiens
cttggaaaggttttacaaagcg

SEQ ID NO: 8279112 - DNA, 22 bp, Homo sapiens
cttggaaagttatcattttcct

SEQ ID NO: 8279113 - DNA, 22 bp, Homo sapiens
cttggaaagaatatatgatgct

SEQ ID NO: 8279114 - DNA, 22 bp, Homo sapiens
cttggaaaggaatcttttacca

SEQ ID NO: 8279115 - DNA, 22 bp, Homo sapiens
cttggaaactttccctgggcac

SEQ ID NO: 8279116 - DNA, 22 bp, Homo sapiens
cttcttccaagcttatgctcaa

SEQ ID NO: 8279117 - DNA, 22 bp, Homo sapiens
cttcttctctacatcctttgat

SEQ ID NO: 8279118 - DNA, 22 bp, Homo sapiens
cttgcctccctcagctcacagc

SEQ ID NO: 8279119 - DNA, 22 bp, Homo sapiens
cttgcctacttgtcaaccagca

SEQ ID NO: 8279120 - DNA, 22 bp, Homo sapiens
ttagcaatgtatgattaaaata

SEQ ID NO: 8279121 - DNA, 22 bp, Homo sapiens
ttagcaaatttccaggtgatgc

SEQ ID NO: 8279122 - DNA, 21 bp, Homo sapiens
ttagcaaagcaaacacatgct

SEQ ID NO: 8279123 - DNA, 22 bp, Homo sapiens
ttagcaaagaagatgtgagttt

SEQ ID NO: 8279124 - DNA, 22 bp, Homo sapiens
ttacataacggtatgaaaaatg

SEQ ID NO: 8279125 - DNA, 22 bp, Homo sapiens
ccttcaaactttcattaaccag

SEQ ID NO: 8279126 - DNA, 23 bp, Homo sapiens
ccttcagaagaagtaacaggggc

SEQ ID NO: 8279127 - DNA, 22 bp, Homo sapiens
ccttcaaatttagaacaagtga

SEQ ID NO: 8279128 - DNA, 22 bp, Homo sapiens
ccttcacacaggtagaagcaga

SEQ ID NO: 8279129 - DNA, 22 bp, Homo sapiens
ccttcacactttcacttggata

SEQ ID NO: 8279130 - DNA, 22 bp, Homo sapiens
ttataaacttgccaagaaggag

SEQ ID NO: 8279131 - DNA, 22 bp, Homo sapiens
ccttgcccgctgcctctgagtt

SEQ ID NO: 8279132 - DNA, 22 bp, Homo sapiens
ccttgcccgctgcctctgagtt

SEQ ID NO: 8279133 - DNA, 22 bp, Homo sapiens
ttataaagtgagaagtgctatg

SEQ ID NO: 8279134 - DNA, 22 bp, Homo sapiens
ttataaaggtttgtgcatattt

SEQ ID NO: 8279135 - DNA, 23 bp, Homo sapiens
ttataaatattttcaggtgtgtt

SEQ ID NO: 8279136 - DNA, 22 bp, Homo sapiens
ttataacattataaagtggaga

SEQ ID NO: 8279137 - DNA, 22 bp, Homo sapiens
ttataacatcaatcagagttaa

SEQ ID NO: 8279138 - DNA, 21 bp, Homo sapiens
ttacaaagcaagtgctgtgtc

SEQ ID NO: 8279139 - DNA, 22 bp, Homo sapiens
ttacaaagattatattcagtta

SEQ ID NO: 8279140 - DNA, 22 bp, Homo sapiens
ttaaattattgagggattgtca

SEQ ID NO: 8279141 - DNA, 22 bp, Homo sapiens
tgtcagcagaaatctggtctgc

SEQ ID NO: 8279142 - DNA, 22 bp, Homo sapiens
ttaagaggtggtcgtgtctgtg

SEQ ID NO: 8279143 - DNA, 22 bp, Homo sapiens
ttaaattttagaaacagactct

SEQ ID NO: 8279144 - DNA, 22 bp, Homo sapiens
ttaaattcattccaacttttga

SEQ ID NO: 8279145 - DNA, 22 bp, Homo sapiens
ttaaattccagcctcataatag

SEQ ID NO: 8279146 - DNA, 22 bp, Homo sapiens
ttaaattatttctagtgaggtg

SEQ ID NO: 8279147 - DNA, 22 bp, Homo sapiens
cgtgagcaaaatggacactccc

SEQ ID NO: 8279148 - DNA, 22 bp, Homo sapiens
cgtggctggtggacctgagggc

SEQ ID NO: 8279149 - DNA, 22 bp, Homo sapiens
cggggccctggggctgaaggtc

SEQ ID NO: 8279150 - DNA, 22 bp, Homo sapiens
cggggagggcagaggctccctc

SEQ ID NO: 8279151 - DNA, 22 bp, Homo sapiens
cggggagaacactgtgtccttc

SEQ ID NO: 8279152 - DNA, 22 bp, Homo sapiens
cggggcaggagtccctgtagag

SEQ ID NO: 8279153 - DNA, 22 bp, Homo sapiens
cggggcagagggtcttctccag

SEQ ID NO: 8279154 - DNA, 22 bp, Homo sapiens
cggaggttgaggctgcagtgag

SEQ ID NO: 8279155 - DNA, 22 bp, Homo sapiens
ttcaaatctctcctaatccact

SEQ ID NO: 8279156 - DNA, 22 bp, Homo sapiens
ttcaaagtttcaatctgtatca

SEQ ID NO: 8279157 - DNA, 22 bp, Homo sapiens
cggcaattagacattcttcccg

SEQ ID NO: 8279158 - DNA, 22 bp, Homo sapiens
cggcagcaaaggaagccaggtc

SEQ ID NO: 8279159 - DNA, 22 bp, Homo sapiens
ccttttgctctcccatccagaa

SEQ ID NO: 8279160 - DNA, 22 bp, Homo sapiens
ccttttgttggggtgtattcaa

SEQ ID NO: 8279161 - DNA, 22 bp, Homo sapiens
ccttttgtacacttactatata

SEQ ID NO: 8279162 - DNA, 22 bp, Homo sapiens
ccttttcttgccactgactcgg

SEQ ID NO: 8279163 - DNA, 22 bp, Homo sapiens
cgagatggtatttttaacgcag

SEQ ID NO: 8279164 - DNA, 23 bp, Homo sapiens
ttattgagggtgtagattggtgt

SEQ ID NO: 8279165 - DNA, 22 bp, Homo sapiens
ttattgcaactcctaaatagag

SEQ ID NO: 8279166 - DNA, 22 bp, Homo sapiens
cgagaggctggacagggctggg

SEQ ID NO: 8279167 - DNA, 23 bp, Homo sapiens
ttattgcatccaaatgcattcct

SEQ ID NO: 8279168 - DNA, 22 bp, Homo sapiens
ttattgcatagattatgccata

SEQ ID NO: 8279169 - DNA, 22 bp, Homo sapiens
ttattgctaaggtactaggtgg

SEQ ID NO: 8279170 - DNA, 23 bp, Homo sapiens
ttattgcaaggtaaaattgctga

SEQ ID NO: 8279171 - DNA, 22 bp, Homo sapiens
ttatttattgtgtacctactgt

SEQ ID NO: 8279172 - DNA, 22 bp, Homo sapiens
ttatttattgtgtacctactgt

SEQ ID NO: 8279173 - DNA, 22 bp, Homo sapiens
cgctggcagggctgatctgaag

SEQ ID NO: 8279174 - DNA, 21 bp, Homo sapiens
cgctgccttgggagtggacct

SEQ ID NO: 8279175 - DNA, 22 bp, Homo sapiens
cgctgccttcatcccacgccta

SEQ ID NO: 8279176 - DNA, 22 bp, Homo sapiens
ttggaagggatattggcatatg

SEQ ID NO: 8279177 - DNA, 22 bp, Homo sapiens
ttggaaggggcagagtggctgc

SEQ ID NO: 8279178 - DNA, 22 bp, Homo sapiens
ctccactcaccagatgccagga

SEQ ID NO: 8279179 - DNA, 22 bp, Homo sapiens
ctccactcaacaagcccagtgt

SEQ ID NO: 8279180 - DNA, 19 bp, Homo sapiens
ctcagtctggctctgcctg

SEQ ID NO: 8279181 - DNA, 22 bp, Homo sapiens
ttggctcttctcccagtggcct

SEQ ID NO: 8279182 - DNA, 22 bp, Homo sapiens
ttggctctttcctcacacagga

SEQ ID NO: 8279183 - DNA, 22 bp, Homo sapiens
ttggctctttcctcacacagga

SEQ ID NO: 8279184 - DNA, 22 bp, Homo sapiens
ttggctgaaggaataaatggat

SEQ ID NO: 8279185 - DNA, 22 bp, Homo sapiens
ctccaggaccagggctcctgga

SEQ ID NO: 8279186 - DNA, 22 bp, Homo sapiens
ctccaggacagattcagggcca

SEQ ID NO: 8279187 - DNA, 22 bp, Homo sapiens
ctccaggacccagtggctccag

SEQ ID NO: 8279188 - DNA, 22 bp, Homo sapiens
ctccaggacccagtggctccag

SEQ ID NO: 8279189 - DNA, 22 bp, Homo sapiens
ctccaggactcaggcccctggg

SEQ ID NO: 8279190 - DNA, 22 bp, Homo sapiens
ctccagaggttctcatctggga

SEQ ID NO: 8279191 - DNA, 22 bp, Homo sapiens
ctccagagtcacactgcctggg

SEQ ID NO: 8279192 - DNA, 22 bp, Homo sapiens
ctccagaggaaagcacatagtg

SEQ ID NO: 8279193 - DNA, 22 bp, Homo sapiens
ctccagagggtcagactctgag

SEQ ID NO: 8279194 - DNA, 22 bp, Homo sapiens
ctcaggacccggtccaggtggg

SEQ ID NO: 8279195 - DNA, 22 bp, Homo sapiens
ctcaggaggatgactgccttgg

SEQ ID NO: 8279196 - DNA, 22 bp, Homo sapiens
ctcaggaggtggtagaggccct

SEQ ID NO: 8279197 - DNA, 22 bp, Homo sapiens
ttgcagttgctttctatattga

SEQ ID NO: 8279198 - DNA, 22 bp, Homo sapiens
ttgcactttgaaataacagtgg

SEQ ID NO: 8279199 - DNA, 22 bp, Homo sapiens
ttgcagttttctgcctcatttc

SEQ ID NO: 8279200 - DNA, 22 bp, Homo sapiens
ttgcagtttctggatgccttct

SEQ ID NO: 8279201 - DNA, 22 bp, Homo sapiens
ctcagggggaatcaggtcacag

SEQ ID NO: 8279202 - DNA, 22 bp, Homo sapiens
ctcagggtgcccggatcccagg

SEQ ID NO: 8279203 - DNA, 22 bp, Homo sapiens
ttgccccttggccgttaaaaca

SEQ ID NO: 8279204 - DNA, 22 bp, Homo sapiens
ttgcccctggtcagaggaggct

SEQ ID NO: 8279205 - DNA, 18 bp, Homo sapiens
ttgcccctgggtgaggat

SEQ ID NO: 8279206 - DNA, 21 bp, Homo sapiens
ttgcccctgagtttttctgag

SEQ ID NO: 8279207 - DNA, 22 bp, Homo sapiens
ttgcccctcttggattttccgg

SEQ ID NO: 8279208 - DNA, 22 bp, Homo sapiens
cgttttcttcactttgcaagtt

SEQ ID NO: 8279209 - DNA, 22 bp, Homo sapiens
cgtttgaaagcctttgtacact

SEQ ID NO: 8279210 - DNA, 23 bp, Homo sapiens
cgttttttcctcagatgttctgg

SEQ ID NO: 8279211 - DNA, 22 bp, Homo sapiens
ctaaaaactctacgatgcacag

SEQ ID NO: 8279212 - DNA, 22 bp, Homo sapiens
ctaaaaatccacactaggtgaa

SEQ ID NO: 8279213 - DNA, 22 bp, Homo sapiens
ctagagaggtggtgttgggtgg

SEQ ID NO: 8279214 - DNA, 22 bp, Homo sapiens
ctagagaatcttttaagaagtg

SEQ ID NO: 8279215 - DNA, 22 bp, Homo sapiens
ctagaaagatacttaaatcaag

SEQ ID NO: 8279216 - DNA, 23 bp, Homo sapiens
ttctggatgttctagtctgagag

SEQ ID NO: 8279217 - DNA, 22 bp, Homo sapiens
ttctgcatgatattaaatgtaa

SEQ ID NO: 8279218 - DNA, 22 bp, Homo sapiens
ttctgcagtgtgcagggcctgt

SEQ ID NO: 8279219 - DNA, 21 bp, Homo sapiens
ttctgcagccatgttggtttt

SEQ ID NO: 8279220 - DNA, 22 bp, Homo sapiens
ttctgcagcccaacagtagttt

SEQ ID NO: 8279221 - DNA, 22 bp, Homo sapiens
ttctatgtgaacgttatagttt

SEQ ID NO: 8279222 - DNA, 21 bp, Homo sapiens
ttctttctgaatctgaagtat

SEQ ID NO: 8279223 - DNA, 22 bp, Homo sapiens
ttctttctgaatacagttgagt

SEQ ID NO: 8279224 - DNA, 22 bp, Homo sapiens
ttctttctgggaagagttcaga

SEQ ID NO: 8279225 - DNA, 22 bp, Homo sapiens
ttctttctgtccataatgagac

SEQ ID NO: 8279226 - DNA, 22 bp, Homo sapiens
ttctttctggggtccttcggct

SEQ ID NO: 8279227 - DNA, 22 bp, Homo sapiens
ctcacccatatctccatgactc

SEQ ID NO: 8279228 - DNA, 22 bp, Homo sapiens
ctcacaggttctgcagctcaca

SEQ ID NO: 8279229 - DNA, 22 bp, Homo sapiens
ctcacctccaggagctgctggc

SEQ ID NO: 8279230 - DNA, 22 bp, Homo sapiens
ctctgtgcgggccatggtcagg

SEQ ID NO: 8279231 - DNA, 22 bp, Homo sapiens
ctctgtgccctactgctcagct

SEQ ID NO: 8279232 - DNA, 22 bp, Homo sapiens
ctctgtgccagtctgcactcgg

SEQ ID NO: 8279233 - DNA, 22 bp, Homo sapiens
tttgttctagatcgtgtttgtg

SEQ ID NO: 8279234 - DNA, 23 bp, Homo sapiens
tttgttcatcattagagtctagc

SEQ ID NO: 8279235 - DNA, 22 bp, Homo sapiens
ctctgggtggtctcactgagtg

SEQ ID NO: 8279236 - DNA, 23 bp, Homo sapiens
ctctgggtccgatgtcctgacag

SEQ ID NO: 8279237 - DNA, 22 bp, Homo sapiens
tttggaattccatttctgcatt

SEQ ID NO: 8279238 - DNA, 20 bp, Homo sapiens
ctctgggctgcaccctcgcc

SEQ ID NO: 8279239 - DNA, 22 bp, Homo sapiens
ctctgggctgaatggctgaacc

SEQ ID NO: 8279240 - DNA, 22 bp, Homo sapiens
tttggaatgtagtttaatcatc

SEQ ID NO: 8279241 - DNA, 22 bp, Homo sapiens
tttggaattatgcttaaagttt

SEQ ID NO: 8279242 - DNA, 22 bp, Homo sapiens
tttggaatggtaccttcagttg

SEQ ID NO: 8279243 - DNA, 22 bp, Homo sapiens
tttggaatattgagaaagtgaa

SEQ ID NO: 8279244 - DNA, 22 bp, Homo sapiens
tttggaatattaaaatgtctca

SEQ ID NO: 8279245 - DNA, 22 bp, Homo sapiens
tttggaatcatagatatattca

SEQ ID NO: 8279246 - DNA, 22 bp, Homo sapiens
tttgacttctgggcattttggt

SEQ ID NO: 8279247 - DNA, 22 bp, Homo sapiens
tttgagaagatgtaatgttaag

SEQ ID NO: 8279248 - DNA, 22 bp, Homo sapiens
tttgagaagagtttgaggtatt

SEQ ID NO: 8279249 - DNA, 22 bp, Homo sapiens
tttgcaaacacttaagaagaga

SEQ ID NO: 8279250 - DNA, 22 bp, Homo sapiens
tttgcaaagaaattattgctgt

SEQ ID NO: 8279251 - DNA, 22 bp, Homo sapiens
ctctggcctgcagatccatgct

SEQ ID NO: 8279252 - DNA, 22 bp, Homo sapiens
ctctggccccagtggccccttg

SEQ ID NO: 8279253 - DNA, 22 bp, Homo sapiens
ctctgaagatggtaccagcttt

SEQ ID NO: 8279254 - DNA, 22 bp, Homo sapiens
tttcttgggttccagttcccag

SEQ ID NO: 8279255 - DNA, 22 bp, Homo sapiens
ctctgcaccttgtaggaggcaa

SEQ ID NO: 8279256 - DNA, 22 bp, Homo sapiens
ctctgaggttcctttgccctcg

SEQ ID NO: 8279257 - DNA, 22 bp, Homo sapiens
tttgaaagagctgatacatgaa

SEQ ID NO: 8279258 - DNA, 22 bp, Homo sapiens
tttctcaacctcaacactattt

SEQ ID NO: 8279259 - DNA, 22 bp, Homo sapiens
tttctcaacagagtatgccctt

SEQ ID NO: 8279260 - DNA, 22 bp, Homo sapiens
tttctcaaatactgttccagga

SEQ ID NO: 8279261 - DNA, 22 bp, Homo sapiens
tttctcaagctgtttgccaatt

SEQ ID NO: 8279262 - DNA, 22 bp, Homo sapiens
tttctcaagctgtttgccaatt

SEQ ID NO: 8279263 - DNA, 22 bp, Homo sapiens
tttctcaaggtgtcatgtattt

SEQ ID NO: 8279264 - DNA, 22 bp, Homo sapiens
ctctcttcccgtgagtgttgca

SEQ ID NO: 8279265 - DNA, 22 bp, Homo sapiens
tttctacaacacttctgaatct

SEQ ID NO: 8279266 - DNA, 22 bp, Homo sapiens
tttccacactgcagccagcaaa

SEQ ID NO: 8279267 - DNA, 22 bp, Homo sapiens
tttccacactcactgcactcat

SEQ ID NO: 8279268 - DNA, 22 bp, Homo sapiens
tttcattatacagcttcataaa

SEQ ID NO: 8279269 - DNA, 22 bp, Homo sapiens
ctccaggcccctggccttctgc

SEQ ID NO: 8279270 - DNA, 22 bp, Homo sapiens
ctccaggcccctggccttctgc

SEQ ID NO: 8279271 - DNA, 22 bp, Homo sapiens
ctccaggccatggctgcggagg

SEQ ID NO: 8279272 - DNA, 19 bp, Homo sapiens
ctccaggatggctgggcga

SEQ ID NO: 8279273 - DNA, 22 bp, Homo sapiens
ctccaggatacctgttcctata

SEQ ID NO: 8279274 - DNA, 22 bp, Homo sapiens
ctccaggaggttgctgcttcct

SEQ ID NO: 8279275 - DNA, 22 bp, Homo sapiens
ctccaggagggggatggctgta

SEQ ID NO: 8279276 - DNA, 22 bp, Homo sapiens
ctccaggagggcttcctgtgat

SEQ ID NO: 8279277 - DNA, 22 bp, Homo sapiens
tttatgcagatttgtacagtga

SEQ ID NO: 8279278 - DNA, 22 bp, Homo sapiens
tttatgtaagtggaatgatgcc

SEQ ID NO: 8279279 - DNA, 22 bp, Homo sapiens
tttcagaagtcacagttgactg

SEQ ID NO: 8279280 - DNA, 22 bp, Homo sapiens
tttcagaatatcgattcagtga

SEQ ID NO: 8279281 - DNA, 22 bp, Homo sapiens
ctccttcccctactcagcatcc

SEQ ID NO: 8279282 - DNA, 22 bp, Homo sapiens
tttcagaaattatattagatgc

SEQ ID NO: 8279283 - DNA, 22 bp, Homo sapiens
ttttgctttaagatggagagga

SEQ ID NO: 8279284 - DNA, 22 bp, Homo sapiens
ttttgcttgagtgcacaaaatg

SEQ ID NO: 8279285 - DNA, 22 bp, Homo sapiens
ttttgcttgagtgcacaaaatg

SEQ ID NO: 8279286 - DNA, 22 bp, Homo sapiens
ctgagcagtctagccaggtgtt

SEQ ID NO: 8279287 - DNA, 22 bp, Homo sapiens
ctgagcaggcggtggagcggct

SEQ ID NO: 8279288 - DNA, 22 bp, Homo sapiens
ctgagcaggacagtgggagacc

SEQ ID NO: 8279289 - DNA, 22 bp, Homo sapiens
ctgagcagcgtggggagctggc

SEQ ID NO: 8279290 - DNA, 22 bp, Homo sapiens
ctgagcagctccctgagtggtc

SEQ ID NO: 8279291 - DNA, 19 bp, Homo sapiens
ctgagcagagggaggaact

SEQ ID NO: 8279292 - DNA, 22 bp, Homo sapiens
ctgagcactgggcacatagctg

SEQ ID NO: 8279293 - DNA, 22 bp, Homo sapiens
ctgaggctggagtgcagtggtg

SEQ ID NO: 8279294 - DNA, 22 bp, Homo sapiens
ctgaggctgcccagggccaggt

SEQ ID NO: 8279295 - DNA, 22 bp, Homo sapiens
ctgaggctgaagagggcctacg

SEQ ID NO: 8279296 - DNA, 22 bp, Homo sapiens
ctgaggctctgagaaagccaaa

SEQ ID NO: 8279297 - DNA, 22 bp, Homo sapiens
ctgaggcctgtgttggggcagt

SEQ ID NO: 8279298 - DNA, 22 bp, Homo sapiens
ctgaggcctggccccaccacag

SEQ ID NO: 8279299 - DNA, 22 bp, Homo sapiens
ctgaggcctgggggcgtggacg

SEQ ID NO: 8279300 - DNA, 22 bp, Homo sapiens
ctgagccaaccacagcaggagc

SEQ ID NO: 8279301 - DNA, 22 bp, Homo sapiens
ctgagccaaaaagcagagcttg

SEQ ID NO: 8279302 - DNA, 22 bp, Homo sapiens
ctgaggccgttggtgggcctta

SEQ ID NO: 8279303 - DNA, 22 bp, Homo sapiens
ctgagccaaaaagcagagcttg

SEQ ID NO: 8279304 - DNA, 22 bp, Homo sapiens
ctgccccatggtccctggtggg

SEQ ID NO: 8279305 - DNA, 22 bp, Homo sapiens
ctgcccctcgaccaagcgcgtc

SEQ ID NO: 8279306 - DNA, 22 bp, Homo sapiens
ctgcccataaactttccacctg

SEQ ID NO: 8279307 - DNA, 18 bp, Homo sapiens
ctgccatgtcctactgtc

SEQ ID NO: 8279308 - DNA, 22 bp, Homo sapiens
ctgccatgttacctgcacaggt

SEQ ID NO: 8279309 - DNA, 20 bp, Homo sapiens
ctgcccagccactgagggat

SEQ ID NO: 8279310 - DNA, 22 bp, Homo sapiens
ctgcaggagtgaaagcaggcct

SEQ ID NO: 8279311 - DNA, 22 bp, Homo sapiens
ctgcaggagcaaagcctctgct

SEQ ID NO: 8279312 - DNA, 22 bp, Homo sapiens
ctgcaggagcaaagcctctgct

SEQ ID NO: 8279313 - DNA, 22 bp, Homo sapiens
ctgcaggagggctggggaagcc

SEQ ID NO: 8279314 - DNA, 22 bp, Homo sapiens
ctgcaggaggatcctgagagtg

SEQ ID NO: 8279315 - DNA, 22 bp, Homo sapiens
ctgaggtgtgagccacttcccc

SEQ ID NO: 8279316 - DNA, 22 bp, Homo sapiens
ctgaggtgtgaaatggtggcaa

SEQ ID NO: 8279317 - DNA, 22 bp, Homo sapiens
ctgaggtttacaagctattgct

SEQ ID NO: 8279318 - DNA, 22 bp, Homo sapiens
ctgcaggaatctgtgctaggtg

SEQ ID NO: 8279319 - DNA, 22 bp, Homo sapiens
ctgcaggactgaaagatgaggt

SEQ ID NO: 8279320 - DNA, 22 bp, Homo sapiens
ctgcagcctcaacctcctgagc

SEQ ID NO: 8279321 - DNA, 16 bp, Homo sapiens
ctgaggtttggccaca

SEQ ID NO: 8279322 - DNA, 22 bp, Homo sapiens
ctgcagcctaggtgcagctggg

SEQ ID NO: 8279323 - DNA, 22 bp, Homo sapiens
ctgccttggttcccagccagca

SEQ ID NO: 8279324 - DNA, 22 bp, Homo sapiens
ctgccttggaaaatgtggtaat

SEQ ID NO: 8279325 - DNA, 22 bp, Homo sapiens
ctgcctggggcatcagtcaagg

SEQ ID NO: 8279326 - DNA, 22 bp, Homo sapiens
ctgcccctgccaggcagctgtc

SEQ ID NO: 8279327 - DNA, 18 bp, Homo sapiens
ctgcctgttgctgagagg

SEQ ID NO: 8279328 - DNA, 22 bp, Homo sapiens
ctgccttccaaccccagactcc

SEQ ID NO: 8279329 - DNA, 22 bp, Homo sapiens
ctgctgagagctgaaggctgta

SEQ ID NO: 8279330 - DNA, 22 bp, Homo sapiens
ctgctgagatgccaggagctct

SEQ ID NO: 8279331 - DNA, 22 bp, Homo sapiens
ctgctgagagccccagctgaga

SEQ ID NO: 8279332 - DNA, 22 bp, Homo sapiens
ctgctgagactggctttgtgtc

SEQ ID NO: 8279333 - DNA, 22 bp, Homo sapiens
ctgctgagaaccagggagaatt

SEQ ID NO: 8279334 - DNA, 22 bp, Homo sapiens
ctgctgactcattttcaacact

SEQ ID NO: 8279335 - DNA, 22 bp, Homo sapiens
ctggagaaacatcaggcatagg

SEQ ID NO: 8279336 - DNA, 22 bp, Homo sapiens
ctggagaaaatccatgtgtatg

SEQ ID NO: 8279337 - DNA, 22 bp, Homo sapiens
ctggagccggcgagccccagcc

SEQ ID NO: 8279338 - DNA, 22 bp, Homo sapiens
cctctttgactatagtagttaa

SEQ ID NO: 8279339 - DNA, 22 bp, Homo sapiens
cctctttgactctcaggtcttt

SEQ ID NO: 8279340 - DNA, 22 bp, Homo sapiens
cctctttgagattcagttttcc

SEQ ID NO: 8279341 - DNA, 22 bp, Homo sapiens
tgggcagggagctggaaccaca

SEQ ID NO: 8279342 - DNA, 22 bp, Homo sapiens
tgggccagaggcatggagctat

SEQ ID NO: 8279343 - DNA, 22 bp, Homo sapiens
tgggccagaggcatggagctat

SEQ ID NO: 8279344 - DNA, 20 bp, Homo sapiens
tggctctctctagtaagtgg

SEQ ID NO: 8279345 - DNA, 21 bp, Homo sapiens
tggctctgaaagagtgctgca

SEQ ID NO: 8279346 - DNA, 21 bp, Homo sapiens
tgggagagcgttgctgtcctc

SEQ ID NO: 8279347 - DNA, 22 bp, Homo sapiens
tggctctcccaatacctttctg

SEQ ID NO: 8279348 - DNA, 23 bp, Homo sapiens
tggctctctcagtgctgcagagg

SEQ ID NO: 8279349 - DNA, 22 bp, Homo sapiens
tggctctccagagcctatggta

SEQ ID NO: 8279350 - DNA, 22 bp, Homo sapiens
cctccctctttcagtcccacag

SEQ ID NO: 8279351 - DNA, 22 bp, Homo sapiens
tgggagccattttagaggctgc

SEQ ID NO: 8279352 - DNA, 22 bp, Homo sapiens
tgggagcccaagggagctgccg

SEQ ID NO: 8279353 - DNA, 22 bp, Homo sapiens
tgggagcctggcaggccagagg

SEQ ID NO: 8279354 - DNA, 22 bp, Homo sapiens
cctctggcaacttcacagccca

SEQ ID NO: 8279355 - DNA, 22 bp, Homo sapiens
cctgagcttgatccttctgtct

SEQ ID NO: 8279356 - DNA, 22 bp, Homo sapiens
cctgaggctggcccttccatcc

SEQ ID NO: 8279357 - DNA, 22 bp, Homo sapiens
cctgcacttctcacagctgctg

SEQ ID NO: 8279358 - DNA, 22 bp, Homo sapiens
cctgccaggagctggtgctgca

SEQ ID NO: 8279359 - DNA, 22 bp, Homo sapiens
tgggggtgtgccagggacctcc

SEQ ID NO: 8279360 - DNA, 22 bp, Homo sapiens
tgggggtgtcctggtgcacaca

SEQ ID NO: 8279361 - DNA, 22 bp, Homo sapiens
tgggggagagaggcattctttc

SEQ ID NO: 8279362 - DNA, 22 bp, Homo sapiens
cctgcctgtactagagacccag

SEQ ID NO: 8279363 - DNA, 22 bp, Homo sapiens
tgggtcagtttgggggccagcc

SEQ ID NO: 8279364 - DNA, 23 bp, Homo sapiens
tgggtcagctgcctccaggacaa

SEQ ID NO: 8279365 - DNA, 22 bp, Homo sapiens
cctgccaggcgagtctaggcca

SEQ ID NO: 8279366 - DNA, 22 bp, Homo sapiens
cctgccagggccagaggccagc

SEQ ID NO: 8279367 - DNA, 22 bp, Homo sapiens
tgggtcactctatcctgcttag

SEQ ID NO: 8279368 - DNA, 22 bp, Homo sapiens
tggtctcttttcagcctgggga

SEQ ID NO: 8279369 - DNA, 22 bp, Homo sapiens
cctgccttcagccctgaagtct

SEQ ID NO: 8279370 - DNA, 22 bp, Homo sapiens
tggtctctgtgctcgggcatgg

SEQ ID NO: 8279371 - DNA, 22 bp, Homo sapiens
cctgctggacaggggtgttcat

SEQ ID NO: 8279372 - DNA, 22 bp, Homo sapiens
tggtctgcctggatcacagccc

SEQ ID NO: 8279373 - DNA, 22 bp, Homo sapiens
cctgctggcattcttgctccct

SEQ ID NO: 8279374 - DNA, 18 bp, Homo sapiens
cctggagctccacagcaa

SEQ ID NO: 8279375 - DNA, 22 bp, Homo sapiens
cctggagggcgccgcacagtcc

SEQ ID NO: 8279376 - DNA, 22 bp, Homo sapiens
cctggagggcagcccattctgg

SEQ ID NO: 8279377 - DNA, 22 bp, Homo sapiens
tgtcaacacacctatctcaatt

SEQ ID NO: 8279378 - DNA, 22 bp, Homo sapiens
tgtaagtagtaatggaaggaca

SEQ ID NO: 8279379 - DNA, 22 bp, Homo sapiens
tgtacatgtgtctgtatatctt

SEQ ID NO: 8279380 - DNA, 22 bp, Homo sapiens
tgtacatgaataaaagatcttg

SEQ ID NO: 8279381 - DNA, 22 bp, Homo sapiens
tgtacattttctcagagtttat

SEQ ID NO: 8279382 - DNA, 22 bp, Homo sapiens
tgtaatttgcatggctgaatgc

SEQ ID NO: 8279383 - DNA, 22 bp, Homo sapiens
tgtaatttcctgatgttagaac

SEQ ID NO: 8279384 - DNA, 22 bp, Homo sapiens
tgtaatttcctgatgttagaac

SEQ ID NO: 8279385 - DNA, 22 bp, Homo sapiens
tgtacagtggaaaatggattcg

SEQ ID NO: 8279386 - DNA, 22 bp, Homo sapiens
tgtacagtgccatgcagtttgc

SEQ ID NO: 8279387 - DNA, 22 bp, Homo sapiens
tgtaattttacgtgacacagtt

SEQ ID NO: 8279388 - DNA, 22 bp, Homo sapiens
tgtacagtgtagtcatgaggtt

SEQ ID NO: 8279389 - DNA, 22 bp, Homo sapiens
tgtacagtgtaaataagtggat

SEQ ID NO: 8279390 - DNA, 22 bp, Homo sapiens
tgtacagttttaactctgaggg

SEQ ID NO: 8279391 - DNA, 22 bp, Homo sapiens
cctcacagccctcctctagcac

SEQ ID NO: 8279392 - DNA, 22 bp, Homo sapiens
cctcacagaggggcagccatct

SEQ ID NO: 8279393 - DNA, 17 bp, Homo sapiens
cctcacagggaccagac

SEQ ID NO: 8279394 - DNA, 20 bp, Homo sapiens
cctcacagggcagagagggg

SEQ ID NO: 8279395 - DNA, 20 bp, Homo sapiens
cctcacagggcagagagggg

SEQ ID NO: 8279396 - DNA, 22 bp, Homo sapiens
ccgtggctggactggcattcag

SEQ ID NO: 8279397 - DNA, 22 bp, Homo sapiens
ccggctactcgggaggctgacg

SEQ ID NO: 8279398 - DNA, 22 bp, Homo sapiens
ccgggcgggggctctcgtcacc

SEQ ID NO: 8279399 - DNA, 22 bp, Homo sapiens
ccggctactcgggaggctgacg

SEQ ID NO: 8279400 - DNA, 22 bp, Homo sapiens
ccgctgtctcatcagtgcccgg

SEQ ID NO: 8279401 - DNA, 22 bp, Homo sapiens
ccgctgtcctggagctgctgct

SEQ ID NO: 8279402 - DNA, 23 bp, Homo sapiens
ccctgtagcccaggacaggcttt

SEQ ID NO: 8279403 - DNA, 22 bp, Homo sapiens
tggctacatttatactctcatt

SEQ ID NO: 8279404 - DNA, 22 bp, Homo sapiens
tggctacatttgttgatcactt

SEQ ID NO: 8279405 - DNA, 22 bp, Homo sapiens
tggctacatttatactctcatt

SEQ ID NO: 8279406 - DNA, 22 bp, Homo sapiens
tggctacagtggcatatcaaat

SEQ ID NO: 8279407 - DNA, 21 bp, Homo sapiens
tggctacagtggtaagaactg

SEQ ID NO: 8279408 - DNA, 21 bp, Homo sapiens
tggctacagtggtaagaactg

SEQ ID NO: 8279409 - DNA, 22 bp, Homo sapiens
tggctacagcaagaggaaagaa

SEQ ID NO: 8279410 - DNA, 22 bp, Homo sapiens
tggctacagacattcctaggga

SEQ ID NO: 8279411 - DNA, 22 bp, Homo sapiens
tggctacagatttgctgacaat

SEQ ID NO: 8279412 - DNA, 22 bp, Homo sapiens
tggctacagcaagaggaaagaa

SEQ ID NO: 8279413 - DNA, 22 bp, Homo sapiens
tggctacagaatgaatgctgcc

SEQ ID NO: 8279414 - DNA, 22 bp, Homo sapiens
tggctacaagtgtgtttagttt

SEQ ID NO: 8279415 - DNA, 19 bp, Homo sapiens
tggctaattttatagaggc

SEQ ID NO: 8279416 - DNA, 22 bp, Homo sapiens
tggctacaaggtggctattcta

SEQ ID NO: 8279417 - DNA, 22 bp, Homo sapiens
tggctaaggtcgatagaggctt

SEQ ID NO: 8279418 - DNA, 22 bp, Homo sapiens
cctccctccctgcagaagccac

SEQ ID NO: 8279419 - DNA, 22 bp, Homo sapiens
cctccctccattgccatcgtct

SEQ ID NO: 8279420 - DNA, 23 bp, Homo sapiens
tggctcagctagttttccatttc

SEQ ID NO: 8279421 - DNA, 21 bp, Homo sapiens
tggccctggccacggctgcca

SEQ ID NO: 8279422 - DNA, 19 bp, Homo sapiens
cctcaccctgcagaggagg

SEQ ID NO: 8279423 - DNA, 19 bp, Homo sapiens
cctcaccctgcagaggagg

SEQ ID NO: 8279424 - DNA, 22 bp, Homo sapiens
cctcactctgcaccctgcagca

SEQ ID NO: 8279425 - DNA, 22 bp, Homo sapiens
tggcctctctaccaggcagcct

SEQ ID NO: 8279426 - DNA, 22 bp, Homo sapiens
tggcctctcctggcagcatcca

SEQ ID NO: 8279427 - DNA, 22 bp, Homo sapiens
cctcagctgcttccctggagcc

SEQ ID NO: 8279428 - DNA, 22 bp, Homo sapiens
tggctaacaaggtgaaaccccg

SEQ ID NO: 8279429 - DNA, 22 bp, Homo sapiens
ccctagaacacgcagacactga

SEQ ID NO: 8279430 - DNA, 22 bp, Homo sapiens
tggaaagagaaactcttgctaa

SEQ ID NO: 8279431 - DNA, 22 bp, Homo sapiens
tggaagaataggatagaagaac

SEQ ID NO: 8279432 - DNA, 22 bp, Homo sapiens
tggaagaaggcagagaggcatt

SEQ ID NO: 8279433 - DNA, 22 bp, Homo sapiens
cccgtgtgtgcgaggctcccgc

SEQ ID NO: 8279434 - DNA, 17 bp, Homo sapiens
cccgttctcttcgctgg

SEQ ID NO: 8279435 - DNA, 22 bp, Homo sapiens
cccgtaaagcatgggttatgct

SEQ ID NO: 8279436 - DNA, 22 bp, Homo sapiens
tggaagaatgtttgccttataa

SEQ ID NO: 8279437 - DNA, 22 bp, Homo sapiens
tgcctgctccagtcctgtccac

SEQ ID NO: 8279438 - DNA, 21 bp, Homo sapiens
tgctttcagactcttacagaa

SEQ ID NO: 8279439 - DNA, 17 bp, Homo sapiens
tgcctccagcagggtga

SEQ ID NO: 8279440 - DNA, 23 bp, Homo sapiens
tgcctccaccgagggccaggcat

SEQ ID NO: 8279441 - DNA, 22 bp, Homo sapiens
tgcctccaccattgctcacttt

SEQ ID NO: 8279442 - DNA, 22 bp, Homo sapiens
tgcctccatgtttcagcatcta

SEQ ID NO: 8279443 - DNA, 22 bp, Homo sapiens
tgcctccatgtttcagcatcta

SEQ ID NO: 8279444 - DNA, 22 bp, Homo sapiens
tgcctccaggaggggcagctct

SEQ ID NO: 8279445 - DNA, 22 bp, Homo sapiens
tgcctccaccattgctcacttt

SEQ ID NO: 8279446 - DNA, 22 bp, Homo sapiens
tgcctccaacagcccatcctag

SEQ ID NO: 8279447 - DNA, 22 bp, Homo sapiens
tgcctccaacagcccatcctag

SEQ ID NO: 8279448 - DNA, 22 bp, Homo sapiens
tgcctcagtttcatctgcagaa

SEQ ID NO: 8279449 - DNA, 22 bp, Homo sapiens
ccctgcagagggatgggggcag

SEQ ID NO: 8279450 - DNA, 22 bp, Homo sapiens
ccctgcagagccagccctgacc

SEQ ID NO: 8279451 - DNA, 22 bp, Homo sapiens
ccctgcagatcagtgagaactt

SEQ ID NO: 8279452 - DNA, 22 bp, Homo sapiens
ccctgcagatctagggtccttc

SEQ ID NO: 8279453 - DNA, 22 bp, Homo sapiens
ccctgcagccggccagctcatt

SEQ ID NO: 8279454 - DNA, 22 bp, Homo sapiens
tggacaggtgcacacagcagcc

SEQ ID NO: 8279455 - DNA, 20 bp, Homo sapiens
ccctgcagccatgggagtgg

SEQ ID NO: 8279456 - DNA, 22 bp, Homo sapiens
ccctgcagaaccacagacaaac

SEQ ID NO: 8279457 - DNA, 22 bp, Homo sapiens
ccctgcagagaccactgacctt

SEQ ID NO: 8279458 - DNA, 22 bp, Homo sapiens
tggacaggttgagtaggaggag

SEQ ID NO: 8279459 - DNA, 22 bp, Homo sapiens
tggacaggtttgggtgcctgtt

SEQ ID NO: 8279460 - DNA, 22 bp, Homo sapiens
ccctgccttgttggagcctatg

SEQ ID NO: 8279461 - DNA, 22 bp, Homo sapiens
ccctgccttgttggagcctatg

SEQ ID NO: 8279462 - DNA, 22 bp, Homo sapiens
ccctgccttgtctgggctaggt

SEQ ID NO: 8279463 - DNA, 19 bp, Homo sapiens
tggaggggtttgaatgtgg

SEQ ID NO: 8279464 - DNA, 22 bp, Homo sapiens
tggagggtcaccccttgctgag

SEQ ID NO: 8279465 - DNA, 22 bp, Homo sapiens
tggaggggcaatggagcgcgga

SEQ ID NO: 8279466 - DNA, 22 bp, Homo sapiens
cccaggagacagaaacagaggt

SEQ ID NO: 8279467 - DNA, 22 bp, Homo sapiens
cccaggaggacattccataccc

SEQ ID NO: 8279468 - DNA, 22 bp, Homo sapiens
cccaggagatctggatctcgtc

SEQ ID NO: 8279469 - DNA, 22 bp, Homo sapiens
cccaggaggcagatgttgcagt

SEQ ID NO: 8279470 - DNA, 22 bp, Homo sapiens
cccaggaggcctgcctggccgg

SEQ ID NO: 8279471 - DNA, 22 bp, Homo sapiens
cccaggaggcctgcctggccgg

SEQ ID NO: 8279472 - DNA, 22 bp, Homo sapiens
cccaggaggcagagatagcagt

SEQ ID NO: 8279473 - DNA, 22 bp, Homo sapiens
cccaggaggcagagcttgcagt

SEQ ID NO: 8279474 - DNA, 22 bp, Homo sapiens
cccaggaggcagagcttgcagt

SEQ ID NO: 8279475 - DNA, 22 bp, Homo sapiens
cccaggaggcagaagttgcagt

SEQ ID NO: 8279476 - DNA, 22 bp, Homo sapiens
cccaggaggttggggctacagt

SEQ ID NO: 8279477 - DNA, 19 bp, Homo sapiens
cccaggagtctggctggtt

SEQ ID NO: 8279478 - DNA, 19 bp, Homo sapiens
cccaggagtctggctggtt

SEQ ID NO: 8279479 - DNA, 20 bp, Homo sapiens
cccaggagtgagcagcttta

SEQ ID NO: 8279480 - DNA, 20 bp, Homo sapiens
cccaggagtgagcagcttta

SEQ ID NO: 8279481 - DNA, 22 bp, Homo sapiens
cccagcccccgagtgtctggaa

SEQ ID NO: 8279482 - DNA, 22 bp, Homo sapiens
cccagcccatctcaaaggtcta

SEQ ID NO: 8279483 - DNA, 22 bp, Homo sapiens
cccagcccagcgttcgaggggt

SEQ ID NO: 8279484 - DNA, 20 bp, Homo sapiens
cccagcccctacctgttgcc

SEQ ID NO: 8279485 - DNA, 22 bp, Homo sapiens
cccagccctgacctattggaaa

SEQ ID NO: 8279486 - DNA, 22 bp, Homo sapiens
cccagccctgacctattggaaa

SEQ ID NO: 8279487 - DNA, 22 bp, Homo sapiens
cccagcccacggtcctgggtgg

SEQ ID NO: 8279488 - DNA, 22 bp, Homo sapiens
cccagcaggtgccatcactctg

SEQ ID NO: 8279489 - DNA, 22 bp, Homo sapiens
cccagcatctccaggcatggcc

SEQ ID NO: 8279490 - DNA, 22 bp, Homo sapiens
cccagcatttctgggctgcact

SEQ ID NO: 8279491 - DNA, 22 bp, Homo sapiens
tgcagcagtttaatgcagggtt

SEQ ID NO: 8279492 - DNA, 22 bp, Homo sapiens
tgcagtggcgccatctcagctc

SEQ ID NO: 8279493 - DNA, 22 bp, Homo sapiens
cccagctcatcaggagccgccc

SEQ ID NO: 8279494 - DNA, 22 bp, Homo sapiens
cccagctccaagggacagcgaa

SEQ ID NO: 8279495 - DNA, 22 bp, Homo sapiens
tgcagtggaatctggagagcag

SEQ ID NO: 8279496 - DNA, 22 bp, Homo sapiens
tgcagtggaagaggtggagatc

SEQ ID NO: 8279497 - DNA, 22 bp, Homo sapiens
tgcagtggaaagactcagactt

SEQ ID NO: 8279498 - DNA, 22 bp, Homo sapiens
cccaggaattggaggctgcagt

SEQ ID NO: 8279499 - DNA, 22 bp, Homo sapiens
cccagctccgagctccgagccg

SEQ ID NO: 8279500 - DNA, 22 bp, Homo sapiens
cccagctccctggtatttgtgc

SEQ ID NO: 8279501 - DNA, 18 bp, Homo sapiens
cccagctccacttccctc

SEQ ID NO: 8279502 - DNA, 18 bp, Homo sapiens
cccagctccacttccctc

SEQ ID NO: 8279503 - DNA, 22 bp, Homo sapiens
cccagctcccatgttctccaat

SEQ ID NO: 8279504 - DNA, 22 bp, Homo sapiens
cccagctcccaagttgctatgg

SEQ ID NO: 8279505 - DNA, 22 bp, Homo sapiens
cccacaggtgtgagcttgctgg

SEQ ID NO: 8279506 - DNA, 22 bp, Homo sapiens
cccacaggccctgctgccttga

SEQ ID NO: 8279507 - DNA, 22 bp, Homo sapiens
cccacccagcctggctgagggg

SEQ ID NO: 8279508 - DNA, 22 bp, Homo sapiens
cccacccagctgagccgctcac

SEQ ID NO: 8279509 - DNA, 22 bp, Homo sapiens
cccacccactctgaccagaagc

SEQ ID NO: 8279510 - DNA, 22 bp, Homo sapiens
cccaccagattctcaaatatct

SEQ ID NO: 8279511 - DNA, 22 bp, Homo sapiens
tgcagaggtgttgctgagataa

SEQ ID NO: 8279512 - DNA, 22 bp, Homo sapiens
tgcagaggtgaaagactagcaa

SEQ ID NO: 8279513 - DNA, 22 bp, Homo sapiens
tgcagaggtttccaggcaagtt

SEQ ID NO: 8279514 - DNA, 22 bp, Homo sapiens
tgcagaggtttgtggtgttgct

SEQ ID NO: 8279515 - DNA, 22 bp, Homo sapiens
tgcagagtaaaagcagatgcta

SEQ ID NO: 8279516 - DNA, 22 bp, Homo sapiens
cccagcagatggctatgtgcta

SEQ ID NO: 8279517 - DNA, 23 bp, Homo sapiens
cccagcagagatgaggaggggtc

SEQ ID NO: 8279518 - DNA, 22 bp, Homo sapiens
cccagcagaccgctgtgatggc

SEQ ID NO: 8279519 - DNA, 22 bp, Homo sapiens
cccagcagaatctgatgagggc

SEQ ID NO: 8279520 - DNA, 22 bp, Homo sapiens
tgcagcagtgttccttggcttg

SEQ ID NO: 8279521 - DNA, 22 bp, Homo sapiens
tgcagcagtcagtcaggcctgg

SEQ ID NO: 8279522 - DNA, 22 bp, Homo sapiens
tgcagcaggtatggcaagctcc

SEQ ID NO: 8279523 - DNA, 22 bp, Homo sapiens
tgcagcaggtatggcaagctcc

SEQ ID NO: 8279524 - DNA, 22 bp, Homo sapiens
cccagcagccagaatgaggagc

SEQ ID NO: 8279525 - DNA, 23 bp, Homo sapiens
cccagcagattgtaaagtgtcca

SEQ ID NO: 8279526 - DNA, 21 bp, Homo sapiens
tgaggcaggggtgcttttgtc

SEQ ID NO: 8279527 - DNA, 22 bp, Homo sapiens
tgaggcagtattttagtgactt

SEQ ID NO: 8279528 - DNA, 22 bp, Homo sapiens
tgatacataaaccatcattttg

SEQ ID NO: 8279529 - DNA, 22 bp, Homo sapiens
tgatgacaatgttgctgcaata

SEQ ID NO: 8279530 - DNA, 22 bp, Homo sapiens
tgatgacaaactttcctgatgc

SEQ ID NO: 8279531 - DNA, 16 bp, Homo sapiens
tgatgacagatatggc

SEQ ID NO: 8279532 - DNA, 22 bp, Homo sapiens
tgatgacagtgttacagctcca

SEQ ID NO: 8279533 - DNA, 22 bp, Homo sapiens
tgatgacaggcagggttaagtg

SEQ ID NO: 8279534 - DNA, 22 bp, Homo sapiens
tgatgacagcatggaccccagg

SEQ ID NO: 8279535 - DNA, 22 bp, Homo sapiens
ccatggaagaactgatgtgcca

SEQ ID NO: 8279536 - DNA, 22 bp, Homo sapiens
ccattgtagtatctgttttagt

SEQ ID NO: 8279537 - DNA, 22 bp, Homo sapiens
cccaaagcagggtcattgggcc

SEQ ID NO: 8279538 - DNA, 23 bp, Homo sapiens
tgagctggtattgtccatctcca

SEQ ID NO: 8279539 - DNA, 22 bp, Homo sapiens
tgagctgggctgggctgagctg

SEQ ID NO: 8279540 - DNA, 22 bp, Homo sapiens
tgagctggggtcagctcccctg

SEQ ID NO: 8279541 - DNA, 22 bp, Homo sapiens
tgaggacattggtcaggacatg

SEQ ID NO: 8279542 - DNA, 23 bp, Homo sapiens
ccagtggcgtaaactagaggata

SEQ ID NO: 8279543 - DNA, 22 bp, Homo sapiens
tgaggacatgagtgggacagag

SEQ ID NO: 8279544 - DNA, 22 bp, Homo sapiens
tgaggacattgagactggagac

SEQ ID NO: 8279545 - DNA, 22 bp, Homo sapiens
tgaggacattaggaagtgaagg

SEQ ID NO: 8279546 - DNA, 22 bp, Homo sapiens
tgagctggcaggggctcaggga

SEQ ID NO: 8279547 - DNA, 22 bp, Homo sapiens
tgagctgggaagagcagccaga

SEQ ID NO: 8279548 - DNA, 22 bp, Homo sapiens
tgagctgggaagagcagccaga

SEQ ID NO: 8279549 - DNA, 22 bp, Homo sapiens
tgagctggcttgtcaaccaggg

SEQ ID NO: 8279550 - DNA, 22 bp, Homo sapiens
tgagctggcttgtcaaccaggg

SEQ ID NO: 8279551 - DNA, 22 bp, Homo sapiens
tgagataacaaaattatcttca

SEQ ID NO: 8279552 - DNA, 22 bp, Homo sapiens
tgagagttctctcttcaggtgg

SEQ ID NO: 8279553 - DNA, 22 bp, Homo sapiens
tgagagttttgacgcttgtaac

SEQ ID NO: 8279554 - DNA, 22 bp, Homo sapiens
tgagagttattctgaatttagc

SEQ ID NO: 8279555 - DNA, 22 bp, Homo sapiens
ccagggttataaatgcatctgt

SEQ ID NO: 8279556 - DNA, 22 bp, Homo sapiens
ccagggttggtctctctgaggt

SEQ ID NO: 8279557 - DNA, 22 bp, Homo sapiens
ccagggtggggtccaggaacca

SEQ ID NO: 8279558 - DNA, 22 bp, Homo sapiens
ccagggaagattagaagccact

SEQ ID NO: 8279559 - DNA, 22 bp, Homo sapiens
tgacagagacagattgaagctt

SEQ ID NO: 8279560 - DNA, 22 bp, Homo sapiens
tgacagagacagattgaagctt

SEQ ID NO: 8279561 - DNA, 22 bp, Homo sapiens
tgacagagacttcagagccaaa

SEQ ID NO: 8279562 - DNA, 22 bp, Homo sapiens
ccagggaaactttggagtggag

SEQ ID NO: 8279563 - DNA, 22 bp, Homo sapiens
tgaaggagaattaataggcatt

SEQ ID NO: 8279564 - DNA, 22 bp, Homo sapiens
tgaaggagaaatggaaagtggg

SEQ ID NO: 8279565 - DNA, 23 bp, Homo sapiens
tgacagagcaagacttggtctca

SEQ ID NO: 8279566 - DNA, 19 bp, Homo sapiens
tgacagagagcagggtggt

SEQ ID NO: 8279567 - DNA, 22 bp, Homo sapiens
tgacagagagcttttgactgtc

SEQ ID NO: 8279568 - DNA, 22 bp, Homo sapiens
tgacagagagcttttgactgtc

SEQ ID NO: 8279569 - DNA, 22 bp, Homo sapiens
tgacagagctggagaataattt

SEQ ID NO: 8279570 - DNA, 22 bp, Homo sapiens
tgacagaggagctggaatgatt

SEQ ID NO: 8279571 - DNA, 22 bp, Homo sapiens
tgacagagctgggatttgaagc

SEQ ID NO: 8279572 - DNA, 22 bp, Homo sapiens
tgacagagcatgtagtgacagc

SEQ ID NO: 8279573 - DNA, 22 bp, Homo sapiens
tgacagagttcggattgagttt

SEQ ID NO: 8279574 - DNA, 22 bp, Homo sapiens
tgacagagtccagaagtagtgt

SEQ ID NO: 8279575 - DNA, 22 bp, Homo sapiens
tgacagagtgacactcttgtct

SEQ ID NO: 8279576 - DNA, 22 bp, Homo sapiens
tgacagagtccagaagtagtgt

SEQ ID NO: 8279577 - DNA, 22 bp, Homo sapiens
tgacagaggctgagttagtctg

SEQ ID NO: 8279578 - DNA, 22 bp, Homo sapiens
tgacagaggcacccacaactat

SEQ ID NO: 8279579 - DNA, 22 bp, Homo sapiens
ccagggcccacggccagaatag

SEQ ID NO: 8279580 - DNA, 22 bp, Homo sapiens
ccagggccagtaagattggcat

SEQ ID NO: 8279581 - DNA, 22 bp, Homo sapiens
ccagggccagtaagattggcat

SEQ ID NO: 8279582 - DNA, 22 bp, Homo sapiens
tgacatgaaactgtgttgctac

SEQ ID NO: 8279583 - DNA, 22 bp, Homo sapiens
tgacatgctaagattatgttat

SEQ ID NO: 8279584 - DNA, 22 bp, Homo sapiens
tgacatctagtaggtagagacc

SEQ ID NO: 8279585 - DNA, 22 bp, Homo sapiens
tgacatctgccagtttggtcgt

SEQ ID NO: 8279586 - DNA, 22 bp, Homo sapiens
tgacatctcattttgttgttgt

SEQ ID NO: 8279587 - DNA, 23 bp, Homo sapiens
ccagggcccctacaccactgtcc

SEQ ID NO: 8279588 - DNA, 22 bp, Homo sapiens
tgaacagatcaatagaactgac

SEQ ID NO: 8279589 - DNA, 22 bp, Homo sapiens
tgaacagagctgattcagctca

SEQ ID NO: 8279590 - DNA, 22 bp, Homo sapiens
tgaagagattaagttggttttg

SEQ ID NO: 8279591 - DNA, 17 bp, Homo sapiens
tgaagatgcatggcagc

SEQ ID NO: 8279592 - DNA, 22 bp, Homo sapiens
tgaagatttaagcatctcaatt

SEQ ID NO: 8279593 - DNA, 22 bp, Homo sapiens
tgaacacataaaagcaaagggt

SEQ ID NO: 8279594 - DNA, 22 bp, Homo sapiens
tgaacacatattaggtgctcat

SEQ ID NO: 8279595 - DNA, 22 bp, Homo sapiens
tgaaatgcaacagttatttttg

SEQ ID NO: 8279596 - DNA, 22 bp, Homo sapiens
ccaggctgcagtcaaggggcat

SEQ ID NO: 8279597 - DNA, 22 bp, Homo sapiens
tgaaaggcagttagaggtgttt

SEQ ID NO: 8279598 - DNA, 22 bp, Homo sapiens
ccaggctccccaggaggccctt

SEQ ID NO: 8279599 - DNA, 22 bp, Homo sapiens
tgaaacagattgatggtttcta

SEQ ID NO: 8279600 - DNA, 22 bp, Homo sapiens
tgaaagctgggcacaagattct

SEQ ID NO: 8279601 - DNA, 21 bp, Homo sapiens
tcttgtccttgctctcccact

SEQ ID NO: 8279602 - DNA, 22 bp, Homo sapiens
tcttgggggactttggcatgga

SEQ ID NO: 8279603 - DNA, 22 bp, Homo sapiens
tcttggtatacgcatggcattg

SEQ ID NO: 8279604 - DNA, 22 bp, Homo sapiens
tcttgccttatgccatgaagca

SEQ ID NO: 8279605 - DNA, 21 bp, Homo sapiens
tcttggggaggagggctgcac

SEQ ID NO: 8279606 - DNA, 18 bp, Homo sapiens
tcttgcctgcaccctctc

SEQ ID NO: 8279607 - DNA, 22 bp, Homo sapiens
tcttggtttttccagggctgat

SEQ ID NO: 8279608 - DNA, 21 bp, Homo sapiens
tcttggttccgtgtgtttgat

SEQ ID NO: 8279609 - DNA, 22 bp, Homo sapiens
ccagcctcactggcatcaccta

SEQ ID NO: 8279610 - DNA, 22 bp, Homo sapiens
tctttaatatctgccccagagc

SEQ ID NO: 8279611 - DNA, 22 bp, Homo sapiens
tctttaagccaagatatattta

SEQ ID NO: 8279612 - DNA, 22 bp, Homo sapiens
tctttaatataaaggaatgaat

SEQ ID NO: 8279613 - DNA, 22 bp, Homo sapiens
ccaggctcacctggagcccctg

SEQ ID NO: 8279614 - DNA, 22 bp, Homo sapiens
ccaggctcagcgcgcacgtctg

SEQ ID NO: 8279615 - DNA, 22 bp, Homo sapiens
ccaggctcagctattaagaaac

SEQ ID NO: 8279616 - DNA, 22 bp, Homo sapiens
ccaggctcaggtgcgagagaca

SEQ ID NO: 8279617 - DNA, 22 bp, Homo sapiens
ccaggctcagggcagactttca

SEQ ID NO: 8279618 - DNA, 17 bp, Homo sapiens
ccaggctccatcactgt

SEQ ID NO: 8279619 - DNA, 22 bp, Homo sapiens
tcggggtctttgacacgctctg

SEQ ID NO: 8279620 - DNA, 22 bp, Homo sapiens
tcgcttgaacccaggaagtgga

SEQ ID NO: 8279621 - DNA, 23 bp, Homo sapiens
tcggtgggcgtggaggccgaggc

SEQ ID NO: 8279622 - DNA, 22 bp, Homo sapiens
ccacccttgggttcggaggccg

SEQ ID NO: 8279623 - DNA, 22 bp, Homo sapiens
ccaccacatttgcctagacttt

SEQ ID NO: 8279624 - DNA, 22 bp, Homo sapiens
ccaccacttctggcttctggtg

SEQ ID NO: 8279625 - DNA, 22 bp, Homo sapiens
ccaccagcagtgtgcaaggatt

SEQ ID NO: 8279626 - DNA, 22 bp, Homo sapiens
ccaccagcttcagcagccgcgg

SEQ ID NO: 8279627 - DNA, 22 bp, Homo sapiens
tcgcgggttgcacatggccatc

SEQ ID NO: 8279628 - DNA, 22 bp, Homo sapiens
tcgcccaggctggagtgcagtg

SEQ ID NO: 8279629 - DNA, 22 bp, Homo sapiens
ccaccagctttggcggtgacag

SEQ ID NO: 8279630 - DNA, 22 bp, Homo sapiens
tcctctccatgtctcacgccac

SEQ ID NO: 8279631 - DNA, 18 bp, Homo sapiens
tcctctctttccccaggg

SEQ ID NO: 8279632 - DNA, 20 bp, Homo sapiens
tctccagatgcagatgacat

SEQ ID NO: 8279633 - DNA, 21 bp, Homo sapiens
tctccagagtgggaggaaatc

SEQ ID NO: 8279634 - DNA, 22 bp, Homo sapiens
tctccagaggtcccttgtctct

SEQ ID NO: 8279635 - DNA, 22 bp, Homo sapiens
tctccagaaatggggctgggga

SEQ ID NO: 8279636 - DNA, 22 bp, Homo sapiens
tctccaggaaccatcatggtaa

SEQ ID NO: 8279637 - DNA, 22 bp, Homo sapiens
tctccaggaaccatcatggtaa

SEQ ID NO: 8279638 - DNA, 21 bp, Homo sapiens
ccagagagagggaagtgggtt

SEQ ID NO: 8279639 - DNA, 20 bp, Homo sapiens
tctccctgcccatctcagat

SEQ ID NO: 8279640 - DNA, 22 bp, Homo sapiens
tctccctctttgtctgctttgg

SEQ ID NO: 8279641 - DNA, 22 bp, Homo sapiens
tctccctcattcctgcttccat

SEQ ID NO: 8279642 - DNA, 22 bp, Homo sapiens
tctcccacagtctcccatggct

SEQ ID NO: 8279643 - DNA, 22 bp, Homo sapiens
tctccacaagctttctcctttt

SEQ ID NO: 8279644 - DNA, 22 bp, Homo sapiens
ccagaaaaatcctcccttgtcc

SEQ ID NO: 8279645 - DNA, 22 bp, Homo sapiens
ccagaaaactctacatgcttgt

SEQ ID NO: 8279646 - DNA, 22 bp, Homo sapiens
tctccacattctattggctata

SEQ ID NO: 8279647 - DNA, 22 bp, Homo sapiens
tctccacactttctctcccagg

SEQ ID NO: 8279648 - DNA, 22 bp, Homo sapiens
tctcaaatttatacagagttca

SEQ ID NO: 8279649 - DNA, 22 bp, Homo sapiens
tctatagtttctgagtttcttc

SEQ ID NO: 8279650 - DNA, 22 bp, Homo sapiens
tctatagtgtagataatttgaa

SEQ ID NO: 8279651 - DNA, 22 bp, Homo sapiens
ccacctccacctattgccagcc

SEQ ID NO: 8279652 - DNA, 22 bp, Homo sapiens
ccacctcctaggcctggagaag

SEQ ID NO: 8279653 - DNA, 22 bp, Homo sapiens
ccacctctcagggtttcctaat

SEQ ID NO: 8279654 - DNA, 22 bp, Homo sapiens
tctgagagcaggaggagctgct

SEQ ID NO: 8279655 - DNA, 19 bp, Homo sapiens
ccagccctgtcacttcttg

SEQ ID NO: 8279656 - DNA, 20 bp, Homo sapiens
ccagcatgtacacatgtgga

SEQ ID NO: 8279657 - DNA, 22 bp, Homo sapiens
ccagccacagcttccagctcct

SEQ ID NO: 8279658 - DNA, 22 bp, Homo sapiens
ccagccctcactgaggcctctc

SEQ ID NO: 8279659 - DNA, 22 bp, Homo sapiens
tctgaattagaggatacgtctt

SEQ ID NO: 8279660 - DNA, 20 bp, Homo sapiens
tctgaattgagtgaatgtct

SEQ ID NO: 8279661 - DNA, 17 bp, Homo sapiens
tctgaatttatactttg

SEQ ID NO: 8279662 - DNA, 22 bp, Homo sapiens
tctgaattggctgcgtgtttaa

SEQ ID NO: 8279663 - DNA, 22 bp, Homo sapiens
tctgaatttcccaaggctatct

SEQ ID NO: 8279664 - DNA, 22 bp, Homo sapiens
ccagcagggttggtttcttctg

SEQ ID NO: 8279665 - DNA, 22 bp, Homo sapiens
ccagcaggggaatatttttagg

SEQ ID NO: 8279666 - DNA, 22 bp, Homo sapiens
ccagcaggtgtagggctcatgg

SEQ ID NO: 8279667 - DNA, 22 bp, Homo sapiens
ccagcaggtgtagggctcatgg

SEQ ID NO: 8279668 - DNA, 22 bp, Homo sapiens
tctctgtgtgccttcatctgcc

SEQ ID NO: 8279669 - DNA, 19 bp, Homo sapiens
ccagcaggttcatttcagg

SEQ ID NO: 8279670 - DNA, 17 bp, Homo sapiens
tctcctggctctatcag

SEQ ID NO: 8279671 - DNA, 22 bp, Homo sapiens
tctctcttgtcaccccatctgc

SEQ ID NO: 8279672 - DNA, 22 bp, Homo sapiens
tctctgagttctcctccagccc

SEQ ID NO: 8279673 - DNA, 22 bp, Homo sapiens
tctctgggagccaggatgacac

SEQ ID NO: 8279674 - DNA, 22 bp, Homo sapiens
tctctgcccaagtttctcaagt

SEQ ID NO: 8279675 - DNA, 22 bp, Homo sapiens
tctctgccacagcttctgcctt

SEQ ID NO: 8279676 - DNA, 22 bp, Homo sapiens
tctctgccaccatgagatgggc

SEQ ID NO: 8279677 - DNA, 22 bp, Homo sapiens
ccagcagggaaaaacccaccaa

SEQ ID NO: 8279678 - DNA, 22 bp, Homo sapiens
ccagcagctttattggctctcc

SEQ ID NO: 8279679 - DNA, 22 bp, Homo sapiens
ccagcagggcagtgccctggac

SEQ ID NO: 8279680 - DNA, 22 bp, Homo sapiens
ccagcagggcagtgccctggac

SEQ ID NO: 8279681 - DNA, 22 bp, Homo sapiens
ccagcagggaaaaacccaccaa

SEQ ID NO: 8279682 - DNA, 21 bp, Homo sapiens
ccagcagctcaaggatctctt

SEQ ID NO: 8279683 - DNA, 22 bp, Homo sapiens
ccagcagctgcaaagcctgggt

SEQ ID NO: 8279684 - DNA, 22 bp, Homo sapiens
ccagcagcatcctgcagcactt

SEQ ID NO: 8279685 - DNA, 22 bp, Homo sapiens
ccagcagccagagaaggacctc

SEQ ID NO: 8279686 - DNA, 22 bp, Homo sapiens
tcccaggaggtgcttcctagga

SEQ ID NO: 8279687 - DNA, 19 bp, Homo sapiens
tccccagcacctctgagtc

SEQ ID NO: 8279688 - DNA, 22 bp, Homo sapiens
tccccagaggtgaggcagcttt

SEQ ID NO: 8279689 - DNA, 22 bp, Homo sapiens
tccccactctgggccaccacaa

SEQ ID NO: 8279690 - DNA, 22 bp, Homo sapiens
tccccagctctgtgcttccact

SEQ ID NO: 8279691 - DNA, 22 bp, Homo sapiens
tccccagctctgtgcttccact

SEQ ID NO: 8279692 - DNA, 22 bp, Homo sapiens
tccccagcttgctacttctgct

SEQ ID NO: 8279693 - DNA, 22 bp, Homo sapiens
tccctagaggtcttcacaagat

SEQ ID NO: 8279694 - DNA, 22 bp, Homo sapiens
tccctaaactctgaactgattc

SEQ ID NO: 8279695 - DNA, 22 bp, Homo sapiens
tccctagtcgcatctgtggaga

SEQ ID NO: 8279696 - DNA, 22 bp, Homo sapiens
tccctagtcgcatctgtggaga

SEQ ID NO: 8279697 - DNA, 22 bp, Homo sapiens
tcctctccatattttctgattt

SEQ ID NO: 8279698 - DNA, 22 bp, Homo sapiens
tcctctccatgtctcacgccac

SEQ ID NO: 8279699 - DNA, 21 bp, Homo sapiens
tcctctccatgatctgtttgt

SEQ ID NO: 8279700 - DNA, 22 bp, Homo sapiens
catgttgtatcattctgttcct

SEQ ID NO: 8279701 - DNA, 22 bp, Homo sapiens
catgtttctgatgcagctttta

SEQ ID NO: 8279702 - DNA, 22 bp, Homo sapiens
catgttttctaggctttcacaa

SEQ ID NO: 8279703 - DNA, 22 bp, Homo sapiens
catgttgattagagagcttaga

SEQ ID NO: 8279704 - DNA, 22 bp, Homo sapiens
catgttctaatattgtgacata

SEQ ID NO: 8279705 - DNA, 22 bp, Homo sapiens
catgttctaatattgtgacata

SEQ ID NO: 8279706 - DNA, 22 bp, Homo sapiens
cattcaagagtggacataatgc

SEQ ID NO: 8279707 - DNA, 17 bp, Homo sapiens
cattcagagtaattaca

SEQ ID NO: 8279708 - DNA, 22 bp, Homo sapiens
tcccagaggaaatggcagctga

SEQ ID NO: 8279709 - DNA, 22 bp, Homo sapiens
tcccagagcccaagttggagag

SEQ ID NO: 8279710 - DNA, 22 bp, Homo sapiens
tcccactgagcatatgcagatg

SEQ ID NO: 8279711 - DNA, 22 bp, Homo sapiens
tcccaggacatgggctctgctc

SEQ ID NO: 8279712 - DNA, 22 bp, Homo sapiens
tcccagccaggctctaccactt

SEQ ID NO: 8279713 - DNA, 22 bp, Homo sapiens
tcccagccacagtttccacctg

SEQ ID NO: 8279714 - DNA, 22 bp, Homo sapiens
catctttggttttctatatgcc

SEQ ID NO: 8279715 - DNA, 20 bp, Homo sapiens
tcatgcaagattcataaagg

SEQ ID NO: 8279716 - DNA, 22 bp, Homo sapiens
tcatgaacatggaatatctttt

SEQ ID NO: 8279717 - DNA, 21 bp, Homo sapiens
tcatgaacattcactgactgc

SEQ ID NO: 8279718 - DNA, 22 bp, Homo sapiens
tcatgaacatctcaaataacca

SEQ ID NO: 8279719 - DNA, 22 bp, Homo sapiens
tcatgaacaaatgatttactaa

SEQ ID NO: 8279720 - DNA, 22 bp, Homo sapiens
tcatgaacttcctagccagact

SEQ ID NO: 8279721 - DNA, 22 bp, Homo sapiens
tcatgacaggtgagtttttagg

SEQ ID NO: 8279722 - DNA, 22 bp, Homo sapiens
tcatttatgtctttgccatcca

SEQ ID NO: 8279723 - DNA, 22 bp, Homo sapiens
tcattctttaccaagttgtcac

SEQ ID NO: 8279724 - DNA, 20 bp, Homo sapiens
tcattcgccccagtttaaga

SEQ ID NO: 8279725 - DNA, 22 bp, Homo sapiens
tccagagacttgcatgtgcttg

SEQ ID NO: 8279726 - DNA, 22 bp, Homo sapiens
tccagctcttcagttctgcaaa

SEQ ID NO: 8279727 - DNA, 22 bp, Homo sapiens
tccagctgcaaggggcacagct

SEQ ID NO: 8279728 - DNA, 22 bp, Homo sapiens
tccaggcccatagacacttctc

SEQ ID NO: 8279729 - DNA, 22 bp, Homo sapiens
tccagctggcctaacttcaggg

SEQ ID NO: 8279730 - DNA, 22 bp, Homo sapiens
tccaggccccagaccgtactgc

SEQ ID NO: 8279731 - DNA, 22 bp, Homo sapiens
tccaggccccactgaagcccct

SEQ ID NO: 8279732 - DNA, 22 bp, Homo sapiens
tccaggccccagcaccttggga

SEQ ID NO: 8279733 - DNA, 22 bp, Homo sapiens
tccaggcccctgcctgggcctg

SEQ ID NO: 8279734 - DNA, 22 bp, Homo sapiens
tccaggcccgagatgggctgga

SEQ ID NO: 8279735 - DNA, 22 bp, Homo sapiens
tccaggcccgagatgggctgga

SEQ ID NO: 8279736 - DNA, 22 bp, Homo sapiens
catgtgtgtggctgacaatttt

SEQ ID NO: 8279737 - DNA, 22 bp, Homo sapiens
taggaaattttactggtctggg

SEQ ID NO: 8279738 - DNA, 22 bp, Homo sapiens
tagctagaaagtttcagctgtg

SEQ ID NO: 8279739 - DNA, 22 bp, Homo sapiens
tagctagggtaagacttggacc

SEQ ID NO: 8279740 - DNA, 19 bp, Homo sapiens
taggaccctggtggccccc

SEQ ID NO: 8279741 - DNA, 22 bp, Homo sapiens
taggagaagagtcagggcctaa

SEQ ID NO: 8279742 - DNA, 20 bp, Homo sapiens
taggagcaatgagagtagaa

SEQ ID NO: 8279743 - DNA, 23 bp, Homo sapiens
taggaggagaccgcagtgttacc

SEQ ID NO: 8279744 - DNA, 21 bp, Homo sapiens
taggagctgatggggaagtag

SEQ ID NO: 8279745 - DNA, 22 bp, Homo sapiens
taggaggagggcatttgaagta

SEQ ID NO: 8279746 - DNA, 18 bp, Homo sapiens
taggaggatactgagatg

SEQ ID NO: 8279747 - DNA, 22 bp, Homo sapiens
cagggcggggtctgccggccct

SEQ ID NO: 8279748 - DNA, 22 bp, Homo sapiens
taggtacaaggagggattcttg

SEQ ID NO: 8279749 - DNA, 22 bp, Homo sapiens
taggtacacagtaagtgctcaa

SEQ ID NO: 8279750 - DNA, 22 bp, Homo sapiens
taggtacatggaattggacatt

SEQ ID NO: 8279751 - DNA, 22 bp, Homo sapiens
taggtacagtttctggtgtctt

SEQ ID NO: 8279752 - DNA, 22 bp, Homo sapiens
taggtaccaaggagtcactgga

SEQ ID NO: 8279753 - DNA, 22 bp, Homo sapiens
tagtgaattcctaataggaaga

SEQ ID NO: 8279754 - DNA, 22 bp, Homo sapiens
caggggagttttatgcaacaga

SEQ ID NO: 8279755 - DNA, 22 bp, Homo sapiens
cagggtggcaggcaccatggcc

SEQ ID NO: 8279756 - DNA, 22 bp, Homo sapiens
cagggtggcaggcaccatggcc

SEQ ID NO: 8279757 - DNA, 22 bp, Homo sapiens
tatcatttaacagaatcattgc

SEQ ID NO: 8279758 - DNA, 22 bp, Homo sapiens
cagccctgtgcggagggccctg

SEQ ID NO: 8279759 - DNA, 22 bp, Homo sapiens
gtgagggcagcttggtcagtgt

SEQ ID NO: 8279760 - DNA, 17 bp, Homo sapiens
gtgagggcagaggatgg

SEQ ID NO: 8279761 - DNA, 22 bp, Homo sapiens
tactatttggaattttaaattg

SEQ ID NO: 8279762 - DNA, 21 bp, Homo sapiens
tactgtagccttgcactgtag

SEQ ID NO: 8279763 - DNA, 19 bp, Homo sapiens
tagaatagttacacagatt

SEQ ID NO: 8279764 - DNA, 22 bp, Homo sapiens
caggctggagtgcaatggcaca

SEQ ID NO: 8279765 - DNA, 22 bp, Homo sapiens
caggctgcctggaagaggactg

SEQ ID NO: 8279766 - DNA, 19 bp, Homo sapiens
tagaggagaagggaagtgg

SEQ ID NO: 8279767 - DNA, 22 bp, Homo sapiens
tagaggagaacacaaattatag

SEQ ID NO: 8279768 - DNA, 22 bp, Homo sapiens
tagaggaactgcctttcttctg

SEQ ID NO: 8279769 - DNA, 22 bp, Homo sapiens
tagagtgtccaacacataggag

SEQ ID NO: 8279770 - DNA, 22 bp, Homo sapiens
tagagctggaaaactgcaggta

SEQ ID NO: 8279771 - DNA, 19 bp, Homo sapiens
tagagctgcttcctggcag

SEQ ID NO: 8279772 - DNA, 22 bp, Homo sapiens
tagaggaaatttccaaggtgag

SEQ ID NO: 8279773 - DNA, 22 bp, Homo sapiens
tagctacaaggaagaatggaaa

SEQ ID NO: 8279774 - DNA, 20 bp, Homo sapiens
cagggcacactgcagcctcg

SEQ ID NO: 8279775 - DNA, 22 bp, Homo sapiens
cagggcacttaaattgcctcgt

SEQ ID NO: 8279776 - DNA, 22 bp, Homo sapiens
tagataaattagaaagtttact

SEQ ID NO: 8279777 - DNA, 22 bp, Homo sapiens
tagataatttggcatcatattg

SEQ ID NO: 8279778 - DNA, 22 bp, Homo sapiens
tcagcagaatgtggcatgtcac

SEQ ID NO: 8279779 - DNA, 19 bp, Homo sapiens
tcagcagattttgcaaaca

SEQ ID NO: 8279780 - DNA, 22 bp, Homo sapiens
cagttaaagtgcttatcacaga

SEQ ID NO: 8279781 - DNA, 22 bp, Homo sapiens
cagttaaaggcccaatatctgg

SEQ ID NO: 8279782 - DNA, 22 bp, Homo sapiens
cagttaaagctgcatgtgtcag

SEQ ID NO: 8279783 - DNA, 22 bp, Homo sapiens
cagttaaaggcccaatatctgg

SEQ ID NO: 8279784 - DNA, 22 bp, Homo sapiens
cagttaaacgggccatgtgagt

SEQ ID NO: 8279785 - DNA, 22 bp, Homo sapiens
cagttaaattctccagttacca

SEQ ID NO: 8279786 - DNA, 22 bp, Homo sapiens
cagttaatgtcctatacaatag

SEQ ID NO: 8279787 - DNA, 22 bp, Homo sapiens
cagttaaagtgcttatcacaga

SEQ ID NO: 8279788 - DNA, 22 bp, Homo sapiens
cagttaaattctccagttacca

SEQ ID NO: 8279789 - DNA, 22 bp, Homo sapiens
cagtttatatataagcacattg

SEQ ID NO: 8279790 - DNA, 22 bp, Homo sapiens
cagtttaacctatccattatgt

SEQ ID NO: 8279791 - DNA, 22 bp, Homo sapiens
tcagctttctcttctatcgata

SEQ ID NO: 8279792 - DNA, 22 bp, Homo sapiens
tcagctgccccagtggccccag

SEQ ID NO: 8279793 - DNA, 22 bp, Homo sapiens
tcagctttgatctcaggcaatc

SEQ ID NO: 8279794 - DNA, 21 bp, Homo sapiens
tcagctttgcaactgcacatc

SEQ ID NO: 8279795 - DNA, 22 bp, Homo sapiens
tcagctttgcaagttagaaaat

SEQ ID NO: 8279796 - DNA, 22 bp, Homo sapiens
tcagcttttaaaaacaagaagt

SEQ ID NO: 8279797 - DNA, 22 bp, Homo sapiens
tcagctttgccaccagctgtaa

SEQ ID NO: 8279798 - DNA, 18 bp, Homo sapiens
tcagcttttgaaaaccaa

SEQ ID NO: 8279799 - DNA, 22 bp, Homo sapiens
tcagctttggtcacattgagtt

SEQ ID NO: 8279800 - DNA, 22 bp, Homo sapiens
tcagcttttaaaaacaagaagt

SEQ ID NO: 8279801 - DNA, 22 bp, Homo sapiens
tcagctttgcaagttagaaaat

SEQ ID NO: 8279802 - DNA, 22 bp, Homo sapiens
tcagctttgggggtctcaggag

SEQ ID NO: 8279803 - DNA, 22 bp, Homo sapiens
tcagctttttacatgtgaaata

SEQ ID NO: 8279804 - DNA, 22 bp, Homo sapiens
tcagctttttacatgtgaaata

SEQ ID NO: 8279805 - DNA, 22 bp, Homo sapiens
tcagctttttggattgcccaag

SEQ ID NO: 8279806 - DNA, 22 bp, Homo sapiens
tcagcttttgtcagaaattgta

SEQ ID NO: 8279807 - DNA, 22 bp, Homo sapiens
cagtggcttcttcctagagcca

SEQ ID NO: 8279808 - DNA, 22 bp, Homo sapiens
cagtggcttctcatgtcattca

SEQ ID NO: 8279809 - DNA, 20 bp, Homo sapiens
cagtggcttctgtggaatat

SEQ ID NO: 8279810 - DNA, 22 bp, Homo sapiens
cagtggcttctcatgtcattca

SEQ ID NO: 8279811 - DNA, 22 bp, Homo sapiens
cagtggcttacaatgaactaga

SEQ ID NO: 8279812 - DNA, 22 bp, Homo sapiens
cagtggcttaaataagattagg

SEQ ID NO: 8279813 - DNA, 22 bp, Homo sapiens
cagtggctgtttctggaaggca

SEQ ID NO: 8279814 - DNA, 22 bp, Homo sapiens
cagtggctgtttctggaaggca

SEQ ID NO: 8279815 - DNA, 22 bp, Homo sapiens
cagtggctgagagtggacactg

SEQ ID NO: 8279816 - DNA, 22 bp, Homo sapiens
cagtggctgtgaccagggacct

SEQ ID NO: 8279817 - DNA, 22 bp, Homo sapiens
cagtggctgtgaccagggacct

SEQ ID NO: 8279818 - DNA, 20 bp, Homo sapiens
cagtggctgataacaaatta

SEQ ID NO: 8279819 - DNA, 22 bp, Homo sapiens
cagtggctggttagggacagga

SEQ ID NO: 8279820 - DNA, 22 bp, Homo sapiens
cagtgggattgggattggaacc

SEQ ID NO: 8279821 - DNA, 21 bp, Homo sapiens
tcagaagtgcagcccaggaat

SEQ ID NO: 8279822 - DNA, 22 bp, Homo sapiens
cagtgtctcagtttcacttgaa

SEQ ID NO: 8279823 - DNA, 22 bp, Homo sapiens
tcagagaaatgacaatatatag

SEQ ID NO: 8279824 - DNA, 22 bp, Homo sapiens
tcagagaaaggccaaaatatca

SEQ ID NO: 8279825 - DNA, 22 bp, Homo sapiens
cagtgtctttcagactcagaaa

SEQ ID NO: 8279826 - DNA, 22 bp, Homo sapiens
cagttaaaagaagtctatctta

SEQ ID NO: 8279827 - DNA, 22 bp, Homo sapiens
cagtcccactagtgccaatacc

SEQ ID NO: 8279828 - DNA, 22 bp, Homo sapiens
cagtcccacaagatctccacaa

SEQ ID NO: 8279829 - DNA, 22 bp, Homo sapiens
cagtcccaccaggatcgctctt

SEQ ID NO: 8279830 - DNA, 20 bp, Homo sapiens
cagtcccaatccagggccag

SEQ ID NO: 8279831 - DNA, 20 bp, Homo sapiens
cagtcccaatccagggccag

SEQ ID NO: 8279832 - DNA, 22 bp, Homo sapiens
cagtcccaaggaggaagcagtc

SEQ ID NO: 8279833 - DNA, 19 bp, Homo sapiens
cagtcccaaattcttgtca

SEQ ID NO: 8279834 - DNA, 22 bp, Homo sapiens
cagtcccagaagagcctgggag

SEQ ID NO: 8279835 - DNA, 22 bp, Homo sapiens
cagtcccagaagagcctgggag

SEQ ID NO: 8279836 - DNA, 22 bp, Homo sapiens
cagtcccagacatagtaaggga

SEQ ID NO: 8279837 - DNA, 22 bp, Homo sapiens
cagtcccagacccagaaggtgg

SEQ ID NO: 8279838 - DNA, 22 bp, Homo sapiens
tatttcatgtgcaccataattc

SEQ ID NO: 8279839 - DNA, 22 bp, Homo sapiens
tatttataacagtgagaacggg

SEQ ID NO: 8279840 - DNA, 22 bp, Homo sapiens
tatttataacagtgagaacggg

SEQ ID NO: 8279841 - DNA, 22 bp, Homo sapiens
caggttgaaagtggaggagcta

SEQ ID NO: 8279842 - DNA, 22 bp, Homo sapiens
caggttctgaggatggtgcctg

SEQ ID NO: 8279843 - DNA, 22 bp, Homo sapiens
caggttcattctttcttgtatt

SEQ ID NO: 8279844 - DNA, 22 bp, Homo sapiens
caggttagttaatctttgtttc

SEQ ID NO: 8279845 - DNA, 22 bp, Homo sapiens
caggttagcaacatggttagag

SEQ ID NO: 8279846 - DNA, 15 bp, Homo sapiens
caggttagtttccag

SEQ ID NO: 8279847 - DNA, 22 bp, Homo sapiens
caggttagtatttttagttcat

SEQ ID NO: 8279848 - DNA, 22 bp, Homo sapiens
caggttagtaaggtctacataa

SEQ ID NO: 8279849 - DNA, 22 bp, Homo sapiens
caggtgtgccgggagcagtttg

SEQ ID NO: 8279850 - DNA, 22 bp, Homo sapiens
cagggtgggcacccagcctcca

SEQ ID NO: 8279851 - DNA, 22 bp, Homo sapiens
cagtgcatgcacacacatggta

SEQ ID NO: 8279852 - DNA, 22 bp, Homo sapiens
cagtgcatgtggcactctccag

SEQ ID NO: 8279853 - DNA, 22 bp, Homo sapiens
tcacaggagtcaaggaatagta

SEQ ID NO: 8279854 - DNA, 22 bp, Homo sapiens
tcacagtgtggcaactcacaga

SEQ ID NO: 8279855 - DNA, 22 bp, Homo sapiens
tcacagagaaatgtggcacaaa

SEQ ID NO: 8279856 - DNA, 22 bp, Homo sapiens
tcacagacttgtctccagggat

SEQ ID NO: 8279857 - DNA, 18 bp, Homo sapiens
tcacagacttactgggcc

SEQ ID NO: 8279858 - DNA, 21 bp, Homo sapiens
tcacagactggtcagtgaggc

SEQ ID NO: 8279859 - DNA, 22 bp, Homo sapiens
tcacaggaaccatcagagaaat

SEQ ID NO: 8279860 - DNA, 22 bp, Homo sapiens
tcacagctttgagcagagacca

SEQ ID NO: 8279861 - DNA, 22 bp, Homo sapiens
tcacaggaagggtaaatattta

SEQ ID NO: 8279862 - DNA, 22 bp, Homo sapiens
tcacaggaccctgagggtggcg

SEQ ID NO: 8279863 - DNA, 22 bp, Homo sapiens
tcacaggaggaacctggcctgg

SEQ ID NO: 8279864 - DNA, 22 bp, Homo sapiens
cagtgagaccttctaaggtggt

SEQ ID NO: 8279865 - DNA, 22 bp, Homo sapiens
cagtgaatttagatgttggtgg

SEQ ID NO: 8279866 - DNA, 22 bp, Homo sapiens
tcacagacctggtgggaggtgg

SEQ ID NO: 8279867 - DNA, 22 bp, Homo sapiens
tcacagactcaagggcatagga

SEQ ID NO: 8279868 - DNA, 22 bp, Homo sapiens
cagtgagctcctgtctgtccct

SEQ ID NO: 8279869 - DNA, 22 bp, Homo sapiens
tatttgaaagtgtacaaaaact

SEQ ID NO: 8279870 - DNA, 22 bp, Homo sapiens
tatttgaaagtgtacaaaaact

SEQ ID NO: 8279871 - DNA, 22 bp, Homo sapiens
tcacaaatattttaacagtagg

SEQ ID NO: 8279872 - DNA, 22 bp, Homo sapiens
tcacaaatcattttatctgtgt

SEQ ID NO: 8279873 - DNA, 22 bp, Homo sapiens
tcacaaatgaggaaatcgagca

SEQ ID NO: 8279874 - DNA, 22 bp, Homo sapiens
tcacaaatcgaagccttataat

SEQ ID NO: 8279875 - DNA, 22 bp, Homo sapiens
tcacaaatcgaagccttataat

SEQ ID NO: 8279876 - DNA, 22 bp, Homo sapiens
tcacaacaggaaggaccagctg

SEQ ID NO: 8279877 - DNA, 22 bp, Homo sapiens
tttaccaaggcatagtaatctc

SEQ ID NO: 8279878 - DNA, 23 bp, Homo sapiens
tttaccactatgtttcacaagtt

SEQ ID NO: 8279879 - DNA, 22 bp, Homo sapiens
tttagcaaattactcacagggt

SEQ ID NO: 8279880 - DNA, 22 bp, Homo sapiens
tttagcaaggtaggtccatgga

SEQ ID NO: 8279881 - DNA, 22 bp, Homo sapiens
tttatattgtaaaaatggttct

SEQ ID NO: 8279882 - DNA, 22 bp, Homo sapiens
tttatatagagatttgtgcatg

SEQ ID NO: 8279883 - DNA, 22 bp, Homo sapiens
tttatcaaacaaattatccagc

SEQ ID NO: 8279884 - DNA, 22 bp, Homo sapiens
tttaaatgtttatagagagtac

SEQ ID NO: 8279885 - DNA, 22 bp, Homo sapiens
tttaagatggtattttataaag

SEQ ID NO: 8279886 - DNA, 22 bp, Homo sapiens
tttaaatgtttaaaactcgtga

SEQ ID NO: 8279887 - DNA, 22 bp, Homo sapiens
tttaaatgttcatgatactgaa

SEQ ID NO: 8279888 - DNA, 22 bp, Homo sapiens
tttaaatggcattttcccagat

SEQ ID NO: 8279889 - DNA, 22 bp, Homo sapiens
tttaaatgtgttcttagtagct

SEQ ID NO: 8279890 - DNA, 22 bp, Homo sapiens
tttaaatgctttaagcaagggt

SEQ ID NO: 8279891 - DNA, 22 bp, Homo sapiens
tttaaatgcagacgttgattca

SEQ ID NO: 8279892 - DNA, 22 bp, Homo sapiens
tttaaagaaattcctcatcttt

SEQ ID NO: 8279893 - DNA, 22 bp, Homo sapiens
tttaatgtattctttggaacca

SEQ ID NO: 8279894 - DNA, 22 bp, Homo sapiens
tttaatgtgacatcttttagag

SEQ ID NO: 8279895 - DNA, 22 bp, Homo sapiens
tttaatgtgagtccctttcaag

SEQ ID NO: 8279896 - DNA, 22 bp, Homo sapiens
tttaatgtgacatcttttagag

SEQ ID NO: 8279897 - DNA, 22 bp, Homo sapiens
tttaagcacagggataaagtta

SEQ ID NO: 8279898 - DNA, 22 bp, Homo sapiens
tttaatcttcaaaatagtctta

SEQ ID NO: 8279899 - DNA, 22 bp, Homo sapiens
tttcatgcctgtggtgcagtgt

SEQ ID NO: 8279900 - DNA, 21 bp, Homo sapiens
tttcccagctgaaaataaatg

SEQ ID NO: 8279901 - DNA, 22 bp, Homo sapiens
tttcccagttccctgctctata

SEQ ID NO: 8279902 - DNA, 22 bp, Homo sapiens
tttcacagctgggtggcagagt

SEQ ID NO: 8279903 - DNA, 22 bp, Homo sapiens
tttcacagcgtctttctcttgc

SEQ ID NO: 8279904 - DNA, 22 bp, Homo sapiens
tttcacagcagaatttctgagg

SEQ ID NO: 8279905 - DNA, 22 bp, Homo sapiens
tttcagaaaacttatcatcagt

SEQ ID NO: 8279906 - DNA, 22 bp, Homo sapiens
tttcactagaacgttcttgttt

SEQ ID NO: 8279907 - DNA, 22 bp, Homo sapiens
tttattctgtgctacatgaaga

SEQ ID NO: 8279908 - DNA, 22 bp, Homo sapiens
tttattctagctcagaatagtt

SEQ ID NO: 8279909 - DNA, 22 bp, Homo sapiens
tttattctataggcattaagca

SEQ ID NO: 8279910 - DNA, 22 bp, Homo sapiens
tttattctataggcattaagca

SEQ ID NO: 8279911 - DNA, 22 bp, Homo sapiens
tttcacagaactcactaaggag

SEQ ID NO: 8279912 - DNA, 22 bp, Homo sapiens
tttcacagatgttttggagtct

SEQ ID NO: 8279913 - DNA, 22 bp, Homo sapiens
tttcaagcaggatcaaagcaaa

SEQ ID NO: 8279914 - DNA, 22 bp, Homo sapiens
tttcaagcagcgtgaaaaacga

SEQ ID NO: 8279915 - DNA, 22 bp, Homo sapiens
tttcaactcatgctaaaggaag

SEQ ID NO: 8279916 - DNA, 22 bp, Homo sapiens
tttcaacttgaagaattgatac

SEQ ID NO: 8279917 - DNA, 22 bp, Homo sapiens
tttcaagaacaacattcattca

SEQ ID NO: 8279918 - DNA, 22 bp, Homo sapiens
ttgctctcagaggaggaggccg

SEQ ID NO: 8279919 - DNA, 22 bp, Homo sapiens
ttgctcttgaaaattgatgctg

SEQ ID NO: 8279920 - DNA, 22 bp, Homo sapiens
ttgcattgatgttccttcttgc

SEQ ID NO: 8279921 - DNA, 22 bp, Homo sapiens
ttgcattcccagccaagttagt

SEQ ID NO: 8279922 - DNA, 22 bp, Homo sapiens
ttggaaatacagcagttacttt

SEQ ID NO: 8279923 - DNA, 22 bp, Homo sapiens
ttggaaatggctgtagttatga

SEQ ID NO: 8279924 - DNA, 21 bp, Homo sapiens
ttggaacaagcagcagtttgc

SEQ ID NO: 8279925 - DNA, 22 bp, Homo sapiens
ttggaaattgcaagtgatttgc

SEQ ID NO: 8279926 - DNA, 22 bp, Homo sapiens
ttggaattgaggatttacatag

SEQ ID NO: 8279927 - DNA, 22 bp, Homo sapiens
ttggaattcctgttgtttcgtc

SEQ ID NO: 8279928 - DNA, 22 bp, Homo sapiens
ttggaattgctattgataacaa

SEQ ID NO: 8279929 - DNA, 22 bp, Homo sapiens
ttggaattgctcataagagaga

SEQ ID NO: 8279930 - DNA, 22 bp, Homo sapiens
ttggaatttcatgtaagtgact

SEQ ID NO: 8279931 - DNA, 22 bp, Homo sapiens
ttggaatttagtaaaataatgc

SEQ ID NO: 8279932 - DNA, 22 bp, Homo sapiens
ttggaattgtgaactaagtgat

SEQ ID NO: 8279933 - DNA, 22 bp, Homo sapiens
ttggaatttagggaatattcat

SEQ ID NO: 8279934 - DNA, 22 bp, Homo sapiens
ttggaattggacatgttgaagg

SEQ ID NO: 8279935 - DNA, 22 bp, Homo sapiens
ttggaatttgagaccaagaaaa

SEQ ID NO: 8279936 - DNA, 22 bp, Homo sapiens
ttggaatttgcttcagctaata

SEQ ID NO: 8279937 - DNA, 21 bp, Homo sapiens
ttggaatttgggagctatgtg

SEQ ID NO: 8279938 - DNA, 22 bp, Homo sapiens
ttggaattttccaggtacagtg

SEQ ID NO: 8279939 - DNA, 20 bp, Homo sapiens
ttggacagacgcattgacac

SEQ ID NO: 8279940 - DNA, 22 bp, Homo sapiens
ttggaaactttcaagcataatg

SEQ ID NO: 8279941 - DNA, 22 bp, Homo sapiens
ttggaaagcaagctggacatac

SEQ ID NO: 8279942 - DNA, 22 bp, Homo sapiens
ttggaaagattattattatgaa

SEQ ID NO: 8279943 - DNA, 22 bp, Homo sapiens
ttggaaaggtgcttttgtctgt

SEQ ID NO: 8279944 - DNA, 22 bp, Homo sapiens
ttggaaaggagattctattgtg

SEQ ID NO: 8279945 - DNA, 22 bp, Homo sapiens
ttggaaaggagtttttagctat

SEQ ID NO: 8279946 - DNA, 22 bp, Homo sapiens
ttgacaggaatctttttgttat

SEQ ID NO: 8279947 - DNA, 22 bp, Homo sapiens
ttgcaattgctatggagagcgt

SEQ ID NO: 8279948 - DNA, 22 bp, Homo sapiens
ttgacaaggagccattgcatct

SEQ ID NO: 8279949 - DNA, 22 bp, Homo sapiens
ttgacaagcgaagtaccataat

SEQ ID NO: 8279950 - DNA, 22 bp, Homo sapiens
ttgacacaggaaagttgtaact

SEQ ID NO: 8279951 - DNA, 22 bp, Homo sapiens
ttgacacaaacagtgatgtagt

SEQ ID NO: 8279952 - DNA, 22 bp, Homo sapiens
ttgacaatgtcctttgaatttc

SEQ ID NO: 8279953 - DNA, 22 bp, Homo sapiens
ttgacaaaggctgagaggaaaa

SEQ ID NO: 8279954 - DNA, 22 bp, Homo sapiens
ttgcagttaaaaatcattagtt

SEQ ID NO: 8279955 - DNA, 22 bp, Homo sapiens
ttgcaggggaaggagcagagct

SEQ ID NO: 8279956 - DNA, 22 bp, Homo sapiens
ttgcagctgtgagctttacacg

SEQ ID NO: 8279957 - DNA, 21 bp, Homo sapiens
ttgtacacccacagatcagcc

SEQ ID NO: 8279958 - DNA, 21 bp, Homo sapiens
ttgtacacccacagatcagcc

SEQ ID NO: 8279959 - DNA, 22 bp, Homo sapiens
ttgtatttcgatgcacgtgtag

SEQ ID NO: 8279960 - DNA, 22 bp, Homo sapiens
ttgtattttttcctggcggtgg

SEQ ID NO: 8279961 - DNA, 22 bp, Homo sapiens
ttgtacattctatgggtttgga

SEQ ID NO: 8279962 - DNA, 22 bp, Homo sapiens
ttgtacataatgaaaggaggct

SEQ ID NO: 8279963 - DNA, 22 bp, Homo sapiens
ttgtccctgcccctgcttgctt

SEQ ID NO: 8279964 - DNA, 22 bp, Homo sapiens
ttgtcacaggaaagggtgcaag

SEQ ID NO: 8279965 - DNA, 22 bp, Homo sapiens
ttggagatatgtgaaaaaaaca

SEQ ID NO: 8279966 - DNA, 22 bp, Homo sapiens
ttggcagtccaggattaatata

SEQ ID NO: 8279967 - DNA, 22 bp, Homo sapiens
ttggcagggcatcagacacgtg

SEQ ID NO: 8279968 - DNA, 22 bp, Homo sapiens
ttgggcagtgattagttcatga

SEQ ID NO: 8279969 - DNA, 22 bp, Homo sapiens
ttgggcagtctggctgcagagt

SEQ ID NO: 8279970 - DNA, 22 bp, Homo sapiens
ttgggagacaaaggctctgtct

SEQ ID NO: 8279971 - DNA, 22 bp, Homo sapiens
ttggcccacagtaccatgctgt

SEQ ID NO: 8279972 - DNA, 22 bp, Homo sapiens
ttgggaagtttaatgacagact

SEQ ID NO: 8279973 - DNA, 22 bp, Homo sapiens
ttggccaggtgtccagcccagg

SEQ ID NO: 8279974 - DNA, 22 bp, Homo sapiens
ttggccagtgaaccaggcctgg

SEQ ID NO: 8279975 - DNA, 22 bp, Homo sapiens
ttggccagtggaaagaggagga

SEQ ID NO: 8279976 - DNA, 19 bp, Homo sapiens
ttcacagctctgtgtcagt

SEQ ID NO: 8279977 - DNA, 22 bp, Homo sapiens
ttcacagctccttttactcaac

SEQ ID NO: 8279978 - DNA, 22 bp, Homo sapiens
ttcacagattgactggattcct

SEQ ID NO: 8279979 - DNA, 22 bp, Homo sapiens
ttcacagagagaactcaaacca

SEQ ID NO: 8279980 - DNA, 22 bp, Homo sapiens
ttcaaagaccttacttggcaaa

SEQ ID NO: 8279981 - DNA, 22 bp, Homo sapiens
ttcaaagataatgtagcatttt

SEQ ID NO: 8279982 - DNA, 22 bp, Homo sapiens
ttcagagatggaaggcagaatg

SEQ ID NO: 8279983 - DNA, 18 bp, Homo sapiens
ttcagcagcagacacact

SEQ ID NO: 8279984 - DNA, 18 bp, Homo sapiens
ttcagcagcagacacact

SEQ ID NO: 8279985 - DNA, 22 bp, Homo sapiens
ttcattttctttcacgctgctg

SEQ ID NO: 8279986 - DNA, 22 bp, Homo sapiens
ttcatacaatgggatattatga

SEQ ID NO: 8279987 - DNA, 22 bp, Homo sapiens
ttcattgtgaacacattctgcc

SEQ ID NO: 8279988 - DNA, 22 bp, Homo sapiens
ttcattgtagcttgactaatta

SEQ ID NO: 8279989 - DNA, 22 bp, Homo sapiens
ttcagtgttcttttctgttagc

SEQ ID NO: 8279990 - DNA, 22 bp, Homo sapiens
ttcagtgtgtcagtttcagcag

SEQ ID NO: 8279991 - DNA, 22 bp, Homo sapiens
ttcagtgtgaagcttctgaaag

SEQ ID NO: 8279992 - DNA, 22 bp, Homo sapiens
ttataggaaatagttcatgcga

SEQ ID NO: 8279993 - DNA, 22 bp, Homo sapiens
ttatagtattaggtactcaaca

SEQ ID NO: 8279994 - DNA, 22 bp, Homo sapiens
ttatacatgtgttttgagatga

SEQ ID NO: 8279995 - DNA, 22 bp, Homo sapiens
ttatacatgtttataaggttga

SEQ ID NO: 8279996 - DNA, 22 bp, Homo sapiens
ttaggaaacagtagcctttgct

SEQ ID NO: 8279997 - DNA, 22 bp, Homo sapiens
ttagctttggattgcatttagt

SEQ ID NO: 8279998 - DNA, 22 bp, Homo sapiens
ttagcttttctctatgttggct

SEQ ID NO: 8279999 - DNA, 22 bp, Homo sapiens
ttagcttttgagaatgatttct

SEQ ID NO: 8280000 - DNA, 21 bp, Homo sapiens
ttagctttctagaatctttgt

SEQ ID NO: 8280001 - DNA, 18 bp, Homo sapiens
tcctgcctgtgccccagg

SEQ ID NO: 8280002 - DNA, 22 bp, Homo sapiens
tcctgcctgcaatcccagcact

SEQ ID NO: 8280003 - DNA, 18 bp, Homo sapiens
tcctgcctgcgggctccc

SEQ ID NO: 8280004 - DNA, 22 bp, Homo sapiens
tcctgcctgtttacctgtactt

SEQ ID NO: 8280005 - DNA, 22 bp, Homo sapiens
ttagctttatatatttggatcg

SEQ ID NO: 8280006 - DNA, 22 bp, Homo sapiens
ttattggaaaagggctgtaatt

SEQ ID NO: 8280007 - DNA, 22 bp, Homo sapiens
ttattggattcttgccccaggt

SEQ ID NO: 8280008 - DNA, 22 bp, Homo sapiens
ttattgaagcaagcttttctga

SEQ ID NO: 8280009 - DNA, 22 bp, Homo sapiens
ttattgaaggaactgaaataaa

SEQ ID NO: 8280010 - DNA, 22 bp, Homo sapiens
ttcaaacagttgcacaacttat

SEQ ID NO: 8280011 - DNA, 22 bp, Homo sapiens
ttcaaacagttgcacaacttat

SEQ ID NO: 8280012 - DNA, 22 bp, Homo sapiens
ttattatgtgctagagaatgta

SEQ ID NO: 8280013 - DNA, 22 bp, Homo sapiens
ttattatgtggatgaaagatgt

SEQ ID NO: 8280014 - DNA, 22 bp, Homo sapiens
ttattctttaaacatatatgtt

SEQ ID NO: 8280015 - DNA, 22 bp, Homo sapiens
ttattacactgaaagaattgcg

SEQ ID NO: 8280016 - DNA, 22 bp, Homo sapiens
ttatatatatgtagaggtcacg

SEQ ID NO: 8280017 - DNA, 22 bp, Homo sapiens
ttatatatatgtagaggtcacg

SEQ ID NO: 8280018 - DNA, 22 bp, Homo sapiens
ttattacaatgcagaaaataga

SEQ ID NO: 8280019 - DNA, 22 bp, Homo sapiens
ttgaaatgtagtcctgccttca

SEQ ID NO: 8280020 - DNA, 22 bp, Homo sapiens
ttgaaatggaagtgaaaattct

SEQ ID NO: 8280021 - DNA, 23 bp, Homo sapiens
ttgaatttctcttgcaatattta

SEQ ID NO: 8280022 - DNA, 22 bp, Homo sapiens
ttgaaatgagactaattgattg

SEQ ID NO: 8280023 - DNA, 22 bp, Homo sapiens
ttgaaatgatctatttcagtag

SEQ ID NO: 8280024 - DNA, 22 bp, Homo sapiens
ttgaaatgcatcatcatttaga

SEQ ID NO: 8280025 - DNA, 22 bp, Homo sapiens
ttgaaatgagcaaactgtcagc

SEQ ID NO: 8280026 - DNA, 22 bp, Homo sapiens
ttgaaatatttgggagtgtttg

SEQ ID NO: 8280027 - DNA, 22 bp, Homo sapiens
ttctttttaaagtgtgtatgca

SEQ ID NO: 8280028 - DNA, 22 bp, Homo sapiens
ttcttcaaaatccagcatgatt

SEQ ID NO: 8280029 - DNA, 22 bp, Homo sapiens
ttcttttaatagagatcctgtg

SEQ ID NO: 8280030 - DNA, 22 bp, Homo sapiens
ttcttagaagaaacatctaaaa

SEQ ID NO: 8280031 - DNA, 22 bp, Homo sapiens
ttcttagagatggttaaaaata

SEQ ID NO: 8280032 - DNA, 22 bp, Homo sapiens
ttcttatattgggtcatggata

SEQ ID NO: 8280033 - DNA, 22 bp, Homo sapiens
ttcttatagaagcaaccattgt

SEQ ID NO: 8280034 - DNA, 22 bp, Homo sapiens
ttctgtgtgctgtcttggcttt

SEQ ID NO: 8280035 - DNA, 23 bp, Homo sapiens
ttctgtcttgctgtcagctttct

SEQ ID NO: 8280036 - DNA, 22 bp, Homo sapiens
ttctgtgattagttgtctggct

SEQ ID NO: 8280037 - DNA, 22 bp, Homo sapiens
ttctgtgactcctcagagattt

SEQ ID NO: 8280038 - DNA, 22 bp, Homo sapiens
ttctgtgaggacttctcaagga

SEQ ID NO: 8280039 - DNA, 22 bp, Homo sapiens
ttctgtgaatcttttttcccac

SEQ ID NO: 8280040 - DNA, 22 bp, Homo sapiens
ttctctaaggtcccgttctgga

SEQ ID NO: 8280041 - DNA, 21 bp, Homo sapiens
ttctctacctctagtgctgta

SEQ ID NO: 8280042 - DNA, 22 bp, Homo sapiens
ttctctacttgagattttaatg

SEQ ID NO: 8280043 - DNA, 22 bp, Homo sapiens
ttctctacttcacaagggatgg

SEQ ID NO: 8280044 - DNA, 21 bp, Homo sapiens
ttctctccatatgcccagccc

SEQ ID NO: 8280045 - DNA, 22 bp, Homo sapiens
ttctctccagtcctggattctg

SEQ ID NO: 8280046 - DNA, 21 bp, Homo sapiens
ttctctccatatgcccagccc

SEQ ID NO: 8280047 - DNA, 22 bp, Homo sapiens
ttctctcattcaaattaaagtg

SEQ ID NO: 8280048 - DNA, 22 bp, Homo sapiens
ttctctccagactgcagtgggt

SEQ ID NO: 8280049 - DNA, 22 bp, Homo sapiens
ttctctccagactgcagtgggt

SEQ ID NO: 8280050 - DNA, 22 bp, Homo sapiens
ttctctcccatgaagcttctat

SEQ ID NO: 8280051 - DNA, 22 bp, Homo sapiens
ttctctcccatgaagcttctat

SEQ ID NO: 8280052 - DNA, 22 bp, Homo sapiens
ttctctcctcctagaggctttt

SEQ ID NO: 8280053 - DNA, 22 bp, Homo sapiens
ttctctctgagagcatctggaa

SEQ ID NO: 8280054 - DNA, 22 bp, Homo sapiens
ttctctcttttgggtaggaggt

SEQ ID NO: 8280055 - DNA, 22 bp, Homo sapiens
ttctctcttccagttcccactt

SEQ ID NO: 8280056 - DNA, 22 bp, Homo sapiens
ttctctcttccagttcccactt

SEQ ID NO: 8280057 - DNA, 22 bp, Homo sapiens
ttctctcttactgccatgctgt

SEQ ID NO: 8280058 - DNA, 22 bp, Homo sapiens
ttctctcttactgccatgctgt

SEQ ID NO: 8280059 - DNA, 22 bp, Homo sapiens
ttctctctggacctgggatgcg

SEQ ID NO: 8280060 - DNA, 22 bp, Homo sapiens
ttctctctgtggtcccattttg

SEQ ID NO: 8280061 - DNA, 22 bp, Homo sapiens
ttctctctgtggtcccattttg

SEQ ID NO: 8280062 - DNA, 22 bp, Homo sapiens
ttccttgggaaatgctcgttta

SEQ ID NO: 8280063 - DNA, 22 bp, Homo sapiens
ttctcaggaactcagtgtcagc

SEQ ID NO: 8280064 - DNA, 22 bp, Homo sapiens
ttctccagaccctcctgcagac

SEQ ID NO: 8280065 - DNA, 22 bp, Homo sapiens
ttctccagaccttgtgactatg

SEQ ID NO: 8280066 - DNA, 22 bp, Homo sapiens
ttctccagaccactgcctctgt

SEQ ID NO: 8280067 - DNA, 22 bp, Homo sapiens
ttctccagagggctctgcagga

SEQ ID NO: 8280068 - DNA, 18 bp, Homo sapiens
ttctccagaaaacatagc

SEQ ID NO: 8280069 - DNA, 22 bp, Homo sapiens
ttctccagacacaaaatctaag

SEQ ID NO: 8280070 - DNA, 22 bp, Homo sapiens
ttctccagacaggcagagggaa

SEQ ID NO: 8280071 - DNA, 22 bp, Homo sapiens
ttctccagacaacagagggtga

SEQ ID NO: 8280072 - DNA, 22 bp, Homo sapiens
ttccttggaaattctgacttca

SEQ ID NO: 8280073 - DNA, 20 bp, Homo sapiens
ttccttggattgtgtcttga

SEQ ID NO: 8280074 - DNA, 20 bp, Homo sapiens
ttcctgtatacaaagagttc

SEQ ID NO: 8280075 - DNA, 20 bp, Homo sapiens
ttcctgtatacaaagagttc

SEQ ID NO: 8280076 - DNA, 22 bp, Homo sapiens
ttccttcttccaaacccatcat

SEQ ID NO: 8280077 - DNA, 22 bp, Homo sapiens
ttccttcttccagaggctgccc

SEQ ID NO: 8280078 - DNA, 22 bp, Homo sapiens
ttcctgggggcagcagtcttga

SEQ ID NO: 8280079 - DNA, 22 bp, Homo sapiens
ttcctggtctatttagaattgc

SEQ ID NO: 8280080 - DNA, 22 bp, Homo sapiens
ttcctggtcctattatatacac

SEQ ID NO: 8280081 - DNA, 22 bp, Homo sapiens
ttcctggtttatggaaagcatg

SEQ ID NO: 8280082 - DNA, 22 bp, Homo sapiens
ttcctgtagttgtgcaatgtac

SEQ ID NO: 8280083 - DNA, 20 bp, Homo sapiens
ttcctgtaaccggcagctgc

SEQ ID NO: 8280084 - DNA, 22 bp, Homo sapiens
ttcctgagaaatttgtacctgg

SEQ ID NO: 8280085 - DNA, 22 bp, Homo sapiens
ttcctggagagttttcccaaag

SEQ ID NO: 8280086 - DNA, 22 bp, Homo sapiens
ttcctggagagttttcccaaag

SEQ ID NO: 8280087 - DNA, 22 bp, Homo sapiens
ttcctggaaattatgctcacct

SEQ ID NO: 8280088 - DNA, 22 bp, Homo sapiens
tttgaatgttggattgacttag

SEQ ID NO: 8280089 - DNA, 22 bp, Homo sapiens
tttgaattattccttgagttga

SEQ ID NO: 8280090 - DNA, 22 bp, Homo sapiens
tttgaatgagaattattgtcat

SEQ ID NO: 8280091 - DNA, 22 bp, Homo sapiens
tttgacagaaagttattatttt

SEQ ID NO: 8280092 - DNA, 22 bp, Homo sapiens
tttgacagagctcttagtctct

SEQ ID NO: 8280093 - DNA, 22 bp, Homo sapiens
tttgacagaggttgtggtgtat

SEQ ID NO: 8280094 - DNA, 22 bp, Homo sapiens
tttgaatatacttcaaacaaag

SEQ ID NO: 8280095 - DNA, 22 bp, Homo sapiens
tttgaatatacttcaaacaaag

SEQ ID NO: 8280096 - DNA, 22 bp, Homo sapiens
tttgaatatgtgcttgttaaat

SEQ ID NO: 8280097 - DNA, 22 bp, Homo sapiens
tttgaaaggaagttaatacttt

SEQ ID NO: 8280098 - DNA, 22 bp, Homo sapiens
tttctttgtagtagcataatca

SEQ ID NO: 8280099 - DNA, 22 bp, Homo sapiens
tttcttttgccctgtgggttag

SEQ ID NO: 8280100 - DNA, 22 bp, Homo sapiens
tttcttttgaatagtgtgtggt

SEQ ID NO: 8280101 - DNA, 22 bp, Homo sapiens
tttggaaaaagacagcttatga

SEQ ID NO: 8280102 - DNA, 22 bp, Homo sapiens
tttggaaaaagcctgaacatag

SEQ ID NO: 8280103 - DNA, 22 bp, Homo sapiens
tttggaaacacggtcatcttcc

SEQ ID NO: 8280104 - DNA, 22 bp, Homo sapiens
tttggaaaattttctaagtctg

SEQ ID NO: 8280105 - DNA, 22 bp, Homo sapiens
tttggaaaatattgaactggtt

SEQ ID NO: 8280106 - DNA, 22 bp, Homo sapiens
tttggaaacacggtcatcttcc

SEQ ID NO: 8280107 - DNA, 22 bp, Homo sapiens
tttggaaactgcctcagctctt

SEQ ID NO: 8280108 - DNA, 22 bp, Homo sapiens
tttggaaactgcctcagctctt

SEQ ID NO: 8280109 - DNA, 22 bp, Homo sapiens
tttggaaactgatggtacattc

SEQ ID NO: 8280110 - DNA, 22 bp, Homo sapiens
tttggaaacatctcagaaaata

SEQ ID NO: 8280111 - DNA, 22 bp, Homo sapiens
tttggaaatttcatcaatagcc

SEQ ID NO: 8280112 - DNA, 22 bp, Homo sapiens
tttggaaatttcatcaatagcc

SEQ ID NO: 8280113 - DNA, 22 bp, Homo sapiens
tttggaaattactcattgtcct

SEQ ID NO: 8280114 - DNA, 22 bp, Homo sapiens
tttggaaatgagaagccacctt

SEQ ID NO: 8280115 - DNA, 22 bp, Homo sapiens
tttggaaatacgcgtaggcaga

SEQ ID NO: 8280116 - DNA, 22 bp, Homo sapiens
tttggaaatgaccccgtctaag

SEQ ID NO: 8280117 - DNA, 22 bp, Homo sapiens
tttggaaataattccatctcat

SEQ ID NO: 8280118 - DNA, 22 bp, Homo sapiens
tttggaaagttgtcactttaga

SEQ ID NO: 8280119 - DNA, 22 bp, Homo sapiens
tttggaaagtgtacaaatttga

SEQ ID NO: 8280120 - DNA, 17 bp, Homo sapiens
tttggaaagtgatcatt

SEQ ID NO: 8280121 - DNA, 22 bp, Homo sapiens
tttggaaaggtttggccattat

SEQ ID NO: 8280122 - DNA, 22 bp, Homo sapiens
tttggaaagacacacagtttta

SEQ ID NO: 8280123 - DNA, 22 bp, Homo sapiens
tttggaaagttgtcactttaga

SEQ ID NO: 8280124 - DNA, 22 bp, Homo sapiens
tttggaaagtgtgatttcaagg

SEQ ID NO: 8280125 - DNA, 22 bp, Homo sapiens
tttggaaagtgtgatttcaagg

SEQ ID NO: 8280126 - DNA, 22 bp, Homo sapiens
tttggtttttaatacaaagtac

SEQ ID NO: 8280127 - DNA, 22 bp, Homo sapiens
tttggtttattaaattgtaggc

SEQ ID NO: 8280128 - DNA, 22 bp, Homo sapiens
tttggtttagggtcatttaaca

SEQ ID NO: 8280129 - DNA, 22 bp, Homo sapiens
tttggtcatgtcgtcatttggg

SEQ ID NO: 8280130 - DNA, 22 bp, Homo sapiens
tttggtcactggatttggctgt

SEQ ID NO: 8280131 - DNA, 17 bp, Homo sapiens
tttggtaatatattaag

SEQ ID NO: 8280132 - DNA, 22 bp, Homo sapiens
tttggaaattttcatccagaca

SEQ ID NO: 8280133 - DNA, 22 bp, Homo sapiens
tttgaggttagctagcagatca

SEQ ID NO: 8280134 - DNA, 22 bp, Homo sapiens
tttgagttgcttatttaatagg

SEQ ID NO: 8280135 - DNA, 22 bp, Homo sapiens
tttgagtagtgagactaggcag

SEQ ID NO: 8280136 - DNA, 22 bp, Homo sapiens
tttgatccgttgctggtgagga

SEQ ID NO: 8280137 - DNA, 22 bp, Homo sapiens
tttgattgcaatagttttatga

SEQ ID NO: 8280138 - DNA, 20 bp, Homo sapiens
tttgattgcccctctgactt

SEQ ID NO: 8280139 - DNA, 18 bp, Homo sapiens
tttgattgctgtcatcca

SEQ ID NO: 8280140 - DNA, 22 bp, Homo sapiens
tttgattgtcacctaccttgca

SEQ ID NO: 8280141 - DNA, 22 bp, Homo sapiens
tttgctttgggaggttgtctgg

SEQ ID NO: 8280142 - DNA, 22 bp, Homo sapiens
ttttattatctttgaatgggac

SEQ ID NO: 8280143 - DNA, 22 bp, Homo sapiens
ttttattagtggctagatgggg

SEQ ID NO: 8280144 - DNA, 22 bp, Homo sapiens
ttttattagtggctagatgggg

SEQ ID NO: 8280145 - DNA, 22 bp, Homo sapiens
ttttcacattgtcccagcacta

SEQ ID NO: 8280146 - DNA, 19 bp, Homo sapiens
ttttcacatactggatcct

SEQ ID NO: 8280147 - DNA, 22 bp, Homo sapiens
ttttcatttttgtagatgcaag

SEQ ID NO: 8280148 - DNA, 19 bp, Homo sapiens
ttttctcagcttctagcgg

SEQ ID NO: 8280149 - DNA, 22 bp, Homo sapiens
ttttctcagctgcactgtatta

SEQ ID NO: 8280150 - DNA, 22 bp, Homo sapiens
ttttctcaagatccaatgcact

SEQ ID NO: 8280151 - DNA, 22 bp, Homo sapiens
ttttaattcaaagtgaatagtg

SEQ ID NO: 8280152 - DNA, 22 bp, Homo sapiens
ttttaattcaaagtgaatagtg

SEQ ID NO: 8280153 - DNA, 22 bp, Homo sapiens
ttttatgtaatccttactgtcg

SEQ ID NO: 8280154 - DNA, 22 bp, Homo sapiens
ttttaaaggatagctctggttg

SEQ ID NO: 8280155 - DNA, 22 bp, Homo sapiens
tttgttcaatccagacaatagc

SEQ ID NO: 8280156 - DNA, 22 bp, Homo sapiens
ttttaagaaatgtatgactgtc

SEQ ID NO: 8280157 - DNA, 22 bp, Homo sapiens
tttgttcaaaaattataagata

SEQ ID NO: 8280158 - DNA, 22 bp, Homo sapiens
tttgtgttgttttaagccacta

SEQ ID NO: 8280159 - DNA, 22 bp, Homo sapiens
tttgtgtttgtacaatgcacta

SEQ ID NO: 8280160 - DNA, 22 bp, Homo sapiens
ttttgttggcttaagaaataca

SEQ ID NO: 8280161 - DNA, 22 bp, Homo sapiens
ttttgtttgtgtccactgcagt

SEQ ID NO: 8280162 - DNA, 19 bp, Homo sapiens
tttttacaagtaggtgtga

SEQ ID NO: 8280163 - DNA, 22 bp, Homo sapiens
tttttagaattggctgagaatt

SEQ ID NO: 8280164 - DNA, 22 bp, Homo sapiens
tttttagagtgttaccagtata

SEQ ID NO: 8280165 - DNA, 22 bp, Homo sapiens
tttttagattactcagccacca

SEQ ID NO: 8280166 - DNA, 19 bp, Homo sapiens
tttttagcagggtacacct

SEQ ID NO: 8280167 - DNA, 22 bp, Homo sapiens
cacatgctcattggcactgttc

SEQ ID NO: 8280168 - DNA, 22 bp, Homo sapiens
ggcaggtgtgagatcgaggcca

SEQ ID NO: 8280169 - DNA, 22 bp, Homo sapiens
cacatttctgtgagtcaatatt

SEQ ID NO: 8280170 - DNA, 19 bp, Homo sapiens
ggcagtcacggtcaggagc

SEQ ID NO: 8280171 - DNA, 22 bp, Homo sapiens
ggcagtcacaggggagactggg

SEQ ID NO: 8280172 - DNA, 22 bp, Homo sapiens
ggcaggaataaattatggactt

SEQ ID NO: 8280173 - DNA, 20 bp, Homo sapiens
ggcaggacccggtagggagc

SEQ ID NO: 8280174 - DNA, 19 bp, Homo sapiens
ggataaggttggagtgatc

SEQ ID NO: 8280175 - DNA, 22 bp, Homo sapiens
ggcaggaagaggagggtgaact

SEQ ID NO: 8280176 - DNA, 22 bp, Homo sapiens
ggcccagagacgtgcaatgtac

SEQ ID NO: 8280177 - DNA, 22 bp, Homo sapiens
ggcgccgcactcggtgcagccg

SEQ ID NO: 8280178 - DNA, 17 bp, Homo sapiens
ggcctgtgtggctgcag

SEQ ID NO: 8280179 - DNA, 22 bp, Homo sapiens
cacccaggacaggccagatgtg

SEQ ID NO: 8280180 - DNA, 22 bp, Homo sapiens
cacccaggacaggccagatgtg

SEQ ID NO: 8280181 - DNA, 22 bp, Homo sapiens
ggccagctcagtctccatcagg

SEQ ID NO: 8280182 - DNA, 22 bp, Homo sapiens
cacccagcttttgcatcctccg

SEQ ID NO: 8280183 - DNA, 22 bp, Homo sapiens
cacccagcagcacttaagacta

SEQ ID NO: 8280184 - DNA, 22 bp, Homo sapiens
cacccagcattggctaagagag

SEQ ID NO: 8280185 - DNA, 22 bp, Homo sapiens
ggctgcagatagccagccacca

SEQ ID NO: 8280186 - DNA, 22 bp, Homo sapiens
cactgtgaaaaatggagtggtc

SEQ ID NO: 8280187 - DNA, 22 bp, Homo sapiens
ggctgctcaaggactctgatcg

SEQ ID NO: 8280188 - DNA, 22 bp, Homo sapiens
ggctgctcctttaccctggcag

SEQ ID NO: 8280189 - DNA, 18 bp, Homo sapiens
ggctcctgtgatcacatt

SEQ ID NO: 8280190 - DNA, 22 bp, Homo sapiens
ggctcctgtcctcctggagctc

SEQ ID NO: 8280191 - DNA, 22 bp, Homo sapiens
ggctcctgggggtgctcctgcc

SEQ ID NO: 8280192 - DNA, 22 bp, Homo sapiens
ggctcctgtcccctcagctgct

SEQ ID NO: 8280193 - DNA, 19 bp, Homo sapiens
ggctcctgtggctgcagcc

SEQ ID NO: 8280194 - DNA, 22 bp, Homo sapiens
ggcgctcagtgttgccccagag

SEQ ID NO: 8280195 - DNA, 22 bp, Homo sapiens
cactgcaacctccacctcctgg

SEQ ID NO: 8280196 - DNA, 19 bp, Homo sapiens
ggctcctggggctcagccc

SEQ ID NO: 8280197 - DNA, 22 bp, Homo sapiens
cagaacatccccactgctacct

SEQ ID NO: 8280198 - DNA, 22 bp, Homo sapiens
cagaacattcactcatatgtgg

SEQ ID NO: 8280199 - DNA, 22 bp, Homo sapiens
cagaacatgatataaacagaag

SEQ ID NO: 8280200 - DNA, 20 bp, Homo sapiens
cagaacagtctgagaggcca

SEQ ID NO: 8280201 - DNA, 19 bp, Homo sapiens
cagaacaggaccaggggcc

SEQ ID NO: 8280202 - DNA, 22 bp, Homo sapiens
cagaacaggtcatgcttgctgt

SEQ ID NO: 8280203 - DNA, 23 bp, Homo sapiens
ggcttggccctcaagggccctgc

SEQ ID NO: 8280204 - DNA, 22 bp, Homo sapiens
ggcttctttgtaacgtgccagc

SEQ ID NO: 8280205 - DNA, 22 bp, Homo sapiens
ggcttctttcagagtgaataga

SEQ ID NO: 8280206 - DNA, 20 bp, Homo sapiens
ggcttctttacatctgtgtt

SEQ ID NO: 8280207 - DNA, 22 bp, Homo sapiens
ggcttcttgtgtgtcaggctct

SEQ ID NO: 8280208 - DNA, 22 bp, Homo sapiens
ggcttcttctctgtgtccagca

SEQ ID NO: 8280209 - DNA, 23 bp, Homo sapiens
ggcttcttgcctgtcttggtgct

SEQ ID NO: 8280210 - DNA, 20 bp, Homo sapiens
ggcttcttcaggtgtctatt

SEQ ID NO: 8280211 - DNA, 19 bp, Homo sapiens
ggcttcagggagttagcat

SEQ ID NO: 8280212 - DNA, 20 bp, Homo sapiens
ggcttcttcaggtgtctatt

SEQ ID NO: 8280213 - DNA, 22 bp, Homo sapiens
ggcttcaggggcccagtcagca

SEQ ID NO: 8280214 - DNA, 22 bp, Homo sapiens
ggctgctgtgacctcaggtgat

SEQ ID NO: 8280215 - DNA, 19 bp, Homo sapiens
ggctgctggttacagaggc

SEQ ID NO: 8280216 - DNA, 22 bp, Homo sapiens
ggctgctggtggaatggtaggc

SEQ ID NO: 8280217 - DNA, 20 bp, Homo sapiens
ggctgctggtttggctctgt

SEQ ID NO: 8280218 - DNA, 22 bp, Homo sapiens
ggctgctgtactgatgtcagtt

SEQ ID NO: 8280219 - DNA, 22 bp, Homo sapiens
ggctgggagccccacagagtca

SEQ ID NO: 8280220 - DNA, 23 bp, Homo sapiens
ggctgggagctccgggtgcacgt

SEQ ID NO: 8280221 - DNA, 22 bp, Homo sapiens
cagaacacaggctaaactgaga

SEQ ID NO: 8280222 - DNA, 22 bp, Homo sapiens
cagaaattggaatagagaaata

SEQ ID NO: 8280223 - DNA, 22 bp, Homo sapiens
ggaggagcacttgacggggtct

SEQ ID NO: 8280224 - DNA, 22 bp, Homo sapiens
ggaggagcacttctgagctcag

SEQ ID NO: 8280225 - DNA, 22 bp, Homo sapiens
ggaggagattcccctctcactt

SEQ ID NO: 8280226 - DNA, 22 bp, Homo sapiens
cacagccatgtcctcattcttc

SEQ ID NO: 8280227 - DNA, 19 bp, Homo sapiens
cacagccacagccaacctc

SEQ ID NO: 8280228 - DNA, 22 bp, Homo sapiens
cacagcattcacagaaagacat

SEQ ID NO: 8280229 - DNA, 22 bp, Homo sapiens
cacagcagggcatggctgttgt

SEQ ID NO: 8280230 - DNA, 22 bp, Homo sapiens
cacagcagggatgaatggagtg

SEQ ID NO: 8280231 - DNA, 22 bp, Homo sapiens
cacagcaggtgcttaatgatta

SEQ ID NO: 8280232 - DNA, 22 bp, Homo sapiens
cacagcctttagggtacacaca

SEQ ID NO: 8280233 - DNA, 22 bp, Homo sapiens
cacagctaactttcactgagca

SEQ ID NO: 8280234 - DNA, 22 bp, Homo sapiens
cacagctagatggatagataga

SEQ ID NO: 8280235 - DNA, 22 bp, Homo sapiens
cacagcctccttcagagagcat

SEQ ID NO: 8280236 - DNA, 22 bp, Homo sapiens
ggaggggatggtttgaccctgg

SEQ ID NO: 8280237 - DNA, 22 bp, Homo sapiens
ggaggggatttagtagatgcta

SEQ ID NO: 8280238 - DNA, 22 bp, Homo sapiens
ggaggggatttagtagatgcta

SEQ ID NO: 8280239 - DNA, 22 bp, Homo sapiens
cacaggagaggttaatgggggc

SEQ ID NO: 8280240 - DNA, 22 bp, Homo sapiens
ggaggggatttagtagatgcta

SEQ ID NO: 8280241 - DNA, 19 bp, Homo sapiens
ggacacagaaagctgcatt

SEQ ID NO: 8280242 - DNA, 22 bp, Homo sapiens
ggacacagataatcacacagat

SEQ ID NO: 8280243 - DNA, 22 bp, Homo sapiens
ggacaagcctgtgagtgggttt

SEQ ID NO: 8280244 - DNA, 22 bp, Homo sapiens
ggaacactgtggttccatagca

SEQ ID NO: 8280245 - DNA, 22 bp, Homo sapiens
cacagagacatgatgtcattgc

SEQ ID NO: 8280246 - DNA, 22 bp, Homo sapiens
cacagagaactgtgggagtgtg

SEQ ID NO: 8280247 - DNA, 22 bp, Homo sapiens
cacagagaactgtgggagtgtg

SEQ ID NO: 8280248 - DNA, 22 bp, Homo sapiens
cacagagaatactgctcttgct

SEQ ID NO: 8280249 - DNA, 22 bp, Homo sapiens
ggacagcatatcagcagggcag

SEQ ID NO: 8280250 - DNA, 22 bp, Homo sapiens
ggacagcattcctagttccaaa

SEQ ID NO: 8280251 - DNA, 22 bp, Homo sapiens
ggacagccgagtggccttctcc

SEQ ID NO: 8280252 - DNA, 20 bp, Homo sapiens
caaattctgttgaatacacc

SEQ ID NO: 8280253 - DNA, 22 bp, Homo sapiens
caaatttaagttagaaagcaat

SEQ ID NO: 8280254 - DNA, 22 bp, Homo sapiens
gctgaggtccagcattcgccta

SEQ ID NO: 8280255 - DNA, 22 bp, Homo sapiens
gctgaggtgaggctggaaagga

SEQ ID NO: 8280256 - DNA, 22 bp, Homo sapiens
gctgaggtaggaggttgcagtg

SEQ ID NO: 8280257 - DNA, 22 bp, Homo sapiens
gctgaggtcaggagctgtgggg

SEQ ID NO: 8280258 - DNA, 19 bp, Homo sapiens
gctgaggtggaggaaggag

SEQ ID NO: 8280259 - DNA, 22 bp, Homo sapiens
gctggcagcattagaccctggg

SEQ ID NO: 8280260 - DNA, 22 bp, Homo sapiens
gctggccatagaagccaaagag

SEQ ID NO: 8280261 - DNA, 17 bp, Homo sapiens
ggaacaaatactatgca

SEQ ID NO: 8280262 - DNA, 22 bp, Homo sapiens
caatggaagaatctgacctgca

SEQ ID NO: 8280263 - DNA, 21 bp, Homo sapiens
caagttctgctgaatcttctt

SEQ ID NO: 8280264 - DNA, 22 bp, Homo sapiens
caagttctactgggacatcagt

SEQ ID NO: 8280265 - DNA, 22 bp, Homo sapiens
caagttctactgggacatcagt

SEQ ID NO: 8280266 - DNA, 22 bp, Homo sapiens
caagttatttcattggaacaat

SEQ ID NO: 8280267 - DNA, 22 bp, Homo sapiens
caagttattcctttacactata

SEQ ID NO: 8280268 - DNA, 22 bp, Homo sapiens
caagttatcagggcagttagag

SEQ ID NO: 8280269 - DNA, 19 bp, Homo sapiens
caagttaaaatgaggtcat

SEQ ID NO: 8280270 - DNA, 22 bp, Homo sapiens
caagttaattggtattttgatc

SEQ ID NO: 8280271 - DNA, 22 bp, Homo sapiens
caagttaaatttgcatttcaga

SEQ ID NO: 8280272 - DNA, 22 bp, Homo sapiens
caagttaatatatagaattttg

SEQ ID NO: 8280273 - DNA, 22 bp, Homo sapiens
gctggttcacctggctcctccc

SEQ ID NO: 8280274 - DNA, 19 bp, Homo sapiens
cagcctcaatccctcgggc

SEQ ID NO: 8280275 - DNA, 21 bp, Homo sapiens
gtgcatgagggaggatagcaa

SEQ ID NO: 8280276 - DNA, 22 bp, Homo sapiens
cagccctgtgctaagcaccctc

SEQ ID NO: 8280277 - DNA, 22 bp, Homo sapiens
gtgcatggtaagatgcttcaca

SEQ ID NO: 8280278 - DNA, 22 bp, Homo sapiens
cagctcccagagtgaccagcag

SEQ ID NO: 8280279 - DNA, 22 bp, Homo sapiens
cagctcccagaactgaccatgt

SEQ ID NO: 8280280 - DNA, 22 bp, Homo sapiens
cagctcccagtggcagctcctt

SEQ ID NO: 8280281 - DNA, 20 bp, Homo sapiens
gtgctgagggctgggcaatg

SEQ ID NO: 8280282 - DNA, 22 bp, Homo sapiens
cagctcagcttcctgggtgtgt

SEQ ID NO: 8280283 - DNA, 22 bp, Homo sapiens
cagctcagcttcctgggtgtgt

SEQ ID NO: 8280284 - DNA, 17 bp, Homo sapiens
cagctctgcagacttcc

SEQ ID NO: 8280285 - DNA, 22 bp, Homo sapiens
cagctctgagactgaggctatg

SEQ ID NO: 8280286 - DNA, 21 bp, Homo sapiens
cagctctgagatttctactag

SEQ ID NO: 8280287 - DNA, 22 bp, Homo sapiens
cagctctgatgaaatgtaccag

SEQ ID NO: 8280288 - DNA, 22 bp, Homo sapiens
cagctctgaggaacactccttt

SEQ ID NO: 8280289 - DNA, 22 bp, Homo sapiens
gtgcaaaatgatatcctgaagc

SEQ ID NO: 8280290 - DNA, 22 bp, Homo sapiens
gtgcaaaatttggccaataaca

SEQ ID NO: 8280291 - DNA, 22 bp, Homo sapiens
gtgcaggagcaggagccatgtc

SEQ ID NO: 8280292 - DNA, 22 bp, Homo sapiens
gtctccacagcccagctgccac

SEQ ID NO: 8280293 - DNA, 22 bp, Homo sapiens
gtctcagggcagctggaggagg

SEQ ID NO: 8280294 - DNA, 22 bp, Homo sapiens
gtctcaggtattgaatgggaac

SEQ ID NO: 8280295 - DNA, 22 bp, Homo sapiens
gtctccagaagcctagacagcc

SEQ ID NO: 8280296 - DNA, 22 bp, Homo sapiens
gtctctgtgccttctccccacc

SEQ ID NO: 8280297 - DNA, 22 bp, Homo sapiens
gtctttgccacacttctgtaca

SEQ ID NO: 8280298 - DNA, 22 bp, Homo sapiens
gtctttcttaattcaagtgctt

SEQ ID NO: 8280299 - DNA, 22 bp, Homo sapiens
gtctttcttaaacaacagaaca

SEQ ID NO: 8280300 - DNA, 22 bp, Homo sapiens
gtctttcttaaacaacagaaca

SEQ ID NO: 8280301 - DNA, 22 bp, Homo sapiens
gtctgttagtgataactgtttt

SEQ ID NO: 8280302 - DNA, 22 bp, Homo sapiens
cagcagtcacacaaactctgga

SEQ ID NO: 8280303 - DNA, 22 bp, Homo sapiens
cagcagtacttctcagaggtat

SEQ ID NO: 8280304 - DNA, 22 bp, Homo sapiens
cagcagtaattagtgctgcatg

SEQ ID NO: 8280305 - DNA, 22 bp, Homo sapiens
cagcagtaactcccgtgcagca

SEQ ID NO: 8280306 - DNA, 22 bp, Homo sapiens
cagcaggtggacacactcacct

SEQ ID NO: 8280307 - DNA, 22 bp, Homo sapiens
cagcaggtgctgcctgtcaccc

SEQ ID NO: 8280308 - DNA, 20 bp, Homo sapiens
cagcagtggatgagagtttt

SEQ ID NO: 8280309 - DNA, 22 bp, Homo sapiens
cagcagtcttcccttccttttt

SEQ ID NO: 8280310 - DNA, 22 bp, Homo sapiens
cagcagtctgtttcaacaggtc

SEQ ID NO: 8280311 - DNA, 22 bp, Homo sapiens
cagcagtccctgcagtggggaa

SEQ ID NO: 8280312 - DNA, 22 bp, Homo sapiens
cagcagtcaggcctgtgggaga

SEQ ID NO: 8280313 - DNA, 22 bp, Homo sapiens
cagcagtcaggcaaatgggagg

SEQ ID NO: 8280314 - DNA, 22 bp, Homo sapiens
cagcagagcatttggtaggagg

SEQ ID NO: 8280315 - DNA, 22 bp, Homo sapiens
cagcagagctgggctttgaatt

SEQ ID NO: 8280316 - DNA, 22 bp, Homo sapiens
cagcagagctgtgtgggaaggg

SEQ ID NO: 8280317 - DNA, 22 bp, Homo sapiens
cagcagggttaagtgactcacc

SEQ ID NO: 8280318 - DNA, 22 bp, Homo sapiens
cagcagggttaagtgactcacc

SEQ ID NO: 8280319 - DNA, 18 bp, Homo sapiens
cagcaggtagagtttggt

SEQ ID NO: 8280320 - DNA, 22 bp, Homo sapiens
cagcaggtctcagcagctcctt

SEQ ID NO: 8280321 - DNA, 22 bp, Homo sapiens
cagcagtggctgcaggcagctg

SEQ ID NO: 8280322 - DNA, 22 bp, Homo sapiens
cagcagtggctgcaggcagctg

SEQ ID NO: 8280323 - DNA, 22 bp, Homo sapiens
gtcctgagatgtcacaaggttt

SEQ ID NO: 8280324 - DNA, 22 bp, Homo sapiens
gtcctgtgtaagccaggacaat

SEQ ID NO: 8280325 - DNA, 22 bp, Homo sapiens
gtcctgtgggcccaccatgagc

SEQ ID NO: 8280326 - DNA, 22 bp, Homo sapiens
gtctcaaactcctaggctaaag

SEQ ID NO: 8280327 - DNA, 22 bp, Homo sapiens
cagcatgcaagtccagatgtgg

SEQ ID NO: 8280328 - DNA, 22 bp, Homo sapiens
ggtgggaaggggccagtgtgcg

SEQ ID NO: 8280329 - DNA, 22 bp, Homo sapiens
ggtgggaaggccactgaaggtt

SEQ ID NO: 8280330 - DNA, 22 bp, Homo sapiens
ggtgggaaggccactgaaggtt

SEQ ID NO: 8280331 - DNA, 18 bp, Homo sapiens
ggtgggaagccagggcct

SEQ ID NO: 8280332 - DNA, 21 bp, Homo sapiens
cagcagaagcatctatggaag

SEQ ID NO: 8280333 - DNA, 22 bp, Homo sapiens
ggtggctgcttcctcaagagga

SEQ ID NO: 8280334 - DNA, 22 bp, Homo sapiens
ggtggcagtggtctctgacaga

SEQ ID NO: 8280335 - DNA, 18 bp, Homo sapiens
ggtggctggggacggaca

SEQ ID NO: 8280336 - DNA, 22 bp, Homo sapiens
ggtggctgtgagcattatgtga

SEQ ID NO: 8280337 - DNA, 22 bp, Homo sapiens
ggtggctggttttataagaggt

SEQ ID NO: 8280338 - DNA, 22 bp, Homo sapiens
ggtggctggaggagctgatgga

SEQ ID NO: 8280339 - DNA, 22 bp, Homo sapiens
ggtggctgggattagtagccca

SEQ ID NO: 8280340 - DNA, 22 bp, Homo sapiens
cagatggcaacagctctgtgac

SEQ ID NO: 8280341 - DNA, 22 bp, Homo sapiens
ggtggcagtcttaagagatctt

SEQ ID NO: 8280342 - DNA, 22 bp, Homo sapiens
ggtggcagtcttaagagatctt

SEQ ID NO: 8280343 - DNA, 18 bp, Homo sapiens
ggtggcaggtcagatgcc

SEQ ID NO: 8280344 - DNA, 22 bp, Homo sapiens
ggtgtctatgattcagtttatg

SEQ ID NO: 8280345 - DNA, 20 bp, Homo sapiens
cagcagagacccatggggag

SEQ ID NO: 8280346 - DNA, 22 bp, Homo sapiens
cagcagactggagtaggcagtg

SEQ ID NO: 8280347 - DNA, 22 bp, Homo sapiens
gtaactgggatttttcaatgtg

SEQ ID NO: 8280348 - DNA, 20 bp, Homo sapiens
cagcagagacccatggggag

SEQ ID NO: 8280349 - DNA, 22 bp, Homo sapiens
cagcagagacggtaagcagaac

SEQ ID NO: 8280350 - DNA, 20 bp, Homo sapiens
cagcagagacccatggggag

SEQ ID NO: 8280351 - DNA, 22 bp, Homo sapiens
gtaagaaaaccttctttctaat

SEQ ID NO: 8280352 - DNA, 22 bp, Homo sapiens
gtaagaaaaccttctttctaat

SEQ ID NO: 8280353 - DNA, 22 bp, Homo sapiens
cagagttcaaagcctgctggga

SEQ ID NO: 8280354 - DNA, 22 bp, Homo sapiens
cagagtggtgcaagggcagtgt

SEQ ID NO: 8280355 - DNA, 22 bp, Homo sapiens
cagagtgttagcgctggttggg

SEQ ID NO: 8280356 - DNA, 22 bp, Homo sapiens
cagaggctgccagccatgtgca

SEQ ID NO: 8280357 - DNA, 22 bp, Homo sapiens
cagaggctgaccctgctgttgt

SEQ ID NO: 8280358 - DNA, 22 bp, Homo sapiens
cagaggctgagcagtcagtttg

SEQ ID NO: 8280359 - DNA, 22 bp, Homo sapiens
cagaggctgaccctgctgttgt

SEQ ID NO: 8280360 - DNA, 21 bp, Homo sapiens
cagaggctgagagggcaatct

SEQ ID NO: 8280361 - DNA, 22 bp, Homo sapiens
ggtgagaggcagaggacagctt

SEQ ID NO: 8280362 - DNA, 22 bp, Homo sapiens
ggtgcagaggagccagctgggg

SEQ ID NO: 8280363 - DNA, 20 bp, Homo sapiens
cagataaacgggaaagaagc

SEQ ID NO: 8280364 - DNA, 22 bp, Homo sapiens
cagataaatagatagataaact

SEQ ID NO: 8280365 - DNA, 22 bp, Homo sapiens
cagatatattttatttggtcaa

SEQ ID NO: 8280366 - DNA, 22 bp, Homo sapiens
cagaggaccagaaaggggccca

SEQ ID NO: 8280367 - DNA, 22 bp, Homo sapiens
cagaggacaactggggcaagga

SEQ ID NO: 8280368 - DNA, 22 bp, Homo sapiens
cagaggaagctgggtgtggagt

SEQ ID NO: 8280369 - DNA, 22 bp, Homo sapiens
cagaggcaggaagatgggcagt

SEQ ID NO: 8280370 - DNA, 22 bp, Homo sapiens
cagaggcagaggtcatctctgg

SEQ ID NO: 8280371 - DNA, 20 bp, Homo sapiens
gggctctgcatccatcagcc

SEQ ID NO: 8280372 - DNA, 22 bp, Homo sapiens
cagagctgtcatttgccagtga

SEQ ID NO: 8280373 - DNA, 22 bp, Homo sapiens
cagagctgtcatttgccagtga

SEQ ID NO: 8280374 - DNA, 22 bp, Homo sapiens
gggctcagtctgcggcgcgcgg

SEQ ID NO: 8280375 - DNA, 22 bp, Homo sapiens
cagagagaatcttggcagctga

SEQ ID NO: 8280376 - DNA, 22 bp, Homo sapiens
cagagagaatcttggcagctga

SEQ ID NO: 8280377 - DNA, 22 bp, Homo sapiens
cagagagaatatgtagtatgga

SEQ ID NO: 8280378 - DNA, 22 bp, Homo sapiens
cagagagaggtgccgataatgg

SEQ ID NO: 8280379 - DNA, 22 bp, Homo sapiens
cagaagcacatgtttacatgta

SEQ ID NO: 8280380 - DNA, 22 bp, Homo sapiens
cagaagcactaggaggaaacgt

SEQ ID NO: 8280381 - DNA, 22 bp, Homo sapiens
cagaagatctcttagtggaggg

SEQ ID NO: 8280382 - DNA, 22 bp, Homo sapiens
cagaagcaaatgccttgctgag

SEQ ID NO: 8280383 - DNA, 22 bp, Homo sapiens
cagagcagcctccagggggagc

SEQ ID NO: 8280384 - DNA, 21 bp, Homo sapiens
cagagcagcgttctgctgtgg

SEQ ID NO: 8280385 - DNA, 21 bp, Homo sapiens
cagagcagcgttctgctgtgg

SEQ ID NO: 8280386 - DNA, 22 bp, Homo sapiens
cagagcagagtgattgttctgg

SEQ ID NO: 8280387 - DNA, 18 bp, Homo sapiens
cagagcagaggtggagcg

SEQ ID NO: 8280388 - DNA, 22 bp, Homo sapiens
cagagagcatgggaggcccgag

SEQ ID NO: 8280389 - DNA, 21 bp, Homo sapiens
cagagagctagaacttcatga

SEQ ID NO: 8280390 - DNA, 22 bp, Homo sapiens
cagagagagtggggtgtggatt

SEQ ID NO: 8280391 - DNA, 22 bp, Homo sapiens
cagagagcacataggatacttt

SEQ ID NO: 8280392 - DNA, 22 bp, Homo sapiens
gggccctggacgtggcggcaga

SEQ ID NO: 8280393 - DNA, 22 bp, Homo sapiens
atgccctgcatcaagtgacact

SEQ ID NO: 8280394 - DNA, 22 bp, Homo sapiens
atgcccctccttgtggtcgccc

SEQ ID NO: 8280395 - DNA, 22 bp, Homo sapiens
atgcccctggccactcatattg

SEQ ID NO: 8280396 - DNA, 22 bp, Homo sapiens
atgcccctggcctggggaacat

SEQ ID NO: 8280397 - DNA, 22 bp, Homo sapiens
gacagggaggaaagagactgct

SEQ ID NO: 8280398 - DNA, 22 bp, Homo sapiens
gacagggacgaggcttcaggca

SEQ ID NO: 8280399 - DNA, 22 bp, Homo sapiens
atgcctcctgtgccactgtgat

SEQ ID NO: 8280400 - DNA, 22 bp, Homo sapiens
atgcctccttctgaaacagggc

SEQ ID NO: 8280401 - DNA, 22 bp, Homo sapiens
atgcctcctcaaatctgccaca

SEQ ID NO: 8280402 - DNA, 22 bp, Homo sapiens
atgcctccgcatgtgcctttga

SEQ ID NO: 8280403 - DNA, 22 bp, Homo sapiens
atgcctccctgtccttcagttc

SEQ ID NO: 8280404 - DNA, 22 bp, Homo sapiens
atgcctccaagattcttacgtt

SEQ ID NO: 8280405 - DNA, 22 bp, Homo sapiens
atgcctcccctgtgtcttttat

SEQ ID NO: 8280406 - DNA, 22 bp, Homo sapiens
gaatgtcctcctggatcactcc

SEQ ID NO: 8280407 - DNA, 22 bp, Homo sapiens
gaagcacatggctatagctatt

SEQ ID NO: 8280408 - DNA, 22 bp, Homo sapiens
gaagcagagcctaaggcagaca

SEQ ID NO: 8280409 - DNA, 22 bp, Homo sapiens
gaatcaggattcaagatcagct

SEQ ID NO: 8280410 - DNA, 22 bp, Homo sapiens
gacagtgtgaacatctaatagt

SEQ ID NO: 8280411 - DNA, 22 bp, Homo sapiens
gacagttacccccaaaagaatt

SEQ ID NO: 8280412 - DNA, 22 bp, Homo sapiens
gacagggaggaaagagactgct

SEQ ID NO: 8280413 - DNA, 22 bp, Homo sapiens
gaccctcctactaccctggaaa

SEQ ID NO: 8280414 - DNA, 19 bp, Homo sapiens
atgctttatgttatttctt

SEQ ID NO: 8280415 - DNA, 22 bp, Homo sapiens
cttgagaatgtgagccacagat

SEQ ID NO: 8280416 - DNA, 22 bp, Homo sapiens
cttgagagggagtagtttagga

SEQ ID NO: 8280417 - DNA, 22 bp, Homo sapiens
cttgagaaggaggaagggcttt

SEQ ID NO: 8280418 - DNA, 22 bp, Homo sapiens
atcttcccaggctggggagagg

SEQ ID NO: 8280419 - DNA, 22 bp, Homo sapiens
cttgagaaaggaacaggaagct

SEQ ID NO: 8280420 - DNA, 22 bp, Homo sapiens
atgaatattgaatgtcttatga

SEQ ID NO: 8280421 - DNA, 22 bp, Homo sapiens
atgaatgacatctgattccata

SEQ ID NO: 8280422 - DNA, 22 bp, Homo sapiens
atgaatgaataccatgcaacta

SEQ ID NO: 8280423 - DNA, 23 bp, Homo sapiens
atgaatgaataaggcaggaaagc

SEQ ID NO: 8280424 - DNA, 22 bp, Homo sapiens
atgaatgaaatacagagtactt

SEQ ID NO: 8280425 - DNA, 22 bp, Homo sapiens
atgaatgaagaacatctgtgcc

SEQ ID NO: 8280426 - DNA, 22 bp, Homo sapiens
cttgagcatcggatggaatttc

SEQ ID NO: 8280427 - DNA, 22 bp, Homo sapiens
atgaataaaacattttaatcag

SEQ ID NO: 8280428 - DNA, 22 bp, Homo sapiens
atgaatgattttatgtaaatga

SEQ ID NO: 8280429 - DNA, 22 bp, Homo sapiens
atgaatgactgtctactttggg

SEQ ID NO: 8280430 - DNA, 22 bp, Homo sapiens
atgaatgagaaacaggtgagat

SEQ ID NO: 8280431 - DNA, 22 bp, Homo sapiens
atgaatgagagaatagtggagc

SEQ ID NO: 8280432 - DNA, 22 bp, Homo sapiens
atgaatgagattaccaatgtga

SEQ ID NO: 8280433 - DNA, 22 bp, Homo sapiens
atgaatgattaaagagtacagt

SEQ ID NO: 8280434 - DNA, 22 bp, Homo sapiens
atgaatgatgccagttgaaatg

SEQ ID NO: 8280435 - DNA, 21 bp, Homo sapiens
gaaaaccatttgcatcatgag

SEQ ID NO: 8280436 - DNA, 22 bp, Homo sapiens
gaaaacttggatctctagaatg

SEQ ID NO: 8280437 - DNA, 22 bp, Homo sapiens
atgaattgaggaaaacagtcgt

SEQ ID NO: 8280438 - DNA, 22 bp, Homo sapiens
gaaaacttggatctctagaatg

SEQ ID NO: 8280439 - DNA, 22 bp, Homo sapiens
gaaatgaactgattatcattgc

SEQ ID NO: 8280440 - DNA, 22 bp, Homo sapiens
gaactttgcaaatgtcagaagc

SEQ ID NO: 8280441 - DNA, 22 bp, Homo sapiens
atgcaataccttctgaaaataa

SEQ ID NO: 8280442 - DNA, 22 bp, Homo sapiens
gaagaaagattggcatgcttca

SEQ ID NO: 8280443 - DNA, 22 bp, Homo sapiens
gaagaaagatcaaatagtttcc

SEQ ID NO: 8280444 - DNA, 22 bp, Homo sapiens
gaagaaactgaaaggggttggt

SEQ ID NO: 8280445 - DNA, 22 bp, Homo sapiens
gaagaaacaggggcttggggag

SEQ ID NO: 8280446 - DNA, 22 bp, Homo sapiens
atgcaagagatggacttgtgtt

SEQ ID NO: 8280447 - DNA, 22 bp, Homo sapiens
atgcaagcaacattttgcacat

SEQ ID NO: 8280448 - DNA, 22 bp, Homo sapiens
gagggatggtagttgacactga

SEQ ID NO: 8280449 - DNA, 22 bp, Homo sapiens
gaggctttcacaaggttagttc

SEQ ID NO: 8280450 - DNA, 22 bp, Homo sapiens
gaggcttggggctggcttgcct

SEQ ID NO: 8280451 - DNA, 22 bp, Homo sapiens
gaggccaactttggagaacagg

SEQ ID NO: 8280452 - DNA, 22 bp, Homo sapiens
gaggccaagttggagaccaggt

SEQ ID NO: 8280453 - DNA, 22 bp, Homo sapiens
gaggccacattacttggtgggt

SEQ ID NO: 8280454 - DNA, 22 bp, Homo sapiens
gaggccacagtcctgaggcatc

SEQ ID NO: 8280455 - DNA, 22 bp, Homo sapiens
gagggggtctatgaggtagagc

SEQ ID NO: 8280456 - DNA, 17 bp, Homo sapiens
gaggtaggaagtgagtc

SEQ ID NO: 8280457 - DNA, 22 bp, Homo sapiens
gaggtagccacagatagagact

SEQ ID NO: 8280458 - DNA, 19 bp, Homo sapiens
gaggggaggaattgacaag

SEQ ID NO: 8280459 - DNA, 19 bp, Homo sapiens
gaggggaggaattgacaag

SEQ ID NO: 8280460 - DNA, 22 bp, Homo sapiens
gagggggcgtgcaaggctccgc

SEQ ID NO: 8280461 - DNA, 22 bp, Homo sapiens
gagttagtatgttctgtaagta

SEQ ID NO: 8280462 - DNA, 22 bp, Homo sapiens
gatctggaatctgaaggctgag

SEQ ID NO: 8280463 - DNA, 20 bp, Homo sapiens
gagtccaggggcctgtagca

SEQ ID NO: 8280464 - DNA, 22 bp, Homo sapiens
gagtccagttagtgaggctggg

SEQ ID NO: 8280465 - DNA, 21 bp, Homo sapiens
gagtgcaggtctgatgccatc

SEQ ID NO: 8280466 - DNA, 22 bp, Homo sapiens
gagaggctggcagtgccaggtt

SEQ ID NO: 8280467 - DNA, 22 bp, Homo sapiens
gagcagggagacaactctggtg

SEQ ID NO: 8280468 - DNA, 22 bp, Homo sapiens
gagccctgaacaacagcaggaa

SEQ ID NO: 8280469 - DNA, 22 bp, Homo sapiens
gagcagggccacttctgtacct

SEQ ID NO: 8280470 - DNA, 17 bp, Homo sapiens
gagcagggatgcggttc

SEQ ID NO: 8280471 - DNA, 22 bp, Homo sapiens
gagcagggcttgtcctcctcat

SEQ ID NO: 8280472 - DNA, 22 bp, Homo sapiens
gagcaggtctttcatggtgcat

SEQ ID NO: 8280473 - DNA, 20 bp, Homo sapiens
gagccttcccctcaccactg

SEQ ID NO: 8280474 - DNA, 22 bp, Homo sapiens
atgtaaagttacttgagttttg

SEQ ID NO: 8280475 - DNA, 22 bp, Homo sapiens
atgtaattctaagactgaagaa

SEQ ID NO: 8280476 - DNA, 22 bp, Homo sapiens
atgtaatttagaaatgaacaca

SEQ ID NO: 8280477 - DNA, 22 bp, Homo sapiens
atgtaatttgccctcaagttaa

SEQ ID NO: 8280478 - DNA, 22 bp, Homo sapiens
atgtaatttatgttatccataa

SEQ ID NO: 8280479 - DNA, 22 bp, Homo sapiens
atgtcacagcaggagtattctt

SEQ ID NO: 8280480 - DNA, 22 bp, Homo sapiens
atgtcacaggcaacaagattgc

SEQ ID NO: 8280481 - DNA, 22 bp, Homo sapiens
atgtacaagctgttttactgca

SEQ ID NO: 8280482 - DNA, 22 bp, Homo sapiens
atgtacaaaatgttttgaaatg

SEQ ID NO: 8280483 - DNA, 22 bp, Homo sapiens
gagcttggtgatgcctcctggt

SEQ ID NO: 8280484 - DNA, 22 bp, Homo sapiens
gagcttgggtgccatgctgagc

SEQ ID NO: 8280485 - DNA, 22 bp, Homo sapiens
gagcttggtgcacagtggttaa

SEQ ID NO: 8280486 - DNA, 22 bp, Homo sapiens
gagcttggggcatatggtgcta

SEQ ID NO: 8280487 - DNA, 22 bp, Homo sapiens
gagctggggcggatactcagct

SEQ ID NO: 8280488 - DNA, 22 bp, Homo sapiens
gagctttgagattcttatggta

SEQ ID NO: 8280489 - DNA, 22 bp, Homo sapiens
gagctttgagattcttatggta

SEQ ID NO: 8280490 - DNA, 22 bp, Homo sapiens
gagctttgatcgctaagcctca

SEQ ID NO: 8280491 - DNA, 22 bp, Homo sapiens
gagcttggtgttatttctgtgg

SEQ ID NO: 8280492 - DNA, 22 bp, Homo sapiens
gagcttggtgctgcctgttgtc

SEQ ID NO: 8280493 - DNA, 22 bp, Homo sapiens
gaggaaggaatgcagtgtatgc

SEQ ID NO: 8280494 - DNA, 22 bp, Homo sapiens
gaggaaggagggaaagcgcgcg

SEQ ID NO: 8280495 - DNA, 22 bp, Homo sapiens
gaggaaggatttagtttgaggg

SEQ ID NO: 8280496 - DNA, 22 bp, Homo sapiens
gaggaaggagggaaagcgcgcg

SEQ ID NO: 8280497 - DNA, 22 bp, Homo sapiens
gaggaaggagggaaagcgcgcg

SEQ ID NO: 8280498 - DNA, 22 bp, Homo sapiens
gaggaaggatttagtttgaggg

SEQ ID NO: 8280499 - DNA, 22 bp, Homo sapiens
gaggaaggctaaggggcttaga

SEQ ID NO: 8280500 - DNA, 22 bp, Homo sapiens
gagctttgtaaaaaacttgcac

SEQ ID NO: 8280501 - DNA, 22 bp, Homo sapiens
gaggaagatggttgagtggtcc

SEQ ID NO: 8280502 - DNA, 22 bp, Homo sapiens
gaggaagccccattgaagccag

SEQ ID NO: 8280503 - DNA, 22 bp, Homo sapiens
gagctttgcattattcagaagc

SEQ ID NO: 8280504 - DNA, 22 bp, Homo sapiens
gagctttgatcgctaagcctca

SEQ ID NO: 8280505 - DNA, 22 bp, Homo sapiens
gagctttgcctaaaactagaat

SEQ ID NO: 8280506 - DNA, 22 bp, Homo sapiens
gagctttgcattattcagaagc

SEQ ID NO: 8280507 - DNA, 22 bp, Homo sapiens
gagctttgctggaagcctgggg

SEQ ID NO: 8280508 - DNA, 22 bp, Homo sapiens
gagctttgcctaaaactagaat

SEQ ID NO: 8280509 - DNA, 22 bp, Homo sapiens
gagctttgctggaagcctgggg

SEQ ID NO: 8280510 - DNA, 22 bp, Homo sapiens
gagctttggtgccaagtatttg

SEQ ID NO: 8280511 - DNA, 22 bp, Homo sapiens
gagctttggtgccaagtatttg

SEQ ID NO: 8280512 - DNA, 22 bp, Homo sapiens
gagctttggggaagaatacaga

SEQ ID NO: 8280513 - DNA, 22 bp, Homo sapiens
gagctttggggaagaatacaga

SEQ ID NO: 8280514 - DNA, 22 bp, Homo sapiens
gagctttgctggaagcctgggg

SEQ ID NO: 8280515 - DNA, 22 bp, Homo sapiens
gagctttgtgctggtaggtggt

SEQ ID NO: 8280516 - DNA, 22 bp, Homo sapiens
gagctttgtctcctggagaccc

SEQ ID NO: 8280517 - DNA, 22 bp, Homo sapiens
gagctttgttccgtggtggcac

SEQ ID NO: 8280518 - DNA, 22 bp, Homo sapiens
gagctttgttccgtggtggcac

SEQ ID NO: 8280519 - DNA, 22 bp, Homo sapiens
gagctttgtgctggtaggtggt

SEQ ID NO: 8280520 - DNA, 22 bp, Homo sapiens
gagctttgtctcctggagaccc

SEQ ID NO: 8280521 - DNA, 22 bp, Homo sapiens
gagctttgtcccttgggggctc

SEQ ID NO: 8280522 - DNA, 22 bp, Homo sapiens
gagctttgtcccttgggggctc

SEQ ID NO: 8280523 - DNA, 22 bp, Homo sapiens
gagctttgtagcaggaaggaag

SEQ ID NO: 8280524 - DNA, 22 bp, Homo sapiens
gagctttgtaaaaaacttgcac

SEQ ID NO: 8280525 - DNA, 22 bp, Homo sapiens
gagctttgtagcaggaaggaag

SEQ ID NO: 8280526 - DNA, 22 bp, Homo sapiens
gcagcaggtccgcatcatcatc

SEQ ID NO: 8280527 - DNA, 22 bp, Homo sapiens
gcagccaggggctgtgacctgt

SEQ ID NO: 8280528 - DNA, 19 bp, Homo sapiens
gcagccaggtgctctacct

SEQ ID NO: 8280529 - DNA, 19 bp, Homo sapiens
gcagccaggtgctctacct

SEQ ID NO: 8280530 - DNA, 22 bp, Homo sapiens
gcagccaggtttgaggaccact

SEQ ID NO: 8280531 - DNA, 19 bp, Homo sapiens
gcagccaggtgctctacct

SEQ ID NO: 8280532 - DNA, 19 bp, Homo sapiens
gcagccaggtgctctacct

SEQ ID NO: 8280533 - DNA, 22 bp, Homo sapiens
gcagccagggagagaaccaggg

SEQ ID NO: 8280534 - DNA, 22 bp, Homo sapiens
gcagccagggctaagctgggga

SEQ ID NO: 8280535 - DNA, 22 bp, Homo sapiens
gcagccagggctaagctgggga

SEQ ID NO: 8280536 - DNA, 22 bp, Homo sapiens
gcagccaggctacagcgggctt

SEQ ID NO: 8280537 - DNA, 22 bp, Homo sapiens
gcagccaggctacagcgggctt

SEQ ID NO: 8280538 - DNA, 22 bp, Homo sapiens
gcagccagggagagaaccaggg

SEQ ID NO: 8280539 - DNA, 22 bp, Homo sapiens
gcagcctgggcaacagagtgag

SEQ ID NO: 8280540 - DNA, 22 bp, Homo sapiens
gcagccaggtttgaggaccact

SEQ ID NO: 8280541 - DNA, 22 bp, Homo sapiens
gcagctttaaaggaggctctga

SEQ ID NO: 8280542 - DNA, 22 bp, Homo sapiens
gcagctttaaaggaggctctga

SEQ ID NO: 8280543 - DNA, 22 bp, Homo sapiens
gcagctttaatctgaataagta

SEQ ID NO: 8280544 - DNA, 22 bp, Homo sapiens
gcagctttagaaacaagggctg

SEQ ID NO: 8280545 - DNA, 22 bp, Homo sapiens
gcagctttaaacattggaaata

SEQ ID NO: 8280546 - DNA, 22 bp, Homo sapiens
gcagctttctaagctttattgc

SEQ ID NO: 8280547 - DNA, 22 bp, Homo sapiens
gcagaagtggattctacaattt

SEQ ID NO: 8280548 - DNA, 22 bp, Homo sapiens
gcagaaggtctggcacttcagg

SEQ ID NO: 8280549 - DNA, 22 bp, Homo sapiens
gcagaggggaagctgaggaatt

SEQ ID NO: 8280550 - DNA, 22 bp, Homo sapiens
gcaaaagtacagccggatttct

SEQ ID NO: 8280551 - DNA, 22 bp, Homo sapiens
gcaaaactcggacatctaatct

SEQ ID NO: 8280552 - DNA, 22 bp, Homo sapiens
gcaaaactcgcaattacttttg

SEQ ID NO: 8280553 - DNA, 22 bp, Homo sapiens
gcacacaggggagttctcagaa

SEQ ID NO: 8280554 - DNA, 22 bp, Homo sapiens
gcacacaggggagttctcagaa

SEQ ID NO: 8280555 - DNA, 22 bp, Homo sapiens
gcaaattaaccaatcatgctcg

SEQ ID NO: 8280556 - DNA, 22 bp, Homo sapiens
gcaaattagtggccaagcccaa

SEQ ID NO: 8280557 - DNA, 20 bp, Homo sapiens
gcaaatggatcccacaagcc

SEQ ID NO: 8280558 - DNA, 22 bp, Homo sapiens
gcaaatggagtgaagagctgga

SEQ ID NO: 8280559 - DNA, 20 bp, Homo sapiens
gcaaatggacactcagggaa

SEQ ID NO: 8280560 - DNA, 22 bp, Homo sapiens
gcaaatggagtgaagagctgga

SEQ ID NO: 8280561 - DNA, 22 bp, Homo sapiens
gcactgtagtgggggagaaatg

SEQ ID NO: 8280562 - DNA, 20 bp, Homo sapiens
gcacagagatgagcaaagta

SEQ ID NO: 8280563 - DNA, 22 bp, Homo sapiens
gcacagaggatgaggcagctct

SEQ ID NO: 8280564 - DNA, 22 bp, Homo sapiens
gcacaggctgttggccttcaga

SEQ ID NO: 8280565 - DNA, 22 bp, Homo sapiens
gcacagggagacagccgtggcc

SEQ ID NO: 8280566 - DNA, 22 bp, Homo sapiens
gcagggacgccagggacagcaa

SEQ ID NO: 8280567 - DNA, 22 bp, Homo sapiens
gcagggactttggcaacaggtg

SEQ ID NO: 8280568 - DNA, 22 bp, Homo sapiens
gcagggaggaagagatgcttcc

SEQ ID NO: 8280569 - DNA, 22 bp, Homo sapiens
gcagggagggcctttcatgaca

SEQ ID NO: 8280570 - DNA, 18 bp, Homo sapiens
gcaggagatgggtggggt

SEQ ID NO: 8280571 - DNA, 22 bp, Homo sapiens
gcaggagcaatggcctatcaga

SEQ ID NO: 8280572 - DNA, 22 bp, Homo sapiens
gcaggatggtggaaggcctgct

SEQ ID NO: 8280573 - DNA, 22 bp, Homo sapiens
gcaggatgggtgtagcccagca

SEQ ID NO: 8280574 - DNA, 22 bp, Homo sapiens
gcagggtaggtgacaggtagtc

SEQ ID NO: 8280575 - DNA, 22 bp, Homo sapiens
gcagggtccatggaggcagccc

SEQ ID NO: 8280576 - DNA, 22 bp, Homo sapiens
gcagggtcttgagaggcagcca

SEQ ID NO: 8280577 - DNA, 22 bp, Homo sapiens
gcaggtggatattgctacttga

SEQ ID NO: 8280578 - DNA, 22 bp, Homo sapiens
gcaggtggatcacctgaggtca

SEQ ID NO: 8280579 - DNA, 22 bp, Homo sapiens
attggtggtgaggacatgccag

SEQ ID NO: 8280580 - DNA, 18 bp, Homo sapiens
attgttaatagagtactt

SEQ ID NO: 8280581 - DNA, 22 bp, Homo sapiens
attgttctaagggtttaattaa

SEQ ID NO: 8280582 - DNA, 22 bp, Homo sapiens
attgttctggatatttacattg

SEQ ID NO: 8280583 - DNA, 22 bp, Homo sapiens
attgttctgtagtgacatgtag

SEQ ID NO: 8280584 - DNA, 18 bp, Homo sapiens
attgttctgtgacatgtc

SEQ ID NO: 8280585 - DNA, 22 bp, Homo sapiens
attgtacaagtttggttattta

SEQ ID NO: 8280586 - DNA, 22 bp, Homo sapiens
attgtacaatgctgaggtttgg

SEQ ID NO: 8280587 - DNA, 22 bp, Homo sapiens
gcagtgcatgtcggaactcatt

SEQ ID NO: 8280588 - DNA, 22 bp, Homo sapiens
gcagtgcaggacaaatcagtgc

SEQ ID NO: 8280589 - DNA, 18 bp, Homo sapiens
gcagtgcaggaagaagag

SEQ ID NO: 8280590 - DNA, 22 bp, Homo sapiens
gcattcagggttcacggtcaac

SEQ ID NO: 8280591 - DNA, 22 bp, Homo sapiens
gcattcagcctaaagagaaaag

SEQ ID NO: 8280592 - DNA, 22 bp, Homo sapiens
gcattcaggaaccggaagggta

SEQ ID NO: 8280593 - DNA, 21 bp, Homo sapiens
gccactgcactccagcctggg

SEQ ID NO: 8280594 - DNA, 23 bp, Homo sapiens
attgtttttggctctcagggaat

SEQ ID NO: 8280595 - DNA, 22 bp, Homo sapiens
attgttttgtagaatgaccctt

SEQ ID NO: 8280596 - DNA, 22 bp, Homo sapiens
attgttttattaaatgagccct

SEQ ID NO: 8280597 - DNA, 22 bp, Homo sapiens
attgttttaattccattgtgaa

SEQ ID NO: 8280598 - DNA, 22 bp, Homo sapiens
gccactgtcctgtgcctgtgct

SEQ ID NO: 8280599 - DNA, 23 bp, Homo sapiens
atttgacagagcatagcatttct

SEQ ID NO: 8280600 - DNA, 22 bp, Homo sapiens
atttgattagctgtgtaatttt

SEQ ID NO: 8280601 - DNA, 22 bp, Homo sapiens
atttgattagctgtgtaatttt

SEQ ID NO: 8280602 - DNA, 22 bp, Homo sapiens
atttgatttgtagatagtgtag

SEQ ID NO: 8280603 - DNA, 22 bp, Homo sapiens
atttgatttgtagatagtgtag

SEQ ID NO: 8280604 - DNA, 22 bp, Homo sapiens
atttgagatggtaaataacttt

SEQ ID NO: 8280605 - DNA, 22 bp, Homo sapiens
atttgcaagcatgcacaaaagc

SEQ ID NO: 8280606 - DNA, 22 bp, Homo sapiens
atttgcaagagtaagaatttct

SEQ ID NO: 8280607 - DNA, 22 bp, Homo sapiens
atttgcaaagtcgtatctgtga

SEQ ID NO: 8280608 - DNA, 22 bp, Homo sapiens
atttgccttactgaagaaggag

SEQ ID NO: 8280609 - DNA, 23 bp, Homo sapiens
attttaaccttgactaacatgca

SEQ ID NO: 8280610 - DNA, 22 bp, Homo sapiens
attttaataagatccatttggt

SEQ ID NO: 8280611 - DNA, 22 bp, Homo sapiens
attttaataagatccatttggt

SEQ ID NO: 8280612 - DNA, 22 bp, Homo sapiens
attttacataaggaaggtttaa

SEQ ID NO: 8280613 - DNA, 22 bp, Homo sapiens
attttactaagtggatatctgt

SEQ ID NO: 8280614 - DNA, 23 bp, Homo sapiens
gcctgccgcctggctgagaactg

SEQ ID NO: 8280615 - DNA, 22 bp, Homo sapiens
gcctgcctagaattgcagcttt

SEQ ID NO: 8280616 - DNA, 21 bp, Homo sapiens
gcctgccctctgtgatggcca

SEQ ID NO: 8280617 - DNA, 22 bp, Homo sapiens
attttgaagggaattgaagttc

SEQ ID NO: 8280618 - DNA, 22 bp, Homo sapiens
attttgaaaccaagttatttcc

SEQ ID NO: 8280619 - DNA, 22 bp, Homo sapiens
attttcttctctccctggctgc

SEQ ID NO: 8280620 - DNA, 22 bp, Homo sapiens
attttcttctctccctggctgc

SEQ ID NO: 8280621 - DNA, 22 bp, Homo sapiens
atttacataatagactttaggt

SEQ ID NO: 8280622 - DNA, 22 bp, Homo sapiens
gcccagccagagctgtgtgatg

SEQ ID NO: 8280623 - DNA, 18 bp, Homo sapiens
gccagagggcccaaggtc

SEQ ID NO: 8280624 - DNA, 22 bp, Homo sapiens
gccagaggggctcgaaggcgcg

SEQ ID NO: 8280625 - DNA, 22 bp, Homo sapiens
gccagagggattcctggtgtgt

SEQ ID NO: 8280626 - DNA, 22 bp, Homo sapiens
gccctccacctggtctctctgg

SEQ ID NO: 8280627 - DNA, 22 bp, Homo sapiens
gcccaggagttgaagggctgac

SEQ ID NO: 8280628 - DNA, 22 bp, Homo sapiens
gcccaggagttcaaggctgcag

SEQ ID NO: 8280629 - DNA, 22 bp, Homo sapiens
gcccaggaggtcaagtagctat

SEQ ID NO: 8280630 - DNA, 22 bp, Homo sapiens
gcccagcccctgggtggacgtg

SEQ ID NO: 8280631 - DNA, 22 bp, Homo sapiens
gctctgagaggatgctgagcag

SEQ ID NO: 8280632 - DNA, 20 bp, Homo sapiens
caaatccctgctctgtgctg

SEQ ID NO: 8280633 - DNA, 20 bp, Homo sapiens
caaatccctgctctgtgctg

SEQ ID NO: 8280634 - DNA, 20 bp, Homo sapiens
caaatccctgctctgtgctg

SEQ ID NO: 8280635 - DNA, 22 bp, Homo sapiens
caaattcaatgaacatgtttaa

SEQ ID NO: 8280636 - DNA, 22 bp, Homo sapiens
gctgactttgcctgtctttagc

SEQ ID NO: 8280637 - DNA, 22 bp, Homo sapiens
gctgagctgctgttcatcctgc

SEQ ID NO: 8280638 - DNA, 22 bp, Homo sapiens
gctacacaatagcgttcactta

SEQ ID NO: 8280639 - DNA, 22 bp, Homo sapiens
gctacaagtcttgtcattcatt

SEQ ID NO: 8280640 - DNA, 22 bp, Homo sapiens
gctacaaagtggtaggaggtca

SEQ ID NO: 8280641 - DNA, 22 bp, Homo sapiens
gctatgtgtgttttgctgcagc

SEQ ID NO: 8280642 - DNA, 22 bp, Homo sapiens
gctattacttttggagtgtggg

SEQ ID NO: 8280643 - DNA, 22 bp, Homo sapiens
gctattactgatggagatttag

SEQ ID NO: 8280644 - DNA, 22 bp, Homo sapiens
gctatgttcccttttgctataa

SEQ ID NO: 8280645 - DNA, 22 bp, Homo sapiens
gcctggctcctaaggactggct

SEQ ID NO: 8280646 - DNA, 22 bp, Homo sapiens
gcctggctctgagtttctctcc

SEQ ID NO: 8280647 - DNA, 22 bp, Homo sapiens
gctaaatctcctacaatgcaca

SEQ ID NO: 8280648 - DNA, 22 bp, Homo sapiens
gcgtgtcaatctatctgttcca

SEQ ID NO: 8280649 - DNA, 22 bp, Homo sapiens
gctaaaaggagcactagagatt

SEQ ID NO: 8280650 - DNA, 22 bp, Homo sapiens
gctccaggcgagctggaccaga

SEQ ID NO: 8280651 - DNA, 22 bp, Homo sapiens
gctccaggcagcatagtggatg

SEQ ID NO: 8280652 - DNA, 22 bp, Homo sapiens
gctccaggcagcatagtggatg

SEQ ID NO: 8280653 - DNA, 22 bp, Homo sapiens
gctcgttgaacctgtccccgag

SEQ ID NO: 8280654 - DNA, 22 bp, Homo sapiens
gctccaggctgctctgtcccat

SEQ ID NO: 8280655 - DNA, 17 bp, Homo sapiens
gctccaggcgtgagtga

SEQ ID NO: 8280656 - DNA, 22 bp, Homo sapiens
ccccagagtgagggattgagtg

SEQ ID NO: 8280657 - DNA, 22 bp, Homo sapiens
ccccagaagtttgcacaagaga

SEQ ID NO: 8280658 - DNA, 22 bp, Homo sapiens
cccatgcaccctctaagaagga

SEQ ID NO: 8280659 - DNA, 22 bp, Homo sapiens
ccccagcactaccagaagccag

SEQ ID NO: 8280660 - DNA, 17 bp, Homo sapiens
ccctcactcctgccggg

SEQ ID NO: 8280661 - DNA, 22 bp, Homo sapiens
ccctatcagaagctgagagaag

SEQ ID NO: 8280662 - DNA, 22 bp, Homo sapiens
ccctccattaaaacagacctat

SEQ ID NO: 8280663 - DNA, 22 bp, Homo sapiens
ccctcagctccaccctcagcag

SEQ ID NO: 8280664 - DNA, 22 bp, Homo sapiens
ccctcccaagcactctgacata

SEQ ID NO: 8280665 - DNA, 22 bp, Homo sapiens
ccctcccaggagtggccagaga

SEQ ID NO: 8280666 - DNA, 22 bp, Homo sapiens
ccctgcccaccacatgctggga

SEQ ID NO: 8280667 - DNA, 22 bp, Homo sapiens
cccaggagccatctgtcttggc

SEQ ID NO: 8280668 - DNA, 22 bp, Homo sapiens
cccaggaattcagggctcaagg

SEQ ID NO: 8280669 - DNA, 22 bp, Homo sapiens
cccaggaatgggaaggaggaat

SEQ ID NO: 8280670 - DNA, 22 bp, Homo sapiens
cccaggagatgcactccattgg

SEQ ID NO: 8280671 - DNA, 23 bp, Homo sapiens
cccaggagcctgagtcctctctg

SEQ ID NO: 8280672 - DNA, 23 bp, Homo sapiens
cccaggagcctgagtcctctctg

SEQ ID NO: 8280673 - DNA, 20 bp, Homo sapiens
cccaggagctgtgccccatc

SEQ ID NO: 8280674 - DNA, 22 bp, Homo sapiens
cccaggagcttctctctgcctc

SEQ ID NO: 8280675 - DNA, 22 bp, Homo sapiens
cccaggagcttctctctgcctc

SEQ ID NO: 8280676 - DNA, 22 bp, Homo sapiens
cccaggagcttctctctgcctc

SEQ ID NO: 8280677 - DNA, 22 bp, Homo sapiens
cccaggaatgaggggcggaggc

SEQ ID NO: 8280678 - DNA, 22 bp, Homo sapiens
cccatccctgattttcactcgt

SEQ ID NO: 8280679 - DNA, 22 bp, Homo sapiens
cccagtttcaactttccagtgg

SEQ ID NO: 8280680 - DNA, 22 bp, Homo sapiens
cccatagaaggggaagtgctac

SEQ ID NO: 8280681 - DNA, 18 bp, Homo sapiens
cccaggctttgtgggtct

SEQ ID NO: 8280682 - DNA, 22 bp, Homo sapiens
cccaggaggtcaaggctgcagt

SEQ ID NO: 8280683 - DNA, 22 bp, Homo sapiens
cccaggaggtggagcttgcagt

SEQ ID NO: 8280684 - DNA, 22 bp, Homo sapiens
cccaggctgagttagaggtgtc

SEQ ID NO: 8280685 - DNA, 22 bp, Homo sapiens
cccaggaggtcgaagctgcagt

SEQ ID NO: 8280686 - DNA, 22 bp, Homo sapiens
cccaggaggtcgaagctgcagt

SEQ ID NO: 8280687 - DNA, 22 bp, Homo sapiens
cccaggctgatgttcagcgggt

SEQ ID NO: 8280688 - DNA, 22 bp, Homo sapiens
cccaggctgccacgattactgc

SEQ ID NO: 8280689 - DNA, 22 bp, Homo sapiens
cccaggctgatgggatgggcca

SEQ ID NO: 8280690 - DNA, 22 bp, Homo sapiens
cctgagagtgagtgcctcctta

SEQ ID NO: 8280691 - DNA, 22 bp, Homo sapiens
cctgagagtgagggcctcctta

SEQ ID NO: 8280692 - DNA, 22 bp, Homo sapiens
cctgagagtaggtgtctcttta

SEQ ID NO: 8280693 - DNA, 22 bp, Homo sapiens
agggtaggaactgagtggaagg

SEQ ID NO: 8280694 - DNA, 22 bp, Homo sapiens
cctgagaggttggcctgtccag

SEQ ID NO: 8280695 - DNA, 22 bp, Homo sapiens
cctgagaggccctctcactgtc

SEQ ID NO: 8280696 - DNA, 22 bp, Homo sapiens
cctgagagccagtgcctgccca

SEQ ID NO: 8280697 - DNA, 22 bp, Homo sapiens
cctgagagcagcttcctgctta

SEQ ID NO: 8280698 - DNA, 22 bp, Homo sapiens
cctgaaatccatagtttacact

SEQ ID NO: 8280699 - DNA, 22 bp, Homo sapiens
aggggagagttaatgtgaatgt

SEQ ID NO: 8280700 - DNA, 22 bp, Homo sapiens
aggggatggagctggaaggcag

SEQ ID NO: 8280701 - DNA, 22 bp, Homo sapiens
agggcctcagtgttctcatctg

SEQ ID NO: 8280702 - DNA, 22 bp, Homo sapiens
ccctggaaatgaggcatgtgcg

SEQ ID NO: 8280703 - DNA, 22 bp, Homo sapiens
agggctggagccacagctggga

SEQ ID NO: 8280704 - DNA, 22 bp, Homo sapiens
agggctggagggtactagttta

SEQ ID NO: 8280705 - DNA, 22 bp, Homo sapiens
agggctagagttgagatgggga

SEQ ID NO: 8280706 - DNA, 22 bp, Homo sapiens
agggcgaggagacggaggcaca

SEQ ID NO: 8280707 - DNA, 22 bp, Homo sapiens
ccaggtctggcactggccagtc

SEQ ID NO: 8280708 - DNA, 19 bp, Homo sapiens
ccaggtctggggccagatt

SEQ ID NO: 8280709 - DNA, 22 bp, Homo sapiens
aggctggcggtgactgctctga

SEQ ID NO: 8280710 - DNA, 22 bp, Homo sapiens
ccatttagtaaggaagaacagc

SEQ ID NO: 8280711 - DNA, 22 bp, Homo sapiens
ccatttgaaatgaatgttttta

SEQ ID NO: 8280712 - DNA, 17 bp, Homo sapiens
aggctggccttcacagt

SEQ ID NO: 8280713 - DNA, 22 bp, Homo sapiens
aggctggccctactggctgcct

SEQ ID NO: 8280714 - DNA, 22 bp, Homo sapiens
aggctggggaattgaatttgct

SEQ ID NO: 8280715 - DNA, 22 bp, Homo sapiens
ccatttgttgtgtattaatatt

SEQ ID NO: 8280716 - DNA, 22 bp, Homo sapiens
ccatttgtttcccttgggaaac

SEQ ID NO: 8280717 - DNA, 22 bp, Homo sapiens
ccatttgttttcgctaccatgg

SEQ ID NO: 8280718 - DNA, 22 bp, Homo sapiens
ccatttgttgtgtattaatatt

SEQ ID NO: 8280719 - DNA, 22 bp, Homo sapiens
ccatttgttgagaacgtgcctt

SEQ ID NO: 8280720 - DNA, 22 bp, Homo sapiens
ccatttgttcgcccagctccaa

SEQ ID NO: 8280721 - DNA, 22 bp, Homo sapiens
ccatttgtggtttatttgctct

SEQ ID NO: 8280722 - DNA, 22 bp, Homo sapiens
ccatttgtgcttcttcaaagca

SEQ ID NO: 8280723 - DNA, 22 bp, Homo sapiens
ccatttgtcacctctgcactcc

SEQ ID NO: 8280724 - DNA, 22 bp, Homo sapiens
ccatttgtgatgtggcagcatc

SEQ ID NO: 8280725 - DNA, 22 bp, Homo sapiens
ccatttgtattactgccccagg

SEQ ID NO: 8280726 - DNA, 22 bp, Homo sapiens
ccatttgtaccatttctttgta

SEQ ID NO: 8280727 - DNA, 22 bp, Homo sapiens
ccatttgtaccatttctttgta

SEQ ID NO: 8280728 - DNA, 21 bp, Homo sapiens
ccatttgtaggtttccctctg

SEQ ID NO: 8280729 - DNA, 22 bp, Homo sapiens
ccatttgtaaccttagagcaat

SEQ ID NO: 8280730 - DNA, 22 bp, Homo sapiens
aggctgaggcaggtggatcacc

SEQ ID NO: 8280731 - DNA, 22 bp, Homo sapiens
ccaggtctgcgggcggcaggca

SEQ ID NO: 8280732 - DNA, 22 bp, Homo sapiens
aggctgagctgacctggtttgg

SEQ ID NO: 8280733 - DNA, 22 bp, Homo sapiens
ccagggctgggtttgtcggtgt

SEQ ID NO: 8280734 - DNA, 22 bp, Homo sapiens
ccagggcctcgtgttctgagtg

SEQ ID NO: 8280735 - DNA, 22 bp, Homo sapiens
ccagggcctcgtgttctgagtg

SEQ ID NO: 8280736 - DNA, 22 bp, Homo sapiens
ccagggcctgccacttagcaag

SEQ ID NO: 8280737 - DNA, 22 bp, Homo sapiens
ccagggctggaccagtgcttgg

SEQ ID NO: 8280738 - DNA, 20 bp, Homo sapiens
ccagggctggctcctgggat

SEQ ID NO: 8280739 - DNA, 22 bp, Homo sapiens
aggctacaataattcccatgca

SEQ ID NO: 8280740 - DNA, 22 bp, Homo sapiens
aggctaagtgattagtgacata

SEQ ID NO: 8280741 - DNA, 22 bp, Homo sapiens
aggctacagatacagaggctac

SEQ ID NO: 8280742 - DNA, 22 bp, Homo sapiens
aggctacagcctcaagagtgca

SEQ ID NO: 8280743 - DNA, 22 bp, Homo sapiens
aggctacaggagacgccaggag

SEQ ID NO: 8280744 - DNA, 22 bp, Homo sapiens
aggctagaggcttctggcttca

SEQ ID NO: 8280745 - DNA, 22 bp, Homo sapiens
ccaggctgcttagccttatctt

SEQ ID NO: 8280746 - DNA, 19 bp, Homo sapiens
ccagcagctttgattctct

SEQ ID NO: 8280747 - DNA, 22 bp, Homo sapiens
ccagcaggactttggaaatatg

SEQ ID NO: 8280748 - DNA, 22 bp, Homo sapiens
ccagcaggaaagtgacgtttga

SEQ ID NO: 8280749 - DNA, 22 bp, Homo sapiens
ccagagcctggcatctgcataa

SEQ ID NO: 8280750 - DNA, 21 bp, Homo sapiens
ccagagcctgctgagccccct

SEQ ID NO: 8280751 - DNA, 22 bp, Homo sapiens
ccaggaagtatgacccaacaga

SEQ ID NO: 8280752 - DNA, 22 bp, Homo sapiens
aggcggggaggcgctgctgtag

SEQ ID NO: 8280753 - DNA, 22 bp, Homo sapiens
aggcctgcttacaatgttatcc

SEQ ID NO: 8280754 - DNA, 22 bp, Homo sapiens
ccaggaaggcgttgttcctctc

SEQ ID NO: 8280755 - DNA, 22 bp, Homo sapiens
ccaggaaggtatgggaagaaaa

SEQ ID NO: 8280756 - DNA, 22 bp, Homo sapiens
ccaggaaggcctggatgccccc

SEQ ID NO: 8280757 - DNA, 22 bp, Homo sapiens
ccagcaggagagaacatttccc

SEQ ID NO: 8280758 - DNA, 22 bp, Homo sapiens
ccagcaggagactagcaacata

SEQ ID NO: 8280759 - DNA, 21 bp, Homo sapiens
ccagctctgcctccagttggt

SEQ ID NO: 8280760 - DNA, 22 bp, Homo sapiens
ccagcaggcagtcatatccttt

SEQ ID NO: 8280761 - DNA, 22 bp, Homo sapiens
ccagcaggagatgcctgtgtct

SEQ ID NO: 8280762 - DNA, 22 bp, Homo sapiens
ccagctctggcttcttgctggg

SEQ ID NO: 8280763 - DNA, 22 bp, Homo sapiens
agctgaagaaatgggaagcatt

SEQ ID NO: 8280764 - DNA, 22 bp, Homo sapiens
agctgaagaaatgggaagcatt

SEQ ID NO: 8280765 - DNA, 22 bp, Homo sapiens
agctgccctggcggagctgctc

SEQ ID NO: 8280766 - DNA, 20 bp, Homo sapiens
agctgcccctgggcactgcc

SEQ ID NO: 8280767 - DNA, 22 bp, Homo sapiens
agctgcccctcattttcaccac

SEQ ID NO: 8280768 - DNA, 22 bp, Homo sapiens
agctgccgatgcccagctgcat

SEQ ID NO: 8280769 - DNA, 17 bp, Homo sapiens
agctgcctctcccacca

SEQ ID NO: 8280770 - DNA, 22 bp, Homo sapiens
agctggtgctcaggggcatgga

SEQ ID NO: 8280771 - DNA, 22 bp, Homo sapiens
agctggtgagggttgaggggta

SEQ ID NO: 8280772 - DNA, 22 bp, Homo sapiens
agctggtgaacctgaggcacag

SEQ ID NO: 8280773 - DNA, 22 bp, Homo sapiens
agctgggtttctggcaggctta

SEQ ID NO: 8280774 - DNA, 22 bp, Homo sapiens
agctgggtggcctctcctcggg

SEQ ID NO: 8280775 - DNA, 22 bp, Homo sapiens
agctgggtgcggtggctcatgc

SEQ ID NO: 8280776 - DNA, 22 bp, Homo sapiens
agctggagatgcccagcaccgg

SEQ ID NO: 8280777 - DNA, 22 bp, Homo sapiens
agctggagagtttccaggaagg

SEQ ID NO: 8280778 - DNA, 22 bp, Homo sapiens
agctgggcagactgcagtggtt

SEQ ID NO: 8280779 - DNA, 22 bp, Homo sapiens
agctgggcaccccgctgcgtct

SEQ ID NO: 8280780 - DNA, 22 bp, Homo sapiens
agctgggactcaactgtctggg

SEQ ID NO: 8280781 - DNA, 22 bp, Homo sapiens
agctgggctccaagagggatct

SEQ ID NO: 8280782 - DNA, 22 bp, Homo sapiens
agctgggctgatgactcatgtt

SEQ ID NO: 8280783 - DNA, 22 bp, Homo sapiens
agctgggctccaagagggatct

SEQ ID NO: 8280784 - DNA, 22 bp, Homo sapiens
agctgggcgcagtggctggtga

SEQ ID NO: 8280785 - DNA, 22 bp, Homo sapiens
agctgggcctgatttgcagggg

SEQ ID NO: 8280786 - DNA, 21 bp, Homo sapiens
agctgggcctcagcctgcagt

SEQ ID NO: 8280787 - DNA, 22 bp, Homo sapiens
agctgggcctgagctggaagct

SEQ ID NO: 8280788 - DNA, 17 bp, Homo sapiens
caggtcccagggtctct

SEQ ID NO: 8280789 - DNA, 22 bp, Homo sapiens
caggtcccgccccgggctgacc

SEQ ID NO: 8280790 - DNA, 22 bp, Homo sapiens
aggaagggctgtttctccaaga

SEQ ID NO: 8280791 - DNA, 22 bp, Homo sapiens
aggaatgtgaccactagactct

SEQ ID NO: 8280792 - DNA, 22 bp, Homo sapiens
aggaagaggtagctgtcaaggg

SEQ ID NO: 8280793 - DNA, 22 bp, Homo sapiens
aggaagagggtggcagataatc

SEQ ID NO: 8280794 - DNA, 22 bp, Homo sapiens
aggaagagggtggcagataatc

SEQ ID NO: 8280795 - DNA, 20 bp, Homo sapiens
aggaaggagaatctgagcaa

SEQ ID NO: 8280796 - DNA, 22 bp, Homo sapiens
aggaagaggtgtgcaatggtgt

SEQ ID NO: 8280797 - DNA, 22 bp, Homo sapiens
aggaagatgggagagctctgga

SEQ ID NO: 8280798 - DNA, 22 bp, Homo sapiens
cagggtgctgcaccatccctca

SEQ ID NO: 8280799 - DNA, 22 bp, Homo sapiens
cagggttcagtgggccctcttg

SEQ ID NO: 8280800 - DNA, 22 bp, Homo sapiens
cagggtggtgaatagctatagt

SEQ ID NO: 8280801 - DNA, 22 bp, Homo sapiens
cagggtggtaccagcatctagt

SEQ ID NO: 8280802 - DNA, 22 bp, Homo sapiens
aggaaaagtgtgaagtatggag

SEQ ID NO: 8280803 - DNA, 22 bp, Homo sapiens
aggaaaagtgtgaagtatggag

SEQ ID NO: 8280804 - DNA, 22 bp, Homo sapiens
agctttattcatgatttcaggg

SEQ ID NO: 8280805 - DNA, 22 bp, Homo sapiens
agcttctgcccgtgtttgctct

SEQ ID NO: 8280806 - DNA, 17 bp, Homo sapiens
agcttctgccctttctt

SEQ ID NO: 8280807 - DNA, 22 bp, Homo sapiens
agcttctgaaagtctgttttcc

SEQ ID NO: 8280808 - DNA, 20 bp, Homo sapiens
agcttctgctgcctttcggc

SEQ ID NO: 8280809 - DNA, 21 bp, Homo sapiens
caggcttgaggaatgtgcctg

SEQ ID NO: 8280810 - DNA, 22 bp, Homo sapiens
caggctgtctgctgaggaaagg

SEQ ID NO: 8280811 - DNA, 20 bp, Homo sapiens
aggagggtttctctgacaca

SEQ ID NO: 8280812 - DNA, 22 bp, Homo sapiens
aggagggttgaggaggatactt

SEQ ID NO: 8280813 - DNA, 22 bp, Homo sapiens
aggagggtggcctcatgtgagt

SEQ ID NO: 8280814 - DNA, 22 bp, Homo sapiens
aggagggtggggtctgcctgtc

SEQ ID NO: 8280815 - DNA, 22 bp, Homo sapiens
aggagggtggcctcatgtgagt

SEQ ID NO: 8280816 - DNA, 22 bp, Homo sapiens
aggaggggcaatgatagtctgg

SEQ ID NO: 8280817 - DNA, 22 bp, Homo sapiens
catcactgacgctgagattcca

SEQ ID NO: 8280818 - DNA, 22 bp, Homo sapiens
catcactgaaccccaactttct

SEQ ID NO: 8280819 - DNA, 22 bp, Homo sapiens
catcactgcttctaaaatggtg

SEQ ID NO: 8280820 - DNA, 22 bp, Homo sapiens
catcactgcttctaaaatggtg

SEQ ID NO: 8280821 - DNA, 22 bp, Homo sapiens
catcactggcatcatgggaggg

SEQ ID NO: 8280822 - DNA, 22 bp, Homo sapiens
catcactgtcaccatctttcct

SEQ ID NO: 8280823 - DNA, 22 bp, Homo sapiens
catcactggctgctgacagatg

SEQ ID NO: 8280824 - DNA, 22 bp, Homo sapiens
catcactggcatcatgggaggg

SEQ ID NO: 8280825 - DNA, 22 bp, Homo sapiens
catcactgtccaaagttcagtt

SEQ ID NO: 8280826 - DNA, 22 bp, Homo sapiens
catcactgtcctcagcattcca

SEQ ID NO: 8280827 - DNA, 22 bp, Homo sapiens
catcactgtcctcagcattcca

SEQ ID NO: 8280828 - DNA, 22 bp, Homo sapiens
catcagaattacttggggagct

SEQ ID NO: 8280829 - DNA, 22 bp, Homo sapiens
catcagaatgttagagaaggga

SEQ ID NO: 8280830 - DNA, 19 bp, Homo sapiens
catatttttgggctggcat

SEQ ID NO: 8280831 - DNA, 22 bp, Homo sapiens
catcactgaaccccaactttct

SEQ ID NO: 8280832 - DNA, 22 bp, Homo sapiens
cagttataggagccattgtata

SEQ ID NO: 8280833 - DNA, 22 bp, Homo sapiens
aggaattcctgggaaggcacag

SEQ ID NO: 8280834 - DNA, 22 bp, Homo sapiens
aggaattcaagaccagctgggc

SEQ ID NO: 8280835 - DNA, 22 bp, Homo sapiens
cagtgaggagtccagggcagag

SEQ ID NO: 8280836 - DNA, 18 bp, Homo sapiens
cagtgaggatgaagggtt

SEQ ID NO: 8280837 - DNA, 22 bp, Homo sapiens
cagtgcaggctgggggccctgc

SEQ ID NO: 8280838 - DNA, 22 bp, Homo sapiens
cagtgagggcattcagtgctgg

SEQ ID NO: 8280839 - DNA, 22 bp, Homo sapiens
aggagctgggctgctgctggga

SEQ ID NO: 8280840 - DNA, 22 bp, Homo sapiens
aggagccaaattttagactctg

SEQ ID NO: 8280841 - DNA, 22 bp, Homo sapiens
cagtgcttttcaaagttctatg

SEQ ID NO: 8280842 - DNA, 22 bp, Homo sapiens
aggagcagcttctgaaccatgt

SEQ ID NO: 8280843 - DNA, 22 bp, Homo sapiens
aggagcagcccactcctgtcct

SEQ ID NO: 8280844 - DNA, 22 bp, Homo sapiens
aggagcagaccgtagtcctgca

SEQ ID NO: 8280845 - DNA, 22 bp, Homo sapiens
aggagcagattggtaagatcat

SEQ ID NO: 8280846 - DNA, 22 bp, Homo sapiens
aggatcttcattgtgctgcaaa

SEQ ID NO: 8280847 - DNA, 22 bp, Homo sapiens
aggcacaggtggacttcacagt

SEQ ID NO: 8280848 - DNA, 22 bp, Homo sapiens
aggagtgttgagttgggttttg

SEQ ID NO: 8280849 - DNA, 22 bp, Homo sapiens
aggagtgttgcttcagggaagc

SEQ ID NO: 8280850 - DNA, 22 bp, Homo sapiens
aggatcaggccctctagggtag

SEQ ID NO: 8280851 - DNA, 20 bp, Homo sapiens
aggatagcatgcaagtgaga

SEQ ID NO: 8280852 - DNA, 22 bp, Homo sapiens
aggatcagtgaatactcagggt

SEQ ID NO: 8280853 - DNA, 19 bp, Homo sapiens
aggcacaggttgtctggac

SEQ ID NO: 8280854 - DNA, 22 bp, Homo sapiens
aggcacagtgcctggaatcaaa

SEQ ID NO: 8280855 - DNA, 22 bp, Homo sapiens
aggcacagtggctcacacctgt

SEQ ID NO: 8280856 - DNA, 22 bp, Homo sapiens
ccaaaatattagtgcttaagta

SEQ ID NO: 8280857 - DNA, 22 bp, Homo sapiens
ccaaaatgtttgaatgcatgtg

SEQ ID NO: 8280858 - DNA, 22 bp, Homo sapiens
ccaaaattattacatttgtagg

SEQ ID NO: 8280859 - DNA, 22 bp, Homo sapiens
aggcaggctcaggcccatgctt

SEQ ID NO: 8280860 - DNA, 22 bp, Homo sapiens
aggcagcttaagccctggccca

SEQ ID NO: 8280861 - DNA, 23 bp, Homo sapiens
ccaaaagcgagtctgttgttccc

SEQ ID NO: 8280862 - DNA, 22 bp, Homo sapiens
aggcaggaaaatcgcttgaacc

SEQ ID NO: 8280863 - DNA, 22 bp, Homo sapiens
aggcagctttcagtgtctctca

SEQ ID NO: 8280864 - DNA, 22 bp, Homo sapiens
atcagcaggcatattaactgaa

SEQ ID NO: 8280865 - DNA, 22 bp, Homo sapiens
atcagcaggcatattaactgaa

SEQ ID NO: 8280866 - DNA, 22 bp, Homo sapiens
atcagcagctaaggaactaaca

SEQ ID NO: 8280867 - DNA, 22 bp, Homo sapiens
atcagcagatgctcaatgaaca

SEQ ID NO: 8280868 - DNA, 22 bp, Homo sapiens
atcagcagatgctcaatgaaca

SEQ ID NO: 8280869 - DNA, 22 bp, Homo sapiens
atcagcagatgctcaatgaaca

SEQ ID NO: 8280870 - DNA, 22 bp, Homo sapiens
ctgtaatcccagctacctggga

SEQ ID NO: 8280871 - DNA, 22 bp, Homo sapiens
ctgtaatcccagctactcggga

SEQ ID NO: 8280872 - DNA, 22 bp, Homo sapiens
atcacaaagggttttctctgag

SEQ ID NO: 8280873 - DNA, 22 bp, Homo sapiens
atcataattgctccagtgatat

SEQ ID NO: 8280874 - DNA, 22 bp, Homo sapiens
atcataaaccactttgtaatct

SEQ ID NO: 8280875 - DNA, 22 bp, Homo sapiens
atcataaagtgctatctgattg

SEQ ID NO: 8280876 - DNA, 22 bp, Homo sapiens
atcagtttctgtgaagaacaca

SEQ ID NO: 8280877 - DNA, 22 bp, Homo sapiens
atcagttttgggggacatactg

SEQ ID NO: 8280878 - DNA, 22 bp, Homo sapiens
atcagtttgtatatgaaacact

SEQ ID NO: 8280879 - DNA, 22 bp, Homo sapiens
ctgtctctgataagctcgaggg

SEQ ID NO: 8280880 - DNA, 22 bp, Homo sapiens
atcaggtagatttaatattctg

SEQ ID NO: 8280881 - DNA, 22 bp, Homo sapiens
ctgtctcctccactgcatggga

SEQ ID NO: 8280882 - DNA, 22 bp, Homo sapiens
atcagcttggaccaataagatg

SEQ ID NO: 8280883 - DNA, 21 bp, Homo sapiens
ctgtctacatatatacacaca

SEQ ID NO: 8280884 - DNA, 23 bp, Homo sapiens
ctgtccttggtcttggctgagtg

SEQ ID NO: 8280885 - DNA, 22 bp, Homo sapiens
ctggtccattctctccctgaag

SEQ ID NO: 8280886 - DNA, 22 bp, Homo sapiens
ctggtccctggacctccctgga

SEQ ID NO: 8280887 - DNA, 22 bp, Homo sapiens
ctggggctgtaggaggacttat

SEQ ID NO: 8280888 - DNA, 22 bp, Homo sapiens
ctggggcatgggcccctagagg

SEQ ID NO: 8280889 - DNA, 22 bp, Homo sapiens
ctggggcttcaatgcttcggtg

SEQ ID NO: 8280890 - DNA, 22 bp, Homo sapiens
atctgtgtgttattgtttatca

SEQ ID NO: 8280891 - DNA, 23 bp, Homo sapiens
atctgtgtgtgggtagggatgat

SEQ ID NO: 8280892 - DNA, 22 bp, Homo sapiens
cttcttaaatatttggctgact

SEQ ID NO: 8280893 - DNA, 22 bp, Homo sapiens
cttcttaaattggattgctatt

SEQ ID NO: 8280894 - DNA, 22 bp, Homo sapiens
cttcttaatgacagattaaaat

SEQ ID NO: 8280895 - DNA, 22 bp, Homo sapiens
atctggctcacttagtctagga

SEQ ID NO: 8280896 - DNA, 22 bp, Homo sapiens
atctgtaacatcagtagcagaa

SEQ ID NO: 8280897 - DNA, 22 bp, Homo sapiens
cttctgatctggattcctaact

SEQ ID NO: 8280898 - DNA, 22 bp, Homo sapiens
cttctgcaggccttattttagt

SEQ ID NO: 8280899 - DNA, 19 bp, Homo sapiens
cttctgatggaaagccaac

SEQ ID NO: 8280900 - DNA, 22 bp, Homo sapiens
cttctgcactgaccttttgtcc

SEQ ID NO: 8280901 - DNA, 19 bp, Homo sapiens
atctcctttcttcaagctt

SEQ ID NO: 8280902 - DNA, 22 bp, Homo sapiens
atctctccttcagctgaggccc

SEQ ID NO: 8280903 - DNA, 22 bp, Homo sapiens
atctctaatttaaaaagtaaca

SEQ ID NO: 8280904 - DNA, 22 bp, Homo sapiens
cttctccttatatgtcccgttc

SEQ ID NO: 8280905 - DNA, 22 bp, Homo sapiens
cttcaagatccatagatattgc

SEQ ID NO: 8280906 - DNA, 22 bp, Homo sapiens
cttcctctatgttcaggtagaa

SEQ ID NO: 8280907 - DNA, 22 bp, Homo sapiens
cttcctctcttgcccataagag

SEQ ID NO: 8280908 - DNA, 22 bp, Homo sapiens
cttcaactttgtaagtagaatt

SEQ ID NO: 8280909 - DNA, 22 bp, Homo sapiens
cttatgatcctaaattgcaggt

SEQ ID NO: 8280910 - DNA, 22 bp, Homo sapiens
cttaatgaaaggttgcacatgg

SEQ ID NO: 8280911 - DNA, 22 bp, Homo sapiens
cttaataataggtgaggctatg

SEQ ID NO: 8280912 - DNA, 22 bp, Homo sapiens
cttaagacaggctcaaagatta

SEQ ID NO: 8280913 - DNA, 22 bp, Homo sapiens
cttaagaaattgcattctaatc

SEQ ID NO: 8280914 - DNA, 22 bp, Homo sapiens
cttaagcaaaatattctttcac

SEQ ID NO: 8280915 - DNA, 22 bp, Homo sapiens
atcatcagggacatttctgtgc

SEQ ID NO: 8280916 - DNA, 22 bp, Homo sapiens
ctgggagaggaacctcgagggt

SEQ ID NO: 8280917 - DNA, 22 bp, Homo sapiens
ctgggagctggaatgggagaag

SEQ ID NO: 8280918 - DNA, 22 bp, Homo sapiens
atatacactccactgatacagg

SEQ ID NO: 8280919 - DNA, 22 bp, Homo sapiens
atatacactgtttcagttgaag

SEQ ID NO: 8280920 - DNA, 22 bp, Homo sapiens
atatacacatttgcttatgtgt

SEQ ID NO: 8280921 - DNA, 22 bp, Homo sapiens
ctggctgattttctcacttctc

SEQ ID NO: 8280922 - DNA, 22 bp, Homo sapiens
atagtggggacaggatggttgg

SEQ ID NO: 8280923 - DNA, 22 bp, Homo sapiens
ctggctaattgtcagttgttac

SEQ ID NO: 8280924 - DNA, 22 bp, Homo sapiens
ctggcctgtgggctgtctccgg

SEQ ID NO: 8280925 - DNA, 22 bp, Homo sapiens
atataaagagcttagtatagtg

SEQ ID NO: 8280926 - DNA, 23 bp, Homo sapiens
atataaacaccagatagattgta

SEQ ID NO: 8280927 - DNA, 22 bp, Homo sapiens
ctggcaggtggatggggactcc

SEQ ID NO: 8280928 - DNA, 20 bp, Homo sapiens
atacacattcatagaaaaat

SEQ ID NO: 8280929 - DNA, 22 bp, Homo sapiens
agttctcacttcagagctgccc

SEQ ID NO: 8280930 - DNA, 22 bp, Homo sapiens
agttctaaacacttgaggaacc

SEQ ID NO: 8280931 - DNA, 22 bp, Homo sapiens
agttttgggaatatgtaattat

SEQ ID NO: 8280932 - DNA, 17 bp, Homo sapiens
agttttgatataatggc

SEQ ID NO: 8280933 - DNA, 22 bp, Homo sapiens
ataaagcaatagattgtgtaat

SEQ ID NO: 8280934 - DNA, 22 bp, Homo sapiens
ataaagcaaataggactattgc

SEQ ID NO: 8280935 - DNA, 22 bp, Homo sapiens
ctgcaggcttccagggctgtgg

SEQ ID NO: 8280936 - DNA, 22 bp, Homo sapiens
ctgcagggaactgaggcccaga

SEQ ID NO: 8280937 - DNA, 22 bp, Homo sapiens
ctgcagggaccacaagcaggtt

SEQ ID NO: 8280938 - DNA, 22 bp, Homo sapiens
ctgcctggaaggagcaagggga

SEQ ID NO: 8280939 - DNA, 22 bp, Homo sapiens
ctgcctggtctcaggcatgggg

SEQ ID NO: 8280940 - DNA, 22 bp, Homo sapiens
ctgcctgtattgtctgcttggg

SEQ ID NO: 8280941 - DNA, 22 bp, Homo sapiens
ctgctaattttgtgcaagtctg

SEQ ID NO: 8280942 - DNA, 22 bp, Homo sapiens
ctgctgcccagtgtgcattggg

SEQ ID NO: 8280943 - DNA, 22 bp, Homo sapiens
ctgctagcccaggatgcaggga

SEQ ID NO: 8280944 - DNA, 19 bp, Homo sapiens
ctgctcaggtcagtctgtc

SEQ ID NO: 8280945 - DNA, 22 bp, Homo sapiens
atacacatctatttaagagaca

SEQ ID NO: 8280946 - DNA, 22 bp, Homo sapiens
atacacatgcacacatgtgtgt

SEQ ID NO: 8280947 - DNA, 22 bp, Homo sapiens
aggtggcaaggggcgcctctct

SEQ ID NO: 8280948 - DNA, 22 bp, Homo sapiens
cctgtgggccaaggacctgcca

SEQ ID NO: 8280949 - DNA, 22 bp, Homo sapiens
cctggggctctgcacagagcag

SEQ ID NO: 8280950 - DNA, 22 bp, Homo sapiens
cctgggtcactcaggcaggcgg

SEQ ID NO: 8280951 - DNA, 21 bp, Homo sapiens
aggtgcagaggcctcactcac

SEQ ID NO: 8280952 - DNA, 21 bp, Homo sapiens
cctgtgccagtctatgtgttc

SEQ ID NO: 8280953 - DNA, 22 bp, Homo sapiens
aggtcacatggataatgatcag

SEQ ID NO: 8280954 - DNA, 22 bp, Homo sapiens
aggtcagctgtgtgtgcatgag

SEQ ID NO: 8280955 - DNA, 22 bp, Homo sapiens
aggtcagctgcactggtgtaat

SEQ ID NO: 8280956 - DNA, 22 bp, Homo sapiens
aggtcagctgctgataggcagc

SEQ ID NO: 8280957 - DNA, 23 bp, Homo sapiens
aggtcagcaggcaaggaaatggc

SEQ ID NO: 8280958 - DNA, 22 bp, Homo sapiens
aggtcagctagacagctctctg

SEQ ID NO: 8280959 - DNA, 21 bp, Homo sapiens
aggtcagcccagctctggaag

SEQ ID NO: 8280960 - DNA, 22 bp, Homo sapiens
aggtcagcatgctcctctctgt

SEQ ID NO: 8280961 - DNA, 21 bp, Homo sapiens
aggtcagcccagctctggaag

SEQ ID NO: 8280962 - DNA, 19 bp, Homo sapiens
cctgaggtggggtggaagg

SEQ ID NO: 8280963 - DNA, 18 bp, Homo sapiens
cctgaggtgggaggaagg

SEQ ID NO: 8280964 - DNA, 22 bp, Homo sapiens
cctgaggtctagagtcagggtg

SEQ ID NO: 8280965 - DNA, 23 bp, Homo sapiens
agggtggcttgctttgcttcctt

SEQ ID NO: 8280966 - DNA, 22 bp, Homo sapiens
agggtgggctagactcttcccc

SEQ ID NO: 8280967 - DNA, 22 bp, Homo sapiens
aggtacagatgaaagtctagtt

SEQ ID NO: 8280968 - DNA, 22 bp, Homo sapiens
aggtcacacttggatcatagaa

SEQ ID NO: 8280969 - DNA, 22 bp, Homo sapiens
aggtaaggaaattgaggcaatt

SEQ ID NO: 8280970 - DNA, 22 bp, Homo sapiens
ctagctttgtccattgtcttgc

SEQ ID NO: 8280971 - DNA, 22 bp, Homo sapiens
ctagctgacgggttgataggtg

SEQ ID NO: 8280972 - DNA, 22 bp, Homo sapiens
ctagacacagtttttgctccca

SEQ ID NO: 8280973 - DNA, 22 bp, Homo sapiens
ctagacacagtttttgctccca

SEQ ID NO: 8280974 - DNA, 20 bp, Homo sapiens
agtcacattgagcttttgga

SEQ ID NO: 8280975 - DNA, 22 bp, Homo sapiens
agtcacatagctctggtttctt

SEQ ID NO: 8280976 - DNA, 22 bp, Homo sapiens
agtcacatagaagtgggtttaa

SEQ ID NO: 8280977 - DNA, 22 bp, Homo sapiens
agtcacatagtgttttggaatc

SEQ ID NO: 8280978 - DNA, 22 bp, Homo sapiens
agtcacatgcattttcttcaat

SEQ ID NO: 8280979 - DNA, 20 bp, Homo sapiens
agtcacatgcatacacaagt

SEQ ID NO: 8280980 - DNA, 22 bp, Homo sapiens
agtcacatgagtttctctttat

SEQ ID NO: 8280981 - DNA, 22 bp, Homo sapiens
ctattctaagctcagaatccca

SEQ ID NO: 8280982 - DNA, 22 bp, Homo sapiens
ctattctagattacagtataaa

SEQ ID NO: 8280983 - DNA, 22 bp, Homo sapiens
ctattctagtctgtcatgtcca

SEQ ID NO: 8280984 - DNA, 21 bp, Homo sapiens
ctattggaaaagaaaatattt

SEQ ID NO: 8280985 - DNA, 22 bp, Homo sapiens
ctatttacgctgctggggatca

SEQ ID NO: 8280986 - DNA, 22 bp, Homo sapiens
agtcctgggtctggagaatgga

SEQ ID NO: 8280987 - DNA, 22 bp, Homo sapiens
ctatatttcttggctttaaaca

SEQ ID NO: 8280988 - DNA, 22 bp, Homo sapiens
agtcagctggatactcttgtag

SEQ ID NO: 8280989 - DNA, 22 bp, Homo sapiens
ccttctcctgccttgggttcat

SEQ ID NO: 8280990 - DNA, 22 bp, Homo sapiens
agtagcttggccctttgttctt

SEQ ID NO: 8280991 - DNA, 22 bp, Homo sapiens
agtagacatgagcaatgataat

SEQ ID NO: 8280992 - DNA, 22 bp, Homo sapiens
agtacagttataagtggtcttg

SEQ ID NO: 8280993 - DNA, 22 bp, Homo sapiens
agtgaaaagatgcatttctctg

SEQ ID NO: 8280994 - DNA, 22 bp, Homo sapiens
agtgaaatcaggttttgactgc

SEQ ID NO: 8280995 - DNA, 22 bp, Homo sapiens
agtgagtggaccctgcaaggaa

SEQ ID NO: 8280996 - DNA, 22 bp, Homo sapiens
agtgagtggatgtaggaattgg

SEQ ID NO: 8280997 - DNA, 22 bp, Homo sapiens
agtgaggggattcaggcaaggt

SEQ ID NO: 8280998 - DNA, 22 bp, Homo sapiens
agtgagtgggttacagatggga

SEQ ID NO: 8280999 - DNA, 20 bp, Homo sapiens
ctcacagtcaatgcagaggt

SEQ ID NO: 8281000 - DNA, 22 bp, Homo sapiens
ctcacagtctctccctaatttt

SEQ ID NO: 8281001 - DNA, 19 bp, Homo sapiens
agtctttgcctggggcctt

SEQ ID NO: 8281002 - DNA, 22 bp, Homo sapiens
ctcacatgagatctgtacatcc

SEQ ID NO: 8281003 - DNA, 22 bp, Homo sapiens
ctcacagtgtaatattgaaccc

SEQ ID NO: 8281004 - DNA, 22 bp, Homo sapiens
ctcacagttggctcattaatga

SEQ ID NO: 8281005 - DNA, 22 bp, Homo sapiens
agtggccagcagcctagcctag

SEQ ID NO: 8281006 - DNA, 20 bp, Homo sapiens
agtggccactgcagagatgc

SEQ ID NO: 8281007 - DNA, 22 bp, Homo sapiens
agtggccactagaagctcagct

SEQ ID NO: 8281008 - DNA, 22 bp, Homo sapiens
agtggccaatatgtcatgctct

SEQ ID NO: 8281009 - DNA, 22 bp, Homo sapiens
agtggccaccatgccagctctc

SEQ ID NO: 8281010 - DNA, 22 bp, Homo sapiens
agtggaatgtagaaaaaagatg

SEQ ID NO: 8281011 - DNA, 22 bp, Homo sapiens
agtgcttttgtcattgaatctt

SEQ ID NO: 8281012 - DNA, 22 bp, Homo sapiens
agtgccagctccacacagcagc

SEQ ID NO: 8281013 - DNA, 22 bp, Homo sapiens
agtgattctttaaagtggtatt

SEQ ID NO: 8281014 - DNA, 22 bp, Homo sapiens
agtgcccacctctcttcagcta

SEQ ID NO: 8281015 - DNA, 22 bp, Homo sapiens
agttaaatgtcagtagcttaac

SEQ ID NO: 8281016 - DNA, 22 bp, Homo sapiens
agtgtgcatttgcagaagaccc

SEQ ID NO: 8281017 - DNA, 22 bp, Homo sapiens
agtgtgagtaattcagggaggg

SEQ ID NO: 8281018 - DNA, 20 bp, Homo sapiens
agttccacatggctggggag

SEQ ID NO: 8281019 - DNA, 22 bp, Homo sapiens
agttcatattgaaagcaggtga

SEQ ID NO: 8281020 - DNA, 22 bp, Homo sapiens
ctgagctgcagtcctggctctg

SEQ ID NO: 8281021 - DNA, 20 bp, Homo sapiens
ctgagctgagctccatgggt

SEQ ID NO: 8281022 - DNA, 22 bp, Homo sapiens
ctgagctgagccaaatctgtct

SEQ ID NO: 8281023 - DNA, 22 bp, Homo sapiens
ctgagccagctggcatgtgcta

SEQ ID NO: 8281024 - DNA, 22 bp, Homo sapiens
ctgagctaggagttaggaagct

SEQ ID NO: 8281025 - DNA, 22 bp, Homo sapiens
agttaacacatccagaatagag

SEQ ID NO: 8281026 - DNA, 22 bp, Homo sapiens
ctgagccaccggcagggacatc

SEQ ID NO: 8281027 - DNA, 22 bp, Homo sapiens
agtggcctggagccccgcctgg

SEQ ID NO: 8281028 - DNA, 22 bp, Homo sapiens
agtggctaataacagctaaaca

SEQ ID NO: 8281029 - DNA, 22 bp, Homo sapiens
agtggccagtgctgctctgggg

SEQ ID NO: 8281030 - DNA, 22 bp, Homo sapiens
agtggccatccctcaggtaggc

SEQ ID NO: 8281031 - DNA, 22 bp, Homo sapiens
agtggccaggaaaggtccagcc

SEQ ID NO: 8281032 - DNA, 22 bp, Homo sapiens
agtggggagtttccagatgtgt

SEQ ID NO: 8281033 - DNA, 22 bp, Homo sapiens
agtggctcttgggtcactgggc

SEQ ID NO: 8281034 - DNA, 22 bp, Homo sapiens
agtgggtactgggcaggcagag

SEQ ID NO: 8281035 - DNA, 22 bp, Homo sapiens
agtgggtactgggcaggcagag

SEQ ID NO: 8281036 - DNA, 22 bp, Homo sapiens
agtgggtaggcctctggtgcct

SEQ ID NO: 8281037 - DNA, 19 bp, Homo sapiens
agtgggtaatagaggctcc

SEQ ID NO: 8281038 - DNA, 22 bp, Homo sapiens
agtgggtaggcctctggtgcct

SEQ ID NO: 8281039 - DNA, 22 bp, Homo sapiens
agtgggtcagagagctccagat

SEQ ID NO: 8281040 - DNA, 22 bp, Homo sapiens
agtggtagagtcaaggttgtaa

SEQ ID NO: 8281041 - DNA, 22 bp, Homo sapiens
agtgtcatcgtgaaaacatagc

SEQ ID NO: 8281042 - DNA, 22 bp, Homo sapiens
agtgtcatttccacgacattca

SEQ ID NO: 8281043 - DNA, 18 bp, Homo sapiens
agtgtcagctgcagctca

SEQ ID NO: 8281044 - DNA, 22 bp, Homo sapiens
agtgtattcagaatgtagcaaa

SEQ ID NO: 8281045 - DNA, 22 bp, Homo sapiens
agtgtatttgagcatctcctta

SEQ ID NO: 8281046 - DNA, 22 bp, Homo sapiens
agtgtctttctctctccaagtg

SEQ ID NO: 8281047 - DNA, 22 bp, Homo sapiens
agtgtgagctaatagcagagcc

SEQ ID NO: 8281048 - DNA, 22 bp, Homo sapiens
agtgtgagtaattcagggaggg

SEQ ID NO: 8281049 - DNA, 22 bp, Homo sapiens
agaaggagtgtacaggtcatgc

SEQ ID NO: 8281050 - DNA, 19 bp, Homo sapiens
agaagctgtgaaatgaagg

SEQ ID NO: 8281051 - DNA, 22 bp, Homo sapiens
agaaggagtgtacaggtcatgc

SEQ ID NO: 8281052 - DNA, 22 bp, Homo sapiens
agaaggcagatgggacggagca

SEQ ID NO: 8281053 - DNA, 22 bp, Homo sapiens
atcccagagaataatgatcagg

SEQ ID NO: 8281054 - DNA, 22 bp, Homo sapiens
atcccagatagtgaccctcagg

SEQ ID NO: 8281055 - DNA, 22 bp, Homo sapiens
atcccagatggaggctggtcac

SEQ ID NO: 8281056 - DNA, 22 bp, Homo sapiens
agaacagtcgtggtgagagaaa

SEQ ID NO: 8281057 - DNA, 22 bp, Homo sapiens
atccccagaaagaccgatgtac

SEQ ID NO: 8281058 - DNA, 23 bp, Homo sapiens
agaacagtgactaatatagagag

SEQ ID NO: 8281059 - DNA, 20 bp, Homo sapiens
agaacctaagttaaaacaca

SEQ ID NO: 8281060 - DNA, 22 bp, Homo sapiens
agaaccattttgacagatatac

SEQ ID NO: 8281061 - DNA, 22 bp, Homo sapiens
agaaatcattcccaaacccata

SEQ ID NO: 8281062 - DNA, 18 bp, Homo sapiens
atcagtcctgggagggta

SEQ ID NO: 8281063 - DNA, 22 bp, Homo sapiens
atcagtccaccatactcatctt

SEQ ID NO: 8281064 - DNA, 22 bp, Homo sapiens
atcagtccacttgatgaaatcg

SEQ ID NO: 8281065 - DNA, 22 bp, Homo sapiens
atcagtatattccttggtcttt

SEQ ID NO: 8281066 - DNA, 21 bp, Homo sapiens
agaaaaacacgatataagccc

SEQ ID NO: 8281067 - DNA, 21 bp, Homo sapiens
agaaaaacacgatataagccc

SEQ ID NO: 8281068 - DNA, 22 bp, Homo sapiens
atattttggtagctctcaatga

SEQ ID NO: 8281069 - DNA, 22 bp, Homo sapiens
atattttgtaacttggaatagg

SEQ ID NO: 8281070 - DNA, 22 bp, Homo sapiens
atattttggggtgatgtgcatc

SEQ ID NO: 8281071 - DNA, 22 bp, Homo sapiens
atagatacttataacaattgtg

SEQ ID NO: 8281072 - DNA, 22 bp, Homo sapiens
atagatactgggtatggagatg

SEQ ID NO: 8281073 - DNA, 23 bp, Homo sapiens
acttttcaattagctatgcttaa

SEQ ID NO: 8281074 - DNA, 23 bp, Homo sapiens
acttttcaattagctatgcttaa

SEQ ID NO: 8281075 - DNA, 22 bp, Homo sapiens
atagatcaatgagcaatttaat

SEQ ID NO: 8281076 - DNA, 22 bp, Homo sapiens
actttgttcctttcacaaagaa

SEQ ID NO: 8281077 - DNA, 22 bp, Homo sapiens
actttggatctgatgtaatcag

SEQ ID NO: 8281078 - DNA, 22 bp, Homo sapiens
actttctgtcatctagacaagt

SEQ ID NO: 8281079 - DNA, 22 bp, Homo sapiens
actttgcaatacttaatacaaa

SEQ ID NO: 8281080 - DNA, 22 bp, Homo sapiens
actttgcaaggtactaactgta

SEQ ID NO: 8281081 - DNA, 22 bp, Homo sapiens
actttgcaaataaactctctaa

SEQ ID NO: 8281082 - DNA, 22 bp, Homo sapiens
actttgcaatgggcagaaccca

SEQ ID NO: 8281083 - DNA, 22 bp, Homo sapiens
actttgcactaagttactcatt

SEQ ID NO: 8281084 - DNA, 22 bp, Homo sapiens
actttgcacttcaatataactt

SEQ ID NO: 8281085 - DNA, 22 bp, Homo sapiens
atacatcatgctccatatattt

SEQ ID NO: 8281086 - DNA, 22 bp, Homo sapiens
atacatcatgctccatatattt

SEQ ID NO: 8281087 - DNA, 22 bp, Homo sapiens
atacatcatttatgatgtgtgt

SEQ ID NO: 8281088 - DNA, 22 bp, Homo sapiens
atacatcatttcccatcaatcg

SEQ ID NO: 8281089 - DNA, 20 bp, Homo sapiens
actttgcatttcctgatttt

SEQ ID NO: 8281090 - DNA, 23 bp, Homo sapiens
actttgcatacccaaattgtttt

SEQ ID NO: 8281091 - DNA, 21 bp, Homo sapiens
actttgcatctaccttgggtt

SEQ ID NO: 8281092 - DNA, 22 bp, Homo sapiens
actttgcatggaaaatggtcat

SEQ ID NO: 8281093 - DNA, 22 bp, Homo sapiens
actttgcaggccttttcttgtg

SEQ ID NO: 8281094 - DNA, 19 bp, Homo sapiens
actttgcatgtgtgtctaa

SEQ ID NO: 8281095 - DNA, 22 bp, Homo sapiens
actttgcagggcttgatatcca

SEQ ID NO: 8281096 - DNA, 22 bp, Homo sapiens
actttgcaggtacatgagcatc

SEQ ID NO: 8281097 - DNA, 18 bp, Homo sapiens
actttgcaggctcccatt

SEQ ID NO: 8281098 - DNA, 22 bp, Homo sapiens
actttgcagctgaggacatttc

SEQ ID NO: 8281099 - DNA, 23 bp, Homo sapiens
actttgcagagccccttgaaaca

SEQ ID NO: 8281100 - DNA, 22 bp, Homo sapiens
actttgcagagccagaagagaa

SEQ ID NO: 8281101 - DNA, 21 bp, Homo sapiens
actttaatatacatgaggagg

SEQ ID NO: 8281102 - DNA, 21 bp, Homo sapiens
actttaatatacatgaggagg

SEQ ID NO: 8281103 - DNA, 21 bp, Homo sapiens
actttacaatttacatagtga

SEQ ID NO: 8281104 - DNA, 22 bp, Homo sapiens
atacaaaatatatactggagac

SEQ ID NO: 8281105 - DNA, 22 bp, Homo sapiens
atacaaaatatatactggagac

SEQ ID NO: 8281106 - DNA, 22 bp, Homo sapiens
atacaaaatatatactggagac

SEQ ID NO: 8281107 - DNA, 22 bp, Homo sapiens
acttctctcattcagacatagc

SEQ ID NO: 8281108 - DNA, 22 bp, Homo sapiens
atacaaaaattagccgggagta

SEQ ID NO: 8281109 - DNA, 22 bp, Homo sapiens
acttcctgtaaatagaattcca

SEQ ID NO: 8281110 - DNA, 22 bp, Homo sapiens
acttcctgtatttatccatagc

SEQ ID NO: 8281111 - DNA, 22 bp, Homo sapiens
acttaaaaagaatcttttcacg

SEQ ID NO: 8281112 - DNA, 22 bp, Homo sapiens
acttaaaaccagacagcgtcat

SEQ ID NO: 8281113 - DNA, 22 bp, Homo sapiens
actgttttctgtaaagggccag

SEQ ID NO: 8281114 - DNA, 22 bp, Homo sapiens
acttaaaaacagatccagcagg

SEQ ID NO: 8281115 - DNA, 22 bp, Homo sapiens
actgttttctgtaaagggccag

SEQ ID NO: 8281116 - DNA, 21 bp, Homo sapiens
actgttattcccattttcacc

SEQ ID NO: 8281117 - DNA, 22 bp, Homo sapiens
ataaaaactgacccatcctttg

SEQ ID NO: 8281118 - DNA, 22 bp, Homo sapiens
agtttttgagaatttactatgt

SEQ ID NO: 8281119 - DNA, 22 bp, Homo sapiens
agttttataaaggcacctcagt

SEQ ID NO: 8281120 - DNA, 22 bp, Homo sapiens
aggtgggcggattcatgaggtc

SEQ ID NO: 8281121 - DNA, 21 bp, Homo sapiens
aggtgggcaggtggagtggcc

SEQ ID NO: 8281122 - DNA, 22 bp, Homo sapiens
aggtgggcatagctagaatatt

SEQ ID NO: 8281123 - DNA, 22 bp, Homo sapiens
aggtgggcccagtgggctccag

SEQ ID NO: 8281124 - DNA, 22 bp, Homo sapiens
aggtgggcggatcacaaggtca

SEQ ID NO: 8281125 - DNA, 22 bp, Homo sapiens
agtacttttttgatatctgagt

SEQ ID NO: 8281126 - DNA, 21 bp, Homo sapiens
agtagtttagcacagggtttg

SEQ ID NO: 8281127 - DNA, 21 bp, Homo sapiens
agtagtttagcacagggtttg

SEQ ID NO: 8281128 - DNA, 22 bp, Homo sapiens
actccagggtgactctgtctga

SEQ ID NO: 8281129 - DNA, 22 bp, Homo sapiens
actccctccaaatctgcacagt

SEQ ID NO: 8281130 - DNA, 22 bp, Homo sapiens
actccctctctagtccttgcaa

SEQ ID NO: 8281131 - DNA, 22 bp, Homo sapiens
actctccttttgatcttcagaa

SEQ ID NO: 8281132 - DNA, 22 bp, Homo sapiens
actctcccttggagcctcaggc

SEQ ID NO: 8281133 - DNA, 22 bp, Homo sapiens
agtcactgtttaatctagctaa

SEQ ID NO: 8281134 - DNA, 22 bp, Homo sapiens
agtcacttccagctgtgtttca

SEQ ID NO: 8281135 - DNA, 22 bp, Homo sapiens
aggtatttgttatttgagagtg

SEQ ID NO: 8281136 - DNA, 22 bp, Homo sapiens
acccttctgtgacctgcctgtc

SEQ ID NO: 8281137 - DNA, 22 bp, Homo sapiens
aggtaggaaagtctccttgtat

SEQ ID NO: 8281138 - DNA, 22 bp, Homo sapiens
aggtagctggtgctgggctcct

SEQ ID NO: 8281139 - DNA, 22 bp, Homo sapiens
aggtagcttggtgctttcattc

SEQ ID NO: 8281140 - DNA, 20 bp, Homo sapiens
aggtagctttgcatttttgt

SEQ ID NO: 8281141 - DNA, 22 bp, Homo sapiens
aggtagctatccagacgctgaa

SEQ ID NO: 8281142 - DNA, 19 bp, Homo sapiens
aggtagctcagactcaaag

SEQ ID NO: 8281143 - DNA, 19 bp, Homo sapiens
acctttgagaagaaatgtc

SEQ ID NO: 8281144 - DNA, 22 bp, Homo sapiens
acctttgacgctatttaatttg

SEQ ID NO: 8281145 - DNA, 22 bp, Homo sapiens
aggtccaggttccgtttctgcg

SEQ ID NO: 8281146 - DNA, 22 bp, Homo sapiens
actagaaattactcagaataaa

SEQ ID NO: 8281147 - DNA, 22 bp, Homo sapiens
actagaaagtttccagagttat

SEQ ID NO: 8281148 - DNA, 22 bp, Homo sapiens
actagaaatgtattggtagctg

SEQ ID NO: 8281149 - DNA, 22 bp, Homo sapiens
aggtgggcactccgctcgaggt

SEQ ID NO: 8281150 - DNA, 22 bp, Homo sapiens
aggtgggcaccaggcttgtggt

SEQ ID NO: 8281151 - DNA, 22 bp, Homo sapiens
actagaaaattcctagaaacta

SEQ ID NO: 8281152 - DNA, 22 bp, Homo sapiens
actagaaaattcctagaaacta

SEQ ID NO: 8281153 - DNA, 22 bp, Homo sapiens
actagaaagcaaaagccatttc

SEQ ID NO: 8281154 - DNA, 20 bp, Homo sapiens
actagaaagtcactgggggg

SEQ ID NO: 8281155 - DNA, 22 bp, Homo sapiens
actagaaagcactaagctaggc

SEQ ID NO: 8281156 - DNA, 23 bp, Homo sapiens
actagaaaatgactttctccctg

SEQ ID NO: 8281157 - DNA, 22 bp, Homo sapiens
actacagtaagggaggcagcat

SEQ ID NO: 8281158 - DNA, 22 bp, Homo sapiens
actaaatatttgagaggtgtag

SEQ ID NO: 8281159 - DNA, 22 bp, Homo sapiens
aggtgacatgaaaaatgttgag

SEQ ID NO: 8281160 - DNA, 22 bp, Homo sapiens
acgaggtatcacattgcatctc

SEQ ID NO: 8281161 - DNA, 22 bp, Homo sapiens
acgaggttggagagttgtttgg

SEQ ID NO: 8281162 - DNA, 22 bp, Homo sapiens
actgagagtcaagatagcatgg

SEQ ID NO: 8281163 - DNA, 22 bp, Homo sapiens
actgagaggtgatagtgacatt

SEQ ID NO: 8281164 - DNA, 22 bp, Homo sapiens
actgagagggaggctgtccggt

SEQ ID NO: 8281165 - DNA, 22 bp, Homo sapiens
actgagagagctgggtatctcc

SEQ ID NO: 8281166 - DNA, 22 bp, Homo sapiens
actgagaggaaattgagactat

SEQ ID NO: 8281167 - DNA, 22 bp, Homo sapiens
actgagagttgtgcattcatgc

SEQ ID NO: 8281168 - DNA, 22 bp, Homo sapiens
actgagagtcttagaaacacat

SEQ ID NO: 8281169 - DNA, 22 bp, Homo sapiens
actgagagttgaaaagggagga

SEQ ID NO: 8281170 - DNA, 22 bp, Homo sapiens
actgagcagaacaatgggagcc

SEQ ID NO: 8281171 - DNA, 19 bp, Homo sapiens
agtgaactccatatcaggt

SEQ ID NO: 8281172 - DNA, 22 bp, Homo sapiens
actgaatttgtgtagatggtct

SEQ ID NO: 8281173 - DNA, 22 bp, Homo sapiens
actgaatttattagtatagtct

SEQ ID NO: 8281174 - DNA, 22 bp, Homo sapiens
actgcactcctgcctgggtaac

SEQ ID NO: 8281175 - DNA, 21 bp, Homo sapiens
agtgctgaaaaagcatgtctc

SEQ ID NO: 8281176 - DNA, 22 bp, Homo sapiens
agtgctgaacatagaatggaca

SEQ ID NO: 8281177 - DNA, 22 bp, Homo sapiens
actgccacgttccaggcttagc

SEQ ID NO: 8281178 - DNA, 22 bp, Homo sapiens
actgccaggtgctccatctgaa

SEQ ID NO: 8281179 - DNA, 23 bp, Homo sapiens
actgccagttttaccacagacgg

SEQ ID NO: 8281180 - DNA, 22 bp, Homo sapiens
actgcccacatctctttccgct

SEQ ID NO: 8281181 - DNA, 22 bp, Homo sapiens
actgcccttgtcctggcacacc

SEQ ID NO: 8281182 - DNA, 22 bp, Homo sapiens
actgcctcttggtgctgagaga

SEQ ID NO: 8281183 - DNA, 22 bp, Homo sapiens
actgcccatgtgcatcaagtag

SEQ ID NO: 8281184 - DNA, 22 bp, Homo sapiens
actgcccagaagagatgaaagt

SEQ ID NO: 8281185 - DNA, 22 bp, Homo sapiens
actggctggactctgacctctt

SEQ ID NO: 8281186 - DNA, 22 bp, Homo sapiens
actggctgcggggtggaagaag

SEQ ID NO: 8281187 - DNA, 22 bp, Homo sapiens
actggcttggcaggaggaagat

SEQ ID NO: 8281188 - DNA, 22 bp, Homo sapiens
actggcttcagggggaaagtcc

SEQ ID NO: 8281189 - DNA, 22 bp, Homo sapiens
actggcttgaagtagattcaaa

SEQ ID NO: 8281190 - DNA, 22 bp, Homo sapiens
actggcttcaaaccgtttcacc

SEQ ID NO: 8281191 - DNA, 22 bp, Homo sapiens
actggctgtgtaacctcaggca

SEQ ID NO: 8281192 - DNA, 22 bp, Homo sapiens
actgggcagggaaggagaccga

SEQ ID NO: 8281193 - DNA, 20 bp, Homo sapiens
actgggcatacctgtcctgt

SEQ ID NO: 8281194 - DNA, 22 bp, Homo sapiens
actgggcatcccatggcagagc

SEQ ID NO: 8281195 - DNA, 22 bp, Homo sapiens
aggctccaggcccttcaccagc

SEQ ID NO: 8281196 - DNA, 22 bp, Homo sapiens
aggcttcccagctgagctcagc

SEQ ID NO: 8281197 - DNA, 22 bp, Homo sapiens
aggctccagcagccagaggaag

SEQ ID NO: 8281198 - DNA, 22 bp, Homo sapiens
aggctccacggtcactggctct

SEQ ID NO: 8281199 - DNA, 22 bp, Homo sapiens
acattgaatttcacttttgtac

SEQ ID NO: 8281200 - DNA, 22 bp, Homo sapiens
acattgaaagcatattatctcc

SEQ ID NO: 8281201 - DNA, 22 bp, Homo sapiens
acattcaagtttctgctcatgg

SEQ ID NO: 8281202 - DNA, 22 bp, Homo sapiens
aggccctgcaggaagcaggatg

SEQ ID NO: 8281203 - DNA, 22 bp, Homo sapiens
aggccctgcaggagtggggaca

SEQ ID NO: 8281204 - DNA, 22 bp, Homo sapiens
aggccctgcattgtactgaggg

SEQ ID NO: 8281205 - DNA, 22 bp, Homo sapiens
acattaatgaggtgatgacaca

SEQ ID NO: 8281206 - DNA, 22 bp, Homo sapiens
aggccctgcattgtactgaggg

SEQ ID NO: 8281207 - DNA, 22 bp, Homo sapiens
acatacatgggattaaaaaatt

SEQ ID NO: 8281208 - DNA, 22 bp, Homo sapiens
acatacatggattcatggattc

SEQ ID NO: 8281209 - DNA, 22 bp, Homo sapiens
acatacatggttctcagccctt

SEQ ID NO: 8281210 - DNA, 22 bp, Homo sapiens
acatacatggtgctttcttggt

SEQ ID NO: 8281211 - DNA, 22 bp, Homo sapiens
acatacatgtaaaggaaattat

SEQ ID NO: 8281212 - DNA, 22 bp, Homo sapiens
aggccacacaactcttagagat

SEQ ID NO: 8281213 - DNA, 22 bp, Homo sapiens
aggccctgagaaaatccctgca

SEQ ID NO: 8281214 - DNA, 22 bp, Homo sapiens
aggccctgatccgaatccagat

SEQ ID NO: 8281215 - DNA, 22 bp, Homo sapiens
aggccagcattctctctccagg

SEQ ID NO: 8281216 - DNA, 22 bp, Homo sapiens
aggccagcctcaggcagggacc

SEQ ID NO: 8281217 - DNA, 22 bp, Homo sapiens
agggcctcctaatttcctcata

SEQ ID NO: 8281218 - DNA, 22 bp, Homo sapiens
agggccatttgctggagctttg

SEQ ID NO: 8281219 - DNA, 22 bp, Homo sapiens
agggcctcgggctcagtgggtc

SEQ ID NO: 8281220 - DNA, 22 bp, Homo sapiens
accagggctgggataggtcagg

SEQ ID NO: 8281221 - DNA, 22 bp, Homo sapiens
accagggcccgggagagctctc

SEQ ID NO: 8281222 - DNA, 22 bp, Homo sapiens
accagggcagccgaggtgtgtc

SEQ ID NO: 8281223 - DNA, 22 bp, Homo sapiens
accaggaggtgtttgctcaagt

SEQ ID NO: 8281224 - DNA, 22 bp, Homo sapiens
accaggagtagaatatctgtga

SEQ ID NO: 8281225 - DNA, 22 bp, Homo sapiens
accaggagtctagcctagtcaa

SEQ ID NO: 8281226 - DNA, 22 bp, Homo sapiens
accaggaagctgtgagaccttt

SEQ ID NO: 8281227 - DNA, 22 bp, Homo sapiens
accaagcttcgtggaggaagtt

SEQ ID NO: 8281228 - DNA, 23 bp, Homo sapiens
aggcttcctatcttagagctggg

SEQ ID NO: 8281229 - DNA, 22 bp, Homo sapiens
aggcttcctcgtgccttagata

SEQ ID NO: 8281230 - DNA, 22 bp, Homo sapiens
accccacagcatacaaaggcac

SEQ ID NO: 8281231 - DNA, 22 bp, Homo sapiens
accccagccctgcttctgggag

SEQ ID NO: 8281232 - DNA, 22 bp, Homo sapiens
acccacgaagatgagcggcatg

SEQ ID NO: 8281233 - DNA, 22 bp, Homo sapiens
acccaccctactagcagtgtcc

SEQ ID NO: 8281234 - DNA, 21 bp, Homo sapiens
agggcctctcatttgtgccag

SEQ ID NO: 8281235 - DNA, 22 bp, Homo sapiens
agggcctctgagccagttctgg

SEQ ID NO: 8281236 - DNA, 22 bp, Homo sapiens
agctgctgtcctaggcactgta

SEQ ID NO: 8281237 - DNA, 22 bp, Homo sapiens
agctgctggggagggcagacac

SEQ ID NO: 8281238 - DNA, 22 bp, Homo sapiens
agctgctgtttggtgagtcttg

SEQ ID NO: 8281239 - DNA, 21 bp, Homo sapiens
agctgctgtggccagaatcca

SEQ ID NO: 8281240 - DNA, 22 bp, Homo sapiens
agctgctgtggggctcggcctg

SEQ ID NO: 8281241 - DNA, 22 bp, Homo sapiens
agctgcttagagtctcttctta

SEQ ID NO: 8281242 - DNA, 22 bp, Homo sapiens
agctccaggtgcaagtcatggt

SEQ ID NO: 8281243 - DNA, 22 bp, Homo sapiens
acagccagggtctcaggaggcg

SEQ ID NO: 8281244 - DNA, 22 bp, Homo sapiens
agctgcagccctcctgcatggc

SEQ ID NO: 8281245 - DNA, 22 bp, Homo sapiens
acagccagtgactggacaagct

SEQ ID NO: 8281246 - DNA, 22 bp, Homo sapiens
acagccagtgctccgtgaggac

SEQ ID NO: 8281247 - DNA, 22 bp, Homo sapiens
agctgcaggagtcgcctaggat

SEQ ID NO: 8281248 - DNA, 22 bp, Homo sapiens
agctgcaggaagtagaagcgga

SEQ ID NO: 8281249 - DNA, 22 bp, Homo sapiens
aggaagcagtttataatgcatt

SEQ ID NO: 8281250 - DNA, 22 bp, Homo sapiens
aggaagagcattcacatggtag

SEQ ID NO: 8281251 - DNA, 22 bp, Homo sapiens
aggaaaaacctgttaatggtag

SEQ ID NO: 8281252 - DNA, 22 bp, Homo sapiens
aggaaaaaagtctgtgattata

SEQ ID NO: 8281253 - DNA, 22 bp, Homo sapiens
agctttgtcttctcacatatcc

SEQ ID NO: 8281254 - DNA, 22 bp, Homo sapiens
agctgggcaaaatgtgaggttg

SEQ ID NO: 8281255 - DNA, 22 bp, Homo sapiens
agctgggatgataacctcagtc

SEQ ID NO: 8281256 - DNA, 21 bp, Homo sapiens
agctgtggcgaggggaacatg

SEQ ID NO: 8281257 - DNA, 21 bp, Homo sapiens
agctgtggcgaggggaacatg

SEQ ID NO: 8281258 - DNA, 22 bp, Homo sapiens
agctgtggccagatgtgagcgg

SEQ ID NO: 8281259 - DNA, 22 bp, Homo sapiens
agctgggagctgaaggctgatt

SEQ ID NO: 8281260 - DNA, 22 bp, Homo sapiens
agctgggagcagagccacagcc

SEQ ID NO: 8281261 - DNA, 22 bp, Homo sapiens
agcttagcacacacaggcaggt

SEQ ID NO: 8281262 - DNA, 18 bp, Homo sapiens
agcttagcatacttttcc

SEQ ID NO: 8281263 - DNA, 22 bp, Homo sapiens
agcttcactttgtactttgtca

SEQ ID NO: 8281264 - DNA, 22 bp, Homo sapiens
agctgtggttagatagagtcct

SEQ ID NO: 8281265 - DNA, 22 bp, Homo sapiens
agctgtggttctgggcagcgac

SEQ ID NO: 8281266 - DNA, 22 bp, Homo sapiens
agctgtgtaagtcatgtaggtg

SEQ ID NO: 8281267 - DNA, 22 bp, Homo sapiens
agctgtggggaggaggctagca

SEQ ID NO: 8281268 - DNA, 22 bp, Homo sapiens
agctgtgggcctgggagagctg

SEQ ID NO: 8281269 - DNA, 22 bp, Homo sapiens
agctgtggggcaggcagcgagg

SEQ ID NO: 8281270 - DNA, 20 bp, Homo sapiens
aggatggcaagcaagtgcat

SEQ ID NO: 8281271 - DNA, 22 bp, Homo sapiens
aggaggggttctcgggtgctga

SEQ ID NO: 8281272 - DNA, 22 bp, Homo sapiens
aggagggtacaatgggtggaaa

SEQ ID NO: 8281273 - DNA, 21 bp, Homo sapiens
aggaggggtctttcccactga

SEQ ID NO: 8281274 - DNA, 21 bp, Homo sapiens
aggaggggtctttcccactga

SEQ ID NO: 8281275 - DNA, 22 bp, Homo sapiens
aggaggggttctcgggtgctga

SEQ ID NO: 8281276 - DNA, 22 bp, Homo sapiens
aggcaaattattgtatgcagtt

SEQ ID NO: 8281277 - DNA, 22 bp, Homo sapiens
aggcaaattattgtatgcagtt

SEQ ID NO: 8281278 - DNA, 22 bp, Homo sapiens
aggcaaaataagcctctcctgt

SEQ ID NO: 8281279 - DNA, 22 bp, Homo sapiens
aggcaaaagaatgtcataaatg

SEQ ID NO: 8281280 - DNA, 22 bp, Homo sapiens
aggaggggcatagaaatgtaat

SEQ ID NO: 8281281 - DNA, 20 bp, Homo sapiens
aggagggacctggattggcg

SEQ ID NO: 8281282 - DNA, 17 bp, Homo sapiens
aggagggaaatagcttg

SEQ ID NO: 8281283 - DNA, 22 bp, Homo sapiens
aggaggccgctgatgggctccc

SEQ ID NO: 8281284 - DNA, 21 bp, Homo sapiens
acatacataccttaccacctt

SEQ ID NO: 8281285 - DNA, 22 bp, Homo sapiens
acatacatatgtttaaatgcat

SEQ ID NO: 8281286 - DNA, 22 bp, Homo sapiens
acatacatatgacaactttcct

SEQ ID NO: 8281287 - DNA, 23 bp, Homo sapiens
acatacatggagataaagtgatg

SEQ ID NO: 8281288 - DNA, 22 bp, Homo sapiens
acatacatcaagtatcacaaga

SEQ ID NO: 8281289 - DNA, 23 bp, Homo sapiens
acatacataagcaccacattttg

SEQ ID NO: 8281290 - DNA, 22 bp, Homo sapiens
aggcacagaatggcattcagtg

SEQ ID NO: 8281291 - DNA, 18 bp, Homo sapiens
aggcacagagcatacata

SEQ ID NO: 8281292 - DNA, 18 bp, Homo sapiens
aggcacagagcatacata

SEQ ID NO: 8281293 - DNA, 22 bp, Homo sapiens
aggcacagatttggggaaagca

SEQ ID NO: 8281294 - DNA, 22 bp, Homo sapiens
aggcacagatttggggaaagca

SEQ ID NO: 8281295 - DNA, 22 bp, Homo sapiens
aggcaactaggcctctgcctca

SEQ ID NO: 8281296 - DNA, 22 bp, Homo sapiens
aggcaacaggaaaccacatgat

SEQ ID NO: 8281297 - DNA, 22 bp, Homo sapiens
aggagacatactataggaatat

SEQ ID NO: 8281298 - DNA, 22 bp, Homo sapiens
aggagacatctaactgtaggtt

SEQ ID NO: 8281299 - DNA, 22 bp, Homo sapiens
aggagacatctaactgtaggtt

SEQ ID NO: 8281300 - DNA, 22 bp, Homo sapiens
aggagacatggaatagtgaggc

SEQ ID NO: 8281301 - DNA, 22 bp, Homo sapiens
aggagacagtttggacgtgtag

SEQ ID NO: 8281302 - DNA, 22 bp, Homo sapiens
aggagacataactatgatgaga

SEQ ID NO: 8281303 - DNA, 23 bp, Homo sapiens
aggagacagggaagtgcctggct

SEQ ID NO: 8281304 - DNA, 17 bp, Homo sapiens
aggaagggcaagtttct

SEQ ID NO: 8281305 - DNA, 22 bp, Homo sapiens
aggaagggatacataggatagt

SEQ ID NO: 8281306 - DNA, 17 bp, Homo sapiens
aggaagcgagctggcct

SEQ ID NO: 8281307 - DNA, 22 bp, Homo sapiens
acagggtgactttgtgacagat

SEQ ID NO: 8281308 - DNA, 22 bp, Homo sapiens
aggagccattttccaagggcga

SEQ ID NO: 8281309 - DNA, 23 bp, Homo sapiens
aggagcccaaggagaggtaactt

SEQ ID NO: 8281310 - DNA, 22 bp, Homo sapiens
aggagcctgagtcacagtgcct

SEQ ID NO: 8281311 - DNA, 22 bp, Homo sapiens
atgcctggtcccacctctaggt

SEQ ID NO: 8281312 - DNA, 22 bp, Homo sapiens
agacccaggattggggctgccg

SEQ ID NO: 8281313 - DNA, 22 bp, Homo sapiens
atgatatacttcctagaacagt

SEQ ID NO: 8281314 - DNA, 22 bp, Homo sapiens
atgcagggttctgggctagaga

SEQ ID NO: 8281315 - DNA, 22 bp, Homo sapiens
atgatatacttcctagaacagt

SEQ ID NO: 8281316 - DNA, 22 bp, Homo sapiens
atgatacatcttcatgtcagtg

SEQ ID NO: 8281317 - DNA, 22 bp, Homo sapiens
atgatacattgcaaaattttaa

SEQ ID NO: 8281318 - DNA, 22 bp, Homo sapiens
atgcatttttgagtatgaatga

SEQ ID NO: 8281319 - DNA, 22 bp, Homo sapiens
atgcatttttgagtatgaatga

SEQ ID NO: 8281320 - DNA, 22 bp, Homo sapiens
atctgcctggctccaggtgagc

SEQ ID NO: 8281321 - DNA, 20 bp, Homo sapiens
atctgctgagaatgaaaggc

SEQ ID NO: 8281322 - DNA, 20 bp, Homo sapiens
atctgctgagaatgaaaggc

SEQ ID NO: 8281323 - DNA, 18 bp, Homo sapiens
atctgctggcaggtctgg

SEQ ID NO: 8281324 - DNA, 22 bp, Homo sapiens
atctgctgttcttcacagcttg

SEQ ID NO: 8281325 - DNA, 22 bp, Homo sapiens
atgaagtcgttactaccaattg

SEQ ID NO: 8281326 - DNA, 22 bp, Homo sapiens
agacaaggcaaggcggccagat

SEQ ID NO: 8281327 - DNA, 22 bp, Homo sapiens
agacaaggaatgtagcttactc

SEQ ID NO: 8281328 - DNA, 22 bp, Homo sapiens
agacaaggcccccttgggctct

SEQ ID NO: 8281329 - DNA, 22 bp, Homo sapiens
agacaaggcccccttgggctct

SEQ ID NO: 8281330 - DNA, 22 bp, Homo sapiens
agacaaggctggagtttaggca

SEQ ID NO: 8281331 - DNA, 22 bp, Homo sapiens
agaatcaattagattctatgag

SEQ ID NO: 8281332 - DNA, 22 bp, Homo sapiens
atgagggaggggtggtgccgca

SEQ ID NO: 8281333 - DNA, 23 bp, Homo sapiens
agagaaaaatatctgggcacatt

SEQ ID NO: 8281334 - DNA, 22 bp, Homo sapiens
agagaaaactcattgaggtgtc

SEQ ID NO: 8281335 - DNA, 22 bp, Homo sapiens
agagaatacagggtaacaggaa

SEQ ID NO: 8281336 - DNA, 22 bp, Homo sapiens
agacttcttgagctggcacttc

SEQ ID NO: 8281337 - DNA, 22 bp, Homo sapiens
agacttctcttggctatattat

SEQ ID NO: 8281338 - DNA, 22 bp, Homo sapiens
agagacaagggacctctggaga

SEQ ID NO: 8281339 - DNA, 22 bp, Homo sapiens
agagaattggagcagtgacagg

SEQ ID NO: 8281340 - DNA, 22 bp, Homo sapiens
agagagaagcaatcagtggcca

SEQ ID NO: 8281341 - DNA, 19 bp, Homo sapiens
agagaggctgtgtgaggga

SEQ ID NO: 8281342 - DNA, 19 bp, Homo sapiens
agagaggctgtgtgaggga

SEQ ID NO: 8281343 - DNA, 23 bp, Homo sapiens
agagagctcactatatagcattg

SEQ ID NO: 8281344 - DNA, 22 bp, Homo sapiens
agagcacagtatctgcacatca

SEQ ID NO: 8281345 - DNA, 22 bp, Homo sapiens
agagcagagtggctgtagcttg

SEQ ID NO: 8281346 - DNA, 22 bp, Homo sapiens
agagagttctttctagttgaag

SEQ ID NO: 8281347 - DNA, 22 bp, Homo sapiens
agagcctctgtcatggagagaa

SEQ ID NO: 8281348 - DNA, 22 bp, Homo sapiens
agagccctgacggggacagatg

SEQ ID NO: 8281349 - DNA, 22 bp, Homo sapiens
agagccctgaagcagagctaaa

SEQ ID NO: 8281350 - DNA, 23 bp, Homo sapiens
agagcctgaaagacttctggcac

SEQ ID NO: 8281351 - DNA, 22 bp, Homo sapiens
agagggcttccctaggagtgag

SEQ ID NO: 8281352 - DNA, 22 bp, Homo sapiens
agagggcagggcggtaagtcct

SEQ ID NO: 8281353 - DNA, 22 bp, Homo sapiens
agagggcagtctcagattggga

SEQ ID NO: 8281354 - DNA, 22 bp, Homo sapiens
agaggggacagccacctgcccg

SEQ ID NO: 8281355 - DNA, 22 bp, Homo sapiens
agaggggaggcgaaccagagtc

SEQ ID NO: 8281356 - DNA, 22 bp, Homo sapiens
agagtccctcttcccaggaggc

SEQ ID NO: 8281357 - DNA, 22 bp, Homo sapiens
agagtccaggtgggctggaggc

SEQ ID NO: 8281358 - DNA, 22 bp, Homo sapiens
agagtctgaggcagctgcagcc

SEQ ID NO: 8281359 - DNA, 22 bp, Homo sapiens
agagtgagggggcactgagacg

SEQ ID NO: 8281360 - DNA, 22 bp, Homo sapiens
agagtcagactaagccatggtg

SEQ ID NO: 8281361 - DNA, 22 bp, Homo sapiens
agagtccagaaaacagtgtgct

SEQ ID NO: 8281362 - DNA, 22 bp, Homo sapiens
agagtcaccaaagtaaaacagt

SEQ ID NO: 8281363 - DNA, 22 bp, Homo sapiens
attacacactcaagtcctgtta

SEQ ID NO: 8281364 - DNA, 22 bp, Homo sapiens
attacacaggctggctctttga

SEQ ID NO: 8281365 - DNA, 22 bp, Homo sapiens
agaggaggctgggtccagataa

SEQ ID NO: 8281366 - DNA, 22 bp, Homo sapiens
agaggaggctgggtccagataa

SEQ ID NO: 8281367 - DNA, 22 bp, Homo sapiens
agagctggctgtgggtgacttt

SEQ ID NO: 8281368 - DNA, 18 bp, Homo sapiens
agaggctggacaggggat

SEQ ID NO: 8281369 - DNA, 22 bp, Homo sapiens
agaggctggattgagcatagac

SEQ ID NO: 8281370 - DNA, 22 bp, Homo sapiens
agaggccagctagcgggccatc

SEQ ID NO: 8281371 - DNA, 22 bp, Homo sapiens
agaggccagcagtgcctatctg

SEQ ID NO: 8281372 - DNA, 22 bp, Homo sapiens
agaggccagcccaggccaccga

SEQ ID NO: 8281373 - DNA, 22 bp, Homo sapiens
agaggccaccttctcttgagaa

SEQ ID NO: 8281374 - DNA, 22 bp, Homo sapiens
agaggccagaaggcgcaccccg

SEQ ID NO: 8281375 - DNA, 22 bp, Homo sapiens
agaggccagaaagtatgccacc

SEQ ID NO: 8281376 - DNA, 22 bp, Homo sapiens
agaggccagaaagtatgccacc

SEQ ID NO: 8281377 - DNA, 22 bp, Homo sapiens
agaggccaccttctcttgagaa

SEQ ID NO: 8281378 - DNA, 22 bp, Homo sapiens
attttagcagttctctaatttc

SEQ ID NO: 8281379 - DNA, 22 bp, Homo sapiens
attttagtacctcaagtatcca

SEQ ID NO: 8281380 - DNA, 22 bp, Homo sapiens
attttaaccctcttatatatac

SEQ ID NO: 8281381 - DNA, 22 bp, Homo sapiens
attttcaaaacatctgctgtgt

SEQ ID NO: 8281382 - DNA, 22 bp, Homo sapiens
agatgtggatcctagggtagaa

SEQ ID NO: 8281383 - DNA, 22 bp, Homo sapiens
attttcaccctgaatatattga

SEQ ID NO: 8281384 - DNA, 22 bp, Homo sapiens
agatgtgggtgtcaggcagtga

SEQ ID NO: 8281385 - DNA, 22 bp, Homo sapiens
agatgtgtttctagttcctgca

SEQ ID NO: 8281386 - DNA, 22 bp, Homo sapiens
agcaaatcagctgctcaggaaa

SEQ ID NO: 8281387 - DNA, 22 bp, Homo sapiens
agcaacaggaatattatggcaa

SEQ ID NO: 8281388 - DNA, 20 bp, Homo sapiens
agcaacaataaaatgtcctg

SEQ ID NO: 8281389 - DNA, 19 bp, Homo sapiens
agcaacctgtcagagatgc

SEQ ID NO: 8281390 - DNA, 23 bp, Homo sapiens
agcaacagtgggtgagtgttgct

SEQ ID NO: 8281391 - DNA, 22 bp, Homo sapiens
caaagcagaaggttctgtggta

SEQ ID NO: 8281392 - DNA, 22 bp, Homo sapiens
caaagcagacctttacccttta

SEQ ID NO: 8281393 - DNA, 20 bp, Homo sapiens
agcaagagtaaggacagcga

SEQ ID NO: 8281394 - DNA, 22 bp, Homo sapiens
caaagataatcacagaataccc

SEQ ID NO: 8281395 - DNA, 22 bp, Homo sapiens
caaagataatcacagaataccc

SEQ ID NO: 8281396 - DNA, 23 bp, Homo sapiens
caaagatgattggaacatggctt

SEQ ID NO: 8281397 - DNA, 22 bp, Homo sapiens
caaagatgtcattggtaagaca

SEQ ID NO: 8281398 - DNA, 22 bp, Homo sapiens
caaagatgctgatgttggatca

SEQ ID NO: 8281399 - DNA, 22 bp, Homo sapiens
agatcagatctccttttgcatt

SEQ ID NO: 8281400 - DNA, 17 bp, Homo sapiens
agatggcaggaggcaga

SEQ ID NO: 8281401 - DNA, 22 bp, Homo sapiens
agatggccccaggtgcccaggg

SEQ ID NO: 8281402 - DNA, 22 bp, Homo sapiens
agatggccccaggtgcccaggg

SEQ ID NO: 8281403 - DNA, 22 bp, Homo sapiens
agatggctccagtgtccagagg

SEQ ID NO: 8281404 - DNA, 22 bp, Homo sapiens
agatggctgatggcaggagcca

SEQ ID NO: 8281405 - DNA, 22 bp, Homo sapiens
agagtggcaccttacctgagac

SEQ ID NO: 8281406 - DNA, 22 bp, Homo sapiens
agagtggcaccttacctgagac

SEQ ID NO: 8281407 - DNA, 22 bp, Homo sapiens
attggcatactttctatattca

SEQ ID NO: 8281408 - DNA, 22 bp, Homo sapiens
agagtggcagcaagtcaggtag

SEQ ID NO: 8281409 - DNA, 22 bp, Homo sapiens
attggctattgagtgtgtgctg

SEQ ID NO: 8281410 - DNA, 22 bp, Homo sapiens
attgggatgccggctgataaga

SEQ ID NO: 8281411 - DNA, 22 bp, Homo sapiens
agatattaatcgtacataaggt

SEQ ID NO: 8281412 - DNA, 22 bp, Homo sapiens
agatcaaagccatgagagattt

SEQ ID NO: 8281413 - DNA, 22 bp, Homo sapiens
agatcactggttacttaatgaa

SEQ ID NO: 8281414 - DNA, 22 bp, Homo sapiens
agatcacagtggcaactccctt

SEQ ID NO: 8281415 - DNA, 22 bp, Homo sapiens
agcacctgtgttcatgcctcat

SEQ ID NO: 8281416 - DNA, 22 bp, Homo sapiens
agcacctgtggctcatgctcgt

SEQ ID NO: 8281417 - DNA, 22 bp, Homo sapiens
agcactgcctctgagctccagc

SEQ ID NO: 8281418 - DNA, 22 bp, Homo sapiens
agcagagcggggcctccggaag

SEQ ID NO: 8281419 - DNA, 22 bp, Homo sapiens
agcagagctgggatcctgggtc

SEQ ID NO: 8281420 - DNA, 22 bp, Homo sapiens
caataatatcctgtgctgtttg

SEQ ID NO: 8281421 - DNA, 20 bp, Homo sapiens
caataatttacttccctatt

SEQ ID NO: 8281422 - DNA, 22 bp, Homo sapiens
agcagaggtgtttattatggga

SEQ ID NO: 8281423 - DNA, 22 bp, Homo sapiens
cacagagcaggggtctgtgtca

SEQ ID NO: 8281424 - DNA, 22 bp, Homo sapiens
agcagctgcttttcttcattgg

SEQ ID NO: 8281425 - DNA, 22 bp, Homo sapiens
cacagagatggccagggcacat

SEQ ID NO: 8281426 - DNA, 22 bp, Homo sapiens
cacagagatggtctggcaggtg

SEQ ID NO: 8281427 - DNA, 22 bp, Homo sapiens
cacagagatggtctggcaggtg

SEQ ID NO: 8281428 - DNA, 17 bp, Homo sapiens
agcagctggcacaggag

SEQ ID NO: 8281429 - DNA, 22 bp, Homo sapiens
agcagctggcagcttcttctct

SEQ ID NO: 8281430 - DNA, 21 bp, Homo sapiens
agcagctgggcaacatggagg

SEQ ID NO: 8281431 - DNA, 22 bp, Homo sapiens
cacagagatcggaacagaagta

SEQ ID NO: 8281432 - DNA, 22 bp, Homo sapiens
cacagagaggcttgtctccaag

SEQ ID NO: 8281433 - DNA, 22 bp, Homo sapiens
cacagagagctacgtgcagcgt

SEQ ID NO: 8281434 - DNA, 22 bp, Homo sapiens
cacagaacatccttagctcatg

SEQ ID NO: 8281435 - DNA, 19 bp, Homo sapiens
agcagcagaagtgtgcctt

SEQ ID NO: 8281436 - DNA, 22 bp, Homo sapiens
caatacatcaggtcaaaatgtg

SEQ ID NO: 8281437 - DNA, 22 bp, Homo sapiens
agcagcagatcaaacaggcttg

SEQ ID NO: 8281438 - DNA, 22 bp, Homo sapiens
agcagcagatcaaacaggcttg

SEQ ID NO: 8281439 - DNA, 22 bp, Homo sapiens
agcagcagatccaaaaaatgtg

SEQ ID NO: 8281440 - DNA, 22 bp, Homo sapiens
agcagcagagctctggtctgca

SEQ ID NO: 8281441 - DNA, 22 bp, Homo sapiens
agcagcagaggtcagaaaggta

SEQ ID NO: 8281442 - DNA, 21 bp, Homo sapiens
agcagcagatctggtgagggc

SEQ ID NO: 8281443 - DNA, 19 bp, Homo sapiens
agcatggaagctggtgcca

SEQ ID NO: 8281444 - DNA, 22 bp, Homo sapiens
agcatgcaggaaccacatggca

SEQ ID NO: 8281445 - DNA, 22 bp, Homo sapiens
agcatgctggttacgtgtagca

SEQ ID NO: 8281446 - DNA, 22 bp, Homo sapiens
agcatgctggtgttcatggcag

SEQ ID NO: 8281447 - DNA, 22 bp, Homo sapiens
agcatgttcatcttctgttggt

SEQ ID NO: 8281448 - DNA, 22 bp, Homo sapiens
agcatgttgggatgagaaggaa

SEQ ID NO: 8281449 - DNA, 23 bp, Homo sapiens
agcatgttgtgatgttaccactg

SEQ ID NO: 8281450 - DNA, 22 bp, Homo sapiens
cactgttgagcaatgtacagtg

SEQ ID NO: 8281451 - DNA, 22 bp, Homo sapiens
cactgttgagcaatgtacagtg

SEQ ID NO: 8281452 - DNA, 22 bp, Homo sapiens
cactttactatctataaaataa

SEQ ID NO: 8281453 - DNA, 22 bp, Homo sapiens
cactttacccttgttactcatg

SEQ ID NO: 8281454 - DNA, 22 bp, Homo sapiens
agcagtgaaacagctgcatatg

SEQ ID NO: 8281455 - DNA, 22 bp, Homo sapiens
agcagtcttgagggatgctaga

SEQ ID NO: 8281456 - DNA, 18 bp, Homo sapiens
agcaggttctcacagcca

SEQ ID NO: 8281457 - DNA, 22 bp, Homo sapiens
agcaggttaccattgatttcct

SEQ ID NO: 8281458 - DNA, 22 bp, Homo sapiens
agcaggttccaggcactgtggc

SEQ ID NO: 8281459 - DNA, 22 bp, Homo sapiens
agcaggtgttagggatccaatg

SEQ ID NO: 8281460 - DNA, 22 bp, Homo sapiens
agcaggtgttggctgggccatc

SEQ ID NO: 8281461 - DNA, 22 bp, Homo sapiens
agcagggctggatttggcaaga

SEQ ID NO: 8281462 - DNA, 22 bp, Homo sapiens
agcagggctctgccatgggccc

SEQ ID NO: 8281463 - DNA, 22 bp, Homo sapiens
agcagggctgcagtgtgtcttt

SEQ ID NO: 8281464 - DNA, 22 bp, Homo sapiens
caccagcagcggtgtgagggtg

SEQ ID NO: 8281465 - DNA, 20 bp, Homo sapiens
caccagcagcagctgccacc

SEQ ID NO: 8281466 - DNA, 20 bp, Homo sapiens
caccagcagcagctgccacc

SEQ ID NO: 8281467 - DNA, 20 bp, Homo sapiens
caccagcagcagctgccacc

SEQ ID NO: 8281468 - DNA, 20 bp, Homo sapiens
caccagcagcagctgccacc

SEQ ID NO: 8281469 - DNA, 22 bp, Homo sapiens
caccagcaccagctctgtgcct

SEQ ID NO: 8281470 - DNA, 22 bp, Homo sapiens
caccagcaccagctctgtgcct

SEQ ID NO: 8281471 - DNA, 22 bp, Homo sapiens
agcagggcagcttttttcagaa

SEQ ID NO: 8281472 - DNA, 23 bp, Homo sapiens
caccactttctccttctccttgg

SEQ ID NO: 8281473 - DNA, 22 bp, Homo sapiens
agcagggcaaagtcaggctaac

SEQ ID NO: 8281474 - DNA, 19 bp, Homo sapiens
agcagggagtggttgtggg

SEQ ID NO: 8281475 - DNA, 17 bp, Homo sapiens
agcagggagtcaaggga

SEQ ID NO: 8281476 - DNA, 21 bp, Homo sapiens
agcagctgggcaacatggagg

SEQ ID NO: 8281477 - DNA, 22 bp, Homo sapiens
agcagcttctttcactcctgga

SEQ ID NO: 8281478 - DNA, 22 bp, Homo sapiens
agcaggaactcagggagttctc

SEQ ID NO: 8281479 - DNA, 22 bp, Homo sapiens
agcaggaagtagtctgtaagca

SEQ ID NO: 8281480 - DNA, 22 bp, Homo sapiens
agcaggaaggctttgggggttc

SEQ ID NO: 8281481 - DNA, 22 bp, Homo sapiens
agcaggaagtcctctcaggaga

SEQ ID NO: 8281482 - DNA, 22 bp, Homo sapiens
cacagcaagagctaaatgacca

SEQ ID NO: 8281483 - DNA, 22 bp, Homo sapiens
agcagggagaccatctcttcct

SEQ ID NO: 8281484 - DNA, 22 bp, Homo sapiens
agcaggcttatggttgaaggga

SEQ ID NO: 8281485 - DNA, 22 bp, Homo sapiens
agcagggaggcccagggcactg

SEQ ID NO: 8281486 - DNA, 22 bp, Homo sapiens
agcagggaggcggtgtgctggc

SEQ ID NO: 8281487 - DNA, 22 bp, Homo sapiens
agcagggaggtctagcacgtgg

SEQ ID NO: 8281488 - DNA, 22 bp, Homo sapiens
cacagcagacagggaggcggct

SEQ ID NO: 8281489 - DNA, 22 bp, Homo sapiens
agcctgggttagggttcttccc

SEQ ID NO: 8281490 - DNA, 22 bp, Homo sapiens
agcctgggggcgcagaaaccgg

SEQ ID NO: 8281491 - DNA, 22 bp, Homo sapiens
agcctgggccctgcctcttctc

SEQ ID NO: 8281492 - DNA, 18 bp, Homo sapiens
agcctgggctctgcctgg

SEQ ID NO: 8281493 - DNA, 22 bp, Homo sapiens
agctaaggaactctgtaacacc

SEQ ID NO: 8281494 - DNA, 23 bp, Homo sapiens
agctaaggaagctgaggcacagt

SEQ ID NO: 8281495 - DNA, 22 bp, Homo sapiens
agctaaggacagttgatttaga

SEQ ID NO: 8281496 - DNA, 22 bp, Homo sapiens
agctaaggatgactagtacttc

SEQ ID NO: 8281497 - DNA, 22 bp, Homo sapiens
agctacaatcaatgtacatcat

SEQ ID NO: 8281498 - DNA, 22 bp, Homo sapiens
agctactatgtgaaagccaggc

SEQ ID NO: 8281499 - DNA, 22 bp, Homo sapiens
agctagaatattgatctgaaat

SEQ ID NO: 8281500 - DNA, 22 bp, Homo sapiens
agcctgggcaacaacacagcga

SEQ ID NO: 8281501 - DNA, 20 bp, Homo sapiens
cagatgggacgtggaggagt

SEQ ID NO: 8281502 - DNA, 22 bp, Homo sapiens
cagatggggcaaggccatctgt

SEQ ID NO: 8281503 - DNA, 22 bp, Homo sapiens
cagcaacctaaatccactaact

SEQ ID NO: 8281504 - DNA, 22 bp, Homo sapiens
cagcaacatatatgaaactgtg

SEQ ID NO: 8281505 - DNA, 22 bp, Homo sapiens
agctctgtggccttgggtgaat

SEQ ID NO: 8281506 - DNA, 22 bp, Homo sapiens
agctctgtctttctcttagtaa

SEQ ID NO: 8281507 - DNA, 22 bp, Homo sapiens
agctctgggattctcaggccac

SEQ ID NO: 8281508 - DNA, 22 bp, Homo sapiens
agctccaggataagacaggtgc

SEQ ID NO: 8281509 - DNA, 23 bp, Homo sapiens
agctccagctgacgtgggcagcc

SEQ ID NO: 8281510 - DNA, 21 bp, Homo sapiens
agctccaggctcctggggttc

SEQ ID NO: 8281511 - DNA, 22 bp, Homo sapiens
agctccagggaaagagtggatc

SEQ ID NO: 8281512 - DNA, 22 bp, Homo sapiens
agctagcttagcctgtgaggta

SEQ ID NO: 8281513 - DNA, 23 bp, Homo sapiens
agctccagaacatagcacaggaa

SEQ ID NO: 8281514 - DNA, 22 bp, Homo sapiens
cactttatgggaagcaaaaatt

SEQ ID NO: 8281515 - DNA, 22 bp, Homo sapiens
agccagagagtgttggagatgt

SEQ ID NO: 8281516 - DNA, 22 bp, Homo sapiens
agccagagttgaatgtgagtct

SEQ ID NO: 8281517 - DNA, 22 bp, Homo sapiens
agccagcagggcttagaggaca

SEQ ID NO: 8281518 - DNA, 22 bp, Homo sapiens
agccagcatgaagacagaggcc

SEQ ID NO: 8281519 - DNA, 22 bp, Homo sapiens
agccagctaagggaagcatgat

SEQ ID NO: 8281520 - DNA, 22 bp, Homo sapiens
agccagctaagggaagcatgat

SEQ ID NO: 8281521 - DNA, 17 bp, Homo sapiens
agccaggcatatgaagt

SEQ ID NO: 8281522 - DNA, 22 bp, Homo sapiens
cagagcccaagagcaagccatg

SEQ ID NO: 8281523 - DNA, 22 bp, Homo sapiens
agccaggccttttctcaaggtt

SEQ ID NO: 8281524 - DNA, 22 bp, Homo sapiens
cagagcctggcgatgtcatgga

SEQ ID NO: 8281525 - DNA, 20 bp, Homo sapiens
agccaggcctcaagttaagt

SEQ ID NO: 8281526 - DNA, 22 bp, Homo sapiens
agccaggccttagggagaggca

SEQ ID NO: 8281527 - DNA, 22 bp, Homo sapiens
cagagccttagttctcctagaa

SEQ ID NO: 8281528 - DNA, 22 bp, Homo sapiens
agccccagcccctctctcacaa

SEQ ID NO: 8281529 - DNA, 22 bp, Homo sapiens
agccccaggcccggacgcctct

SEQ ID NO: 8281530 - DNA, 22 bp, Homo sapiens
agcccaggttgaggctgcagtg

SEQ ID NO: 8281531 - DNA, 22 bp, Homo sapiens
agcccaggttgaggctgcagtg

SEQ ID NO: 8281532 - DNA, 22 bp, Homo sapiens
agcccaggttgaggctgcagtg

SEQ ID NO: 8281533 - DNA, 22 bp, Homo sapiens
agcccagggagttgattagcat

SEQ ID NO: 8281534 - DNA, 22 bp, Homo sapiens
agccctggctcccagcagcgct

SEQ ID NO: 8281535 - DNA, 22 bp, Homo sapiens
cagatggccagaggcagctgca

SEQ ID NO: 8281536 - DNA, 22 bp, Homo sapiens
cagatggctgccaagatgggct

SEQ ID NO: 8281537 - DNA, 22 bp, Homo sapiens
agccctggcagagccaggtagt

SEQ ID NO: 8281538 - DNA, 22 bp, Homo sapiens
agccctggaagccacagtccta

SEQ ID NO: 8281539 - DNA, 22 bp, Homo sapiens
aagcacatgaaaatgtgaagct

SEQ ID NO: 8281540 - DNA, 22 bp, Homo sapiens
acagagcacatagattggagtt

SEQ ID NO: 8281541 - DNA, 22 bp, Homo sapiens
aagcaaacaggagaagagctgt

SEQ ID NO: 8281542 - DNA, 22 bp, Homo sapiens
acagaggacaactaggcgctca

SEQ ID NO: 8281543 - DNA, 22 bp, Homo sapiens
aagatatactattaagtaccat

SEQ ID NO: 8281544 - DNA, 22 bp, Homo sapiens
acagaagacagagtgttcatct

SEQ ID NO: 8281545 - DNA, 22 bp, Homo sapiens
acagaagacagagtgttcatct

SEQ ID NO: 8281546 - DNA, 22 bp, Homo sapiens
acagaagaagttcaaggtgaag

SEQ ID NO: 8281547 - DNA, 22 bp, Homo sapiens
aagatacatcattcaggagtga

SEQ ID NO: 8281548 - DNA, 22 bp, Homo sapiens
acagaagataatgctgccttgg

SEQ ID NO: 8281549 - DNA, 22 bp, Homo sapiens
acagaagataatgctgccttgg

SEQ ID NO: 8281550 - DNA, 22 bp, Homo sapiens
aagcaaaaggttacacttctgg

SEQ ID NO: 8281551 - DNA, 22 bp, Homo sapiens
aagcaaaacgtgctctaggagg

SEQ ID NO: 8281552 - DNA, 22 bp, Homo sapiens
aagagttctcagaaacgtgggt

SEQ ID NO: 8281553 - DNA, 22 bp, Homo sapiens
aagaggtttaactgactcacag

SEQ ID NO: 8281554 - DNA, 22 bp, Homo sapiens
aagaggttgtctgtgatgagtt

SEQ ID NO: 8281555 - DNA, 22 bp, Homo sapiens
aagaggttctccttggagtggg

SEQ ID NO: 8281556 - DNA, 22 bp, Homo sapiens
acacggcactttaggaaggggc

SEQ ID NO: 8281557 - DNA, 22 bp, Homo sapiens
acacccaggctggcgtgcagtg

SEQ ID NO: 8281558 - DNA, 22 bp, Homo sapiens
acacacaggtaaaggagcctgg

SEQ ID NO: 8281559 - DNA, 22 bp, Homo sapiens
acacacagagtttatacaggca

SEQ ID NO: 8281560 - DNA, 22 bp, Homo sapiens
acacacagcgcctaccatgtgc

SEQ ID NO: 8281561 - DNA, 22 bp, Homo sapiens
acacacagcgcctaccatgtgc

SEQ ID NO: 8281562 - DNA, 22 bp, Homo sapiens
acacacagcgcctaccatgtgc

SEQ ID NO: 8281563 - DNA, 22 bp, Homo sapiens
aagaggaggattgatgtgggag

SEQ ID NO: 8281564 - DNA, 22 bp, Homo sapiens
aagaggaagtctccatggagag

SEQ ID NO: 8281565 - DNA, 22 bp, Homo sapiens
aagaggagggcagattcaaggc

SEQ ID NO: 8281566 - DNA, 22 bp, Homo sapiens
aattactgtctgtaaagggaat

SEQ ID NO: 8281567 - DNA, 22 bp, Homo sapiens
aatgtgaactttgtcatgtaac

SEQ ID NO: 8281568 - DNA, 22 bp, Homo sapiens
aatgttaatttactgtcttcat

SEQ ID NO: 8281569 - DNA, 22 bp, Homo sapiens
aatgttaagtttagattataac

SEQ ID NO: 8281570 - DNA, 22 bp, Homo sapiens
aactctatttaccctactaaac

SEQ ID NO: 8281571 - DNA, 22 bp, Homo sapiens
aatgtacaataagacaaagagg

SEQ ID NO: 8281572 - DNA, 22 bp, Homo sapiens
aactgaaacggtgatcttttaa

SEQ ID NO: 8281573 - DNA, 22 bp, Homo sapiens
aatgtattttgggagtttcttt

SEQ ID NO: 8281574 - DNA, 22 bp, Homo sapiens
aatgtatttgatgtattagcct

SEQ ID NO: 8281575 - DNA, 22 bp, Homo sapiens
aagacacagcgaaatgttcctg

SEQ ID NO: 8281576 - DNA, 22 bp, Homo sapiens
aagacacacacatatgctgagt

SEQ ID NO: 8281577 - DNA, 22 bp, Homo sapiens
aagacacaatgtagcccagcac

SEQ ID NO: 8281578 - DNA, 22 bp, Homo sapiens
aagacacacacatatgctgagt

SEQ ID NO: 8281579 - DNA, 22 bp, Homo sapiens
acaactgtcagtaaagaatatt

SEQ ID NO: 8281580 - DNA, 22 bp, Homo sapiens
acaactgatgggtcatgtggga

SEQ ID NO: 8281581 - DNA, 22 bp, Homo sapiens
acaactgttggaggaacacagg

SEQ ID NO: 8281582 - DNA, 22 bp, Homo sapiens
aagacaatgtttctgatagata

SEQ ID NO: 8281583 - DNA, 22 bp, Homo sapiens
aagacaatgcattactaagaag

SEQ ID NO: 8281584 - DNA, 22 bp, Homo sapiens
aagacacaaagcttcccttttc

SEQ ID NO: 8281585 - DNA, 22 bp, Homo sapiens
acaagaaaggtaggattcaggt

SEQ ID NO: 8281586 - DNA, 22 bp, Homo sapiens
aagaattattgcaatactagat

SEQ ID NO: 8281587 - DNA, 22 bp, Homo sapiens
aagaattggtcacatgctacaa

SEQ ID NO: 8281588 - DNA, 22 bp, Homo sapiens
aagaattttccagcatgtcagt

SEQ ID NO: 8281589 - DNA, 22 bp, Homo sapiens
aagacaacagagatgacagact

SEQ ID NO: 8281590 - DNA, 22 bp, Homo sapiens
aagacaaaggggtccttggatg

SEQ ID NO: 8281591 - DNA, 22 bp, Homo sapiens
aattatttaactcctttggaga

SEQ ID NO: 8281592 - DNA, 22 bp, Homo sapiens
aattagcatttcccatataaat

SEQ ID NO: 8281593 - DNA, 22 bp, Homo sapiens
aattagcatttcccatataaat

SEQ ID NO: 8281594 - DNA, 22 bp, Homo sapiens
aattagaagctgttagcaaaat

SEQ ID NO: 8281595 - DNA, 22 bp, Homo sapiens
aagctgatcatccttccaggtt

SEQ ID NO: 8281596 - DNA, 22 bp, Homo sapiens
aagctgtatgttaccactgtca

SEQ ID NO: 8281597 - DNA, 22 bp, Homo sapiens
aagctttgttcttcacagagtg

SEQ ID NO: 8281598 - DNA, 22 bp, Homo sapiens
aagctttgtccaaggccatgca

SEQ ID NO: 8281599 - DNA, 22 bp, Homo sapiens
aagctttgggcagaagaggatt

SEQ ID NO: 8281600 - DNA, 22 bp, Homo sapiens
aagctttgtccaaggccatgca

SEQ ID NO: 8281601 - DNA, 22 bp, Homo sapiens
aagctttgttcttcacagagtg

SEQ ID NO: 8281602 - DNA, 22 bp, Homo sapiens
aagctttgactactgcctcttg

SEQ ID NO: 8281603 - DNA, 22 bp, Homo sapiens
aagctttgactactgcctcttg

SEQ ID NO: 8281604 - DNA, 22 bp, Homo sapiens
aagctttatgatctctcagcta

SEQ ID NO: 8281605 - DNA, 22 bp, Homo sapiens
aagctttggagaggcgggcagg

SEQ ID NO: 8281606 - DNA, 22 bp, Homo sapiens
aagctttgggcagaagaggatt

SEQ ID NO: 8281607 - DNA, 22 bp, Homo sapiens
aagctttggaagggcagggttg

SEQ ID NO: 8281608 - DNA, 22 bp, Homo sapiens
aagctttggaagggcagggttg

SEQ ID NO: 8281609 - DNA, 22 bp, Homo sapiens
aagctttggagaggcgggcagg

SEQ ID NO: 8281610 - DNA, 22 bp, Homo sapiens
aagctttgcaccggtggctgga

SEQ ID NO: 8281611 - DNA, 22 bp, Homo sapiens
aagctttgcaccggtggctgga

SEQ ID NO: 8281612 - DNA, 22 bp, Homo sapiens
aagctttgataattggattact

SEQ ID NO: 8281613 - DNA, 22 bp, Homo sapiens
aagctttgataattggattact

SEQ ID NO: 8281614 - DNA, 22 bp, Homo sapiens
aagctttgcaatgcttcattat

SEQ ID NO: 8281615 - DNA, 22 bp, Homo sapiens
aagctttgcaatgcttcattat

SEQ ID NO: 8281616 - DNA, 22 bp, Homo sapiens
aaggacaggttggggcttcagg

SEQ ID NO: 8281617 - DNA, 22 bp, Homo sapiens
aaggacagggatggttgattgt

SEQ ID NO: 8281618 - DNA, 22 bp, Homo sapiens
aaattagtacattgcaaagtcc

SEQ ID NO: 8281619 - DNA, 22 bp, Homo sapiens
aaattagtcatgttgtattact

SEQ ID NO: 8281620 - DNA, 22 bp, Homo sapiens
aaggagaaggcatcattcaagt

SEQ ID NO: 8281621 - DNA, 22 bp, Homo sapiens
aaattgttgatctacagtaagg

SEQ ID NO: 8281622 - DNA, 22 bp, Homo sapiens
aaatttaaggaggtgctcactt

SEQ ID NO: 8281623 - DNA, 22 bp, Homo sapiens
aaatttaaaaagcagcattgca

SEQ ID NO: 8281624 - DNA, 22 bp, Homo sapiens
aaggagaaatggtagatgtgca

SEQ ID NO: 8281625 - DNA, 22 bp, Homo sapiens
aaggccactgaagaaatcacaa

SEQ ID NO: 8281626 - DNA, 22 bp, Homo sapiens
aaggccacgtctccttccagag

SEQ ID NO: 8281627 - DNA, 22 bp, Homo sapiens
aaggccacagagcctcagagag

SEQ ID NO: 8281628 - DNA, 22 bp, Homo sapiens
aaatttctaagcagccacttcc

SEQ ID NO: 8281629 - DNA, 22 bp, Homo sapiens
aaatttcaagcaaagtagctat

SEQ ID NO: 8281630 - DNA, 22 bp, Homo sapiens
aaatttcagttacctttacgtt

SEQ ID NO: 8281631 - DNA, 22 bp, Homo sapiens
aaatttcagttggaatgagctc

SEQ ID NO: 8281632 - DNA, 22 bp, Homo sapiens
aacaagttgttgaaaataatta

SEQ ID NO: 8281633 - DNA, 22 bp, Homo sapiens
aacaagttgttgaaaataatta

SEQ ID NO: 8281634 - DNA, 22 bp, Homo sapiens
aacaagttgttgaaaataatta

SEQ ID NO: 8281635 - DNA, 22 bp, Homo sapiens
aacaagttctacctcacaaggt

SEQ ID NO: 8281636 - DNA, 22 bp, Homo sapiens
aacaagttctaagtgtctactt

SEQ ID NO: 8281637 - DNA, 22 bp, Homo sapiens
aacaagttactcttaaagtata

SEQ ID NO: 8281638 - DNA, 22 bp, Homo sapiens
aaggggagttagtgataaaacc

SEQ ID NO: 8281639 - DNA, 22 bp, Homo sapiens
aagggagccaagaaagcagggc

SEQ ID NO: 8281640 - DNA, 22 bp, Homo sapiens
aacaatgctgaactgaggaaag

SEQ ID NO: 8281641 - DNA, 22 bp, Homo sapiens
aacaatgcctgatgacctcctg

SEQ ID NO: 8281642 - DNA, 22 bp, Homo sapiens
aacaatgccacattaagtgtat

SEQ ID NO: 8281643 - DNA, 22 bp, Homo sapiens
aacaatgccaacagcatgctgg

SEQ ID NO: 8281644 - DNA, 16 bp, Homo sapiens
aacaatgccaatccag

SEQ ID NO: 8281645 - DNA, 22 bp, Homo sapiens
aacaatgcactatcgtaagtgg

SEQ ID NO: 8281646 - DNA, 22 bp, Homo sapiens
aacaatgcagttaatgggaaga

SEQ ID NO: 8281647 - DNA, 22 bp, Homo sapiens
aagtatgtcaatcatacttcaa

SEQ ID NO: 8281648 - DNA, 22 bp, Homo sapiens
aagtttctgggcaagacaaggc

SEQ ID NO: 8281649 - DNA, 22 bp, Homo sapiens
aagtttctgccatactgtggtg

SEQ ID NO: 8281650 - DNA, 22 bp, Homo sapiens
aagtttctgatattgttaaagc

SEQ ID NO: 8281651 - DNA, 20 bp, Homo sapiens
aagtttctggtttatatctt

SEQ ID NO: 8281652 - DNA, 20 bp, Homo sapiens
aagtttctggtttatatctt

SEQ ID NO: 8281653 - DNA, 22 bp, Homo sapiens
aagtttctgttcatatctctga

SEQ ID NO: 8281654 - DNA, 22 bp, Homo sapiens
aagtttctttattagcttgtcc

SEQ ID NO: 8281655 - DNA, 22 bp, Homo sapiens
aagtttctttattagcttgtcc

SEQ ID NO: 8281656 - DNA, 22 bp, Homo sapiens
aataaaatggtcagttttctca

SEQ ID NO: 8281657 - DNA, 22 bp, Homo sapiens
aagtttggaggtcactggtctt

SEQ ID NO: 8281658 - DNA, 22 bp, Homo sapiens
aataaacttccactgtgttttt

SEQ ID NO: 8281659 - DNA, 22 bp, Homo sapiens
aacagtttgcctgaaatgtatt

SEQ ID NO: 8281660 - DNA, 20 bp, Homo sapiens
aataaactactgagagatgt

SEQ ID NO: 8281661 - DNA, 22 bp, Homo sapiens
aataaactgctcaattgcatca

SEQ ID NO: 8281662 - DNA, 22 bp, Homo sapiens
aagttctggggtaatgagaatt

SEQ ID NO: 8281663 - DNA, 22 bp, Homo sapiens
aacactgcctacactttatgaa

SEQ ID NO: 8281664 - DNA, 22 bp, Homo sapiens
aagtatttctggcctgtgaaag

SEQ ID NO: 8281665 - DNA, 22 bp, Homo sapiens
aagtatttcgttctgaaaaagt

SEQ ID NO: 8281666 - DNA, 22 bp, Homo sapiens
aactcccactcagcttcttaat

SEQ ID NO: 8281667 - DNA, 21 bp, Homo sapiens
aactcccagtgccttcccagc

SEQ ID NO: 8281668 - DNA, 22 bp, Homo sapiens
aaccagtgaaacaccaggcaag

SEQ ID NO: 8281669 - DNA, 22 bp, Homo sapiens
aacattcttaagatttgtgtct

SEQ ID NO: 8281670 - DNA, 22 bp, Homo sapiens
aacattcttcaaatatcactct

SEQ ID NO: 8281671 - DNA, 22 bp, Homo sapiens
aacattctgtcaattgatgacc

SEQ ID NO: 8281672 - DNA, 22 bp, Homo sapiens
aacattctttggaggattattc

SEQ ID NO: 8281673 - DNA, 21 bp, Homo sapiens
aacattggttcaaataaaact

SEQ ID NO: 8281674 - DNA, 20 bp, Homo sapiens
aacattgtttgtaaaagcag

SEQ ID NO: 8281675 - DNA, 22 bp, Homo sapiens
aatatttgaacagtcactgagt

SEQ ID NO: 8281676 - DNA, 22 bp, Homo sapiens
aagagagagttcctaggcaaaa

SEQ ID NO: 8281677 - DNA, 22 bp, Homo sapiens
aagagcagtgttttactcagct

SEQ ID NO: 8281678 - DNA, 22 bp, Homo sapiens
aagacactaagctttcaggata

SEQ ID NO: 8281679 - DNA, 22 bp, Homo sapiens
aagacactgatactctgtgatt

SEQ ID NO: 8281680 - DNA, 22 bp, Homo sapiens
aactttctttgcatctaagttt

SEQ ID NO: 8281681 - DNA, 22 bp, Homo sapiens
aacttgccaagagctttgctag

SEQ ID NO: 8281682 - DNA, 22 bp, Homo sapiens
aagaaaggatatatgggaggta

SEQ ID NO: 8281683 - DNA, 22 bp, Homo sapiens
aagaaagggagaaggatggtgt

SEQ ID NO: 8281684 - DNA, 23 bp, Homo sapiens
aacttttagagtttaacagtgtt

SEQ ID NO: 8281685 - DNA, 22 bp, Homo sapiens
aagaaagggctattgttctcca

SEQ ID NO: 8281686 - DNA, 22 bp, Homo sapiens
aagaaaggtgtgtttgcagatg

SEQ ID NO: 8281687 - DNA, 22 bp, Homo sapiens
aagaaaggtgtgtttgcagatg

SEQ ID NO: 8281688 - DNA, 22 bp, Homo sapiens
aagaaaggtctctgcccgctat

SEQ ID NO: 8281689 - DNA, 22 bp, Homo sapiens
aagaatgagctcaaagatctta

SEQ ID NO: 8281690 - DNA, 22 bp, Homo sapiens
aagcagaactgggaagtagtgg

SEQ ID NO: 8281691 - DNA, 22 bp, Homo sapiens
aagcagcaacaaactggataaa

SEQ ID NO: 8281692 - DNA, 22 bp, Homo sapiens
aagcactttagtgagaataagg

SEQ ID NO: 8281693 - DNA, 22 bp, Homo sapiens
aagcactttatgtcaatgtcct

SEQ ID NO: 8281694 - DNA, 22 bp, Homo sapiens
aagcactggagatgccagagtg

SEQ ID NO: 8281695 - DNA, 22 bp, Homo sapiens
aagcagcagcaggattaaagag

SEQ ID NO: 8281696 - DNA, 22 bp, Homo sapiens
aagcagcacagcaatgactcta

SEQ ID NO: 8281697 - DNA, 22 bp, Homo sapiens
aagcagcacagtaatattggtg

SEQ ID NO: 8281698 - DNA, 22 bp, Homo sapiens
aagcagcagcaggattaaagag

SEQ ID NO: 8281699 - DNA, 22 bp, Homo sapiens
aagccacaatctgcatcagcat

SEQ ID NO: 8281700 - DNA, 22 bp, Homo sapiens
aagccactatggtgattctcaa

SEQ ID NO: 8281701 - DNA, 22 bp, Homo sapiens
aagccactgcggtttcccatcc

SEQ ID NO: 8281702 - DNA, 22 bp, Homo sapiens
aagccagatcaaagtgtccagg

SEQ ID NO: 8281703 - DNA, 22 bp, Homo sapiens
aagcacagctggaacagcagga

SEQ ID NO: 8281704 - DNA, 22 bp, Homo sapiens
aaatatcattctggtgcacaga

SEQ ID NO: 8281705 - DNA, 19 bp, Homo sapiens
aaatatcagagagatgata

SEQ ID NO: 8281706 - DNA, 22 bp, Homo sapiens
aagaggagacttcagcaacttg

SEQ ID NO: 8281707 - DNA, 22 bp, Homo sapiens
aagaggaggacggttcccagaa

SEQ ID NO: 8281708 - DNA, 18 bp, Homo sapiens
aagaggaggagcaggttg

SEQ ID NO: 8281709 - DNA, 22 bp, Homo sapiens
aagcaaaggcaggagcttgtga

SEQ ID NO: 8281710 - DNA, 22 bp, Homo sapiens
aagcaaagagtttagtgggtga

SEQ ID NO: 8281711 - DNA, 22 bp, Homo sapiens
aagcaaatgaaccagaggtaat

SEQ ID NO: 8281712 - DNA, 22 bp, Homo sapiens
aagcaaatatttctagagactg

SEQ ID NO: 8281713 - DNA, 22 bp, Homo sapiens
aagcaaatgtgggtgcagaatt

SEQ ID NO: 8281714 - DNA, 22 bp, Homo sapiens
aagcaaatgtgggtgcagaatt

SEQ ID NO: 8281715 - DNA, 22 bp, Homo sapiens
aactcagcatcagtgtccagaa

SEQ ID NO: 8281716 - DNA, 22 bp, Homo sapiens
aactcaggagaatggagggtat

SEQ ID NO: 8281717 - DNA, 20 bp, Homo sapiens
aactgagagttcaggaggag

SEQ ID NO: 8281718 - DNA, 23 bp, Homo sapiens
aactgagataatgtatgtaaagc

SEQ ID NO: 8281719 - DNA, 22 bp, Homo sapiens
aactgagcccctgcacttgtga

SEQ ID NO: 8281720 - DNA, 22 bp, Homo sapiens
aactcaaagatgcatgacgctt

SEQ ID NO: 8281721 - DNA, 22 bp, Homo sapiens
aacaggaaatacttatgaggta

SEQ ID NO: 8281722 - DNA, 22 bp, Homo sapiens
aacagtaatggcattgccatga

SEQ ID NO: 8281723 - DNA, 22 bp, Homo sapiens
aacagtacaactccacaagact

SEQ ID NO: 8281724 - DNA, 22 bp, Homo sapiens
aacagtaatttgcggtttttgc

SEQ ID NO: 8281725 - DNA, 22 bp, Homo sapiens
aacagtaatgtggtgttgggtt

SEQ ID NO: 8281726 - DNA, 22 bp, Homo sapiens
aacattctactgtactgcattg

SEQ ID NO: 8281727 - DNA, 22 bp, Homo sapiens
aacattctattttgctaaaaca

SEQ ID NO: 8281728 - DNA, 22 bp, Homo sapiens
aacattctatgtgcattcagaa

SEQ ID NO: 8281729 - DNA, 22 bp, Homo sapiens
aacatgcaatgtctgaaaatcc

SEQ ID NO: 8281730 - DNA, 22 bp, Homo sapiens
aacattaattacagtcaaacat

SEQ ID NO: 8281731 - DNA, 21 bp, Homo sapiens
aacacatccagagtatttgac

SEQ ID NO: 8281732 - DNA, 22 bp, Homo sapiens
aacacatatttttgctgagcat

SEQ ID NO: 8281733 - DNA, 22 bp, Homo sapiens
aacacatggcaagagcaggaaa

SEQ ID NO: 8281734 - DNA, 22 bp, Homo sapiens
aacacatggcaagagcaggaaa

SEQ ID NO: 8281735 - DNA, 22 bp, Homo sapiens
aacagctttgagcagttctgta

SEQ ID NO: 8281736 - DNA, 22 bp, Homo sapiens
aacagctttgtatacagtaact

SEQ ID NO: 8281737 - DNA, 22 bp, Homo sapiens
aacacataggcagagcatgaca

SEQ ID NO: 8281738 - DNA, 23 bp, Homo sapiens
aacacaaagctgattccagtggc

SEQ ID NO: 8281739 - DNA, 23 bp, Homo sapiens
aacacaaagctgattccagtggc

SEQ ID NO: 8281740 - DNA, 22 bp, Homo sapiens
aacacaaagaagctgcaggatc

SEQ ID NO: 8281741 - DNA, 22 bp, Homo sapiens
aacacaaagaagctgcaggatc

SEQ ID NO: 8281742 - DNA, 22 bp, Homo sapiens
aacacaaaaattctcaggggca

SEQ ID NO: 8281743 - DNA, 22 bp, Homo sapiens
aacacaaaaattctcaggggca

SEQ ID NO: 8281744 - DNA, 22 bp, Homo sapiens
aacaagagactctgttccagaa

SEQ ID NO: 8281745 - DNA, 22 bp, Homo sapiens
aacaagaataagtggtttctgg

SEQ ID NO: 8281746 - DNA, 22 bp, Homo sapiens
aaatggtatgaaaagagatttc

SEQ ID NO: 8281747 - DNA, 22 bp, Homo sapiens
aaatgggcctggaaagaggatg

SEQ ID NO: 8281748 - DNA, 22 bp, Homo sapiens
aaatggctttgagggtaggaca

SEQ ID NO: 8281749 - DNA, 22 bp, Homo sapiens
aaatggctgcatttgtgtaaat

SEQ ID NO: 8281750 - DNA, 23 bp, Homo sapiens
aaatggcttgccctctcgtttgg

SEQ ID NO: 8281751 - DNA, 16 bp, Homo sapiens
aaatggcttaggctta

SEQ ID NO: 8281752 - DNA, 23 bp, Homo sapiens
aaatggctttagacgtgccttat

SEQ ID NO: 8281753 - DNA, 19 bp, Homo sapiens
aaatggctttctacttaat

SEQ ID NO: 8281754 - DNA, 22 bp, Homo sapiens
aaatggctgactaaattaaatt

SEQ ID NO: 8281755 - DNA, 22 bp, Homo sapiens
aaatggctgacttttcatggga

SEQ ID NO: 8281756 - DNA, 22 bp, Homo sapiens
aaatggctgacttttcatggga

SEQ ID NO: 8281757 - DNA, 22 bp, Homo sapiens
aaatggctccagttgacttttt

SEQ ID NO: 8281758 - DNA, 18 bp, Homo sapiens
aaatggctacctttgtca

SEQ ID NO: 8281759 - DNA, 22 bp, Homo sapiens
aaatggctacaagatgtgctct

SEQ ID NO: 8281760 - DNA, 22 bp, Homo sapiens
aaatggtccatcctaaagaagt

SEQ ID NO: 8281761 - DNA, 22 bp, Homo sapiens
aaagcacagggtgctagagagt

SEQ ID NO: 8281762 - DNA, 22 bp, Homo sapiens
aaagcacaggagagttcagtaa

SEQ ID NO: 8281763 - DNA, 22 bp, Homo sapiens
aaagcacatgagtagtgtagta

SEQ ID NO: 8281764 - DNA, 22 bp, Homo sapiens
aacaacttgcgttcagagatgt

SEQ ID NO: 8281765 - DNA, 22 bp, Homo sapiens
aacaacaacggagaaagggttg

SEQ ID NO: 8281766 - DNA, 22 bp, Homo sapiens
aaacatttttcttcatcatcct

SEQ ID NO: 8281767 - DNA, 22 bp, Homo sapiens
aaacatctgacttgctttttca

SEQ ID NO: 8281768 - DNA, 22 bp, Homo sapiens
aaactttaggaaggaatttaca

SEQ ID NO: 8281769 - DNA, 22 bp, Homo sapiens
aaagaactacctgtatgatatt

SEQ ID NO: 8281770 - DNA, 20 bp, Homo sapiens
aaacttgttggtggatgagg

SEQ ID NO: 8281771 - DNA, 22 bp, Homo sapiens
aaacttgtgagctaaataaatg

SEQ ID NO: 8281772 - DNA, 22 bp, Homo sapiens
aaacttgtcattgtaatggtat

SEQ ID NO: 8281773 - DNA, 22 bp, Homo sapiens
aaacttgtgtatgtatatgcaa

SEQ ID NO: 8281774 - DNA, 22 bp, Homo sapiens
aaacttgtggtggagaagccta

SEQ ID NO: 8281775 - DNA, 23 bp, Homo sapiens
aaacttgttaatgaggcaacagg

SEQ ID NO: 8281776 - DNA, 22 bp, Homo sapiens
aaacttgttctcttgtgcctat

SEQ ID NO: 8281777 - DNA, 22 bp, Homo sapiens
aaacttgttctcatgttgcaga

SEQ ID NO: 8281778 - DNA, 22 bp, Homo sapiens
aaacttcttgctgcattttctg

SEQ ID NO: 8281779 - DNA, 20 bp, Homo sapiens
aaacttgatggcatagaata

SEQ ID NO: 8281780 - DNA, 22 bp, Homo sapiens
aaagaagagctggaaggagtct

SEQ ID NO: 8281781 - DNA, 22 bp, Homo sapiens
aaagagctttagaaatctcaga

SEQ ID NO: 8281782 - DNA, 22 bp, Homo sapiens
aaagaaggatgggagaaatcct

SEQ ID NO: 8281783 - DNA, 22 bp, Homo sapiens
aaagaaggacctggaggaggat

SEQ ID NO: 8281784 - DNA, 22 bp, Homo sapiens
aaagatggcccatgatctcttg

SEQ ID NO: 8281785 - DNA, 22 bp, Homo sapiens
aaacaaatttcaagctgtgaca

SEQ ID NO: 8281786 - DNA, 22 bp, Homo sapiens
aaacaaacataggtttgaaagt

SEQ ID NO: 8281787 - DNA, 22 bp, Homo sapiens
aaacaaacataggtttgaaagt

SEQ ID NO: 8281788 - DNA, 22 bp, Homo sapiens
aaacaaacataggtttgaaagt

SEQ ID NO: 8281789 - DNA, 22 bp, Homo sapiens
aaacaagagcttacatggctgc

SEQ ID NO: 8281790 - DNA, 22 bp, Homo sapiens
aaacacacagaaatgaatgagg

SEQ ID NO: 8281791 - DNA, 22 bp, Homo sapiens
aaacacacagaaatgaatgagg

SEQ ID NO: 8281792 - DNA, 22 bp, Homo sapiens
aaacacacctttggaactgtga

SEQ ID NO: 8281793 - DNA, 22 bp, Homo sapiens
aaacacacctttggaactgtga

SEQ ID NO: 8281794 - DNA, 22 bp, Homo sapiens
aaaagtgatgggatggcacttc

SEQ ID NO: 8281795 - DNA, 22 bp, Homo sapiens
aaaagtgtccagattatgaaga

SEQ ID NO: 8281796 - DNA, 22 bp, Homo sapiens
aaaagtgaggcagcccaaggga

SEQ ID NO: 8281797 - DNA, 22 bp, Homo sapiens
aaaatagcatgaaaggcctttg

SEQ ID NO: 8281798 - DNA, 22 bp, Homo sapiens
aaaaactgtaattacttttgca

SEQ ID NO: 8281799 - DNA, 19 bp, Homo sapiens
aaaaacttagtccagaaag

SEQ ID NO: 8281800 - DNA, 22 bp, Homo sapiens
aaaaagatagcattgtgctcct

SEQ ID NO: 8281801 - DNA, 22 bp, Homo sapiens
aaaaagatgtcctgaagtttag

SEQ ID NO: 8281802 - DNA, 22 bp, Homo sapiens
aaaaatgctgtggtagctgtgt

SEQ ID NO: 8281803 - DNA, 22 bp, Homo sapiens
aaaaatgtgaccacagggtgtt

SEQ ID NO: 8281804 - DNA, 22 bp, Homo sapiens
aaaaggctcttcaaaatggaag

SEQ ID NO: 8281805 - DNA, 22 bp, Homo sapiens
aaaaggcttggaacctttccct

SEQ ID NO: 8281806 - DNA, 23 bp, Homo sapiens
aaagtgcagttgaggaatcatag

SEQ ID NO: 8281807 - DNA, 22 bp, Homo sapiens
aaagtccaattttgttcaggct

SEQ ID NO: 8281808 - DNA, 22 bp, Homo sapiens
aaacactggtatgatgtatagt

SEQ ID NO: 8281809 - DNA, 22 bp, Homo sapiens
aaaggccaccaacatgaagcat

SEQ ID NO: 8281810 - DNA, 22 bp, Homo sapiens
aaaggctagtggattcattgat

SEQ ID NO: 8281811 - DNA, 22 bp, Homo sapiens
aaaggcctgtgcttctaatgtg

SEQ ID NO: 8281812 - DNA, 22 bp, Homo sapiens
aaaggccaataaagacaagctg

SEQ ID NO: 8281813 - DNA, 22 bp, Homo sapiens
aaaggaggaatggagagatgct

SEQ ID NO: 8281814 - DNA, 22 bp, Homo sapiens
aaatgcctgtgtaaattctagc

SEQ ID NO: 8281815 - DNA, 22 bp, Homo sapiens
aaatgcctctgggttattctag

SEQ ID NO: 8281816 - DNA, 22 bp, Homo sapiens
aaatgcctgaatggtatttggt

SEQ ID NO: 8281817 - DNA, 22 bp, Homo sapiens
aaatgcctctgggttattctag

SEQ ID NO: 8281818 - DNA, 22 bp, Homo sapiens
aaatgcctctgctgtacacaat

SEQ ID NO: 8281819 - DNA, 23 bp, Homo sapiens
aaaccttttgtagaacaattgct

SEQ ID NO: 8281820 - DNA, 22 bp, Homo sapiens
aaactaaacctggcttagtaag

SEQ ID NO: 8281821 - DNA, 22 bp, Homo sapiens
aaactaaggtgctgtggactga

SEQ ID NO: 8281822 - DNA, 22 bp, Homo sapiens
aaactaagactaatgaagaact

SEQ ID NO: 8281823 - DNA, 20 bp, Homo sapiens
aaactaaaggtgtttggttt

SEQ ID NO: 8281824 - DNA, 22 bp, Homo sapiens
aagtgacataccttacatatgt

SEQ ID NO: 8281825 - DNA, 22 bp, Homo sapiens
aagtgacaaaagggtatccaaa

SEQ ID NO: 8281826 - DNA, 22 bp, Homo sapiens
aagtgaatgtagcaaacttgaa

SEQ ID NO: 8281827 - DNA, 22 bp, Homo sapiens
aagtgaataaaattgtgttctt

SEQ ID NO: 8281828 - DNA, 22 bp, Homo sapiens
aagtgaatagcctatttactag

SEQ ID NO: 8281829 - DNA, 22 bp, Homo sapiens
acctttatagctgattatgaca

SEQ ID NO: 8281830 - DNA, 22 bp, Homo sapiens
acctttatagcaacctggtgaa

SEQ ID NO: 8281831 - DNA, 22 bp, Homo sapiens
acctttatatatcaacttctcc

SEQ ID NO: 8281832 - DNA, 22 bp, Homo sapiens
acctttatatgaaagatgacat

SEQ ID NO: 8281833 - DNA, 22 bp, Homo sapiens
acctttatcgccatcattgtgc

SEQ ID NO: 8281834 - DNA, 22 bp, Homo sapiens
aagtgatacctaggaaatcaag

SEQ ID NO: 8281835 - DNA, 22 bp, Homo sapiens
aagtgatacatctagtctataa

SEQ ID NO: 8281836 - DNA, 22 bp, Homo sapiens
aagtaacacatgttacttctgc

SEQ ID NO: 8281837 - DNA, 18 bp, Homo sapiens
aagtaacagaagagcaca

SEQ ID NO: 8281838 - DNA, 22 bp, Homo sapiens
acctgcctctaagcagcaggtg

SEQ ID NO: 8281839 - DNA, 22 bp, Homo sapiens
aagtaacagcatcaagtctcaa

SEQ ID NO: 8281840 - DNA, 22 bp, Homo sapiens
aagtaaacattgagagacaaga

SEQ ID NO: 8281841 - DNA, 21 bp, Homo sapiens
aagtaaatcagagaaataacc

SEQ ID NO: 8281842 - DNA, 22 bp, Homo sapiens
aagtaaatcttatgtcagggag

SEQ ID NO: 8281843 - DNA, 21 bp, Homo sapiens
aagtaaatcagagaaataacc

SEQ ID NO: 8281844 - DNA, 22 bp, Homo sapiens
aagtttctgaatttgaaaggat

SEQ ID NO: 8281845 - DNA, 21 bp, Homo sapiens
aagtttctccctaattgttgc

SEQ ID NO: 8281846 - DNA, 22 bp, Homo sapiens
aagtttctcaatggcaactggg

SEQ ID NO: 8281847 - DNA, 22 bp, Homo sapiens
aagtggctttgagcttctgcca

SEQ ID NO: 8281848 - DNA, 22 bp, Homo sapiens
aagtggctaacagtccttgcct

SEQ ID NO: 8281849 - DNA, 22 bp, Homo sapiens
aagtggctcatgtggcttctgc

SEQ ID NO: 8281850 - DNA, 22 bp, Homo sapiens
aagttttaacaagtacttacta

SEQ ID NO: 8281851 - DNA, 22 bp, Homo sapiens
aagttttatgggaagatgtgca

SEQ ID NO: 8281852 - DNA, 22 bp, Homo sapiens
actcatgatatgcctataagat

SEQ ID NO: 8281853 - DNA, 22 bp, Homo sapiens
actcagtatacaccagtatagg

SEQ ID NO: 8281854 - DNA, 22 bp, Homo sapiens
actcagtacatctggagttggc

SEQ ID NO: 8281855 - DNA, 22 bp, Homo sapiens
actgactgtggatggcagcagc

SEQ ID NO: 8281856 - DNA, 22 bp, Homo sapiens
actgactgtcagtggaaggcta

SEQ ID NO: 8281857 - DNA, 22 bp, Homo sapiens
aataaatgttaagattgtctca

SEQ ID NO: 8281858 - DNA, 22 bp, Homo sapiens
aataaatcaatcctattggtag

SEQ ID NO: 8281859 - DNA, 22 bp, Homo sapiens
aataaatgaacaaagcaggttg

SEQ ID NO: 8281860 - DNA, 22 bp, Homo sapiens
aataaagtgtattctttgtcat

SEQ ID NO: 8281861 - DNA, 22 bp, Homo sapiens
agaaactattatggtaaacaaa

SEQ ID NO: 8281862 - DNA, 22 bp, Homo sapiens
agaaactacttggaggaaagat

SEQ ID NO: 8281863 - DNA, 22 bp, Homo sapiens
agaaacctccatttattcactc

SEQ ID NO: 8281864 - DNA, 22 bp, Homo sapiens
aatctgtattgttaacaagtaa

SEQ ID NO: 8281865 - DNA, 22 bp, Homo sapiens
aatctttccctattaaatgtgg

SEQ ID NO: 8281866 - DNA, 22 bp, Homo sapiens
aatctttttcacaagaaagcac

SEQ ID NO: 8281867 - DNA, 22 bp, Homo sapiens
aatcttctttcttaacagtaca

SEQ ID NO: 8281868 - DNA, 22 bp, Homo sapiens
aatcttggaggtgacattccat

SEQ ID NO: 8281869 - DNA, 22 bp, Homo sapiens
aatctttaaggactcagtctct

SEQ ID NO: 8281870 - DNA, 22 bp, Homo sapiens
aatatgcagcatgatgaagtaa

SEQ ID NO: 8281871 - DNA, 22 bp, Homo sapiens
aatatgcagcatgatgaagtaa

SEQ ID NO: 8281872 - DNA, 22 bp, Homo sapiens
aatatggcttgttactatgttt

SEQ ID NO: 8281873 - DNA, 22 bp, Homo sapiens
aatatgtgggtgctaatcaaaa

SEQ ID NO: 8281874 - DNA, 22 bp, Homo sapiens
aatatgttgagtctatctttat

SEQ ID NO: 8281875 - DNA, 22 bp, Homo sapiens
agaaaatattcattgagaggct

SEQ ID NO: 8281876 - DNA, 22 bp, Homo sapiens
agaaaattactccagagacaag

SEQ ID NO: 8281877 - DNA, 22 bp, Homo sapiens
acttccagctgccctgtgtgct

SEQ ID NO: 8281878 - DNA, 22 bp, Homo sapiens
acttccaggaactgccgctaac

SEQ ID NO: 8281879 - DNA, 22 bp, Homo sapiens
aatatgaattattgttacaagt

SEQ ID NO: 8281880 - DNA, 22 bp, Homo sapiens
aatatcagcacttttgtggtat

SEQ ID NO: 8281881 - DNA, 22 bp, Homo sapiens
acttccagtgtctgctgctagc

SEQ ID NO: 8281882 - DNA, 22 bp, Homo sapiens
acttcccaacacttttgagatg

SEQ ID NO: 8281883 - DNA, 22 bp, Homo sapiens
acttcccactgcagtgactgag

SEQ ID NO: 8281884 - DNA, 22 bp, Homo sapiens
acttcccacaccctgttttctc

SEQ ID NO: 8281885 - DNA, 22 bp, Homo sapiens
acttcctgaatggggctaatta

SEQ ID NO: 8281886 - DNA, 22 bp, Homo sapiens
acttcccaggtggtgtggagtt

SEQ ID NO: 8281887 - DNA, 22 bp, Homo sapiens
acttcccatttctctgctttag

SEQ ID NO: 8281888 - DNA, 22 bp, Homo sapiens
accaggcactcctgaggtctga

SEQ ID NO: 8281889 - DNA, 22 bp, Homo sapiens
accaggcagtatggtgctgcaa

SEQ ID NO: 8281890 - DNA, 22 bp, Homo sapiens
aaggttagtaagtatcttatgt

SEQ ID NO: 8281891 - DNA, 22 bp, Homo sapiens
aaggttagttttcaataattac

SEQ ID NO: 8281892 - DNA, 22 bp, Homo sapiens
aaggttagtgcatcttttgttt

SEQ ID NO: 8281893 - DNA, 22 bp, Homo sapiens
aaggttagtaatatttctatat

SEQ ID NO: 8281894 - DNA, 22 bp, Homo sapiens
aaggttgcagcagtgttgatga

SEQ ID NO: 8281895 - DNA, 22 bp, Homo sapiens
aagtaaaagcaggtgtgctggg

SEQ ID NO: 8281896 - DNA, 22 bp, Homo sapiens
accacagtgggccacaagaagt

SEQ ID NO: 8281897 - DNA, 22 bp, Homo sapiens
accaccccagaatttttcaagg

SEQ ID NO: 8281898 - DNA, 22 bp, Homo sapiens
acattcttaacagttaaaaact

SEQ ID NO: 8281899 - DNA, 22 bp, Homo sapiens
acattttgcccttatttgctga

SEQ ID NO: 8281900 - DNA, 22 bp, Homo sapiens
aagggcagctgacagatgctta

SEQ ID NO: 8281901 - DNA, 22 bp, Homo sapiens
accacctcatcaagctggattg

SEQ ID NO: 8281902 - DNA, 17 bp, Homo sapiens
accacctctcaccagca

SEQ ID NO: 8281903 - DNA, 17 bp, Homo sapiens
accacctctcaccagca

SEQ ID NO: 8281904 - DNA, 22 bp, Homo sapiens
aagggcagcctgactcacggtc

SEQ ID NO: 8281905 - DNA, 22 bp, Homo sapiens
aagggcagcctgactcacggtc

SEQ ID NO: 8281906 - DNA, 18 bp, Homo sapiens
acatacattctgtctgca

SEQ ID NO: 8281907 - DNA, 22 bp, Homo sapiens
acatactatgaatacatgtgtc

SEQ ID NO: 8281908 - DNA, 22 bp, Homo sapiens
acatacttagagtaaacaagta

SEQ ID NO: 8281909 - DNA, 22 bp, Homo sapiens
acatacttatgctaaaaatata

SEQ ID NO: 8281910 - DNA, 22 bp, Homo sapiens
acatacttgaagcaagtgatca

SEQ ID NO: 8281911 - DNA, 22 bp, Homo sapiens
acatactttagcactgcattgt

SEQ ID NO: 8281912 - DNA, 17 bp, Homo sapiens
acatgggctgagactcc

SEQ ID NO: 8281913 - DNA, 22 bp, Homo sapiens
acattctcttttagaaagctgt

SEQ ID NO: 8281914 - DNA, 22 bp, Homo sapiens
acattctcttcctaaatatact

SEQ ID NO: 8281915 - DNA, 22 bp, Homo sapiens
acattctctccatgtcttcttt

SEQ ID NO: 8281916 - DNA, 22 bp, Homo sapiens
acattcaaaatatttctgatgt

SEQ ID NO: 8281917 - DNA, 22 bp, Homo sapiens
acattctcatttggtgatcatt

SEQ ID NO: 8281918 - DNA, 22 bp, Homo sapiens
acattctcaaatatttgtggaa

SEQ ID NO: 8281919 - DNA, 21 bp, Homo sapiens
acattataattcatattccac

SEQ ID NO: 8281920 - DNA, 22 bp, Homo sapiens
acattcaaaaagcatctgtcac

SEQ ID NO: 8281921 - DNA, 22 bp, Homo sapiens
aaggccaggcctagcacggagg

SEQ ID NO: 8281922 - DNA, 22 bp, Homo sapiens
aaggccagcttgtagggctggt

SEQ ID NO: 8281923 - DNA, 22 bp, Homo sapiens
aaggccagccttggaaccctga

SEQ ID NO: 8281924 - DNA, 22 bp, Homo sapiens
acaggtagtgggctagatctgg

SEQ ID NO: 8281925 - DNA, 22 bp, Homo sapiens
acaggtgaggatctgagcctca

SEQ ID NO: 8281926 - DNA, 22 bp, Homo sapiens
acaggtgaggatctgagcctca

SEQ ID NO: 8281927 - DNA, 22 bp, Homo sapiens
acaggtgacttgcattttcaca

SEQ ID NO: 8281928 - DNA, 22 bp, Homo sapiens
acaggtgagggagctttgtgcc

SEQ ID NO: 8281929 - DNA, 22 bp, Homo sapiens
acaggtgaggggttctaggctg

SEQ ID NO: 8281930 - DNA, 22 bp, Homo sapiens
acaggtgaagtattacactaag

SEQ ID NO: 8281931 - DNA, 22 bp, Homo sapiens
acaggtgacctgctcatatgaa

SEQ ID NO: 8281932 - DNA, 22 bp, Homo sapiens
acaggtagatacatacttctaa

SEQ ID NO: 8281933 - DNA, 22 bp, Homo sapiens
acaggtagaaattcatctatat

SEQ ID NO: 8281934 - DNA, 23 bp, Homo sapiens
acaggtacacttgattgcaatcc

SEQ ID NO: 8281935 - DNA, 22 bp, Homo sapiens
acagggttttttatgagaacag

SEQ ID NO: 8281936 - DNA, 22 bp, Homo sapiens
acaggcttttacggatatcttt

SEQ ID NO: 8281937 - DNA, 23 bp, Homo sapiens
acaggctcttaatcagtgctcct

SEQ ID NO: 8281938 - DNA, 22 bp, Homo sapiens
acaggctgagcgtccatcttca

SEQ ID NO: 8281939 - DNA, 22 bp, Homo sapiens
acagtggtaggataactgtttt

SEQ ID NO: 8281940 - DNA, 22 bp, Homo sapiens
acaggtgatgacatttgaacca

SEQ ID NO: 8281941 - DNA, 22 bp, Homo sapiens
acaggtgatgacatttgaacca

SEQ ID NO: 8281942 - DNA, 22 bp, Homo sapiens
acaggtgataagaaaactcgct

SEQ ID NO: 8281943 - DNA, 18 bp, Homo sapiens
acaggtgatatcttgaga

SEQ ID NO: 8281944 - DNA, 22 bp, Homo sapiens
acaggtgattcaggctctggga

SEQ ID NO: 8281945 - DNA, 22 bp, Homo sapiens
acaggtgattcaggctctggga

SEQ ID NO: 8281946 - DNA, 22 bp, Homo sapiens
acagtgcagtgtgatgagtatt

SEQ ID NO: 8281947 - DNA, 22 bp, Homo sapiens
acaggagccaaacacatgccag

SEQ ID NO: 8281948 - DNA, 22 bp, Homo sapiens
aagccctgataggaaaatgctg

SEQ ID NO: 8281949 - DNA, 22 bp, Homo sapiens
aagccctgagcactgcagagaa

SEQ ID NO: 8281950 - DNA, 22 bp, Homo sapiens
aagccctgactatgaagacata

SEQ ID NO: 8281951 - DNA, 22 bp, Homo sapiens
aagccctggattaaagatgcca

SEQ ID NO: 8281952 - DNA, 22 bp, Homo sapiens
aagccctggatagagagaactg

SEQ ID NO: 8281953 - DNA, 22 bp, Homo sapiens
aagccctggcaatgtcagatga

SEQ ID NO: 8281954 - DNA, 22 bp, Homo sapiens
acagcttttatgggaccagcca

SEQ ID NO: 8281955 - DNA, 22 bp, Homo sapiens
acagctttgggcaatgctatga

SEQ ID NO: 8281956 - DNA, 22 bp, Homo sapiens
acagctttgttttccctgctga

SEQ ID NO: 8281957 - DNA, 22 bp, Homo sapiens
acagctttgtgttaatgggaag

SEQ ID NO: 8281958 - DNA, 22 bp, Homo sapiens
acagctttagtgtgggtggtgc

SEQ ID NO: 8281959 - DNA, 22 bp, Homo sapiens
acagctttatctcagggatcag

SEQ ID NO: 8281960 - DNA, 22 bp, Homo sapiens
acagctttgggcaatgctatga

SEQ ID NO: 8281961 - DNA, 22 bp, Homo sapiens
acagcttgtctaccccagaggt

SEQ ID NO: 8281962 - DNA, 22 bp, Homo sapiens
acagcttgtatcccaatggagc

SEQ ID NO: 8281963 - DNA, 22 bp, Homo sapiens
acagcttgggatgctttatttc

SEQ ID NO: 8281964 - DNA, 23 bp, Homo sapiens
acagcttgccaattagccttccg

SEQ ID NO: 8281965 - DNA, 22 bp, Homo sapiens
acagcttgtagaggccctggca

SEQ ID NO: 8281966 - DNA, 22 bp, Homo sapiens
acagcttggggaggccctggga

SEQ ID NO: 8281967 - DNA, 22 bp, Homo sapiens
acagcttttctgatagatcctg

SEQ ID NO: 8281968 - DNA, 22 bp, Homo sapiens
acagcttttgaaaaattactgg

SEQ ID NO: 8281969 - DNA, 22 bp, Homo sapiens
acagcttttcaattctgctgag

SEQ ID NO: 8281970 - DNA, 22 bp, Homo sapiens
acagcttttgaaaaattactgg

SEQ ID NO: 8281971 - DNA, 22 bp, Homo sapiens
acagctttttactaatagattg

SEQ ID NO: 8281972 - DNA, 22 bp, Homo sapiens
acagctttttactaatagattg

SEQ ID NO: 8281973 - DNA, 22 bp, Homo sapiens
acagatttttggtaaataattt

SEQ ID NO: 8281974 - DNA, 22 bp, Homo sapiens
acagcttgcatgcagaggcact

SEQ ID NO: 8281975 - DNA, 22 bp, Homo sapiens
acagcttgcacaagggaactca

SEQ ID NO: 8281976 - DNA, 22 bp, Homo sapiens
acagattttattattcaggtat

SEQ ID NO: 8281977 - DNA, 22 bp, Homo sapiens
acagattttattattcaggtat

SEQ ID NO: 8281978 - DNA, 18 bp, Homo sapiens
agagagaattccagtagg

SEQ ID NO: 8281979 - DNA, 22 bp, Homo sapiens
agagagaattggataaattggt

SEQ ID NO: 8281980 - DNA, 20 bp, Homo sapiens
agagagacctaggcctagtc

SEQ ID NO: 8281981 - DNA, 22 bp, Homo sapiens
agagacagggttttgccatgtt

SEQ ID NO: 8281982 - DNA, 21 bp, Homo sapiens
agagaaagtcatggctgtggc

SEQ ID NO: 8281983 - DNA, 22 bp, Homo sapiens
agagaaatagattggtccagaa

SEQ ID NO: 8281984 - DNA, 22 bp, Homo sapiens
agagaaagtcctgatctctcta

SEQ ID NO: 8281985 - DNA, 22 bp, Homo sapiens
agagagacgggggctgctgctt

SEQ ID NO: 8281986 - DNA, 22 bp, Homo sapiens
agagagagaaatgaaatgtgct

SEQ ID NO: 8281987 - DNA, 17 bp, Homo sapiens
agagagagcatgccacc

SEQ ID NO: 8281988 - DNA, 20 bp, Homo sapiens
agagagaggtaaattgagca

SEQ ID NO: 8281989 - DNA, 22 bp, Homo sapiens
agagagaggggcgagcaaacac

SEQ ID NO: 8281990 - DNA, 22 bp, Homo sapiens
agagagagggaaactgctaaac

SEQ ID NO: 8281991 - DNA, 22 bp, Homo sapiens
agagagcagtctggaagaaaca

SEQ ID NO: 8281992 - DNA, 20 bp, Homo sapiens
agagagttgtcagtagcttc

SEQ ID NO: 8281993 - DNA, 22 bp, Homo sapiens
agagagcaggacttcactgagc

SEQ ID NO: 8281994 - DNA, 23 bp, Homo sapiens
agagagagtttgtgtcaggtacc

SEQ ID NO: 8281995 - DNA, 22 bp, Homo sapiens
agagaaacaggtcagctgggag

SEQ ID NO: 8281996 - DNA, 22 bp, Homo sapiens
agactggggttctggcaaggag

SEQ ID NO: 8281997 - DNA, 18 bp, Homo sapiens
agagaaagaccaaagcat

SEQ ID NO: 8281998 - DNA, 22 bp, Homo sapiens
agactgcatattgtcctttaga

SEQ ID NO: 8281999 - DNA, 22 bp, Homo sapiens
agactgcatattgtcctttaga

SEQ ID NO: 8282000 - DNA, 22 bp, Homo sapiens
aatgtataaccataggaaattt

SEQ ID NO: 8282001 - DNA, 22 bp, Homo sapiens
aatgtataaagtgttaataact

SEQ ID NO: 8282002 - DNA, 22 bp, Homo sapiens
aatgtacatctcagtgtagtac

SEQ ID NO: 8282003 - DNA, 22 bp, Homo sapiens
aatgtacaggctggctatgggg

SEQ ID NO: 8282004 - DNA, 22 bp, Homo sapiens
aatgtacagctgtctttcctcc

SEQ ID NO: 8282005 - DNA, 22 bp, Homo sapiens
aatgtacagctgctgctgaagg

SEQ ID NO: 8282006 - DNA, 22 bp, Homo sapiens
aatgtacagctgctgctgaagg

SEQ ID NO: 8282007 - DNA, 22 bp, Homo sapiens
aatgtacactgaaagcctatca

SEQ ID NO: 8282008 - DNA, 22 bp, Homo sapiens
aatgtacagctgtctttcctcc

SEQ ID NO: 8282009 - DNA, 23 bp, Homo sapiens
agacaaaagcctcagtcttaggc

SEQ ID NO: 8282010 - DNA, 22 bp, Homo sapiens
aatgtacaccgtgggtttttta

SEQ ID NO: 8282011 - DNA, 22 bp, Homo sapiens
agaatttttgattatctactcg

SEQ ID NO: 8282012 - DNA, 22 bp, Homo sapiens
agaatcctggccaggtcagagc

SEQ ID NO: 8282013 - DNA, 22 bp, Homo sapiens
agaatccttgactcaggctgag

SEQ ID NO: 8282014 - DNA, 22 bp, Homo sapiens
agaatcctgttttacttcatca

SEQ ID NO: 8282015 - DNA, 22 bp, Homo sapiens
agaatcctgatgaaaaggagag

SEQ ID NO: 8282016 - DNA, 22 bp, Homo sapiens
agaatcctcttcagtaaattct

SEQ ID NO: 8282017 - DNA, 22 bp, Homo sapiens
agaatcctggagaagctgtacc

SEQ ID NO: 8282018 - DNA, 22 bp, Homo sapiens
agaatcctattgtcagattctt

SEQ ID NO: 8282019 - DNA, 22 bp, Homo sapiens
aatgctttgactatatctataa

SEQ ID NO: 8282020 - DNA, 22 bp, Homo sapiens
aatggaatgcctcacatgtatt

SEQ ID NO: 8282021 - DNA, 22 bp, Homo sapiens
aatggaacttgtaattatgtcc

SEQ ID NO: 8282022 - DNA, 18 bp, Homo sapiens
aatggaaggggtgctgtt

SEQ ID NO: 8282023 - DNA, 19 bp, Homo sapiens
agaatcaggtcaggtgaca

SEQ ID NO: 8282024 - DNA, 22 bp, Homo sapiens
agaatcaggacctgtggctgtc

SEQ ID NO: 8282025 - DNA, 22 bp, Homo sapiens
agaataaatgctacctatcaca

SEQ ID NO: 8282026 - DNA, 22 bp, Homo sapiens
agatgggtaattgatggcagta

SEQ ID NO: 8282027 - DNA, 21 bp, Homo sapiens
agattacaggtgtgatccacc

SEQ ID NO: 8282028 - DNA, 22 bp, Homo sapiens
agatcggctttgcagacctcat

SEQ ID NO: 8282029 - DNA, 22 bp, Homo sapiens
agagtaatattctccgaggtga

SEQ ID NO: 8282030 - DNA, 22 bp, Homo sapiens
agaggggttatgcttgacattt

SEQ ID NO: 8282031 - DNA, 22 bp, Homo sapiens
agaggggttaagtgctagtccg

SEQ ID NO: 8282032 - DNA, 22 bp, Homo sapiens
agaggggttaagtgctagtccg

SEQ ID NO: 8282033 - DNA, 22 bp, Homo sapiens
acaaaaaccgtggattcagcat

SEQ ID NO: 8282034 - DNA, 22 bp, Homo sapiens
agatataataatttacaagtgt

SEQ ID NO: 8282035 - DNA, 22 bp, Homo sapiens
agagtctgggcactgggaatgc

SEQ ID NO: 8282036 - DNA, 22 bp, Homo sapiens
agagtaatttttggacaatgcc

SEQ ID NO: 8282037 - DNA, 22 bp, Homo sapiens
agagtaatgaacacattccaca

SEQ ID NO: 8282038 - DNA, 23 bp, Homo sapiens
agagtaatgtttttactgtattc

SEQ ID NO: 8282039 - DNA, 22 bp, Homo sapiens
agagtaatttctgctgaaaagg

SEQ ID NO: 8282040 - DNA, 21 bp, Homo sapiens
agagtaattcctgctggaaag

SEQ ID NO: 8282041 - DNA, 21 bp, Homo sapiens
agagtctgcatttctgacaag

SEQ ID NO: 8282042 - DNA, 22 bp, Homo sapiens
aattcacatatacattattcct

SEQ ID NO: 8282043 - DNA, 22 bp, Homo sapiens
aattcacaggaggtatttgtcc

SEQ ID NO: 8282044 - DNA, 22 bp, Homo sapiens
aattcacatgcatgtctgtgca

SEQ ID NO: 8282045 - DNA, 22 bp, Homo sapiens
aattcactgttccttctgcttt

SEQ ID NO: 8282046 - DNA, 22 bp, Homo sapiens
aattcactgaacttctctgaga

SEQ ID NO: 8282047 - DNA, 22 bp, Homo sapiens
agagcagctcgctacctctcta

SEQ ID NO: 8282048 - DNA, 22 bp, Homo sapiens
aattcagttgtgtctgacctcg

SEQ ID NO: 8282049 - DNA, 22 bp, Homo sapiens
aattcagtggtttctgcaacaa

SEQ ID NO: 8282050 - DNA, 22 bp, Homo sapiens
aattcagttatatgtccacttc

SEQ ID NO: 8282051 - DNA, 23 bp, Homo sapiens
agaggccaacttcttgcccctcc

SEQ ID NO: 8282052 - DNA, 22 bp, Homo sapiens
agaggccaaagaatctacaaga

SEQ ID NO: 8282053 - DNA, 23 bp, Homo sapiens
agaggccaacttcttgcccctcc

SEQ ID NO: 8282054 - DNA, 22 bp, Homo sapiens
agaggccaagccagactgtgca

SEQ ID NO: 8282055 - DNA, 22 bp, Homo sapiens
agagcagctggggcagagacca

SEQ ID NO: 8282056 - DNA, 21 bp, Homo sapiens
agagggcgaaggcggggtccg

SEQ ID NO: 8282057 - DNA, 22 bp, Homo sapiens
agagggctaactgggaagcagg

SEQ ID NO: 8282058 - DNA, 22 bp, Homo sapiens
agagggcataaaatagagcacg

SEQ ID NO: 8282059 - DNA, 22 bp, Homo sapiens
agagggcatgcttggtggcctg

SEQ ID NO: 8282060 - DNA, 22 bp, Homo sapiens
agagggccataggtgcatagtt

SEQ ID NO: 8282061 - DNA, 22 bp, Homo sapiens
agagggcattaactctgtcttg

SEQ ID NO: 8282062 - DNA, 22 bp, Homo sapiens
aattttgtgtgggatcaaagga

SEQ ID NO: 8282063 - DNA, 21 bp, Homo sapiens
aattttgaaggaagattaagg

SEQ ID NO: 8282064 - DNA, 17 bp, Homo sapiens
agagggctcaaggcatc

SEQ ID NO: 8282065 - DNA, 22 bp, Homo sapiens
aattttctggtgtgtaatgaag

SEQ ID NO: 8282066 - DNA, 22 bp, Homo sapiens
agctcaggtcattccagggatg

SEQ ID NO: 8282067 - DNA, 22 bp, Homo sapiens
agctcatggtgctatctcaggg

SEQ ID NO: 8282068 - DNA, 22 bp, Homo sapiens
agctcaggctctgcagggacta

SEQ ID NO: 8282069 - DNA, 22 bp, Homo sapiens
agctcaggctctgcagggacta

SEQ ID NO: 8282070 - DNA, 22 bp, Homo sapiens
agctcaagctacacacagagtc

SEQ ID NO: 8282071 - DNA, 23 bp, Homo sapiens
agctcaaggcagtccacatttcc

SEQ ID NO: 8282072 - DNA, 22 bp, Homo sapiens
agctcaagctacacacagagtc

SEQ ID NO: 8282073 - DNA, 22 bp, Homo sapiens
agctcaagtgcaagcattctat

SEQ ID NO: 8282074 - DNA, 22 bp, Homo sapiens
agctcaagtatttgggatttgt

SEQ ID NO: 8282075 - DNA, 22 bp, Homo sapiens
agctcaagtgcagttgggggat

SEQ ID NO: 8282076 - DNA, 22 bp, Homo sapiens
agctcaggccggagctacaggc

SEQ ID NO: 8282077 - DNA, 22 bp, Homo sapiens
agctcaggccggagctacaggc

SEQ ID NO: 8282078 - DNA, 22 bp, Homo sapiens
agctcaagttcttttaccatat

SEQ ID NO: 8282079 - DNA, 22 bp, Homo sapiens
agcctgtgtgctttggacaggg

SEQ ID NO: 8282080 - DNA, 22 bp, Homo sapiens
agcctgtggaaactgggtgcag

SEQ ID NO: 8282081 - DNA, 22 bp, Homo sapiens
agcctgtgagggatgctgcagt

SEQ ID NO: 8282082 - DNA, 22 bp, Homo sapiens
agcctgtggatccctgcactgg

SEQ ID NO: 8282083 - DNA, 22 bp, Homo sapiens
agcctgtgtcctcatctgcagc

SEQ ID NO: 8282084 - DNA, 22 bp, Homo sapiens
agcctgtgtgaagccctcagag

SEQ ID NO: 8282085 - DNA, 22 bp, Homo sapiens
agcctgtctgtctccaaagctg

SEQ ID NO: 8282086 - DNA, 22 bp, Homo sapiens
agcctgtgaaatctctgccact

SEQ ID NO: 8282087 - DNA, 22 bp, Homo sapiens
agccctggggtgcagaaccatg

SEQ ID NO: 8282088 - DNA, 22 bp, Homo sapiens
agccctgtagatttaggagagt

SEQ ID NO: 8282089 - DNA, 22 bp, Homo sapiens
agccctggtagcctgctgccat

SEQ ID NO: 8282090 - DNA, 22 bp, Homo sapiens
agcccaggtctggcccagcctg

SEQ ID NO: 8282091 - DNA, 22 bp, Homo sapiens
agcccaggttctaaagccaaac

SEQ ID NO: 8282092 - DNA, 22 bp, Homo sapiens
agcccaggtggagtgtgtgggg

SEQ ID NO: 8282093 - DNA, 21 bp, Homo sapiens
acagacagggccagtgtcccc

SEQ ID NO: 8282094 - DNA, 21 bp, Homo sapiens
acagacagggccagtgtcccc

SEQ ID NO: 8282095 - DNA, 21 bp, Homo sapiens
acagacagtccagagaaaaga

SEQ ID NO: 8282096 - DNA, 22 bp, Homo sapiens
acagaacaggctgagaaaaaca

SEQ ID NO: 8282097 - DNA, 20 bp, Homo sapiens
acagaactgagaacagtctc

SEQ ID NO: 8282098 - DNA, 18 bp, Homo sapiens
acagaactgagatttgag

SEQ ID NO: 8282099 - DNA, 22 bp, Homo sapiens
acagaactgggaaatgcacata

SEQ ID NO: 8282100 - DNA, 22 bp, Homo sapiens
acagaactgcaggaggaaaagc

SEQ ID NO: 8282101 - DNA, 22 bp, Homo sapiens
acagaactgtgatctcataaat

SEQ ID NO: 8282102 - DNA, 22 bp, Homo sapiens
acagaactgtgtgatgattaag

SEQ ID NO: 8282103 - DNA, 22 bp, Homo sapiens
acagaacttcagtagtattccc

SEQ ID NO: 8282104 - DNA, 22 bp, Homo sapiens
acagaactgggggcacagatag

SEQ ID NO: 8282105 - DNA, 22 bp, Homo sapiens
agcattggtggccagagtgcct

SEQ ID NO: 8282106 - DNA, 22 bp, Homo sapiens
agcattgcctgcctattgctaa

SEQ ID NO: 8282107 - DNA, 22 bp, Homo sapiens
agcatttaatcctacatagatc

SEQ ID NO: 8282108 - DNA, 22 bp, Homo sapiens
agccaggaatgcatgctctgct

SEQ ID NO: 8282109 - DNA, 22 bp, Homo sapiens
agccaggacagggcagctcgct

SEQ ID NO: 8282110 - DNA, 22 bp, Homo sapiens
agccaggacagggcagctcgct

SEQ ID NO: 8282111 - DNA, 20 bp, Homo sapiens
agccaggctcaagctccccc

SEQ ID NO: 8282112 - DNA, 22 bp, Homo sapiens
agccaggctcaaggcctgctcc

SEQ ID NO: 8282113 - DNA, 22 bp, Homo sapiens
agccaggctaaatgagccatga

SEQ ID NO: 8282114 - DNA, 22 bp, Homo sapiens
agccaggctactccttgctgac

SEQ ID NO: 8282115 - DNA, 22 bp, Homo sapiens
agcatctgcttaatggcttaac

SEQ ID NO: 8282116 - DNA, 22 bp, Homo sapiens
agcatctggtgagggcctagtt

SEQ ID NO: 8282117 - DNA, 22 bp, Homo sapiens
agcatctgttaagtgccttcaa

SEQ ID NO: 8282118 - DNA, 22 bp, Homo sapiens
agcatctgcataatgccttccc

SEQ ID NO: 8282119 - DNA, 22 bp, Homo sapiens
agcattccacactgaagtctgc

SEQ ID NO: 8282120 - DNA, 22 bp, Homo sapiens
acacactgttgctcatccaggc

SEQ ID NO: 8282121 - DNA, 22 bp, Homo sapiens
acacactgtaaggactatcact

SEQ ID NO: 8282122 - DNA, 22 bp, Homo sapiens
agcagcagttgctgacgttcta

SEQ ID NO: 8282123 - DNA, 22 bp, Homo sapiens
agcagcagttgctgacgttcta

SEQ ID NO: 8282124 - DNA, 22 bp, Homo sapiens
agcagccaggaatctgcagagc

SEQ ID NO: 8282125 - DNA, 22 bp, Homo sapiens
agcagcagattatggtctacat

SEQ ID NO: 8282126 - DNA, 22 bp, Homo sapiens
agcagcagattcagcaggaatg

SEQ ID NO: 8282127 - DNA, 22 bp, Homo sapiens
agcagcaactgctagagtggca

SEQ ID NO: 8282128 - DNA, 23 bp, Homo sapiens
agcagcagcaattaagtggatat

SEQ ID NO: 8282129 - DNA, 21 bp, Homo sapiens
agcagcagcagtggggcttct

SEQ ID NO: 8282130 - DNA, 21 bp, Homo sapiens
agcagcagcagtggggcttct

SEQ ID NO: 8282131 - DNA, 22 bp, Homo sapiens
agcagcagcattgagcgcttgt

SEQ ID NO: 8282132 - DNA, 22 bp, Homo sapiens
acacactggaggtaaatggggt

SEQ ID NO: 8282133 - DNA, 22 bp, Homo sapiens
acacactgctcgctcagattaa

SEQ ID NO: 8282134 - DNA, 22 bp, Homo sapiens
agcacttctcatgggatcaggt

SEQ ID NO: 8282135 - DNA, 22 bp, Homo sapiens
acacactcaattgcataagcac

SEQ ID NO: 8282136 - DNA, 21 bp, Homo sapiens
acacactctgagtcttctatt

SEQ ID NO: 8282137 - DNA, 22 bp, Homo sapiens
acacacatggtattgttcagaa

SEQ ID NO: 8282138 - DNA, 22 bp, Homo sapiens
acacacatggtattgttcagaa

SEQ ID NO: 8282139 - DNA, 22 bp, Homo sapiens
acacacatggtattgttcagaa

SEQ ID NO: 8282140 - DNA, 22 bp, Homo sapiens
agatttgttgtgagcaggaata

SEQ ID NO: 8282141 - DNA, 22 bp, Homo sapiens
agatttgcggctttactttgca

SEQ ID NO: 8282142 - DNA, 22 bp, Homo sapiens
agatttgatatcatgcaacaaa

SEQ ID NO: 8282143 - DNA, 21 bp, Homo sapiens
agcaggaggcagtcacagctc

SEQ ID NO: 8282144 - DNA, 22 bp, Homo sapiens
agcaggagctgtgggaagatgg

SEQ ID NO: 8282145 - DNA, 22 bp, Homo sapiens
agcaggagctgtgggaagatgg

SEQ ID NO: 8282146 - DNA, 22 bp, Homo sapiens
agcaggagcccttatcaccagg

SEQ ID NO: 8282147 - DNA, 22 bp, Homo sapiens
agcaggagggttttgtagagtc

SEQ ID NO: 8282148 - DNA, 22 bp, Homo sapiens
agcaggagggttttgtagagtc

SEQ ID NO: 8282149 - DNA, 22 bp, Homo sapiens
agcaggagggttttgtagagtc

SEQ ID NO: 8282150 - DNA, 21 bp, Homo sapiens
agcaggaggcagtcacagctc

SEQ ID NO: 8282151 - DNA, 21 bp, Homo sapiens
agcagccatttcacagagact

SEQ ID NO: 8282152 - DNA, 23 bp, Homo sapiens
agcagccatagggaagcaataca

SEQ ID NO: 8282153 - DNA, 17 bp, Homo sapiens
agcagctgaagcagcca

SEQ ID NO: 8282154 - DNA, 23 bp, Homo sapiens
agcaggcatctgtggcacaaggc

SEQ ID NO: 8282155 - DNA, 22 bp, Homo sapiens
agcagggctgtgtaggtaatga

SEQ ID NO: 8282156 - DNA, 20 bp, Homo sapiens
agcaggtgacggggcctgct

SEQ ID NO: 8282157 - DNA, 20 bp, Homo sapiens
agcaggtgacggggcctgct

SEQ ID NO: 8282158 - DNA, 22 bp, Homo sapiens
agcaggtgagcacagccaggct

SEQ ID NO: 8282159 - DNA, 22 bp, Homo sapiens
agcagggctttggctggctttc

SEQ ID NO: 8282160 - DNA, 22 bp, Homo sapiens
agcaggtgacccaagcaggctg

SEQ ID NO: 8282161 - DNA, 22 bp, Homo sapiens
agcaggtgacagggctgtggtg

SEQ ID NO: 8282162 - DNA, 22 bp, Homo sapiens
tcctcatctcggaacctgccac

SEQ ID NO: 8282163 - DNA, 22 bp, Homo sapiens
tcctccagcaggactgaggccc

SEQ ID NO: 8282164 - DNA, 23 bp, Homo sapiens
tcctccagaggccctccttggcc

SEQ ID NO: 8282165 - DNA, 22 bp, Homo sapiens
tcctccagaccacttctgtgcg

SEQ ID NO: 8282166 - DNA, 22 bp, Homo sapiens
tcctccaggataaaatgtgttg

SEQ ID NO: 8282167 - DNA, 22 bp, Homo sapiens
tcctccagggggatcttcagcc

SEQ ID NO: 8282168 - DNA, 22 bp, Homo sapiens
tcctccagctgtatcctgcctg

SEQ ID NO: 8282169 - DNA, 23 bp, Homo sapiens
tcctcctgagtgagagtgccagc

SEQ ID NO: 8282170 - DNA, 22 bp, Homo sapiens
tcctcctgctgttagtcttgaa

SEQ ID NO: 8282171 - DNA, 22 bp, Homo sapiens
tcctccagttccttggtttcag

SEQ ID NO: 8282172 - DNA, 22 bp, Homo sapiens
tcctccagtggtactggccaat

SEQ ID NO: 8282173 - DNA, 22 bp, Homo sapiens
tcctccagtgtctggggccttg

SEQ ID NO: 8282174 - DNA, 22 bp, Homo sapiens
tcctccagtggcccagtccttc

SEQ ID NO: 8282175 - DNA, 22 bp, Homo sapiens
tcctccaggtctagggtggctt

SEQ ID NO: 8282176 - DNA, 22 bp, Homo sapiens
tcccttctggcagcagtgtgag

SEQ ID NO: 8282177 - DNA, 22 bp, Homo sapiens
tccctgcatttgggagagtgtc

SEQ ID NO: 8282178 - DNA, 22 bp, Homo sapiens
tccctgccctcagtgcacccgg

SEQ ID NO: 8282179 - DNA, 22 bp, Homo sapiens
tccctgcagacgtcctgcgggt

SEQ ID NO: 8282180 - DNA, 22 bp, Homo sapiens
tccctgcagcccctgagccttc

SEQ ID NO: 8282181 - DNA, 22 bp, Homo sapiens
tccctgcaggtgtgcaagctga

SEQ ID NO: 8282182 - DNA, 22 bp, Homo sapiens
tccctgcaggtggggtggccag

SEQ ID NO: 8282183 - DNA, 22 bp, Homo sapiens
tccctgcagtaggcagccctcc

SEQ ID NO: 8282184 - DNA, 22 bp, Homo sapiens
tccctgcagtagtggctaagat

SEQ ID NO: 8282185 - DNA, 22 bp, Homo sapiens
tccctgcacccttgctgggccc

SEQ ID NO: 8282186 - DNA, 22 bp, Homo sapiens
tcccaggcaaaggcagctcatt

SEQ ID NO: 8282187 - DNA, 22 bp, Homo sapiens
tcccaggattttaggctctcag

SEQ ID NO: 8282188 - DNA, 19 bp, Homo sapiens
tcccaggcaaaggcttctc

SEQ ID NO: 8282189 - DNA, 21 bp, Homo sapiens
tccaggacttgagaattccag

SEQ ID NO: 8282190 - DNA, 22 bp, Homo sapiens
tccaggacctcccaggctagag

SEQ ID NO: 8282191 - DNA, 22 bp, Homo sapiens
tccaggacctcccaggctagag

SEQ ID NO: 8282192 - DNA, 20 bp, Homo sapiens
tccaggagaactgggagccg

SEQ ID NO: 8282193 - DNA, 22 bp, Homo sapiens
tccaggagaaggccatccagcg

SEQ ID NO: 8282194 - DNA, 20 bp, Homo sapiens
tccagccctgcttctctctt

SEQ ID NO: 8282195 - DNA, 22 bp, Homo sapiens
tccagccctgcttcctgcctca

SEQ ID NO: 8282196 - DNA, 22 bp, Homo sapiens
tccagccctcctgggatcacag

SEQ ID NO: 8282197 - DNA, 22 bp, Homo sapiens
tccagccctcagccaagtggaa

SEQ ID NO: 8282198 - DNA, 22 bp, Homo sapiens
tccagcccgggggcaggtgacc

SEQ ID NO: 8282199 - DNA, 20 bp, Homo sapiens
tccagcccctgcatgttgct

SEQ ID NO: 8282200 - DNA, 20 bp, Homo sapiens
tccagcccaggtcctgcctg

SEQ ID NO: 8282201 - DNA, 22 bp, Homo sapiens
tccagccactcagcagggattg

SEQ ID NO: 8282202 - DNA, 22 bp, Homo sapiens
tccagcccaggctggagtgtag

SEQ ID NO: 8282203 - DNA, 19 bp, Homo sapiens
tccagcccctctgtgtgtg

SEQ ID NO: 8282204 - DNA, 22 bp, Homo sapiens
tccagcccatccctagcctggg

SEQ ID NO: 8282205 - DNA, 22 bp, Homo sapiens
tccacagaatggaattctccgc

SEQ ID NO: 8282206 - DNA, 22 bp, Homo sapiens
tccacagaatgtaagatccaca

SEQ ID NO: 8282207 - DNA, 22 bp, Homo sapiens
tcattaatttgcttagacttat

SEQ ID NO: 8282208 - DNA, 22 bp, Homo sapiens
tccacagcacaaagccagtgtg

SEQ ID NO: 8282209 - DNA, 22 bp, Homo sapiens
tccacagattaaaaacatactt

SEQ ID NO: 8282210 - DNA, 22 bp, Homo sapiens
tcatgtttttgccatatgactc

SEQ ID NO: 8282211 - DNA, 22 bp, Homo sapiens
tcatgttttagtaaagtgaagg

SEQ ID NO: 8282212 - DNA, 20 bp, Homo sapiens
tccaccaggaagggtaggga

SEQ ID NO: 8282213 - DNA, 22 bp, Homo sapiens
tccacctccatgctgggcagag

SEQ ID NO: 8282214 - DNA, 22 bp, Homo sapiens
tccactctaattactaccttct

SEQ ID NO: 8282215 - DNA, 22 bp, Homo sapiens
tccactccttatgccagacggt

SEQ ID NO: 8282216 - DNA, 22 bp, Homo sapiens
tccactggcccacctcctcagt

SEQ ID NO: 8282217 - DNA, 22 bp, Homo sapiens
tccactgtgcagctctgctgat

SEQ ID NO: 8282218 - DNA, 22 bp, Homo sapiens
tccactgtggtcccttgctgcc

SEQ ID NO: 8282219 - DNA, 22 bp, Homo sapiens
tccagggcaccagcgtccccct

SEQ ID NO: 8282220 - DNA, 22 bp, Homo sapiens
tccagtccatggcctcagtctt

SEQ ID NO: 8282221 - DNA, 20 bp, Homo sapiens
tccagggcaaactcatcacc

SEQ ID NO: 8282222 - DNA, 22 bp, Homo sapiens
tccagggagcaagtcaggccgg

SEQ ID NO: 8282223 - DNA, 22 bp, Homo sapiens
tccagggatctttagagtcttt

SEQ ID NO: 8282224 - DNA, 23 bp, Homo sapiens
tccagtcccctaaatctcactgt

SEQ ID NO: 8282225 - DNA, 22 bp, Homo sapiens
tccaggaggcagggctgtgccc

SEQ ID NO: 8282226 - DNA, 19 bp, Homo sapiens
tccaggccattcccagagc

SEQ ID NO: 8282227 - DNA, 21 bp, Homo sapiens
tccaggccatggtggggaggc

SEQ ID NO: 8282228 - DNA, 22 bp, Homo sapiens
tccaggcccactcggtggggct

SEQ ID NO: 8282229 - DNA, 22 bp, Homo sapiens
tccaggcccactcggtggggct

SEQ ID NO: 8282230 - DNA, 20 bp, Homo sapiens
tccaggcccactcagctgaa

SEQ ID NO: 8282231 - DNA, 22 bp, Homo sapiens
tccaggccattgactgcatcct

SEQ ID NO: 8282232 - DNA, 22 bp, Homo sapiens
tccaggccctgggatgggagca

SEQ ID NO: 8282233 - DNA, 22 bp, Homo sapiens
tccaggccctgggatgggagca

SEQ ID NO: 8282234 - DNA, 22 bp, Homo sapiens
tccaggccgcatagttactctg

SEQ ID NO: 8282235 - DNA, 22 bp, Homo sapiens
tccagggagatggcagaggctg

SEQ ID NO: 8282236 - DNA, 22 bp, Homo sapiens
tcccagagtcttctcctgtaat

SEQ ID NO: 8282237 - DNA, 22 bp, Homo sapiens
tcccagagtcagaggtggggcc

SEQ ID NO: 8282238 - DNA, 22 bp, Homo sapiens
tcccagagtattagcaattgct

SEQ ID NO: 8282239 - DNA, 22 bp, Homo sapiens
tcccagagtattagcaattgct

SEQ ID NO: 8282240 - DNA, 21 bp, Homo sapiens
tcccagagtgcttgggactgc

SEQ ID NO: 8282241 - DNA, 22 bp, Homo sapiens
tcccactgagcccctgctggtg

SEQ ID NO: 8282242 - DNA, 22 bp, Homo sapiens
tcccactggacgtctgtgctgg

SEQ ID NO: 8282243 - DNA, 22 bp, Homo sapiens
tcccactgtctgtcttgctgca

SEQ ID NO: 8282244 - DNA, 22 bp, Homo sapiens
tcccactgtctgtcttgctgca

SEQ ID NO: 8282245 - DNA, 22 bp, Homo sapiens
tcccagcacagggcagatgtga

SEQ ID NO: 8282246 - DNA, 22 bp, Homo sapiens
tcccagagttcaatgggaaggt

SEQ ID NO: 8282247 - DNA, 22 bp, Homo sapiens
tcccagcataacaaactgcccg

SEQ ID NO: 8282248 - DNA, 22 bp, Homo sapiens
tcccagcttagatttgctcatt

SEQ ID NO: 8282249 - DNA, 22 bp, Homo sapiens
tcccaggaaaacactcgaggac

SEQ ID NO: 8282250 - DNA, 22 bp, Homo sapiens
tcaaacagcaggtctttcatag

SEQ ID NO: 8282251 - DNA, 20 bp, Homo sapiens
tcaaaataggtgtgggcgga

SEQ ID NO: 8282252 - DNA, 18 bp, Homo sapiens
tcaaaatatttctgtgga

SEQ ID NO: 8282253 - DNA, 22 bp, Homo sapiens
tcaaaattaaaccaacgtccag

SEQ ID NO: 8282254 - DNA, 22 bp, Homo sapiens
tcaaaattagtgaccaaaggca

SEQ ID NO: 8282255 - DNA, 22 bp, Homo sapiens
tcaaacagaggaacaattgttt

SEQ ID NO: 8282256 - DNA, 22 bp, Homo sapiens
tcaaacagaggaacaattgttt

SEQ ID NO: 8282257 - DNA, 22 bp, Homo sapiens
tcaaacactgtaacatggaaaa

SEQ ID NO: 8282258 - DNA, 22 bp, Homo sapiens
tcaaacactgtaacatggaaaa

SEQ ID NO: 8282259 - DNA, 22 bp, Homo sapiens
tcaaaatttcagcactagccct

SEQ ID NO: 8282260 - DNA, 22 bp, Homo sapiens
tcaaaattttatttctcaagga

SEQ ID NO: 8282261 - DNA, 22 bp, Homo sapiens
tcaaaattctagggagaatggt

SEQ ID NO: 8282262 - DNA, 22 bp, Homo sapiens
tcacacagcagccccgggtgtt

SEQ ID NO: 8282263 - DNA, 22 bp, Homo sapiens
tcacaatttggatacagctatg

SEQ ID NO: 8282264 - DNA, 22 bp, Homo sapiens
tcaattatttgatatgaaaggg

SEQ ID NO: 8282265 - DNA, 23 bp, Homo sapiens
tcaattatcaatggaaagaagtt

SEQ ID NO: 8282266 - DNA, 22 bp, Homo sapiens
tcaatgtgaattaagaatactt

SEQ ID NO: 8282267 - DNA, 22 bp, Homo sapiens
tcacagaatgtctagcataatt

SEQ ID NO: 8282268 - DNA, 22 bp, Homo sapiens
tcacagacatggtgaggtaaca

SEQ ID NO: 8282269 - DNA, 22 bp, Homo sapiens
tcacagacagaagggatgggat

SEQ ID NO: 8282270 - DNA, 22 bp, Homo sapiens
tcacagacacattaaacatgtg

SEQ ID NO: 8282271 - DNA, 22 bp, Homo sapiens
tcacagacacattaaacatgtg

SEQ ID NO: 8282272 - DNA, 22 bp, Homo sapiens
tcacagcaaatgctgcttctca

SEQ ID NO: 8282273 - DNA, 22 bp, Homo sapiens
tcacagcaaaagtgtgcagagc

SEQ ID NO: 8282274 - DNA, 20 bp, Homo sapiens
tcacagagtagccttgtctg

SEQ ID NO: 8282275 - DNA, 23 bp, Homo sapiens
tcacatatgtagaagtggaattc

SEQ ID NO: 8282276 - DNA, 23 bp, Homo sapiens
tcacatatcaagaaagtggtaga

SEQ ID NO: 8282277 - DNA, 22 bp, Homo sapiens
tcacagcctggtcactctgccc

SEQ ID NO: 8282278 - DNA, 22 bp, Homo sapiens
tcacatcaacattatagcatga

SEQ ID NO: 8282279 - DNA, 22 bp, Homo sapiens
tcacatcacatgagtgcaagga

SEQ ID NO: 8282280 - DNA, 22 bp, Homo sapiens
tcacatctgaaaaaatattgag

SEQ ID NO: 8282281 - DNA, 22 bp, Homo sapiens
tcacagcagggtaacaggaaga

SEQ ID NO: 8282282 - DNA, 22 bp, Homo sapiens
tcacagcaggcagatattgttg

SEQ ID NO: 8282283 - DNA, 22 bp, Homo sapiens
tcacagcaaccctgaggcgagt

SEQ ID NO: 8282284 - DNA, 22 bp, Homo sapiens
tcacagcacatggaccgagtcc

SEQ ID NO: 8282285 - DNA, 22 bp, Homo sapiens
tcacagcaccaggatctctcca

SEQ ID NO: 8282286 - DNA, 22 bp, Homo sapiens
tcacagcagtaaagaaaacact

SEQ ID NO: 8282287 - DNA, 19 bp, Homo sapiens
tcacagcatctgtctgaac

SEQ ID NO: 8282288 - DNA, 19 bp, Homo sapiens
tcacagcatctgtctgaac

SEQ ID NO: 8282289 - DNA, 22 bp, Homo sapiens
tcacagcattgagtgtactaga

SEQ ID NO: 8282290 - DNA, 22 bp, Homo sapiens
tcacagcatttttagaaagatt

SEQ ID NO: 8282291 - DNA, 22 bp, Homo sapiens
tcagagagctggtgggcagagg

SEQ ID NO: 8282292 - DNA, 22 bp, Homo sapiens
tcagagagcctcaggcactgcc

SEQ ID NO: 8282293 - DNA, 22 bp, Homo sapiens
tcagaggaccttactgagaacc

SEQ ID NO: 8282294 - DNA, 23 bp, Homo sapiens
tcagagagctgttgagagctgcc

SEQ ID NO: 8282295 - DNA, 22 bp, Homo sapiens
tcagaggattgcctcagcgagc

SEQ ID NO: 8282296 - DNA, 22 bp, Homo sapiens
tcagaggctcatctgccttgca

SEQ ID NO: 8282297 - DNA, 22 bp, Homo sapiens
tcagagaattctcagatgactc

SEQ ID NO: 8282298 - DNA, 22 bp, Homo sapiens
tcagaagactactaggacacat

SEQ ID NO: 8282299 - DNA, 22 bp, Homo sapiens
tcagaactatagtagtttcatg

SEQ ID NO: 8282300 - DNA, 22 bp, Homo sapiens
tcagaagaaagatgttattact

SEQ ID NO: 8282301 - DNA, 22 bp, Homo sapiens
tcagaacattgacattcttatt

SEQ ID NO: 8282302 - DNA, 22 bp, Homo sapiens
tcagaacatttgggactttggg

SEQ ID NO: 8282303 - DNA, 22 bp, Homo sapiens
tcagaacattacattttgagct

SEQ ID NO: 8282304 - DNA, 22 bp, Homo sapiens
tcagaacatgaaggttaatttg

SEQ ID NO: 8282305 - DNA, 22 bp, Homo sapiens
tcagaacattaaggatttgaag

SEQ ID NO: 8282306 - DNA, 22 bp, Homo sapiens
tcactgtgaatgttatcatctt

SEQ ID NO: 8282307 - DNA, 22 bp, Homo sapiens
tcactgtctgaaagaaatggcc

SEQ ID NO: 8282308 - DNA, 20 bp, Homo sapiens
tcagaacagtagaggagcta

SEQ ID NO: 8282309 - DNA, 22 bp, Homo sapiens
tcagaacagttcttaatattgc

SEQ ID NO: 8282310 - DNA, 22 bp, Homo sapiens
tcagaacatatattttgtgatg

SEQ ID NO: 8282311 - DNA, 22 bp, Homo sapiens
tcactgtaataggtttgaagat

SEQ ID NO: 8282312 - DNA, 22 bp, Homo sapiens
tcactggggcctttggtcagga

SEQ ID NO: 8282313 - DNA, 22 bp, Homo sapiens
tcactgggtaggacatgctgat

SEQ ID NO: 8282314 - DNA, 22 bp, Homo sapiens
tcactggggagcactgacatgt

SEQ ID NO: 8282315 - DNA, 22 bp, Homo sapiens
tcactgggcatcggagctgaaa

SEQ ID NO: 8282316 - DNA, 18 bp, Homo sapiens
tcactgggagaagatatt

SEQ ID NO: 8282317 - DNA, 22 bp, Homo sapiens
tcactgggagagctgacaagga

SEQ ID NO: 8282318 - DNA, 22 bp, Homo sapiens
tcactaagtgccgagtttagtt

SEQ ID NO: 8282319 - DNA, 22 bp, Homo sapiens
tcacccaggctggtgcgcagtg

SEQ ID NO: 8282320 - DNA, 22 bp, Homo sapiens
tcacccagggactgtgatggaa

SEQ ID NO: 8282321 - DNA, 22 bp, Homo sapiens
tcacccaggtaatagcagtttg

SEQ ID NO: 8282322 - DNA, 22 bp, Homo sapiens
tcacatgagtattattttccaa

SEQ ID NO: 8282323 - DNA, 22 bp, Homo sapiens
tcaccggcagacgtggcctgat

SEQ ID NO: 8282324 - DNA, 22 bp, Homo sapiens
tcaccgaggctggagtgcagtg

SEQ ID NO: 8282325 - DNA, 22 bp, Homo sapiens
tcacctgttcaacagcaataat

SEQ ID NO: 8282326 - DNA, 22 bp, Homo sapiens
tcaccttgtgatctccctgcct

SEQ ID NO: 8282327 - DNA, 22 bp, Homo sapiens
tcaccttgtgatctccctgcct

SEQ ID NO: 8282328 - DNA, 22 bp, Homo sapiens
tcagccagttaaggcttagaca

SEQ ID NO: 8282329 - DNA, 22 bp, Homo sapiens
tcagccagttgccccagttagt

SEQ ID NO: 8282330 - DNA, 22 bp, Homo sapiens
tcagctgttatcactgtctgtc

SEQ ID NO: 8282331 - DNA, 22 bp, Homo sapiens
tcagctgtatcttgctgcactt

SEQ ID NO: 8282332 - DNA, 22 bp, Homo sapiens
tcagctttctatgttgctaaac

SEQ ID NO: 8282333 - DNA, 22 bp, Homo sapiens
tcagctttccttgctttagatt

SEQ ID NO: 8282334 - DNA, 22 bp, Homo sapiens
tcagctttctcaaagaagctgg

SEQ ID NO: 8282335 - DNA, 22 bp, Homo sapiens
tcagcttgggaaattgagcaag

SEQ ID NO: 8282336 - DNA, 22 bp, Homo sapiens
tcagcttgggggtggcttctca

SEQ ID NO: 8282337 - DNA, 20 bp, Homo sapiens
tcagcttgggtgaagttcat

SEQ ID NO: 8282338 - DNA, 22 bp, Homo sapiens
tcagctttcctgcagctaaggg

SEQ ID NO: 8282339 - DNA, 22 bp, Homo sapiens
tcagctttcctgcagctaaggg

SEQ ID NO: 8282340 - DNA, 22 bp, Homo sapiens
tcagcttgtttatgataagcag

SEQ ID NO: 8282341 - DNA, 22 bp, Homo sapiens
tcagcttgatccatccaactat

SEQ ID NO: 8282342 - DNA, 21 bp, Homo sapiens
tcagcttgaatctagagatag

SEQ ID NO: 8282343 - DNA, 22 bp, Homo sapiens
tcagaggctggaagagcctcct

SEQ ID NO: 8282344 - DNA, 22 bp, Homo sapiens
tcagaggcttctgctcacctca

SEQ ID NO: 8282345 - DNA, 22 bp, Homo sapiens
tcagagggcttatgatatattg

SEQ ID NO: 8282346 - DNA, 21 bp, Homo sapiens
tcagagggccctggaggctca

SEQ ID NO: 8282347 - DNA, 22 bp, Homo sapiens
tcagccagtatttgagtgctca

SEQ ID NO: 8282348 - DNA, 22 bp, Homo sapiens
tcagccagggctctggcctcag

SEQ ID NO: 8282349 - DNA, 22 bp, Homo sapiens
tcagccagggcagagcaggtga

SEQ ID NO: 8282350 - DNA, 22 bp, Homo sapiens
tcagccaggccaggcattcaca

SEQ ID NO: 8282351 - DNA, 22 bp, Homo sapiens
tcaggagcagggggaagctctg

SEQ ID NO: 8282352 - DNA, 19 bp, Homo sapiens
tcaggagcagcttctgaac

SEQ ID NO: 8282353 - DNA, 22 bp, Homo sapiens
tcaggagggattgttgcctatt

SEQ ID NO: 8282354 - DNA, 22 bp, Homo sapiens
tcaggaggatgtcggcaaattt

SEQ ID NO: 8282355 - DNA, 22 bp, Homo sapiens
tcaggagcaacatctttgaatc

SEQ ID NO: 8282356 - DNA, 22 bp, Homo sapiens
tcaggaaatggtgatttggttg

SEQ ID NO: 8282357 - DNA, 22 bp, Homo sapiens
tcaggaaatggacatctttgct

SEQ ID NO: 8282358 - DNA, 22 bp, Homo sapiens
tcagctttctctcgccatcagg

SEQ ID NO: 8282359 - DNA, 22 bp, Homo sapiens
tcagctttctcagaggcctaac

SEQ ID NO: 8282360 - DNA, 23 bp, Homo sapiens
tcaggcagctggggtagttggag

SEQ ID NO: 8282361 - DNA, 22 bp, Homo sapiens
tcaggcaggaagggaggacttg

SEQ ID NO: 8282362 - DNA, 22 bp, Homo sapiens
tcaggcaggtggctggctatgg

SEQ ID NO: 8282363 - DNA, 22 bp, Homo sapiens
tcaggcaggttggctgcaggtc

SEQ ID NO: 8282364 - DNA, 22 bp, Homo sapiens
tcaggccttgtcctgacctcct

SEQ ID NO: 8282365 - DNA, 22 bp, Homo sapiens
tcatccagtaccatggaaggca

SEQ ID NO: 8282366 - DNA, 21 bp, Homo sapiens
tcatccaggtcctgcttcttc

SEQ ID NO: 8282367 - DNA, 22 bp, Homo sapiens
tcatccagaaaaatgtcttagc

SEQ ID NO: 8282368 - DNA, 22 bp, Homo sapiens
tcatattttgcaaggtcagcta

SEQ ID NO: 8282369 - DNA, 22 bp, Homo sapiens
tcatcaaagcgcttggagtagg

SEQ ID NO: 8282370 - DNA, 22 bp, Homo sapiens
tcatctcaaaattatgctgcac

SEQ ID NO: 8282371 - DNA, 22 bp, Homo sapiens
tcatctaagagtcttacattta

SEQ ID NO: 8282372 - DNA, 22 bp, Homo sapiens
tcatctaagagtcttacattta

SEQ ID NO: 8282373 - DNA, 22 bp, Homo sapiens
tcatcccagtgtccatgctcag

SEQ ID NO: 8282374 - DNA, 22 bp, Homo sapiens
tcatccctaaggacagctctgc

SEQ ID NO: 8282375 - DNA, 22 bp, Homo sapiens
tcatccagttcacatggtgagt

SEQ ID NO: 8282376 - DNA, 22 bp, Homo sapiens
tcataaaaatagactctaaagt

SEQ ID NO: 8282377 - DNA, 22 bp, Homo sapiens
tcagggtgaaattgggtcctgg

SEQ ID NO: 8282378 - DNA, 22 bp, Homo sapiens
tcagtgcatggacagatttaga

SEQ ID NO: 8282379 - DNA, 22 bp, Homo sapiens
tcaggtgacctgagccactatg

SEQ ID NO: 8282380 - DNA, 22 bp, Homo sapiens
tcagtgcagtgaaaggtttact

SEQ ID NO: 8282381 - DNA, 22 bp, Homo sapiens
tcaggctcaaagggccggatga

SEQ ID NO: 8282382 - DNA, 22 bp, Homo sapiens
tcaggctctgggtacacctgac

SEQ ID NO: 8282383 - DNA, 22 bp, Homo sapiens
gtttctcacttaccaacacatg

SEQ ID NO: 8282384 - DNA, 22 bp, Homo sapiens
gtttctcagtttggtctgcaga

SEQ ID NO: 8282385 - DNA, 22 bp, Homo sapiens
gtttctgattctagaggcaggc

SEQ ID NO: 8282386 - DNA, 22 bp, Homo sapiens
gtttctcaaattatttcagctt

SEQ ID NO: 8282387 - DNA, 22 bp, Homo sapiens
gtttctcaacatgctttctaac

SEQ ID NO: 8282388 - DNA, 22 bp, Homo sapiens
gtttctcaagcttgaatgcaca

SEQ ID NO: 8282389 - DNA, 22 bp, Homo sapiens
gtttctcagcatgtcagtacaa

SEQ ID NO: 8282390 - DNA, 22 bp, Homo sapiens
gtttctcagcaactatatgact

SEQ ID NO: 8282391 - DNA, 22 bp, Homo sapiens
gtttctcacttccagtagccaa

SEQ ID NO: 8282392 - DNA, 22 bp, Homo sapiens
gtttctatggtttatattactg

SEQ ID NO: 8282393 - DNA, 22 bp, Homo sapiens
gttccttggaagaacttgaggt

SEQ ID NO: 8282394 - DNA, 22 bp, Homo sapiens
gtttaattttaggttgtcaagc

SEQ ID NO: 8282395 - DNA, 22 bp, Homo sapiens
gttccagtatgattccacccat

SEQ ID NO: 8282396 - DNA, 22 bp, Homo sapiens
gttagcaattgcttaagactag

SEQ ID NO: 8282397 - DNA, 22 bp, Homo sapiens
gttagcaatgcccaggaatgca

SEQ ID NO: 8282398 - DNA, 22 bp, Homo sapiens
gttagagggctgccttttgttt

SEQ ID NO: 8282399 - DNA, 22 bp, Homo sapiens
gttagctttaaacatgatcatt

SEQ ID NO: 8282400 - DNA, 22 bp, Homo sapiens
gttactcttccccggggtctgg

SEQ ID NO: 8282401 - DNA, 22 bp, Homo sapiens
gttactcttgagaggctgaggt

SEQ ID NO: 8282402 - DNA, 22 bp, Homo sapiens
gttactcttgagaggctgaggt

SEQ ID NO: 8282403 - DNA, 22 bp, Homo sapiens
gttagtgggttactctcagccc

SEQ ID NO: 8282404 - DNA, 22 bp, Homo sapiens
gttataaatacctaataggatt

SEQ ID NO: 8282405 - DNA, 22 bp, Homo sapiens
gttataaaggtgataatggtca

SEQ ID NO: 8282406 - DNA, 22 bp, Homo sapiens
gttataaatacctaataggatt

SEQ ID NO: 8282407 - DNA, 22 bp, Homo sapiens
gttcatttttactttgatctac

SEQ ID NO: 8282408 - DNA, 22 bp, Homo sapiens
gttttataattgcttcataaga

SEQ ID NO: 8282409 - DNA, 22 bp, Homo sapiens
taaacatggctgtttcagttat

SEQ ID NO: 8282410 - DNA, 22 bp, Homo sapiens
taaacagagtgctagttcacgg

SEQ ID NO: 8282411 - DNA, 22 bp, Homo sapiens
taaagaatagatgggtagggag

SEQ ID NO: 8282412 - DNA, 22 bp, Homo sapiens
taaagaataatacccatggagc

SEQ ID NO: 8282413 - DNA, 22 bp, Homo sapiens
taaagacaataggaaagttgtt

SEQ ID NO: 8282414 - DNA, 17 bp, Homo sapiens
taaatacacaagggtat

SEQ ID NO: 8282415 - DNA, 22 bp, Homo sapiens
taacacataagctgagaccatg

SEQ ID NO: 8282416 - DNA, 22 bp, Homo sapiens
taacacatagatattttaactt

SEQ ID NO: 8282417 - DNA, 22 bp, Homo sapiens
taacacatatctacaacatgtg

SEQ ID NO: 8282418 - DNA, 22 bp, Homo sapiens
taacacatatctacaacatgtg

SEQ ID NO: 8282419 - DNA, 22 bp, Homo sapiens
taacacatatttcaagagtagt

SEQ ID NO: 8282420 - DNA, 22 bp, Homo sapiens
taacacatggttagtacacaat

SEQ ID NO: 8282421 - DNA, 22 bp, Homo sapiens
taacacatggttagtacacaat

SEQ ID NO: 8282422 - DNA, 22 bp, Homo sapiens
taacacatgaaagcaccttctt

SEQ ID NO: 8282423 - DNA, 22 bp, Homo sapiens
taacacatatttgcagtaagca

SEQ ID NO: 8282424 - DNA, 22 bp, Homo sapiens
taacacattttcctcatacgga

SEQ ID NO: 8282425 - DNA, 21 bp, Homo sapiens
taacacattttggtactttgg

SEQ ID NO: 8282426 - DNA, 22 bp, Homo sapiens
taacacatgtctgggatgtgaa

SEQ ID NO: 8282427 - DNA, 22 bp, Homo sapiens
taacacattagttctcctagat

SEQ ID NO: 8282428 - DNA, 22 bp, Homo sapiens
taacacattttaagccatttta

SEQ ID NO: 8282429 - DNA, 22 bp, Homo sapiens
taacacatggttctgtcaggaa

SEQ ID NO: 8282430 - DNA, 22 bp, Homo sapiens
taacaatagtgtttgctagtca

SEQ ID NO: 8282431 - DNA, 22 bp, Homo sapiens
taacaaactggaaattgacatt

SEQ ID NO: 8282432 - DNA, 22 bp, Homo sapiens
taacaatgattagtgactacag

SEQ ID NO: 8282433 - DNA, 22 bp, Homo sapiens
taacttctctgctatcatagga

SEQ ID NO: 8282434 - DNA, 22 bp, Homo sapiens
taactgtagttataaagctatc

SEQ ID NO: 8282435 - DNA, 22 bp, Homo sapiens
taagaaactattgtctctgaac

SEQ ID NO: 8282436 - DNA, 22 bp, Homo sapiens
taagaaactgtcacagtactat

SEQ ID NO: 8282437 - DNA, 22 bp, Homo sapiens
taagaaacttaactgggaacta

SEQ ID NO: 8282438 - DNA, 22 bp, Homo sapiens
taagaaactaatgcaataagag

SEQ ID NO: 8282439 - DNA, 22 bp, Homo sapiens
taagaaactatggagaagaact

SEQ ID NO: 8282440 - DNA, 22 bp, Homo sapiens
taagaaacccaggaatttctta

SEQ ID NO: 8282441 - DNA, 22 bp, Homo sapiens
taagatattgagtggtaatttg

SEQ ID NO: 8282442 - DNA, 22 bp, Homo sapiens
taagatggtccagaagggaggc

SEQ ID NO: 8282443 - DNA, 22 bp, Homo sapiens
taagatgggggaaagaaatagt

SEQ ID NO: 8282444 - DNA, 22 bp, Homo sapiens
taataaatgaaagtgctggcat

SEQ ID NO: 8282445 - DNA, 22 bp, Homo sapiens
taagttttctggaataacttgg

SEQ ID NO: 8282446 - DNA, 22 bp, Homo sapiens
taataaatgaaagtgctggcat

SEQ ID NO: 8282447 - DNA, 21 bp, Homo sapiens
taagttggcatgagtggctac

SEQ ID NO: 8282448 - DNA, 22 bp, Homo sapiens
taagttggctgttgctatagtt

SEQ ID NO: 8282449 - DNA, 22 bp, Homo sapiens
taagttggaaaggctatgaggc

SEQ ID NO: 8282450 - DNA, 22 bp, Homo sapiens
taagtttaaatgtacatgaagc

SEQ ID NO: 8282451 - DNA, 22 bp, Homo sapiens
taagtttaccactttcagaatt

SEQ ID NO: 8282452 - DNA, 22 bp, Homo sapiens
taagcaggggtcaagtgtacaa

SEQ ID NO: 8282453 - DNA, 22 bp, Homo sapiens
taatgccacggcagggaacagc

SEQ ID NO: 8282454 - DNA, 22 bp, Homo sapiens
taatgccaatttaatgatccat

SEQ ID NO: 8282455 - DNA, 22 bp, Homo sapiens
taatgccacctacctgctttat

SEQ ID NO: 8282456 - DNA, 23 bp, Homo sapiens
taatgccagccctgcagttaagc

SEQ ID NO: 8282457 - DNA, 22 bp, Homo sapiens
taatgatatttcccatttctct

SEQ ID NO: 8282458 - DNA, 22 bp, Homo sapiens
taatttctaattcattttcagt

SEQ ID NO: 8282459 - DNA, 22 bp, Homo sapiens
taatgccaggagggagttttta

SEQ ID NO: 8282460 - DNA, 22 bp, Homo sapiens
tacacatctggagaagccctgt

SEQ ID NO: 8282461 - DNA, 22 bp, Homo sapiens
tacacatctggtgtgactgcca

SEQ ID NO: 8282462 - DNA, 22 bp, Homo sapiens
tacacatcccagactcccagga

SEQ ID NO: 8282463 - DNA, 22 bp, Homo sapiens
tacacatccatgttttgacttt

SEQ ID NO: 8282464 - DNA, 22 bp, Homo sapiens
tacacatcatacactgggatta

SEQ ID NO: 8282465 - DNA, 22 bp, Homo sapiens
tacacatccttctgaacaacct

SEQ ID NO: 8282466 - DNA, 22 bp, Homo sapiens
tacacatctctgtcagtagtga

SEQ ID NO: 8282467 - DNA, 22 bp, Homo sapiens
tacacatcactgtatctttcag

SEQ ID NO: 8282468 - DNA, 22 bp, Homo sapiens
tacacatcaacctggctttggc

SEQ ID NO: 8282469 - DNA, 22 bp, Homo sapiens
tacacatatgtgtgtatatgtg

SEQ ID NO: 8282470 - DNA, 17 bp, Homo sapiens
tacaatgtgattcaatc

SEQ ID NO: 8282471 - DNA, 22 bp, Homo sapiens
tacaatgtgtgcttcttgtcac

SEQ ID NO: 8282472 - DNA, 22 bp, Homo sapiens
tacaatgtgtgcttcttgtcac

SEQ ID NO: 8282473 - DNA, 22 bp, Homo sapiens
tacaatgttaaggaaagagaga

SEQ ID NO: 8282474 - DNA, 22 bp, Homo sapiens
tacaattactcagctctgctgt

SEQ ID NO: 8282475 - DNA, 22 bp, Homo sapiens
tacaatgttggtaaagtatcat

SEQ ID NO: 8282476 - DNA, 22 bp, Homo sapiens
tacacccacatgcctaggaggg

SEQ ID NO: 8282477 - DNA, 22 bp, Homo sapiens
tacactaagaacaaagatctgt

SEQ ID NO: 8282478 - DNA, 22 bp, Homo sapiens
tacaccttaatcatatgtgtct

SEQ ID NO: 8282479 - DNA, 22 bp, Homo sapiens
tacacattacataatactatct

SEQ ID NO: 8282480 - DNA, 22 bp, Homo sapiens
tacacattacataatactatct

SEQ ID NO: 8282481 - DNA, 22 bp, Homo sapiens
tacacattagtcaagagtttga

SEQ ID NO: 8282482 - DNA, 22 bp, Homo sapiens
tacacattagtgaggtattttg

SEQ ID NO: 8282483 - DNA, 22 bp, Homo sapiens
tacacatgatcatttagtagca

SEQ ID NO: 8282484 - DNA, 22 bp, Homo sapiens
tacacatgcatgtactccagga

SEQ ID NO: 8282485 - DNA, 22 bp, Homo sapiens
tacacatgtttggcaagtatgt

SEQ ID NO: 8282486 - DNA, 22 bp, Homo sapiens
tacaatgcattcatttttgagg

SEQ ID NO: 8282487 - DNA, 22 bp, Homo sapiens
tacaatgtaattctgattatgt

SEQ ID NO: 8282488 - DNA, 22 bp, Homo sapiens
tacaatgctgtttgtttctact

SEQ ID NO: 8282489 - DNA, 22 bp, Homo sapiens
taattttatgacagtgtatttt

SEQ ID NO: 8282490 - DNA, 22 bp, Homo sapiens
taattttccactctgtttatct

SEQ ID NO: 8282491 - DNA, 22 bp, Homo sapiens
taattttaatagtatgtggcat

SEQ ID NO: 8282492 - DNA, 22 bp, Homo sapiens
taattttaactgtgctgtttgg

SEQ ID NO: 8282493 - DNA, 22 bp, Homo sapiens
taatttctggagggagaaagag

SEQ ID NO: 8282494 - DNA, 22 bp, Homo sapiens
taatttctagggactaaggtgc

SEQ ID NO: 8282495 - DNA, 22 bp, Homo sapiens
taatttcttcatctctgcagct

SEQ ID NO: 8282496 - DNA, 22 bp, Homo sapiens
tacttattggttcagaagttta

SEQ ID NO: 8282497 - DNA, 22 bp, Homo sapiens
tactgcacttgagaaagctgag

SEQ ID NO: 8282498 - DNA, 22 bp, Homo sapiens
tactgaaatagcactctgatgc

SEQ ID NO: 8282499 - DNA, 22 bp, Homo sapiens
tactgaaatggcagatatataa

SEQ ID NO: 8282500 - DNA, 22 bp, Homo sapiens
tactgaaatactaagaagttaa

SEQ ID NO: 8282501 - DNA, 22 bp, Homo sapiens
tactgaaagtctgtgggtcctc

SEQ ID NO: 8282502 - DNA, 22 bp, Homo sapiens
tactgaaagagtggtggactct

SEQ ID NO: 8282503 - DNA, 22 bp, Homo sapiens
tactgaaagtggtcaacagtgg

SEQ ID NO: 8282504 - DNA, 22 bp, Homo sapiens
tactgaaagactgaatatttag

SEQ ID NO: 8282505 - DNA, 22 bp, Homo sapiens
tactaagtagcagaactaagaa

SEQ ID NO: 8282506 - DNA, 22 bp, Homo sapiens
tactaacaatgagaacaagcca

SEQ ID NO: 8282507 - DNA, 22 bp, Homo sapiens
tactaaatagtttaattcctca

SEQ ID NO: 8282508 - DNA, 22 bp, Homo sapiens
tactaaatgattaagcaggaat

SEQ ID NO: 8282509 - DNA, 22 bp, Homo sapiens
tacccagcaatccctagaggtt

SEQ ID NO: 8282510 - DNA, 22 bp, Homo sapiens
taccttgattttgaatccatga

SEQ ID NO: 8282511 - DNA, 22 bp, Homo sapiens
taccttgagccgttgctgatga

SEQ ID NO: 8282512 - DNA, 22 bp, Homo sapiens
tacattagctcatctatttatt

SEQ ID NO: 8282513 - DNA, 22 bp, Homo sapiens
tacattacaggaaagataaaga

SEQ ID NO: 8282514 - DNA, 22 bp, Homo sapiens
tacattaaggatatggacatga

SEQ ID NO: 8282515 - DNA, 22 bp, Homo sapiens
tacattatcttgttatctttca

SEQ ID NO: 8282516 - DNA, 22 bp, Homo sapiens
tacattcaaacgatttattgat

SEQ ID NO: 8282517 - DNA, 22 bp, Homo sapiens
tacattcacttgttgaaggtgg

SEQ ID NO: 8282518 - DNA, 22 bp, Homo sapiens
tacattcagaagaatggacacg

SEQ ID NO: 8282519 - DNA, 22 bp, Homo sapiens
tacattcatggtgacttgtatg

SEQ ID NO: 8282520 - DNA, 22 bp, Homo sapiens
tacattcagcaaaagaatggtt

SEQ ID NO: 8282521 - DNA, 22 bp, Homo sapiens
tacattcatatgtgtgcataca

SEQ ID NO: 8282522 - DNA, 22 bp, Homo sapiens
tacatgtattgatttctcttct

SEQ ID NO: 8282523 - DNA, 22 bp, Homo sapiens
tacatacatattcatacaggtg

SEQ ID NO: 8282524 - DNA, 22 bp, Homo sapiens
tacatacacaaatatactgttt

SEQ ID NO: 8282525 - DNA, 17 bp, Homo sapiens
tacaggagagcaggaac

SEQ ID NO: 8282526 - DNA, 22 bp, Homo sapiens
tacagtttttcactgaagatgt

SEQ ID NO: 8282527 - DNA, 22 bp, Homo sapiens
tacagctttagcaaattaccta

SEQ ID NO: 8282528 - DNA, 22 bp, Homo sapiens
tacagcttgacccataatgtct

SEQ ID NO: 8282529 - DNA, 22 bp, Homo sapiens
tacagcttcagtgtgccccagt

SEQ ID NO: 8282530 - DNA, 22 bp, Homo sapiens
tacagcagagtgggatgcatct

SEQ ID NO: 8282531 - DNA, 22 bp, Homo sapiens
tattcagtgcgggaactcagcc

SEQ ID NO: 8282532 - DNA, 22 bp, Homo sapiens
tattcagtggaaaatgtgttga

SEQ ID NO: 8282533 - DNA, 22 bp, Homo sapiens
tattcacaggcacgaaatattg

SEQ ID NO: 8282534 - DNA, 22 bp, Homo sapiens
tattcacattaataagtcttca

SEQ ID NO: 8282535 - DNA, 22 bp, Homo sapiens
tattcacatgtacatatgctca

SEQ ID NO: 8282536 - DNA, 22 bp, Homo sapiens
tattcacatgtacatatgctca

SEQ ID NO: 8282537 - DNA, 22 bp, Homo sapiens
tattcacatgaaaacaaatttt

SEQ ID NO: 8282538 - DNA, 22 bp, Homo sapiens
tattcacatgaaaacaaatttt

SEQ ID NO: 8282539 - DNA, 22 bp, Homo sapiens
tatgtgttatttggtatacatt

SEQ ID NO: 8282540 - DNA, 22 bp, Homo sapiens
tatgctactagaaataaaatgg

SEQ ID NO: 8282541 - DNA, 22 bp, Homo sapiens
tatgctagatggaaaaatattg

SEQ ID NO: 8282542 - DNA, 22 bp, Homo sapiens
tatgcctacctccaaaatatat

SEQ ID NO: 8282543 - DNA, 22 bp, Homo sapiens
tatgttattttcatacaacaga

SEQ ID NO: 8282544 - DNA, 22 bp, Homo sapiens
tatgttacaaagtttttctaaa

SEQ ID NO: 8282545 - DNA, 22 bp, Homo sapiens
tatttccagcagtaagaagaca

SEQ ID NO: 8282546 - DNA, 22 bp, Homo sapiens
tatttccaggccccactctaga

SEQ ID NO: 8282547 - DNA, 22 bp, Homo sapiens
tatttctaagctgtaagtctga

SEQ ID NO: 8282548 - DNA, 22 bp, Homo sapiens
tatttgtatgtgtgtacatata

SEQ ID NO: 8282549 - DNA, 22 bp, Homo sapiens
tatttgtatgtgtgtacatata

SEQ ID NO: 8282550 - DNA, 22 bp, Homo sapiens
tatttggcaaagaattttctgg

SEQ ID NO: 8282551 - DNA, 22 bp, Homo sapiens
tatttgttgagttgttatgtct

SEQ ID NO: 8282552 - DNA, 22 bp, Homo sapiens
tatttgtcacctatggctgtcc

SEQ ID NO: 8282553 - DNA, 22 bp, Homo sapiens
tatttgtccttattaagatctg

SEQ ID NO: 8282554 - DNA, 22 bp, Homo sapiens
tattgtatcttaccacatgtat

SEQ ID NO: 8282555 - DNA, 22 bp, Homo sapiens
tatttcaacgtatgaaaagctg

SEQ ID NO: 8282556 - DNA, 22 bp, Homo sapiens
tattgcatattgtacttgaatg

SEQ ID NO: 8282557 - DNA, 22 bp, Homo sapiens
tattgcacgatagtgtgggctt

SEQ ID NO: 8282558 - DNA, 22 bp, Homo sapiens
tattgtacatggttatgcagga

SEQ ID NO: 8282559 - DNA, 22 bp, Homo sapiens
tattgtacagagagagaggttt

SEQ ID NO: 8282560 - DNA, 22 bp, Homo sapiens
tattgcatcttagtgtaagtca

SEQ ID NO: 8282561 - DNA, 22 bp, Homo sapiens
tagttaaagccctaaattgata

SEQ ID NO: 8282562 - DNA, 22 bp, Homo sapiens
tagtgtatgtctaacatacact

SEQ ID NO: 8282563 - DNA, 22 bp, Homo sapiens
tagtgtatgttcagcttatatg

SEQ ID NO: 8282564 - DNA, 22 bp, Homo sapiens
tatacagatatctaagatgtaa

SEQ ID NO: 8282565 - DNA, 22 bp, Homo sapiens
tataccaaaaaaattcttgtct

SEQ ID NO: 8282566 - DNA, 22 bp, Homo sapiens
tatactttcctgcaactttgat

SEQ ID NO: 8282567 - DNA, 22 bp, Homo sapiens
tatagacaagcgtaacaagaag

SEQ ID NO: 8282568 - DNA, 22 bp, Homo sapiens
tatactgatcactgaggtcatc

SEQ ID NO: 8282569 - DNA, 22 bp, Homo sapiens
tatactgagtgtgttaatgatg

SEQ ID NO: 8282570 - DNA, 22 bp, Homo sapiens
tatattatcataaaaccattca

SEQ ID NO: 8282571 - DNA, 22 bp, Homo sapiens
tatattaaagtgctttgcagtg

SEQ ID NO: 8282572 - DNA, 20 bp, Homo sapiens
tatatgtgtacatacacaca

SEQ ID NO: 8282573 - DNA, 22 bp, Homo sapiens
tatatgtttcttacaaaatatt

SEQ ID NO: 8282574 - DNA, 22 bp, Homo sapiens
tatatgttgatactaattctgg

SEQ ID NO: 8282575 - DNA, 22 bp, Homo sapiens
tatatgttgatactaattctgg

SEQ ID NO: 8282576 - DNA, 22 bp, Homo sapiens
tatatgatgccaaataacctgt

SEQ ID NO: 8282577 - DNA, 22 bp, Homo sapiens
tatatgatgccaaataacctgt

SEQ ID NO: 8282578 - DNA, 22 bp, Homo sapiens
tatatgtaaataagtctaatgt

SEQ ID NO: 8282579 - DNA, 22 bp, Homo sapiens
tatcttggtgggcttaatataa

SEQ ID NO: 8282580 - DNA, 22 bp, Homo sapiens
tatgcataggtatctatactca

SEQ ID NO: 8282581 - DNA, 22 bp, Homo sapiens
tatgcatagatattatcagcca

SEQ ID NO: 8282582 - DNA, 22 bp, Homo sapiens
tatctttgatgccagatgttac

SEQ ID NO: 8282583 - DNA, 22 bp, Homo sapiens
tatcaatacatgttatcagtgt

SEQ ID NO: 8282584 - DNA, 22 bp, Homo sapiens
tatcaacttttcagaaggggct

SEQ ID NO: 8282585 - DNA, 19 bp, Homo sapiens
tatatttgttgaataaaaa

SEQ ID NO: 8282586 - DNA, 22 bp, Homo sapiens
tatattttagacaccctcacgc

SEQ ID NO: 8282587 - DNA, 20 bp, Homo sapiens
tatattttctctttggcctt

SEQ ID NO: 8282588 - DNA, 20 bp, Homo sapiens
tatattttctctttggcctt

SEQ ID NO: 8282589 - DNA, 22 bp, Homo sapiens
tatatttaattagttgctggat

SEQ ID NO: 8282590 - DNA, 22 bp, Homo sapiens
taggaaagcagtagagccagga

SEQ ID NO: 8282591 - DNA, 22 bp, Homo sapiens
taggaaatattgatttcagtca

SEQ ID NO: 8282592 - DNA, 22 bp, Homo sapiens
taggaaagaaatgagtagtgat

SEQ ID NO: 8282593 - DNA, 22 bp, Homo sapiens
tagcccagagagccaggggctt

SEQ ID NO: 8282594 - DNA, 22 bp, Homo sapiens
taggaaatggctcagttactgc

SEQ ID NO: 8282595 - DNA, 22 bp, Homo sapiens
taggaaatgctccattgcataa

SEQ ID NO: 8282596 - DNA, 22 bp, Homo sapiens
taggaagaaactttccctgcag

SEQ ID NO: 8282597 - DNA, 22 bp, Homo sapiens
taggaaggaggccatcttggcg

SEQ ID NO: 8282598 - DNA, 22 bp, Homo sapiens
taggaaggaagagcctcagatt

SEQ ID NO: 8282599 - DNA, 20 bp, Homo sapiens
taggacagggcctggcttct

SEQ ID NO: 8282600 - DNA, 21 bp, Homo sapiens
taggacagcccccctgccctc

SEQ ID NO: 8282601 - DNA, 22 bp, Homo sapiens
taggacagagttccctgatggc

SEQ ID NO: 8282602 - DNA, 22 bp, Homo sapiens
taggacaggctaaaagggataa

SEQ ID NO: 8282603 - DNA, 22 bp, Homo sapiens
taggacagggacatctttttga

SEQ ID NO: 8282604 - DNA, 22 bp, Homo sapiens
taggacaggatcatgatgctgg

SEQ ID NO: 8282605 - DNA, 20 bp, Homo sapiens
taggacaggcagccgagggg

SEQ ID NO: 8282606 - DNA, 22 bp, Homo sapiens
taggaaggtgtttttaaggagc

SEQ ID NO: 8282607 - DNA, 22 bp, Homo sapiens
taggaaggtccatgtcttatct

SEQ ID NO: 8282608 - DNA, 22 bp, Homo sapiens
taggaaggcctgtcactacttg

SEQ ID NO: 8282609 - DNA, 22 bp, Homo sapiens
taggaagggaaaggcttcaact

SEQ ID NO: 8282610 - DNA, 22 bp, Homo sapiens
taggaagggctcagggctcggt

SEQ ID NO: 8282611 - DNA, 22 bp, Homo sapiens
taggacagagctggttacaatg

SEQ ID NO: 8282612 - DNA, 22 bp, Homo sapiens
taggacagagatttgttttatg

SEQ ID NO: 8282613 - DNA, 23 bp, Homo sapiens
taggacagaatgcagaaaaatac

SEQ ID NO: 8282614 - DNA, 22 bp, Homo sapiens
tagtggctgcagggctgtttga

SEQ ID NO: 8282615 - DNA, 22 bp, Homo sapiens
tagtgtatccagtcattcaagg

SEQ ID NO: 8282616 - DNA, 22 bp, Homo sapiens
tagtggggaaggaggacaagaa

SEQ ID NO: 8282617 - DNA, 22 bp, Homo sapiens
tagtcctgaccagctggatgtt

SEQ ID NO: 8282618 - DNA, 22 bp, Homo sapiens
tagtatttataatcatgcttaa

SEQ ID NO: 8282619 - DNA, 22 bp, Homo sapiens
tagtcatttttccactaagtta

SEQ ID NO: 8282620 - DNA, 22 bp, Homo sapiens
tagtccacagactctacagcat

SEQ ID NO: 8282621 - DNA, 22 bp, Homo sapiens
tagtatatctttagtacatagt

SEQ ID NO: 8282622 - DNA, 22 bp, Homo sapiens
taggtttaggagtgaaggtgaa

SEQ ID NO: 8282623 - DNA, 22 bp, Homo sapiens
tagtaaaaagcaatggtgagta

SEQ ID NO: 8282624 - DNA, 22 bp, Homo sapiens
tagtacagtttaaatattaata

SEQ ID NO: 8282625 - DNA, 22 bp, Homo sapiens
tagtacagtttactttcagcgc

SEQ ID NO: 8282626 - DNA, 22 bp, Homo sapiens
taggttcagagaactgaaaata

SEQ ID NO: 8282627 - DNA, 22 bp, Homo sapiens
taggttcaagttcaggctctat

SEQ ID NO: 8282628 - DNA, 22 bp, Homo sapiens
taggttcagcttccactgccta

SEQ ID NO: 8282629 - DNA, 22 bp, Homo sapiens
taggttcagctttcatcctgaa

SEQ ID NO: 8282630 - DNA, 22 bp, Homo sapiens
tagcacactgccttcactgagg

SEQ ID NO: 8282631 - DNA, 22 bp, Homo sapiens
tagatgttttgatatttgctga

SEQ ID NO: 8282632 - DNA, 22 bp, Homo sapiens
tagatgtttgagaagtttatgt

SEQ ID NO: 8282633 - DNA, 22 bp, Homo sapiens
tagattttaggagattttactg

SEQ ID NO: 8282634 - DNA, 22 bp, Homo sapiens
tagattttaggagattttactg

SEQ ID NO: 8282635 - DNA, 22 bp, Homo sapiens
tagattttgcatttctaacaag

SEQ ID NO: 8282636 - DNA, 22 bp, Homo sapiens
tagcagggttttgaagagggtt

SEQ ID NO: 8282637 - DNA, 22 bp, Homo sapiens
tagccacatgcagactttcatg

SEQ ID NO: 8282638 - DNA, 22 bp, Homo sapiens
tagccaggcgaggtcagtgtcg

SEQ ID NO: 8282639 - DNA, 22 bp, Homo sapiens
tagccaggtcacactgtgtgtt

SEQ ID NO: 8282640 - DNA, 22 bp, Homo sapiens
tagccaggtcacactgtgtgtt

SEQ ID NO: 8282641 - DNA, 22 bp, Homo sapiens
tagccaggctgcagctgatccg

SEQ ID NO: 8282642 - DNA, 22 bp, Homo sapiens
tagccaggctgcagctgatccg

SEQ ID NO: 8282643 - DNA, 22 bp, Homo sapiens
tagccagggagacactgtggag

SEQ ID NO: 8282644 - DNA, 22 bp, Homo sapiens
tagccagggagacactgtggag

SEQ ID NO: 8282645 - DNA, 22 bp, Homo sapiens
tagaatctagttcattcatttg

SEQ ID NO: 8282646 - DNA, 22 bp, Homo sapiens
tagaaggaggactggcagtgtt

SEQ ID NO: 8282647 - DNA, 22 bp, Homo sapiens
tacttgttaggaatttctacta

SEQ ID NO: 8282648 - DNA, 22 bp, Homo sapiens
tagaggagcggcgagctgagct

SEQ ID NO: 8282649 - DNA, 22 bp, Homo sapiens
tagagctgataatgaggccaag

SEQ ID NO: 8282650 - DNA, 22 bp, Homo sapiens
tagagctgagttgactccattt

SEQ ID NO: 8282651 - DNA, 22 bp, Homo sapiens
tagagcagccttcagagcagtt

SEQ ID NO: 8282652 - DNA, 22 bp, Homo sapiens
tagagcagttggcagctgtatt

SEQ ID NO: 8282653 - DNA, 22 bp, Homo sapiens
gcctggtgtccagaggcgagtg

SEQ ID NO: 8282654 - DNA, 22 bp, Homo sapiens
gccttcagtagtgtcagctgta

SEQ ID NO: 8282655 - DNA, 22 bp, Homo sapiens
gcctggtgaaaggcagagagcg

SEQ ID NO: 8282656 - DNA, 22 bp, Homo sapiens
gcctggctgggcaccaggggag

SEQ ID NO: 8282657 - DNA, 22 bp, Homo sapiens
gcctggctggtagagggggctc

SEQ ID NO: 8282658 - DNA, 22 bp, Homo sapiens
gcctggcttgccagccctggcg

SEQ ID NO: 8282659 - DNA, 22 bp, Homo sapiens
gcctcagggataggatgagcat

SEQ ID NO: 8282660 - DNA, 22 bp, Homo sapiens
gctcagctggagagggacgggt

SEQ ID NO: 8282661 - DNA, 22 bp, Homo sapiens
gctcacaggtctgtggctattg

SEQ ID NO: 8282662 - DNA, 22 bp, Homo sapiens
gctcaaggcaggcagacatgag

SEQ ID NO: 8282663 - DNA, 22 bp, Homo sapiens
gctcaagaccaagggagcgggg

SEQ ID NO: 8282664 - DNA, 22 bp, Homo sapiens
gctcaagaccagacaaagcctg

SEQ ID NO: 8282665 - DNA, 22 bp, Homo sapiens
gctcaagactgttagcctggca

SEQ ID NO: 8282666 - DNA, 22 bp, Homo sapiens
gctcaagacccctctgtgactg

SEQ ID NO: 8282667 - DNA, 22 bp, Homo sapiens
gctcaagagagatgcagttctt

SEQ ID NO: 8282668 - DNA, 22 bp, Homo sapiens
gctcaagatgtggcctctgaag

SEQ ID NO: 8282669 - DNA, 20 bp, Homo sapiens
gctcaagagcccattctgaa

SEQ ID NO: 8282670 - DNA, 22 bp, Homo sapiens
gctcaagagccagcgtctcctg

SEQ ID NO: 8282671 - DNA, 22 bp, Homo sapiens
gccttctctgtgagctcctagg

SEQ ID NO: 8282672 - DNA, 22 bp, Homo sapiens
gccttctgtgctcctggccttt

SEQ ID NO: 8282673 - DNA, 22 bp, Homo sapiens
gccttgatctgctgtgtttgag

SEQ ID NO: 8282674 - DNA, 22 bp, Homo sapiens
gcggaggaaactgaggcaagag

SEQ ID NO: 8282675 - DNA, 22 bp, Homo sapiens
gcggcggagacagcaggaagcc

SEQ ID NO: 8282676 - DNA, 22 bp, Homo sapiens
gctgcaggagctggagctgtgg

SEQ ID NO: 8282677 - DNA, 22 bp, Homo sapiens
gctgcaggagattttgagagtc

SEQ ID NO: 8282678 - DNA, 22 bp, Homo sapiens
gctgcagctttaggatccagtg

SEQ ID NO: 8282679 - DNA, 23 bp, Homo sapiens
gctgcagctgtggatgttctcag

SEQ ID NO: 8282680 - DNA, 22 bp, Homo sapiens
gctgcagggggtgggcgtctcc

SEQ ID NO: 8282681 - DNA, 22 bp, Homo sapiens
gctgcagggggtgggcgtctcc

SEQ ID NO: 8282682 - DNA, 22 bp, Homo sapiens
gctgcaggttgggcaacagagt

SEQ ID NO: 8282683 - DNA, 22 bp, Homo sapiens
gctgcaggttgggcaacagagt

SEQ ID NO: 8282684 - DNA, 22 bp, Homo sapiens
gctgcaggggggtctggacttg

SEQ ID NO: 8282685 - DNA, 22 bp, Homo sapiens
gctgccacgatctctgctgtag

SEQ ID NO: 8282686 - DNA, 22 bp, Homo sapiens
gctgccacttggtcatgtcatg

SEQ ID NO: 8282687 - DNA, 22 bp, Homo sapiens
gctgccagtgtggcatgatgca

SEQ ID NO: 8282688 - DNA, 22 bp, Homo sapiens
gctgccagctgcggcccacgcg

SEQ ID NO: 8282689 - DNA, 22 bp, Homo sapiens
gctgccagcgtcagacctgggg

SEQ ID NO: 8282690 - DNA, 22 bp, Homo sapiens
gctgcaaacctgccacctggtg

SEQ ID NO: 8282691 - DNA, 22 bp, Homo sapiens
gctgcaatggagtcaggctggt

SEQ ID NO: 8282692 - DNA, 22 bp, Homo sapiens
gctgaataggcacagagggcat

SEQ ID NO: 8282693 - DNA, 22 bp, Homo sapiens
gctgatgtgatgtcagaagagg

SEQ ID NO: 8282694 - DNA, 22 bp, Homo sapiens
gctgatgggagctggctcaccc

SEQ ID NO: 8282695 - DNA, 22 bp, Homo sapiens
gctgatggaattgtaaaatagt

SEQ ID NO: 8282696 - DNA, 22 bp, Homo sapiens
gctgatggaaggacaggcgccg

SEQ ID NO: 8282697 - DNA, 22 bp, Homo sapiens
gctgaagttttgcagagagtaa

SEQ ID NO: 8282698 - DNA, 22 bp, Homo sapiens
gctgaagggagtgctgagtctg

SEQ ID NO: 8282699 - DNA, 22 bp, Homo sapiens
gctgaaggcccggaggacaggg

SEQ ID NO: 8282700 - DNA, 19 bp, Homo sapiens
gctgaaggcgctcagaagc

SEQ ID NO: 8282701 - DNA, 22 bp, Homo sapiens
gctgaagcccacgtggcttgta

SEQ ID NO: 8282702 - DNA, 22 bp, Homo sapiens
gctgaagctgcagcaggaggaa

SEQ ID NO: 8282703 - DNA, 22 bp, Homo sapiens
gctctgctgacagctgggacag

SEQ ID NO: 8282704 - DNA, 22 bp, Homo sapiens
gctctgctgagatatctgggag

SEQ ID NO: 8282705 - DNA, 22 bp, Homo sapiens
gctctgctggaagttctctgga

SEQ ID NO: 8282706 - DNA, 23 bp, Homo sapiens
gctctgctctgtttcatagacag

SEQ ID NO: 8282707 - DNA, 22 bp, Homo sapiens
gctctgcctggtcgcgtgctgg

SEQ ID NO: 8282708 - DNA, 22 bp, Homo sapiens
gctctccagctacccctttagc

SEQ ID NO: 8282709 - DNA, 22 bp, Homo sapiens
gctctccagattcaggagggat

SEQ ID NO: 8282710 - DNA, 22 bp, Homo sapiens
gctctccaaaccctgtggcttt

SEQ ID NO: 8282711 - DNA, 22 bp, Homo sapiens
gctctccaaaccctgtggcttt

SEQ ID NO: 8282712 - DNA, 22 bp, Homo sapiens
gctctccactgaccacggggca

SEQ ID NO: 8282713 - DNA, 22 bp, Homo sapiens
gctcaggctctcccaggggaat

SEQ ID NO: 8282714 - DNA, 22 bp, Homo sapiens
gctcaggctctcccaggggaat

SEQ ID NO: 8282715 - DNA, 22 bp, Homo sapiens
gcttcccatagtggaattcggg

SEQ ID NO: 8282716 - DNA, 22 bp, Homo sapiens
gcttcccattatggaaactctt

SEQ ID NO: 8282717 - DNA, 22 bp, Homo sapiens
gcttcctcaccttctcttgcat

SEQ ID NO: 8282718 - DNA, 23 bp, Homo sapiens
gcttcccagacaatactgcttcc

SEQ ID NO: 8282719 - DNA, 22 bp, Homo sapiens
gcttcccaggcgcctgaccttt

SEQ ID NO: 8282720 - DNA, 22 bp, Homo sapiens
gcttcccagcagaggaaagact

SEQ ID NO: 8282721 - DNA, 19 bp, Homo sapiens
gcttcccaccagccagccc

SEQ ID NO: 8282722 - DNA, 22 bp, Homo sapiens
gcttcccacagctggactgggg

SEQ ID NO: 8282723 - DNA, 22 bp, Homo sapiens
gcttcccacagctggactgggg

SEQ ID NO: 8282724 - DNA, 22 bp, Homo sapiens
gcttcccaatgtgctagtttct

SEQ ID NO: 8282725 - DNA, 20 bp, Homo sapiens
gcttcccaattcttgatctg

SEQ ID NO: 8282726 - DNA, 22 bp, Homo sapiens
gcttcctccctgctgctcacta

SEQ ID NO: 8282727 - DNA, 22 bp, Homo sapiens
gcttcctcctggaggtcactca

SEQ ID NO: 8282728 - DNA, 22 bp, Homo sapiens
gcttcctccctgctgctcacta

SEQ ID NO: 8282729 - DNA, 22 bp, Homo sapiens
gcttcctcgctgggcagaggca

SEQ ID NO: 8282730 - DNA, 22 bp, Homo sapiens
ggaaaggctaacagtcatggaa

SEQ ID NO: 8282731 - DNA, 22 bp, Homo sapiens
ggaaaggcaggggccctgccca

SEQ ID NO: 8282732 - DNA, 22 bp, Homo sapiens
ggaaaggcctgggtgtcctggg

SEQ ID NO: 8282733 - DNA, 21 bp, Homo sapiens
ggaagctgtgtccatgctcct

SEQ ID NO: 8282734 - DNA, 22 bp, Homo sapiens
ggaagctgttgtgagtgcagca

SEQ ID NO: 8282735 - DNA, 22 bp, Homo sapiens
ggacacgatttattgctaaggg

SEQ ID NO: 8282736 - DNA, 21 bp, Homo sapiens
ggacaccagtcacactggatt

SEQ ID NO: 8282737 - DNA, 22 bp, Homo sapiens
ggacagagagtgaatatgacat

SEQ ID NO: 8282738 - DNA, 22 bp, Homo sapiens
ggacagagccctggtggcctaa

SEQ ID NO: 8282739 - DNA, 22 bp, Homo sapiens
ggacccaggtagggaggaagat

SEQ ID NO: 8282740 - DNA, 18 bp, Homo sapiens
ggacccagggcctcaccc

SEQ ID NO: 8282741 - DNA, 22 bp, Homo sapiens
ggacagagggttgacagagtat

SEQ ID NO: 8282742 - DNA, 21 bp, Homo sapiens
ggacagaggagaaggcaccct

SEQ ID NO: 8282743 - DNA, 22 bp, Homo sapiens
ggacctgaacataaaacgaggc

SEQ ID NO: 8282744 - DNA, 23 bp, Homo sapiens
ggactaggcaacagatgggacag

SEQ ID NO: 8282745 - DNA, 22 bp, Homo sapiens
ggagagagatgccgccttgctc

SEQ ID NO: 8282746 - DNA, 22 bp, Homo sapiens
gctggtagacctcactgcactc

SEQ ID NO: 8282747 - DNA, 22 bp, Homo sapiens
gctgtcttccttgctccaaggg

SEQ ID NO: 8282748 - DNA, 22 bp, Homo sapiens
gctgggtgtcacggggctcgtg

SEQ ID NO: 8282749 - DNA, 22 bp, Homo sapiens
gctgggtctctccctggtcctg

SEQ ID NO: 8282750 - DNA, 22 bp, Homo sapiens
gctgggtggatcggaggctctg

SEQ ID NO: 8282751 - DNA, 21 bp, Homo sapiens
gctgggtcagcaggtcctctg

SEQ ID NO: 8282752 - DNA, 22 bp, Homo sapiens
gctgggtccatggtcctcgggt

SEQ ID NO: 8282753 - DNA, 21 bp, Homo sapiens
gctgggtcagcaggtcctctg

SEQ ID NO: 8282754 - DNA, 22 bp, Homo sapiens
gctgggtcagaatctccctgtg

SEQ ID NO: 8282755 - DNA, 22 bp, Homo sapiens
gctgggtattttaagaaaggaa

SEQ ID NO: 8282756 - DNA, 16 bp, Homo sapiens
gctgggagggagaggt

SEQ ID NO: 8282757 - DNA, 22 bp, Homo sapiens
gctgtgagtggaggaggctgag

SEQ ID NO: 8282758 - DNA, 22 bp, Homo sapiens
gctgtgagtgagctgcctaggc

SEQ ID NO: 8282759 - DNA, 22 bp, Homo sapiens
gctgtgagtgagctgcctaggc

SEQ ID NO: 8282760 - DNA, 22 bp, Homo sapiens
gctgtgagggcttctgaggcat

SEQ ID NO: 8282761 - DNA, 22 bp, Homo sapiens
gctgtgagggcttctgaggcat

SEQ ID NO: 8282762 - DNA, 22 bp, Homo sapiens
gctgtgagtggagttctgtgct

SEQ ID NO: 8282763 - DNA, 22 bp, Homo sapiens
gctgtgagcactgctgggtgga

SEQ ID NO: 8282764 - DNA, 22 bp, Homo sapiens
gctgtgagccgctgctgagcat

SEQ ID NO: 8282765 - DNA, 22 bp, Homo sapiens
gctgtgagccgctgctgagcat

SEQ ID NO: 8282766 - DNA, 22 bp, Homo sapiens
gctgtgagctgcctgtgtcaca

SEQ ID NO: 8282767 - DNA, 22 bp, Homo sapiens
gctgtgagaaacagggagtgtc

SEQ ID NO: 8282768 - DNA, 22 bp, Homo sapiens
gctgtgagcactgctgggtgga

SEQ ID NO: 8282769 - DNA, 22 bp, Homo sapiens
gctgtcttgctcactcttgcag

SEQ ID NO: 8282770 - DNA, 20 bp, Homo sapiens
gctgtgccatgaccctcgag

SEQ ID NO: 8282771 - DNA, 22 bp, Homo sapiens
gctgtgcccagctccagctctg

SEQ ID NO: 8282772 - DNA, 22 bp, Homo sapiens
gcttcccaaacttgtggataga

SEQ ID NO: 8282773 - DNA, 22 bp, Homo sapiens
gcttcccaaacttgtggataga

SEQ ID NO: 8282774 - DNA, 21 bp, Homo sapiens
gctgcccaaccctgcatctcc

SEQ ID NO: 8282775 - DNA, 22 bp, Homo sapiens
gctggctcccagaggccccagc

SEQ ID NO: 8282776 - DNA, 22 bp, Homo sapiens
gctggctcaagtgtgcttccca

SEQ ID NO: 8282777 - DNA, 22 bp, Homo sapiens
gctggctgcacaggggctcact

SEQ ID NO: 8282778 - DNA, 18 bp, Homo sapiens
gctggctgcacttctgct

SEQ ID NO: 8282779 - DNA, 22 bp, Homo sapiens
gctggctctgatgggctccagg

SEQ ID NO: 8282780 - DNA, 22 bp, Homo sapiens
gctggctcctctgtcctcacgg

SEQ ID NO: 8282781 - DNA, 22 bp, Homo sapiens
gctggctcccattggtccttcc

SEQ ID NO: 8282782 - DNA, 22 bp, Homo sapiens
gctgggaagtggcagagctgga

SEQ ID NO: 8282783 - DNA, 22 bp, Homo sapiens
gcagagctccccaagacaccaa

SEQ ID NO: 8282784 - DNA, 22 bp, Homo sapiens
gcagagctgagcggctgcccgg

SEQ ID NO: 8282785 - DNA, 22 bp, Homo sapiens
gcagagctgagcggctgcccgg

SEQ ID NO: 8282786 - DNA, 22 bp, Homo sapiens
gcagagctctgttcttatctcc

SEQ ID NO: 8282787 - DNA, 22 bp, Homo sapiens
gcagagctgcagcgaggcctgg

SEQ ID NO: 8282788 - DNA, 22 bp, Homo sapiens
gcagaggacacaggagggcaag

SEQ ID NO: 8282789 - DNA, 20 bp, Homo sapiens
gcactgttacaaagcacacc

SEQ ID NO: 8282790 - DNA, 22 bp, Homo sapiens
gcactgttctaggtgcagagct

SEQ ID NO: 8282791 - DNA, 22 bp, Homo sapiens
gcactgcttttacctaggtgag

SEQ ID NO: 8282792 - DNA, 22 bp, Homo sapiens
gcactgctccaggtgtggcttg

SEQ ID NO: 8282793 - DNA, 22 bp, Homo sapiens
gcaagacctatctagttgctgt

SEQ ID NO: 8282794 - DNA, 22 bp, Homo sapiens
gcaaatgaactgatgccaatgg

SEQ ID NO: 8282795 - DNA, 22 bp, Homo sapiens
gcaaatcctggaccagcctctt

SEQ ID NO: 8282796 - DNA, 22 bp, Homo sapiens
gcaaatgctaaagtgtagagac

SEQ ID NO: 8282797 - DNA, 22 bp, Homo sapiens
gcaaatgacagactcaccttgg

SEQ ID NO: 8282798 - DNA, 22 bp, Homo sapiens
gaggggtccaggaggcacttac

SEQ ID NO: 8282799 - DNA, 22 bp, Homo sapiens
gaggggtcacatgggctggctt

SEQ ID NO: 8282800 - DNA, 22 bp, Homo sapiens
gcacagccttgccctgtgccct

SEQ ID NO: 8282801 - DNA, 22 bp, Homo sapiens
gcacagccctgagcgcatgtct

SEQ ID NO: 8282802 - DNA, 22 bp, Homo sapiens
gcacaggaaatgactcatgtta

SEQ ID NO: 8282803 - DNA, 22 bp, Homo sapiens
gcacagctggggtatgatgcca

SEQ ID NO: 8282804 - DNA, 22 bp, Homo sapiens
gcacaggcaatagatacagcta

SEQ ID NO: 8282805 - DNA, 22 bp, Homo sapiens
gcacagcatgaagagaggaagc

SEQ ID NO: 8282806 - DNA, 22 bp, Homo sapiens
gcaaggaacaaatgctctgctt

SEQ ID NO: 8282807 - DNA, 22 bp, Homo sapiens
gcaggagctttgcttactgctg

SEQ ID NO: 8282808 - DNA, 22 bp, Homo sapiens
gcagctggatttcaagagggag

SEQ ID NO: 8282809 - DNA, 22 bp, Homo sapiens
gcaggcctctaattcaccgcag

SEQ ID NO: 8282810 - DNA, 22 bp, Homo sapiens
gcagggccttagcagcggctgc

SEQ ID NO: 8282811 - DNA, 22 bp, Homo sapiens
gcaggctccaactggaggagtt

SEQ ID NO: 8282812 - DNA, 22 bp, Homo sapiens
gcagcaggactgccgttaaagt

SEQ ID NO: 8282813 - DNA, 22 bp, Homo sapiens
gcagcaggagagtaatagcggt

SEQ ID NO: 8282814 - DNA, 22 bp, Homo sapiens
gcagcaggagagtttgtcctgc

SEQ ID NO: 8282815 - DNA, 22 bp, Homo sapiens
gcagcaggagagtaatagcggt

SEQ ID NO: 8282816 - DNA, 22 bp, Homo sapiens
gcagcaggaatttaaatttata

SEQ ID NO: 8282817 - DNA, 22 bp, Homo sapiens
gcagcaggaataggataagcaa

SEQ ID NO: 8282818 - DNA, 22 bp, Homo sapiens
gcagcaggaataggataagcaa

SEQ ID NO: 8282819 - DNA, 22 bp, Homo sapiens
gcagcaggcacggtctcgacat

SEQ ID NO: 8282820 - DNA, 22 bp, Homo sapiens
gcagcaggatggccaattgcca

SEQ ID NO: 8282821 - DNA, 22 bp, Homo sapiens
gcagcaggatggccaattgcca

SEQ ID NO: 8282822 - DNA, 22 bp, Homo sapiens
gcagcaggatggccaattgcca

SEQ ID NO: 8282823 - DNA, 22 bp, Homo sapiens
gcagcaggagagtttgtcctgc

SEQ ID NO: 8282824 - DNA, 22 bp, Homo sapiens
gcagcaggagagtttgtcctgc

SEQ ID NO: 8282825 - DNA, 22 bp, Homo sapiens
gcagcaggcacggtctcgacat

SEQ ID NO: 8282826 - DNA, 22 bp, Homo sapiens
gcagcaggcacggtctcgacat

SEQ ID NO: 8282827 - DNA, 22 bp, Homo sapiens
gcagcaggtctgtcaatgtcat

SEQ ID NO: 8282828 - DNA, 22 bp, Homo sapiens
gcagcaggtctgtcaatgtcat

SEQ ID NO: 8282829 - DNA, 22 bp, Homo sapiens
gcagcaggtctgtcaatgtcat

SEQ ID NO: 8282830 - DNA, 22 bp, Homo sapiens
gcagcagtggtctgtagaagga

SEQ ID NO: 8282831 - DNA, 22 bp, Homo sapiens
gcagcagtggttttatcatttt

SEQ ID NO: 8282832 - DNA, 22 bp, Homo sapiens
gcagcagtgtgggctgaaccta

SEQ ID NO: 8282833 - DNA, 20 bp, Homo sapiens
gcagcagtgcaagtcctctt

SEQ ID NO: 8282834 - DNA, 22 bp, Homo sapiens
gcagcagtgcgggcagctacag

SEQ ID NO: 8282835 - DNA, 22 bp, Homo sapiens
gcagcaggtgtgcttttaatga

SEQ ID NO: 8282836 - DNA, 22 bp, Homo sapiens
gcagcagtaggaaataacacag

SEQ ID NO: 8282837 - DNA, 22 bp, Homo sapiens
gcagcagtactcaatatcctgg

SEQ ID NO: 8282838 - DNA, 22 bp, Homo sapiens
gcagcatgttgaaagggccaca

SEQ ID NO: 8282839 - DNA, 22 bp, Homo sapiens
gccctctggcagccttggctgg

SEQ ID NO: 8282840 - DNA, 22 bp, Homo sapiens
gccctctggtgggtgagccccg

SEQ ID NO: 8282841 - DNA, 22 bp, Homo sapiens
gcccagagttcaaggctgcagt

SEQ ID NO: 8282842 - DNA, 22 bp, Homo sapiens
gcccagggcagggcaagagtga

SEQ ID NO: 8282843 - DNA, 22 bp, Homo sapiens
gccctgagactgaagaactgtc

SEQ ID NO: 8282844 - DNA, 22 bp, Homo sapiens
gccctgaggcaaaagaacagtc

SEQ ID NO: 8282845 - DNA, 22 bp, Homo sapiens
gcctcagctcccagcccaggct

SEQ ID NO: 8282846 - DNA, 22 bp, Homo sapiens
gccaggaatggagaggtggcct

SEQ ID NO: 8282847 - DNA, 22 bp, Homo sapiens
gccagccccttagggctctccc

SEQ ID NO: 8282848 - DNA, 22 bp, Homo sapiens
gccaggagaaaaggcgaatgat

SEQ ID NO: 8282849 - DNA, 22 bp, Homo sapiens
gccaggagtgtgtggctatgtt

SEQ ID NO: 8282850 - DNA, 22 bp, Homo sapiens
gccaggagccctgggcaagttc

SEQ ID NO: 8282851 - DNA, 22 bp, Homo sapiens
gccaggagactccattcatttg

SEQ ID NO: 8282852 - DNA, 22 bp, Homo sapiens
gccaggagttcagatgcatgtt

SEQ ID NO: 8282853 - DNA, 23 bp, Homo sapiens
gccaggcacatggtggacacgca

SEQ ID NO: 8282854 - DNA, 22 bp, Homo sapiens
gccaggtgtagtggccacacct

SEQ ID NO: 8282855 - DNA, 22 bp, Homo sapiens
gccaggtggtctggctccagag

SEQ ID NO: 8282856 - DNA, 22 bp, Homo sapiens
gccaggttctggggaggtacaa

SEQ ID NO: 8282857 - DNA, 22 bp, Homo sapiens
gccaggtgtcctcacagtgagg

SEQ ID NO: 8282858 - DNA, 22 bp, Homo sapiens
gccaggtggtctggctccagag

SEQ ID NO: 8282859 - DNA, 22 bp, Homo sapiens
gccaggtgggagacagacagca

SEQ ID NO: 8282860 - DNA, 22 bp, Homo sapiens
gccaggtggtctggctccagag

SEQ ID NO: 8282861 - DNA, 22 bp, Homo sapiens
gccaggtctcataaatgcagct

SEQ ID NO: 8282862 - DNA, 22 bp, Homo sapiens
gccaggtctgcaggcatcctga

SEQ ID NO: 8282863 - DNA, 22 bp, Homo sapiens
gccaggtcgtctccatgtccaa

SEQ ID NO: 8282864 - DNA, 22 bp, Homo sapiens
gccagtggcttgccaggcagga

SEQ ID NO: 8282865 - DNA, 22 bp, Homo sapiens
gccagtggagcacatggtgaag

SEQ ID NO: 8282866 - DNA, 22 bp, Homo sapiens
gccagtggaggacccatggaga

SEQ ID NO: 8282867 - DNA, 22 bp, Homo sapiens
gccagtggcatgcggcagggac

SEQ ID NO: 8282868 - DNA, 22 bp, Homo sapiens
gccagtggcttgccaggcagga

SEQ ID NO: 8282869 - DNA, 22 bp, Homo sapiens
gccagtggccctctggagaagg

SEQ ID NO: 8282870 - DNA, 18 bp, Homo sapiens
gccagtgccctggctcac

SEQ ID NO: 8282871 - DNA, 22 bp, Homo sapiens
gccagtgctgtcatggaaatcc

SEQ ID NO: 8282872 - DNA, 22 bp, Homo sapiens
gccagtgcttgtggagctggca

SEQ ID NO: 8282873 - DNA, 22 bp, Homo sapiens
gccagtgcttgtggagctggca

SEQ ID NO: 8282874 - DNA, 22 bp, Homo sapiens
gccaggttgctgacgacgatct

SEQ ID NO: 8282875 - DNA, 22 bp, Homo sapiens
gcccagagtgagtcctgggccc

SEQ ID NO: 8282876 - DNA, 18 bp, Homo sapiens
gcccagaggtctgggccc

SEQ ID NO: 8282877 - DNA, 23 bp, Homo sapiens
gcccagagaggctcaccaggaat

SEQ ID NO: 8282878 - DNA, 21 bp, Homo sapiens
gcccagagggagccaagccca

SEQ ID NO: 8282879 - DNA, 22 bp, Homo sapiens
gcccagagggaagaggtgtcat

SEQ ID NO: 8282880 - DNA, 22 bp, Homo sapiens
gcccagagagatgaagtgatgg

SEQ ID NO: 8282881 - DNA, 22 bp, Homo sapiens
gcccagagagatgctgtagacc

SEQ ID NO: 8282882 - DNA, 22 bp, Homo sapiens
gcatgattaatatgcttactgt

SEQ ID NO: 8282883 - DNA, 22 bp, Homo sapiens
gcatgcaactcccagttctgcc

SEQ ID NO: 8282884 - DNA, 22 bp, Homo sapiens
gcatgacattcctaatcacagt

SEQ ID NO: 8282885 - DNA, 22 bp, Homo sapiens
gcatgactggttttcttacaaa

SEQ ID NO: 8282886 - DNA, 22 bp, Homo sapiens
gccagagcacaggctggtagta

SEQ ID NO: 8282887 - DNA, 22 bp, Homo sapiens
gccagagcacaggctggtagta

SEQ ID NO: 8282888 - DNA, 22 bp, Homo sapiens
gccagagaggccgaggtaccca

SEQ ID NO: 8282889 - DNA, 22 bp, Homo sapiens
gccagagaggcaaatcctagca

SEQ ID NO: 8282890 - DNA, 22 bp, Homo sapiens
gccagagccggcttcacaggat

SEQ ID NO: 8282891 - DNA, 22 bp, Homo sapiens
gccagagccacttttgggtgat

SEQ ID NO: 8282892 - DNA, 21 bp, Homo sapiens
gccagagcagtacaatgaggt

SEQ ID NO: 8282893 - DNA, 22 bp, Homo sapiens
gccagagcatgcactgcctgca

SEQ ID NO: 8282894 - DNA, 22 bp, Homo sapiens
gccagagcatcgcaccctccat

SEQ ID NO: 8282895 - DNA, 22 bp, Homo sapiens
gccagagcagaatagagtggcc

SEQ ID NO: 8282896 - DNA, 21 bp, Homo sapiens
gccagagcagtacaatgaggt

SEQ ID NO: 8282897 - DNA, 22 bp, Homo sapiens
gcattttataaagagttatttg

SEQ ID NO: 8282898 - DNA, 22 bp, Homo sapiens
gccaaggcctgcagcacctcat

SEQ ID NO: 8282899 - DNA, 22 bp, Homo sapiens
gccaaggagacacggtgttgta

SEQ ID NO: 8282900 - DNA, 22 bp, Homo sapiens
gccaagcttggaaggatcatgg

SEQ ID NO: 8282901 - DNA, 22 bp, Homo sapiens
gccaagctgtttttcagagacg

SEQ ID NO: 8282902 - DNA, 22 bp, Homo sapiens
gccaagctcaccttctgatgga

SEQ ID NO: 8282903 - DNA, 22 bp, Homo sapiens
gccagcagtggccaccaccagg

SEQ ID NO: 8282904 - DNA, 22 bp, Homo sapiens
gccagcattccttggctcctgg

SEQ ID NO: 8282905 - DNA, 22 bp, Homo sapiens
gccagccataggccagcactgg

SEQ ID NO: 8282906 - DNA, 22 bp, Homo sapiens
gccagcagtcctgctgtgtgcc

SEQ ID NO: 8282907 - DNA, 22 bp, Homo sapiens
gccagcagtccagtccttagtg

SEQ ID NO: 8282908 - DNA, 22 bp, Homo sapiens
gccagcagtatgtcctggcagt

SEQ ID NO: 8282909 - DNA, 22 bp, Homo sapiens
gccagcccattaacccctgtcc

SEQ ID NO: 8282910 - DNA, 20 bp, Homo sapiens
gccagaggccggcaggggct

SEQ ID NO: 8282911 - DNA, 22 bp, Homo sapiens
gccagcagggcccaaatgctgg

SEQ ID NO: 8282912 - DNA, 22 bp, Homo sapiens
gccagaggcccaaggacagctg

SEQ ID NO: 8282913 - DNA, 22 bp, Homo sapiens
gccagcagggcggagccatcta

SEQ ID NO: 8282914 - DNA, 22 bp, Homo sapiens
gccagcaggttgtcaaggagct

SEQ ID NO: 8282915 - DNA, 22 bp, Homo sapiens
gccagcaggtggagagatcaag

SEQ ID NO: 8282916 - DNA, 22 bp, Homo sapiens
gccagagcttcccccgagtgtg

SEQ ID NO: 8282917 - DNA, 23 bp, Homo sapiens
gccagagctgcctgcccttgctg

SEQ ID NO: 8282918 - DNA, 22 bp, Homo sapiens
gccagagcttcccccgagtgtg

SEQ ID NO: 8282919 - DNA, 22 bp, Homo sapiens
gccagagctgagtgaggttctt

SEQ ID NO: 8282920 - DNA, 22 bp, Homo sapiens
gccagagctgagacacgagtcc

SEQ ID NO: 8282921 - DNA, 22 bp, Homo sapiens
gccagaggaacgctgcgcgccc

SEQ ID NO: 8282922 - DNA, 22 bp, Homo sapiens
gccagaggaacgctgcgcgccc

SEQ ID NO: 8282923 - DNA, 22 bp, Homo sapiens
ggctgtgccctcacatggggca

SEQ ID NO: 8282924 - DNA, 22 bp, Homo sapiens
ggctgggtttgactcctggctt

SEQ ID NO: 8282925 - DNA, 21 bp, Homo sapiens
ggctgggtcatgcagctggcc

SEQ ID NO: 8282926 - DNA, 18 bp, Homo sapiens
ggctgaggttgactagaa

SEQ ID NO: 8282927 - DNA, 22 bp, Homo sapiens
ggctgcttaaacagatgtgctg

SEQ ID NO: 8282928 - DNA, 21 bp, Homo sapiens
ggctgctgggggttggcacag

SEQ ID NO: 8282929 - DNA, 22 bp, Homo sapiens
ggctgctgggtcatgatgcaga

SEQ ID NO: 8282930 - DNA, 22 bp, Homo sapiens
ggctacagaggccgtgagcctg

SEQ ID NO: 8282931 - DNA, 22 bp, Homo sapiens
ggctaatatacccagctctgta

SEQ ID NO: 8282932 - DNA, 22 bp, Homo sapiens
ggctacagggcctggccaaggt

SEQ ID NO: 8282933 - DNA, 22 bp, Homo sapiens
ggctagcttagagtcatgctag

SEQ ID NO: 8282934 - DNA, 22 bp, Homo sapiens
ggctagctcctccgcgcatcca

SEQ ID NO: 8282935 - DNA, 22 bp, Homo sapiens
ggctagcttagagtcatgctag

SEQ ID NO: 8282936 - DNA, 23 bp, Homo sapiens
ggctagagtggaggggaactgca

SEQ ID NO: 8282937 - DNA, 22 bp, Homo sapiens
ggctccctgcctgtcctcagtc

SEQ ID NO: 8282938 - DNA, 22 bp, Homo sapiens
ggctccagggagtggagagaag

SEQ ID NO: 8282939 - DNA, 22 bp, Homo sapiens
ggctccaggctcctatttcact

SEQ ID NO: 8282940 - DNA, 22 bp, Homo sapiens
ggctcctgaggaccaggcacag

SEQ ID NO: 8282941 - DNA, 22 bp, Homo sapiens
ggctcctgagaatgggccatca

SEQ ID NO: 8282942 - DNA, 22 bp, Homo sapiens
ggctcctgaaagactatgggaa

SEQ ID NO: 8282943 - DNA, 22 bp, Homo sapiens
ggctctgggcctccaaggtctg

SEQ ID NO: 8282944 - DNA, 22 bp, Homo sapiens
ggctgagcactttaggcaggag

SEQ ID NO: 8282945 - DNA, 22 bp, Homo sapiens
ggctgagccatgggcactgcag

SEQ ID NO: 8282946 - DNA, 22 bp, Homo sapiens
gggagggatctgctaggcaatg

SEQ ID NO: 8282947 - DNA, 22 bp, Homo sapiens
gggagggaggtgctggttcacg

SEQ ID NO: 8282948 - DNA, 22 bp, Homo sapiens
gggaggtgattaggaccatgta

SEQ ID NO: 8282949 - DNA, 22 bp, Homo sapiens
gggaggttgaggctgcagtgag

SEQ ID NO: 8282950 - DNA, 21 bp, Homo sapiens
gggagggatggaaatgatgtt

SEQ ID NO: 8282951 - DNA, 22 bp, Homo sapiens
gggcaggttattggagtaggga

SEQ ID NO: 8282952 - DNA, 23 bp, Homo sapiens
gggcaggtttttataggcttcag

SEQ ID NO: 8282953 - DNA, 22 bp, Homo sapiens
gggcactggaggccaaggagct

SEQ ID NO: 8282954 - DNA, 22 bp, Homo sapiens
gggcaccttgggtctcaggcaa

SEQ ID NO: 8282955 - DNA, 22 bp, Homo sapiens
gggcacagtctgcagcccccca

SEQ ID NO: 8282956 - DNA, 18 bp, Homo sapiens
ggctttgctggggtttct

SEQ ID NO: 8282957 - DNA, 22 bp, Homo sapiens
ggctttgcattttgatggaggt

SEQ ID NO: 8282958 - DNA, 22 bp, Homo sapiens
ggctttgcaggcagcatcaagg

SEQ ID NO: 8282959 - DNA, 22 bp, Homo sapiens
ggctttgccctggactgaggca

SEQ ID NO: 8282960 - DNA, 22 bp, Homo sapiens
ggctttgcctgaataagcccac

SEQ ID NO: 8282961 - DNA, 22 bp, Homo sapiens
ggctttgcctggaatttccttg

SEQ ID NO: 8282962 - DNA, 22 bp, Homo sapiens
ggctttgcagtcatgttttgct

SEQ ID NO: 8282963 - DNA, 23 bp, Homo sapiens
ggctttgccacatattgaccatg

SEQ ID NO: 8282964 - DNA, 23 bp, Homo sapiens
ggctttgctctgggttctagggt

SEQ ID NO: 8282965 - DNA, 21 bp, Homo sapiens
ggctttgctcagcttaccaaa

SEQ ID NO: 8282966 - DNA, 22 bp, Homo sapiens
ggctttgcgaagatggcggcgc

SEQ ID NO: 8282967 - DNA, 22 bp, Homo sapiens
ggctttgcttaacgtgcttcta

SEQ ID NO: 8282968 - DNA, 22 bp, Homo sapiens
ggctttgacatgctgaattaaa

SEQ ID NO: 8282969 - DNA, 22 bp, Homo sapiens
ggctttgatgtggtgtcaattt

SEQ ID NO: 8282970 - DNA, 22 bp, Homo sapiens
ggctttgcaaaatcggcttctg

SEQ ID NO: 8282971 - DNA, 22 bp, Homo sapiens
ggctttgcagcctcattgctct

SEQ ID NO: 8282972 - DNA, 22 bp, Homo sapiens
ggctttgcaaactcattccaca

SEQ ID NO: 8282973 - DNA, 22 bp, Homo sapiens
ggctttgacatgctgaattaaa

SEQ ID NO: 8282974 - DNA, 22 bp, Homo sapiens
ggctttgacatgctgaattaaa

SEQ ID NO: 8282975 - DNA, 22 bp, Homo sapiens
ggctttattttgcatgaatgct

SEQ ID NO: 8282976 - DNA, 22 bp, Homo sapiens
ggctttctagatctagctctgt

SEQ ID NO: 8282977 - DNA, 22 bp, Homo sapiens
ggctttctcacagcatggcagc

SEQ ID NO: 8282978 - DNA, 22 bp, Homo sapiens
ggctttctgtctgcgtctgtgt

SEQ ID NO: 8282979 - DNA, 22 bp, Homo sapiens
ggctttatagggtagaggatca

SEQ ID NO: 8282980 - DNA, 22 bp, Homo sapiens
ggctttatgcagggatagaaat

SEQ ID NO: 8282981 - DNA, 22 bp, Homo sapiens
ggctttatcaaatgagaccctg

SEQ ID NO: 8282982 - DNA, 22 bp, Homo sapiens
ggctttatgcacagcagatggt

SEQ ID NO: 8282983 - DNA, 22 bp, Homo sapiens
ggctttatattgtttgagcaga

SEQ ID NO: 8282984 - DNA, 22 bp, Homo sapiens
ggctttatattgtttgagcaga

SEQ ID NO: 8282985 - DNA, 22 bp, Homo sapiens
ggctttattatgtggccatgtg

SEQ ID NO: 8282986 - DNA, 22 bp, Homo sapiens
ggctttatttgcagccattgtt

SEQ ID NO: 8282987 - DNA, 22 bp, Homo sapiens
ggctttatttcactgtaccata

SEQ ID NO: 8282988 - DNA, 21 bp, Homo sapiens
ggctttatgctcacccagcct

SEQ ID NO: 8282989 - DNA, 22 bp, Homo sapiens
ggctttatgtttttcatgtggt

SEQ ID NO: 8282990 - DNA, 22 bp, Homo sapiens
ggctttattaactcatccgtaa

SEQ ID NO: 8282991 - DNA, 22 bp, Homo sapiens
ggctttattaagcagggtaagt

SEQ ID NO: 8282992 - DNA, 16 bp, Homo sapiens
ggcagcagctccgtgc

SEQ ID NO: 8282993 - DNA, 22 bp, Homo sapiens
ggcactgattccattcatgaag

SEQ ID NO: 8282994 - DNA, 22 bp, Homo sapiens
ggcactgcaggtaagtgctgtc

SEQ ID NO: 8282995 - DNA, 21 bp, Homo sapiens
ggcactgctgggccatctgct

SEQ ID NO: 8282996 - DNA, 22 bp, Homo sapiens
ggcagcagggtctagattgatg

SEQ ID NO: 8282997 - DNA, 22 bp, Homo sapiens
ggcagcagggtagccatttctc

SEQ ID NO: 8282998 - DNA, 22 bp, Homo sapiens
ggcagcagggctgtctccctac

SEQ ID NO: 8282999 - DNA, 22 bp, Homo sapiens
ggcagcagggctgtctccctac

SEQ ID NO: 8283000 - DNA, 22 bp, Homo sapiens
ggcagccatactcagacctggg

SEQ ID NO: 8283001 - DNA, 22 bp, Homo sapiens
ggcagccatgcacgctgcctgg

SEQ ID NO: 8283002 - DNA, 17 bp, Homo sapiens
ggcagctgtgtgcatgc

SEQ ID NO: 8283003 - DNA, 17 bp, Homo sapiens
ggcagctgtgtgcatgc

SEQ ID NO: 8283004 - DNA, 22 bp, Homo sapiens
ggcagctgtttgtcctcctgtt

SEQ ID NO: 8283005 - DNA, 22 bp, Homo sapiens
ggcagctgttggctctctagga

SEQ ID NO: 8283006 - DNA, 22 bp, Homo sapiens
ggcagcttcggacggcttataa

SEQ ID NO: 8283007 - DNA, 22 bp, Homo sapiens
ggatgacagcaagggggtgaag

SEQ ID NO: 8283008 - DNA, 22 bp, Homo sapiens
ggatgacagctcttccatgtgg

SEQ ID NO: 8283009 - DNA, 22 bp, Homo sapiens
ggatgacacagttagaaagaga

SEQ ID NO: 8283010 - DNA, 22 bp, Homo sapiens
ggagatggtggaagctggtgca

SEQ ID NO: 8283011 - DNA, 22 bp, Homo sapiens
ggagatgggggattttacagcg

SEQ ID NO: 8283012 - DNA, 22 bp, Homo sapiens
ggagatggtctgttctcatatt

SEQ ID NO: 8283013 - DNA, 21 bp, Homo sapiens
ggagatgggtatcgcctgggc

SEQ ID NO: 8283014 - DNA, 22 bp, Homo sapiens
ggagatggctggcaggtagatg

SEQ ID NO: 8283015 - DNA, 22 bp, Homo sapiens
ggagatggcaagaagttattag

SEQ ID NO: 8283016 - DNA, 22 bp, Homo sapiens
ggagatggccaaaaacacaaat

SEQ ID NO: 8283017 - DNA, 22 bp, Homo sapiens
ggagatggagtggattcagcag

SEQ ID NO: 8283018 - DNA, 22 bp, Homo sapiens
ggagatggctctgcaaggtcta

SEQ ID NO: 8283019 - DNA, 22 bp, Homo sapiens
ggagatggccacgtcactcagt

SEQ ID NO: 8283020 - DNA, 22 bp, Homo sapiens
ggatgctgggagacagcaggca

SEQ ID NO: 8283021 - DNA, 22 bp, Homo sapiens
ggatggccttcttgctcaggaa

SEQ ID NO: 8283022 - DNA, 20 bp, Homo sapiens
ggattctgactgtgaagagg

SEQ ID NO: 8283023 - DNA, 18 bp, Homo sapiens
ggattctggggacctggg

SEQ ID NO: 8283024 - DNA, 22 bp, Homo sapiens
ggccaggagaggagggcactga

SEQ ID NO: 8283025 - DNA, 22 bp, Homo sapiens
ggccaggcactgtgtgagatat

SEQ ID NO: 8283026 - DNA, 22 bp, Homo sapiens
ggccctggcagccacgaaagcc

SEQ ID NO: 8283027 - DNA, 22 bp, Homo sapiens
ggccctgctgagtggagtggag

SEQ ID NO: 8283028 - DNA, 22 bp, Homo sapiens
ggccctggtcctaggggtggaa

SEQ ID NO: 8283029 - DNA, 22 bp, Homo sapiens
ggccctgggcagaggagtgggc

SEQ ID NO: 8283030 - DNA, 19 bp, Homo sapiens
ggcctggctatccctgctg

SEQ ID NO: 8283031 - DNA, 22 bp, Homo sapiens
ggcatctggatctgcttctccc

SEQ ID NO: 8283032 - DNA, 22 bp, Homo sapiens
ggcatctgtccatctctccagc

SEQ ID NO: 8283033 - DNA, 18 bp, Homo sapiens
ggcatctgcacagcagcc

SEQ ID NO: 8283034 - DNA, 22 bp, Homo sapiens
ggcagtggtgggaggctcgctc

SEQ ID NO: 8283035 - DNA, 22 bp, Homo sapiens
ggcagtgggttccccaaggcac

SEQ ID NO: 8283036 - DNA, 19 bp, Homo sapiens
ggcatccacagctggagag

SEQ ID NO: 8283037 - DNA, 22 bp, Homo sapiens
ggcatccaaataccaagatgta

SEQ ID NO: 8283038 - DNA, 22 bp, Homo sapiens
ggcatcctctagaagctggaaa

SEQ ID NO: 8283039 - DNA, 22 bp, Homo sapiens
ggccagcttctctgctgcctgt

SEQ ID NO: 8283040 - DNA, 19 bp, Homo sapiens
ggccagctgtctcctgcta

SEQ ID NO: 8283041 - DNA, 22 bp, Homo sapiens
ggccagctttgagctgcaggaa

SEQ ID NO: 8283042 - DNA, 22 bp, Homo sapiens
ggcatgcttgccatgggccagt

SEQ ID NO: 8283043 - DNA, 22 bp, Homo sapiens
ggcatgcttctgagatgtctcc

SEQ ID NO: 8283044 - DNA, 22 bp, Homo sapiens
ggcagggtggcagaggctcaga

SEQ ID NO: 8283045 - DNA, 22 bp, Homo sapiens
ggcagtgggtggatctcaggga

SEQ ID NO: 8283046 - DNA, 22 bp, Homo sapiens
ggcagtgggttccccaaggcac

SEQ ID NO: 8283047 - DNA, 22 bp, Homo sapiens
ggcagggtaaaccgaggtaagt

SEQ ID NO: 8283048 - DNA, 22 bp, Homo sapiens
gggctccagcccgggaccaggt

SEQ ID NO: 8283049 - DNA, 22 bp, Homo sapiens
gggctccagtttggccaggaag

SEQ ID NO: 8283050 - DNA, 22 bp, Homo sapiens
gggctccaggagccctaagaga

SEQ ID NO: 8283051 - DNA, 19 bp, Homo sapiens
gggctccttgggcctctct

SEQ ID NO: 8283052 - DNA, 22 bp, Homo sapiens
gggctcctggcagtcatgctca

SEQ ID NO: 8283053 - DNA, 22 bp, Homo sapiens
gggctcctgcctcctggcacct

SEQ ID NO: 8283054 - DNA, 19 bp, Homo sapiens
gggctctcgagcaaccaac

SEQ ID NO: 8283055 - DNA, 22 bp, Homo sapiens
gggctctcccacaacgtgccag

SEQ ID NO: 8283056 - DNA, 22 bp, Homo sapiens
gggctctcatgagtgtgtggta

SEQ ID NO: 8283057 - DNA, 22 bp, Homo sapiens
gggctctcgattagaccctggg

SEQ ID NO: 8283058 - DNA, 22 bp, Homo sapiens
gggctctctttttggcctgccc

SEQ ID NO: 8283059 - DNA, 22 bp, Homo sapiens
gggcatcttgtagccttcactt

SEQ ID NO: 8283060 - DNA, 20 bp, Homo sapiens
gggcatctttgctcctgttt

SEQ ID NO: 8283061 - DNA, 22 bp, Homo sapiens
gggcatgagagggcagctggca

SEQ ID NO: 8283062 - DNA, 22 bp, Homo sapiens
gggcatcttctgtagccatctc

SEQ ID NO: 8283063 - DNA, 22 bp, Homo sapiens
gggcatctggtggagcctcagg

SEQ ID NO: 8283064 - DNA, 22 bp, Homo sapiens
gggcatccagagggatgcctgg

SEQ ID NO: 8283065 - DNA, 22 bp, Homo sapiens
gggcctctgtgcagaggggcct

SEQ ID NO: 8283066 - DNA, 22 bp, Homo sapiens
gggcctccgtgtgctggtgctc

SEQ ID NO: 8283067 - DNA, 22 bp, Homo sapiens
gggggagctagtccagctgagg

SEQ ID NO: 8283068 - DNA, 22 bp, Homo sapiens
gggggagagacgagcggctctg

SEQ ID NO: 8283069 - DNA, 22 bp, Homo sapiens
gggggagaagattctgctgctt

SEQ ID NO: 8283070 - DNA, 22 bp, Homo sapiens
gggtcagctgctgggggctgac

SEQ ID NO: 8283071 - DNA, 22 bp, Homo sapiens
gggtcagcgatttcaggggcag

SEQ ID NO: 8283072 - DNA, 22 bp, Homo sapiens
ggggcaggagcccttcttcagc

SEQ ID NO: 8283073 - DNA, 22 bp, Homo sapiens
gggctgggattgcttgctgtga

SEQ ID NO: 8283074 - DNA, 22 bp, Homo sapiens
gggctgggaatggctaagtatg

SEQ ID NO: 8283075 - DNA, 22 bp, Homo sapiens
ggggatggtagaccggtgacgt

SEQ ID NO: 8283076 - DNA, 22 bp, Homo sapiens
ggggatggtggcatttgtaaaa

SEQ ID NO: 8283077 - DNA, 22 bp, Homo sapiens
ggggatggaggcgtgtggtcct

SEQ ID NO: 8283078 - DNA, 22 bp, Homo sapiens
ggggcagaaagcccacagagtg

SEQ ID NO: 8283079 - DNA, 22 bp, Homo sapiens
ggggcacctcctcttggcaatt

SEQ ID NO: 8283080 - DNA, 22 bp, Homo sapiens
ggggcacctcctcttggcaatt

SEQ ID NO: 8283081 - DNA, 22 bp, Homo sapiens
ggggcaaagtggttgctattgg

SEQ ID NO: 8283082 - DNA, 22 bp, Homo sapiens
ggggcaaagggagagtccctac

SEQ ID NO: 8283083 - DNA, 22 bp, Homo sapiens
ggtggctgaagcagtcttcggg

SEQ ID NO: 8283084 - DNA, 22 bp, Homo sapiens
ggtgccatattatatacagttt

SEQ ID NO: 8283085 - DNA, 22 bp, Homo sapiens
ggtgccctggaagctgctgcat

SEQ ID NO: 8283086 - DNA, 22 bp, Homo sapiens
ggtgccactgcactctggcctg

SEQ ID NO: 8283087 - DNA, 21 bp, Homo sapiens
ggtgggcacaggagagcagag

SEQ ID NO: 8283088 - DNA, 22 bp, Homo sapiens
ggtgggcaacatttggcctgag

SEQ ID NO: 8283089 - DNA, 22 bp, Homo sapiens
ggtggctgcaatggctaacttc

SEQ ID NO: 8283090 - DNA, 22 bp, Homo sapiens
ggtggctgaatcaaatcaggcc

SEQ ID NO: 8283091 - DNA, 22 bp, Homo sapiens
ggtggctgcaccctggctaact

SEQ ID NO: 8283092 - DNA, 22 bp, Homo sapiens
ggtcccaaggaggatgaggcta

SEQ ID NO: 8283093 - DNA, 22 bp, Homo sapiens
ggtcttcagctttgcatgtctt

SEQ ID NO: 8283094 - DNA, 22 bp, Homo sapiens
ggtgcatggaaagagtaagtaa

SEQ ID NO: 8283095 - DNA, 22 bp, Homo sapiens
ggtaaggagctccggcttctgc

SEQ ID NO: 8283096 - DNA, 22 bp, Homo sapiens
ggtaaggagagagaaattatgc

SEQ ID NO: 8283097 - DNA, 22 bp, Homo sapiens
ggtagaaggggaagaggtccat

SEQ ID NO: 8283098 - DNA, 22 bp, Homo sapiens
ggtaccatgagatgccactaat

SEQ ID NO: 8283099 - DNA, 23 bp, Homo sapiens
ggtaccagcacagagtggagagg

SEQ ID NO: 8283100 - DNA, 22 bp, Homo sapiens
ggtaagcacttcatgtacatga

SEQ ID NO: 8283101 - DNA, 21 bp, Homo sapiens
ggtagcttcccttctggaata

SEQ ID NO: 8283102 - DNA, 22 bp, Homo sapiens
ggtagcgttatcaatttgagtg

SEQ ID NO: 8283103 - DNA, 22 bp, Homo sapiens
ggtcaggaaaagactccccaga

SEQ ID NO: 8283104 - DNA, 22 bp, Homo sapiens
ggtcaggccactcaacccttat

SEQ ID NO: 8283105 - DNA, 19 bp, Homo sapiens
ggtcagctgggctagaggc

SEQ ID NO: 8283106 - DNA, 22 bp, Homo sapiens
ggtgggcacccgagactggatc

SEQ ID NO: 8283107 - DNA, 22 bp, Homo sapiens
ggtgggcacattcagtctctgt

SEQ ID NO: 8283108 - DNA, 22 bp, Homo sapiens
ggtgggcagctcttggcaggca

SEQ ID NO: 8283109 - DNA, 22 bp, Homo sapiens
gtaaatcatggtcagaataaat

SEQ ID NO: 8283110 - DNA, 22 bp, Homo sapiens
gtaatctcagctacttgggagg

SEQ ID NO: 8283111 - DNA, 22 bp, Homo sapiens
gtagccagatctgctgtgtctg

SEQ ID NO: 8283112 - DNA, 22 bp, Homo sapiens
gtagcccacctggggagggcga

SEQ ID NO: 8283113 - DNA, 16 bp, Homo sapiens
gtagccgtggccgctg

SEQ ID NO: 8283114 - DNA, 22 bp, Homo sapiens
gtagaggggtgattctgtgaga

SEQ ID NO: 8283115 - DNA, 22 bp, Homo sapiens
gtaggaaatcaggggtttaagc

SEQ ID NO: 8283116 - DNA, 22 bp, Homo sapiens
gtagctttaaagactggctgat

SEQ ID NO: 8283117 - DNA, 22 bp, Homo sapiens
gtaggaaagggagtgaagggaa

SEQ ID NO: 8283118 - DNA, 22 bp, Homo sapiens
gtaggaaagtaaatgaaataca

SEQ ID NO: 8283119 - DNA, 22 bp, Homo sapiens
gtagctttatagtgaataaacc

SEQ ID NO: 8283120 - DNA, 22 bp, Homo sapiens
gtagctgtgtataattgagaat

SEQ ID NO: 8283121 - DNA, 22 bp, Homo sapiens
gtcaacttgacaggcagagtgg

SEQ ID NO: 8283122 - DNA, 22 bp, Homo sapiens
gtcaatatcttggttgtactat

SEQ ID NO: 8283123 - DNA, 22 bp, Homo sapiens
gtcaggctggggctgctgccag

SEQ ID NO: 8283124 - DNA, 22 bp, Homo sapiens
gtcaccagtcccagctcctgaa

SEQ ID NO: 8283125 - DNA, 22 bp, Homo sapiens
gtcagggatccactgctcttct

SEQ ID NO: 8283126 - DNA, 21 bp, Homo sapiens
gtcagggattcaagtgctcac

SEQ ID NO: 8283127 - DNA, 22 bp, Homo sapiens
gtcacagtgtatctcttcagct

SEQ ID NO: 8283128 - DNA, 19 bp, Homo sapiens
gtcctctcaacaacccggg

SEQ ID NO: 8283129 - DNA, 22 bp, Homo sapiens
gtctcccatgtccctgtccagt

SEQ ID NO: 8283130 - DNA, 22 bp, Homo sapiens
gtcctctgcccaggtcaaggtt

SEQ ID NO: 8283131 - DNA, 22 bp, Homo sapiens
gtctcccactttctggcctctt

SEQ ID NO: 8283132 - DNA, 22 bp, Homo sapiens
gtctcccatcgtttgtgaggaa

SEQ ID NO: 8283133 - DNA, 22 bp, Homo sapiens
gtctcccatcgtttgtgaggaa

SEQ ID NO: 8283134 - DNA, 22 bp, Homo sapiens
gtctcccatctctgtccttgtg

SEQ ID NO: 8283135 - DNA, 22 bp, Homo sapiens
gtctcccagcctacatctttct

SEQ ID NO: 8283136 - DNA, 22 bp, Homo sapiens
gtcctcagaagcctgcttagct

SEQ ID NO: 8283137 - DNA, 22 bp, Homo sapiens
gtctggggtactttcatctgat

SEQ ID NO: 8283138 - DNA, 22 bp, Homo sapiens
gtctctctcccaagattggcta

SEQ ID NO: 8283139 - DNA, 22 bp, Homo sapiens
gtgaggtgactagcaggtgggg

SEQ ID NO: 8283140 - DNA, 22 bp, Homo sapiens
gtgatgtcacagaataagtgat

SEQ ID NO: 8283141 - DNA, 22 bp, Homo sapiens
gtgagtctgcctagcacatcac

SEQ ID NO: 8283142 - DNA, 22 bp, Homo sapiens
gtgcctccatcagtgcctccaa

SEQ ID NO: 8283143 - DNA, 22 bp, Homo sapiens
gtgcaagaaggggagactgggt

SEQ ID NO: 8283144 - DNA, 18 bp, Homo sapiens
gtgcaatgaatagcagag

SEQ ID NO: 8283145 - DNA, 22 bp, Homo sapiens
gtgcaatggggcaatatcagct

SEQ ID NO: 8283146 - DNA, 22 bp, Homo sapiens
gtgattctgaccttcagggagt

SEQ ID NO: 8283147 - DNA, 22 bp, Homo sapiens
gtgattcattcgattagtattt

SEQ ID NO: 8283148 - DNA, 22 bp, Homo sapiens
gtgattcttcctgctggcatac

SEQ ID NO: 8283149 - DNA, 22 bp, Homo sapiens
cggcttccaacaagctttgctg

SEQ ID NO: 8283150 - DNA, 22 bp, Homo sapiens
cgggaaagttccacagatggat

SEQ ID NO: 8283151 - DNA, 22 bp, Homo sapiens
cgggaggaaaggcgaggctctg

SEQ ID NO: 8283152 - DNA, 20 bp, Homo sapiens
cgcagcagtggaagtggaat

SEQ ID NO: 8283153 - DNA, 22 bp, Homo sapiens
cgcagctgcaaaggaaacattt

SEQ ID NO: 8283154 - DNA, 21 bp, Homo sapiens
cgcagctgagaaatatacaga

SEQ ID NO: 8283155 - DNA, 22 bp, Homo sapiens
ttcctccagcctggagcacttc

SEQ ID NO: 8283156 - DNA, 22 bp, Homo sapiens
ttcctctgaaatggcttggaaa

SEQ ID NO: 8283157 - DNA, 17 bp, Homo sapiens
ttcctctcacatttttt

SEQ ID NO: 8283158 - DNA, 22 bp, Homo sapiens
ttcctctcctcacatgagtcac

SEQ ID NO: 8283159 - DNA, 22 bp, Homo sapiens
cgtcatcacggcaagcatctcc

SEQ ID NO: 8283160 - DNA, 22 bp, Homo sapiens
cgtccctacctggcagctgcgc

SEQ ID NO: 8283161 - DNA, 22 bp, Homo sapiens
cgtccttgcaagatctgtacaa

SEQ ID NO: 8283162 - DNA, 22 bp, Homo sapiens
cgtctaggccgtgccctgaggt

SEQ ID NO: 8283163 - DNA, 21 bp, Homo sapiens
ttccagaaatctctttcttca

SEQ ID NO: 8283164 - DNA, 21 bp, Homo sapiens
ttctcctgttttgcaccacag

SEQ ID NO: 8283165 - DNA, 22 bp, Homo sapiens
ctagttagttctgggtcatcct

SEQ ID NO: 8283166 - DNA, 22 bp, Homo sapiens
ctagttgaagaggctgtcatca

SEQ ID NO: 8283167 - DNA, 22 bp, Homo sapiens
ctagttttaagctccttgaggt

SEQ ID NO: 8283168 - DNA, 22 bp, Homo sapiens
ctacattgttatctgtaagtgt

SEQ ID NO: 8283169 - DNA, 22 bp, Homo sapiens
ctacatttacacagttaggctt

SEQ ID NO: 8283170 - DNA, 22 bp, Homo sapiens
ttctcatgaaactcgcttcctc

SEQ ID NO: 8283171 - DNA, 21 bp, Homo sapiens
ttctcatgggataagtacatg

SEQ ID NO: 8283172 - DNA, 22 bp, Homo sapiens
ctaacttcccctctggcagaaa

SEQ ID NO: 8283173 - DNA, 22 bp, Homo sapiens
ctaaattatttgcacattagag

SEQ ID NO: 8283174 - DNA, 22 bp, Homo sapiens
ctaaattatcatgagaattatg

SEQ ID NO: 8283175 - DNA, 22 bp, Homo sapiens
ctacataaatatttatgtgtct

SEQ ID NO: 8283176 - DNA, 22 bp, Homo sapiens
ctacatcaagtaatcttcaaaa

SEQ ID NO: 8283177 - DNA, 22 bp, Homo sapiens
ctacatcacttaattcttagaa

SEQ ID NO: 8283178 - DNA, 22 bp, Homo sapiens
ttcttaaagaggcaaaacacag

SEQ ID NO: 8283179 - DNA, 22 bp, Homo sapiens
ttcttaaagaggcaaaacacag

SEQ ID NO: 8283180 - DNA, 22 bp, Homo sapiens
ttcttaagaaaccatcacattc

SEQ ID NO: 8283181 - DNA, 22 bp, Homo sapiens
ttcttaagtatgatcttaacgg

SEQ ID NO: 8283182 - DNA, 22 bp, Homo sapiens
ttcttaagtatttcagagactg

SEQ ID NO: 8283183 - DNA, 22 bp, Homo sapiens
ttcttaatcccacaaatcttca

SEQ ID NO: 8283184 - DNA, 22 bp, Homo sapiens
ttcttaatacctattttctacc

SEQ ID NO: 8283185 - DNA, 22 bp, Homo sapiens
ttgaaatatcaagttattagtg

SEQ ID NO: 8283186 - DNA, 19 bp, Homo sapiens
ttgaaggttcggagatagg

SEQ ID NO: 8283187 - DNA, 19 bp, Homo sapiens
ttgaagttacagtcatgcc

SEQ ID NO: 8283188 - DNA, 22 bp, Homo sapiens
ctcactgtgacctcagcagaca

SEQ ID NO: 8283189 - DNA, 22 bp, Homo sapiens
ctcacttagcaggttaatatca

SEQ ID NO: 8283190 - DNA, 20 bp, Homo sapiens
ctcacttacctttttctata

SEQ ID NO: 8283191 - DNA, 19 bp, Homo sapiens
ttgaatatgcaaactgaag

SEQ ID NO: 8283192 - DNA, 22 bp, Homo sapiens
ttgaatgaaattgctgtgttat

SEQ ID NO: 8283193 - DNA, 22 bp, Homo sapiens
ttgaatctataatttcagtatt

SEQ ID NO: 8283194 - DNA, 22 bp, Homo sapiens
ttgaatctatgtattcagtgta

SEQ ID NO: 8283195 - DNA, 22 bp, Homo sapiens
ttgaatctctctgagattcagt

SEQ ID NO: 8283196 - DNA, 22 bp, Homo sapiens
ctcaggccattcttccagctgc

SEQ ID NO: 8283197 - DNA, 22 bp, Homo sapiens
ctcagcagtgacaagagagtat

SEQ ID NO: 8283198 - DNA, 22 bp, Homo sapiens
ctcagcagtatactctgaagat

SEQ ID NO: 8283199 - DNA, 22 bp, Homo sapiens
ttgatttttttctactatgcgc

SEQ ID NO: 8283200 - DNA, 22 bp, Homo sapiens
ttgctgagctttggcaaggaag

SEQ ID NO: 8283201 - DNA, 23 bp, Homo sapiens
ttgctgcctgagccttcctctgg

SEQ ID NO: 8283202 - DNA, 22 bp, Homo sapiens
ttgctgctcccaagaggcagct

SEQ ID NO: 8283203 - DNA, 18 bp, Homo sapiens
ctcaggcctttccctgtg

SEQ ID NO: 8283204 - DNA, 20 bp, Homo sapiens
ttgcacagaggtttcaagtg

SEQ ID NO: 8283205 - DNA, 23 bp, Homo sapiens
ttgcacagtgtatacacatattt

SEQ ID NO: 8283206 - DNA, 22 bp, Homo sapiens
ttgcacagtagcgcgtgattgt

SEQ ID NO: 8283207 - DNA, 22 bp, Homo sapiens
ttgcacagcaacgtgaatgtac

SEQ ID NO: 8283208 - DNA, 22 bp, Homo sapiens
ttgcacagatgcacatggttgc

SEQ ID NO: 8283209 - DNA, 22 bp, Homo sapiens
ttgcacagatgagggtgatgct

SEQ ID NO: 8283210 - DNA, 22 bp, Homo sapiens
ttgcactttatagaaacttttg

SEQ ID NO: 8283211 - DNA, 22 bp, Homo sapiens
ttgcacatgttggttcttgaaa

SEQ ID NO: 8283212 - DNA, 22 bp, Homo sapiens
ttgcacatgctatttatgtttt

SEQ ID NO: 8283213 - DNA, 22 bp, Homo sapiens
ttgcacctgtctctgtgttggg

SEQ ID NO: 8283214 - DNA, 22 bp, Homo sapiens
ttgcactcaccacatttcaggt

SEQ ID NO: 8283215 - DNA, 22 bp, Homo sapiens
ttaatatgttgaaatttattag

SEQ ID NO: 8283216 - DNA, 22 bp, Homo sapiens
cctgtcacatatttgctgttca

SEQ ID NO: 8283217 - DNA, 22 bp, Homo sapiens
cctgtacattagctgtgaattg

SEQ ID NO: 8283218 - DNA, 22 bp, Homo sapiens
cctgtaactccttggctcaagt

SEQ ID NO: 8283219 - DNA, 22 bp, Homo sapiens
ttaaaaggcatcataggtgaat

SEQ ID NO: 8283220 - DNA, 22 bp, Homo sapiens
ttaaaagggtaagcagcaactt

SEQ ID NO: 8283221 - DNA, 22 bp, Homo sapiens
ttaaaagggatgttatctgtaa

SEQ ID NO: 8283222 - DNA, 19 bp, Homo sapiens
cctgtggcagagtggaaac

SEQ ID NO: 8283223 - DNA, 22 bp, Homo sapiens
ttaatctaagtaatggatgctg

SEQ ID NO: 8283224 - DNA, 22 bp, Homo sapiens
ttaatgaaacattgactatgat

SEQ ID NO: 8283225 - DNA, 22 bp, Homo sapiens
ttacaatagttccttcttttgt

SEQ ID NO: 8283226 - DNA, 22 bp, Homo sapiens
ttacaatagttccttcttttgt

SEQ ID NO: 8283227 - DNA, 22 bp, Homo sapiens
ttacaataccacatcacctcat

SEQ ID NO: 8283228 - DNA, 22 bp, Homo sapiens
cctgtggctggtcaggccagca

SEQ ID NO: 8283229 - DNA, 22 bp, Homo sapiens
cctgtggcgggggccagtgcct

SEQ ID NO: 8283230 - DNA, 18 bp, Homo sapiens
cctgtggctcagcccaca

SEQ ID NO: 8283231 - DNA, 22 bp, Homo sapiens
cctgtggctctctttggaggtc

SEQ ID NO: 8283232 - DNA, 22 bp, Homo sapiens
cctgctccatgctcaccatcag

SEQ ID NO: 8283233 - DNA, 22 bp, Homo sapiens
tgttgattagtgtttagactta

SEQ ID NO: 8283234 - DNA, 22 bp, Homo sapiens
tgttggctattattattactgc

SEQ ID NO: 8283235 - DNA, 22 bp, Homo sapiens
tgttggcttgaccttcgctgtt

SEQ ID NO: 8283236 - DNA, 19 bp, Homo sapiens
tgttggctgttctagctca

SEQ ID NO: 8283237 - DNA, 22 bp, Homo sapiens
tgttgctgacaagagaggagca

SEQ ID NO: 8283238 - DNA, 22 bp, Homo sapiens
tgttgctcttcatacatcaatg

SEQ ID NO: 8283239 - DNA, 21 bp, Homo sapiens
tggttcagttcgttacgtgtg

SEQ ID NO: 8283240 - DNA, 22 bp, Homo sapiens
tggttccaatcgcactggctca

SEQ ID NO: 8283241 - DNA, 22 bp, Homo sapiens
cctgccttctaaagcgcccgcc

SEQ ID NO: 8283242 - DNA, 22 bp, Homo sapiens
tgttttccggcctcagcacgcc

SEQ ID NO: 8283243 - DNA, 22 bp, Homo sapiens
tgttttcatttgatgtaacaaa

SEQ ID NO: 8283244 - DNA, 22 bp, Homo sapiens
tgttttcatttgatgtaacaaa

SEQ ID NO: 8283245 - DNA, 22 bp, Homo sapiens
tgttttcatttgatgtaacaaa

SEQ ID NO: 8283246 - DNA, 17 bp, Homo sapiens
tgttttcattcattgct

SEQ ID NO: 8283247 - DNA, 17 bp, Homo sapiens
tgttttcattcattgct

SEQ ID NO: 8283248 - DNA, 22 bp, Homo sapiens
tgtttcttatccaagtggtctg

SEQ ID NO: 8283249 - DNA, 21 bp, Homo sapiens
ccttctccacagggtctccgg

SEQ ID NO: 8283250 - DNA, 22 bp, Homo sapiens
ttacagaactgtcttgaaattt

SEQ ID NO: 8283251 - DNA, 22 bp, Homo sapiens
ccttctgatactgacatcattt

SEQ ID NO: 8283252 - DNA, 22 bp, Homo sapiens
ccttctgagcttcaatttcagt

SEQ ID NO: 8283253 - DNA, 21 bp, Homo sapiens
ccttctcttgcttcagcttca

SEQ ID NO: 8283254 - DNA, 22 bp, Homo sapiens
ttaccagtggtacacatgacct

SEQ ID NO: 8283255 - DNA, 22 bp, Homo sapiens
ttaccacacttatttacattgg

SEQ ID NO: 8283256 - DNA, 22 bp, Homo sapiens
ttacctgaaaggttaatttcca

SEQ ID NO: 8283257 - DNA, 22 bp, Homo sapiens
cctttaagtcctcttttatatt

SEQ ID NO: 8283258 - DNA, 21 bp, Homo sapiens
ttactaaacaaaacatgcagg

SEQ ID NO: 8283259 - DNA, 22 bp, Homo sapiens
cctttgcaatgaattgttattg

SEQ ID NO: 8283260 - DNA, 22 bp, Homo sapiens
cctttgcaacagaaagacctga

SEQ ID NO: 8283261 - DNA, 22 bp, Homo sapiens
cctttgcaatcctgtaggcctt

SEQ ID NO: 8283262 - DNA, 18 bp, Homo sapiens
cctttgcaaagggggtta

SEQ ID NO: 8283263 - DNA, 22 bp, Homo sapiens
cctttgcattctagatgtttag

SEQ ID NO: 8283264 - DNA, 22 bp, Homo sapiens
cctttgcattatccttgattga

SEQ ID NO: 8283265 - DNA, 22 bp, Homo sapiens
cctttgcatttatgtgtccatt

SEQ ID NO: 8283266 - DNA, 22 bp, Homo sapiens
ttatgtactctgcaatgtttga

SEQ ID NO: 8283267 - DNA, 22 bp, Homo sapiens
ttatgtatgaatatagtagaag

SEQ ID NO: 8283268 - DNA, 22 bp, Homo sapiens
ttatgtacctgaattagtaaag

SEQ ID NO: 8283269 - DNA, 22 bp, Homo sapiens
ttatgtacaatgttaatgtaaa

SEQ ID NO: 8283270 - DNA, 22 bp, Homo sapiens
ttatgggagcaattggggaggt

SEQ ID NO: 8283271 - DNA, 22 bp, Homo sapiens
cgatgacagtgagttccttctt

SEQ ID NO: 8283272 - DNA, 22 bp, Homo sapiens
ttatttttaaaagttcacacag

SEQ ID NO: 8283273 - DNA, 22 bp, Homo sapiens
ttatttttaaaagttcacacag

SEQ ID NO: 8283274 - DNA, 17 bp, Homo sapiens
ttattttttgggctgag

SEQ ID NO: 8283275 - DNA, 17 bp, Homo sapiens
ttattttttgggctgag

SEQ ID NO: 8283276 - DNA, 17 bp, Homo sapiens
ttattttttgggctgag

SEQ ID NO: 8283277 - DNA, 22 bp, Homo sapiens
cgcaccactgaattccagcctg

SEQ ID NO: 8283278 - DNA, 22 bp, Homo sapiens
cgcagagggcaggcagtgctgg

SEQ ID NO: 8283279 - DNA, 22 bp, Homo sapiens
cgcagagggagccgcgggctgc

SEQ ID NO: 8283280 - DNA, 22 bp, Homo sapiens
ttattattttgtgtacagcaaa

SEQ ID NO: 8283281 - DNA, 22 bp, Homo sapiens
ttttctcctttcaagatagcat

SEQ ID NO: 8283282 - DNA, 22 bp, Homo sapiens
ttttctccagggaacaaggtga

SEQ ID NO: 8283283 - DNA, 22 bp, Homo sapiens
ttttctcaggtgcttatctaag

SEQ ID NO: 8283284 - DNA, 22 bp, Homo sapiens
tttttcttgtgctggatctaat

SEQ ID NO: 8283285 - DNA, 22 bp, Homo sapiens
tttttcttgtgctggatctaat

SEQ ID NO: 8283286 - DNA, 22 bp, Homo sapiens
tttttcttaaatgtgggttggc

SEQ ID NO: 8283287 - DNA, 22 bp, Homo sapiens
tttttcttaaatgtgggttggc

SEQ ID NO: 8283288 - DNA, 22 bp, Homo sapiens
tttttcttaaatgtgggttggc

SEQ ID NO: 8283289 - DNA, 22 bp, Homo sapiens
ctgaaactttagttctgcaaca

SEQ ID NO: 8283290 - DNA, 22 bp, Homo sapiens
ctgaaactgtcttcctagccat

SEQ ID NO: 8283291 - DNA, 22 bp, Homo sapiens
ctgaaactggtcaattaatctg

SEQ ID NO: 8283292 - DNA, 22 bp, Homo sapiens
ctgaaactggagtccttatatc

SEQ ID NO: 8283293 - DNA, 22 bp, Homo sapiens
ctgaaactgctcccagccccat

SEQ ID NO: 8283294 - DNA, 22 bp, Homo sapiens
ctgaaactacagtaaggagaac

SEQ ID NO: 8283295 - DNA, 22 bp, Homo sapiens
ctgaaactccatgagaaattgc

SEQ ID NO: 8283296 - DNA, 22 bp, Homo sapiens
ctgaaactatggggaggggagc

SEQ ID NO: 8283297 - DNA, 22 bp, Homo sapiens
ctgaagtcagatggcacaaggt

SEQ ID NO: 8283298 - DNA, 22 bp, Homo sapiens
ctgaaggaggtagagtgacata

SEQ ID NO: 8283299 - DNA, 22 bp, Homo sapiens
ctgaagatgttctttttggttc

SEQ ID NO: 8283300 - DNA, 22 bp, Homo sapiens
ctgaagattcgcctttgtttat

SEQ ID NO: 8283301 - DNA, 22 bp, Homo sapiens
ctgagagatcaagccacaggat

SEQ ID NO: 8283302 - DNA, 22 bp, Homo sapiens
ctgagagatgatatagcttaat

SEQ ID NO: 8283303 - DNA, 19 bp, Homo sapiens
ctgagagatgcttcacaca

SEQ ID NO: 8283304 - DNA, 22 bp, Homo sapiens
ctgaagtttttcaatttatgtt

SEQ ID NO: 8283305 - DNA, 22 bp, Homo sapiens
ctgagaggtgctggtggctgca

SEQ ID NO: 8283306 - DNA, 22 bp, Homo sapiens
ctgagggcagtgatgaaggtga

SEQ ID NO: 8283307 - DNA, 22 bp, Homo sapiens
ctgagggcaccgacagagtgga

SEQ ID NO: 8283308 - DNA, 22 bp, Homo sapiens
ctgagctgttactctgtcctcg

SEQ ID NO: 8283309 - DNA, 22 bp, Homo sapiens
ctgagctggttctcttgtgaaa

SEQ ID NO: 8283310 - DNA, 22 bp, Homo sapiens
ctgagctgggctctcttgaggg

SEQ ID NO: 8283311 - DNA, 22 bp, Homo sapiens
ctgagctggtctatggacttgg

SEQ ID NO: 8283312 - DNA, 21 bp, Homo sapiens
ctgagctggggtgaaggttgc

SEQ ID NO: 8283313 - DNA, 22 bp, Homo sapiens
ctgagctggtgtttcagggtca

SEQ ID NO: 8283314 - DNA, 22 bp, Homo sapiens
ctgaggaaggagttaggcagtt

SEQ ID NO: 8283315 - DNA, 22 bp, Homo sapiens
ctgaggaaagctgcagcggtac

SEQ ID NO: 8283316 - DNA, 22 bp, Homo sapiens
ctgaggaagacagcagctgtgt

SEQ ID NO: 8283317 - DNA, 19 bp, Homo sapiens
ctgctccctccttctggca

SEQ ID NO: 8283318 - DNA, 22 bp, Homo sapiens
ctgctccagacacctgcagggg

SEQ ID NO: 8283319 - DNA, 22 bp, Homo sapiens
ctgcctgcgccaccaccacgtc

SEQ ID NO: 8283320 - DNA, 22 bp, Homo sapiens
ctgcctgccttggcctccagga

SEQ ID NO: 8283321 - DNA, 22 bp, Homo sapiens
ctgcctctgttgggcatggtct

SEQ ID NO: 8283322 - DNA, 22 bp, Homo sapiens
ctgcctcttaagtggatggagt

SEQ ID NO: 8283323 - DNA, 22 bp, Homo sapiens
ctgcctcttaagtggatggagt

SEQ ID NO: 8283324 - DNA, 22 bp, Homo sapiens
ctgctgctcgaccagtcccagg

SEQ ID NO: 8283325 - DNA, 21 bp, Homo sapiens
ctgctgctggggtctgggcag

SEQ ID NO: 8283326 - DNA, 22 bp, Homo sapiens
ctgctgccctagacccagtcct

SEQ ID NO: 8283327 - DNA, 20 bp, Homo sapiens
ctgctgccctgtcagcctct

SEQ ID NO: 8283328 - DNA, 19 bp, Homo sapiens
ctgctgccggagactcgtc

SEQ ID NO: 8283329 - DNA, 22 bp, Homo sapiens
ctgctgccggcgagcctccctt

SEQ ID NO: 8283330 - DNA, 19 bp, Homo sapiens
ctgctctccttgacttgga

SEQ ID NO: 8283331 - DNA, 22 bp, Homo sapiens
ctgctctccccaggccagtctg

SEQ ID NO: 8283332 - DNA, 22 bp, Homo sapiens
ctgcagtgcctgccactgagcc

SEQ ID NO: 8283333 - DNA, 22 bp, Homo sapiens
ctgcagtgaaatcaggaagcaa

SEQ ID NO: 8283334 - DNA, 22 bp, Homo sapiens
ctgcagtgttctggaatgcatt

SEQ ID NO: 8283335 - DNA, 22 bp, Homo sapiens
ctgcccctgctcatggctgtcc

SEQ ID NO: 8283336 - DNA, 21 bp, Homo sapiens
ctgagggctttgaatccagac

SEQ ID NO: 8283337 - DNA, 22 bp, Homo sapiens
ctgcaggggctggagttggctt

SEQ ID NO: 8283338 - DNA, 22 bp, Homo sapiens
ctgcaggggcctcgagcacagg

SEQ ID NO: 8283339 - DNA, 22 bp, Homo sapiens
ctgcaggttgagcagccaggtt

SEQ ID NO: 8283340 - DNA, 21 bp, Homo sapiens
ctgcaggtgctgccatcaggg

SEQ ID NO: 8283341 - DNA, 22 bp, Homo sapiens
ctgcagggtttttcaaggacaa

SEQ ID NO: 8283342 - DNA, 22 bp, Homo sapiens
ctgagggccttctatgctgagc

SEQ ID NO: 8283343 - DNA, 21 bp, Homo sapiens
ctgagggccgcagctgggctc

SEQ ID NO: 8283344 - DNA, 22 bp, Homo sapiens
ctgagggccttggctcctgccc

SEQ ID NO: 8283345 - DNA, 22 bp, Homo sapiens
ctgcctctggttttggtccctg

SEQ ID NO: 8283346 - DNA, 22 bp, Homo sapiens
ctgcctctggcctcaggcccag

SEQ ID NO: 8283347 - DNA, 22 bp, Homo sapiens
ctgcctctataggagtccacca

SEQ ID NO: 8283348 - DNA, 22 bp, Homo sapiens
ctgccctgggatggtctgtgcg

SEQ ID NO: 8283349 - DNA, 22 bp, Homo sapiens
ctgccctggcagcctaccatgg

SEQ ID NO: 8283350 - DNA, 22 bp, Homo sapiens
ctgccctggccactgtgcccag

SEQ ID NO: 8283351 - DNA, 22 bp, Homo sapiens
ctgccctgcttgatgacagcga

SEQ ID NO: 8283352 - DNA, 22 bp, Homo sapiens
ctgcccctggtgatggacgcca

SEQ ID NO: 8283353 - DNA, 22 bp, Homo sapiens
ctgcccctggctggtgaagcag

SEQ ID NO: 8283354 - DNA, 22 bp, Homo sapiens
ctgccctgagggcctgtgtgtt

SEQ ID NO: 8283355 - DNA, 22 bp, Homo sapiens
ctgccctgcccaggccttgggc

SEQ ID NO: 8283356 - DNA, 20 bp, Homo sapiens
ctgccctgccctgggtcctg

SEQ ID NO: 8283357 - DNA, 22 bp, Homo sapiens
ctgccctgctggagatcacagt

SEQ ID NO: 8283358 - DNA, 22 bp, Homo sapiens
ctgccctgcttctgagggaagc

SEQ ID NO: 8283359 - DNA, 22 bp, Homo sapiens
ttgtttcaaatatttcagaata

SEQ ID NO: 8283360 - DNA, 18 bp, Homo sapiens
ctccccagctgcccccag

SEQ ID NO: 8283361 - DNA, 22 bp, Homo sapiens
ctccccagcattctgacttcct

SEQ ID NO: 8283362 - DNA, 22 bp, Homo sapiens
ctcagggaagctatggtgaggg

SEQ ID NO: 8283363 - DNA, 22 bp, Homo sapiens
ctccccacatttctccctgtct

SEQ ID NO: 8283364 - DNA, 22 bp, Homo sapiens
ctccctctgtcttgtccagaaa

SEQ ID NO: 8283365 - DNA, 22 bp, Homo sapiens
ctccctgccctgtgagttggcc

SEQ ID NO: 8283366 - DNA, 22 bp, Homo sapiens
ctccctggaggtgagctggcac

SEQ ID NO: 8283367 - DNA, 22 bp, Homo sapiens
ctccctgggcagatgtggctct

SEQ ID NO: 8283368 - DNA, 22 bp, Homo sapiens
ctcgttgctgaagccaaagtca

SEQ ID NO: 8283369 - DNA, 22 bp, Homo sapiens
ctccttcctggttagcacctta

SEQ ID NO: 8283370 - DNA, 22 bp, Homo sapiens
tttcaaagtggagaattagaca

SEQ ID NO: 8283371 - DNA, 22 bp, Homo sapiens
tttcaaagttgggaattgtaat

SEQ ID NO: 8283372 - DNA, 22 bp, Homo sapiens
ctcctggttcctgtcttaaata

SEQ ID NO: 8283373 - DNA, 22 bp, Homo sapiens
ctcctggaagcccgccctgctg

SEQ ID NO: 8283374 - DNA, 22 bp, Homo sapiens
tttatatgtttgtacaattaag

SEQ ID NO: 8283375 - DNA, 22 bp, Homo sapiens
tttatatcttatgtcatttcaa

SEQ ID NO: 8283376 - DNA, 22 bp, Homo sapiens
ctcctgctcctgcttgcaagga

SEQ ID NO: 8283377 - DNA, 22 bp, Homo sapiens
tttacaatagggtctgaatgaa

SEQ ID NO: 8283378 - DNA, 22 bp, Homo sapiens
tttacaattctctaccagtgtt

SEQ ID NO: 8283379 - DNA, 22 bp, Homo sapiens
tttacaattggttttctctaat

SEQ ID NO: 8283380 - DNA, 22 bp, Homo sapiens
tttacaattctggtgccagcta

SEQ ID NO: 8283381 - DNA, 19 bp, Homo sapiens
ctctgcctctggctgtggc

SEQ ID NO: 8283382 - DNA, 22 bp, Homo sapiens
ctctgctgcccaggcctgctag

SEQ ID NO: 8283383 - DNA, 22 bp, Homo sapiens
ctctgctggtgaccactgggcc

SEQ ID NO: 8283384 - DNA, 19 bp, Homo sapiens
ctctgcttggtccatatgc

SEQ ID NO: 8283385 - DNA, 22 bp, Homo sapiens
tttgaagtcaaagattgattcc

SEQ ID NO: 8283386 - DNA, 22 bp, Homo sapiens
tttgaagggcacgacaatagtt

SEQ ID NO: 8283387 - DNA, 22 bp, Homo sapiens
tttgaagggcacgacaatagtt

SEQ ID NO: 8283388 - DNA, 22 bp, Homo sapiens
tttgaagggcacgacaatagtt

SEQ ID NO: 8283389 - DNA, 22 bp, Homo sapiens
tttgaagtcaggctttctaccc

SEQ ID NO: 8283390 - DNA, 22 bp, Homo sapiens
tttgaagtgggcattagaacct

SEQ ID NO: 8283391 - DNA, 22 bp, Homo sapiens
ctctggagcatttcacctacat

SEQ ID NO: 8283392 - DNA, 22 bp, Homo sapiens
tttgaagtgtatgaaaatacag

SEQ ID NO: 8283393 - DNA, 22 bp, Homo sapiens
tttgaataaacggttaatgttc

SEQ ID NO: 8283394 - DNA, 22 bp, Homo sapiens
ctctggagtcaggcagccctgg

SEQ ID NO: 8283395 - DNA, 22 bp, Homo sapiens
ctctggaggttgagcccagcaa

SEQ ID NO: 8283396 - DNA, 22 bp, Homo sapiens
ctctggaggccgttggccctta

SEQ ID NO: 8283397 - DNA, 22 bp, Homo sapiens
ctctatgttatgcagaattaag

SEQ ID NO: 8283398 - DNA, 22 bp, Homo sapiens
ctctagagtacgggctggcatg

SEQ ID NO: 8283399 - DNA, 19 bp, Homo sapiens
tttctctccctcatcccga

SEQ ID NO: 8283400 - DNA, 22 bp, Homo sapiens
ctctgaggtccttcccagctct

SEQ ID NO: 8283401 - DNA, 22 bp, Homo sapiens
tttctgcaaacttccacgtctc

SEQ ID NO: 8283402 - DNA, 22 bp, Homo sapiens
tttctgcatctctacagttgtt

SEQ ID NO: 8283403 - DNA, 22 bp, Homo sapiens
ctctgagctcgtgcagtacttc

SEQ ID NO: 8283404 - DNA, 22 bp, Homo sapiens
ctctgagctgaaacatgagcat

SEQ ID NO: 8283405 - DNA, 22 bp, Homo sapiens
ctctgaggtcagggcccggcaa

SEQ ID NO: 8283406 - DNA, 22 bp, Homo sapiens
gaggaagaaagcataggtgggg

SEQ ID NO: 8283407 - DNA, 22 bp, Homo sapiens
gaggagagagggactgtctgca

SEQ ID NO: 8283408 - DNA, 22 bp, Homo sapiens
gaggaagaattggttattggag

SEQ ID NO: 8283409 - DNA, 22 bp, Homo sapiens
gaggaagaatcagggtggtgag

SEQ ID NO: 8283410 - DNA, 22 bp, Homo sapiens
gaggaaagaaccccagtcaata

SEQ ID NO: 8283411 - DNA, 22 bp, Homo sapiens
gaggaaacattgtagaagcagt

SEQ ID NO: 8283412 - DNA, 18 bp, Homo sapiens
gaggaaacaaggcagagg

SEQ ID NO: 8283413 - DNA, 23 bp, Homo sapiens
gaggaaagaatatagatgcaatc

SEQ ID NO: 8283414 - DNA, 22 bp, Homo sapiens
gaggaaaatgggacaggctgta

SEQ ID NO: 8283415 - DNA, 22 bp, Homo sapiens
gaggaaaatggagtgtaattaa

SEQ ID NO: 8283416 - DNA, 22 bp, Homo sapiens
gagctgagatttgaagcaagtt

SEQ ID NO: 8283417 - DNA, 22 bp, Homo sapiens
gagctgcctacattgccaagag

SEQ ID NO: 8283418 - DNA, 22 bp, Homo sapiens
gagctgagggtctaggagggtt

SEQ ID NO: 8283419 - DNA, 22 bp, Homo sapiens
gagccctgtgaggaaagagggt

SEQ ID NO: 8283420 - DNA, 22 bp, Homo sapiens
gagccctgtagcaagtcatgtc

SEQ ID NO: 8283421 - DNA, 22 bp, Homo sapiens
gagccctggcagtctgggatgg

SEQ ID NO: 8283422 - DNA, 22 bp, Homo sapiens
gagccagtgatcagacagggag

SEQ ID NO: 8283423 - DNA, 22 bp, Homo sapiens
gagcccagctctacctcagact

SEQ ID NO: 8283424 - DNA, 22 bp, Homo sapiens
gagcccaggagtttgatgctgc

SEQ ID NO: 8283425 - DNA, 22 bp, Homo sapiens
gagcccagctgcggccctcagc

SEQ ID NO: 8283426 - DNA, 22 bp, Homo sapiens
gagcccagctgtccttggcaaa

SEQ ID NO: 8283427 - DNA, 22 bp, Homo sapiens
gagccctgacactgagggagtt

SEQ ID NO: 8283428 - DNA, 22 bp, Homo sapiens
gagcccaggttctgcttccagc

SEQ ID NO: 8283429 - DNA, 22 bp, Homo sapiens
gagcccagggcaggcaaggcag

SEQ ID NO: 8283430 - DNA, 22 bp, Homo sapiens
gagcccagggtgaaatagcagc

SEQ ID NO: 8283431 - DNA, 22 bp, Homo sapiens
gagagggtgcctggaagccagg

SEQ ID NO: 8283432 - DNA, 22 bp, Homo sapiens
gaggagccatagatagtgctgc

SEQ ID NO: 8283433 - DNA, 22 bp, Homo sapiens
gaggagcccccactgggctcac

SEQ ID NO: 8283434 - DNA, 22 bp, Homo sapiens
gaggagagatggtagattgggt

SEQ ID NO: 8283435 - DNA, 22 bp, Homo sapiens
gaggagccaggaggtctccctg

SEQ ID NO: 8283436 - DNA, 22 bp, Homo sapiens
gaggagcacatgaggctgaggg

SEQ ID NO: 8283437 - DNA, 22 bp, Homo sapiens
gaggagcacatgaggctgaggg

SEQ ID NO: 8283438 - DNA, 22 bp, Homo sapiens
gaggctcactgggcaaagactc

SEQ ID NO: 8283439 - DNA, 22 bp, Homo sapiens
gaggcatctgggcacagaagtg

SEQ ID NO: 8283440 - DNA, 22 bp, Homo sapiens
gagggagggactagcattctct

SEQ ID NO: 8283441 - DNA, 22 bp, Homo sapiens
gagggaggggagctccaccctc

SEQ ID NO: 8283442 - DNA, 22 bp, Homo sapiens
gagggagggccaggtcccaacc

SEQ ID NO: 8283443 - DNA, 22 bp, Homo sapiens
gagggagggccaggtcccaacc

SEQ ID NO: 8283444 - DNA, 22 bp, Homo sapiens
gagggagggccaggtcccaacc

SEQ ID NO: 8283445 - DNA, 22 bp, Homo sapiens
gagggaggcatcatgaatccag

SEQ ID NO: 8283446 - DNA, 22 bp, Homo sapiens
gagggaggcatcatgaatccag

SEQ ID NO: 8283447 - DNA, 22 bp, Homo sapiens
gagggagctggagcagacgccg

SEQ ID NO: 8283448 - DNA, 22 bp, Homo sapiens
gagggagccgccacagactggg

SEQ ID NO: 8283449 - DNA, 22 bp, Homo sapiens
gaggctgcactggctaaaggct

SEQ ID NO: 8283450 - DNA, 22 bp, Homo sapiens
gagaaaggcatccttggcttca

SEQ ID NO: 8283451 - DNA, 22 bp, Homo sapiens
gagaaagatgtaggctgggagg

SEQ ID NO: 8283452 - DNA, 22 bp, Homo sapiens
gagaaagatgtaggctgggagg

SEQ ID NO: 8283453 - DNA, 22 bp, Homo sapiens
gagaaagacgtaggctgggagg

SEQ ID NO: 8283454 - DNA, 22 bp, Homo sapiens
gagaaagacgtaggctgggagg

SEQ ID NO: 8283455 - DNA, 22 bp, Homo sapiens
gagaaacactgttagtttatta

SEQ ID NO: 8283456 - DNA, 22 bp, Homo sapiens
gagaaacactgttagtttatta

SEQ ID NO: 8283457 - DNA, 22 bp, Homo sapiens
gagacctcttggtatcgctagg

SEQ ID NO: 8283458 - DNA, 22 bp, Homo sapiens
gagactgcattgtccaagggtt

SEQ ID NO: 8283459 - DNA, 22 bp, Homo sapiens
gagactgctggtaaagatggga

SEQ ID NO: 8283460 - DNA, 22 bp, Homo sapiens
gagacgtggcctttgcctgagc

SEQ ID NO: 8283461 - DNA, 22 bp, Homo sapiens
gagagaaaggataacagctcaa

SEQ ID NO: 8283462 - DNA, 22 bp, Homo sapiens
gagagaaaggataacagctcaa

SEQ ID NO: 8283463 - DNA, 22 bp, Homo sapiens
gagagggccgggggccagctcc

SEQ ID NO: 8283464 - DNA, 22 bp, Homo sapiens
gacagaggagaagatgctgtgg

SEQ ID NO: 8283465 - DNA, 22 bp, Homo sapiens
gacagagattgaatcaggaaat

SEQ ID NO: 8283466 - DNA, 22 bp, Homo sapiens
gacagagaggctgagcagtaca

SEQ ID NO: 8283467 - DNA, 22 bp, Homo sapiens
gacagagaggctgagcagtaca

SEQ ID NO: 8283468 - DNA, 22 bp, Homo sapiens
gacagcagacaaaccatgtttt

SEQ ID NO: 8283469 - DNA, 22 bp, Homo sapiens
gacagcagaaaacttttgtgct

SEQ ID NO: 8283470 - DNA, 22 bp, Homo sapiens
gacagcagacagaactacctgc

SEQ ID NO: 8283471 - DNA, 22 bp, Homo sapiens
gacagcagacagcctggcccct

SEQ ID NO: 8283472 - DNA, 22 bp, Homo sapiens
gacagcaatgacggggcagctg

SEQ ID NO: 8283473 - DNA, 21 bp, Homo sapiens
gacagcaactgtagtcctctt

SEQ ID NO: 8283474 - DNA, 22 bp, Homo sapiens
gacattctgtgactctgaacag

SEQ ID NO: 8283475 - DNA, 22 bp, Homo sapiens
gacattcattaagcctttctgt

SEQ ID NO: 8283476 - DNA, 22 bp, Homo sapiens
gacattctaaaaaatatggaag

SEQ ID NO: 8283477 - DNA, 22 bp, Homo sapiens
gacattcattgatgtcttcctc

SEQ ID NO: 8283478 - DNA, 22 bp, Homo sapiens
gacattcagccaattactttct

SEQ ID NO: 8283479 - DNA, 22 bp, Homo sapiens
gacattcaggtgttcaatgcca

SEQ ID NO: 8283480 - DNA, 22 bp, Homo sapiens
gacattcaagtttgcagttagg

SEQ ID NO: 8283481 - DNA, 22 bp, Homo sapiens
gacattcagactcacatggagg

SEQ ID NO: 8283482 - DNA, 22 bp, Homo sapiens
gactcccaagcttggaggaagg

SEQ ID NO: 8283483 - DNA, 22 bp, Homo sapiens
gaagcagcagctggggacagtt

SEQ ID NO: 8283484 - DNA, 22 bp, Homo sapiens
gaagcaaagagctagtgccgct

SEQ ID NO: 8283485 - DNA, 22 bp, Homo sapiens
gaaagcttccattttgtacatt

SEQ ID NO: 8283486 - DNA, 18 bp, Homo sapiens
gaaaggagagacagtagg

SEQ ID NO: 8283487 - DNA, 22 bp, Homo sapiens
gaaggagctaaagggagccctg

SEQ ID NO: 8283488 - DNA, 22 bp, Homo sapiens
gaaggcagggaatgtggtgcta

SEQ ID NO: 8283489 - DNA, 22 bp, Homo sapiens
gaaggccagttttgagataggt

SEQ ID NO: 8283490 - DNA, 22 bp, Homo sapiens
gaagggagaaggttgggtgacg

SEQ ID NO: 8283491 - DNA, 18 bp, Homo sapiens
gaagggagctggaatgca

SEQ ID NO: 8283492 - DNA, 22 bp, Homo sapiens
gaaggccaagaggctccaagat

SEQ ID NO: 8283493 - DNA, 22 bp, Homo sapiens
gacagaagaggaacttggacag

SEQ ID NO: 8283494 - DNA, 22 bp, Homo sapiens
gacagacaggagctcacaggca

SEQ ID NO: 8283495 - DNA, 22 bp, Homo sapiens
gaatgaattcagcacatggaat

SEQ ID NO: 8283496 - DNA, 22 bp, Homo sapiens
gaatgaattttggatggtgaag

SEQ ID NO: 8283497 - DNA, 22 bp, Homo sapiens
gaatgaatctgtaagtgacaag

SEQ ID NO: 8283498 - DNA, 22 bp, Homo sapiens
gaatctggaagtgggcagtagg

SEQ ID NO: 8283499 - DNA, 20 bp, Homo sapiens
gaatctggtcaaatgtctat

SEQ ID NO: 8283500 - DNA, 22 bp, Homo sapiens
gaatctgggtgactggttcttt

SEQ ID NO: 8283501 - DNA, 22 bp, Homo sapiens
gaaggggactggcagctgcaga

SEQ ID NO: 8283502 - DNA, 20 bp, Homo sapiens
ctttgcaggagaacagagaa

SEQ ID NO: 8283503 - DNA, 22 bp, Homo sapiens
ctttgcaaagtctttggcaaga

SEQ ID NO: 8283504 - DNA, 22 bp, Homo sapiens
ctttgcaagtgctttgtagtcc

SEQ ID NO: 8283505 - DNA, 22 bp, Homo sapiens
ctttgcaagggatttcatgtct

SEQ ID NO: 8283506 - DNA, 22 bp, Homo sapiens
ctttgcactccagtctcctgct

SEQ ID NO: 8283507 - DNA, 22 bp, Homo sapiens
ctttgattcagagagaattagc

SEQ ID NO: 8283508 - DNA, 22 bp, Homo sapiens
ctttgattatcggtgtgaatgt

SEQ ID NO: 8283509 - DNA, 22 bp, Homo sapiens
ctttgattccaggcacatgttt

SEQ ID NO: 8283510 - DNA, 22 bp, Homo sapiens
ctttgatttctctggtccaatc

SEQ ID NO: 8283511 - DNA, 22 bp, Homo sapiens
ctttgcaaaagttaattgttga

SEQ ID NO: 8283512 - DNA, 22 bp, Homo sapiens
ctttgcaaacgattaccacatg

SEQ ID NO: 8283513 - DNA, 22 bp, Homo sapiens
cttttcttctcacggctgtcag

SEQ ID NO: 8283514 - DNA, 22 bp, Homo sapiens
cttttgatggagttcaagaagc

SEQ ID NO: 8283515 - DNA, 22 bp, Homo sapiens
cttttgatagttgctgagcagg

SEQ ID NO: 8283516 - DNA, 22 bp, Homo sapiens
cttttctggaatcatctctaac

SEQ ID NO: 8283517 - DNA, 22 bp, Homo sapiens
cttttctctgcaccatgtgtga

SEQ ID NO: 8283518 - DNA, 22 bp, Homo sapiens
gaaagagaggggctgagatgca

SEQ ID NO: 8283519 - DNA, 22 bp, Homo sapiens
gaaagagaggggctgagatgca

SEQ ID NO: 8283520 - DNA, 18 bp, Homo sapiens
gaaagccatgcagcagtg

SEQ ID NO: 8283521 - DNA, 22 bp, Homo sapiens
gaaacacatgcagctccataga

SEQ ID NO: 8283522 - DNA, 22 bp, Homo sapiens
gaaacacatatgaacagttgat

SEQ ID NO: 8283523 - DNA, 22 bp, Homo sapiens
gaaacactggtaaagactgccg

SEQ ID NO: 8283524 - DNA, 22 bp, Homo sapiens
gaaaatacttcagtgttctggc

SEQ ID NO: 8283525 - DNA, 22 bp, Homo sapiens
cttttgcaccttttaagtaatg

SEQ ID NO: 8283526 - DNA, 22 bp, Homo sapiens
cttttgcacccagagttatttg

SEQ ID NO: 8283527 - DNA, 22 bp, Homo sapiens
cttttgcagccattattgctgc

SEQ ID NO: 8283528 - DNA, 22 bp, Homo sapiens
cttttgcagccattattgctgc

SEQ ID NO: 8283529 - DNA, 22 bp, Homo sapiens
ctttctcttcagcacccagccc

SEQ ID NO: 8283530 - DNA, 22 bp, Homo sapiens
ctttgaaaacttaaataacagc

SEQ ID NO: 8283531 - DNA, 22 bp, Homo sapiens
ctttgaaaacttaaataacagc

SEQ ID NO: 8283532 - DNA, 22 bp, Homo sapiens
ctttgaattccagtacaataac

SEQ ID NO: 8283533 - DNA, 22 bp, Homo sapiens
ctttgattcagactttgtcggc

SEQ ID NO: 8283534 - DNA, 22 bp, Homo sapiens
ctttaattgtagctcccataat

SEQ ID NO: 8283535 - DNA, 22 bp, Homo sapiens
ctttctcttcagcacccagccc

SEQ ID NO: 8283536 - DNA, 22 bp, Homo sapiens
ctttaattctcaggtgcacata

SEQ ID NO: 8283537 - DNA, 22 bp, Homo sapiens
ctttaattcagatttgaaggga

SEQ ID NO: 8283538 - DNA, 22 bp, Homo sapiens
ctttaattaggaagtataatga

SEQ ID NO: 8283539 - DNA, 20 bp, Homo sapiens
ctttaactggaaggctgctt

SEQ ID NO: 8283540 - DNA, 22 bp, Homo sapiens
cttctgctgccgcctcggcaca

SEQ ID NO: 8283541 - DNA, 22 bp, Homo sapiens
cttctcttggtagttcttgttg

SEQ ID NO: 8283542 - DNA, 22 bp, Homo sapiens
cttgtgcaaatcctcgagcaca

SEQ ID NO: 8283543 - DNA, 22 bp, Homo sapiens
cttgtgcagcctcctcttgcag

SEQ ID NO: 8283544 - DNA, 22 bp, Homo sapiens
cttgttttggaacagagtgaat

SEQ ID NO: 8283545 - DNA, 22 bp, Homo sapiens
cttgttttggctagtatgatgt

SEQ ID NO: 8283546 - DNA, 22 bp, Homo sapiens
cttgttttggctagtatgatgt

SEQ ID NO: 8283547 - DNA, 22 bp, Homo sapiens
cttagaaattgttactcattca

SEQ ID NO: 8283548 - DNA, 22 bp, Homo sapiens
cttagaaatgcagattctcagg

SEQ ID NO: 8283549 - DNA, 22 bp, Homo sapiens
cttagaaataatggtttcagtt

SEQ ID NO: 8283550 - DNA, 22 bp, Homo sapiens
cttacaagcaaaacaactgtag

SEQ ID NO: 8283551 - DNA, 22 bp, Homo sapiens
cttaattactgtccaatatgca

SEQ ID NO: 8283552 - DNA, 22 bp, Homo sapiens
cttaattacccaatgtggtagg

SEQ ID NO: 8283553 - DNA, 22 bp, Homo sapiens
cttaaagagtatttaatataat

SEQ ID NO: 8283554 - DNA, 22 bp, Homo sapiens
cttacaaaggagaggagatagg

SEQ ID NO: 8283555 - DNA, 21 bp, Homo sapiens
ctgtgctttttaagtgtgatg

SEQ ID NO: 8283556 - DNA, 22 bp, Homo sapiens
ctgtttgtgattagcagtgggt

SEQ ID NO: 8283557 - DNA, 22 bp, Homo sapiens
cttcctgttgtcacagtctgcg

SEQ ID NO: 8283558 - DNA, 22 bp, Homo sapiens
cttccttccacaccttcagaat

SEQ ID NO: 8283559 - DNA, 20 bp, Homo sapiens
cttccaccagggccgctgat

SEQ ID NO: 8283560 - DNA, 22 bp, Homo sapiens
ctgtagagaaagcatggaagct

SEQ ID NO: 8283561 - DNA, 22 bp, Homo sapiens
ctgtacacttcagtgagttttg

SEQ ID NO: 8283562 - DNA, 22 bp, Homo sapiens
ctgtacaggagacgtctgtgca

SEQ ID NO: 8283563 - DNA, 22 bp, Homo sapiens
ctgtacagagttctgagtgtac

SEQ ID NO: 8283564 - DNA, 19 bp, Homo sapiens
ctgtacaggttgcttctgg

SEQ ID NO: 8283565 - DNA, 22 bp, Homo sapiens
ctgtaaaatgaacctagtcatc

SEQ ID NO: 8283566 - DNA, 22 bp, Homo sapiens
ctgtacaaaagaaagttcctat

SEQ ID NO: 8283567 - DNA, 22 bp, Homo sapiens
ctgtaattttccagccaatatg

SEQ ID NO: 8283568 - DNA, 22 bp, Homo sapiens
ctgtacaaagtagctgctggga

SEQ ID NO: 8283569 - DNA, 22 bp, Homo sapiens
ctggtgccctgtgtggcaggag

SEQ ID NO: 8283570 - DNA, 22 bp, Homo sapiens
ctggtgccattctgtggcctag

SEQ ID NO: 8283571 - DNA, 22 bp, Homo sapiens
ctggggagacgatcgatgttct

SEQ ID NO: 8283572 - DNA, 20 bp, Homo sapiens
ctggggagcctcgcggtggc

SEQ ID NO: 8283573 - DNA, 22 bp, Homo sapiens
ctggggacttgcagacacaatt

SEQ ID NO: 8283574 - DNA, 22 bp, Homo sapiens
ctggggagaagcgactcggctg

SEQ ID NO: 8283575 - DNA, 18 bp, Homo sapiens
ctgtcaactcaacaagag

SEQ ID NO: 8283576 - DNA, 22 bp, Homo sapiens
ctgtctgccaataatctatggc

SEQ ID NO: 8283577 - DNA, 22 bp, Homo sapiens
ctgtgccctgtggctggcacct

SEQ ID NO: 8283578 - DNA, 22 bp, Homo sapiens
ctgtctgctagaacatctatac

SEQ ID NO: 8283579 - DNA, 22 bp, Homo sapiens
ctgggctacgtgttgacagcat

SEQ ID NO: 8283580 - DNA, 22 bp, Homo sapiens
ctgggctaattaagcacagctg

SEQ ID NO: 8283581 - DNA, 22 bp, Homo sapiens
ctgggctgtttgttctggtctc

SEQ ID NO: 8283582 - DNA, 22 bp, Homo sapiens
ctgggctggagtgcaatggcgc

SEQ ID NO: 8283583 - DNA, 22 bp, Homo sapiens
ctgggcagagtccggaagatgg

SEQ ID NO: 8283584 - DNA, 22 bp, Homo sapiens
ctgggcagaattttaggatggc

SEQ ID NO: 8283585 - DNA, 22 bp, Homo sapiens
ctgggcactttggggagcctac

SEQ ID NO: 8283586 - DNA, 22 bp, Homo sapiens
ctgggcactttggggagcctac

SEQ ID NO: 8283587 - DNA, 22 bp, Homo sapiens
ctgggcagctccataccaccca

SEQ ID NO: 8283588 - DNA, 22 bp, Homo sapiens
ctgggcagctgtgcaaacaata

SEQ ID NO: 8283589 - DNA, 22 bp, Homo sapiens
ctgggagcaccatacttgtttc

SEQ ID NO: 8283590 - DNA, 22 bp, Homo sapiens
ctgggcacctttgcagcaggct

SEQ ID NO: 8283591 - DNA, 22 bp, Homo sapiens
ctgggcaaattgtgccagctat

SEQ ID NO: 8283592 - DNA, 22 bp, Homo sapiens
ctgggcacctttgcagcaggct

SEQ ID NO: 8283593 - DNA, 22 bp, Homo sapiens
ctgggcactgcagcaggcatca

SEQ ID NO: 8283594 - DNA, 22 bp, Homo sapiens
ctgggcacttgctcacagctct

SEQ ID NO: 8283595 - DNA, 22 bp, Homo sapiens
ctgggcactgcagggtgttgag

SEQ ID NO: 8283596 - DNA, 22 bp, Homo sapiens
ctgggcaaattgtgccagctat

SEQ ID NO: 8283597 - DNA, 22 bp, Homo sapiens
ctgggagatgactcagagcagg

SEQ ID NO: 8283598 - DNA, 22 bp, Homo sapiens
ctgggagatctcctgagggcag

SEQ ID NO: 8283599 - DNA, 22 bp, Homo sapiens
ctgggagattgaggccatggtg

SEQ ID NO: 8283600 - DNA, 23 bp, Homo sapiens
ctgggacatggtaggggcacaac

SEQ ID NO: 8283601 - DNA, 22 bp, Homo sapiens
ctgggacagctgagacaggaga

SEQ ID NO: 8283602 - DNA, 22 bp, Homo sapiens
ctgggacagctgagacaggaga

SEQ ID NO: 8283603 - DNA, 22 bp, Homo sapiens
ctgggacagagcagcagtgggg

SEQ ID NO: 8283604 - DNA, 22 bp, Homo sapiens
ctgggaagatggtgacagaatt

SEQ ID NO: 8283605 - DNA, 20 bp, Homo sapiens
ctgcttccaggctcaccccc

SEQ ID NO: 8283606 - DNA, 20 bp, Homo sapiens
ctgctgtgtgtgcctcagcc

SEQ ID NO: 8283607 - DNA, 22 bp, Homo sapiens
ctgctgtgattgggagaaaccg

SEQ ID NO: 8283608 - DNA, 20 bp, Homo sapiens
ctgctgtgttattgtagaac

SEQ ID NO: 8283609 - DNA, 23 bp, Homo sapiens
ctgctgtgttggtctcgatggga

SEQ ID NO: 8283610 - DNA, 22 bp, Homo sapiens
tggcacagtgctggatggtgct

SEQ ID NO: 8283611 - DNA, 22 bp, Homo sapiens
cccttgaggtagactgaacacc

SEQ ID NO: 8283612 - DNA, 22 bp, Homo sapiens
tggcaggaaaaacattggagat

SEQ ID NO: 8283613 - DNA, 19 bp, Homo sapiens
tggcaggcccaggatggac

SEQ ID NO: 8283614 - DNA, 22 bp, Homo sapiens
tggcaggctgagttggcctggt

SEQ ID NO: 8283615 - DNA, 22 bp, Homo sapiens
tggagatggcctcaggccctca

SEQ ID NO: 8283616 - DNA, 22 bp, Homo sapiens
tggagatgtaaagcaaggctta

SEQ ID NO: 8283617 - DNA, 22 bp, Homo sapiens
tggaggcattgtgactgctgaa

SEQ ID NO: 8283618 - DNA, 22 bp, Homo sapiens
tggaggcatgacagtgtctgga

SEQ ID NO: 8283619 - DNA, 22 bp, Homo sapiens
tggaggcatcagagtgcttggc

SEQ ID NO: 8283620 - DNA, 22 bp, Homo sapiens
tggaggcataggcctgggccct

SEQ ID NO: 8283621 - DNA, 22 bp, Homo sapiens
tggaggacgtgtccaccatgaa

SEQ ID NO: 8283622 - DNA, 22 bp, Homo sapiens
tggagaattctatgttgagggg

SEQ ID NO: 8283623 - DNA, 22 bp, Homo sapiens
tggagaattctatgttgagggg

SEQ ID NO: 8283624 - DNA, 22 bp, Homo sapiens
tggagactctgcatctgtgaca

SEQ ID NO: 8283625 - DNA, 22 bp, Homo sapiens
tggagactgactgcctgtattt

SEQ ID NO: 8283626 - DNA, 22 bp, Homo sapiens
tggaaacctgtcattggatcca

SEQ ID NO: 8283627 - DNA, 22 bp, Homo sapiens
tggaaacctactgatacaggag

SEQ ID NO: 8283628 - DNA, 22 bp, Homo sapiens
tggaaactataaaagcaccttc

SEQ ID NO: 8283629 - DNA, 22 bp, Homo sapiens
ccctccctttgcagcagtgcat

SEQ ID NO: 8283630 - DNA, 22 bp, Homo sapiens
ccctcctcaactctggcttcca

SEQ ID NO: 8283631 - DNA, 22 bp, Homo sapiens
ccccagctcagtgcagggacat

SEQ ID NO: 8283632 - DNA, 22 bp, Homo sapiens
tgctgggcaccagtgcctgcag

SEQ ID NO: 8283633 - DNA, 22 bp, Homo sapiens
tgctgctcaagctgcagcaaaa

SEQ ID NO: 8283634 - DNA, 22 bp, Homo sapiens
tgctgcctttgtggggtcactg

SEQ ID NO: 8283635 - DNA, 22 bp, Homo sapiens
tgctgctcaatgagatgccatc

SEQ ID NO: 8283636 - DNA, 22 bp, Homo sapiens
tgcttcctgctaaggctgcctg

SEQ ID NO: 8283637 - DNA, 22 bp, Homo sapiens
ccctccagtgtcccagtgggga

SEQ ID NO: 8283638 - DNA, 22 bp, Homo sapiens
tgctcaggaggaggctgtgagg

SEQ ID NO: 8283639 - DNA, 22 bp, Homo sapiens
tgctcaggagcttagagcacag

SEQ ID NO: 8283640 - DNA, 22 bp, Homo sapiens
tgctcagggacaatggagaggg

SEQ ID NO: 8283641 - DNA, 22 bp, Homo sapiens
tgctcaggccagccggacagag

SEQ ID NO: 8283642 - DNA, 19 bp, Homo sapiens
tgctcaggccaaggagccc

SEQ ID NO: 8283643 - DNA, 19 bp, Homo sapiens
tgctcaggccaaggagccc

SEQ ID NO: 8283644 - DNA, 22 bp, Homo sapiens
tgctaggtgattttattacttg

SEQ ID NO: 8283645 - DNA, 22 bp, Homo sapiens
tgctaggtgctcctccctaatt

SEQ ID NO: 8283646 - DNA, 22 bp, Homo sapiens
tgctagtgtgtgagatgttcaa

SEQ ID NO: 8283647 - DNA, 22 bp, Homo sapiens
tgcagggctaagtcagagcctg

SEQ ID NO: 8283648 - DNA, 22 bp, Homo sapiens
tgcaggtgctccgggggtgccc

SEQ ID NO: 8283649 - DNA, 22 bp, Homo sapiens
tgctacataggatagctcaaat

SEQ ID NO: 8283650 - DNA, 22 bp, Homo sapiens
tgctacaaattcgtaatcaatt

SEQ ID NO: 8283651 - DNA, 22 bp, Homo sapiens
tgctgccttctaggcgtgccct

SEQ ID NO: 8283652 - DNA, 22 bp, Homo sapiens
tgctgccttagcagccaggcaa

SEQ ID NO: 8283653 - DNA, 22 bp, Homo sapiens
tgctgccttctaggcgtgccct

SEQ ID NO: 8283654 - DNA, 22 bp, Homo sapiens
tgctgcctgatgctttctggac

SEQ ID NO: 8283655 - DNA, 22 bp, Homo sapiens
tgctctggacgctgagtggttt

SEQ ID NO: 8283656 - DNA, 20 bp, Homo sapiens
tgctctggaaatggtctgag

SEQ ID NO: 8283657 - DNA, 19 bp, Homo sapiens
cccagtccttgtcctgggc

SEQ ID NO: 8283658 - DNA, 22 bp, Homo sapiens
tgctcaggtgccttggctgctg

SEQ ID NO: 8283659 - DNA, 22 bp, Homo sapiens
tgctcaggtcgttctgcccctt

SEQ ID NO: 8283660 - DNA, 22 bp, Homo sapiens
tggtacaagttctggcatgtga

SEQ ID NO: 8283661 - DNA, 22 bp, Homo sapiens
tggtaatatatgccagataaaa

SEQ ID NO: 8283662 - DNA, 22 bp, Homo sapiens
tgggtgggagcaccctgtctgg

SEQ ID NO: 8283663 - DNA, 23 bp, Homo sapiens
tggtaatagggagcagaaggtag

SEQ ID NO: 8283664 - DNA, 22 bp, Homo sapiens
tggtaatactcatggcctgtca

SEQ ID NO: 8283665 - DNA, 22 bp, Homo sapiens
tggtaaggttccagatctagaa

SEQ ID NO: 8283666 - DNA, 22 bp, Homo sapiens
tggtaaggttctacagtgttga

SEQ ID NO: 8283667 - DNA, 22 bp, Homo sapiens
cctgcaggtaaggctaactgcc

SEQ ID NO: 8283668 - DNA, 22 bp, Homo sapiens
cctgcagggtgctgccacagat

SEQ ID NO: 8283669 - DNA, 22 bp, Homo sapiens
cctgcagggtgctgccacagat

SEQ ID NO: 8283670 - DNA, 19 bp, Homo sapiens
cctgcagggatgagaggtt

SEQ ID NO: 8283671 - DNA, 22 bp, Homo sapiens
cctgcaggggagagacttctag

SEQ ID NO: 8283672 - DNA, 22 bp, Homo sapiens
cctgcaggggagagacttctag

SEQ ID NO: 8283673 - DNA, 19 bp, Homo sapiens
cctgcagggatgagaggtt

SEQ ID NO: 8283674 - DNA, 22 bp, Homo sapiens
cctgcaggtccccggatgcgca

SEQ ID NO: 8283675 - DNA, 22 bp, Homo sapiens
cctgcaggttgcagaggcggaa

SEQ ID NO: 8283676 - DNA, 22 bp, Homo sapiens
cctgcaggttgcagaggcggaa

SEQ ID NO: 8283677 - DNA, 22 bp, Homo sapiens
cctgcaggtttcccccggacgg

SEQ ID NO: 8283678 - DNA, 22 bp, Homo sapiens
cctgccactgtaggtgacagtt

SEQ ID NO: 8283679 - DNA, 22 bp, Homo sapiens
tggtacatgggtaggtatctct

SEQ ID NO: 8283680 - DNA, 22 bp, Homo sapiens
tggtacataaatggatgttttc

SEQ ID NO: 8283681 - DNA, 22 bp, Homo sapiens
tggtaccatttcccaggagtgt

SEQ ID NO: 8283682 - DNA, 22 bp, Homo sapiens
cctgcctcaggactctgcatat

SEQ ID NO: 8283683 - DNA, 22 bp, Homo sapiens
cctgcccttctttccccagcat

SEQ ID NO: 8283684 - DNA, 22 bp, Homo sapiens
cctgcccttctttccccagcat

SEQ ID NO: 8283685 - DNA, 22 bp, Homo sapiens
cctgcctgcaccttctctgggg

SEQ ID NO: 8283686 - DNA, 23 bp, Homo sapiens
cctgcctccccatcagttataca

SEQ ID NO: 8283687 - DNA, 22 bp, Homo sapiens
cctgcctcccagaggtcctcta

SEQ ID NO: 8283688 - DNA, 22 bp, Homo sapiens
cctgcctcccagaggtcctcta

SEQ ID NO: 8283689 - DNA, 22 bp, Homo sapiens
cctgcctcatcaacttgtcgtg

SEQ ID NO: 8283690 - DNA, 23 bp, Homo sapiens
tggggagagttaccctggaagcg

SEQ ID NO: 8283691 - DNA, 22 bp, Homo sapiens
tggggagattgttaaatttaga

SEQ ID NO: 8283692 - DNA, 23 bp, Homo sapiens
tggggagagttaccctggaagcg

SEQ ID NO: 8283693 - DNA, 22 bp, Homo sapiens
tggggagagttacaaggaatct

SEQ ID NO: 8283694 - DNA, 22 bp, Homo sapiens
tggggagagattgaggagtttt

SEQ ID NO: 8283695 - DNA, 22 bp, Homo sapiens
tggggagagaccggaatgtttc

SEQ ID NO: 8283696 - DNA, 22 bp, Homo sapiens
tggggagaggtatcattgagat

SEQ ID NO: 8283697 - DNA, 22 bp, Homo sapiens
tggggagagattgaggagtttt

SEQ ID NO: 8283698 - DNA, 22 bp, Homo sapiens
tggggagaggaatttgaatgat

SEQ ID NO: 8283699 - DNA, 22 bp, Homo sapiens
cctgcagggaatcgaggcagaa

SEQ ID NO: 8283700 - DNA, 22 bp, Homo sapiens
cctgcagggaatcgaggcagaa

SEQ ID NO: 8283701 - DNA, 22 bp, Homo sapiens
cctgcaggctgcaggccagttc

SEQ ID NO: 8283702 - DNA, 22 bp, Homo sapiens
cctgaggtcatggtccagtgtt

SEQ ID NO: 8283703 - DNA, 22 bp, Homo sapiens
cctgagtgaattccctcactgt

SEQ ID NO: 8283704 - DNA, 22 bp, Homo sapiens
tggggagaaatgtctttgttcc

SEQ ID NO: 8283705 - DNA, 22 bp, Homo sapiens
tggggagactggccgagatcct

SEQ ID NO: 8283706 - DNA, 22 bp, Homo sapiens
tggggagaagcaatagactcta

SEQ ID NO: 8283707 - DNA, 22 bp, Homo sapiens
tgggcaggagagaagctaaaga

SEQ ID NO: 8283708 - DNA, 22 bp, Homo sapiens
tgggcaggagagaagctaaaga

SEQ ID NO: 8283709 - DNA, 22 bp, Homo sapiens
tgggcaggcaagtgaatacctt

SEQ ID NO: 8283710 - DNA, 22 bp, Homo sapiens
tgggctccagcacctgtgctct

SEQ ID NO: 8283711 - DNA, 22 bp, Homo sapiens
tgggctccgttgcctggggcag

SEQ ID NO: 8283712 - DNA, 22 bp, Homo sapiens
tgggctccggcggcctcaggct

SEQ ID NO: 8283713 - DNA, 22 bp, Homo sapiens
tggcagtgtcttatcaggagtg

SEQ ID NO: 8283714 - DNA, 22 bp, Homo sapiens
tggcagtggtaccggctctcag

SEQ ID NO: 8283715 - DNA, 22 bp, Homo sapiens
tggcagtgggaagctggaagtc

SEQ ID NO: 8283716 - DNA, 22 bp, Homo sapiens
cctccagcgcgatccactccgg

SEQ ID NO: 8283717 - DNA, 22 bp, Homo sapiens
tggccaattgaattttaattat

SEQ ID NO: 8283718 - DNA, 22 bp, Homo sapiens
cctccagctgcctcagtctctt

SEQ ID NO: 8283719 - DNA, 22 bp, Homo sapiens
cctccaggctggttatcagctg

SEQ ID NO: 8283720 - DNA, 22 bp, Homo sapiens
cctccaggctggttatcagctg

SEQ ID NO: 8283721 - DNA, 22 bp, Homo sapiens
cctccagggcccctctcactgg

SEQ ID NO: 8283722 - DNA, 22 bp, Homo sapiens
cctccagggcagacggggagca

SEQ ID NO: 8283723 - DNA, 22 bp, Homo sapiens
cctccagggcagacggggagca

SEQ ID NO: 8283724 - DNA, 21 bp, Homo sapiens
cctccaggtgattccgtgctc

SEQ ID NO: 8283725 - DNA, 22 bp, Homo sapiens
cctccagggcccctctcactgg

SEQ ID NO: 8283726 - DNA, 19 bp, Homo sapiens
cctcccacggattccttcc

SEQ ID NO: 8283727 - DNA, 22 bp, Homo sapiens
cctcccacttcttgctgaggtc

SEQ ID NO: 8283728 - DNA, 22 bp, Homo sapiens
cctcctgggagagcacggaggg

SEQ ID NO: 8283729 - DNA, 22 bp, Homo sapiens
cctcctgggacaggctggcaca

SEQ ID NO: 8283730 - DNA, 22 bp, Homo sapiens
cctcctggcctgtgcagagccc

SEQ ID NO: 8283731 - DNA, 22 bp, Homo sapiens
cctctcccgggtgccgctgggc

SEQ ID NO: 8283732 - DNA, 19 bp, Homo sapiens
tgggacacgatctgcctgt

SEQ ID NO: 8283733 - DNA, 19 bp, Homo sapiens
cctctcccatgcttacctc

SEQ ID NO: 8283734 - DNA, 22 bp, Homo sapiens
cctctcccctcccaaggcggga

SEQ ID NO: 8283735 - DNA, 22 bp, Homo sapiens
cctctcccagggagagcctgag

SEQ ID NO: 8283736 - DNA, 22 bp, Homo sapiens
cctctccagttttaacgtgacc

SEQ ID NO: 8283737 - DNA, 22 bp, Homo sapiens
cctctcccaggcgcggcggcag

SEQ ID NO: 8283738 - DNA, 22 bp, Homo sapiens
cctctcccacgtggcagaggct

SEQ ID NO: 8283739 - DNA, 22 bp, Homo sapiens
cctctccagcggcctcagggcc

SEQ ID NO: 8283740 - DNA, 22 bp, Homo sapiens
tggcttgggtgtctcagctctt

SEQ ID NO: 8283741 - DNA, 22 bp, Homo sapiens
tggcttctttgtgacagctctt

SEQ ID NO: 8283742 - DNA, 22 bp, Homo sapiens
tggcttgcttccccattctcat

SEQ ID NO: 8283743 - DNA, 22 bp, Homo sapiens
tggcttgcaaaattatttttct

SEQ ID NO: 8283744 - DNA, 23 bp, Homo sapiens
tggcttgctaatgttccaaataa

SEQ ID NO: 8283745 - DNA, 22 bp, Homo sapiens
tggcttcccatagcttgctagt

SEQ ID NO: 8283746 - DNA, 16 bp, Homo sapiens
tggcttcccagagata

SEQ ID NO: 8283747 - DNA, 22 bp, Homo sapiens
tggcttcccctaccttccaatt

SEQ ID NO: 8283748 - DNA, 22 bp, Homo sapiens
tggcttccccggagtgacatgt

SEQ ID NO: 8283749 - DNA, 22 bp, Homo sapiens
tggcttcccctaccttccaatt

SEQ ID NO: 8283750 - DNA, 22 bp, Homo sapiens
tgggcagaatgtgggatccaga

SEQ ID NO: 8283751 - DNA, 22 bp, Homo sapiens
tgggcagaaatcagtatcagat

SEQ ID NO: 8283752 - DNA, 22 bp, Homo sapiens
tgggacaggaggcctctggaga

SEQ ID NO: 8283753 - DNA, 22 bp, Homo sapiens
tgggacagagtgagctttggcc

SEQ ID NO: 8283754 - DNA, 22 bp, Homo sapiens
tgaaggtgtttatacctcagat

SEQ ID NO: 8283755 - DNA, 22 bp, Homo sapiens
ccagggcatcacatccagtgtt

SEQ ID NO: 8283756 - DNA, 22 bp, Homo sapiens
tgaagtgaagaagcatgaatag

SEQ ID NO: 8283757 - DNA, 22 bp, Homo sapiens
ccagggctccattgctcatcct

SEQ ID NO: 8283758 - DNA, 22 bp, Homo sapiens
ccagggctgagactgtattggg

SEQ ID NO: 8283759 - DNA, 22 bp, Homo sapiens
ccagggctctatgagggtggag

SEQ ID NO: 8283760 - DNA, 22 bp, Homo sapiens
ccagggcaattatttggagggt

SEQ ID NO: 8283761 - DNA, 22 bp, Homo sapiens
ccagggcaattatttggagggt

SEQ ID NO: 8283762 - DNA, 22 bp, Homo sapiens
ccagggagggtcctgtggcttc

SEQ ID NO: 8283763 - DNA, 22 bp, Homo sapiens
tgaaatgatcagtttggttact

SEQ ID NO: 8283764 - DNA, 22 bp, Homo sapiens
tgaaatgatatctgataacaaa

SEQ ID NO: 8283765 - DNA, 22 bp, Homo sapiens
tgaaatgagcatttattcttta

SEQ ID NO: 8283766 - DNA, 22 bp, Homo sapiens
tgaaatgagagcacagaataaa

SEQ ID NO: 8283767 - DNA, 22 bp, Homo sapiens
tgaaatgagataatttaagtgc

SEQ ID NO: 8283768 - DNA, 22 bp, Homo sapiens
tgaaatgagatagataatcagg

SEQ ID NO: 8283769 - DNA, 22 bp, Homo sapiens
ccaggcctctggctgcttagtc

SEQ ID NO: 8283770 - DNA, 21 bp, Homo sapiens
tcttgattttggacttcttcc

SEQ ID NO: 8283771 - DNA, 22 bp, Homo sapiens
tcttttctggactctgcatgga

SEQ ID NO: 8283772 - DNA, 22 bp, Homo sapiens
tcttttgtagctaacacattca

SEQ ID NO: 8283773 - DNA, 22 bp, Homo sapiens
tcttttgtactcagtattgaca

SEQ ID NO: 8283774 - DNA, 22 bp, Homo sapiens
tcttttgtcatcccttgtacat

SEQ ID NO: 8283775 - DNA, 22 bp, Homo sapiens
tcttttgtcatagagcatggta

SEQ ID NO: 8283776 - DNA, 22 bp, Homo sapiens
tgaaacagaagatgttcatgtg

SEQ ID NO: 8283777 - DNA, 22 bp, Homo sapiens
tcttttgtggatgaagaaatgg

SEQ ID NO: 8283778 - DNA, 22 bp, Homo sapiens
tcttttgtggatgaagaaatgg

SEQ ID NO: 8283779 - DNA, 22 bp, Homo sapiens
tcttttgtgattctttagttac

SEQ ID NO: 8283780 - DNA, 22 bp, Homo sapiens
tgaaatgaatgtgattcgatag

SEQ ID NO: 8283781 - DNA, 22 bp, Homo sapiens
tgaaatgacagtcttaagctct

SEQ ID NO: 8283782 - DNA, 22 bp, Homo sapiens
tcttctctcatgtaggagggaa

SEQ ID NO: 8283783 - DNA, 22 bp, Homo sapiens
tcttctctgtggcctggtggtg

SEQ ID NO: 8283784 - DNA, 22 bp, Homo sapiens
ccaggcagcaaattttctgaat

SEQ ID NO: 8283785 - DNA, 22 bp, Homo sapiens
tcttctctgtggcctggtggtg

SEQ ID NO: 8283786 - DNA, 22 bp, Homo sapiens
tcttctctgtggcctggtggtg

SEQ ID NO: 8283787 - DNA, 17 bp, Homo sapiens
tcttctcttccagtctt

SEQ ID NO: 8283788 - DNA, 17 bp, Homo sapiens
tcttctcttccagtctt

SEQ ID NO: 8283789 - DNA, 22 bp, Homo sapiens
ccaggcctcccttttccagcca

SEQ ID NO: 8283790 - DNA, 22 bp, Homo sapiens
ccaggcctcctgtgagtggacc

SEQ ID NO: 8283791 - DNA, 22 bp, Homo sapiens
ccaggcaggcgatggtgcagtg

SEQ ID NO: 8283792 - DNA, 22 bp, Homo sapiens
ccaggcaggcagcgttctcagg

SEQ ID NO: 8283793 - DNA, 22 bp, Homo sapiens
ccaggaggcggaggttgcagtg

SEQ ID NO: 8283794 - DNA, 22 bp, Homo sapiens
ccaggaggcggaggttgcagtg

SEQ ID NO: 8283795 - DNA, 22 bp, Homo sapiens
ccaggaggctcttgtccctggt

SEQ ID NO: 8283796 - DNA, 22 bp, Homo sapiens
ccaggcagatgggccggcttca

SEQ ID NO: 8283797 - DNA, 22 bp, Homo sapiens
tcttacaagtcacccgctttct

SEQ ID NO: 8283798 - DNA, 22 bp, Homo sapiens
ccaggagcctgggccaggctgg

SEQ ID NO: 8283799 - DNA, 22 bp, Homo sapiens
ccaggagccctgccacaatggt

SEQ ID NO: 8283800 - DNA, 22 bp, Homo sapiens
ccaggagcctgggccaggctgg

SEQ ID NO: 8283801 - DNA, 22 bp, Homo sapiens
tctgttcagttgattagacaga

SEQ ID NO: 8283802 - DNA, 22 bp, Homo sapiens
tctgttcatcatctggacacat

SEQ ID NO: 8283803 - DNA, 22 bp, Homo sapiens
tctgttcagttgtaccttcccc

SEQ ID NO: 8283804 - DNA, 22 bp, Homo sapiens
tctgttcatacagagtatagta

SEQ ID NO: 8283805 - DNA, 22 bp, Homo sapiens
tctgttcatagtagtgtatatg

SEQ ID NO: 8283806 - DNA, 22 bp, Homo sapiens
tctgttcaggtttcagagaact

SEQ ID NO: 8283807 - DNA, 22 bp, Homo sapiens
tctgttcagaattgtaacactc

SEQ ID NO: 8283808 - DNA, 22 bp, Homo sapiens
tctgttcactgagcaatggcaa

SEQ ID NO: 8283809 - DNA, 22 bp, Homo sapiens
tctgttcagacactttacatgt

SEQ ID NO: 8283810 - DNA, 22 bp, Homo sapiens
tctgttcagaagaggtgaaagt

SEQ ID NO: 8283811 - DNA, 17 bp, Homo sapiens
tctgttcaagtgagagg

SEQ ID NO: 8283812 - DNA, 21 bp, Homo sapiens
tctgttcaaggaactacggat

SEQ ID NO: 8283813 - DNA, 22 bp, Homo sapiens
tctgttcagaaatggaagtgcc

SEQ ID NO: 8283814 - DNA, 22 bp, Homo sapiens
ccaggaggcggaggttgcagcg

SEQ ID NO: 8283815 - DNA, 22 bp, Homo sapiens
tctgttcttcctacattcacat

SEQ ID NO: 8283816 - DNA, 17 bp, Homo sapiens
tctgttcatgcatacct

SEQ ID NO: 8283817 - DNA, 22 bp, Homo sapiens
tctgttctaagcattctatgtg

SEQ ID NO: 8283818 - DNA, 22 bp, Homo sapiens
tctgttctaagcattctatgtg

SEQ ID NO: 8283819 - DNA, 22 bp, Homo sapiens
ccaggagccactcaggcccaca

SEQ ID NO: 8283820 - DNA, 22 bp, Homo sapiens
ccaggagcattaagagaacata

SEQ ID NO: 8283821 - DNA, 22 bp, Homo sapiens
ccaggagcagggctggctgcac

SEQ ID NO: 8283822 - DNA, 19 bp, Homo sapiens
ccaggagcagtggtgagct

SEQ ID NO: 8283823 - DNA, 19 bp, Homo sapiens
ccaggagcagtggtgagct

SEQ ID NO: 8283824 - DNA, 22 bp, Homo sapiens
ccaggagcagggctggctgcac

SEQ ID NO: 8283825 - DNA, 22 bp, Homo sapiens
ccaggagcagggctggctgcac

SEQ ID NO: 8283826 - DNA, 22 bp, Homo sapiens
ccaggagcagagtaggtgttca

SEQ ID NO: 8283827 - DNA, 22 bp, Homo sapiens
ccaggagcagatatggacataa

SEQ ID NO: 8283828 - DNA, 22 bp, Homo sapiens
ccaggagcaccaggcctgtgcc

SEQ ID NO: 8283829 - DNA, 22 bp, Homo sapiens
ccaggagcaccaggcctgtgcc

SEQ ID NO: 8283830 - DNA, 22 bp, Homo sapiens
ccaggagcaggagctgcagctg

SEQ ID NO: 8283831 - DNA, 22 bp, Homo sapiens
ccaggagcaggagctgcagctg

SEQ ID NO: 8283832 - DNA, 22 bp, Homo sapiens
ccaggagcaggagctggacaga

SEQ ID NO: 8283833 - DNA, 22 bp, Homo sapiens
ccaggagcaaagatcactggga

SEQ ID NO: 8283834 - DNA, 17 bp, Homo sapiens
ccaggagagatgcttgt

SEQ ID NO: 8283835 - DNA, 22 bp, Homo sapiens
ccagcactcctgtctcaagtct

SEQ ID NO: 8283836 - DNA, 22 bp, Homo sapiens
ccaggtggataaggtttctgga

SEQ ID NO: 8283837 - DNA, 22 bp, Homo sapiens
tgagcaggtcaagactccagct

SEQ ID NO: 8283838 - DNA, 21 bp, Homo sapiens
tgagcaggtgcagggaagtgg

SEQ ID NO: 8283839 - DNA, 22 bp, Homo sapiens
ccagggctgctcattggctggt

SEQ ID NO: 8283840 - DNA, 19 bp, Homo sapiens
ccagtcccatacaggagat

SEQ ID NO: 8283841 - DNA, 22 bp, Homo sapiens
tgagccatgggactccaaggga

SEQ ID NO: 8283842 - DNA, 22 bp, Homo sapiens
tgagccagtggaagatggcagt

SEQ ID NO: 8283843 - DNA, 22 bp, Homo sapiens
tgagccagttcttcagatccat

SEQ ID NO: 8283844 - DNA, 22 bp, Homo sapiens
tgagccagtgtggtaaagctga

SEQ ID NO: 8283845 - DNA, 22 bp, Homo sapiens
tgagccagtggaagatggcagt

SEQ ID NO: 8283846 - DNA, 23 bp, Homo sapiens
tgagcccaggaggtcaaggctgc

SEQ ID NO: 8283847 - DNA, 18 bp, Homo sapiens
ccagtgccaagagtggca

SEQ ID NO: 8283848 - DNA, 22 bp, Homo sapiens
ccagtgcccagtctccctggtc

SEQ ID NO: 8283849 - DNA, 19 bp, Homo sapiens
ccagtgccggcgctgggga

SEQ ID NO: 8283850 - DNA, 22 bp, Homo sapiens
ccagtgcctatctcctctggga

SEQ ID NO: 8283851 - DNA, 17 bp, Homo sapiens
ccagtgcctgtggcaac

SEQ ID NO: 8283852 - DNA, 18 bp, Homo sapiens
tgaggctgagggtagagg

SEQ ID NO: 8283853 - DNA, 22 bp, Homo sapiens
ccagttaaggaaacagcacgaa

SEQ ID NO: 8283854 - DNA, 18 bp, Homo sapiens
ccatcaccctaactagtg

SEQ ID NO: 8283855 - DNA, 22 bp, Homo sapiens
ccatcactcatctagatattta

SEQ ID NO: 8283856 - DNA, 17 bp, Homo sapiens
tgaggccatggcaccat

SEQ ID NO: 8283857 - DNA, 22 bp, Homo sapiens
tgaggctgaaactggcgataga

SEQ ID NO: 8283858 - DNA, 22 bp, Homo sapiens
tgaggcccagccgccctgagag

SEQ ID NO: 8283859 - DNA, 18 bp, Homo sapiens
tgaggcccatctctctga

SEQ ID NO: 8283860 - DNA, 22 bp, Homo sapiens
tgaggctgacaaaagatgaggt

SEQ ID NO: 8283861 - DNA, 22 bp, Homo sapiens
tgagttctttgcaaataacaag

SEQ ID NO: 8283862 - DNA, 22 bp, Homo sapiens
tgcagggatcctagctgaagag

SEQ ID NO: 8283863 - DNA, 22 bp, Homo sapiens
cccagcagggtctctgtgtcta

SEQ ID NO: 8283864 - DNA, 22 bp, Homo sapiens
cccagcaggtcggtgctgcctg

SEQ ID NO: 8283865 - DNA, 22 bp, Homo sapiens
cccagcaggaggaggttgcagt

SEQ ID NO: 8283866 - DNA, 22 bp, Homo sapiens
cccagcaggcatgttgggagga

SEQ ID NO: 8283867 - DNA, 22 bp, Homo sapiens
tgcaggcagtaggccagctcca

SEQ ID NO: 8283868 - DNA, 22 bp, Homo sapiens
cccagcagcctggatgttcttt

SEQ ID NO: 8283869 - DNA, 22 bp, Homo sapiens
cccagcagcttgcacagtgctg

SEQ ID NO: 8283870 - DNA, 22 bp, Homo sapiens
cccagcagccttgtcccttctc

SEQ ID NO: 8283871 - DNA, 23 bp, Homo sapiens
tgcaggactactcgagcactgct

SEQ ID NO: 8283872 - DNA, 22 bp, Homo sapiens
cccagaggctgagttgggagca

SEQ ID NO: 8283873 - DNA, 22 bp, Homo sapiens
cccagaggaggcaaagctctgt

SEQ ID NO: 8283874 - DNA, 22 bp, Homo sapiens
cccagaggaggcaaagctctgt

SEQ ID NO: 8283875 - DNA, 22 bp, Homo sapiens
cccagaggaggatctcggcccg

SEQ ID NO: 8283876 - DNA, 22 bp, Homo sapiens
cccagagggaagggaatgaggt

SEQ ID NO: 8283877 - DNA, 22 bp, Homo sapiens
tgcagctgcaagtccaggtcag

SEQ ID NO: 8283878 - DNA, 20 bp, Homo sapiens
tgcagctgcaggagggtggg

SEQ ID NO: 8283879 - DNA, 22 bp, Homo sapiens
cccagaggggtcgtctgagggg

SEQ ID NO: 8283880 - DNA, 18 bp, Homo sapiens
tgcactgtgctgagtggc

SEQ ID NO: 8283881 - DNA, 22 bp, Homo sapiens
tgcactttaaaaaatggtgatg

SEQ ID NO: 8283882 - DNA, 21 bp, Homo sapiens
cccagagcctagggagggcac

SEQ ID NO: 8283883 - DNA, 22 bp, Homo sapiens
cccagagctgagggggcacgtt

SEQ ID NO: 8283884 - DNA, 22 bp, Homo sapiens
cccagagctcagtgtgcaaggt

SEQ ID NO: 8283885 - DNA, 22 bp, Homo sapiens
cccagagcctcattctgttggg

SEQ ID NO: 8283886 - DNA, 22 bp, Homo sapiens
cccagagctccggtcctgccca

SEQ ID NO: 8283887 - DNA, 18 bp, Homo sapiens
cccagaggaatgcctgga

SEQ ID NO: 8283888 - DNA, 22 bp, Homo sapiens
cccagagctgagtctgatatat

SEQ ID NO: 8283889 - DNA, 23 bp, Homo sapiens
cccagaggagcagggcgtgagat

SEQ ID NO: 8283890 - DNA, 22 bp, Homo sapiens
tgcactccaggctgggtgacag

SEQ ID NO: 8283891 - DNA, 22 bp, Homo sapiens
tgcactccaggctgggtgacag

SEQ ID NO: 8283892 - DNA, 23 bp, Homo sapiens
cccaagcctgtgccctctgactc

SEQ ID NO: 8283893 - DNA, 22 bp, Homo sapiens
cccaagccagaccctgaccctg

SEQ ID NO: 8283894 - DNA, 22 bp, Homo sapiens
catgctgagcacattctgtatt

SEQ ID NO: 8283895 - DNA, 22 bp, Homo sapiens
tccaagcactgttaattaaact

SEQ ID NO: 8283896 - DNA, 22 bp, Homo sapiens
tccaagcatgtggtcaggagcc

SEQ ID NO: 8283897 - DNA, 22 bp, Homo sapiens
tccaagatctacagcagtttag

SEQ ID NO: 8283898 - DNA, 22 bp, Homo sapiens
tccaagatgtcggtcctgtcca

SEQ ID NO: 8283899 - DNA, 22 bp, Homo sapiens
tccaagagaatactggagagta

SEQ ID NO: 8283900 - DNA, 22 bp, Homo sapiens
catgcttttttctagtataaat

SEQ ID NO: 8283901 - DNA, 22 bp, Homo sapiens
catgcttttcaatctatcttaa

SEQ ID NO: 8283902 - DNA, 22 bp, Homo sapiens
tccagcagaaaagaggtaggga

SEQ ID NO: 8283903 - DNA, 22 bp, Homo sapiens
tccagcagaaccagagacctgg

SEQ ID NO: 8283904 - DNA, 21 bp, Homo sapiens
tccagcacagatgacctcccc

SEQ ID NO: 8283905 - DNA, 22 bp, Homo sapiens
tccagggcagggtgcgcatggg

SEQ ID NO: 8283906 - DNA, 22 bp, Homo sapiens
tccagggcaggtgctgggctct

SEQ ID NO: 8283907 - DNA, 22 bp, Homo sapiens
tccagggcagtgactacagcgg

SEQ ID NO: 8283908 - DNA, 23 bp, Homo sapiens
tccagggcagtggctgggtctgc

SEQ ID NO: 8283909 - DNA, 22 bp, Homo sapiens
tccagggcatgctcagactcag

SEQ ID NO: 8283910 - DNA, 22 bp, Homo sapiens
tccaggctttggggcaggagcg

SEQ ID NO: 8283911 - DNA, 22 bp, Homo sapiens
catgttttctaggctttcacaa

SEQ ID NO: 8283912 - DNA, 22 bp, Homo sapiens
catgttttgtgtacagaatatt

SEQ ID NO: 8283913 - DNA, 23 bp, Homo sapiens
catgtacagagtttgataaagtg

SEQ ID NO: 8283914 - DNA, 22 bp, Homo sapiens
catgtacagccagggttgagaa

SEQ ID NO: 8283915 - DNA, 22 bp, Homo sapiens
catgtacactcatgtaactata

SEQ ID NO: 8283916 - DNA, 22 bp, Homo sapiens
catgtacactcatgtaactata

SEQ ID NO: 8283917 - DNA, 23 bp, Homo sapiens
catgtacacacagctgtacagtg

SEQ ID NO: 8283918 - DNA, 22 bp, Homo sapiens
catgtacacacaaagggacaat

SEQ ID NO: 8283919 - DNA, 22 bp, Homo sapiens
catgtacatgcatgggcactgt

SEQ ID NO: 8283920 - DNA, 22 bp, Homo sapiens
catgtacagtttttctgtcctg

SEQ ID NO: 8283921 - DNA, 22 bp, Homo sapiens
tcaggctgcctatcagactgtg

SEQ ID NO: 8283922 - DNA, 22 bp, Homo sapiens
tcaggctgcagctgtcagcagc

SEQ ID NO: 8283923 - DNA, 21 bp, Homo sapiens
catcaactcttgtgctcacac

SEQ ID NO: 8283924 - DNA, 22 bp, Homo sapiens
tcaggcagaccaccgtgggcag

SEQ ID NO: 8283925 - DNA, 22 bp, Homo sapiens
tcactgttgacctggaagtggg

SEQ ID NO: 8283926 - DNA, 22 bp, Homo sapiens
cagtgtaagaattcaaagccta

SEQ ID NO: 8283927 - DNA, 22 bp, Homo sapiens
tcacttaggtgcaaagggaact

SEQ ID NO: 8283928 - DNA, 22 bp, Homo sapiens
tcactgtttgcagtgaagagaa

SEQ ID NO: 8283929 - DNA, 22 bp, Homo sapiens
catccgcatgcaagtgctgtcc

SEQ ID NO: 8283930 - DNA, 22 bp, Homo sapiens
catcctgactgtaactaagaga

SEQ ID NO: 8283931 - DNA, 22 bp, Homo sapiens
catccttcaaaggctacaatta

SEQ ID NO: 8283932 - DNA, 22 bp, Homo sapiens
tcatacataacttgtacagtga

SEQ ID NO: 8283933 - DNA, 22 bp, Homo sapiens
tcatacataaataagagtttag

SEQ ID NO: 8283934 - DNA, 22 bp, Homo sapiens
tcataattgtatacatttatgg

SEQ ID NO: 8283935 - DNA, 22 bp, Homo sapiens
tcagtgtcttctctttcctacc

SEQ ID NO: 8283936 - DNA, 22 bp, Homo sapiens
tcagtgtcttgggcttgaatgc

SEQ ID NO: 8283937 - DNA, 22 bp, Homo sapiens
tcagtgtgattaggctatctga

SEQ ID NO: 8283938 - DNA, 22 bp, Homo sapiens
tcagtgtgggtaagcatgctgt

SEQ ID NO: 8283939 - DNA, 22 bp, Homo sapiens
tcagtgtgtacactgagcattt

SEQ ID NO: 8283940 - DNA, 22 bp, Homo sapiens
catcagtctgtgaagagggcta

SEQ ID NO: 8283941 - DNA, 22 bp, Homo sapiens
catcagtctgaaagccagggag

SEQ ID NO: 8283942 - DNA, 22 bp, Homo sapiens
catcagtctagattctagtacc

SEQ ID NO: 8283943 - DNA, 22 bp, Homo sapiens
catcagtcccacggagcagccc

SEQ ID NO: 8283944 - DNA, 22 bp, Homo sapiens
catcagtcagtctcttcagtat

SEQ ID NO: 8283945 - DNA, 22 bp, Homo sapiens
catcagtcagtcaacgcagttt

SEQ ID NO: 8283946 - DNA, 22 bp, Homo sapiens
catcagcagtcacatgatgctg

SEQ ID NO: 8283947 - DNA, 22 bp, Homo sapiens
catcagctgagggtgagcagaa

SEQ ID NO: 8283948 - DNA, 22 bp, Homo sapiens
ccaagaggcagaatgcagagaa

SEQ ID NO: 8283949 - DNA, 23 bp, Homo sapiens
ccaagactgttaggagtggggag

SEQ ID NO: 8283950 - DNA, 22 bp, Homo sapiens
ccaagaggggcagagggctgca

SEQ ID NO: 8283951 - DNA, 19 bp, Homo sapiens
tcctgcccaccagccaggg

SEQ ID NO: 8283952 - DNA, 22 bp, Homo sapiens
ccaagaggttgaggctgcagtg

SEQ ID NO: 8283953 - DNA, 22 bp, Homo sapiens
tcctgcccagagctctccactc

SEQ ID NO: 8283954 - DNA, 21 bp, Homo sapiens
tcctgccttagtccagagcag

SEQ ID NO: 8283955 - DNA, 22 bp, Homo sapiens
tcctggagccatgattcccctc

SEQ ID NO: 8283956 - DNA, 22 bp, Homo sapiens
tcctggagccaggacccttccc

SEQ ID NO: 8283957 - DNA, 22 bp, Homo sapiens
tcctgctagagaataacagcac

SEQ ID NO: 8283958 - DNA, 22 bp, Homo sapiens
ccaccaggacagccctgagggg

SEQ ID NO: 8283959 - DNA, 22 bp, Homo sapiens
tcctggctaacacggtgacacc

SEQ ID NO: 8283960 - DNA, 22 bp, Homo sapiens
tcctggagctgactccgtttga

SEQ ID NO: 8283961 - DNA, 22 bp, Homo sapiens
tcctggagcttcagtttccttt

SEQ ID NO: 8283962 - DNA, 22 bp, Homo sapiens
tcctggagctggtgtctttccc

SEQ ID NO: 8283963 - DNA, 22 bp, Homo sapiens
tcctggagctggtgtctttccc

SEQ ID NO: 8283964 - DNA, 22 bp, Homo sapiens
tcctggagcttccttcatggta

SEQ ID NO: 8283965 - DNA, 22 bp, Homo sapiens
ccacagctgaccgcaggtgagc

SEQ ID NO: 8283966 - DNA, 22 bp, Homo sapiens
ccacagctgacaatggatagac

SEQ ID NO: 8283967 - DNA, 22 bp, Homo sapiens
ccacaggctgctgcaggtcccg

SEQ ID NO: 8283968 - DNA, 19 bp, Homo sapiens
cattttaagcatccccagt

SEQ ID NO: 8283969 - DNA, 22 bp, Homo sapiens
catttgtctctaggaagtgagg

SEQ ID NO: 8283970 - DNA, 22 bp, Homo sapiens
catttgtcatcactgagctgcc

SEQ ID NO: 8283971 - DNA, 19 bp, Homo sapiens
cattttaagcatccccagt

SEQ ID NO: 8283972 - DNA, 22 bp, Homo sapiens
cattttaagatgacctggtttc

SEQ ID NO: 8283973 - DNA, 22 bp, Homo sapiens
cattttaaatgatttaagccaa

SEQ ID NO: 8283974 - DNA, 22 bp, Homo sapiens
cattttaagatgacctggtttc

SEQ ID NO: 8283975 - DNA, 21 bp, Homo sapiens
catttcagtaaggaagcctgt

SEQ ID NO: 8283976 - DNA, 22 bp, Homo sapiens
catttccactctgggagtcaga

SEQ ID NO: 8283977 - DNA, 22 bp, Homo sapiens
catttcctgtctggaggtcaaa

SEQ ID NO: 8283978 - DNA, 22 bp, Homo sapiens
tccatacatatccaaagagaag

SEQ ID NO: 8283979 - DNA, 22 bp, Homo sapiens
tccataggatctgcttcatact

SEQ ID NO: 8283980 - DNA, 22 bp, Homo sapiens
tccatacagaatgcagtaaggg

SEQ ID NO: 8283981 - DNA, 22 bp, Homo sapiens
tccatacagtgactcaggaatc

SEQ ID NO: 8283982 - DNA, 22 bp, Homo sapiens
tctatacatgtgcacacacatc

SEQ ID NO: 8283983 - DNA, 22 bp, Homo sapiens
tctcagcttgagtggatgagct

SEQ ID NO: 8283984 - DNA, 18 bp, Homo sapiens
ccacccagggggagagga

SEQ ID NO: 8283985 - DNA, 18 bp, Homo sapiens
ccacccatctctgccttt

SEQ ID NO: 8283986 - DNA, 22 bp, Homo sapiens
ccaccctggacaggcctctgag

SEQ ID NO: 8283987 - DNA, 22 bp, Homo sapiens
ccaccctgagccgcaagagcag

SEQ ID NO: 8283988 - DNA, 18 bp, Homo sapiens
tctagaaacttctctcct

SEQ ID NO: 8283989 - DNA, 22 bp, Homo sapiens
tcctgtgttacccttgcagtga

SEQ ID NO: 8283990 - DNA, 22 bp, Homo sapiens
ccagcaaggtccagcataggga

SEQ ID NO: 8283991 - DNA, 22 bp, Homo sapiens
ccagaggtgaacaggaggctgt

SEQ ID NO: 8283992 - DNA, 22 bp, Homo sapiens
ccagaggtctcctgcacgggat

SEQ ID NO: 8283993 - DNA, 22 bp, Homo sapiens
ccagaggtcccctgccaggagg

SEQ ID NO: 8283994 - DNA, 18 bp, Homo sapiens
ccagagggtgcgtcagct

SEQ ID NO: 8283995 - DNA, 22 bp, Homo sapiens
ccagagggccctggtctcagct

SEQ ID NO: 8283996 - DNA, 22 bp, Homo sapiens
ccagagggcctttggagttatc

SEQ ID NO: 8283997 - DNA, 22 bp, Homo sapiens
ccagaggggtgggcctggttta

SEQ ID NO: 8283998 - DNA, 20 bp, Homo sapiens
ccagagggtagggccgcccc

SEQ ID NO: 8283999 - DNA, 22 bp, Homo sapiens
ccagaggggctgagcaggtcac

SEQ ID NO: 8284000 - DNA, 22 bp, Homo sapiens
ccagaggggctgagcaggtcac

SEQ ID NO: 8284001 - DNA, 22 bp, Homo sapiens
ccagaggggctgagcaggtcac

SEQ ID NO: 8284002 - DNA, 22 bp, Homo sapiens
ccagagcctaagatctgatcct

SEQ ID NO: 8284003 - DNA, 22 bp, Homo sapiens
ccagagcctcgcccggagcctc

SEQ ID NO: 8284004 - DNA, 22 bp, Homo sapiens
ccagagcctgctgagccccatt

SEQ ID NO: 8284005 - DNA, 22 bp, Homo sapiens
ccagaggctggcaagggctcct

SEQ ID NO: 8284006 - DNA, 22 bp, Homo sapiens
ccagagggacgttaccagttca

SEQ ID NO: 8284007 - DNA, 22 bp, Homo sapiens
ccagagggagccaccagggtgt

SEQ ID NO: 8284008 - DNA, 22 bp, Homo sapiens
ccagagggagccaccagggtgt

SEQ ID NO: 8284009 - DNA, 22 bp, Homo sapiens
ccagagggaactgggcctcatt

SEQ ID NO: 8284010 - DNA, 22 bp, Homo sapiens
ccagagcccagggtcatgcagg

SEQ ID NO: 8284011 - DNA, 19 bp, Homo sapiens
ccagagcccgccagatggg

SEQ ID NO: 8284012 - DNA, 22 bp, Homo sapiens
ccagagcccctgagcttccctg

SEQ ID NO: 8284013 - DNA, 19 bp, Homo sapiens
ccagagcccgccagatggg

SEQ ID NO: 8284014 - DNA, 19 bp, Homo sapiens
ccagagcccgccagatggg

SEQ ID NO: 8284015 - DNA, 22 bp, Homo sapiens
ccagagccggctccctcagctt

SEQ ID NO: 8284016 - DNA, 22 bp, Homo sapiens
ccagagccggctccctcagctt

SEQ ID NO: 8284017 - DNA, 20 bp, Homo sapiens
ccagagcagccactgaagtt

SEQ ID NO: 8284018 - DNA, 22 bp, Homo sapiens
ccagagcatgaagggcaatgac

SEQ ID NO: 8284019 - DNA, 22 bp, Homo sapiens
ccagagccagagaggtgcctgc

SEQ ID NO: 8284020 - DNA, 22 bp, Homo sapiens
ccagagcccagcacacggtgct

SEQ ID NO: 8284021 - DNA, 22 bp, Homo sapiens
tagtttctggttcttgctctgg

SEQ ID NO: 8284022 - DNA, 22 bp, Homo sapiens
tatattcacttgtgtccaacca

SEQ ID NO: 8284023 - DNA, 22 bp, Homo sapiens
tagttttagtcccattttacag

SEQ ID NO: 8284024 - DNA, 22 bp, Homo sapiens
cagggccaagttggtgcctttt

SEQ ID NO: 8284025 - DNA, 22 bp, Homo sapiens
cagggccaagctgcagcatctg

SEQ ID NO: 8284026 - DNA, 20 bp, Homo sapiens
cagggccacgctccaaggca

SEQ ID NO: 8284027 - DNA, 22 bp, Homo sapiens
cagggccaccctctgctgggtg

SEQ ID NO: 8284028 - DNA, 22 bp, Homo sapiens
cagggccaccgtgtttgctgct

SEQ ID NO: 8284029 - DNA, 22 bp, Homo sapiens
tagtaacaacaactagcatttt

SEQ ID NO: 8284030 - DNA, 22 bp, Homo sapiens
taggtagttacacagcaatgta

SEQ ID NO: 8284031 - DNA, 22 bp, Homo sapiens
tagtaacacattgaacgatcgc

SEQ ID NO: 8284032 - DNA, 20 bp, Homo sapiens
tagtgcaaaggcagccatag

SEQ ID NO: 8284033 - DNA, 22 bp, Homo sapiens
caggtggggcgccctcaggcag

SEQ ID NO: 8284034 - DNA, 22 bp, Homo sapiens
caggtggcttattagggtcagt

SEQ ID NO: 8284035 - DNA, 22 bp, Homo sapiens
caggtgggcgtggcgagaaggc

SEQ ID NO: 8284036 - DNA, 22 bp, Homo sapiens
caggtgggccggggtttgttct

SEQ ID NO: 8284037 - DNA, 22 bp, Homo sapiens
caggtgggcttgggagaacact

SEQ ID NO: 8284038 - DNA, 22 bp, Homo sapiens
tatgtacatcgttgaattcaaa

SEQ ID NO: 8284039 - DNA, 22 bp, Homo sapiens
tatgtacatcttgagcaatgaa

SEQ ID NO: 8284040 - DNA, 22 bp, Homo sapiens
tatgtacatggagagcaattga

SEQ ID NO: 8284041 - DNA, 22 bp, Homo sapiens
tatgtacatgatttcatttgct

SEQ ID NO: 8284042 - DNA, 22 bp, Homo sapiens
tatgcaacagcattattacaat

SEQ ID NO: 8284043 - DNA, 22 bp, Homo sapiens
tatgatttgtagacatttgatt

SEQ ID NO: 8284044 - DNA, 22 bp, Homo sapiens
tcacactgtgaagagacaagca

SEQ ID NO: 8284045 - DNA, 22 bp, Homo sapiens
tcacaccaggagcagtgccaga

SEQ ID NO: 8284046 - DNA, 22 bp, Homo sapiens
tcacactctgcgggtgaccttt

SEQ ID NO: 8284047 - DNA, 23 bp, Homo sapiens
tcacactggatacacatgcaaga

SEQ ID NO: 8284048 - DNA, 22 bp, Homo sapiens
cagtgcataatctaaatggggg

SEQ ID NO: 8284049 - DNA, 22 bp, Homo sapiens
cagtgcaggtttagggctgggg

SEQ ID NO: 8284050 - DNA, 21 bp, Homo sapiens
tcactgcaatgctaggagaaa

SEQ ID NO: 8284051 - DNA, 22 bp, Homo sapiens
tcacatgtcaaaaactacataa

SEQ ID NO: 8284052 - DNA, 19 bp, Homo sapiens
tcactctccctgtctgtcc

SEQ ID NO: 8284053 - DNA, 22 bp, Homo sapiens
tcactctctaagcatgacagac

SEQ ID NO: 8284054 - DNA, 22 bp, Homo sapiens
tattccatgccagagtttattg

SEQ ID NO: 8284055 - DNA, 20 bp, Homo sapiens
cagtagcaataattagaagc

SEQ ID NO: 8284056 - DNA, 21 bp, Homo sapiens
tcaaagcacatatttgcacat

SEQ ID NO: 8284057 - DNA, 22 bp, Homo sapiens
tattccgtggctccaggtggta

SEQ ID NO: 8284058 - DNA, 22 bp, Homo sapiens
tattccgtggtgccaggtagta

SEQ ID NO: 8284059 - DNA, 22 bp, Homo sapiens
cagtcccatctcccaggtggct

SEQ ID NO: 8284060 - DNA, 22 bp, Homo sapiens
cagtcccatgagcccagaacat

SEQ ID NO: 8284061 - DNA, 22 bp, Homo sapiens
cagtcccatctcccaggtggct

SEQ ID NO: 8284062 - DNA, 22 bp, Homo sapiens
cagtcccagtttgagactctgg

SEQ ID NO: 8284063 - DNA, 15 bp, Homo sapiens
cagtcccagggaccc

SEQ ID NO: 8284064 - DNA, 22 bp, Homo sapiens
cagtcccagggttggttcagct

SEQ ID NO: 8284065 - DNA, 22 bp, Homo sapiens
cagtcccagtttgagactctgg

SEQ ID NO: 8284066 - DNA, 22 bp, Homo sapiens
cagtcccagctgctcagaaggc

SEQ ID NO: 8284067 - DNA, 22 bp, Homo sapiens
cagtcccagctgctcagaaggc

SEQ ID NO: 8284068 - DNA, 22 bp, Homo sapiens
cagtctggaggtcagctggctt

SEQ ID NO: 8284069 - DNA, 22 bp, Homo sapiens
cagtctttgacaagccctttca

SEQ ID NO: 8284070 - DNA, 22 bp, Homo sapiens
tcaaattagtggaataataatg

SEQ ID NO: 8284071 - DNA, 22 bp, Homo sapiens
tcaaattagtggaataataatg

SEQ ID NO: 8284072 - DNA, 17 bp, Homo sapiens
tcaaatgtacagaacta

SEQ ID NO: 8284073 - DNA, 22 bp, Homo sapiens
tagaaagagcatagtattataa

SEQ ID NO: 8284074 - DNA, 22 bp, Homo sapiens
tacctcaagttccaggaaagcg

SEQ ID NO: 8284075 - DNA, 22 bp, Homo sapiens
tagaaacaagggagaggattct

SEQ ID NO: 8284076 - DNA, 22 bp, Homo sapiens
tacctcaagttccaggaaagcg

SEQ ID NO: 8284077 - DNA, 22 bp, Homo sapiens
caggctgcagcagcagtggccc

SEQ ID NO: 8284078 - DNA, 22 bp, Homo sapiens
tacccagcttcaagtcaggact

SEQ ID NO: 8284079 - DNA, 22 bp, Homo sapiens
tacccaggagaaacagcagggc

SEQ ID NO: 8284080 - DNA, 22 bp, Homo sapiens
tacctacagatgtaaatgaaac

SEQ ID NO: 8284081 - DNA, 22 bp, Homo sapiens
caggctgagggttaggccttag

SEQ ID NO: 8284082 - DNA, 22 bp, Homo sapiens
cagggacagcgggactctgaca

SEQ ID NO: 8284083 - DNA, 22 bp, Homo sapiens
tagaaatgtgataatagcttaa

SEQ ID NO: 8284084 - DNA, 22 bp, Homo sapiens
tagaaatgtgataatagcttaa

SEQ ID NO: 8284085 - DNA, 23 bp, Homo sapiens
tagacataagctctgtcaccttc

SEQ ID NO: 8284086 - DNA, 22 bp, Homo sapiens
cagggagctttcccaggaccct

SEQ ID NO: 8284087 - DNA, 22 bp, Homo sapiens
cagggagctttgtcttctcatt

SEQ ID NO: 8284088 - DNA, 22 bp, Homo sapiens
cagggagcctgaatgttccagg

SEQ ID NO: 8284089 - DNA, 22 bp, Homo sapiens
cagggagggaggaaaatttgct

SEQ ID NO: 8284090 - DNA, 22 bp, Homo sapiens
cagggatgagagatggcacaga

SEQ ID NO: 8284091 - DNA, 22 bp, Homo sapiens
cagggccaagcccctttggctg

SEQ ID NO: 8284092 - DNA, 22 bp, Homo sapiens
tagcagcacctacacgtcagag

SEQ ID NO: 8284093 - DNA, 22 bp, Homo sapiens
tagcagcaggggaaacagctgt

SEQ ID NO: 8284094 - DNA, 22 bp, Homo sapiens
tacagctcccggggagcttcgt

SEQ ID NO: 8284095 - DNA, 22 bp, Homo sapiens
tacagccacaggtgactctcat

SEQ ID NO: 8284096 - DNA, 22 bp, Homo sapiens
tacagcattgtgtcttcactca

SEQ ID NO: 8284097 - DNA, 22 bp, Homo sapiens
tacagccacggtctatggaggc

SEQ ID NO: 8284098 - DNA, 22 bp, Homo sapiens
tacagcagggcgctgtgatgaa

SEQ ID NO: 8284099 - DNA, 22 bp, Homo sapiens
caggccttgggagagggtagat

SEQ ID NO: 8284100 - DNA, 22 bp, Homo sapiens
caggctccttcccagggatggt

SEQ ID NO: 8284101 - DNA, 22 bp, Homo sapiens
caggctccttcccagggatggt

SEQ ID NO: 8284102 - DNA, 22 bp, Homo sapiens
caggctctaggttagtaggaga

SEQ ID NO: 8284103 - DNA, 17 bp, Homo sapiens
caggctccttccagatt

SEQ ID NO: 8284104 - DNA, 22 bp, Homo sapiens
caggctcctcactcatgctccc

SEQ ID NO: 8284105 - DNA, 22 bp, Homo sapiens
caggctccctgccagggccggc

SEQ ID NO: 8284106 - DNA, 22 bp, Homo sapiens
caggctccctaagtcagcagcc

SEQ ID NO: 8284107 - DNA, 22 bp, Homo sapiens
caggctcccgctccactgggca

SEQ ID NO: 8284108 - DNA, 22 bp, Homo sapiens
caggctcccgaaatcacccatg

SEQ ID NO: 8284109 - DNA, 22 bp, Homo sapiens
caggctcccaccctcctgcagc

SEQ ID NO: 8284110 - DNA, 22 bp, Homo sapiens
caggctcccacaagctcccagc

SEQ ID NO: 8284111 - DNA, 22 bp, Homo sapiens
caggctccagcttcctgctcag

SEQ ID NO: 8284112 - DNA, 22 bp, Homo sapiens
tacacagactcttcaattcaga

SEQ ID NO: 8284113 - DNA, 22 bp, Homo sapiens
caggccaactgcatggtgacca

SEQ ID NO: 8284114 - DNA, 22 bp, Homo sapiens
caggccaaagatcccattgaca

SEQ ID NO: 8284115 - DNA, 22 bp, Homo sapiens
gtggagcacggaggaggcccct

SEQ ID NO: 8284116 - DNA, 22 bp, Homo sapiens
gtggagcaggactagctgagaa

SEQ ID NO: 8284117 - DNA, 22 bp, Homo sapiens
cagctctgccacttcctagcta

SEQ ID NO: 8284118 - DNA, 22 bp, Homo sapiens
cagctctgccacttcctagcta

SEQ ID NO: 8284119 - DNA, 17 bp, Homo sapiens
cagctctgcatcttcct

SEQ ID NO: 8284120 - DNA, 22 bp, Homo sapiens
cagctctgctgggaggatgcag

SEQ ID NO: 8284121 - DNA, 22 bp, Homo sapiens
cagctctgccatcatctgcctt

SEQ ID NO: 8284122 - DNA, 22 bp, Homo sapiens
cagctctgcctctggggctgag

SEQ ID NO: 8284123 - DNA, 22 bp, Homo sapiens
tacagagaactcatagaaagaa

SEQ ID NO: 8284124 - DNA, 22 bp, Homo sapiens
caggcccaggggtctggcccac

SEQ ID NO: 8284125 - DNA, 22 bp, Homo sapiens
caggccacagctaaagaggatt

SEQ ID NO: 8284126 - DNA, 22 bp, Homo sapiens
caggccacaagttgggttcaag

SEQ ID NO: 8284127 - DNA, 22 bp, Homo sapiens
caggccctcgtggtgagctggg

SEQ ID NO: 8284128 - DNA, 22 bp, Homo sapiens
caggccctgcacagtggtcctg

SEQ ID NO: 8284129 - DNA, 22 bp, Homo sapiens
tttctaaactggattcagcctg

SEQ ID NO: 8284130 - DNA, 22 bp, Homo sapiens
tttctaaagggtagatttggcc

SEQ ID NO: 8284131 - DNA, 22 bp, Homo sapiens
tttctaaacaaagggagtttgg

SEQ ID NO: 8284132 - DNA, 22 bp, Homo sapiens
tttctaaacaaagggagtttgg

SEQ ID NO: 8284133 - DNA, 22 bp, Homo sapiens
tttcgtttgcttatataataga

SEQ ID NO: 8284134 - DNA, 22 bp, Homo sapiens
tttctaaaatagattttatggt

SEQ ID NO: 8284135 - DNA, 22 bp, Homo sapiens
tttctaaaatagattttatggt

SEQ ID NO: 8284136 - DNA, 22 bp, Homo sapiens
tttctaaatggtggctgcattg

SEQ ID NO: 8284137 - DNA, 22 bp, Homo sapiens
tttctaaagggtagatttggcc

SEQ ID NO: 8284138 - DNA, 22 bp, Homo sapiens
tttccatatttaatcaaaataa

SEQ ID NO: 8284139 - DNA, 22 bp, Homo sapiens
tttcccaacagtctctctcaaa

SEQ ID NO: 8284140 - DNA, 22 bp, Homo sapiens
tttcccaagaaaaataattgga

SEQ ID NO: 8284141 - DNA, 23 bp, Homo sapiens
tttcccaccctctctcattgctg

SEQ ID NO: 8284142 - DNA, 22 bp, Homo sapiens
tttccaggtgcatagaaaacag

SEQ ID NO: 8284143 - DNA, 22 bp, Homo sapiens
tttccagatgctaggttgaaag

SEQ ID NO: 8284144 - DNA, 22 bp, Homo sapiens
tttccaaataaggtcacattct

SEQ ID NO: 8284145 - DNA, 22 bp, Homo sapiens
tttcatagtcaagtgtgtatga

SEQ ID NO: 8284146 - DNA, 22 bp, Homo sapiens
tttcataatactgtacatgaaa

SEQ ID NO: 8284147 - DNA, 22 bp, Homo sapiens
tttcaagtagccctggctccca

SEQ ID NO: 8284148 - DNA, 22 bp, Homo sapiens
tttcaagtagagggatcgctag

SEQ ID NO: 8284149 - DNA, 20 bp, Homo sapiens
tttcaagtcagcaattctca

SEQ ID NO: 8284150 - DNA, 22 bp, Homo sapiens
tttcaagtactgtaaacatgct

SEQ ID NO: 8284151 - DNA, 22 bp, Homo sapiens
tttcaagtaagatacatttcag

SEQ ID NO: 8284152 - DNA, 22 bp, Homo sapiens
tttcaagtcattctataatatc

SEQ ID NO: 8284153 - DNA, 22 bp, Homo sapiens
tttcaagtcagtagctaatcat

SEQ ID NO: 8284154 - DNA, 22 bp, Homo sapiens
tttcaagcatgtcaagttagtc

SEQ ID NO: 8284155 - DNA, 22 bp, Homo sapiens
tttatttatccttctggattgc

SEQ ID NO: 8284156 - DNA, 20 bp, Homo sapiens
tttcaagtcggtagagtcta

SEQ ID NO: 8284157 - DNA, 22 bp, Homo sapiens
tttcaagtggcgagataaggaa

SEQ ID NO: 8284158 - DNA, 22 bp, Homo sapiens
tttcaagtgactatggtttttg

SEQ ID NO: 8284159 - DNA, 22 bp, Homo sapiens
tttcaagtgtcctgattaatgg

SEQ ID NO: 8284160 - DNA, 22 bp, Homo sapiens
tttcaagtggggacatttgaga

SEQ ID NO: 8284161 - DNA, 22 bp, Homo sapiens
tttcaagttcccagttttgtgg

SEQ ID NO: 8284162 - DNA, 22 bp, Homo sapiens
tttcaagttctgttcctaaact

SEQ ID NO: 8284163 - DNA, 22 bp, Homo sapiens
tttcaagttaaatggggtcttt

SEQ ID NO: 8284164 - DNA, 22 bp, Homo sapiens
tttcaagtttagtgtgttcaaa

SEQ ID NO: 8284165 - DNA, 22 bp, Homo sapiens
tttcaataacaaagctcatttt

SEQ ID NO: 8284166 - DNA, 22 bp, Homo sapiens
tttcaagttgtttatatccaga

SEQ ID NO: 8284167 - DNA, 20 bp, Homo sapiens
tttcaagttgtaaggtatca

SEQ ID NO: 8284168 - DNA, 22 bp, Homo sapiens
tttcaagttctgttctagggta

SEQ ID NO: 8284169 - DNA, 22 bp, Homo sapiens
tttcaagttgttgcattaaatg

SEQ ID NO: 8284170 - DNA, 22 bp, Homo sapiens
tttcacatttgttttaagaagt

SEQ ID NO: 8284171 - DNA, 23 bp, Homo sapiens
tttcacatttactgttagatggc

SEQ ID NO: 8284172 - DNA, 23 bp, Homo sapiens
tttcacattaatgtttagcagga

SEQ ID NO: 8284173 - DNA, 22 bp, Homo sapiens
tttcacaggagtcctttctata

SEQ ID NO: 8284174 - DNA, 22 bp, Homo sapiens
tttaagaagttatgttataaat

SEQ ID NO: 8284175 - DNA, 22 bp, Homo sapiens
tttacaccaaaatgacacagag

SEQ ID NO: 8284176 - DNA, 22 bp, Homo sapiens
tttacactcctggaaatgatat

SEQ ID NO: 8284177 - DNA, 22 bp, Homo sapiens
tttacacggcattatcttcatg

SEQ ID NO: 8284178 - DNA, 22 bp, Homo sapiens
tttacacttgaggaaactgagg

SEQ ID NO: 8284179 - DNA, 22 bp, Homo sapiens
tttacagagaatgtacataaag

SEQ ID NO: 8284180 - DNA, 22 bp, Homo sapiens
tttacagatgtggaaagtgagc

SEQ ID NO: 8284181 - DNA, 22 bp, Homo sapiens
tttacagatgaggatactgagg

SEQ ID NO: 8284182 - DNA, 22 bp, Homo sapiens
tttacagatgaggaaactgaga

SEQ ID NO: 8284183 - DNA, 22 bp, Homo sapiens
ttgttggtgaatagggtggaat

SEQ ID NO: 8284184 - DNA, 22 bp, Homo sapiens
ttgttggtggaattgatgctag

SEQ ID NO: 8284185 - DNA, 22 bp, Homo sapiens
ttgttggtggaattgatgctag

SEQ ID NO: 8284186 - DNA, 22 bp, Homo sapiens
ttgttcttgccaagacatgaag

SEQ ID NO: 8284187 - DNA, 22 bp, Homo sapiens
ttgttcttggagcaggcagaga

SEQ ID NO: 8284188 - DNA, 23 bp, Homo sapiens
ttgttcttggatcttcctgaagc

SEQ ID NO: 8284189 - DNA, 22 bp, Homo sapiens
ttgttcttctctagagaagtgg

SEQ ID NO: 8284190 - DNA, 22 bp, Homo sapiens
ttgttcttacttaagagtgaat

SEQ ID NO: 8284191 - DNA, 21 bp, Homo sapiens
ttgttcttccagaagcaaagt

SEQ ID NO: 8284192 - DNA, 22 bp, Homo sapiens
ttgttcttagtatgcattgttt

SEQ ID NO: 8284193 - DNA, 22 bp, Homo sapiens
ttgttgcagagatgaatgacat

SEQ ID NO: 8284194 - DNA, 22 bp, Homo sapiens
ttgttctttatcctggaagcct

SEQ ID NO: 8284195 - DNA, 22 bp, Homo sapiens
ttgttcttgtctttgccttcac

SEQ ID NO: 8284196 - DNA, 22 bp, Homo sapiens
ttgttctttttctccatgagat

SEQ ID NO: 8284197 - DNA, 22 bp, Homo sapiens
ttgttcttttgcttagacagat

SEQ ID NO: 8284198 - DNA, 22 bp, Homo sapiens
tttaagaagttatgttataaat

SEQ ID NO: 8284199 - DNA, 23 bp, Homo sapiens
tttaactttccaataattcattg

SEQ ID NO: 8284200 - DNA, 23 bp, Homo sapiens
tttaactttccaataattcattg

SEQ ID NO: 8284201 - DNA, 22 bp, Homo sapiens
tttaggcagaacatggactttg

SEQ ID NO: 8284202 - DNA, 22 bp, Homo sapiens
tttacagctagacatacctgag

SEQ ID NO: 8284203 - DNA, 22 bp, Homo sapiens
tttagcgtagctgacagctaat

SEQ ID NO: 8284204 - DNA, 22 bp, Homo sapiens
ttggggcacctccccagcattt

SEQ ID NO: 8284205 - DNA, 22 bp, Homo sapiens
ttggggagttaatgccaaagat

SEQ ID NO: 8284206 - DNA, 22 bp, Homo sapiens
ttggggcagagaggatacggca

SEQ ID NO: 8284207 - DNA, 22 bp, Homo sapiens
ttggggcagttattctgtgccc

SEQ ID NO: 8284208 - DNA, 22 bp, Homo sapiens
ttggcttcttcgcacagcagta

SEQ ID NO: 8284209 - DNA, 22 bp, Homo sapiens
ttggcttccaggatctcagcag

SEQ ID NO: 8284210 - DNA, 22 bp, Homo sapiens
ttggcttcaatgtcagagacag

SEQ ID NO: 8284211 - DNA, 22 bp, Homo sapiens
ttggcttcaatgtcagagacag

SEQ ID NO: 8284212 - DNA, 22 bp, Homo sapiens
ttggccctgaggaggcagctgc

SEQ ID NO: 8284213 - DNA, 22 bp, Homo sapiens
ttggcccactctcagaatgtgg

SEQ ID NO: 8284214 - DNA, 22 bp, Homo sapiens
ttggcagattcatttaataaat

SEQ ID NO: 8284215 - DNA, 22 bp, Homo sapiens
ttggctacatcgaggctccagc

SEQ ID NO: 8284216 - DNA, 22 bp, Homo sapiens
ttggcgatttctgaaattataa

SEQ ID NO: 8284217 - DNA, 22 bp, Homo sapiens
ttggctggtttcaagaaggcat

SEQ ID NO: 8284218 - DNA, 22 bp, Homo sapiens
ttggctggttttgagtatgtgc

SEQ ID NO: 8284219 - DNA, 22 bp, Homo sapiens
ttggctggtaagccaaatgaaa

SEQ ID NO: 8284220 - DNA, 22 bp, Homo sapiens
ttggctgggcacagtgtctcat

SEQ ID NO: 8284221 - DNA, 22 bp, Homo sapiens
ttggctggctacctgggccgag

SEQ ID NO: 8284222 - DNA, 22 bp, Homo sapiens
ttggctggcttctcgacttgtt

SEQ ID NO: 8284223 - DNA, 22 bp, Homo sapiens
ttgtgagagccaaacatgtaag

SEQ ID NO: 8284224 - DNA, 22 bp, Homo sapiens
ttgtgcaatggtgtttaggttt

SEQ ID NO: 8284225 - DNA, 22 bp, Homo sapiens
ttgtgcaatttaaaatcttcct

SEQ ID NO: 8284226 - DNA, 22 bp, Homo sapiens
ttgtgcaagaagccagcaccaa

SEQ ID NO: 8284227 - DNA, 22 bp, Homo sapiens
ttgtgcatgatgcatacatggt

SEQ ID NO: 8284228 - DNA, 22 bp, Homo sapiens
ttgtgcatgatgcatacatggt

SEQ ID NO: 8284229 - DNA, 22 bp, Homo sapiens
ttgtgcatattaggtacatgct

SEQ ID NO: 8284230 - DNA, 23 bp, Homo sapiens
ttgtggaagggagatggcaacag

SEQ ID NO: 8284231 - DNA, 22 bp, Homo sapiens
ttgtactgcacccctgggaatg

SEQ ID NO: 8284232 - DNA, 22 bp, Homo sapiens
ttgtactgatatgaagaatcaa

SEQ ID NO: 8284233 - DNA, 20 bp, Homo sapiens
ttggggcatccaccgaatgg

SEQ ID NO: 8284234 - DNA, 22 bp, Homo sapiens
ttggggcatgattagattatga

SEQ ID NO: 8284235 - DNA, 22 bp, Homo sapiens
ttgtactggttttgaaatgagc

SEQ ID NO: 8284236 - DNA, 22 bp, Homo sapiens
ttgtactgtggatctgtatttg

SEQ ID NO: 8284237 - DNA, 20 bp, Homo sapiens
ttgtagcgatacagtttgca

SEQ ID NO: 8284238 - DNA, 22 bp, Homo sapiens
ttgtagcgttagcagtgtggag

SEQ ID NO: 8284239 - DNA, 22 bp, Homo sapiens
ttgtagatataaattttattgt

SEQ ID NO: 8284240 - DNA, 22 bp, Homo sapiens
ttgtattaattgaaatgaatgc

SEQ ID NO: 8284241 - DNA, 22 bp, Homo sapiens
ttgtatttatattgaatagctt

SEQ ID NO: 8284242 - DNA, 22 bp, Homo sapiens
ttgtatttcctataacctttct

SEQ ID NO: 8284243 - DNA, 22 bp, Homo sapiens
ttgtatagcccagagagtgaga

SEQ ID NO: 8284244 - DNA, 22 bp, Homo sapiens
ttggcaatttaaatagcaggag

SEQ ID NO: 8284245 - DNA, 22 bp, Homo sapiens
ttggcaattagttatatctgca

SEQ ID NO: 8284246 - DNA, 22 bp, Homo sapiens
ttggcaattcaccaaggctcgc

SEQ ID NO: 8284247 - DNA, 22 bp, Homo sapiens
ttggcaatgatctcaatcttct

SEQ ID NO: 8284248 - DNA, 22 bp, Homo sapiens
ttggcaatgtctaaacacattt

SEQ ID NO: 8284249 - DNA, 22 bp, Homo sapiens
ttggcaatgaaagctgcccggg

SEQ ID NO: 8284250 - DNA, 22 bp, Homo sapiens
ttggcaatggaccagccactgg

SEQ ID NO: 8284251 - DNA, 22 bp, Homo sapiens
ttggcaatatttactgaagttg

SEQ ID NO: 8284252 - DNA, 22 bp, Homo sapiens
ttggcaatcaattctgacgtct

SEQ ID NO: 8284253 - DNA, 22 bp, Homo sapiens
ttggcaaaggactcaaagcagg

SEQ ID NO: 8284254 - DNA, 22 bp, Homo sapiens
ttggcaatttaaatagcaggag

SEQ ID NO: 8284255 - DNA, 22 bp, Homo sapiens
ttggcactttgaatgagctcag

SEQ ID NO: 8284256 - DNA, 22 bp, Homo sapiens
ttggcagaaatgtggctgggag

SEQ ID NO: 8284257 - DNA, 22 bp, Homo sapiens
ttggaatcattcttaaaggtct

SEQ ID NO: 8284258 - DNA, 22 bp, Homo sapiens
ttggaattaatatttgtataca

SEQ ID NO: 8284259 - DNA, 22 bp, Homo sapiens
ttggaattaaaaggagaacttc

SEQ ID NO: 8284260 - DNA, 22 bp, Homo sapiens
ttggaattcaagttgtagctta

SEQ ID NO: 8284261 - DNA, 22 bp, Homo sapiens
ttggaattcagcttgcttataa

SEQ ID NO: 8284262 - DNA, 22 bp, Homo sapiens
ttggaagttgatttaaaaagga

SEQ ID NO: 8284263 - DNA, 22 bp, Homo sapiens
ttgcttctggaactttctgttc

SEQ ID NO: 8284264 - DNA, 22 bp, Homo sapiens
ttgcttcttagatattcctctc

SEQ ID NO: 8284265 - DNA, 18 bp, Homo sapiens
ttgcttcttttctctagg

SEQ ID NO: 8284266 - DNA, 22 bp, Homo sapiens
ttgctttacaaaaattgatggt

SEQ ID NO: 8284267 - DNA, 23 bp, Homo sapiens
ttggaacacagtaaatgcacaat

SEQ ID NO: 8284268 - DNA, 22 bp, Homo sapiens
ttgctttattcacatctatatt

SEQ ID NO: 8284269 - DNA, 22 bp, Homo sapiens
ttgctttagggcaaatatttca

SEQ ID NO: 8284270 - DNA, 20 bp, Homo sapiens
ttggaacagtggatcagcag

SEQ ID NO: 8284271 - DNA, 22 bp, Homo sapiens
ttggaactcgtgttacttgtat

SEQ ID NO: 8284272 - DNA, 22 bp, Homo sapiens
ttgcgcaactttaaattaattc

SEQ ID NO: 8284273 - DNA, 22 bp, Homo sapiens
ttgccatttcaagtggccactg

SEQ ID NO: 8284274 - DNA, 22 bp, Homo sapiens
ttgctaaatccctataatattc

SEQ ID NO: 8284275 - DNA, 22 bp, Homo sapiens
ttgctagataatctcacacact

SEQ ID NO: 8284276 - DNA, 22 bp, Homo sapiens
ttgccaagtgttttaaaatatt

SEQ ID NO: 8284277 - DNA, 22 bp, Homo sapiens
ttgccaccgtcatggccattat

SEQ ID NO: 8284278 - DNA, 22 bp, Homo sapiens
ttgcattttggttgtaaatatg

SEQ ID NO: 8284279 - DNA, 22 bp, Homo sapiens
ttgcatttgtttgagtagaatg

SEQ ID NO: 8284280 - DNA, 22 bp, Homo sapiens
ttgcatttggttctgcctggta

SEQ ID NO: 8284281 - DNA, 22 bp, Homo sapiens
ttgccagtattaatagcacttt

SEQ ID NO: 8284282 - DNA, 22 bp, Homo sapiens
ttgcatttgacaaattatttaa

SEQ ID NO: 8284283 - DNA, 22 bp, Homo sapiens
ttgcatttcccattgagtaatg

SEQ ID NO: 8284284 - DNA, 21 bp, Homo sapiens
ttctgggaaatgagctggggc

SEQ ID NO: 8284285 - DNA, 22 bp, Homo sapiens
ttctgggaacaaagtggagtgg

SEQ ID NO: 8284286 - DNA, 20 bp, Homo sapiens
ttctgggaattgggtagctg

SEQ ID NO: 8284287 - DNA, 22 bp, Homo sapiens
ttctgggacatctggacagttt

SEQ ID NO: 8284288 - DNA, 22 bp, Homo sapiens
ttcttctacagtgattaatagt

SEQ ID NO: 8284289 - DNA, 22 bp, Homo sapiens
ttcttctcctaaggagagtcct

SEQ ID NO: 8284290 - DNA, 22 bp, Homo sapiens
ttcttctcagggtcccacatgg

SEQ ID NO: 8284291 - DNA, 22 bp, Homo sapiens
ttctgggacattgcaggtattc

SEQ ID NO: 8284292 - DNA, 22 bp, Homo sapiens
ttctgggagagaaagggccttg

SEQ ID NO: 8284293 - DNA, 22 bp, Homo sapiens
ttctgggagaatctaaatggtt

SEQ ID NO: 8284294 - DNA, 22 bp, Homo sapiens
ttctgggagattcatatgaaaa

SEQ ID NO: 8284295 - DNA, 22 bp, Homo sapiens
ttctgggaggatgggaaatcat

SEQ ID NO: 8284296 - DNA, 22 bp, Homo sapiens
ttctgggaggcctttgtgtctg

SEQ ID NO: 8284297 - DNA, 22 bp, Homo sapiens
ttctgggaggctggctgtcata

SEQ ID NO: 8284298 - DNA, 22 bp, Homo sapiens
ttctgggatgtgaatggtttaa

SEQ ID NO: 8284299 - DNA, 20 bp, Homo sapiens
ttctgggatgcctgcatctt

SEQ ID NO: 8284300 - DNA, 19 bp, Homo sapiens
ttctgggaggggctgactg

SEQ ID NO: 8284301 - DNA, 22 bp, Homo sapiens
ttctgggagtttgggtcggctg

SEQ ID NO: 8284302 - DNA, 22 bp, Homo sapiens
ttctttgaccaaacagttttcc

SEQ ID NO: 8284303 - DNA, 22 bp, Homo sapiens
ttctttctcactctttaggaag

SEQ ID NO: 8284304 - DNA, 22 bp, Homo sapiens
ttctttctcagtgggcagatac

SEQ ID NO: 8284305 - DNA, 22 bp, Homo sapiens
ttgagaactctgtatgtccagc

SEQ ID NO: 8284306 - DNA, 19 bp, Homo sapiens
ttgagaacaccaagtactg

SEQ ID NO: 8284307 - DNA, 22 bp, Homo sapiens
ttgagaggctgttgacattctg

SEQ ID NO: 8284308 - DNA, 22 bp, Homo sapiens
ttgagaggatggattagacaaa

SEQ ID NO: 8284309 - DNA, 22 bp, Homo sapiens
ttgagggtctggatctgctgct

SEQ ID NO: 8284310 - DNA, 23 bp, Homo sapiens
ttgaaaaatatagtcccattgtc

SEQ ID NO: 8284311 - DNA, 22 bp, Homo sapiens
ttctttttatcttcccataaga

SEQ ID NO: 8284312 - DNA, 22 bp, Homo sapiens
ttctttttggatagctgatgaa

SEQ ID NO: 8284313 - DNA, 22 bp, Homo sapiens
ttgaaactcccttttgtctagt

SEQ ID NO: 8284314 - DNA, 22 bp, Homo sapiens
ttgaaagacattatttatatat

SEQ ID NO: 8284315 - DNA, 22 bp, Homo sapiens
ttctgcattcatttttcctaca

SEQ ID NO: 8284316 - DNA, 22 bp, Homo sapiens
ttctgcagcatgaggctggagc

SEQ ID NO: 8284317 - DNA, 22 bp, Homo sapiens
ttctcttcccactttctgtatt

SEQ ID NO: 8284318 - DNA, 22 bp, Homo sapiens
ttctcttctgttcagtgcccaa

SEQ ID NO: 8284319 - DNA, 20 bp, Homo sapiens
ttctccagtgcggtagccat

SEQ ID NO: 8284320 - DNA, 21 bp, Homo sapiens
ttctccagggggagctctctc

SEQ ID NO: 8284321 - DNA, 22 bp, Homo sapiens
ttctccagtcactgacttcgag

SEQ ID NO: 8284322 - DNA, 22 bp, Homo sapiens
ttctccagtttctcccttcagt

SEQ ID NO: 8284323 - DNA, 22 bp, Homo sapiens
ttctccagttatattatgttaa

SEQ ID NO: 8284324 - DNA, 22 bp, Homo sapiens
ttctcccatctcagtcttacat

SEQ ID NO: 8284325 - DNA, 22 bp, Homo sapiens
ttctcccactccgtgcttcagt

SEQ ID NO: 8284326 - DNA, 22 bp, Homo sapiens
ttctcccactccgtgcttcagt

SEQ ID NO: 8284327 - DNA, 22 bp, Homo sapiens
ttctcctcagcaaggcagcttt

SEQ ID NO: 8284328 - DNA, 22 bp, Homo sapiens
ttctccctgtcctatcaagact

SEQ ID NO: 8284329 - DNA, 22 bp, Homo sapiens
ttctccctgccaaagctgcctc

SEQ ID NO: 8284330 - DNA, 22 bp, Homo sapiens
ttctccctgccaaagctgcctc

SEQ ID NO: 8284331 - DNA, 22 bp, Homo sapiens
ttctcctctgttaccttgcaaa

SEQ ID NO: 8284332 - DNA, 22 bp, Homo sapiens
ttctcacaggatttcttttagt

SEQ ID NO: 8284333 - DNA, 22 bp, Homo sapiens
ttctcaaagaaagctgtcatta

SEQ ID NO: 8284334 - DNA, 22 bp, Homo sapiens
ttctaactggtgcagtgctgca

SEQ ID NO: 8284335 - DNA, 22 bp, Homo sapiens
ttctccagaggtggctagagtt

SEQ ID NO: 8284336 - DNA, 19 bp, Homo sapiens
ttctccagggacttaggga

SEQ ID NO: 8284337 - DNA, 22 bp, Homo sapiens
ttctccaggggagggttctcca

SEQ ID NO: 8284338 - DNA, 22 bp, Homo sapiens
ttctccaggcttgggccaggtc

SEQ ID NO: 8284339 - DNA, 19 bp, Homo sapiens
ttctccaggctgcagaggg

SEQ ID NO: 8284340 - DNA, 22 bp, Homo sapiens
ttctccaggccgcgcagggggc

SEQ ID NO: 8284341 - DNA, 22 bp, Homo sapiens
ttctccagctcatcagggaggg

SEQ ID NO: 8284342 - DNA, 21 bp, Homo sapiens
ttctccaggcaaccatttcag

SEQ ID NO: 8284343 - DNA, 19 bp, Homo sapiens
ttctccagcctgacctgag

SEQ ID NO: 8284344 - DNA, 22 bp, Homo sapiens
ttctccagagtttctctcactg

SEQ ID NO: 8284345 - DNA, 22 bp, Homo sapiens
ttctccagcacattttctttga

SEQ ID NO: 8284346 - DNA, 22 bp, Homo sapiens
ttctccagcctattggcctatc

SEQ ID NO: 8284347 - DNA, 19 bp, Homo sapiens
ttctccagcctgacctgag

SEQ ID NO: 8284348 - DNA, 22 bp, Homo sapiens
ttccctctctccagggctgcct

SEQ ID NO: 8284349 - DNA, 22 bp, Homo sapiens
ttccctctgcgcattgaatttc

SEQ ID NO: 8284350 - DNA, 22 bp, Homo sapiens
ttccctctcctactcaggaaag

SEQ ID NO: 8284351 - DNA, 22 bp, Homo sapiens
ttccctctctagctttccccaa

SEQ ID NO: 8284352 - DNA, 22 bp, Homo sapiens
ttccctctcacttaaagcttgg

SEQ ID NO: 8284353 - DNA, 22 bp, Homo sapiens
ttccctctccaggagccctgag

SEQ ID NO: 8284354 - DNA, 22 bp, Homo sapiens
ttccctaagcattgcaatggcg

SEQ ID NO: 8284355 - DNA, 22 bp, Homo sapiens
ttccctaatgtctaacgctatt

SEQ ID NO: 8284356 - DNA, 22 bp, Homo sapiens
ttccctcttttccaacagttgt

SEQ ID NO: 8284357 - DNA, 22 bp, Homo sapiens
ttccctctttcactgtgatttt

SEQ ID NO: 8284358 - DNA, 22 bp, Homo sapiens
ttcctttagtgtcatatacttt

SEQ ID NO: 8284359 - DNA, 22 bp, Homo sapiens
ttcctttagggaaatcgtctca

SEQ ID NO: 8284360 - DNA, 22 bp, Homo sapiens
ttctaaacactacgggatttgg

SEQ ID NO: 8284361 - DNA, 22 bp, Homo sapiens
ttctaaacttcaattctaaatt

SEQ ID NO: 8284362 - DNA, 22 bp, Homo sapiens
ttctaaacggcttcacaggaat

SEQ ID NO: 8284363 - DNA, 22 bp, Homo sapiens
ttctaaactgaagtattttaaa

SEQ ID NO: 8284364 - DNA, 21 bp, Homo sapiens
ttctaaactaggggaagcgtc

SEQ ID NO: 8284365 - DNA, 20 bp, Homo sapiens
ttctaaactgttaggcttgc

SEQ ID NO: 8284366 - DNA, 22 bp, Homo sapiens
ttcggctttccagtttgtctcg

SEQ ID NO: 8284367 - DNA, 22 bp, Homo sapiens
ttctaaaaccaattctgcttct

SEQ ID NO: 8284368 - DNA, 22 bp, Homo sapiens
ttcccagattggagggcagggg

SEQ ID NO: 8284369 - DNA, 22 bp, Homo sapiens
ttcccagaggcaaagtctggat

SEQ ID NO: 8284370 - DNA, 22 bp, Homo sapiens
ttccccagtaacatacatgtga

SEQ ID NO: 8284371 - DNA, 22 bp, Homo sapiens
ttccccaggtgattctcatggc

SEQ ID NO: 8284372 - DNA, 22 bp, Homo sapiens
ttccccaggctggagtgcagtg

SEQ ID NO: 8284373 - DNA, 22 bp, Homo sapiens
ttccccttgataatgcagtaag

SEQ ID NO: 8284374 - DNA, 22 bp, Homo sapiens
ttcccagactccacactgaggc

SEQ ID NO: 8284375 - DNA, 19 bp, Homo sapiens
ttcccagagccatgagtga

SEQ ID NO: 8284376 - DNA, 22 bp, Homo sapiens
ttccatgtactgggttttgtat

SEQ ID NO: 8284377 - DNA, 22 bp, Homo sapiens
ttcccagacctgtaggatcaga

SEQ ID NO: 8284378 - DNA, 22 bp, Homo sapiens
ttccatttattcttgtccagat

SEQ ID NO: 8284379 - DNA, 22 bp, Homo sapiens
ttcccagaatgaatggatggag

SEQ ID NO: 8284380 - DNA, 22 bp, Homo sapiens
ttcccagaattgttgggaactg

SEQ ID NO: 8284381 - DNA, 19 bp, Homo sapiens
ttccatctatcttcttact

SEQ ID NO: 8284382 - DNA, 22 bp, Homo sapiens
ttccatctttcagctttgttgg

SEQ ID NO: 8284383 - DNA, 22 bp, Homo sapiens
ttcatcaggcatcatgctcaag

SEQ ID NO: 8284384 - DNA, 22 bp, Homo sapiens
ttccaataaaatgttatttgca

SEQ ID NO: 8284385 - DNA, 22 bp, Homo sapiens
ttcagaaggatgacaccagttg

SEQ ID NO: 8284386 - DNA, 22 bp, Homo sapiens
ttcagaagttttcaaaactaag

SEQ ID NO: 8284387 - DNA, 22 bp, Homo sapiens
ttcagaacaaccatggttagat

SEQ ID NO: 8284388 - DNA, 22 bp, Homo sapiens
ttcagaaatcgagtttcatgtc

SEQ ID NO: 8284389 - DNA, 22 bp, Homo sapiens
ttcagaaatgaatattggtatt

SEQ ID NO: 8284390 - DNA, 22 bp, Homo sapiens
ttcactgtgatgtttaagagaa

SEQ ID NO: 8284391 - DNA, 22 bp, Homo sapiens
ttcactgtgatggtgcagaggc

SEQ ID NO: 8284392 - DNA, 22 bp, Homo sapiens
ttcactgtcctgcaactctaga

SEQ ID NO: 8284393 - DNA, 22 bp, Homo sapiens
ttcaatatctctaagaatgagg

SEQ ID NO: 8284394 - DNA, 22 bp, Homo sapiens
ttcaatatgatattagctgtgg

SEQ ID NO: 8284395 - DNA, 22 bp, Homo sapiens
ttcaatatcattgtttagtctc

SEQ ID NO: 8284396 - DNA, 22 bp, Homo sapiens
ttcatatgcagattaacaaata

SEQ ID NO: 8284397 - DNA, 22 bp, Homo sapiens
ttcatatatatgcactacgtac

SEQ ID NO: 8284398 - DNA, 21 bp, Homo sapiens
ttcatcagccagaaatcaagc

SEQ ID NO: 8284399 - DNA, 18 bp, Homo sapiens
ttatttgttacagcacat

SEQ ID NO: 8284400 - DNA, 22 bp, Homo sapiens
ttatttatatctctgcagttta

SEQ ID NO: 8284401 - DNA, 22 bp, Homo sapiens
ttatttaatgtgatctgaagag

SEQ ID NO: 8284402 - DNA, 22 bp, Homo sapiens
ttatttaatgtgatctgaagag

SEQ ID NO: 8284403 - DNA, 22 bp, Homo sapiens
ttatttaattttctcactcaga

SEQ ID NO: 8284404 - DNA, 22 bp, Homo sapiens
ttatttactggatggccttggg

SEQ ID NO: 8284405 - DNA, 22 bp, Homo sapiens
ttatttacaactcttctcttcc

SEQ ID NO: 8284406 - DNA, 22 bp, Homo sapiens
ttatttaaaagtggtaagattc

SEQ ID NO: 8284407 - DNA, 22 bp, Homo sapiens
ttatttaaaatgtaggttggga

SEQ ID NO: 8284408 - DNA, 22 bp, Homo sapiens
ttattttaccttcctctgagct

SEQ ID NO: 8284409 - DNA, 22 bp, Homo sapiens
ttattttaccttcctctgagct

SEQ ID NO: 8284410 - DNA, 22 bp, Homo sapiens
ttcaaaagtaatcagtattaga

SEQ ID NO: 8284411 - DNA, 22 bp, Homo sapiens
ttattttggtaaatgtttgcct

SEQ ID NO: 8284412 - DNA, 22 bp, Homo sapiens
ttcaaaattgttctaagctctg

SEQ ID NO: 8284413 - DNA, 22 bp, Homo sapiens
ttcaagatccagcacaacagtg

SEQ ID NO: 8284414 - DNA, 22 bp, Homo sapiens
ttcaagaggcttaattctggat

SEQ ID NO: 8284415 - DNA, 22 bp, Homo sapiens
ttcaagatgacccagtcacacg

SEQ ID NO: 8284416 - DNA, 22 bp, Homo sapiens
ttcaagcaagtcctttgtgcat

SEQ ID NO: 8284417 - DNA, 22 bp, Homo sapiens
ttcaagcaccaaattagtaggc

SEQ ID NO: 8284418 - DNA, 22 bp, Homo sapiens
ttcaagcagttaagcagtctcc

SEQ ID NO: 8284419 - DNA, 22 bp, Homo sapiens
ttcaagcagttaagcagtctcc

SEQ ID NO: 8284420 - DNA, 22 bp, Homo sapiens
tcctctccagcaaactggctat

SEQ ID NO: 8284421 - DNA, 22 bp, Homo sapiens
tcctctccagcaaactggctat

SEQ ID NO: 8284422 - DNA, 22 bp, Homo sapiens
ttagtgtgcatggatgcctcaa

SEQ ID NO: 8284423 - DNA, 22 bp, Homo sapiens
tcctctggccttggaatccttt

SEQ ID NO: 8284424 - DNA, 22 bp, Homo sapiens
tcctctggcccagctgcctctg

SEQ ID NO: 8284425 - DNA, 22 bp, Homo sapiens
tcctctggcccagctgcctctg

SEQ ID NO: 8284426 - DNA, 22 bp, Homo sapiens
tcctctggatataagcctcacc

SEQ ID NO: 8284427 - DNA, 22 bp, Homo sapiens
tcctctggatataagcctcacc

SEQ ID NO: 8284428 - DNA, 21 bp, Homo sapiens
tcctctgctctcataccacaa

SEQ ID NO: 8284429 - DNA, 22 bp, Homo sapiens
ttatgtcttaagtatgctaatt

SEQ ID NO: 8284430 - DNA, 22 bp, Homo sapiens
ttatgtgtgtacatgcatatgt

SEQ ID NO: 8284431 - DNA, 22 bp, Homo sapiens
ttatggcaagggttttaatttg

SEQ ID NO: 8284432 - DNA, 22 bp, Homo sapiens
ttagttagtggggctgtcagtc

SEQ ID NO: 8284433 - DNA, 22 bp, Homo sapiens
ttagttagaataatacaagtaa

SEQ ID NO: 8284434 - DNA, 22 bp, Homo sapiens
ttagttagagccctatgttagg

SEQ ID NO: 8284435 - DNA, 22 bp, Homo sapiens
ttagttaggatttggtggtata

SEQ ID NO: 8284436 - DNA, 22 bp, Homo sapiens
ttagttagggctcctgaggacc

SEQ ID NO: 8284437 - DNA, 20 bp, Homo sapiens
ttatgcaagcatcaatattg

SEQ ID NO: 8284438 - DNA, 22 bp, Homo sapiens
ttatgcaaggacttattacagt

SEQ ID NO: 8284439 - DNA, 22 bp, Homo sapiens
tttgagaatggtaagtggatcg

SEQ ID NO: 8284440 - DNA, 21 bp, Homo sapiens
tttgagaattggtcagagtgc

SEQ ID NO: 8284441 - DNA, 21 bp, Homo sapiens
tttgagaattggtcagagtgc

SEQ ID NO: 8284442 - DNA, 18 bp, Homo sapiens
tttgagaatgcatgactg

SEQ ID NO: 8284443 - DNA, 22 bp, Homo sapiens
tttgcatcctgtgtgtgaaagt

SEQ ID NO: 8284444 - DNA, 22 bp, Homo sapiens
tttgcattatctcacttatata

SEQ ID NO: 8284445 - DNA, 22 bp, Homo sapiens
tttgcattatatttatagaaga

SEQ ID NO: 8284446 - DNA, 22 bp, Homo sapiens
tttgcagttcatctgagaaaaa

SEQ ID NO: 8284447 - DNA, 22 bp, Homo sapiens
tttgcagttcatgttggaaaat

SEQ ID NO: 8284448 - DNA, 22 bp, Homo sapiens
tttgcattgtttcaaaagtgaa

SEQ ID NO: 8284449 - DNA, 22 bp, Homo sapiens
tttgcattgcatacaaggaact

SEQ ID NO: 8284450 - DNA, 22 bp, Homo sapiens
tttgcatttctcgtaaggaaac

SEQ ID NO: 8284451 - DNA, 22 bp, Homo sapiens
tttgggttaagagatggtacca

SEQ ID NO: 8284452 - DNA, 22 bp, Homo sapiens
tttgggcattagaatattcttt

SEQ ID NO: 8284453 - DNA, 17 bp, Homo sapiens
tttggcagtcttttaca

SEQ ID NO: 8284454 - DNA, 22 bp, Homo sapiens
tttggctaagttgtaatgtaaa

SEQ ID NO: 8284455 - DNA, 22 bp, Homo sapiens
tttgggaaacttaggggtcaga

SEQ ID NO: 8284456 - DNA, 22 bp, Homo sapiens
tttggctagagaaattactata

SEQ ID NO: 8284457 - DNA, 22 bp, Homo sapiens
tttgaagaccttatctctaaat

SEQ ID NO: 8284458 - DNA, 22 bp, Homo sapiens
tttgaagactactgggagtgaa

SEQ ID NO: 8284459 - DNA, 22 bp, Homo sapiens
tttgaagactactgggagtgaa

SEQ ID NO: 8284460 - DNA, 23 bp, Homo sapiens
tttgacagcgtggtttctgtggg

SEQ ID NO: 8284461 - DNA, 22 bp, Homo sapiens
tttgaagacatattgttacata

SEQ ID NO: 8284462 - DNA, 23 bp, Homo sapiens
tttgaagaagtgaatatcatata

SEQ ID NO: 8284463 - DNA, 22 bp, Homo sapiens
tttgaacaggagtatctatagt

SEQ ID NO: 8284464 - DNA, 22 bp, Homo sapiens
tttgacatggaataactcattt

SEQ ID NO: 8284465 - DNA, 22 bp, Homo sapiens
tttgagaagtaattcaagacat

SEQ ID NO: 8284466 - DNA, 22 bp, Homo sapiens
tttgagaaggtgacaaattcta

SEQ ID NO: 8284467 - DNA, 22 bp, Homo sapiens
tttgagaagctgtcttgggctc

SEQ ID NO: 8284468 - DNA, 22 bp, Homo sapiens
tttgacagtaataaagcacaag

SEQ ID NO: 8284469 - DNA, 22 bp, Homo sapiens
tttgacagtgacgcctgtatga

SEQ ID NO: 8284470 - DNA, 22 bp, Homo sapiens
tttgacagtcccctgatgtttg

SEQ ID NO: 8284471 - DNA, 22 bp, Homo sapiens
tttgaaatgtatcagtataggt

SEQ ID NO: 8284472 - DNA, 22 bp, Homo sapiens
tttgaaatatgtgatgagagag

SEQ ID NO: 8284473 - DNA, 22 bp, Homo sapiens
tttctagagtgggcatgtctta

SEQ ID NO: 8284474 - DNA, 22 bp, Homo sapiens
ttttttatatcaactgaagtct

SEQ ID NO: 8284475 - DNA, 22 bp, Homo sapiens
tttttgttctgattatactggt

SEQ ID NO: 8284476 - DNA, 22 bp, Homo sapiens
tttttgttcccagagaatttgt

SEQ ID NO: 8284477 - DNA, 22 bp, Homo sapiens
ttttgtatcctccctttcactg

SEQ ID NO: 8284478 - DNA, 22 bp, Homo sapiens
ttttgtatagtcaaagacaaga

SEQ ID NO: 8284479 - DNA, 22 bp, Homo sapiens
ttttgtgtgtggtgatacaaag

SEQ ID NO: 8284480 - DNA, 22 bp, Homo sapiens
ttttgggtggaagctgttatgg

SEQ ID NO: 8284481 - DNA, 22 bp, Homo sapiens
ttttgggtgaatttgccagtta

SEQ ID NO: 8284482 - DNA, 22 bp, Homo sapiens
ttttgggtatagaggtgttcat

SEQ ID NO: 8284483 - DNA, 19 bp, Homo sapiens
ttttccttctatatgtttc

SEQ ID NO: 8284484 - DNA, 22 bp, Homo sapiens
ttttggtgattttactgaaggt

SEQ ID NO: 8284485 - DNA, 22 bp, Homo sapiens
ttttccttaacagagggagaaa

SEQ ID NO: 8284486 - DNA, 22 bp, Homo sapiens
ttttcccatctacaaagcaggg

SEQ ID NO: 8284487 - DNA, 22 bp, Homo sapiens
ttttcctatatgcaaagaatgc

SEQ ID NO: 8284488 - DNA, 22 bp, Homo sapiens
ttttagaagtgcctatcctatg

SEQ ID NO: 8284489 - DNA, 22 bp, Homo sapiens
ttttacattgggaaatgcctct

SEQ ID NO: 8284490 - DNA, 22 bp, Homo sapiens
ttttacttaattcttggtcatg

SEQ ID NO: 8284491 - DNA, 22 bp, Homo sapiens
ttttactttggatacagtactt

SEQ ID NO: 8284492 - DNA, 22 bp, Homo sapiens
ttttactttggatacagtactt

SEQ ID NO: 8284493 - DNA, 22 bp, Homo sapiens
ttttcaagagagtgttctatgt

SEQ ID NO: 8284494 - DNA, 22 bp, Homo sapiens
ttttacacctcagatgagcaga

SEQ ID NO: 8284495 - DNA, 22 bp, Homo sapiens
ttttacacctgttaactctaag

SEQ ID NO: 8284496 - DNA, 22 bp, Homo sapiens
ttttacacttcggttgtgtgca

SEQ ID NO: 8284497 - DNA, 22 bp, Homo sapiens
ttttaattttgcaaatctggtg

SEQ ID NO: 8284498 - DNA, 22 bp, Homo sapiens
ttttaattttagcccttctggt

SEQ ID NO: 8284499 - DNA, 22 bp, Homo sapiens
tttgtgcacattgcttttctat

SEQ ID NO: 8284500 - DNA, 22 bp, Homo sapiens
tttgtctacaaaaagtgtacag

SEQ ID NO: 8284501 - DNA, 21 bp, Homo sapiens
ttttttcttgcgtgaggcctg

SEQ ID NO: 8284502 - DNA, 22 bp, Homo sapiens
gcagagcttctgtccttcagga

SEQ ID NO: 8284503 - DNA, 22 bp, Homo sapiens
attccctgaaattgtgctttca

SEQ ID NO: 8284504 - DNA, 22 bp, Homo sapiens
attcctggtggcagaaacatga

SEQ ID NO: 8284505 - DNA, 22 bp, Homo sapiens
gcagcaggcacttaccgttgct

SEQ ID NO: 8284506 - DNA, 22 bp, Homo sapiens
gcagcaggcacttaccgttgct

SEQ ID NO: 8284507 - DNA, 22 bp, Homo sapiens
gcagcaggcacttaccgttgct

SEQ ID NO: 8284508 - DNA, 22 bp, Homo sapiens
gcagcaggcatggccgccctgg

SEQ ID NO: 8284509 - DNA, 22 bp, Homo sapiens
gcagcaggcatggccgccctgg

SEQ ID NO: 8284510 - DNA, 22 bp, Homo sapiens
gcagcaggcatggccgccctgg

SEQ ID NO: 8284511 - DNA, 22 bp, Homo sapiens
gcagcaggcttttcataccttg

SEQ ID NO: 8284512 - DNA, 22 bp, Homo sapiens
gcagcagggtgccagctttgca

SEQ ID NO: 8284513 - DNA, 22 bp, Homo sapiens
gcagcagggtgccagctttgca

SEQ ID NO: 8284514 - DNA, 22 bp, Homo sapiens
gcagcagggtgccagctttgca

SEQ ID NO: 8284515 - DNA, 22 bp, Homo sapiens
gcagcaggcttttcataccttg

SEQ ID NO: 8284516 - DNA, 22 bp, Homo sapiens
gcagcaggcttttcataccttg

SEQ ID NO: 8284517 - DNA, 22 bp, Homo sapiens
gcagcagggagcaggggtgtca

SEQ ID NO: 8284518 - DNA, 22 bp, Homo sapiens
gcagcagggagcaggggtgtca

SEQ ID NO: 8284519 - DNA, 22 bp, Homo sapiens
attctagaaggcaaagcaaggg

SEQ ID NO: 8284520 - DNA, 22 bp, Homo sapiens
attcagagcactgggtagaatt

SEQ ID NO: 8284521 - DNA, 22 bp, Homo sapiens
attcagtattcttgaaaggttc

SEQ ID NO: 8284522 - DNA, 21 bp, Homo sapiens
gcagagctggaaccaggaccc

SEQ ID NO: 8284523 - DNA, 22 bp, Homo sapiens
gcagagctgcagcgaggcctgg

SEQ ID NO: 8284524 - DNA, 21 bp, Homo sapiens
gcagagctggaaccaggaccc

SEQ ID NO: 8284525 - DNA, 22 bp, Homo sapiens
gcagagctgggatatgaaccca

SEQ ID NO: 8284526 - DNA, 20 bp, Homo sapiens
gcagagctgttctgtgggga

SEQ ID NO: 8284527 - DNA, 22 bp, Homo sapiens
gcagagctggtacttgagcctg

SEQ ID NO: 8284528 - DNA, 22 bp, Homo sapiens
gcagagctgggtctgtatccaa

SEQ ID NO: 8284529 - DNA, 22 bp, Homo sapiens
attgaagattctgacatcagaa

SEQ ID NO: 8284530 - DNA, 22 bp, Homo sapiens
attgaagatcagggaaagattc

SEQ ID NO: 8284531 - DNA, 22 bp, Homo sapiens
attgaatgtctactatgtgcaa

SEQ ID NO: 8284532 - DNA, 22 bp, Homo sapiens
attgaatctgcactagtatttt

SEQ ID NO: 8284533 - DNA, 20 bp, Homo sapiens
attgaaatttttctgagatt

SEQ ID NO: 8284534 - DNA, 22 bp, Homo sapiens
attgacaatgtatttgtatctg

SEQ ID NO: 8284535 - DNA, 22 bp, Homo sapiens
attgacaaatctgaacatacgg

SEQ ID NO: 8284536 - DNA, 22 bp, Homo sapiens
attctagatgctgtaagtagca

SEQ ID NO: 8284537 - DNA, 22 bp, Homo sapiens
attcttaattccaaagactgag

SEQ ID NO: 8284538 - DNA, 22 bp, Homo sapiens
gcaaggctgtgcactttgcatt

SEQ ID NO: 8284539 - DNA, 22 bp, Homo sapiens
gcaaggctgtgcactttgcatt

SEQ ID NO: 8284540 - DNA, 22 bp, Homo sapiens
gcaaggctgttgctgctgcaag

SEQ ID NO: 8284541 - DNA, 22 bp, Homo sapiens
gcaaggctgttgctgctgcaag

SEQ ID NO: 8284542 - DNA, 21 bp, Homo sapiens
gcaaggcttttgtgtttccca

SEQ ID NO: 8284543 - DNA, 21 bp, Homo sapiens
gcaaggcttttgtgtttccca

SEQ ID NO: 8284544 - DNA, 17 bp, Homo sapiens
gcaagggatgggagatt

SEQ ID NO: 8284545 - DNA, 23 bp, Homo sapiens
attagaaaggctttctggtgaaa

SEQ ID NO: 8284546 - DNA, 22 bp, Homo sapiens
attagaagatagtgatttctgc

SEQ ID NO: 8284547 - DNA, 22 bp, Homo sapiens
attagaagcgtgaatcctttca

SEQ ID NO: 8284548 - DNA, 22 bp, Homo sapiens
attagacatcatatgattcagc

SEQ ID NO: 8284549 - DNA, 22 bp, Homo sapiens
attattaaagctacatcaagga

SEQ ID NO: 8284550 - DNA, 22 bp, Homo sapiens
attaatatcctgctggctaaat

SEQ ID NO: 8284551 - DNA, 22 bp, Homo sapiens
attaatatcctgctggctaaat

SEQ ID NO: 8284552 - DNA, 22 bp, Homo sapiens
attaatatgagaaagtggcaga

SEQ ID NO: 8284553 - DNA, 22 bp, Homo sapiens
attaattttacctttgtaaaca

SEQ ID NO: 8284554 - DNA, 22 bp, Homo sapiens
attacaagatgcatccatattt

SEQ ID NO: 8284555 - DNA, 22 bp, Homo sapiens
attacaactatgtgctctgcaa

SEQ ID NO: 8284556 - DNA, 22 bp, Homo sapiens
attacaactgttcccactgtct

SEQ ID NO: 8284557 - DNA, 22 bp, Homo sapiens
attaatttttctgacagccaca

SEQ ID NO: 8284558 - DNA, 22 bp, Homo sapiens
gcaaggctgctgccacccatct

SEQ ID NO: 8284559 - DNA, 22 bp, Homo sapiens
gcaaggctggtggtggtgaagt

SEQ ID NO: 8284560 - DNA, 22 bp, Homo sapiens
gcaaggctgacctctctagact

SEQ ID NO: 8284561 - DNA, 22 bp, Homo sapiens
gcaactttagaaaaatctataa

SEQ ID NO: 8284562 - DNA, 22 bp, Homo sapiens
attacaataatacatgctcatt

SEQ ID NO: 8284563 - DNA, 22 bp, Homo sapiens
atgtttttggaaatgggaacat

SEQ ID NO: 8284564 - DNA, 22 bp, Homo sapiens
atgtttttggcttcaagtttct

SEQ ID NO: 8284565 - DNA, 22 bp, Homo sapiens
atgtttttggcttcaagtttct

SEQ ID NO: 8284566 - DNA, 22 bp, Homo sapiens
atgtttttggaaatgggaacat

SEQ ID NO: 8284567 - DNA, 22 bp, Homo sapiens
atgtttttgagatacaaacaga

SEQ ID NO: 8284568 - DNA, 22 bp, Homo sapiens
atgtttttgagatacaaacaga

SEQ ID NO: 8284569 - DNA, 22 bp, Homo sapiens
atgtttttgagatacaaacaga

SEQ ID NO: 8284570 - DNA, 22 bp, Homo sapiens
atgtttttaaatagacttacag

SEQ ID NO: 8284571 - DNA, 22 bp, Homo sapiens
atgtttttcataccagtgttgg

SEQ ID NO: 8284572 - DNA, 22 bp, Homo sapiens
atgtttttcataccagtgttgg

SEQ ID NO: 8284573 - DNA, 22 bp, Homo sapiens
attaaatgatggcatgtcttat

SEQ ID NO: 8284574 - DNA, 22 bp, Homo sapiens
attaaattagcaaactgtgaaa

SEQ ID NO: 8284575 - DNA, 22 bp, Homo sapiens
attaaatgttggcatattttgt

SEQ ID NO: 8284576 - DNA, 22 bp, Homo sapiens
attaaatgttggcatattttgt

SEQ ID NO: 8284577 - DNA, 23 bp, Homo sapiens
atgttttatgtctctagctgcca

SEQ ID NO: 8284578 - DNA, 22 bp, Homo sapiens
atgttttatattttgcagcagt

SEQ ID NO: 8284579 - DNA, 22 bp, Homo sapiens
atgtttttaaatagacttacag

SEQ ID NO: 8284580 - DNA, 22 bp, Homo sapiens
atgttaaaaaccagtacagttg

SEQ ID NO: 8284581 - DNA, 22 bp, Homo sapiens
atgtgtttggttatatggtatt

SEQ ID NO: 8284582 - DNA, 22 bp, Homo sapiens
atgtgtttgtacctttaaatat

SEQ ID NO: 8284583 - DNA, 22 bp, Homo sapiens
gcctggctgaggtggggaggca

SEQ ID NO: 8284584 - DNA, 22 bp, Homo sapiens
gcctggagctactggacactga

SEQ ID NO: 8284585 - DNA, 22 bp, Homo sapiens
gcctgctgaacctcatgcagtc

SEQ ID NO: 8284586 - DNA, 22 bp, Homo sapiens
gcctgctggctgtccattgcag

SEQ ID NO: 8284587 - DNA, 22 bp, Homo sapiens
gcctgctggaggagcctcaggg

SEQ ID NO: 8284588 - DNA, 22 bp, Homo sapiens
gcctccagctggggcatttcag

SEQ ID NO: 8284589 - DNA, 22 bp, Homo sapiens
gcctccagcccacgcaggcctg

SEQ ID NO: 8284590 - DNA, 22 bp, Homo sapiens
gcctccagcccacgcaggcctg

SEQ ID NO: 8284591 - DNA, 22 bp, Homo sapiens
gcctccagggtagaggaggaag

SEQ ID NO: 8284592 - DNA, 21 bp, Homo sapiens
gcctctccaaatcctgccttc

SEQ ID NO: 8284593 - DNA, 22 bp, Homo sapiens
gcctctccgagccactgcctct

SEQ ID NO: 8284594 - DNA, 21 bp, Homo sapiens
gcctctccaaatcctgccttc

SEQ ID NO: 8284595 - DNA, 22 bp, Homo sapiens
gcctctctccttggcttgcagt

SEQ ID NO: 8284596 - DNA, 22 bp, Homo sapiens
gcctctccgagccactgcctct

SEQ ID NO: 8284597 - DNA, 22 bp, Homo sapiens
atttctcagtaatctcagcaat

SEQ ID NO: 8284598 - DNA, 22 bp, Homo sapiens
atttctcagtaggtgcacagtg

SEQ ID NO: 8284599 - DNA, 21 bp, Homo sapiens
gcctccagccagatggcctcc

SEQ ID NO: 8284600 - DNA, 22 bp, Homo sapiens
gcctccacttttgctggcttct

SEQ ID NO: 8284601 - DNA, 22 bp, Homo sapiens
atttctcaggactccatgggcg

SEQ ID NO: 8284602 - DNA, 22 bp, Homo sapiens
atttctcagcacttcctatctc

SEQ ID NO: 8284603 - DNA, 22 bp, Homo sapiens
atttctcaaccaggtcaaaaag

SEQ ID NO: 8284604 - DNA, 22 bp, Homo sapiens
caaaaactgcaattacttttac

SEQ ID NO: 8284605 - DNA, 22 bp, Homo sapiens
caaaaaacacctgtgtgagtat

SEQ ID NO: 8284606 - DNA, 22 bp, Homo sapiens
caaaacattctctgcagcaggg

SEQ ID NO: 8284607 - DNA, 22 bp, Homo sapiens
caaaactatcaggctcaaagct

SEQ ID NO: 8284608 - DNA, 22 bp, Homo sapiens
gcctgtccactaaacagccaag

SEQ ID NO: 8284609 - DNA, 22 bp, Homo sapiens
gcctgtcccgcaccggagcccg

SEQ ID NO: 8284610 - DNA, 22 bp, Homo sapiens
gcctgtccttgtgaggtcccag

SEQ ID NO: 8284611 - DNA, 22 bp, Homo sapiens
gctcaggcaaatttctggtgaa

SEQ ID NO: 8284612 - DNA, 22 bp, Homo sapiens
caaactgagcatcagaaagttt

SEQ ID NO: 8284613 - DNA, 22 bp, Homo sapiens
caaactgagcatcagaaagttt

SEQ ID NO: 8284614 - DNA, 22 bp, Homo sapiens
caaactattgttcacaagacaa

SEQ ID NO: 8284615 - DNA, 22 bp, Homo sapiens
caaactgaacacgaaagtcttt

SEQ ID NO: 8284616 - DNA, 23 bp, Homo sapiens
caaacctgttctccccacatgca

SEQ ID NO: 8284617 - DNA, 22 bp, Homo sapiens
gccaggcctgcaagtgctggtg

SEQ ID NO: 8284618 - DNA, 22 bp, Homo sapiens
atttcatatgtatcacctagcc

SEQ ID NO: 8284619 - DNA, 20 bp, Homo sapiens
atttcagtgtttgcaatttc

SEQ ID NO: 8284620 - DNA, 22 bp, Homo sapiens
atttctacattgagttttagca

SEQ ID NO: 8284621 - DNA, 22 bp, Homo sapiens
atttcctttgcaaagactgtgc

SEQ ID NO: 8284622 - DNA, 22 bp, Homo sapiens
atttctaaagagggtggtttgg

SEQ ID NO: 8284623 - DNA, 22 bp, Homo sapiens
atttacactggttctcagagct

SEQ ID NO: 8284624 - DNA, 22 bp, Homo sapiens
atttacactaaaggaaggagga

SEQ ID NO: 8284625 - DNA, 22 bp, Homo sapiens
atttacacattcataagatttc

SEQ ID NO: 8284626 - DNA, 21 bp, Homo sapiens
gccaggagtagattacattta

SEQ ID NO: 8284627 - DNA, 22 bp, Homo sapiens
gccaggagtgtgtggctatgtt

SEQ ID NO: 8284628 - DNA, 22 bp, Homo sapiens
gccaggagtgtcccactcattt

SEQ ID NO: 8284629 - DNA, 22 bp, Homo sapiens
gccaggagtgtgtggctatgtt

SEQ ID NO: 8284630 - DNA, 22 bp, Homo sapiens
attggaaagttcttaagggata

SEQ ID NO: 8284631 - DNA, 22 bp, Homo sapiens
attggaaaatatggtttctgga

SEQ ID NO: 8284632 - DNA, 21 bp, Homo sapiens
attggaaaaggtagttggctt

SEQ ID NO: 8284633 - DNA, 22 bp, Homo sapiens
attggaaagtgtctagtgtggt

SEQ ID NO: 8284634 - DNA, 22 bp, Homo sapiens
attggaaatacagtagaaaaat

SEQ ID NO: 8284635 - DNA, 22 bp, Homo sapiens
attggaaatacagtagaaaaat

SEQ ID NO: 8284636 - DNA, 22 bp, Homo sapiens
attggatagacataagaaaaat

SEQ ID NO: 8284637 - DNA, 22 bp, Homo sapiens
attggagaacagacttaaaaat

SEQ ID NO: 8284638 - DNA, 22 bp, Homo sapiens
attggaatggctttgcatgtcc

SEQ ID NO: 8284639 - DNA, 22 bp, Homo sapiens
attggactgcagcacaaaagcc

SEQ ID NO: 8284640 - DNA, 22 bp, Homo sapiens
attggaaataggccttgtacag

SEQ ID NO: 8284641 - DNA, 22 bp, Homo sapiens
attggaaatactgagagataaa

SEQ ID NO: 8284642 - DNA, 22 bp, Homo sapiens
attggaaataggccttgtacag

SEQ ID NO: 8284643 - DNA, 22 bp, Homo sapiens
attggaaatgctacaagttaga

SEQ ID NO: 8284644 - DNA, 21 bp, Homo sapiens
attggcacaccttttattgga

SEQ ID NO: 8284645 - DNA, 22 bp, Homo sapiens
attggcaatagagaataaattg

SEQ ID NO: 8284646 - DNA, 22 bp, Homo sapiens
attggcaagtgaatttaacagc

SEQ ID NO: 8284647 - DNA, 22 bp, Homo sapiens
attggcactgcacatgattgct

SEQ ID NO: 8284648 - DNA, 22 bp, Homo sapiens
atttaattaatcatggtgaatt

SEQ ID NO: 8284649 - DNA, 22 bp, Homo sapiens
atttaattttctcaacagtgct

SEQ ID NO: 8284650 - DNA, 21 bp, Homo sapiens
atttacaaaacagtcccttcc

SEQ ID NO: 8284651 - DNA, 22 bp, Homo sapiens
atttaattttctcaacagtgct

SEQ ID NO: 8284652 - DNA, 22 bp, Homo sapiens
atttaatttggagagagaaacc

SEQ ID NO: 8284653 - DNA, 22 bp, Homo sapiens
atttaatttatagatgtggata

SEQ ID NO: 8284654 - DNA, 22 bp, Homo sapiens
atgcatctatgacttagacatt

SEQ ID NO: 8284655 - DNA, 23 bp, Homo sapiens
atgcatcatgaaaactagagagc

SEQ ID NO: 8284656 - DNA, 21 bp, Homo sapiens
atgcatggatttcagtgagag

SEQ ID NO: 8284657 - DNA, 22 bp, Homo sapiens
atgcatggtctgaagtcaacct

SEQ ID NO: 8284658 - DNA, 23 bp, Homo sapiens
atgcagagaataacaaatgccat

SEQ ID NO: 8284659 - DNA, 22 bp, Homo sapiens
atgcaaagcacacacagaatcc

SEQ ID NO: 8284660 - DNA, 22 bp, Homo sapiens
atgcaaagcaccacactaagat

SEQ ID NO: 8284661 - DNA, 22 bp, Homo sapiens
atgcaaatcttaagtatgtgtg

SEQ ID NO: 8284662 - DNA, 22 bp, Homo sapiens
gaaagcaagttgactgcagaat

SEQ ID NO: 8284663 - DNA, 22 bp, Homo sapiens
atgaggaacagacttgctggat

SEQ ID NO: 8284664 - DNA, 22 bp, Homo sapiens
atgagttagtttcttgtctaga

SEQ ID NO: 8284665 - DNA, 22 bp, Homo sapiens
atgagtgcttagagagtaatcc

SEQ ID NO: 8284666 - DNA, 22 bp, Homo sapiens
atgattcagcaattttatatct

SEQ ID NO: 8284667 - DNA, 22 bp, Homo sapiens
atgatttttcagcagaggatct

SEQ ID NO: 8284668 - DNA, 22 bp, Homo sapiens
atgagtatatgatatggtttgg

SEQ ID NO: 8284669 - DNA, 22 bp, Homo sapiens
atctttttgacatggtgatggt

SEQ ID NO: 8284670 - DNA, 22 bp, Homo sapiens
atctttttatctgtttggaaca

SEQ ID NO: 8284671 - DNA, 22 bp, Homo sapiens
atctttttactaacactgctta

SEQ ID NO: 8284672 - DNA, 22 bp, Homo sapiens
atcttttctgtttgctatgtct

SEQ ID NO: 8284673 - DNA, 22 bp, Homo sapiens
atcttgcttgctgggcattttc

SEQ ID NO: 8284674 - DNA, 22 bp, Homo sapiens
atcttggactacagaagagagg

SEQ ID NO: 8284675 - DNA, 22 bp, Homo sapiens
cttgtttaagccgctgttaagc

SEQ ID NO: 8284676 - DNA, 22 bp, Homo sapiens
atgaaatgctgagaggtgcttc

SEQ ID NO: 8284677 - DNA, 23 bp, Homo sapiens
atgaaatgatactttattcactg

SEQ ID NO: 8284678 - DNA, 22 bp, Homo sapiens
cttttacatttgttgaagagta

SEQ ID NO: 8284679 - DNA, 22 bp, Homo sapiens
atgaaattaatcaacacataca

SEQ ID NO: 8284680 - DNA, 22 bp, Homo sapiens
atgaaattaatcaacacataca

SEQ ID NO: 8284681 - DNA, 22 bp, Homo sapiens
atgaaattaatcaacacataca

SEQ ID NO: 8284682 - DNA, 22 bp, Homo sapiens
cttttcaaacgctgatgtcagt

SEQ ID NO: 8284683 - DNA, 19 bp, Homo sapiens
cttttcaagccatcagttt

SEQ ID NO: 8284684 - DNA, 22 bp, Homo sapiens
cttgcctttgtcttcaaaggct

SEQ ID NO: 8284685 - DNA, 22 bp, Homo sapiens
cttgagttacagctctccaaga

SEQ ID NO: 8284686 - DNA, 22 bp, Homo sapiens
atctatgtgggaatcataatag

SEQ ID NO: 8284687 - DNA, 22 bp, Homo sapiens
atctattatgctgagaaactgt

SEQ ID NO: 8284688 - DNA, 22 bp, Homo sapiens
atctagaaagtgttgaagatca

SEQ ID NO: 8284689 - DNA, 22 bp, Homo sapiens
atctagattaggtataagagct

SEQ ID NO: 8284690 - DNA, 22 bp, Homo sapiens
cttgggtgtgaccttggcattg

SEQ ID NO: 8284691 - DNA, 16 bp, Homo sapiens
cttggtgttggcagag

SEQ ID NO: 8284692 - DNA, 22 bp, Homo sapiens
cttgtaatagataggatcaaat

SEQ ID NO: 8284693 - DNA, 22 bp, Homo sapiens
cttgtaattataatgtactgtt

SEQ ID NO: 8284694 - DNA, 22 bp, Homo sapiens
cttgtaatggcagagacctgtc

SEQ ID NO: 8284695 - DNA, 22 bp, Homo sapiens
atcttctgggcagtgaaaattg

SEQ ID NO: 8284696 - DNA, 22 bp, Homo sapiens
atgtacatttgtagtaatatca

SEQ ID NO: 8284697 - DNA, 22 bp, Homo sapiens
atgtacattttcctaatgtttt

SEQ ID NO: 8284698 - DNA, 18 bp, Homo sapiens
atgtacatttgctaaagc

SEQ ID NO: 8284699 - DNA, 22 bp, Homo sapiens
atgtacatttagatcatttctg

SEQ ID NO: 8284700 - DNA, 22 bp, Homo sapiens
atgtacattattcgagtgatgg

SEQ ID NO: 8284701 - DNA, 22 bp, Homo sapiens
atgtacatgtgaatttaggcaa

SEQ ID NO: 8284702 - DNA, 22 bp, Homo sapiens
atgtacatctttataacaagct

SEQ ID NO: 8284703 - DNA, 22 bp, Homo sapiens
atgtacattctaagtatgtgta

SEQ ID NO: 8284704 - DNA, 22 bp, Homo sapiens
atgtacatttagatcatttctg

SEQ ID NO: 8284705 - DNA, 22 bp, Homo sapiens
gagctgggcctgcgagtgctgc

SEQ ID NO: 8284706 - DNA, 23 bp, Homo sapiens
atggtccagccagctgcacagga

SEQ ID NO: 8284707 - DNA, 22 bp, Homo sapiens
gagctgggcctcagaacacagt

SEQ ID NO: 8284708 - DNA, 22 bp, Homo sapiens
atggtcaagccacactcatcca

SEQ ID NO: 8284709 - DNA, 21 bp, Homo sapiens
atggtcaattcattagaaaga

SEQ ID NO: 8284710 - DNA, 22 bp, Homo sapiens
gagctgggcgagccggggaagt

SEQ ID NO: 8284711 - DNA, 22 bp, Homo sapiens
atgtacaattctccttggtagg

SEQ ID NO: 8284712 - DNA, 22 bp, Homo sapiens
atggtcaagatcctctagttta

SEQ ID NO: 8284713 - DNA, 22 bp, Homo sapiens
atggtcaagccacactcatcca

SEQ ID NO: 8284714 - DNA, 22 bp, Homo sapiens
atggtcaagatcctctagttta

SEQ ID NO: 8284715 - DNA, 22 bp, Homo sapiens
atggtacaatgtgtgtatcttt

SEQ ID NO: 8284716 - DNA, 22 bp, Homo sapiens
atggtacagataatacatgctg

SEQ ID NO: 8284717 - DNA, 19 bp, Homo sapiens
atggtacagtgtacacttg

SEQ ID NO: 8284718 - DNA, 22 bp, Homo sapiens
atggctggcactggcctgggtt

SEQ ID NO: 8284719 - DNA, 22 bp, Homo sapiens
atggctggatttgatccatggg

SEQ ID NO: 8284720 - DNA, 22 bp, Homo sapiens
atggctggaggccgggcttcct

SEQ ID NO: 8284721 - DNA, 22 bp, Homo sapiens
atggctggaagagtcgaagagt

SEQ ID NO: 8284722 - DNA, 22 bp, Homo sapiens
atggctggatagttgaagctct

SEQ ID NO: 8284723 - DNA, 22 bp, Homo sapiens
atggctggatttgatccatggg

SEQ ID NO: 8284724 - DNA, 22 bp, Homo sapiens
atgtgtatgtgtatacacacag

SEQ ID NO: 8284725 - DNA, 22 bp, Homo sapiens
gaggggagaggcttatggatca

SEQ ID NO: 8284726 - DNA, 22 bp, Homo sapiens
gaggggagaaggcactaaccag

SEQ ID NO: 8284727 - DNA, 16 bp, Homo sapiens
gaggggagcagtaggc

SEQ ID NO: 8284728 - DNA, 22 bp, Homo sapiens
gaggggagcatgatctagattg

SEQ ID NO: 8284729 - DNA, 22 bp, Homo sapiens
gaggctgcggggaggagcctgc

SEQ ID NO: 8284730 - DNA, 22 bp, Homo sapiens
gagaggaactcccagtgcctgg

SEQ ID NO: 8284731 - DNA, 22 bp, Homo sapiens
gagaggaactcccagtgcctgg

SEQ ID NO: 8284732 - DNA, 22 bp, Homo sapiens
atggccagtctattcatggtta

SEQ ID NO: 8284733 - DNA, 22 bp, Homo sapiens
gagagctgtggtttgaccaggc

SEQ ID NO: 8284734 - DNA, 22 bp, Homo sapiens
gagccaggagatacctaagggg

SEQ ID NO: 8284735 - DNA, 22 bp, Homo sapiens
gagccaggaagaaggccttact

SEQ ID NO: 8284736 - DNA, 22 bp, Homo sapiens
gagccaggaggcagagactgca

SEQ ID NO: 8284737 - DNA, 22 bp, Homo sapiens
gagccaggaggcagagactgca

SEQ ID NO: 8284738 - DNA, 22 bp, Homo sapiens
gagccagggctgtgagctgagc

SEQ ID NO: 8284739 - DNA, 22 bp, Homo sapiens
gagccaggcccgtacttgctgt

SEQ ID NO: 8284740 - DNA, 22 bp, Homo sapiens
gagccaggcccgtacttgctgt

SEQ ID NO: 8284741 - DNA, 22 bp, Homo sapiens
atggctgccccaaattgttgct

SEQ ID NO: 8284742 - DNA, 22 bp, Homo sapiens
atggctgctttcccttagcacc

SEQ ID NO: 8284743 - DNA, 22 bp, Homo sapiens
atggctgcttcagtaccagttc

SEQ ID NO: 8284744 - DNA, 22 bp, Homo sapiens
atggctgctctggatggagtcc

SEQ ID NO: 8284745 - DNA, 22 bp, Homo sapiens
atggctgcttacaaaaactgtg

SEQ ID NO: 8284746 - DNA, 22 bp, Homo sapiens
gagccagccttcttctgaggtc

SEQ ID NO: 8284747 - DNA, 22 bp, Homo sapiens
atggccctggaaagagcttgag

SEQ ID NO: 8284748 - DNA, 22 bp, Homo sapiens
atggagctgtagggagcagtgg

SEQ ID NO: 8284749 - DNA, 22 bp, Homo sapiens
atggaaggctttatgactcaaa

SEQ ID NO: 8284750 - DNA, 22 bp, Homo sapiens
atggaagagtccccatggatga

SEQ ID NO: 8284751 - DNA, 22 bp, Homo sapiens
atggaagactaacagaaacatg

SEQ ID NO: 8284752 - DNA, 22 bp, Homo sapiens
atggaagacagataaggcagaa

SEQ ID NO: 8284753 - DNA, 22 bp, Homo sapiens
atggacatttgagttatttcca

SEQ ID NO: 8284754 - DNA, 22 bp, Homo sapiens
atggaatggcctgtcataatct

SEQ ID NO: 8284755 - DNA, 22 bp, Homo sapiens
atggaaatgtaacttctgattc

SEQ ID NO: 8284756 - DNA, 22 bp, Homo sapiens
atggaaattaagatttgtctca

SEQ ID NO: 8284757 - DNA, 22 bp, Homo sapiens
atggaaatgttccatatattga

SEQ ID NO: 8284758 - DNA, 22 bp, Homo sapiens
atggaaatgttaagtcagtccg

SEQ ID NO: 8284759 - DNA, 22 bp, Homo sapiens
atggaaatgttccatatattga

SEQ ID NO: 8284760 - DNA, 22 bp, Homo sapiens
atggaacatgaattaatatggt

SEQ ID NO: 8284761 - DNA, 22 bp, Homo sapiens
atggaacaagaactcagattta

SEQ ID NO: 8284762 - DNA, 22 bp, Homo sapiens
atggaaatgatggaacattaaa

SEQ ID NO: 8284763 - DNA, 22 bp, Homo sapiens
atgccacttcattccagcctcg

SEQ ID NO: 8284764 - DNA, 22 bp, Homo sapiens
atgccactgcgctccagcctgg

SEQ ID NO: 8284765 - DNA, 22 bp, Homo sapiens
atgccactgcgctctagcctgg

SEQ ID NO: 8284766 - DNA, 22 bp, Homo sapiens
gacagcaacactcaattctgca

SEQ ID NO: 8284767 - DNA, 22 bp, Homo sapiens
atgccactgcgctccagcctgg

SEQ ID NO: 8284768 - DNA, 22 bp, Homo sapiens
ggtggggctcagcaatctgtgt

SEQ ID NO: 8284769 - DNA, 21 bp, Homo sapiens
ggtggggtacctaaggtagct

SEQ ID NO: 8284770 - DNA, 22 bp, Homo sapiens
cagcaagggataaagagttact

SEQ ID NO: 8284771 - DNA, 22 bp, Homo sapiens
cagcaagggataaagagttact

SEQ ID NO: 8284772 - DNA, 22 bp, Homo sapiens
ggtgggtatagttagggcctct

SEQ ID NO: 8284773 - DNA, 22 bp, Homo sapiens
ggtgggtatagttagggcctct

SEQ ID NO: 8284774 - DNA, 22 bp, Homo sapiens
ggtgggtattgaatacaggtgt

SEQ ID NO: 8284775 - DNA, 22 bp, Homo sapiens
gggtgggactgaagtctgaggg

SEQ ID NO: 8284776 - DNA, 22 bp, Homo sapiens
cagagtcagagctccatggagt

SEQ ID NO: 8284777 - DNA, 20 bp, Homo sapiens
cagagtaattattacccttt

SEQ ID NO: 8284778 - DNA, 22 bp, Homo sapiens
cagagtatccctttagaattaa

SEQ ID NO: 8284779 - DNA, 22 bp, Homo sapiens
ggtgggacaggtaggagtggct

SEQ ID NO: 8284780 - DNA, 21 bp, Homo sapiens
gggtgggaggacacagcaggc

SEQ ID NO: 8284781 - DNA, 22 bp, Homo sapiens
gtaaacacctgttaaattcaga

SEQ ID NO: 8284782 - DNA, 23 bp, Homo sapiens
ggttctttaccttgaatgttttc

SEQ ID NO: 8284783 - DNA, 22 bp, Homo sapiens
ggttctttggcagtctgattga

SEQ ID NO: 8284784 - DNA, 22 bp, Homo sapiens
ggttgctctttggaccctgctg

SEQ ID NO: 8284785 - DNA, 22 bp, Homo sapiens
ggttgctgggggtggcagagct

SEQ ID NO: 8284786 - DNA, 22 bp, Homo sapiens
ggttcctgtgcctctagctggc

SEQ ID NO: 8284787 - DNA, 22 bp, Homo sapiens
ggttcctgtacttagctatgta

SEQ ID NO: 8284788 - DNA, 23 bp, Homo sapiens
cagcaagtgaattccaagagaga

SEQ ID NO: 8284789 - DNA, 22 bp, Homo sapiens
cagcagcaacaatagcggtcac

SEQ ID NO: 8284790 - DNA, 22 bp, Homo sapiens
cagcagcaacaacggaagcctt

SEQ ID NO: 8284791 - DNA, 22 bp, Homo sapiens
cagcagcaaatctagaagagga

SEQ ID NO: 8284792 - DNA, 22 bp, Homo sapiens
cagcagcaaatctagaagagga

SEQ ID NO: 8284793 - DNA, 22 bp, Homo sapiens
cagcagagtatggcactcaact

SEQ ID NO: 8284794 - DNA, 22 bp, Homo sapiens
cagcagagtatggcactcaact

SEQ ID NO: 8284795 - DNA, 22 bp, Homo sapiens
cagcagagctgtgtgggaaggg

SEQ ID NO: 8284796 - DNA, 22 bp, Homo sapiens
gtagggagcccagagcccagtg

SEQ ID NO: 8284797 - DNA, 22 bp, Homo sapiens
cagcagcagattcagcgtctgg

SEQ ID NO: 8284798 - DNA, 22 bp, Homo sapiens
cagcagcaaggtgagggtggag

SEQ ID NO: 8284799 - DNA, 22 bp, Homo sapiens
gtatctacgtttgtgtgtacct

SEQ ID NO: 8284800 - DNA, 22 bp, Homo sapiens
gtatcacttttgagagtgagaa

SEQ ID NO: 8284801 - DNA, 22 bp, Homo sapiens
cagcaggatatggtggagagag

SEQ ID NO: 8284802 - DNA, 22 bp, Homo sapiens
gtatttctttccattatagtca

SEQ ID NO: 8284803 - DNA, 22 bp, Homo sapiens
cagcagctacttggagcagcag

SEQ ID NO: 8284804 - DNA, 22 bp, Homo sapiens
cagcaggacatggaggagtaaa

SEQ ID NO: 8284805 - DNA, 22 bp, Homo sapiens
cagcaggaccattgaggcatca

SEQ ID NO: 8284806 - DNA, 22 bp, Homo sapiens
cagccaccatacagcagaagct

SEQ ID NO: 8284807 - DNA, 22 bp, Homo sapiens
cagccaggttcaagtccttata

SEQ ID NO: 8284808 - DNA, 22 bp, Homo sapiens
cagccaggttcaagtccttata

SEQ ID NO: 8284809 - DNA, 22 bp, Homo sapiens
cagcattgggttacctttgttt

SEQ ID NO: 8284810 - DNA, 22 bp, Homo sapiens
gtattttacttacgcatgactt

SEQ ID NO: 8284811 - DNA, 22 bp, Homo sapiens
gtattttactgctcaaagctct

SEQ ID NO: 8284812 - DNA, 22 bp, Homo sapiens
gtattttaagtgactactaggt

SEQ ID NO: 8284813 - DNA, 22 bp, Homo sapiens
cagagctggtgtgtcctggcat

SEQ ID NO: 8284814 - DNA, 22 bp, Homo sapiens
cagagctggtaagtggtagagg

SEQ ID NO: 8284815 - DNA, 22 bp, Homo sapiens
cagaggccacctgtggccactg

SEQ ID NO: 8284816 - DNA, 22 bp, Homo sapiens
cagagctggtgtgtcctggcat

SEQ ID NO: 8284817 - DNA, 21 bp, Homo sapiens
cagaggcctcatgctctgtgc

SEQ ID NO: 8284818 - DNA, 21 bp, Homo sapiens
cagaggcctcatgctctgtgc

SEQ ID NO: 8284819 - DNA, 22 bp, Homo sapiens
cagaggccccagaactagctct

SEQ ID NO: 8284820 - DNA, 22 bp, Homo sapiens
cagaggccagggggctcacaaa

SEQ ID NO: 8284821 - DNA, 22 bp, Homo sapiens
cagaggctggatggacttgcct

SEQ ID NO: 8284822 - DNA, 22 bp, Homo sapiens
gggtctaggagacatgggcaag

SEQ ID NO: 8284823 - DNA, 22 bp, Homo sapiens
cagaggcttcaagtcattctcc

SEQ ID NO: 8284824 - DNA, 22 bp, Homo sapiens
cagaggctgggacctcaggcat

SEQ ID NO: 8284825 - DNA, 22 bp, Homo sapiens
cagaggctgtgtaggcagactg

SEQ ID NO: 8284826 - DNA, 23 bp, Homo sapiens
cagaggtgtcagtgcccagtgtc

SEQ ID NO: 8284827 - DNA, 22 bp, Homo sapiens
cagaggtgtacagagggaggcc

SEQ ID NO: 8284828 - DNA, 23 bp, Homo sapiens
cagaggtgtcagtgcccagtgtc

SEQ ID NO: 8284829 - DNA, 22 bp, Homo sapiens
cagagtaaggagctgtcaaacg

SEQ ID NO: 8284830 - DNA, 22 bp, Homo sapiens
cagagtaaacctgtcatcaaga

SEQ ID NO: 8284831 - DNA, 22 bp, Homo sapiens
cagagctgcgctttttcctggt

SEQ ID NO: 8284832 - DNA, 22 bp, Homo sapiens
cagagctgcagattgaaggcat

SEQ ID NO: 8284833 - DNA, 22 bp, Homo sapiens
cagagctgcagattgaaggcat

SEQ ID NO: 8284834 - DNA, 22 bp, Homo sapiens
gggctgtgtactatgaggaggg

SEQ ID NO: 8284835 - DNA, 22 bp, Homo sapiens
ggggaaagccagccctgcttcc

SEQ ID NO: 8284836 - DNA, 23 bp, Homo sapiens
ggggaaagaccatgcttgaggac

SEQ ID NO: 8284837 - DNA, 22 bp, Homo sapiens
ggggaaattgtggctgacagtg

SEQ ID NO: 8284838 - DNA, 22 bp, Homo sapiens
ggggaaaggccatggcaagaac

SEQ ID NO: 8284839 - DNA, 22 bp, Homo sapiens
ggggaaagtgaattgtgtagtg

SEQ ID NO: 8284840 - DNA, 21 bp, Homo sapiens
cagagctgaagggtgtagtgt

SEQ ID NO: 8284841 - DNA, 22 bp, Homo sapiens
cagagctgagaatgttgatgct

SEQ ID NO: 8284842 - DNA, 22 bp, Homo sapiens
cagagctgattggatccagaga

SEQ ID NO: 8284843 - DNA, 22 bp, Homo sapiens
cagagccctagtcctgatggcc

SEQ ID NO: 8284844 - DNA, 22 bp, Homo sapiens
cagagcccctgggttgggagct

SEQ ID NO: 8284845 - DNA, 22 bp, Homo sapiens
cagagcccctcgtctccaccac

SEQ ID NO: 8284846 - DNA, 22 bp, Homo sapiens
cagagccccccttctgatcaca

SEQ ID NO: 8284847 - DNA, 22 bp, Homo sapiens
cagagccctgtgtgccatgtga

SEQ ID NO: 8284848 - DNA, 22 bp, Homo sapiens
cagagccctgggcacatggtag

SEQ ID NO: 8284849 - DNA, 22 bp, Homo sapiens
cagagccctcaaggccgatgca

SEQ ID NO: 8284850 - DNA, 22 bp, Homo sapiens
cagagcccttcctcccacgggg

SEQ ID NO: 8284851 - DNA, 22 bp, Homo sapiens
cagagcccttggctggagccca

SEQ ID NO: 8284852 - DNA, 22 bp, Homo sapiens
cagagccagctgtccttggcat

SEQ ID NO: 8284853 - DNA, 17 bp, Homo sapiens
cagacaggctgtcaccc

SEQ ID NO: 8284854 - DNA, 22 bp, Homo sapiens
cagacaggctagccagactcac

SEQ ID NO: 8284855 - DNA, 22 bp, Homo sapiens
gggatgagagtagggtgtgaaa

SEQ ID NO: 8284856 - DNA, 22 bp, Homo sapiens
cagacagggccctgtgatggta

SEQ ID NO: 8284857 - DNA, 22 bp, Homo sapiens
cagacagggccctgtgatggta

SEQ ID NO: 8284858 - DNA, 22 bp, Homo sapiens
gggcaaggcagaagagttggag

SEQ ID NO: 8284859 - DNA, 20 bp, Homo sapiens
gggcaaggaaacagccccca

SEQ ID NO: 8284860 - DNA, 22 bp, Homo sapiens
gggcacaccttgtctgagcaca

SEQ ID NO: 8284861 - DNA, 22 bp, Homo sapiens
gggcaatttgttttaatgaggg

SEQ ID NO: 8284862 - DNA, 22 bp, Homo sapiens
gggcaatggtcacatagagtga

SEQ ID NO: 8284863 - DNA, 22 bp, Homo sapiens
gggagcaggagcctgcctgcca

SEQ ID NO: 8284864 - DNA, 22 bp, Homo sapiens
gggaggggttgcatgtttgagt

SEQ ID NO: 8284865 - DNA, 19 bp, Homo sapiens
gggagcaggaaagctgtgg

SEQ ID NO: 8284866 - DNA, 22 bp, Homo sapiens
cagacaggaattctggcgtggt

SEQ ID NO: 8284867 - DNA, 22 bp, Homo sapiens
cagacaggctagccagactcac

SEQ ID NO: 8284868 - DNA, 22 bp, Homo sapiens
cagacaggcaggtgagagctcc

SEQ ID NO: 8284869 - DNA, 22 bp, Homo sapiens
gggaaggacacagccatgactg

SEQ ID NO: 8284870 - DNA, 22 bp, Homo sapiens
gggaaggaaatcttgcttgtga

SEQ ID NO: 8284871 - DNA, 22 bp, Homo sapiens
gggaaggaggtggcttgaagtg

SEQ ID NO: 8284872 - DNA, 22 bp, Homo sapiens
gggaaggacattctgggctcag

SEQ ID NO: 8284873 - DNA, 22 bp, Homo sapiens
gggaaggacattctgggctcag

SEQ ID NO: 8284874 - DNA, 22 bp, Homo sapiens
gggaaggaggtggacctgcccc

SEQ ID NO: 8284875 - DNA, 22 bp, Homo sapiens
gggacagaggcaaactagcaga

SEQ ID NO: 8284876 - DNA, 22 bp, Homo sapiens
gggacagaggcaaactagcaga

SEQ ID NO: 8284877 - DNA, 22 bp, Homo sapiens
cagaaggtttgaaagatgtctt

SEQ ID NO: 8284878 - DNA, 22 bp, Homo sapiens
gggaaaaataatgcacagatat

SEQ ID NO: 8284879 - DNA, 22 bp, Homo sapiens
cagaagcagtgagagatgtgca

SEQ ID NO: 8284880 - DNA, 22 bp, Homo sapiens
cacaaggttctgtaaaatcaaa

SEQ ID NO: 8284881 - DNA, 22 bp, Homo sapiens
cacaagtcattttcagcaggct

SEQ ID NO: 8284882 - DNA, 22 bp, Homo sapiens
cacaagtatctcccaccaggtt

SEQ ID NO: 8284883 - DNA, 22 bp, Homo sapiens
cacacatttcagatgctacaat

SEQ ID NO: 8284884 - DNA, 22 bp, Homo sapiens
cacacattggttttactccttt

SEQ ID NO: 8284885 - DNA, 19 bp, Homo sapiens
cacacccatgcttgccaag

SEQ ID NO: 8284886 - DNA, 21 bp, Homo sapiens
cacaccaggcatgtcttgagc

SEQ ID NO: 8284887 - DNA, 22 bp, Homo sapiens
cacacccaaatttctctctcag

SEQ ID NO: 8284888 - DNA, 22 bp, Homo sapiens
cacacctcacacctcgcatgct

SEQ ID NO: 8284889 - DNA, 22 bp, Homo sapiens
cacaattattatctctttctac

SEQ ID NO: 8284890 - DNA, 22 bp, Homo sapiens
cacaattagcagctctttattt

SEQ ID NO: 8284891 - DNA, 22 bp, Homo sapiens
cacaattatagaagaaagcata

SEQ ID NO: 8284892 - DNA, 22 bp, Homo sapiens
cacaatttggtgctaaagaaag

SEQ ID NO: 8284893 - DNA, 22 bp, Homo sapiens
cacacatcaacctagacattgt

SEQ ID NO: 8284894 - DNA, 22 bp, Homo sapiens
cacacatattgtccctagtgtg

SEQ ID NO: 8284895 - DNA, 22 bp, Homo sapiens
cacaatttgttttatcagtatt

SEQ ID NO: 8284896 - DNA, 20 bp, Homo sapiens
gctgtggcaaagctttgtgt

SEQ ID NO: 8284897 - DNA, 22 bp, Homo sapiens
gctgtggccaacaaaccacttt

SEQ ID NO: 8284898 - DNA, 22 bp, Homo sapiens
gctgtctgcatctctagagctt

SEQ ID NO: 8284899 - DNA, 22 bp, Homo sapiens
caaggcagctattgtctccata

SEQ ID NO: 8284900 - DNA, 22 bp, Homo sapiens
gctgtctcatgggtgctagtcc

SEQ ID NO: 8284901 - DNA, 22 bp, Homo sapiens
caaggattttgattgtttgaaa

SEQ ID NO: 8284902 - DNA, 22 bp, Homo sapiens
gcttctctggcctgcagggcat

SEQ ID NO: 8284903 - DNA, 22 bp, Homo sapiens
gcttctctcaggagcatcagcc

SEQ ID NO: 8284904 - DNA, 22 bp, Homo sapiens
gcttctctggctggtctgccac

SEQ ID NO: 8284905 - DNA, 22 bp, Homo sapiens
gcttctccctacagatgtcagt

SEQ ID NO: 8284906 - DNA, 22 bp, Homo sapiens
gcttctcctcccgctcccaggc

SEQ ID NO: 8284907 - DNA, 22 bp, Homo sapiens
gctgtggcctccagcactcccc

SEQ ID NO: 8284908 - DNA, 22 bp, Homo sapiens
gcttggcttgggctcagaggcc

SEQ ID NO: 8284909 - DNA, 22 bp, Homo sapiens
gcttggccctgccgcctgggtc

SEQ ID NO: 8284910 - DNA, 22 bp, Homo sapiens
caaggacccaaatcttgttctt

SEQ ID NO: 8284911 - DNA, 21 bp, Homo sapiens
caaggacaggttgcagggcaa

SEQ ID NO: 8284912 - DNA, 22 bp, Homo sapiens
caaggacagcgtcaggtgcaac

SEQ ID NO: 8284913 - DNA, 22 bp, Homo sapiens
caaggacagcgtcaggtgcaac

SEQ ID NO: 8284914 - DNA, 22 bp, Homo sapiens
caaggacactgatgttcatcct

SEQ ID NO: 8284915 - DNA, 22 bp, Homo sapiens
caagatgatccctgaaggcagc

SEQ ID NO: 8284916 - DNA, 22 bp, Homo sapiens
caaggaagttttaggagaggaa

SEQ ID NO: 8284917 - DNA, 22 bp, Homo sapiens
caagctgctataggttgctggg

SEQ ID NO: 8284918 - DNA, 22 bp, Homo sapiens
caagctgcttattctctgctct

SEQ ID NO: 8284919 - DNA, 22 bp, Homo sapiens
caaggacactccctgctgggca

SEQ ID NO: 8284920 - DNA, 22 bp, Homo sapiens
caaggacactccctgctgggca

SEQ ID NO: 8284921 - DNA, 22 bp, Homo sapiens
caaggacactgagctttgtaaa

SEQ ID NO: 8284922 - DNA, 22 bp, Homo sapiens
caaggacactgagctttgtaaa

SEQ ID NO: 8284923 - DNA, 22 bp, Homo sapiens
caaggacaacttcatattgtgg

SEQ ID NO: 8284924 - DNA, 22 bp, Homo sapiens
caagatgaaactacagggagga

SEQ ID NO: 8284925 - DNA, 22 bp, Homo sapiens
caagatgaaattgtgatatttt

SEQ ID NO: 8284926 - DNA, 22 bp, Homo sapiens
caagatgaatgatgaagtgtgt

SEQ ID NO: 8284927 - DNA, 22 bp, Homo sapiens
caagatgaagtgaagattagaa

SEQ ID NO: 8284928 - DNA, 22 bp, Homo sapiens
caagatgaggtcatactggaat

SEQ ID NO: 8284929 - DNA, 22 bp, Homo sapiens
caagatgacaaggctggaggct

SEQ ID NO: 8284930 - DNA, 22 bp, Homo sapiens
caagatgactttgggggattaa

SEQ ID NO: 8284931 - DNA, 22 bp, Homo sapiens
caagataaagccaccagaagct

SEQ ID NO: 8284932 - DNA, 22 bp, Homo sapiens
gctgctggccccacatgctcca

SEQ ID NO: 8284933 - DNA, 22 bp, Homo sapiens
gctgccttccctgttctttcag

SEQ ID NO: 8284934 - DNA, 22 bp, Homo sapiens
gctgccttgaacttggcctggg

SEQ ID NO: 8284935 - DNA, 22 bp, Homo sapiens
caaccgcggggcccagcggttc

SEQ ID NO: 8284936 - DNA, 22 bp, Homo sapiens
gctgcatggagggtgcccagga

SEQ ID NO: 8284937 - DNA, 22 bp, Homo sapiens
gctgccaccgtggagatgagtg

SEQ ID NO: 8284938 - DNA, 22 bp, Homo sapiens
gctgcagtgagccaagatcgtg

SEQ ID NO: 8284939 - DNA, 22 bp, Homo sapiens
gctgcagtgagccaagatcgtg

SEQ ID NO: 8284940 - DNA, 22 bp, Homo sapiens
gctgcatgacagacaggcctgg

SEQ ID NO: 8284941 - DNA, 22 bp, Homo sapiens
gctgcaggtttgtctagtctgg

SEQ ID NO: 8284942 - DNA, 17 bp, Homo sapiens
gctgcagcggtaggcag

SEQ ID NO: 8284943 - DNA, 22 bp, Homo sapiens
caacccaaaagcgtttccattt

SEQ ID NO: 8284944 - DNA, 22 bp, Homo sapiens
caacatataatatttgagttct

SEQ ID NO: 8284945 - DNA, 22 bp, Homo sapiens
caacatatgattttgtatataa

SEQ ID NO: 8284946 - DNA, 22 bp, Homo sapiens
caacatatataaggatttacta

SEQ ID NO: 8284947 - DNA, 22 bp, Homo sapiens
caacatatgattttgtatataa

SEQ ID NO: 8284948 - DNA, 20 bp, Homo sapiens
gctgaggtggaggaaggaga

SEQ ID NO: 8284949 - DNA, 22 bp, Homo sapiens
gctgaggtggaggaaggagacc

SEQ ID NO: 8284950 - DNA, 22 bp, Homo sapiens
gctgcagcagaagttctcagag

SEQ ID NO: 8284951 - DNA, 22 bp, Homo sapiens
caaagtatatttcatagtctca

SEQ ID NO: 8284952 - DNA, 22 bp, Homo sapiens
gctcctcttctcccactgaatg

SEQ ID NO: 8284953 - DNA, 22 bp, Homo sapiens
gctcctcttctcccactgaatg

SEQ ID NO: 8284954 - DNA, 22 bp, Homo sapiens
caaagtatgaaccagtttctct

SEQ ID NO: 8284955 - DNA, 22 bp, Homo sapiens
gctcctgcaggacccaggagac

SEQ ID NO: 8284956 - DNA, 22 bp, Homo sapiens
ggctcaagcagtctgcctgcct

SEQ ID NO: 8284957 - DNA, 22 bp, Homo sapiens
ggctagggatctagaccaggac

SEQ ID NO: 8284958 - DNA, 22 bp, Homo sapiens
cactgcagtaactctaggactg

SEQ ID NO: 8284959 - DNA, 22 bp, Homo sapiens
cactgcagtcttcatcaaccaa

SEQ ID NO: 8284960 - DNA, 22 bp, Homo sapiens
cactgcagttccccagtgcgca

SEQ ID NO: 8284961 - DNA, 22 bp, Homo sapiens
cactgactaagtttgtgaaggt

SEQ ID NO: 8284962 - DNA, 22 bp, Homo sapiens
ggcctcgcggcttctggtggct

SEQ ID NO: 8284963 - DNA, 22 bp, Homo sapiens
ggcctcctgttggctagtgtga

SEQ ID NO: 8284964 - DNA, 23 bp, Homo sapiens
ggcctcctggtctaggctagact

SEQ ID NO: 8284965 - DNA, 22 bp, Homo sapiens
cactgcactccatcctgggaaa

SEQ ID NO: 8284966 - DNA, 22 bp, Homo sapiens
cactgcagatcagaggctgaga

SEQ ID NO: 8284967 - DNA, 22 bp, Homo sapiens
cactgcagcaccatgcagggct

SEQ ID NO: 8284968 - DNA, 22 bp, Homo sapiens
cactgcagccacatagatgacg

SEQ ID NO: 8284969 - DNA, 22 bp, Homo sapiens
cactgcaggtctgagatggggg

SEQ ID NO: 8284970 - DNA, 23 bp, Homo sapiens
cactgcagcgtggtctggcagga

SEQ ID NO: 8284971 - DNA, 23 bp, Homo sapiens
cactgcagcgtggtctggcagga

SEQ ID NO: 8284972 - DNA, 22 bp, Homo sapiens
ggcctctcattctccctggtcc

SEQ ID NO: 8284973 - DNA, 22 bp, Homo sapiens
ggcctctcatgtcctgggcttc

SEQ ID NO: 8284974 - DNA, 22 bp, Homo sapiens
ggcctctctagcatccagcctg

SEQ ID NO: 8284975 - DNA, 22 bp, Homo sapiens
cactgcactccagcttgggtga

SEQ ID NO: 8284976 - DNA, 22 bp, Homo sapiens
ggcctcgcggcttctggtggct

SEQ ID NO: 8284977 - DNA, 22 bp, Homo sapiens
ggcctctcatgcccagagccaa

SEQ ID NO: 8284978 - DNA, 22 bp, Homo sapiens
cacccacattccatcactctgc

SEQ ID NO: 8284979 - DNA, 22 bp, Homo sapiens
cacccacatggaaattcacagt

SEQ ID NO: 8284980 - DNA, 22 bp, Homo sapiens
ggcagtgtcaaaataggcagaa

SEQ ID NO: 8284981 - DNA, 22 bp, Homo sapiens
cacccagcacagagggaggcga

SEQ ID NO: 8284982 - DNA, 22 bp, Homo sapiens
ggcagtgttccagaccttcacc

SEQ ID NO: 8284983 - DNA, 22 bp, Homo sapiens
ggcagctgattagcatcaagga

SEQ ID NO: 8284984 - DNA, 19 bp, Homo sapiens
ggcagctcttgtcttctgc

SEQ ID NO: 8284985 - DNA, 19 bp, Homo sapiens
ggcagctcttgtcttctgc

SEQ ID NO: 8284986 - DNA, 22 bp, Homo sapiens
ggcagccagagggcagctggat

SEQ ID NO: 8284987 - DNA, 21 bp, Homo sapiens
ggcagctgaccgcgcggtgca

SEQ ID NO: 8284988 - DNA, 22 bp, Homo sapiens
cacccccaggagctccagggac

SEQ ID NO: 8284989 - DNA, 22 bp, Homo sapiens
cacccctacctgagtcaggagt

SEQ ID NO: 8284990 - DNA, 22 bp, Homo sapiens
caccctgctctgctgtgcggcc

SEQ ID NO: 8284991 - DNA, 22 bp, Homo sapiens
ggcactgcttcctgagcctgag

SEQ ID NO: 8284992 - DNA, 22 bp, Homo sapiens
cacagggcagagacctgggtgc

SEQ ID NO: 8284993 - DNA, 22 bp, Homo sapiens
ggcacagggagccgcagttgca

SEQ ID NO: 8284994 - DNA, 22 bp, Homo sapiens
ggcacagggagccgcagttgca

SEQ ID NO: 8284995 - DNA, 22 bp, Homo sapiens
ggcacagggagaggcggatttt

SEQ ID NO: 8284996 - DNA, 22 bp, Homo sapiens
ggcacagggagaggcggatttt

SEQ ID NO: 8284997 - DNA, 22 bp, Homo sapiens
ggcacagggtgatgttgcagtt

SEQ ID NO: 8284998 - DNA, 22 bp, Homo sapiens
ggcacagggaggccctggtgtg

SEQ ID NO: 8284999 - DNA, 22 bp, Homo sapiens
ggcacagggggctgaggactag

SEQ ID NO: 8285000 - DNA, 22 bp, Homo sapiens
ggcacagggaggccctggtgtg

SEQ ID NO: 8285001 - DNA, 22 bp, Homo sapiens
ggcagatggaagaggctgggtc

SEQ ID NO: 8285002 - DNA, 22 bp, Homo sapiens
ggcagcatctctggcagcagct

SEQ ID NO: 8285003 - DNA, 22 bp, Homo sapiens
ggcagccaccctgggaggcaga

SEQ ID NO: 8285004 - DNA, 22 bp, Homo sapiens
ggcagccaccctgggaggcaga

SEQ ID NO: 8285005 - DNA, 22 bp, Homo sapiens
cacagtggctttgctggtctcg

SEQ ID NO: 8285006 - DNA, 22 bp, Homo sapiens
cacagtggctttgctggtctcg

SEQ ID NO: 8285007 - DNA, 21 bp, Homo sapiens
ggcagagctggggcctccagc

SEQ ID NO: 8285008 - DNA, 22 bp, Homo sapiens
ggcagagctgcatgagcactca

SEQ ID NO: 8285009 - DNA, 22 bp, Homo sapiens
ggcagagctagtggcttctctt

SEQ ID NO: 8285010 - DNA, 19 bp, Homo sapiens
ggcagagctcctgctttct

SEQ ID NO: 8285011 - DNA, 22 bp, Homo sapiens
cacactcattagtcatttctct

SEQ ID NO: 8285012 - DNA, 22 bp, Homo sapiens
cacagcttccattagaatgaga

SEQ ID NO: 8285013 - DNA, 20 bp, Homo sapiens
cacagcttgccttttatgac

SEQ ID NO: 8285014 - DNA, 22 bp, Homo sapiens
cacagcttctgagtgaggattt

SEQ ID NO: 8285015 - DNA, 22 bp, Homo sapiens
ggatgggctgaaaggtagcccc

SEQ ID NO: 8285016 - DNA, 22 bp, Homo sapiens
ggatgttctggggttctcttgt

SEQ ID NO: 8285017 - DNA, 19 bp, Homo sapiens
cacagggagaccacatgtc

SEQ ID NO: 8285018 - DNA, 22 bp, Homo sapiens
ggagggagcagagaacccaacc

SEQ ID NO: 8285019 - DNA, 22 bp, Homo sapiens
ggagggagcagagaacccaacc

SEQ ID NO: 8285020 - DNA, 22 bp, Homo sapiens
ggagggagggctagaccaaaga

SEQ ID NO: 8285021 - DNA, 22 bp, Homo sapiens
ggagggagtttcattcctgccc

SEQ ID NO: 8285022 - DNA, 22 bp, Homo sapiens
ggagggagtcagctgattagaa

SEQ ID NO: 8285023 - DNA, 22 bp, Homo sapiens
ggagggagtcagctgattagaa

SEQ ID NO: 8285024 - DNA, 22 bp, Homo sapiens
ggagggaggttagattcaagct

SEQ ID NO: 8285025 - DNA, 22 bp, Homo sapiens
atatgacataaaatcatttttg

SEQ ID NO: 8285026 - DNA, 22 bp, Homo sapiens
atatgacagaatgtgtgtgtat

SEQ ID NO: 8285027 - DNA, 22 bp, Homo sapiens
atatggcagaccaattagaagc

SEQ ID NO: 8285028 - DNA, 22 bp, Homo sapiens
atatggcaaaggggaattaagg

SEQ ID NO: 8285029 - DNA, 22 bp, Homo sapiens
atatttctctcagacatggaag

SEQ ID NO: 8285030 - DNA, 20 bp, Homo sapiens
atatttcttaagaactttca

SEQ ID NO: 8285031 - DNA, 22 bp, Homo sapiens
atatgtattgagtgccaactgt

SEQ ID NO: 8285032 - DNA, 22 bp, Homo sapiens
atatgtactgaaactgcttttc

SEQ ID NO: 8285033 - DNA, 22 bp, Homo sapiens
atatgtatgtacgcacatattc

SEQ ID NO: 8285034 - DNA, 22 bp, Homo sapiens
atatgtatgtacgcacatattc

SEQ ID NO: 8285035 - DNA, 22 bp, Homo sapiens
atatgtacacttacgttacaaa

SEQ ID NO: 8285036 - DNA, 22 bp, Homo sapiens
atatggctgttgcacatctaag

SEQ ID NO: 8285037 - DNA, 22 bp, Homo sapiens
atatatatgctgatggctgcca

SEQ ID NO: 8285038 - DNA, 22 bp, Homo sapiens
atatatattgcccaggctggtt

SEQ ID NO: 8285039 - DNA, 23 bp, Homo sapiens
ctgggcacccagtacctaggccc

SEQ ID NO: 8285040 - DNA, 22 bp, Homo sapiens
ctgggcaccaggcatgacaggg

SEQ ID NO: 8285041 - DNA, 22 bp, Homo sapiens
ctgggcacaggggagcagagtc

SEQ ID NO: 8285042 - DNA, 22 bp, Homo sapiens
ctgggcacaggggagcagagtc

SEQ ID NO: 8285043 - DNA, 22 bp, Homo sapiens
ctgggcacagcgttgggctctt

SEQ ID NO: 8285044 - DNA, 22 bp, Homo sapiens
ctggcagcttagcactctggtt

SEQ ID NO: 8285045 - DNA, 22 bp, Homo sapiens
ctgggaagcttcgagcaggaaa

SEQ ID NO: 8285046 - DNA, 22 bp, Homo sapiens
ctgggaagcttcgagcaggaaa

SEQ ID NO: 8285047 - DNA, 22 bp, Homo sapiens
ctgggaagtagaatcagatgag

SEQ ID NO: 8285048 - DNA, 22 bp, Homo sapiens
atataacatacatacagaaaag

SEQ ID NO: 8285049 - DNA, 19 bp, Homo sapiens
ctgggacaatgaaagcatc

SEQ ID NO: 8285050 - DNA, 20 bp, Homo sapiens
atataataaattttggttac

SEQ ID NO: 8285051 - DNA, 18 bp, Homo sapiens
ctgtcttttttctctcca

SEQ ID NO: 8285052 - DNA, 22 bp, Homo sapiens
ctgtcctccggccacctacagt

SEQ ID NO: 8285053 - DNA, 22 bp, Homo sapiens
ctgtcctcatctgccccaaggg

SEQ ID NO: 8285054 - DNA, 22 bp, Homo sapiens
atcacatatttaagaaacatgt

SEQ ID NO: 8285055 - DNA, 22 bp, Homo sapiens
atcacatatttaagaaacatgt

SEQ ID NO: 8285056 - DNA, 22 bp, Homo sapiens
atcacatatatgcaccaagaca

SEQ ID NO: 8285057 - DNA, 22 bp, Homo sapiens
ctgggtcaaggaatgctggtgg

SEQ ID NO: 8285058 - DNA, 20 bp, Homo sapiens
ctgggtcacttggctgctct

SEQ ID NO: 8285059 - DNA, 22 bp, Homo sapiens
atctacaaaaactgtctcagga

SEQ ID NO: 8285060 - DNA, 22 bp, Homo sapiens
atcctcagtgtttctgacatct

SEQ ID NO: 8285061 - DNA, 23 bp, Homo sapiens
atcctctctccatcccactgtgc

SEQ ID NO: 8285062 - DNA, 22 bp, Homo sapiens
atcctcacatttgggcaggtga

SEQ ID NO: 8285063 - DNA, 22 bp, Homo sapiens
atccctctctgcatgactgtgt

SEQ ID NO: 8285064 - DNA, 20 bp, Homo sapiens
atccctcttcctagagtccc

SEQ ID NO: 8285065 - DNA, 22 bp, Homo sapiens
atccctctgcagctggttcctg

SEQ ID NO: 8285066 - DNA, 22 bp, Homo sapiens
atccccagggagtgagctgtct

SEQ ID NO: 8285067 - DNA, 22 bp, Homo sapiens
atccccagggagtgagctgtct

SEQ ID NO: 8285068 - DNA, 22 bp, Homo sapiens
atccacagagaggaagaatagt

SEQ ID NO: 8285069 - DNA, 22 bp, Homo sapiens
atccacagtcttagccatcaaa

SEQ ID NO: 8285070 - DNA, 22 bp, Homo sapiens
atcattttgtgacaatgcctgt

SEQ ID NO: 8285071 - DNA, 22 bp, Homo sapiens
agtttgtaagttcattatgagt

SEQ ID NO: 8285072 - DNA, 22 bp, Homo sapiens
ctgcagagcaagttctctgttg

SEQ ID NO: 8285073 - DNA, 22 bp, Homo sapiens
ctgcagcctcctccagctacgt

SEQ ID NO: 8285074 - DNA, 22 bp, Homo sapiens
ctgcagctcctgagctcagaga

SEQ ID NO: 8285075 - DNA, 22 bp, Homo sapiens
ctgcagctccttctggcatgtg

SEQ ID NO: 8285076 - DNA, 22 bp, Homo sapiens
ataaatatcactgttgtccctc

SEQ ID NO: 8285077 - DNA, 22 bp, Homo sapiens
ataaatagtgaagggagccggt

SEQ ID NO: 8285078 - DNA, 20 bp, Homo sapiens
ataaaataactgccacaaga

SEQ ID NO: 8285079 - DNA, 22 bp, Homo sapiens
ctgccaaaaggtgcacctgctg

SEQ ID NO: 8285080 - DNA, 21 bp, Homo sapiens
ctgccaggatagcatgcaggc

SEQ ID NO: 8285081 - DNA, 22 bp, Homo sapiens
ctgccaggcagcagagggagaa

SEQ ID NO: 8285082 - DNA, 22 bp, Homo sapiens
ctgccaggcacgtgcagcatca

SEQ ID NO: 8285083 - DNA, 22 bp, Homo sapiens
ataaaagtctgcttatttgggc

SEQ ID NO: 8285084 - DNA, 22 bp, Homo sapiens
ctgccaggcagcagagggagaa

SEQ ID NO: 8285085 - DNA, 22 bp, Homo sapiens
ctgccaggcagggagatggctg

SEQ ID NO: 8285086 - DNA, 22 bp, Homo sapiens
ctgccaggcagggagatggctg

SEQ ID NO: 8285087 - DNA, 20 bp, Homo sapiens
ctgaggtagggcagatcacc

SEQ ID NO: 8285088 - DNA, 22 bp, Homo sapiens
ctgaggcctctctcctgggctt

SEQ ID NO: 8285089 - DNA, 22 bp, Homo sapiens
ctgaggcctctcccactccagc

SEQ ID NO: 8285090 - DNA, 22 bp, Homo sapiens
ctgaggcctctgttcaccagaa

SEQ ID NO: 8285091 - DNA, 22 bp, Homo sapiens
agttgtaagctctcttgctggg

SEQ ID NO: 8285092 - DNA, 22 bp, Homo sapiens
agttgtaagaggcacaaggaag

SEQ ID NO: 8285093 - DNA, 22 bp, Homo sapiens
agttgggtttgtgtcagttgca

SEQ ID NO: 8285094 - DNA, 22 bp, Homo sapiens
agttggtgggtgtgagctggac

SEQ ID NO: 8285095 - DNA, 22 bp, Homo sapiens
agttggtgagcgtgtggtaatc

SEQ ID NO: 8285096 - DNA, 15 bp, Homo sapiens
agttggtgatttcta

SEQ ID NO: 8285097 - DNA, 22 bp, Homo sapiens
ctgaggcctcgttggctggaac

SEQ ID NO: 8285098 - DNA, 22 bp, Homo sapiens
ctgaggcctcactgtagtccct

SEQ ID NO: 8285099 - DNA, 22 bp, Homo sapiens
ctgaggcctaagacatgaatga

SEQ ID NO: 8285100 - DNA, 22 bp, Homo sapiens
agttcttgctataaaaacaaat

SEQ ID NO: 8285101 - DNA, 22 bp, Homo sapiens
ctggagccccagacagggagag

SEQ ID NO: 8285102 - DNA, 22 bp, Homo sapiens
atacaagttaatgagaatgaca

SEQ ID NO: 8285103 - DNA, 22 bp, Homo sapiens
ctggagggctgcagcgaggctg

SEQ ID NO: 8285104 - DNA, 22 bp, Homo sapiens
atactcagctgctagacagaag

SEQ ID NO: 8285105 - DNA, 22 bp, Homo sapiens
atactgaaaaatgatttgctgt

SEQ ID NO: 8285106 - DNA, 22 bp, Homo sapiens
atacttggtggtgttccatagg

SEQ ID NO: 8285107 - DNA, 22 bp, Homo sapiens
atacttctagaaatactatgca

SEQ ID NO: 8285108 - DNA, 22 bp, Homo sapiens
ctgcccagaatcactcactcga

SEQ ID NO: 8285109 - DNA, 22 bp, Homo sapiens
ctgcccacttggccaccttcta

SEQ ID NO: 8285110 - DNA, 22 bp, Homo sapiens
ataaatcagttagtgccccact

SEQ ID NO: 8285111 - DNA, 22 bp, Homo sapiens
ctgcccacagttctctgccatg

SEQ ID NO: 8285112 - DNA, 22 bp, Homo sapiens
ctgcccaccacacctgctcctg

SEQ ID NO: 8285113 - DNA, 22 bp, Homo sapiens
ctgcccactatgttgtcatggg

SEQ ID NO: 8285114 - DNA, 22 bp, Homo sapiens
ataatacatggttaacctcttt

SEQ ID NO: 8285115 - DNA, 22 bp, Homo sapiens
ataatatttgcattactgtgat

SEQ ID NO: 8285116 - DNA, 22 bp, Homo sapiens
ctgcttctagcaccaagtccct

SEQ ID NO: 8285117 - DNA, 22 bp, Homo sapiens
ctgcttctagcaccaagtccct

SEQ ID NO: 8285118 - DNA, 22 bp, Homo sapiens
ctgcttcttttgggtaattgat

SEQ ID NO: 8285119 - DNA, 18 bp, Homo sapiens
ctgcttctgtctgccagt

SEQ ID NO: 8285120 - DNA, 22 bp, Homo sapiens
ctgcttctccctgagatagtgt

SEQ ID NO: 8285121 - DNA, 22 bp, Homo sapiens
ctgcttctgggatgatggagta

SEQ ID NO: 8285122 - DNA, 22 bp, Homo sapiens
atacaagatcactccagaaaat

SEQ ID NO: 8285123 - DNA, 22 bp, Homo sapiens
atacaagtgatataattgtttc

SEQ ID NO: 8285124 - DNA, 22 bp, Homo sapiens
atacaagtcaatccatgtgatt

SEQ ID NO: 8285125 - DNA, 22 bp, Homo sapiens
atacaagactcagcacagacgg

SEQ ID NO: 8285126 - DNA, 20 bp, Homo sapiens
agggtgagacatgagcctcc

SEQ ID NO: 8285127 - DNA, 20 bp, Homo sapiens
agggtgagacatgagcctcc

SEQ ID NO: 8285128 - DNA, 22 bp, Homo sapiens
agggtcttgaggatctgaactg

SEQ ID NO: 8285129 - DNA, 22 bp, Homo sapiens
agggtctcttgccatgcctcag

SEQ ID NO: 8285130 - DNA, 22 bp, Homo sapiens
agggtctctgggagtagggcac

SEQ ID NO: 8285131 - DNA, 22 bp, Homo sapiens
agggtctctggagagctgagga

SEQ ID NO: 8285132 - DNA, 22 bp, Homo sapiens
agggtcagctggctgtcagggg

SEQ ID NO: 8285133 - DNA, 21 bp, Homo sapiens
agggtcctacagggctcagga

SEQ ID NO: 8285134 - DNA, 22 bp, Homo sapiens
cctctctctgcatctggagggc

SEQ ID NO: 8285135 - DNA, 22 bp, Homo sapiens
cctctctctcctgcacacacac

SEQ ID NO: 8285136 - DNA, 22 bp, Homo sapiens
cctctctctcctgcacacacac

SEQ ID NO: 8285137 - DNA, 22 bp, Homo sapiens
cctctctccttcctttgccaaa

SEQ ID NO: 8285138 - DNA, 22 bp, Homo sapiens
cctctctccaattttcacctca

SEQ ID NO: 8285139 - DNA, 22 bp, Homo sapiens
cctctctccaattttcacctca

SEQ ID NO: 8285140 - DNA, 22 bp, Homo sapiens
cctgcccaggagtctctctgtg

SEQ ID NO: 8285141 - DNA, 22 bp, Homo sapiens
cctgcccagggtcaccacagag

SEQ ID NO: 8285142 - DNA, 22 bp, Homo sapiens
cctggcagcccagagcgccgct

SEQ ID NO: 8285143 - DNA, 20 bp, Homo sapiens
cctgctgagccagtgtgagg

SEQ ID NO: 8285144 - DNA, 19 bp, Homo sapiens
cctgctgaagtgatgcagc

SEQ ID NO: 8285145 - DNA, 22 bp, Homo sapiens
cctgggaaggtgaggccctgga

SEQ ID NO: 8285146 - DNA, 21 bp, Homo sapiens
cctggccaatctgatagggtt

SEQ ID NO: 8285147 - DNA, 22 bp, Homo sapiens
cctggcagctcctccccggcgg

SEQ ID NO: 8285148 - DNA, 20 bp, Homo sapiens
cctggccaatgagataggaa

SEQ ID NO: 8285149 - DNA, 22 bp, Homo sapiens
cctggccacagggctctgcatt

SEQ ID NO: 8285150 - DNA, 22 bp, Homo sapiens
cctttgttctgtgtatctttgt

SEQ ID NO: 8285151 - DNA, 22 bp, Homo sapiens
cctttgttcattgccttcagtc

SEQ ID NO: 8285152 - DNA, 22 bp, Homo sapiens
cctttgtgcatctctgctccta

SEQ ID NO: 8285153 - DNA, 22 bp, Homo sapiens
cctttgtatttacctagtctca

SEQ ID NO: 8285154 - DNA, 22 bp, Homo sapiens
cctttgtatacagttcttgtga

SEQ ID NO: 8285155 - DNA, 22 bp, Homo sapiens
ccttttatagatcagtgtgtta

SEQ ID NO: 8285156 - DNA, 22 bp, Homo sapiens
ccttttataaagttgtattgaa

SEQ ID NO: 8285157 - DNA, 20 bp, Homo sapiens
cgaggccaaggggctgggcc

SEQ ID NO: 8285158 - DNA, 22 bp, Homo sapiens
cgaggccacacctgcttctggg

SEQ ID NO: 8285159 - DNA, 22 bp, Homo sapiens
cggaggggatacattttctgaa

SEQ ID NO: 8285160 - DNA, 22 bp, Homo sapiens
cggaggggtttgaacagaggag

SEQ ID NO: 8285161 - DNA, 22 bp, Homo sapiens
agtatattgctcttaatcatag

SEQ ID NO: 8285162 - DNA, 22 bp, Homo sapiens
agtatatatgaggaaccacaaa

SEQ ID NO: 8285163 - DNA, 22 bp, Homo sapiens
agtatattggtgttattcctca

SEQ ID NO: 8285164 - DNA, 22 bp, Homo sapiens
agtatatttgttaagattattc

SEQ ID NO: 8285165 - DNA, 22 bp, Homo sapiens
cggcgttggagcgggctttggt

SEQ ID NO: 8285166 - DNA, 22 bp, Homo sapiens
cggccaagccggggccccgaag

SEQ ID NO: 8285167 - DNA, 22 bp, Homo sapiens
aggtgccagctctcaggcagga

SEQ ID NO: 8285168 - DNA, 22 bp, Homo sapiens
aggtgcctatctggtctctgca

SEQ ID NO: 8285169 - DNA, 22 bp, Homo sapiens
cctgggacctcgcgggaagcgg

SEQ ID NO: 8285170 - DNA, 22 bp, Homo sapiens
cctgggaagtggaggttacagt

SEQ ID NO: 8285171 - DNA, 22 bp, Homo sapiens
cctgggaagttgtggctgcagt

SEQ ID NO: 8285172 - DNA, 22 bp, Homo sapiens
cctgggaatcggtgcgttgagg

SEQ ID NO: 8285173 - DNA, 22 bp, Homo sapiens
cctgggaatctgcattgtcagc

SEQ ID NO: 8285174 - DNA, 22 bp, Homo sapiens
cctgggaatgatgaccttgcct

SEQ ID NO: 8285175 - DNA, 22 bp, Homo sapiens
aggtggctctgacagctctggt

SEQ ID NO: 8285176 - DNA, 22 bp, Homo sapiens
ccttggccctagcctcaggcaa

SEQ ID NO: 8285177 - DNA, 22 bp, Homo sapiens
ccttggcaaaccagggcagctg

SEQ ID NO: 8285178 - DNA, 22 bp, Homo sapiens
ccttggcatcctctgaagaaat

SEQ ID NO: 8285179 - DNA, 22 bp, Homo sapiens
ccttggcaggggagaaatatat

SEQ ID NO: 8285180 - DNA, 22 bp, Homo sapiens
ccttgctcatcccccagtgcct

SEQ ID NO: 8285181 - DNA, 21 bp, Homo sapiens
aggtgggagaccatgtaggtc

SEQ ID NO: 8285182 - DNA, 21 bp, Homo sapiens
aggtggctgcatcctcagaag

SEQ ID NO: 8285183 - DNA, 22 bp, Homo sapiens
ctcaaactgtgcttgtaaattc

SEQ ID NO: 8285184 - DNA, 22 bp, Homo sapiens
ctcaaatagaactgatctataa

SEQ ID NO: 8285185 - DNA, 22 bp, Homo sapiens
ctcaaatacctctccatgtgac

SEQ ID NO: 8285186 - DNA, 22 bp, Homo sapiens
ctcaaatatgtggtcagaaagc

SEQ ID NO: 8285187 - DNA, 22 bp, Homo sapiens
ctcaagaaggatgagctattgc

SEQ ID NO: 8285188 - DNA, 22 bp, Homo sapiens
cggggttcatccatgctgtggc

SEQ ID NO: 8285189 - DNA, 22 bp, Homo sapiens
ctcagaagccttcagtcttggc

SEQ ID NO: 8285190 - DNA, 22 bp, Homo sapiens
ctcagaagaatcagcagctatt

SEQ ID NO: 8285191 - DNA, 22 bp, Homo sapiens
ctcaccatatgactttactaac

SEQ ID NO: 8285192 - DNA, 22 bp, Homo sapiens
ctcagataatctttgagtcttc

SEQ ID NO: 8285193 - DNA, 22 bp, Homo sapiens
ctcagagggtctcctccagaat

SEQ ID NO: 8285194 - DNA, 22 bp, Homo sapiens
ctccactctggggtgggtgaga

SEQ ID NO: 8285195 - DNA, 22 bp, Homo sapiens
ctccagagagaaaggaggccgc

SEQ ID NO: 8285196 - DNA, 22 bp, Homo sapiens
ctccagagacacttctcatgat

SEQ ID NO: 8285197 - DNA, 22 bp, Homo sapiens
ctccagagacacttctcatgat

SEQ ID NO: 8285198 - DNA, 22 bp, Homo sapiens
ctccactcaggtgcttaagttg

SEQ ID NO: 8285199 - DNA, 22 bp, Homo sapiens
ctccactcaccgaggcagagca

SEQ ID NO: 8285200 - DNA, 20 bp, Homo sapiens
agtgacagagactgtgtggc

SEQ ID NO: 8285201 - DNA, 22 bp, Homo sapiens
ctcagtggttgagagcctgggc

SEQ ID NO: 8285202 - DNA, 22 bp, Homo sapiens
ctcagctacttgggaagcttag

SEQ ID NO: 8285203 - DNA, 19 bp, Homo sapiens
agtctcagtgtacagaggc

SEQ ID NO: 8285204 - DNA, 22 bp, Homo sapiens
ctcagggaggcctctgctggtt

SEQ ID NO: 8285205 - DNA, 22 bp, Homo sapiens
ctcagggaggtcctgtgctgaa

SEQ ID NO: 8285206 - DNA, 22 bp, Homo sapiens
ctcagggacggaggcttgcgga

SEQ ID NO: 8285207 - DNA, 21 bp, Homo sapiens
ctcttgctgatgtctccttta

SEQ ID NO: 8285208 - DNA, 22 bp, Homo sapiens
ctcttgtattggagttagtggg

SEQ ID NO: 8285209 - DNA, 22 bp, Homo sapiens
agtggtgcaaactggggcagct

SEQ ID NO: 8285210 - DNA, 22 bp, Homo sapiens
agtgggagaatgaataagggcc

SEQ ID NO: 8285211 - DNA, 22 bp, Homo sapiens
agtggctgtttataggtgggta

SEQ ID NO: 8285212 - DNA, 22 bp, Homo sapiens
agtggctgttccaggtgaggac

SEQ ID NO: 8285213 - DNA, 22 bp, Homo sapiens
agtggctgttcattttacacaa

SEQ ID NO: 8285214 - DNA, 22 bp, Homo sapiens
agtggctgtgaaatacatggga

SEQ ID NO: 8285215 - DNA, 22 bp, Homo sapiens
ctctctccttagctgcagacca

SEQ ID NO: 8285216 - DNA, 20 bp, Homo sapiens
ctctctccatctcagtggcc

SEQ ID NO: 8285217 - DNA, 19 bp, Homo sapiens
ctctctccagtggctggct

SEQ ID NO: 8285218 - DNA, 19 bp, Homo sapiens
ctctctccagtggctggct

SEQ ID NO: 8285219 - DNA, 22 bp, Homo sapiens
ctctccagttatagctgatttg

SEQ ID NO: 8285220 - DNA, 22 bp, Homo sapiens
ctctccatctgtgtgacctccc

SEQ ID NO: 8285221 - DNA, 22 bp, Homo sapiens
ctctcgccagcggggctgcgct

SEQ ID NO: 8285222 - DNA, 22 bp, Homo sapiens
ctctctcagtgtaatacaggat

SEQ ID NO: 8285223 - DNA, 22 bp, Homo sapiens
ctctctagaggcccaccttgag

SEQ ID NO: 8285224 - DNA, 22 bp, Homo sapiens
ctctcctttcactaaatattct

SEQ ID NO: 8285225 - DNA, 20 bp, Homo sapiens
ctctcccagcacagcttcct

SEQ ID NO: 8285226 - DNA, 22 bp, Homo sapiens
ctctcccagtcaggctcaggat

SEQ ID NO: 8285227 - DNA, 20 bp, Homo sapiens
ctctcccagcacagcttcct

SEQ ID NO: 8285228 - DNA, 22 bp, Homo sapiens
ctctccccacaccctctgcatg

SEQ ID NO: 8285229 - DNA, 22 bp, Homo sapiens
ctctcccagtcaggctcaggat

SEQ ID NO: 8285230 - DNA, 22 bp, Homo sapiens
ctcctgagtagtagcattgtca

SEQ ID NO: 8285231 - DNA, 22 bp, Homo sapiens
ctcctggttcagagagctgaga

SEQ ID NO: 8285232 - DNA, 22 bp, Homo sapiens
ctcctggtgctggggctgccgc

SEQ ID NO: 8285233 - DNA, 22 bp, Homo sapiens
ctcctggtgctggggctgccgc

SEQ ID NO: 8285234 - DNA, 22 bp, Homo sapiens
agtgctgagtgattgcaaagga

SEQ ID NO: 8285235 - DNA, 22 bp, Homo sapiens
ctccagagagtccagctctggg

SEQ ID NO: 8285236 - DNA, 22 bp, Homo sapiens
agtgctgactctgggcacagtg

SEQ ID NO: 8285237 - DNA, 22 bp, Homo sapiens
agtgctatcgagttctaatgct

SEQ ID NO: 8285238 - DNA, 22 bp, Homo sapiens
agtgctatcgagttctaatgct

SEQ ID NO: 8285239 - DNA, 22 bp, Homo sapiens
aggctccattccaggagctaga

SEQ ID NO: 8285240 - DNA, 22 bp, Homo sapiens
ccaggctctatccctccttctt

SEQ ID NO: 8285241 - DNA, 22 bp, Homo sapiens
ccaggctctgagcctcactctt

SEQ ID NO: 8285242 - DNA, 22 bp, Homo sapiens
ccaggctctgccaggcccttga

SEQ ID NO: 8285243 - DNA, 22 bp, Homo sapiens
aggctccatgctaagcgatatg

SEQ ID NO: 8285244 - DNA, 22 bp, Homo sapiens
aggctccacggcaggatgctgt

SEQ ID NO: 8285245 - DNA, 22 bp, Homo sapiens
ccaggcccgttcccttctccag

SEQ ID NO: 8285246 - DNA, 22 bp, Homo sapiens
ccaggcccttgcaagtcccacc

SEQ ID NO: 8285247 - DNA, 22 bp, Homo sapiens
aggcctctctgcttagcttgta

SEQ ID NO: 8285248 - DNA, 17 bp, Homo sapiens
aggcctccctccaggcc

SEQ ID NO: 8285249 - DNA, 23 bp, Homo sapiens
ccagtgagcatggctgtgttcca

SEQ ID NO: 8285250 - DNA, 22 bp, Homo sapiens
ccagtgagatatctgggcatta

SEQ ID NO: 8285251 - DNA, 22 bp, Homo sapiens
ccagtgcacaatggaacaactc

SEQ ID NO: 8285252 - DNA, 22 bp, Homo sapiens
aggctgagcggggtcccagagc

SEQ ID NO: 8285253 - DNA, 22 bp, Homo sapiens
aggctgaggcaggtggatcatt

SEQ ID NO: 8285254 - DNA, 22 bp, Homo sapiens
aggctgaggcaggtggatcact

SEQ ID NO: 8285255 - DNA, 22 bp, Homo sapiens
aggctctgagtctggtgtctgc

SEQ ID NO: 8285256 - DNA, 22 bp, Homo sapiens
aggctctgagtagagctgccag

SEQ ID NO: 8285257 - DNA, 22 bp, Homo sapiens
aggctctgatcaggtggctgtg

SEQ ID NO: 8285258 - DNA, 19 bp, Homo sapiens
aggctctgagctcctggag

SEQ ID NO: 8285259 - DNA, 22 bp, Homo sapiens
aggctctgcagaccccagctgt

SEQ ID NO: 8285260 - DNA, 22 bp, Homo sapiens
aggctctgcaggtatttcttga

SEQ ID NO: 8285261 - DNA, 22 bp, Homo sapiens
aggctctgatgcaagcccaggg

SEQ ID NO: 8285262 - DNA, 22 bp, Homo sapiens
aggctctgcatccaggctttat

SEQ ID NO: 8285263 - DNA, 22 bp, Homo sapiens
aggctctgcagtgctggaggac

SEQ ID NO: 8285264 - DNA, 20 bp, Homo sapiens
aggctctgcatttctgagtg

SEQ ID NO: 8285265 - DNA, 20 bp, Homo sapiens
aggctctgccattgtccctg

SEQ ID NO: 8285266 - DNA, 22 bp, Homo sapiens
aggctctgccaattccttcctc

SEQ ID NO: 8285267 - DNA, 22 bp, Homo sapiens
aggctctgttattctagagggc

SEQ ID NO: 8285268 - DNA, 20 bp, Homo sapiens
aggctctgcctgcaggccca

SEQ ID NO: 8285269 - DNA, 22 bp, Homo sapiens
aggctgagataggtggatcatt

SEQ ID NO: 8285270 - DNA, 22 bp, Homo sapiens
aggcattgaggcggatgtggct

SEQ ID NO: 8285271 - DNA, 22 bp, Homo sapiens
aggcatgttaatcatcttaaaa

SEQ ID NO: 8285272 - DNA, 20 bp, Homo sapiens
aggcatgtcccagtttctcc

SEQ ID NO: 8285273 - DNA, 22 bp, Homo sapiens
ccactggcttttcctaggtctc

SEQ ID NO: 8285274 - DNA, 22 bp, Homo sapiens
ccactgctcctgaccaaggtca

SEQ ID NO: 8285275 - DNA, 23 bp, Homo sapiens
ccactgctttcattttgtcatgg

SEQ ID NO: 8285276 - DNA, 22 bp, Homo sapiens
ccactggcatccagctgccatc

SEQ ID NO: 8285277 - DNA, 22 bp, Homo sapiens
aggcatctctctgcttctgagc

SEQ ID NO: 8285278 - DNA, 21 bp, Homo sapiens
aggcatctaaagagagtagac

SEQ ID NO: 8285279 - DNA, 22 bp, Homo sapiens
aggcatctaacagagatcttta

SEQ ID NO: 8285280 - DNA, 22 bp, Homo sapiens
aggcatctgctgcccttctgga

SEQ ID NO: 8285281 - DNA, 22 bp, Homo sapiens
aggcatctgagtttgcaagctt

SEQ ID NO: 8285282 - DNA, 22 bp, Homo sapiens
aggcatctgcctcctctacccc

SEQ ID NO: 8285283 - DNA, 22 bp, Homo sapiens
aggcatctgcagagcttggtga

SEQ ID NO: 8285284 - DNA, 20 bp, Homo sapiens
aggcatctgagtcacatctt

SEQ ID NO: 8285285 - DNA, 22 bp, Homo sapiens
aggcagtgcctggaccccagct

SEQ ID NO: 8285286 - DNA, 22 bp, Homo sapiens
aggcagtgagtgtgacttcaca

SEQ ID NO: 8285287 - DNA, 22 bp, Homo sapiens
aggcagccatctgcaggaagga

SEQ ID NO: 8285288 - DNA, 22 bp, Homo sapiens
aggccaaagcaagaccctgtaa

SEQ ID NO: 8285289 - DNA, 22 bp, Homo sapiens
aggcattttgttcaagatgaca

SEQ ID NO: 8285290 - DNA, 22 bp, Homo sapiens
aggccaaatgtgtataaaacat

SEQ ID NO: 8285291 - DNA, 22 bp, Homo sapiens
aggccaagtgctgggacaggtg

SEQ ID NO: 8285292 - DNA, 22 bp, Homo sapiens
aggccagctatgactctgctcc

SEQ ID NO: 8285293 - DNA, 22 bp, Homo sapiens
aggccagcgctgctagctcccg

SEQ ID NO: 8285294 - DNA, 22 bp, Homo sapiens
aggccagctcaccctggctcct

SEQ ID NO: 8285295 - DNA, 22 bp, Homo sapiens
aggccctgaagtcggcccctca

SEQ ID NO: 8285296 - DNA, 22 bp, Homo sapiens
cctcaagatgcactgaacatat

SEQ ID NO: 8285297 - DNA, 22 bp, Homo sapiens
cccttcagctgagtgggacagc

SEQ ID NO: 8285298 - DNA, 22 bp, Homo sapiens
cccttcagggttaagtagaggg

SEQ ID NO: 8285299 - DNA, 22 bp, Homo sapiens
ccctgttaatgtcaacctgcct

SEQ ID NO: 8285300 - DNA, 22 bp, Homo sapiens
cctcccatccctgcaagagagc

SEQ ID NO: 8285301 - DNA, 22 bp, Homo sapiens
cctctccttgcacccgtcccgc

SEQ ID NO: 8285302 - DNA, 22 bp, Homo sapiens
cctccaggataagtcagggcct

SEQ ID NO: 8285303 - DNA, 20 bp, Homo sapiens
cctccaggcacacccatgtg

SEQ ID NO: 8285304 - DNA, 20 bp, Homo sapiens
cctccaggcacacccatgtg

SEQ ID NO: 8285305 - DNA, 22 bp, Homo sapiens
cctccaggccttgcaggttaac

SEQ ID NO: 8285306 - DNA, 22 bp, Homo sapiens
cctccaggctgaatatctagaa

SEQ ID NO: 8285307 - DNA, 22 bp, Homo sapiens
cctccaggccttgcaggttaac

SEQ ID NO: 8285308 - DNA, 22 bp, Homo sapiens
cctccaggctgaatatctagaa

SEQ ID NO: 8285309 - DNA, 22 bp, Homo sapiens
cctcccaggcattgccattttc

SEQ ID NO: 8285310 - DNA, 22 bp, Homo sapiens
cctccaggaacttgagagacac

SEQ ID NO: 8285311 - DNA, 22 bp, Homo sapiens
cctccagctgcctcagtctctt

SEQ ID NO: 8285312 - DNA, 22 bp, Homo sapiens
cctccaggaacttgagagacac

SEQ ID NO: 8285313 - DNA, 21 bp, Homo sapiens
cctccaggagcagagccctga

SEQ ID NO: 8285314 - DNA, 21 bp, Homo sapiens
cctccaggagcagagccctga

SEQ ID NO: 8285315 - DNA, 22 bp, Homo sapiens
agggcagccatgagccttcagg

SEQ ID NO: 8285316 - DNA, 22 bp, Homo sapiens
agggcagcagctcctcctagct

SEQ ID NO: 8285317 - DNA, 22 bp, Homo sapiens
agggccagccccaccctctctg

SEQ ID NO: 8285318 - DNA, 22 bp, Homo sapiens
agggccagggaaacgatcagca

SEQ ID NO: 8285319 - DNA, 22 bp, Homo sapiens
ccctggcccctcactccgaggc

SEQ ID NO: 8285320 - DNA, 18 bp, Homo sapiens
agggccagctgtgagtag

SEQ ID NO: 8285321 - DNA, 22 bp, Homo sapiens
agggagcatgggtgaagcaggc

SEQ ID NO: 8285322 - DNA, 21 bp, Homo sapiens
agggagcatgttagctttcga

SEQ ID NO: 8285323 - DNA, 22 bp, Homo sapiens
agggagccaggaacgcaggtcg

SEQ ID NO: 8285324 - DNA, 22 bp, Homo sapiens
agggagccagagttgggagctc

SEQ ID NO: 8285325 - DNA, 22 bp, Homo sapiens
agggagccctgaaccagagggt

SEQ ID NO: 8285326 - DNA, 22 bp, Homo sapiens
agggagcaaaggtttcagggtt

SEQ ID NO: 8285327 - DNA, 22 bp, Homo sapiens
agggagctttttcatgtgtcta

SEQ ID NO: 8285328 - DNA, 22 bp, Homo sapiens
ccccatgaagtagggtctctga

SEQ ID NO: 8285329 - DNA, 22 bp, Homo sapiens
ccccatgaagtagggtctctga

SEQ ID NO: 8285330 - DNA, 22 bp, Homo sapiens
ccccagggtcagtgtgtggagg

SEQ ID NO: 8285331 - DNA, 22 bp, Homo sapiens
agggaagaatcactgggatgtt

SEQ ID NO: 8285332 - DNA, 22 bp, Homo sapiens
agggagaatgaccaaggtatat

SEQ ID NO: 8285333 - DNA, 22 bp, Homo sapiens
ccataaggagccagacattcca

SEQ ID NO: 8285334 - DNA, 22 bp, Homo sapiens
ccatctccactgtccctgtcaa

SEQ ID NO: 8285335 - DNA, 22 bp, Homo sapiens
ccatctccagtttattcttcct

SEQ ID NO: 8285336 - DNA, 22 bp, Homo sapiens
ccatgcaacagaatccagattt

SEQ ID NO: 8285337 - DNA, 22 bp, Homo sapiens
ccatgcaaagaatgtgggcata

SEQ ID NO: 8285338 - DNA, 22 bp, Homo sapiens
cccagcatcctcagggagcggg

SEQ ID NO: 8285339 - DNA, 22 bp, Homo sapiens
cccagcatcccagtgggcagca

SEQ ID NO: 8285340 - DNA, 22 bp, Homo sapiens
cccagcagtggttctcaaactt

SEQ ID NO: 8285341 - DNA, 22 bp, Homo sapiens
cccagcagttgttggtgcacat

SEQ ID NO: 8285342 - DNA, 22 bp, Homo sapiens
cccagcagtttgcttagagtga

SEQ ID NO: 8285343 - DNA, 22 bp, Homo sapiens
cccagcagtagagctcatatgg

SEQ ID NO: 8285344 - DNA, 22 bp, Homo sapiens
cccagcagtacccaagcccttg

SEQ ID NO: 8285345 - DNA, 22 bp, Homo sapiens
cccagcagtgacccagtgatac

SEQ ID NO: 8285346 - DNA, 22 bp, Homo sapiens
cccagcagtaaccagtggaaat

SEQ ID NO: 8285347 - DNA, 22 bp, Homo sapiens
cccagcagtaaccagtggaaat

SEQ ID NO: 8285348 - DNA, 22 bp, Homo sapiens
ccatgcaatatatatcctcaag

SEQ ID NO: 8285349 - DNA, 22 bp, Homo sapiens
ccatgcaatatatatcctcaag

SEQ ID NO: 8285350 - DNA, 22 bp, Homo sapiens
ccatgcaatttctgtaaaacca

SEQ ID NO: 8285351 - DNA, 22 bp, Homo sapiens
ccatgcaaggagaactctcact

SEQ ID NO: 8285352 - DNA, 22 bp, Homo sapiens
ccatgcaagggtctggtcctgc

SEQ ID NO: 8285353 - DNA, 22 bp, Homo sapiens
ccatgcaaggagaactctcact

SEQ ID NO: 8285354 - DNA, 22 bp, Homo sapiens
ccatgcaagaagtccaaccatc

SEQ ID NO: 8285355 - DNA, 22 bp, Homo sapiens
cccagctccttggatgggcagg

SEQ ID NO: 8285356 - DNA, 22 bp, Homo sapiens
cccagctccttggatgggcagg

SEQ ID NO: 8285357 - DNA, 22 bp, Homo sapiens
cccagctccttgtttgcatctc

SEQ ID NO: 8285358 - DNA, 22 bp, Homo sapiens
cccagctctgcagacctgccct

SEQ ID NO: 8285359 - DNA, 22 bp, Homo sapiens
cccagctctgcagacctgccct

SEQ ID NO: 8285360 - DNA, 22 bp, Homo sapiens
cccagctctggaaggtggggga

SEQ ID NO: 8285361 - DNA, 22 bp, Homo sapiens
cccagctctggaaggtggggga

SEQ ID NO: 8285362 - DNA, 22 bp, Homo sapiens
cccagctctgccatctacccac

SEQ ID NO: 8285363 - DNA, 22 bp, Homo sapiens
cccagctctcgcacttactagc

SEQ ID NO: 8285364 - DNA, 22 bp, Homo sapiens
cccagctctctgctcttagcct

SEQ ID NO: 8285365 - DNA, 22 bp, Homo sapiens
cccagctctctgctcttagcct

SEQ ID NO: 8285366 - DNA, 22 bp, Homo sapiens
cccagctctctcagttctgctt

SEQ ID NO: 8285367 - DNA, 22 bp, Homo sapiens
aggctgtgttctgccctctccc

SEQ ID NO: 8285368 - DNA, 21 bp, Homo sapiens
cagcttcttctgtgacctggt

SEQ ID NO: 8285369 - DNA, 22 bp, Homo sapiens
cagcttctgctcatggaggggt

SEQ ID NO: 8285370 - DNA, 22 bp, Homo sapiens
cagcttctgtttattgtgtgcc

SEQ ID NO: 8285371 - DNA, 22 bp, Homo sapiens
cagcttctgtttattgtgtgcc

SEQ ID NO: 8285372 - DNA, 22 bp, Homo sapiens
cagcttctggcgtggagcctga

SEQ ID NO: 8285373 - DNA, 22 bp, Homo sapiens
cagctctgaagaaaggtgtcta

SEQ ID NO: 8285374 - DNA, 22 bp, Homo sapiens
cagctctcacaccctcctccca

SEQ ID NO: 8285375 - DNA, 22 bp, Homo sapiens
cagctctccaccctcctggttc

SEQ ID NO: 8285376 - DNA, 22 bp, Homo sapiens
agctctcttgtgttctgtatgg

SEQ ID NO: 8285377 - DNA, 22 bp, Homo sapiens
agctctcccaccttcttcttac

SEQ ID NO: 8285378 - DNA, 18 bp, Homo sapiens
agctctcccccacatgcc

SEQ ID NO: 8285379 - DNA, 22 bp, Homo sapiens
agctctggaactcccggctgct

SEQ ID NO: 8285380 - DNA, 22 bp, Homo sapiens
agctctggaagccctggtagtt

SEQ ID NO: 8285381 - DNA, 22 bp, Homo sapiens
agctgaggctctgagagggaag

SEQ ID NO: 8285382 - DNA, 22 bp, Homo sapiens
agctgaggctctgagagggaag

SEQ ID NO: 8285383 - DNA, 22 bp, Homo sapiens
agctgcaggcccatgctcagtc

SEQ ID NO: 8285384 - DNA, 21 bp, Homo sapiens
agctgcagccatgtacatggc

SEQ ID NO: 8285385 - DNA, 23 bp, Homo sapiens
agctgaggcagaggggcattctc

SEQ ID NO: 8285386 - DNA, 23 bp, Homo sapiens
cagcttctttgggattctttata

SEQ ID NO: 8285387 - DNA, 22 bp, Homo sapiens
agctgaggccacgagtgaaggg

SEQ ID NO: 8285388 - DNA, 22 bp, Homo sapiens
agctgaggcatggacaggctgc

SEQ ID NO: 8285389 - DNA, 22 bp, Homo sapiens
agctgcaggcctctcctgggga

SEQ ID NO: 8285390 - DNA, 22 bp, Homo sapiens
agctgcaggttcagcattccac

SEQ ID NO: 8285391 - DNA, 22 bp, Homo sapiens
agctgcagggcttgggtttccc

SEQ ID NO: 8285392 - DNA, 22 bp, Homo sapiens
cagcttttaggactgtgagaaa

SEQ ID NO: 8285393 - DNA, 22 bp, Homo sapiens
cagctttgtggccttgacctcg

SEQ ID NO: 8285394 - DNA, 22 bp, Homo sapiens
cagctttgtgacttcggacaag

SEQ ID NO: 8285395 - DNA, 22 bp, Homo sapiens
cagctttgtgcaatgcagtctc

SEQ ID NO: 8285396 - DNA, 22 bp, Homo sapiens
cagctttgtgcaatgcagtctc

SEQ ID NO: 8285397 - DNA, 22 bp, Homo sapiens
cagctttgtggccttgacctcg

SEQ ID NO: 8285398 - DNA, 21 bp, Homo sapiens
cagctttgtctgtcttcgggg

SEQ ID NO: 8285399 - DNA, 22 bp, Homo sapiens
cagctttgtgacttcggacaag

SEQ ID NO: 8285400 - DNA, 21 bp, Homo sapiens
cagctttgtctgtcttcgggg

SEQ ID NO: 8285401 - DNA, 22 bp, Homo sapiens
cagctttggcccagtcgggagg

SEQ ID NO: 8285402 - DNA, 22 bp, Homo sapiens
cagctttggcccagtcgggagg

SEQ ID NO: 8285403 - DNA, 22 bp, Homo sapiens
cagctttggagtgtgagtgctg

SEQ ID NO: 8285404 - DNA, 22 bp, Homo sapiens
cagctttggagtgtgagtgctg

SEQ ID NO: 8285405 - DNA, 22 bp, Homo sapiens
cagctttgtcatttgatttggg

SEQ ID NO: 8285406 - DNA, 22 bp, Homo sapiens
cagctttgtcctgcaaacctga

SEQ ID NO: 8285407 - DNA, 22 bp, Homo sapiens
cagctttgtcctgcaaacctga

SEQ ID NO: 8285408 - DNA, 22 bp, Homo sapiens
cagctttgtcatttgatttggg

SEQ ID NO: 8285409 - DNA, 16 bp, Homo sapiens
cagctttgtctcctcg

SEQ ID NO: 8285410 - DNA, 22 bp, Homo sapiens
cagctttgtctgattcctcttt

SEQ ID NO: 8285411 - DNA, 22 bp, Homo sapiens
cagctttgtctgattcctcttt

SEQ ID NO: 8285412 - DNA, 16 bp, Homo sapiens
cagctttgtctcctcg

SEQ ID NO: 8285413 - DNA, 22 bp, Homo sapiens
cagctttgccctttgcccaatc

SEQ ID NO: 8285414 - DNA, 22 bp, Homo sapiens
cagctttgccaagtaaggtctt

SEQ ID NO: 8285415 - DNA, 22 bp, Homo sapiens
cagctttgccctttgcccaatc

SEQ ID NO: 8285416 - DNA, 22 bp, Homo sapiens
cagctttgcaggctggtcagtg

SEQ ID NO: 8285417 - DNA, 22 bp, Homo sapiens
cagctttgccaagtaaggtctt

SEQ ID NO: 8285418 - DNA, 22 bp, Homo sapiens
cagctttgcaggctggtcagtg

SEQ ID NO: 8285419 - DNA, 22 bp, Homo sapiens
cagctttgattctttctgccat

SEQ ID NO: 8285420 - DNA, 22 bp, Homo sapiens
agctggaggataactcacttct

SEQ ID NO: 8285421 - DNA, 22 bp, Homo sapiens
caggacagaaataaggaatata

SEQ ID NO: 8285422 - DNA, 22 bp, Homo sapiens
caggacagacagaatgcctaac

SEQ ID NO: 8285423 - DNA, 22 bp, Homo sapiens
caggacagacagaatgcctaac

SEQ ID NO: 8285424 - DNA, 22 bp, Homo sapiens
caggacagaccaagatcgtgct

SEQ ID NO: 8285425 - DNA, 19 bp, Homo sapiens
caggacagacttcaaagcc

SEQ ID NO: 8285426 - DNA, 22 bp, Homo sapiens
agctgctgagccaggctgatgt

SEQ ID NO: 8285427 - DNA, 22 bp, Homo sapiens
caggagggtgtggaaaactggg

SEQ ID NO: 8285428 - DNA, 22 bp, Homo sapiens
agctggctggccccttcctgcc

SEQ ID NO: 8285429 - DNA, 19 bp, Homo sapiens
agctggctcttctttgtct

SEQ ID NO: 8285430 - DNA, 22 bp, Homo sapiens
agctggcttctctgcagacatt

SEQ ID NO: 8285431 - DNA, 22 bp, Homo sapiens
agctggcttcacaggcagtgtg

SEQ ID NO: 8285432 - DNA, 22 bp, Homo sapiens
agctggctgggtgccagtctcc

SEQ ID NO: 8285433 - DNA, 22 bp, Homo sapiens
agctggctttgagctgggaggt

SEQ ID NO: 8285434 - DNA, 22 bp, Homo sapiens
agctggctttatggttggctaa

SEQ ID NO: 8285435 - DNA, 22 bp, Homo sapiens
aggaaaggggtaggtgtggacg

SEQ ID NO: 8285436 - DNA, 22 bp, Homo sapiens
cagggccagcgtctcgggctat

SEQ ID NO: 8285437 - DNA, 22 bp, Homo sapiens
aggaaataggaccagacaaagc

SEQ ID NO: 8285438 - DNA, 22 bp, Homo sapiens
aggaacagaagagcaatgcagg

SEQ ID NO: 8285439 - DNA, 20 bp, Homo sapiens
aggaactggaagggaggaaa

SEQ ID NO: 8285440 - DNA, 22 bp, Homo sapiens
aggaagctcggagagggcaaat

SEQ ID NO: 8285441 - DNA, 22 bp, Homo sapiens
aggaagctcctggagagccagt

SEQ ID NO: 8285442 - DNA, 22 bp, Homo sapiens
aggaagctccatgaaggcagag

SEQ ID NO: 8285443 - DNA, 22 bp, Homo sapiens
aggaagctccatgaaggcagag

SEQ ID NO: 8285444 - DNA, 22 bp, Homo sapiens
agcttgttttgttgaatactta

SEQ ID NO: 8285445 - DNA, 18 bp, Homo sapiens
agcttgtttttgccttct

SEQ ID NO: 8285446 - DNA, 22 bp, Homo sapiens
agctttagaatgatgcttttgc

SEQ ID NO: 8285447 - DNA, 18 bp, Homo sapiens
aggaaagacgaagagggc

SEQ ID NO: 8285448 - DNA, 21 bp, Homo sapiens
aggaaaggaagtccccagggt

SEQ ID NO: 8285449 - DNA, 22 bp, Homo sapiens
aggaaagctcccagtagggctc

SEQ ID NO: 8285450 - DNA, 22 bp, Homo sapiens
cagggccagccatcctgctggg

SEQ ID NO: 8285451 - DNA, 22 bp, Homo sapiens
cagggccagagagggctggctg

SEQ ID NO: 8285452 - DNA, 22 bp, Homo sapiens
agctgttgcagggatcagcacc

SEQ ID NO: 8285453 - DNA, 22 bp, Homo sapiens
agctgtgtttccagatggtagc

SEQ ID NO: 8285454 - DNA, 22 bp, Homo sapiens
agctgttggagtaaagcactta

SEQ ID NO: 8285455 - DNA, 22 bp, Homo sapiens
agctgtgtggtgtctgacagct

SEQ ID NO: 8285456 - DNA, 23 bp, Homo sapiens
agctgtgtggccttgggcaagtt

SEQ ID NO: 8285457 - DNA, 22 bp, Homo sapiens
agctgtgtgtgcttgggattat

SEQ ID NO: 8285458 - DNA, 22 bp, Homo sapiens
agctgtgtggtttgggcaaatt

SEQ ID NO: 8285459 - DNA, 22 bp, Homo sapiens
agctgttgttaattaactcatt

SEQ ID NO: 8285460 - DNA, 22 bp, Homo sapiens
agcttctgttcatcttccaggc

SEQ ID NO: 8285461 - DNA, 22 bp, Homo sapiens
agcttcttaagttcctgcagca

SEQ ID NO: 8285462 - DNA, 22 bp, Homo sapiens
agctgtttttccagtctctgga

SEQ ID NO: 8285463 - DNA, 22 bp, Homo sapiens
agcttggtgttgcctgcttgag

SEQ ID NO: 8285464 - DNA, 22 bp, Homo sapiens
agcttggtggccctcctggctg

SEQ ID NO: 8285465 - DNA, 22 bp, Homo sapiens
caggcctcagagagtggcgggg

SEQ ID NO: 8285466 - DNA, 22 bp, Homo sapiens
caggcctcagggctgtccgtag

SEQ ID NO: 8285467 - DNA, 22 bp, Homo sapiens
caggcctcatggtgtgtccttc

SEQ ID NO: 8285468 - DNA, 22 bp, Homo sapiens
agctgggacagacaactatgtt

SEQ ID NO: 8285469 - DNA, 23 bp, Homo sapiens
agctgggaattttctgaagcttt

SEQ ID NO: 8285470 - DNA, 22 bp, Homo sapiens
agctgggacagacaactatgtt

SEQ ID NO: 8285471 - DNA, 21 bp, Homo sapiens
caggccccaggcctggggtgc

SEQ ID NO: 8285472 - DNA, 22 bp, Homo sapiens
agctgtggcagcagccgtggca

SEQ ID NO: 8285473 - DNA, 22 bp, Homo sapiens
agctgtgtagggaatcagagaa

SEQ ID NO: 8285474 - DNA, 22 bp, Homo sapiens
agctgtgtcatcctggaaaatg

SEQ ID NO: 8285475 - DNA, 22 bp, Homo sapiens
agctgtgtgacctagggcaagc

SEQ ID NO: 8285476 - DNA, 22 bp, Homo sapiens
agctgtgtgcatttgggtctca

SEQ ID NO: 8285477 - DNA, 22 bp, Homo sapiens
agctgtgtgactctaagcaagt

SEQ ID NO: 8285478 - DNA, 22 bp, Homo sapiens
aggaggaagggaagacaagtaa

SEQ ID NO: 8285479 - DNA, 22 bp, Homo sapiens
aggaggaattgacacagaagcc

SEQ ID NO: 8285480 - DNA, 21 bp, Homo sapiens
aggaggagagcttggcctacc

SEQ ID NO: 8285481 - DNA, 21 bp, Homo sapiens
aggaggagagcttggcctacc

SEQ ID NO: 8285482 - DNA, 22 bp, Homo sapiens
aggaggataagttagttgggta

SEQ ID NO: 8285483 - DNA, 22 bp, Homo sapiens
aggaggaggctggagtacaccc

SEQ ID NO: 8285484 - DNA, 17 bp, Homo sapiens
aggaggatcagagagta

SEQ ID NO: 8285485 - DNA, 22 bp, Homo sapiens
aggaggcaactgagatttagaa

SEQ ID NO: 8285486 - DNA, 22 bp, Homo sapiens
aggagagaattactgggtgtca

SEQ ID NO: 8285487 - DNA, 22 bp, Homo sapiens
aggagagagctgagctttgctg

SEQ ID NO: 8285488 - DNA, 22 bp, Homo sapiens
aggagagaattactgggtgtca

SEQ ID NO: 8285489 - DNA, 22 bp, Homo sapiens
aggagagagaacacttgggtcc

SEQ ID NO: 8285490 - DNA, 22 bp, Homo sapiens
aggagctagccaggcatatgca

SEQ ID NO: 8285491 - DNA, 22 bp, Homo sapiens
aggagacactgagacttcacca

SEQ ID NO: 8285492 - DNA, 23 bp, Homo sapiens
aggagaagagatttccacatgca

SEQ ID NO: 8285493 - DNA, 22 bp, Homo sapiens
aggacagcattttcagcatctc

SEQ ID NO: 8285494 - DNA, 21 bp, Homo sapiens
aggacaggaactggctgaata

SEQ ID NO: 8285495 - DNA, 22 bp, Homo sapiens
aggacagcccttgagagcacat

SEQ ID NO: 8285496 - DNA, 22 bp, Homo sapiens
aggagaaagactggacagccaa

SEQ ID NO: 8285497 - DNA, 20 bp, Homo sapiens
aggagaaattcgggacacct

SEQ ID NO: 8285498 - DNA, 22 bp, Homo sapiens
aggagaaatccatcgagaatgg

SEQ ID NO: 8285499 - DNA, 22 bp, Homo sapiens
aggaagctgctggagtagtgtg

SEQ ID NO: 8285500 - DNA, 22 bp, Homo sapiens
aggaagctgctggagtagtgtg

SEQ ID NO: 8285501 - DNA, 21 bp, Homo sapiens
aggaagctgcccagatagtag

SEQ ID NO: 8285502 - DNA, 19 bp, Homo sapiens
aggaaggaacctgagtctg

SEQ ID NO: 8285503 - DNA, 22 bp, Homo sapiens
aggaagctttatgaccagctaa

SEQ ID NO: 8285504 - DNA, 22 bp, Homo sapiens
aggaaggactgcagcatttggt

SEQ ID NO: 8285505 - DNA, 22 bp, Homo sapiens
aggaaggactccatggtccgtc

SEQ ID NO: 8285506 - DNA, 20 bp, Homo sapiens
aggaaggaagtttgcatgga

SEQ ID NO: 8285507 - DNA, 18 bp, Homo sapiens
cagtcccaaaccttagga

SEQ ID NO: 8285508 - DNA, 17 bp, Homo sapiens
catgccccaggcttagc

SEQ ID NO: 8285509 - DNA, 22 bp, Homo sapiens
catgcaggcccgcctgaatggg

SEQ ID NO: 8285510 - DNA, 22 bp, Homo sapiens
catgcactttgatggagagcgt

SEQ ID NO: 8285511 - DNA, 22 bp, Homo sapiens
aggcaattagtcttttgttatt

SEQ ID NO: 8285512 - DNA, 22 bp, Homo sapiens
aggcacagcctcccccaactcc

SEQ ID NO: 8285513 - DNA, 22 bp, Homo sapiens
aggcaattgtttgtgtaatagg

SEQ ID NO: 8285514 - DNA, 22 bp, Homo sapiens
aggcaatttggaatctgtactc

SEQ ID NO: 8285515 - DNA, 22 bp, Homo sapiens
aggcacagcctcccttcacatg

SEQ ID NO: 8285516 - DNA, 22 bp, Homo sapiens
aggcacaggcctcagcacccag

SEQ ID NO: 8285517 - DNA, 22 bp, Homo sapiens
aggcacaggaggtggtaagaag

SEQ ID NO: 8285518 - DNA, 22 bp, Homo sapiens
catggccaggcccagggcccag

SEQ ID NO: 8285519 - DNA, 22 bp, Homo sapiens
aggaggcactcactctcagggt

SEQ ID NO: 8285520 - DNA, 22 bp, Homo sapiens
aggaggtgctgtttgtcctgga

SEQ ID NO: 8285521 - DNA, 19 bp, Homo sapiens
aggcagcacccagtccttg

SEQ ID NO: 8285522 - DNA, 19 bp, Homo sapiens
aggcagcattctggggctt

SEQ ID NO: 8285523 - DNA, 22 bp, Homo sapiens
aggcagcatttctgcttatcca

SEQ ID NO: 8285524 - DNA, 22 bp, Homo sapiens
aggcagccaatcagaggctgac

SEQ ID NO: 8285525 - DNA, 22 bp, Homo sapiens
aggcagcagaggttgaggaaag

SEQ ID NO: 8285526 - DNA, 22 bp, Homo sapiens
aggcagcagccacaaggcctga

SEQ ID NO: 8285527 - DNA, 22 bp, Homo sapiens
aggcagcagactgttaatcaga

SEQ ID NO: 8285528 - DNA, 22 bp, Homo sapiens
aggcagcagaaaacaaatggtt

SEQ ID NO: 8285529 - DNA, 22 bp, Homo sapiens
agcagacaccaggagtaaagaa

SEQ ID NO: 8285530 - DNA, 22 bp, Homo sapiens
agcagacaccaggagtaaagaa

SEQ ID NO: 8285531 - DNA, 22 bp, Homo sapiens
agcagcaaggaacagaatggac

SEQ ID NO: 8285532 - DNA, 22 bp, Homo sapiens
agcagagtgccccatcacaagg

SEQ ID NO: 8285533 - DNA, 22 bp, Homo sapiens
agcagcatttaagtttcttcta

SEQ ID NO: 8285534 - DNA, 22 bp, Homo sapiens
agcagcattaagggaactgcag

SEQ ID NO: 8285535 - DNA, 22 bp, Homo sapiens
agcagcattatgatatatctta

SEQ ID NO: 8285536 - DNA, 22 bp, Homo sapiens
agcagcatagaagctgggagga

SEQ ID NO: 8285537 - DNA, 22 bp, Homo sapiens
agcagcagggtgtaattgggca

SEQ ID NO: 8285538 - DNA, 22 bp, Homo sapiens
caaggcatgcaatgtcttcagg

SEQ ID NO: 8285539 - DNA, 22 bp, Homo sapiens
caaggcatgaaaggagtgagtg

SEQ ID NO: 8285540 - DNA, 22 bp, Homo sapiens
agcagcatctcttattgcagtg

SEQ ID NO: 8285541 - DNA, 22 bp, Homo sapiens
caaattaatgtgtctcaaaata

SEQ ID NO: 8285542 - DNA, 22 bp, Homo sapiens
caaattaatgtgtctcaaaata

SEQ ID NO: 8285543 - DNA, 17 bp, Homo sapiens
agcagaagtcagaggga

SEQ ID NO: 8285544 - DNA, 22 bp, Homo sapiens
agcagaagaaagccacatgact

SEQ ID NO: 8285545 - DNA, 22 bp, Homo sapiens
caaatgtttcttgaacaccaac

SEQ ID NO: 8285546 - DNA, 20 bp, Homo sapiens
agcacagcgcggtgttcctt

SEQ ID NO: 8285547 - DNA, 22 bp, Homo sapiens
agcacagctggaaaataaatca

SEQ ID NO: 8285548 - DNA, 22 bp, Homo sapiens
caaatgatccttgcaagctgtg

SEQ ID NO: 8285549 - DNA, 22 bp, Homo sapiens
agcacagagctcggggaatgga

SEQ ID NO: 8285550 - DNA, 22 bp, Homo sapiens
attttctcacaatgcagaagga

SEQ ID NO: 8285551 - DNA, 22 bp, Homo sapiens
attttctgagcacgtgacagca

SEQ ID NO: 8285552 - DNA, 22 bp, Homo sapiens
attttctatgttgtaattgtta

SEQ ID NO: 8285553 - DNA, 22 bp, Homo sapiens
agcaatttttgattttcagtgt

SEQ ID NO: 8285554 - DNA, 22 bp, Homo sapiens
attttctgtaactatttctata

SEQ ID NO: 8285555 - DNA, 22 bp, Homo sapiens
attttctgtaaaaaggcactaa

SEQ ID NO: 8285556 - DNA, 22 bp, Homo sapiens
caccaggtgctggaggacatca

SEQ ID NO: 8285557 - DNA, 22 bp, Homo sapiens
agcagtggctgaagatgttcct

SEQ ID NO: 8285558 - DNA, 22 bp, Homo sapiens
caccagggccccaggctgtgcc

SEQ ID NO: 8285559 - DNA, 22 bp, Homo sapiens
caccagggctctgagctctgaa

SEQ ID NO: 8285560 - DNA, 22 bp, Homo sapiens
caccagggctctgagctctgaa

SEQ ID NO: 8285561 - DNA, 22 bp, Homo sapiens
agcaggtgccaggtgtacccgc

SEQ ID NO: 8285562 - DNA, 22 bp, Homo sapiens
cacatctcagggctacaggcag

SEQ ID NO: 8285563 - DNA, 22 bp, Homo sapiens
agcaggtgatcgcgtgtgctcc

SEQ ID NO: 8285564 - DNA, 22 bp, Homo sapiens
agcaggtgatcgcgtgtgctcc

SEQ ID NO: 8285565 - DNA, 22 bp, Homo sapiens
agcaggtgatgtgagtctggaa

SEQ ID NO: 8285566 - DNA, 22 bp, Homo sapiens
agcaggtgatgtgagtctggaa

SEQ ID NO: 8285567 - DNA, 22 bp, Homo sapiens
agcagggcctgagtgacctaac

SEQ ID NO: 8285568 - DNA, 22 bp, Homo sapiens
cacagtcacatatctatgtgtg

SEQ ID NO: 8285569 - DNA, 22 bp, Homo sapiens
cacaggaggaggccagagcgta

SEQ ID NO: 8285570 - DNA, 22 bp, Homo sapiens
cacaggaggcaatggtaagatt

SEQ ID NO: 8285571 - DNA, 22 bp, Homo sapiens
agcaggagatggggcgtgatgt

SEQ ID NO: 8285572 - DNA, 22 bp, Homo sapiens
agcaggagaacactgtggctct

SEQ ID NO: 8285573 - DNA, 22 bp, Homo sapiens
cacagggcttctcatggggtgc

SEQ ID NO: 8285574 - DNA, 22 bp, Homo sapiens
cacagtatgatctaaagtaagt

SEQ ID NO: 8285575 - DNA, 22 bp, Homo sapiens
cacagtacttaattctctaaat

SEQ ID NO: 8285576 - DNA, 22 bp, Homo sapiens
cacagtacgcacccgatacatg

SEQ ID NO: 8285577 - DNA, 22 bp, Homo sapiens
cacagggccttgtgtgactgca

SEQ ID NO: 8285578 - DNA, 22 bp, Homo sapiens
agcagctgtggggacaagggta

SEQ ID NO: 8285579 - DNA, 19 bp, Homo sapiens
agcagcttaattttgtagc

SEQ ID NO: 8285580 - DNA, 22 bp, Homo sapiens
agcagcttacatgtggcctatc

SEQ ID NO: 8285581 - DNA, 18 bp, Homo sapiens
agcagctgtcagaatgcc

SEQ ID NO: 8285582 - DNA, 23 bp, Homo sapiens
agccaggggatcttgggccctgg

SEQ ID NO: 8285583 - DNA, 17 bp, Homo sapiens
agccaggtacaagtcca

SEQ ID NO: 8285584 - DNA, 20 bp, Homo sapiens
agccagggttctggatgcac

SEQ ID NO: 8285585 - DNA, 23 bp, Homo sapiens
agccaggggatcttgggccctgg

SEQ ID NO: 8285586 - DNA, 21 bp, Homo sapiens
agccagtctcagtactgtact

SEQ ID NO: 8285587 - DNA, 22 bp, Homo sapiens
agcccaggaagttgaggcttgc

SEQ ID NO: 8285588 - DNA, 22 bp, Homo sapiens
agcccaggagtttgaggctgtg

SEQ ID NO: 8285589 - DNA, 22 bp, Homo sapiens
cagagctggagcttgaatggag

SEQ ID NO: 8285590 - DNA, 22 bp, Homo sapiens
cagagctggcggtgagaagaca

SEQ ID NO: 8285591 - DNA, 22 bp, Homo sapiens
cagagctggcggtgagaagaca

SEQ ID NO: 8285592 - DNA, 22 bp, Homo sapiens
cagagctggcggtgagaagaca

SEQ ID NO: 8285593 - DNA, 22 bp, Homo sapiens
agccccttgctgccctctagag

SEQ ID NO: 8285594 - DNA, 22 bp, Homo sapiens
agccaggatcacccggggctgt

SEQ ID NO: 8285595 - DNA, 22 bp, Homo sapiens
agccaggacgttgctcagctcc

SEQ ID NO: 8285596 - DNA, 22 bp, Homo sapiens
agccaggacatctctagctgct

SEQ ID NO: 8285597 - DNA, 21 bp, Homo sapiens
agccagctatcacacagcatt

SEQ ID NO: 8285598 - DNA, 17 bp, Homo sapiens
cagaaggaagcatggca

SEQ ID NO: 8285599 - DNA, 22 bp, Homo sapiens
agccaggcagggctctcgctct

SEQ ID NO: 8285600 - DNA, 22 bp, Homo sapiens
agccaggattggctgagcctta

SEQ ID NO: 8285601 - DNA, 22 bp, Homo sapiens
cagaagcctgcctcagatgcac

SEQ ID NO: 8285602 - DNA, 22 bp, Homo sapiens
cagaagctgcagtgatctggga

SEQ ID NO: 8285603 - DNA, 22 bp, Homo sapiens
cagaagctgaggagtgaggcaa

SEQ ID NO: 8285604 - DNA, 22 bp, Homo sapiens
cagaagagatgaaatagtatta

SEQ ID NO: 8285605 - DNA, 22 bp, Homo sapiens
cagaactgttataacagctgtt

SEQ ID NO: 8285606 - DNA, 22 bp, Homo sapiens
agccacagcccacaggactctt

SEQ ID NO: 8285607 - DNA, 22 bp, Homo sapiens
agccacagctccttggtggaga

SEQ ID NO: 8285608 - DNA, 22 bp, Homo sapiens
cagaacctgaacgtgaggtgga

SEQ ID NO: 8285609 - DNA, 22 bp, Homo sapiens
cagaaccttggtggtagggaca

SEQ ID NO: 8285610 - DNA, 22 bp, Homo sapiens
cagaactgggcagggagcagag

SEQ ID NO: 8285611 - DNA, 22 bp, Homo sapiens
agccttctctgaaattctgttt

SEQ ID NO: 8285612 - DNA, 22 bp, Homo sapiens
agccttcccttagagaatgagc

SEQ ID NO: 8285613 - DNA, 22 bp, Homo sapiens
agccttgctgcaattgttaaaa

SEQ ID NO: 8285614 - DNA, 22 bp, Homo sapiens
agccttgcaaaatttttggcaa

SEQ ID NO: 8285615 - DNA, 22 bp, Homo sapiens
agccttgaaccaattgtttagc

SEQ ID NO: 8285616 - DNA, 22 bp, Homo sapiens
cagcaggacgtccaagtgctat

SEQ ID NO: 8285617 - DNA, 23 bp, Homo sapiens
cagcaggagggtgcctgggctgc

SEQ ID NO: 8285618 - DNA, 22 bp, Homo sapiens
agctcaatgcaacctccgcctc

SEQ ID NO: 8285619 - DNA, 22 bp, Homo sapiens
agctcaagttttcaaatattat

SEQ ID NO: 8285620 - DNA, 22 bp, Homo sapiens
cagcaggaggtgagatgtgacc

SEQ ID NO: 8285621 - DNA, 22 bp, Homo sapiens
cagcaggaggtgagatgtgacc

SEQ ID NO: 8285622 - DNA, 22 bp, Homo sapiens
cagcaggataggtttctttgga

SEQ ID NO: 8285623 - DNA, 22 bp, Homo sapiens
cagcaggaggtgagtagcaggt

SEQ ID NO: 8285624 - DNA, 22 bp, Homo sapiens
cagccctggctagggcgagggc

SEQ ID NO: 8285625 - DNA, 21 bp, Homo sapiens
agctccctgtttcctcactct

SEQ ID NO: 8285626 - DNA, 22 bp, Homo sapiens
agctccctgcacgaccctgccc

SEQ ID NO: 8285627 - DNA, 22 bp, Homo sapiens
agctcctcctgagtgtctggga

SEQ ID NO: 8285628 - DNA, 22 bp, Homo sapiens
cagccagctcaggaaggatttt

SEQ ID NO: 8285629 - DNA, 22 bp, Homo sapiens
agctcccagcagagctggccac

SEQ ID NO: 8285630 - DNA, 22 bp, Homo sapiens
cagcagcagtgttctagaatct

SEQ ID NO: 8285631 - DNA, 22 bp, Homo sapiens
cagcagcagcttagtggtcccc

SEQ ID NO: 8285632 - DNA, 22 bp, Homo sapiens
cagcagcagtggctgcagaaca

SEQ ID NO: 8285633 - DNA, 22 bp, Homo sapiens
cagcagcagccccaggaaggtt

SEQ ID NO: 8285634 - DNA, 22 bp, Homo sapiens
cagcagaggcacgtctgtgaat

SEQ ID NO: 8285635 - DNA, 22 bp, Homo sapiens
cagcagaggcacgtctgtgaat

SEQ ID NO: 8285636 - DNA, 22 bp, Homo sapiens
cagcagagggagccattgaaat

SEQ ID NO: 8285637 - DNA, 22 bp, Homo sapiens
cagcagaggaaagcaaatctaa

SEQ ID NO: 8285638 - DNA, 22 bp, Homo sapiens
cagcacaggaatatggtggaca

SEQ ID NO: 8285639 - DNA, 22 bp, Homo sapiens
cagcacagctgaggggctgtct

SEQ ID NO: 8285640 - DNA, 22 bp, Homo sapiens
cagcacagctgaggggctgtct

SEQ ID NO: 8285641 - DNA, 22 bp, Homo sapiens
cagcacagcacagcggtgactc

SEQ ID NO: 8285642 - DNA, 22 bp, Homo sapiens
cagaggctaagggtagcttggg

SEQ ID NO: 8285643 - DNA, 22 bp, Homo sapiens
atttattgaacactgactatgt

SEQ ID NO: 8285644 - DNA, 22 bp, Homo sapiens
atttattattgtggttacttct

SEQ ID NO: 8285645 - DNA, 22 bp, Homo sapiens
agagtgggcaggagcctcgact

SEQ ID NO: 8285646 - DNA, 22 bp, Homo sapiens
agagtggcttctttgacatgct

SEQ ID NO: 8285647 - DNA, 22 bp, Homo sapiens
agagtggcttgctcagctagca

SEQ ID NO: 8285648 - DNA, 22 bp, Homo sapiens
agagtggcttgctcagctagca

SEQ ID NO: 8285649 - DNA, 22 bp, Homo sapiens
agagtgggacacgggcgctgtc

SEQ ID NO: 8285650 - DNA, 22 bp, Homo sapiens
agagtggggacagggcctgtcc

SEQ ID NO: 8285651 - DNA, 22 bp, Homo sapiens
agagggtggtgaggcctggttc

SEQ ID NO: 8285652 - DNA, 22 bp, Homo sapiens
agaggtagaaaataatggagag

SEQ ID NO: 8285653 - DNA, 22 bp, Homo sapiens
agaggtagaggttgcagtgagc

SEQ ID NO: 8285654 - DNA, 22 bp, Homo sapiens
agagtggcccgttggcctgaac

SEQ ID NO: 8285655 - DNA, 22 bp, Homo sapiens
agagtggcctggcctggggcat

SEQ ID NO: 8285656 - DNA, 22 bp, Homo sapiens
agagtggctctgctgggcacag

SEQ ID NO: 8285657 - DNA, 22 bp, Homo sapiens
atttaagggatttggagaccaa

SEQ ID NO: 8285658 - DNA, 18 bp, Homo sapiens
agatgaaagcaaatgaca

SEQ ID NO: 8285659 - DNA, 22 bp, Homo sapiens
agatgacaaatcaggggacggg

SEQ ID NO: 8285660 - DNA, 23 bp, Homo sapiens
agatgaaagcttcccatcacagt

SEQ ID NO: 8285661 - DNA, 22 bp, Homo sapiens
atttccaaaaccacttattgcc

SEQ ID NO: 8285662 - DNA, 22 bp, Homo sapiens
atttccagaatagaaggttctc

SEQ ID NO: 8285663 - DNA, 22 bp, Homo sapiens
atttccagaccaggtctcaccc

SEQ ID NO: 8285664 - DNA, 22 bp, Homo sapiens
atttccaatctctgcatatggg

SEQ ID NO: 8285665 - DNA, 22 bp, Homo sapiens
agatgggcgccctggactgagg

SEQ ID NO: 8285666 - DNA, 22 bp, Homo sapiens
agcaaacagtgtgctaagaaat

SEQ ID NO: 8285667 - DNA, 22 bp, Homo sapiens
atttgctttaaggtataaaagg

SEQ ID NO: 8285668 - DNA, 22 bp, Homo sapiens
atttgctttcaggtataaaagg

SEQ ID NO: 8285669 - DNA, 22 bp, Homo sapiens
attagcatattaaatagtcatt

SEQ ID NO: 8285670 - DNA, 22 bp, Homo sapiens
attagcaaattctaattcacta

SEQ ID NO: 8285671 - DNA, 22 bp, Homo sapiens
atgttttaccctttgcacaaac

SEQ ID NO: 8285672 - DNA, 22 bp, Homo sapiens
atgttttaaatatgtgtgtaaa

SEQ ID NO: 8285673 - DNA, 22 bp, Homo sapiens
atgttaaagatggtgggaaatt

SEQ ID NO: 8285674 - DNA, 22 bp, Homo sapiens
atgtttctgaagtttacagata

SEQ ID NO: 8285675 - DNA, 22 bp, Homo sapiens
atgtttctgtcctacgagataa

SEQ ID NO: 8285676 - DNA, 22 bp, Homo sapiens
atgtttctgagtgtatatacat

SEQ ID NO: 8285677 - DNA, 23 bp, Homo sapiens
atgtttgcagtaacccatcctgg

SEQ ID NO: 8285678 - DNA, 23 bp, Homo sapiens
atgtttgcagtaacccatcctgg

SEQ ID NO: 8285679 - DNA, 22 bp, Homo sapiens
attctctgttcaaggatggtga

SEQ ID NO: 8285680 - DNA, 21 bp, Homo sapiens
agagggagagtggcccttcca

SEQ ID NO: 8285681 - DNA, 22 bp, Homo sapiens
attctgtatggggaaactagag

SEQ ID NO: 8285682 - DNA, 22 bp, Homo sapiens
attctgtatggaaaagcactat

SEQ ID NO: 8285683 - DNA, 22 bp, Homo sapiens
agagggcaagtgtagtccagta

SEQ ID NO: 8285684 - DNA, 22 bp, Homo sapiens
agagggcaagtgtagtccagta

SEQ ID NO: 8285685 - DNA, 23 bp, Homo sapiens
agagggagatgtttttctcaaga

SEQ ID NO: 8285686 - DNA, 22 bp, Homo sapiens
attatagagggttacagttaat

SEQ ID NO: 8285687 - DNA, 22 bp, Homo sapiens
attataaatattttctaggggt

SEQ ID NO: 8285688 - DNA, 22 bp, Homo sapiens
attataaagaacatgtgtgtgg

SEQ ID NO: 8285689 - DNA, 22 bp, Homo sapiens
attataaacctttgagggtggg

SEQ ID NO: 8285690 - DNA, 22 bp, Homo sapiens
agaagagaaatagtgccactgt

SEQ ID NO: 8285691 - DNA, 22 bp, Homo sapiens
agaagaatacttgatgttcatg

SEQ ID NO: 8285692 - DNA, 22 bp, Homo sapiens
agaagcacaccagtagacaggg

SEQ ID NO: 8285693 - DNA, 22 bp, Homo sapiens
atctttaaagacatgtgaactt

SEQ ID NO: 8285694 - DNA, 22 bp, Homo sapiens
agaatacatcaatctattttct

SEQ ID NO: 8285695 - DNA, 22 bp, Homo sapiens
atctttggtactattcttatca

SEQ ID NO: 8285696 - DNA, 22 bp, Homo sapiens
agaaggccaatagggtgcactg

SEQ ID NO: 8285697 - DNA, 22 bp, Homo sapiens
agaaggcatcagaagtgtgtag

SEQ ID NO: 8285698 - DNA, 22 bp, Homo sapiens
agaatacagtatgcaaaaagat

SEQ ID NO: 8285699 - DNA, 22 bp, Homo sapiens
agaatacaattgttcagtaata

SEQ ID NO: 8285700 - DNA, 22 bp, Homo sapiens
agacagtgaggcagagcttccg

SEQ ID NO: 8285701 - DNA, 22 bp, Homo sapiens
agacaggtagcaggacagatat

SEQ ID NO: 8285702 - DNA, 22 bp, Homo sapiens
atgcaggcagacactgtgggca

SEQ ID NO: 8285703 - DNA, 22 bp, Homo sapiens
atgcagggaggtaagaggtgcc

SEQ ID NO: 8285704 - DNA, 22 bp, Homo sapiens
agacacataggaccacactgtg

SEQ ID NO: 8285705 - DNA, 19 bp, Homo sapiens
agacacatcacatttctcc

SEQ ID NO: 8285706 - DNA, 22 bp, Homo sapiens
agacacagtataagcacaacaa

SEQ ID NO: 8285707 - DNA, 22 bp, Homo sapiens
agacacagtctgtctggaggag

SEQ ID NO: 8285708 - DNA, 21 bp, Homo sapiens
agacacaggggttgctggggt

SEQ ID NO: 8285709 - DNA, 22 bp, Homo sapiens
agacacagattttggaaaagat

SEQ ID NO: 8285710 - DNA, 22 bp, Homo sapiens
agacacagatggtacctgagcc

SEQ ID NO: 8285711 - DNA, 22 bp, Homo sapiens
agacacagaagttgctgttggg

SEQ ID NO: 8285712 - DNA, 22 bp, Homo sapiens
agacaatttcaaagtaatatta

SEQ ID NO: 8285713 - DNA, 22 bp, Homo sapiens
agacacagaacacaaaagcata

SEQ ID NO: 8285714 - DNA, 17 bp, Homo sapiens
agaatgcaaagcaggct

SEQ ID NO: 8285715 - DNA, 17 bp, Homo sapiens
agaatgcaaagcaggct

SEQ ID NO: 8285716 - DNA, 22 bp, Homo sapiens
agaatgcatctaaaagcagaga

SEQ ID NO: 8285717 - DNA, 22 bp, Homo sapiens
atgtctgttttcatatcagata

SEQ ID NO: 8285718 - DNA, 22 bp, Homo sapiens
atgtctgttcattattaactgc

SEQ ID NO: 8285719 - DNA, 19 bp, Homo sapiens
atgtctgttgaatttcata

SEQ ID NO: 8285720 - DNA, 22 bp, Homo sapiens
atgtctgtggcaattgttgatg

SEQ ID NO: 8285721 - DNA, 22 bp, Homo sapiens
atgtctgtctttgtactccaca

SEQ ID NO: 8285722 - DNA, 22 bp, Homo sapiens
atgtccagccaaccactggatt

SEQ ID NO: 8285723 - DNA, 22 bp, Homo sapiens
atgtccagctcatgatactatc

SEQ ID NO: 8285724 - DNA, 22 bp, Homo sapiens
atgtccagggcacacagcagtg

SEQ ID NO: 8285725 - DNA, 22 bp, Homo sapiens
atgtctgtacgagttacaatgg

SEQ ID NO: 8285726 - DNA, 22 bp, Homo sapiens
atgtccaatttcagagtctcat

SEQ ID NO: 8285727 - DNA, 22 bp, Homo sapiens
atgtacatactgcattttcaaa

SEQ ID NO: 8285728 - DNA, 22 bp, Homo sapiens
atgtccagaggtgagtcagagc

SEQ ID NO: 8285729 - DNA, 22 bp, Homo sapiens
atgtacagtttctagactcaaa

SEQ ID NO: 8285730 - DNA, 22 bp, Homo sapiens
atgtacataaaatgtataatga

SEQ ID NO: 8285731 - DNA, 22 bp, Homo sapiens
atgtacagccacttcacagtta

SEQ ID NO: 8285732 - DNA, 22 bp, Homo sapiens
atgtacagccacttcacagtta

SEQ ID NO: 8285733 - DNA, 22 bp, Homo sapiens
atgggtggccccgtgtgcagtc

SEQ ID NO: 8285734 - DNA, 22 bp, Homo sapiens
atgggaggcagacactaagttc

SEQ ID NO: 8285735 - DNA, 22 bp, Homo sapiens
atgggaggatgctcgggtgctc

SEQ ID NO: 8285736 - DNA, 22 bp, Homo sapiens
atgggaggaaggaggcccttga

SEQ ID NO: 8285737 - DNA, 22 bp, Homo sapiens
atgggaggaagagaagatgtct

SEQ ID NO: 8285738 - DNA, 22 bp, Homo sapiens
atggctggtttgagctttagca

SEQ ID NO: 8285739 - DNA, 23 bp, Homo sapiens
atggaaatagcatgtgtcattta

SEQ ID NO: 8285740 - DNA, 22 bp, Homo sapiens
atggaaatcgatgtctaagtta

SEQ ID NO: 8285741 - DNA, 22 bp, Homo sapiens
atggaaatccaagtcaccgtag

SEQ ID NO: 8285742 - DNA, 22 bp, Homo sapiens
atggaaatcaggttcatccaag

SEQ ID NO: 8285743 - DNA, 22 bp, Homo sapiens
agactaaatagttacaggtagg

SEQ ID NO: 8285744 - DNA, 20 bp, Homo sapiens
agactcagtttctatgctct

SEQ ID NO: 8285745 - DNA, 22 bp, Homo sapiens
agactacatatgccacatgaag

SEQ ID NO: 8285746 - DNA, 22 bp, Homo sapiens
agactacagaatggcattgttt

SEQ ID NO: 8285747 - DNA, 19 bp, Homo sapiens
atggaaaatgccagactga

SEQ ID NO: 8285748 - DNA, 23 bp, Homo sapiens
atgcagggttacagggctgactt

SEQ ID NO: 8285749 - DNA, 22 bp, Homo sapiens
atgcagggtctccgtgtgacga

SEQ ID NO: 8285750 - DNA, 22 bp, Homo sapiens
atgcaggggctgtgttttgggt

SEQ ID NO: 8285751 - DNA, 22 bp, Homo sapiens
atgcaggggccgcctggccagg

SEQ ID NO: 8285752 - DNA, 22 bp, Homo sapiens
atggagttctgccagcgctgct

SEQ ID NO: 8285753 - DNA, 20 bp, Homo sapiens
atggagtgaagagtgaaagc

SEQ ID NO: 8285754 - DNA, 22 bp, Homo sapiens
atggctggctgagcctggttat

SEQ ID NO: 8285755 - DNA, 22 bp, Homo sapiens
atggctggctttacttgctttg

SEQ ID NO: 8285756 - DNA, 22 bp, Homo sapiens
atggctggcgtcattgtgtggg

SEQ ID NO: 8285757 - DNA, 22 bp, Homo sapiens
atggctggcatgtgcataacgg

SEQ ID NO: 8285758 - DNA, 22 bp, Homo sapiens
atggctgggtcaccatcagggt

SEQ ID NO: 8285759 - DNA, 22 bp, Homo sapiens
atggctgggcttttagtcagat

SEQ ID NO: 8285760 - DNA, 22 bp, Homo sapiens
atggctgggatttcctttgcgt

SEQ ID NO: 8285761 - DNA, 22 bp, Homo sapiens
atggctgggatggggtagagaa

SEQ ID NO: 8285762 - DNA, 22 bp, Homo sapiens
atggctgggatgcttctagcaa

SEQ ID NO: 8285763 - DNA, 22 bp, Homo sapiens
atggctgggaggagagtatgat

SEQ ID NO: 8285764 - DNA, 22 bp, Homo sapiens
atggctggtctcccatggaaaa

SEQ ID NO: 8285765 - DNA, 22 bp, Homo sapiens
atggctggtagtgaattaatct

SEQ ID NO: 8285766 - DNA, 22 bp, Homo sapiens
atggctgggttcttctataggt

SEQ ID NO: 8285767 - DNA, 21 bp, Homo sapiens
atggctggtggctcagcctcc

SEQ ID NO: 8285768 - DNA, 21 bp, Homo sapiens
atggctggtggctcagcctcc

SEQ ID NO: 8285769 - DNA, 22 bp, Homo sapiens
atggctggtgatactggagtga

SEQ ID NO: 8285770 - DNA, 22 bp, Homo sapiens
actccagggctccatcccttgt

SEQ ID NO: 8285771 - DNA, 22 bp, Homo sapiens
actccaggggttgctatttaca

SEQ ID NO: 8285772 - DNA, 22 bp, Homo sapiens
agtctctgggcatggttgtgac

SEQ ID NO: 8285773 - DNA, 22 bp, Homo sapiens
agtctctggggaggagtggaaa

SEQ ID NO: 8285774 - DNA, 22 bp, Homo sapiens
actccacatttgaacacagttc

SEQ ID NO: 8285775 - DNA, 22 bp, Homo sapiens
actccacaccacgggggccgcc

SEQ ID NO: 8285776 - DNA, 21 bp, Homo sapiens
actccaaacaagttaagctgt

SEQ ID NO: 8285777 - DNA, 22 bp, Homo sapiens
actccaaaacctgcggcttggt

SEQ ID NO: 8285778 - DNA, 22 bp, Homo sapiens
actccagggctccaccccagat

SEQ ID NO: 8285779 - DNA, 22 bp, Homo sapiens
actccagggctccaccccagat

SEQ ID NO: 8285780 - DNA, 22 bp, Homo sapiens
actccagggaggtgagtgtgcg

SEQ ID NO: 8285781 - DNA, 22 bp, Homo sapiens
actccaggcatctgcttctgct

SEQ ID NO: 8285782 - DNA, 22 bp, Homo sapiens
actgaaacactgagtgaattgt

SEQ ID NO: 8285783 - DNA, 22 bp, Homo sapiens
actgaaacatatatttgagttt

SEQ ID NO: 8285784 - DNA, 22 bp, Homo sapiens
actgaaatactgctcttggatt

SEQ ID NO: 8285785 - DNA, 22 bp, Homo sapiens
actgaaatatttagaagtgaag

SEQ ID NO: 8285786 - DNA, 22 bp, Homo sapiens
actgaaatggggacagtcctta

SEQ ID NO: 8285787 - DNA, 22 bp, Homo sapiens
actgaatatattccattgcatg

SEQ ID NO: 8285788 - DNA, 22 bp, Homo sapiens
actgaattcctctttcttatcc

SEQ ID NO: 8285789 - DNA, 22 bp, Homo sapiens
actgaatttatgtttaaaaaca

SEQ ID NO: 8285790 - DNA, 22 bp, Homo sapiens
actgaagttcatacaacagact

SEQ ID NO: 8285791 - DNA, 22 bp, Homo sapiens
actgaagtagtcattgtcatta

SEQ ID NO: 8285792 - DNA, 22 bp, Homo sapiens
actgaagtccacacatgtagga

SEQ ID NO: 8285793 - DNA, 22 bp, Homo sapiens
actgatggatagtcaagatact

SEQ ID NO: 8285794 - DNA, 22 bp, Homo sapiens
actgattgcattcatagggttt

SEQ ID NO: 8285795 - DNA, 22 bp, Homo sapiens
actgattgcattcatagggttt

SEQ ID NO: 8285796 - DNA, 22 bp, Homo sapiens
actgcacagaagaaactatcaa

SEQ ID NO: 8285797 - DNA, 22 bp, Homo sapiens
actgcaacctccacctcctggg

SEQ ID NO: 8285798 - DNA, 22 bp, Homo sapiens
agtggctgagtgactgtgactc

SEQ ID NO: 8285799 - DNA, 20 bp, Homo sapiens
agtggctgatggaaagaagc

SEQ ID NO: 8285800 - DNA, 23 bp, Homo sapiens
agtggctgagagtgtttcatatg

SEQ ID NO: 8285801 - DNA, 22 bp, Homo sapiens
agtggctgattacaaactgagt

SEQ ID NO: 8285802 - DNA, 22 bp, Homo sapiens
agtggctgatgtaggcagtggg

SEQ ID NO: 8285803 - DNA, 22 bp, Homo sapiens
actgctctctttgcaggggcta

SEQ ID NO: 8285804 - DNA, 22 bp, Homo sapiens
actgctgacctcaggtcatcct

SEQ ID NO: 8285805 - DNA, 22 bp, Homo sapiens
actgctgagcacacaagagtgt

SEQ ID NO: 8285806 - DNA, 22 bp, Homo sapiens
actgctgactaaacagctccat

SEQ ID NO: 8285807 - DNA, 22 bp, Homo sapiens
actgctgattttaggactgtta

SEQ ID NO: 8285808 - DNA, 22 bp, Homo sapiens
agtggctgctggagtggagatg

SEQ ID NO: 8285809 - DNA, 22 bp, Homo sapiens
agtggctgctgactttaataca

SEQ ID NO: 8285810 - DNA, 22 bp, Homo sapiens
agtggctgctatgatcaggaca

SEQ ID NO: 8285811 - DNA, 22 bp, Homo sapiens
agtggctgccaagatataattc

SEQ ID NO: 8285812 - DNA, 22 bp, Homo sapiens
agtggctgccaagagcaatgct

SEQ ID NO: 8285813 - DNA, 22 bp, Homo sapiens
agtggctgcttctggttgctcc

SEQ ID NO: 8285814 - DNA, 22 bp, Homo sapiens
actggcactatgttggagaaat

SEQ ID NO: 8285815 - DNA, 22 bp, Homo sapiens
actatgtattgtatgggctggt

SEQ ID NO: 8285816 - DNA, 22 bp, Homo sapiens
actatgtatactagatgtgtaa

SEQ ID NO: 8285817 - DNA, 22 bp, Homo sapiens
actcacagcagactatgaggga

SEQ ID NO: 8285818 - DNA, 22 bp, Homo sapiens
accttaagatcaaacattcttt

SEQ ID NO: 8285819 - DNA, 22 bp, Homo sapiens
actaaaacatagccagtcagtg

SEQ ID NO: 8285820 - DNA, 22 bp, Homo sapiens
actaaactgaagcatgaaaagg

SEQ ID NO: 8285821 - DNA, 22 bp, Homo sapiens
actaaagaacagttcgttcatg

SEQ ID NO: 8285822 - DNA, 22 bp, Homo sapiens
actaaagatgtctaaatatatt

SEQ ID NO: 8285823 - DNA, 22 bp, Homo sapiens
actaaagatgtctaaatatatt

SEQ ID NO: 8285824 - DNA, 22 bp, Homo sapiens
actaaaaactactgccaatagc

SEQ ID NO: 8285825 - DNA, 22 bp, Homo sapiens
agggtggggtgctacatcttta

SEQ ID NO: 8285826 - DNA, 22 bp, Homo sapiens
agggctggtatgtccatgaaag

SEQ ID NO: 8285827 - DNA, 20 bp, Homo sapiens
agggtggggacgttctgact

SEQ ID NO: 8285828 - DNA, 20 bp, Homo sapiens
agggtggggacgttctgact

SEQ ID NO: 8285829 - DNA, 22 bp, Homo sapiens
agggctttaatgattattttct

SEQ ID NO: 8285830 - DNA, 22 bp, Homo sapiens
aggtaccaaaagcctttttctg

SEQ ID NO: 8285831 - DNA, 21 bp, Homo sapiens
aggtaccaaaagcctgcatga

SEQ ID NO: 8285832 - DNA, 22 bp, Homo sapiens
aggtagcagcctagcagggact

SEQ ID NO: 8285833 - DNA, 22 bp, Homo sapiens
acctgtcaacccatcacctagg

SEQ ID NO: 8285834 - DNA, 22 bp, Homo sapiens
acctgtgacccttctttgcttc

SEQ ID NO: 8285835 - DNA, 22 bp, Homo sapiens
acctgtgactccaaaggacttc

SEQ ID NO: 8285836 - DNA, 21 bp, Homo sapiens
acctgtgaatagccactgcac

SEQ ID NO: 8285837 - DNA, 22 bp, Homo sapiens
acctgtcagtgctgcaggctct

SEQ ID NO: 8285838 - DNA, 22 bp, Homo sapiens
aggtagctaaaacaggcttttg

SEQ ID NO: 8285839 - DNA, 22 bp, Homo sapiens
aggtagctagtcctttaagtta

SEQ ID NO: 8285840 - DNA, 21 bp, Homo sapiens
aggtacaggtcttgtgagtct

SEQ ID NO: 8285841 - DNA, 22 bp, Homo sapiens
aggtacagtagacagacagtta

SEQ ID NO: 8285842 - DNA, 22 bp, Homo sapiens
acctggacacctgctgtcatct

SEQ ID NO: 8285843 - DNA, 18 bp, Homo sapiens
acctgcctgttcttctct

SEQ ID NO: 8285844 - DNA, 22 bp, Homo sapiens
acctgccttctcaaggacatga

SEQ ID NO: 8285845 - DNA, 22 bp, Homo sapiens
agtttccaaatattgttttagc

SEQ ID NO: 8285846 - DNA, 23 bp, Homo sapiens
actgtctgtgcttttttagggct

SEQ ID NO: 8285847 - DNA, 22 bp, Homo sapiens
actgtcttgtgttaaagaacca

SEQ ID NO: 8285848 - DNA, 22 bp, Homo sapiens
actgtgaacggactgaagccca

SEQ ID NO: 8285849 - DNA, 22 bp, Homo sapiens
actgtaaaactgctttggaaac

SEQ ID NO: 8285850 - DNA, 21 bp, Homo sapiens
agtttacaactgtccagcccc

SEQ ID NO: 8285851 - DNA, 22 bp, Homo sapiens
acttcaaattttcagaagaaat

SEQ ID NO: 8285852 - DNA, 22 bp, Homo sapiens
acttcacaaagagatcatctaa

SEQ ID NO: 8285853 - DNA, 22 bp, Homo sapiens
acttcacagaaattttatgagg

SEQ ID NO: 8285854 - DNA, 22 bp, Homo sapiens
acttcacaggttttcataaaac

SEQ ID NO: 8285855 - DNA, 22 bp, Homo sapiens
acttcacagatatttatttggt

SEQ ID NO: 8285856 - DNA, 22 bp, Homo sapiens
acttcagagaaagagggaattc

SEQ ID NO: 8285857 - DNA, 22 bp, Homo sapiens
actgtgtgctggacatgatgtt

SEQ ID NO: 8285858 - DNA, 22 bp, Homo sapiens
acttgatttttataataaatgg

SEQ ID NO: 8285859 - DNA, 22 bp, Homo sapiens
acttcatttcatttgcacagtg

SEQ ID NO: 8285860 - DNA, 22 bp, Homo sapiens
acttcatgttgtttacaactta

SEQ ID NO: 8285861 - DNA, 22 bp, Homo sapiens
acttggaatctgtttccctaga

SEQ ID NO: 8285862 - DNA, 22 bp, Homo sapiens
agaaacagcattagcatcaatt

SEQ ID NO: 8285863 - DNA, 22 bp, Homo sapiens
agaaacatttagattatatgtc

SEQ ID NO: 8285864 - DNA, 22 bp, Homo sapiens
atcacaaaggctgcttcatgat

SEQ ID NO: 8285865 - DNA, 22 bp, Homo sapiens
atcacaaaggctgcttcatgat

SEQ ID NO: 8285866 - DNA, 21 bp, Homo sapiens
agaaacatgatcaaaggaacc

SEQ ID NO: 8285867 - DNA, 22 bp, Homo sapiens
atcagaggacctagttgggcag

SEQ ID NO: 8285868 - DNA, 22 bp, Homo sapiens
atcactgttatctagaagcaca

SEQ ID NO: 8285869 - DNA, 22 bp, Homo sapiens
atcactgtggcccaaaacctca

SEQ ID NO: 8285870 - DNA, 20 bp, Homo sapiens
atcactggagaaggaaacct

SEQ ID NO: 8285871 - DNA, 22 bp, Homo sapiens
atccagagtggccttctttcca

SEQ ID NO: 8285872 - DNA, 22 bp, Homo sapiens
atccagagtgtaattctccatg

SEQ ID NO: 8285873 - DNA, 22 bp, Homo sapiens
atccagagttatatccaagcag

SEQ ID NO: 8285874 - DNA, 22 bp, Homo sapiens
atccagaggcactgccctttgt

SEQ ID NO: 8285875 - DNA, 22 bp, Homo sapiens
agaaccttggtgagtctaacct

SEQ ID NO: 8285876 - DNA, 22 bp, Homo sapiens
agaagaaatgtgaaggccactg

SEQ ID NO: 8285877 - DNA, 22 bp, Homo sapiens
atcagcaagcatttattgagtg

SEQ ID NO: 8285878 - DNA, 22 bp, Homo sapiens
atatacaaagggcaacctcgct

SEQ ID NO: 8285879 - DNA, 22 bp, Homo sapiens
actttgtaggtttcagtgaaac

SEQ ID NO: 8285880 - DNA, 22 bp, Homo sapiens
actttggggatctacggctgga

SEQ ID NO: 8285881 - DNA, 22 bp, Homo sapiens
atatgaaaagaagtcaccattg

SEQ ID NO: 8285882 - DNA, 22 bp, Homo sapiens
agaaacagaagggaaagctttt

SEQ ID NO: 8285883 - DNA, 22 bp, Homo sapiens
agaaaatttaaagagacacaca

SEQ ID NO: 8285884 - DNA, 22 bp, Homo sapiens
agaaaatttaaagagacacaca

SEQ ID NO: 8285885 - DNA, 22 bp, Homo sapiens
agaaaatttattcatgttagtt

SEQ ID NO: 8285886 - DNA, 22 bp, Homo sapiens
atatatttgagaatattcatga

SEQ ID NO: 8285887 - DNA, 22 bp, Homo sapiens
atatatttgagaatattcatga

SEQ ID NO: 8285888 - DNA, 22 bp, Homo sapiens
atatatttgagaatattcatga

SEQ ID NO: 8285889 - DNA, 22 bp, Homo sapiens
atatatttgagaatattcatga

SEQ ID NO: 8285890 - DNA, 22 bp, Homo sapiens
atatatttactctcctgttgca

SEQ ID NO: 8285891 - DNA, 22 bp, Homo sapiens
atatattttgaatagcctctgt

SEQ ID NO: 8285892 - DNA, 22 bp, Homo sapiens
atatattttgaatagcctctgt

SEQ ID NO: 8285893 - DNA, 22 bp, Homo sapiens
acatttaagttaaaacctcagt

SEQ ID NO: 8285894 - DNA, 22 bp, Homo sapiens
acattgtgaagataccactgca

SEQ ID NO: 8285895 - DNA, 22 bp, Homo sapiens
aggctagctttggctcagtaaa

SEQ ID NO: 8285896 - DNA, 22 bp, Homo sapiens
aggctagctgtttcagggctag

SEQ ID NO: 8285897 - DNA, 22 bp, Homo sapiens
aggctagctaatgagtactgtg

SEQ ID NO: 8285898 - DNA, 22 bp, Homo sapiens
aggccttggcagaggccaggct

SEQ ID NO: 8285899 - DNA, 22 bp, Homo sapiens
aggccttggaagccagggagcc

SEQ ID NO: 8285900 - DNA, 22 bp, Homo sapiens
aggccttgtgagaagcagagaa

SEQ ID NO: 8285901 - DNA, 22 bp, Homo sapiens
aggccttgccaatgagagaact

SEQ ID NO: 8285902 - DNA, 22 bp, Homo sapiens
acatttacttatcaaaagtcag

SEQ ID NO: 8285903 - DNA, 22 bp, Homo sapiens
acatttatataactcactagga

SEQ ID NO: 8285904 - DNA, 22 bp, Homo sapiens
acatttattttggcacggcaca

SEQ ID NO: 8285905 - DNA, 22 bp, Homo sapiens
aggccctgcccagagctcctcg

SEQ ID NO: 8285906 - DNA, 22 bp, Homo sapiens
aggccctgttatgagccactgt

SEQ ID NO: 8285907 - DNA, 22 bp, Homo sapiens
acatggcaggaatcatgtgttt

SEQ ID NO: 8285908 - DNA, 22 bp, Homo sapiens
acatggaatgtgtactaagtta

SEQ ID NO: 8285909 - DNA, 22 bp, Homo sapiens
acatggaagcaaagttctattt

SEQ ID NO: 8285910 - DNA, 23 bp, Homo sapiens
aggcaggcagttcagctgttgtt

SEQ ID NO: 8285911 - DNA, 22 bp, Homo sapiens
acatgaggtaagggatgttaag

SEQ ID NO: 8285912 - DNA, 22 bp, Homo sapiens
acatgcaaatgtgcatgcatgt

SEQ ID NO: 8285913 - DNA, 22 bp, Homo sapiens
acatgcaacaaagtacctgcaa

SEQ ID NO: 8285914 - DNA, 22 bp, Homo sapiens
acatgcaaagggatgcaattat

SEQ ID NO: 8285915 - DNA, 22 bp, Homo sapiens
acatgcaaagccacaggacccg

SEQ ID NO: 8285916 - DNA, 23 bp, Homo sapiens
acatgcaaaaatcacagtctcct

SEQ ID NO: 8285917 - DNA, 22 bp, Homo sapiens
acatgcaaaaatatatttatga

SEQ ID NO: 8285918 - DNA, 22 bp, Homo sapiens
acatgatttttaaagagataat

SEQ ID NO: 8285919 - DNA, 22 bp, Homo sapiens
acatgcaatattgagactttct

SEQ ID NO: 8285920 - DNA, 19 bp, Homo sapiens
acatgcaaggcacctgcag

SEQ ID NO: 8285921 - DNA, 22 bp, Homo sapiens
acatgcaagcagccgtgcagat

SEQ ID NO: 8285922 - DNA, 22 bp, Homo sapiens
acatgcaagcccctgaacacat

SEQ ID NO: 8285923 - DNA, 22 bp, Homo sapiens
acatgcaactaaagggtgccac

SEQ ID NO: 8285924 - DNA, 22 bp, Homo sapiens
agggaagaggaccagagtctct

SEQ ID NO: 8285925 - DNA, 23 bp, Homo sapiens
accaggagttgtctcaggaaaca

SEQ ID NO: 8285926 - DNA, 23 bp, Homo sapiens
aggctttatggtagaaagtttgc

SEQ ID NO: 8285927 - DNA, 22 bp, Homo sapiens
aggctttatttgatctatatgc

SEQ ID NO: 8285928 - DNA, 22 bp, Homo sapiens
aggctttactggatttttcgct

SEQ ID NO: 8285929 - DNA, 22 bp, Homo sapiens
aggctttactgcctcaggactc

SEQ ID NO: 8285930 - DNA, 22 bp, Homo sapiens
aggctggcagccacctcagcag

SEQ ID NO: 8285931 - DNA, 22 bp, Homo sapiens
accaaagcgagtgatatgtcat

SEQ ID NO: 8285932 - DNA, 21 bp, Homo sapiens
accaaaacctatactttctgt

SEQ ID NO: 8285933 - DNA, 22 bp, Homo sapiens
acatttttgggttgatgtctga

SEQ ID NO: 8285934 - DNA, 22 bp, Homo sapiens
accaaaaattgtggggctgaat

SEQ ID NO: 8285935 - DNA, 22 bp, Homo sapiens
accctcaacaaattcactctat

SEQ ID NO: 8285936 - DNA, 17 bp, Homo sapiens
acccaggctctatcttg

SEQ ID NO: 8285937 - DNA, 18 bp, Homo sapiens
acccaggctcatggtcct

SEQ ID NO: 8285938 - DNA, 17 bp, Homo sapiens
acccaggctctatcttg

SEQ ID NO: 8285939 - DNA, 22 bp, Homo sapiens
agggagctctaagtagagggac

SEQ ID NO: 8285940 - DNA, 22 bp, Homo sapiens
agggagctatttcagggttatt

SEQ ID NO: 8285941 - DNA, 22 bp, Homo sapiens
agggagctcgatgcctgagtgt

SEQ ID NO: 8285942 - DNA, 20 bp, Homo sapiens
agggcagcttgaggagccgg

SEQ ID NO: 8285943 - DNA, 22 bp, Homo sapiens
agggcatctagttccctctctt

SEQ ID NO: 8285944 - DNA, 22 bp, Homo sapiens
acccaggagcaggctgggcagt

SEQ ID NO: 8285945 - DNA, 22 bp, Homo sapiens
acccaggagcaggctgggcagt

SEQ ID NO: 8285946 - DNA, 21 bp, Homo sapiens
aggagctgtgttagctggtcg

SEQ ID NO: 8285947 - DNA, 22 bp, Homo sapiens
acaggtggcttattggctgatt

SEQ ID NO: 8285948 - DNA, 22 bp, Homo sapiens
acaggtggcataggcagtttga

SEQ ID NO: 8285949 - DNA, 22 bp, Homo sapiens
acaggtggccccgagggagtgg

SEQ ID NO: 8285950 - DNA, 22 bp, Homo sapiens
acaggtgggcttaagagtcggc

SEQ ID NO: 8285951 - DNA, 22 bp, Homo sapiens
acaggtggggaggctgaggttc

SEQ ID NO: 8285952 - DNA, 22 bp, Homo sapiens
acaggtggacacagcagcagtc

SEQ ID NO: 8285953 - DNA, 22 bp, Homo sapiens
acaggtggagtggttagcaggc

SEQ ID NO: 8285954 - DNA, 22 bp, Homo sapiens
acaggtggaaacatggtgttgg

SEQ ID NO: 8285955 - DNA, 22 bp, Homo sapiens
acagggagtctgaggggatagt

SEQ ID NO: 8285956 - DNA, 17 bp, Homo sapiens
acagtaactatgttatg

SEQ ID NO: 8285957 - DNA, 22 bp, Homo sapiens
acagtaatgataaccagcattt

SEQ ID NO: 8285958 - DNA, 22 bp, Homo sapiens
acagtacaagcatgatacataa

SEQ ID NO: 8285959 - DNA, 22 bp, Homo sapiens
aggagggtgatccgggctggtc

SEQ ID NO: 8285960 - DNA, 22 bp, Homo sapiens
aggagtgagctttggggtcaga

SEQ ID NO: 8285961 - DNA, 22 bp, Homo sapiens
acagttaccacttagcagttac

SEQ ID NO: 8285962 - DNA, 23 bp, Homo sapiens
acagttatagctgtgaataacat

SEQ ID NO: 8285963 - DNA, 22 bp, Homo sapiens
acagttatctttgaaatagaga

SEQ ID NO: 8285964 - DNA, 22 bp, Homo sapiens
aggcaggattgctgacaacaat

SEQ ID NO: 8285965 - DNA, 22 bp, Homo sapiens
aggcagcagtgataagatagga

SEQ ID NO: 8285966 - DNA, 22 bp, Homo sapiens
aggcagcaattgaaatcattgt

SEQ ID NO: 8285967 - DNA, 22 bp, Homo sapiens
acagctctgtgtattgtcatct

SEQ ID NO: 8285968 - DNA, 22 bp, Homo sapiens
acagctacatcaaactcagaag

SEQ ID NO: 8285969 - DNA, 20 bp, Homo sapiens
agctgggcaattatgactat

SEQ ID NO: 8285970 - DNA, 23 bp, Homo sapiens
agctgggcaaggatccgggctcc

SEQ ID NO: 8285971 - DNA, 19 bp, Homo sapiens
agctggggcggtgtgtgtt

SEQ ID NO: 8285972 - DNA, 22 bp, Homo sapiens
agctgccatggcctgaatttac

SEQ ID NO: 8285973 - DNA, 22 bp, Homo sapiens
agctgccatccgaggtgtcaga

SEQ ID NO: 8285974 - DNA, 22 bp, Homo sapiens
agctgccatctgaagaactgca

SEQ ID NO: 8285975 - DNA, 22 bp, Homo sapiens
agctgccaggcccctgagaacc

SEQ ID NO: 8285976 - DNA, 22 bp, Homo sapiens
agctgccccatgagaggcaggt

SEQ ID NO: 8285977 - DNA, 22 bp, Homo sapiens
agctgctatgagaaaggcactg

SEQ ID NO: 8285978 - DNA, 23 bp, Homo sapiens
aggaatggctagaagtgtgaccc

SEQ ID NO: 8285979 - DNA, 22 bp, Homo sapiens
aggaagggctgtttctccaaga

SEQ ID NO: 8285980 - DNA, 22 bp, Homo sapiens
acaggctgcctaccaagtatca

SEQ ID NO: 8285981 - DNA, 22 bp, Homo sapiens
acaggcctgacacacagagggc

SEQ ID NO: 8285982 - DNA, 22 bp, Homo sapiens
aagacttgaccaggttgaaggc

SEQ ID NO: 8285983 - DNA, 22 bp, Homo sapiens
aattttacttccctcagtgtag

SEQ ID NO: 8285984 - DNA, 22 bp, Homo sapiens
aagagaaagcagactttgtcat

SEQ ID NO: 8285985 - DNA, 22 bp, Homo sapiens
aattttaagcatatgactggtt

SEQ ID NO: 8285986 - DNA, 22 bp, Homo sapiens
aattttaatcagtggtgctgag

SEQ ID NO: 8285987 - DNA, 22 bp, Homo sapiens
aattttaatcagtggtgctgag

SEQ ID NO: 8285988 - DNA, 22 bp, Homo sapiens
aatttcactgtggagcacattt

SEQ ID NO: 8285989 - DNA, 22 bp, Homo sapiens
aagagaatacaagcaggcagga

SEQ ID NO: 8285990 - DNA, 22 bp, Homo sapiens
acacaaaatcaaagtcctaggc

SEQ ID NO: 8285991 - DNA, 19 bp, Homo sapiens
acaatgttgttggacactc

SEQ ID NO: 8285992 - DNA, 22 bp, Homo sapiens
aagagcagattcctagtggagc

SEQ ID NO: 8285993 - DNA, 22 bp, Homo sapiens
aagagcaacttggaaacactca

SEQ ID NO: 8285994 - DNA, 21 bp, Homo sapiens
acacaaacctcctcagcctgg

SEQ ID NO: 8285995 - DNA, 22 bp, Homo sapiens
acacaaacagtctatagcacca

SEQ ID NO: 8285996 - DNA, 20 bp, Homo sapiens
acacaaagcaatggagtaca

SEQ ID NO: 8285997 - DNA, 17 bp, Homo sapiens
aagaacactcaatagca

SEQ ID NO: 8285998 - DNA, 22 bp, Homo sapiens
aagaaattaaggaatgcaacga

SEQ ID NO: 8285999 - DNA, 22 bp, Homo sapiens
aagaaattaaggaatgcaacga

SEQ ID NO: 8286000 - DNA, 22 bp, Homo sapiens
aagaacaactgctttaaaagca

SEQ ID NO: 8286001 - DNA, 22 bp, Homo sapiens
aattcacaatgtgtagtcatgc

SEQ ID NO: 8286002 - DNA, 22 bp, Homo sapiens
aattcacaatgtgtagtcatgc

SEQ ID NO: 8286003 - DNA, 21 bp, Homo sapiens
aagaaagataattaaggaccc

SEQ ID NO: 8286004 - DNA, 22 bp, Homo sapiens
aagaaagagatcactcctccat

SEQ ID NO: 8286005 - DNA, 20 bp, Homo sapiens
aagaaacttgaaagtacaag

SEQ ID NO: 8286006 - DNA, 22 bp, Homo sapiens
aattctcaggaatttcatctgt

SEQ ID NO: 8286007 - DNA, 22 bp, Homo sapiens
aattctctactgtttggtgctc

SEQ ID NO: 8286008 - DNA, 22 bp, Homo sapiens
aattccgtgcctgctgttatgt

SEQ ID NO: 8286009 - DNA, 22 bp, Homo sapiens
aagaaactggaatatagagagc

SEQ ID NO: 8286010 - DNA, 22 bp, Homo sapiens
aagaaaatcagttctggtcagt

SEQ ID NO: 8286011 - DNA, 22 bp, Homo sapiens
aagaaaacatgatctaatttaa

SEQ ID NO: 8286012 - DNA, 22 bp, Homo sapiens
aactggaagagtgaatataact

SEQ ID NO: 8286013 - DNA, 22 bp, Homo sapiens
aatgggaaaagagtatgattta

SEQ ID NO: 8286014 - DNA, 22 bp, Homo sapiens
aatgggaagccagaagacaagg

SEQ ID NO: 8286015 - DNA, 22 bp, Homo sapiens
aactggagcccctctgccactg

SEQ ID NO: 8286016 - DNA, 21 bp, Homo sapiens
aagcagcttaataaagtatgt

SEQ ID NO: 8286017 - DNA, 22 bp, Homo sapiens
aagcagctggaagagtaagatg

SEQ ID NO: 8286018 - DNA, 22 bp, Homo sapiens
aagcagctgtgtgacataatct

SEQ ID NO: 8286019 - DNA, 22 bp, Homo sapiens
acagcaaaagacaagaacttaa

SEQ ID NO: 8286020 - DNA, 22 bp, Homo sapiens
acagcagaccccagtgccatgg

SEQ ID NO: 8286021 - DNA, 21 bp, Homo sapiens
acagcagagatcaagactaag

SEQ ID NO: 8286022 - DNA, 19 bp, Homo sapiens
aagcagactctgagccagg

SEQ ID NO: 8286023 - DNA, 22 bp, Homo sapiens
aagcagagccaccagctttgga

SEQ ID NO: 8286024 - DNA, 22 bp, Homo sapiens
aagcagaatttaatagaaaggt

SEQ ID NO: 8286025 - DNA, 22 bp, Homo sapiens
aagcagaatttaatagaaaggt

SEQ ID NO: 8286026 - DNA, 22 bp, Homo sapiens
aagcagaatttcccactagttg

SEQ ID NO: 8286027 - DNA, 21 bp, Homo sapiens
aagcagacctgagcacagaac

SEQ ID NO: 8286028 - DNA, 22 bp, Homo sapiens
aagcacactcagatattgactc

SEQ ID NO: 8286029 - DNA, 22 bp, Homo sapiens
aagcacacctccctggcaggag

SEQ ID NO: 8286030 - DNA, 22 bp, Homo sapiens
aagcacacagcaaaggggagct

SEQ ID NO: 8286031 - DNA, 22 bp, Homo sapiens
aagcaatagcaacaactttaca

SEQ ID NO: 8286032 - DNA, 22 bp, Homo sapiens
aagatgaagaacatgagcacac

SEQ ID NO: 8286033 - DNA, 22 bp, Homo sapiens
acacattatgagcagttgtctt

SEQ ID NO: 8286034 - DNA, 21 bp, Homo sapiens
acacattatgagcatagactc

SEQ ID NO: 8286035 - DNA, 22 bp, Homo sapiens
acacattgtcatttccatacta

SEQ ID NO: 8286036 - DNA, 22 bp, Homo sapiens
acacattgcagacatctcatta

SEQ ID NO: 8286037 - DNA, 22 bp, Homo sapiens
acacatatatacatatttgtgc

SEQ ID NO: 8286038 - DNA, 22 bp, Homo sapiens
acacatgaaagacattaaggtg

SEQ ID NO: 8286039 - DNA, 22 bp, Homo sapiens
aagagcaggctgctgtggagta

SEQ ID NO: 8286040 - DNA, 22 bp, Homo sapiens
acacatgaggaaggcctcaccc

SEQ ID NO: 8286041 - DNA, 22 bp, Homo sapiens
aagcaaggccggaaggaaactc

SEQ ID NO: 8286042 - DNA, 22 bp, Homo sapiens
aagcaaggcaacctatgtccag

SEQ ID NO: 8286043 - DNA, 22 bp, Homo sapiens
aagatggcttagagtcctggtg

SEQ ID NO: 8286044 - DNA, 22 bp, Homo sapiens
aagatgcagcaaactacttttt

SEQ ID NO: 8286045 - DNA, 22 bp, Homo sapiens
aagatgcagcttccacttttgc

SEQ ID NO: 8286046 - DNA, 22 bp, Homo sapiens
aagatgacagatgcttagagtc

SEQ ID NO: 8286047 - DNA, 22 bp, Homo sapiens
aagatgaccctgagggcaattg

SEQ ID NO: 8286048 - DNA, 22 bp, Homo sapiens
aagatgactatttatctgtaag

SEQ ID NO: 8286049 - DNA, 22 bp, Homo sapiens
aacctcaaactcttgggcttaa

SEQ ID NO: 8286050 - DNA, 22 bp, Homo sapiens
aaccctggccctggaataggca

SEQ ID NO: 8286051 - DNA, 22 bp, Homo sapiens
aaccgctgccgccggccgtacg

SEQ ID NO: 8286052 - DNA, 22 bp, Homo sapiens
aacccgggaggcggaggttgtg

SEQ ID NO: 8286053 - DNA, 22 bp, Homo sapiens
aacgcccagccttgatcaaatg

SEQ ID NO: 8286054 - DNA, 22 bp, Homo sapiens
aatgaattcgagtgaaggaaag

SEQ ID NO: 8286055 - DNA, 22 bp, Homo sapiens
aacctttatttggtactattct

SEQ ID NO: 8286056 - DNA, 19 bp, Homo sapiens
aacctttagatcattctcc

SEQ ID NO: 8286057 - DNA, 22 bp, Homo sapiens
aaccttgtataaaactttgaga

SEQ ID NO: 8286058 - DNA, 22 bp, Homo sapiens
aacctgtaaatccaaacaatct

SEQ ID NO: 8286059 - DNA, 22 bp, Homo sapiens
aactataatggggttaggaaat

SEQ ID NO: 8286060 - DNA, 22 bp, Homo sapiens
aatggctatacaacatgagtat

SEQ ID NO: 8286061 - DNA, 20 bp, Homo sapiens
aactagaaagcacccatgga

SEQ ID NO: 8286062 - DNA, 23 bp, Homo sapiens
aatgacaggcaatgtaattgtgt

SEQ ID NO: 8286063 - DNA, 22 bp, Homo sapiens
aatgacataagtgcagatgcta

SEQ ID NO: 8286064 - DNA, 22 bp, Homo sapiens
aatgacatgctttttaattata

SEQ ID NO: 8286065 - DNA, 22 bp, Homo sapiens
aatgacaataatcattaacttt

SEQ ID NO: 8286066 - DNA, 22 bp, Homo sapiens
aatgacaagacatagtctctga

SEQ ID NO: 8286067 - DNA, 22 bp, Homo sapiens
aacatcagaatatccatgttgg

SEQ ID NO: 8286068 - DNA, 22 bp, Homo sapiens
aacagcttagaaatgttgctaa

SEQ ID NO: 8286069 - DNA, 22 bp, Homo sapiens
aacagcttcatcacatggcata

SEQ ID NO: 8286070 - DNA, 22 bp, Homo sapiens
aacatatttggctgatattccc

SEQ ID NO: 8286071 - DNA, 22 bp, Homo sapiens
aacagctgcttctatcttttca

SEQ ID NO: 8286072 - DNA, 22 bp, Homo sapiens
aacagctagtaccaatccacta

SEQ ID NO: 8286073 - DNA, 22 bp, Homo sapiens
aagtgtctagcacctggatgca

SEQ ID NO: 8286074 - DNA, 22 bp, Homo sapiens
aagtgtatttttgtactaacat

SEQ ID NO: 8286075 - DNA, 22 bp, Homo sapiens
aatagacattatttctctatga

SEQ ID NO: 8286076 - DNA, 22 bp, Homo sapiens
aacatgaaaactacctgtgatt

SEQ ID NO: 8286077 - DNA, 22 bp, Homo sapiens
aacatcttcagagaagctaagt

SEQ ID NO: 8286078 - DNA, 22 bp, Homo sapiens
aaggaagacacagatgaagtga

SEQ ID NO: 8286079 - DNA, 22 bp, Homo sapiens
aaggaagacttgagaaggttcc

SEQ ID NO: 8286080 - DNA, 22 bp, Homo sapiens
aaggaagagtctagaacaggca

SEQ ID NO: 8286081 - DNA, 22 bp, Homo sapiens
aaggaagagtctagaacaggca

SEQ ID NO: 8286082 - DNA, 22 bp, Homo sapiens
aaatgtcagaagctttacttct

SEQ ID NO: 8286083 - DNA, 22 bp, Homo sapiens
aaatgtcagaggaacatattga

SEQ ID NO: 8286084 - DNA, 22 bp, Homo sapiens
aaggcagcacagcaactgctca

SEQ ID NO: 8286085 - DNA, 23 bp, Homo sapiens
aaattattgctcttcaattgcct

SEQ ID NO: 8286086 - DNA, 22 bp, Homo sapiens
aacagaaatcatttagggctct

SEQ ID NO: 8286087 - DNA, 22 bp, Homo sapiens
aacacaggttcattctgtgagg

SEQ ID NO: 8286088 - DNA, 20 bp, Homo sapiens
aacacagggttaccatcaga

SEQ ID NO: 8286089 - DNA, 22 bp, Homo sapiens
aacactgtatcagtcttcaata

SEQ ID NO: 8286090 - DNA, 22 bp, Homo sapiens
aacacaggccagcctgtgcagt

SEQ ID NO: 8286091 - DNA, 22 bp, Homo sapiens
aacacaggccagcctgtgcagt

SEQ ID NO: 8286092 - DNA, 22 bp, Homo sapiens
aacacaggccagcctgtgcagt

SEQ ID NO: 8286093 - DNA, 20 bp, Homo sapiens
aacacactggtggcatcagg

SEQ ID NO: 8286094 - DNA, 21 bp, Homo sapiens
aaatttctgcaagcctcaact

SEQ ID NO: 8286095 - DNA, 22 bp, Homo sapiens
aacaatgcttgccaagtgtgat

SEQ ID NO: 8286096 - DNA, 22 bp, Homo sapiens
aaatttgtcaacttcatatgtt

SEQ ID NO: 8286097 - DNA, 22 bp, Homo sapiens
aaagccagagtgtgttagagac

SEQ ID NO: 8286098 - DNA, 22 bp, Homo sapiens
aaagccagagcaagctgtcaca

SEQ ID NO: 8286099 - DNA, 22 bp, Homo sapiens
aaagccagctctgagctgcacc

SEQ ID NO: 8286100 - DNA, 22 bp, Homo sapiens
aaagccaggaggagggcgctcg

SEQ ID NO: 8286101 - DNA, 22 bp, Homo sapiens
aaacagcaggaacatcttgcca

SEQ ID NO: 8286102 - DNA, 22 bp, Homo sapiens
aaacagctacttctgtataatg

SEQ ID NO: 8286103 - DNA, 22 bp, Homo sapiens
aaactgcaatgacaggtaggag

SEQ ID NO: 8286104 - DNA, 22 bp, Homo sapiens
aaactgtaagagaataaactac

SEQ ID NO: 8286105 - DNA, 22 bp, Homo sapiens
aaacatgctatgttttggataa

SEQ ID NO: 8286106 - DNA, 22 bp, Homo sapiens
aaacatgctggatttagaatat

SEQ ID NO: 8286107 - DNA, 22 bp, Homo sapiens
aaagagaaaatgatctgtacat

SEQ ID NO: 8286108 - DNA, 22 bp, Homo sapiens
aaagagaaacttagaagcctga

SEQ ID NO: 8286109 - DNA, 22 bp, Homo sapiens
aaagagaaaaagatcccggctc

SEQ ID NO: 8286110 - DNA, 22 bp, Homo sapiens
aaagagaaaatgatctgtacat

SEQ ID NO: 8286111 - DNA, 20 bp, Homo sapiens
aaagagaagcctcaccttgt

SEQ ID NO: 8286112 - DNA, 22 bp, Homo sapiens
aaagagaacttttacccaagaa

SEQ ID NO: 8286113 - DNA, 22 bp, Homo sapiens
aaagagaacttttacccaagaa

SEQ ID NO: 8286114 - DNA, 22 bp, Homo sapiens
aaagacttgggtgaagtaattt

SEQ ID NO: 8286115 - DNA, 22 bp, Homo sapiens
aaagactttcacctagcaaaga

SEQ ID NO: 8286116 - DNA, 22 bp, Homo sapiens
aaactgtgaagcaagtacaagg

SEQ ID NO: 8286117 - DNA, 22 bp, Homo sapiens
aaacttctggctacaagcaata

SEQ ID NO: 8286118 - DNA, 22 bp, Homo sapiens
aaactttttattctaatgtcta

SEQ ID NO: 8286119 - DNA, 22 bp, Homo sapiens
aaacttttttaggttcataggc

SEQ ID NO: 8286120 - DNA, 22 bp, Homo sapiens
aaagaaacctatcagccacatg

SEQ ID NO: 8286121 - DNA, 16 bp, Homo sapiens
aaagaaacaggtgtcc

SEQ ID NO: 8286122 - DNA, 22 bp, Homo sapiens
aaagaaacctatcagccacatg

SEQ ID NO: 8286123 - DNA, 22 bp, Homo sapiens
aaagaaacctatcagccacatg

SEQ ID NO: 8286124 - DNA, 22 bp, Homo sapiens
aaagaaatagatggcatttaaa

SEQ ID NO: 8286125 - DNA, 21 bp, Homo sapiens
aaagaaatctcccattggtag

SEQ ID NO: 8286126 - DNA, 21 bp, Homo sapiens
aaagaaatctcccattggtag

SEQ ID NO: 8286127 - DNA, 21 bp, Homo sapiens
aaagaaatctcccattggtag

SEQ ID NO: 8286128 - DNA, 22 bp, Homo sapiens
aaagaaatagatggcatttaaa

SEQ ID NO: 8286129 - DNA, 22 bp, Homo sapiens
aaagaaatagatggcatttaaa

SEQ ID NO: 8286130 - DNA, 22 bp, Homo sapiens
aaaactttcagggatacagaaa

SEQ ID NO: 8286131 - DNA, 22 bp, Homo sapiens
aaaattatagatctagtgcctg

SEQ ID NO: 8286132 - DNA, 22 bp, Homo sapiens
aaaattaagtgtctgggaagcc

SEQ ID NO: 8286133 - DNA, 22 bp, Homo sapiens
aaaattaagtgtctgggaagcc

SEQ ID NO: 8286134 - DNA, 22 bp, Homo sapiens
aaaattatggagtatcccaaag

SEQ ID NO: 8286135 - DNA, 22 bp, Homo sapiens
aaaattattcatggcttttgga

SEQ ID NO: 8286136 - DNA, 22 bp, Homo sapiens
aaaaggtagattctccttctat

SEQ ID NO: 8286137 - DNA, 22 bp, Homo sapiens
aaaaggtagttgccaaataagg

SEQ ID NO: 8286138 - DNA, 22 bp, Homo sapiens
aaaagtaattgcaattttgtag

SEQ ID NO: 8286139 - DNA, 22 bp, Homo sapiens
aaaagtaattgcaattttgtag

SEQ ID NO: 8286140 - DNA, 22 bp, Homo sapiens
aaaactcaaacattttggcata

SEQ ID NO: 8286141 - DNA, 22 bp, Homo sapiens
aaaaccttctagactttatatt

SEQ ID NO: 8286142 - DNA, 22 bp, Homo sapiens
aaaacgttatgcattgtttatc

SEQ ID NO: 8286143 - DNA, 22 bp, Homo sapiens
aaaaccaggtagcaaaggagac

SEQ ID NO: 8286144 - DNA, 22 bp, Homo sapiens
aaaaggctagctagtaacagaa

SEQ ID NO: 8286145 - DNA, 22 bp, Homo sapiens
aaaaggctaattaagttttgga

SEQ ID NO: 8286146 - DNA, 22 bp, Homo sapiens
aaaaggctaattaagttttgga

SEQ ID NO: 8286147 - DNA, 22 bp, Homo sapiens
aaaaggctaatccagagcaact

SEQ ID NO: 8286148 - DNA, 22 bp, Homo sapiens
aaaaatacttcacttctgggtg

SEQ ID NO: 8286149 - DNA, 22 bp, Homo sapiens
aaaaagtctgcaaaggaggttg

SEQ ID NO: 8286150 - DNA, 22 bp, Homo sapiens
aaaaactgcaattacttttgtc

SEQ ID NO: 8286151 - DNA, 22 bp, Homo sapiens
aaaaaggttgatccagattagg

SEQ ID NO: 8286152 - DNA, 22 bp, Homo sapiens
aaaaagtattggccatggttga

SEQ ID NO: 8286153 - DNA, 22 bp, Homo sapiens
aaaaaggttgatccagattagg

SEQ ID NO: 8286154 - DNA, 22 bp, Homo sapiens
aaaattgagagtcttgtgcaag

SEQ ID NO: 8286155 - DNA, 22 bp, Homo sapiens
aaacacattttaggaaaatcta

SEQ ID NO: 8286156 - DNA, 22 bp, Homo sapiens
aaacacattagccctgtggaaa

SEQ ID NO: 8286157 - DNA, 22 bp, Homo sapiens
aaagagctcttactctagtgta

SEQ ID NO: 8286158 - DNA, 22 bp, Homo sapiens
aaaatactgtggagtgttgaaa

SEQ ID NO: 8286159 - DNA, 22 bp, Homo sapiens
aaactgctgggcatatatttct

SEQ ID NO: 8286160 - DNA, 22 bp, Homo sapiens
aaagatttatgaagttcaatta

SEQ ID NO: 8286161 - DNA, 22 bp, Homo sapiens
aaagatttgaaattaggcatca

SEQ ID NO: 8286162 - DNA, 22 bp, Homo sapiens
aacacttctcatcactgcaagc

SEQ ID NO: 8286163 - DNA, 22 bp, Homo sapiens
aacactgtcttatacttcaatg

SEQ ID NO: 8286164 - DNA, 22 bp, Homo sapiens
aaagcaaacagaaccccaagct

SEQ ID NO: 8286165 - DNA, 23 bp, Homo sapiens
aacatactgtttaatattcacag

SEQ ID NO: 8286166 - DNA, 22 bp, Homo sapiens
aacatataaactcttaagttca

SEQ ID NO: 8286167 - DNA, 22 bp, Homo sapiens
aaagcacttgaaatctggcagt

SEQ ID NO: 8286168 - DNA, 22 bp, Homo sapiens
aaagcactttgagactgacagg

SEQ ID NO: 8286169 - DNA, 22 bp, Homo sapiens
aaagcagcaaatacttttgcac

SEQ ID NO: 8286170 - DNA, 22 bp, Homo sapiens
aacatttttaagaccaagtgct

SEQ ID NO: 8286171 - DNA, 22 bp, Homo sapiens
aacccaggagttggaggctgtg

SEQ ID NO: 8286172 - DNA, 22 bp, Homo sapiens
aacccaggaggcagaggctgca

SEQ ID NO: 8286173 - DNA, 22 bp, Homo sapiens
aacccgggaggcagaggttgtg

SEQ ID NO: 8286174 - DNA, 22 bp, Homo sapiens
aaccccgctcaggctgggtgag

SEQ ID NO: 8286175 - DNA, 22 bp, Homo sapiens
aaaggcagtgtgatactgtggt

SEQ ID NO: 8286176 - DNA, 22 bp, Homo sapiens
aactgtgaggatgtgcaaattc

SEQ ID NO: 8286177 - DNA, 22 bp, Homo sapiens
aactgtctaaggagaatatgaa

SEQ ID NO: 8286178 - DNA, 22 bp, Homo sapiens
aagaacataacagaagctgtgt

SEQ ID NO: 8286179 - DNA, 22 bp, Homo sapiens
aagaacataaacagaaggacag

SEQ ID NO: 8286180 - DNA, 22 bp, Homo sapiens
aagaacagttgggaggtgagcc

SEQ ID NO: 8286181 - DNA, 22 bp, Homo sapiens
aagaaataagacttctctgtcc

SEQ ID NO: 8286182 - DNA, 22 bp, Homo sapiens
aaagtaagaccaagtgatcatt

SEQ ID NO: 8286183 - DNA, 23 bp, Homo sapiens
aaatacctgaattagatattatc

SEQ ID NO: 8286184 - DNA, 22 bp, Homo sapiens
aagagggctgcaatcttattgc

SEQ ID NO: 8286185 - DNA, 22 bp, Homo sapiens
aaatactgctgctattcctttt

SEQ ID NO: 8286186 - DNA, 22 bp, Homo sapiens
aaagtttcctgctaagtgctat

SEQ ID NO: 8286187 - DNA, 22 bp, Homo sapiens
aaagtttccaagttacaccatt

SEQ ID NO: 8286188 - DNA, 22 bp, Homo sapiens
aaagtttcccaaagtaatgtga

SEQ ID NO: 8286189 - DNA, 22 bp, Homo sapiens
aagagggaggtgcgggtgcaga

SEQ ID NO: 8286190 - DNA, 22 bp, Homo sapiens
aagagggaggtgcgggtgcaga

SEQ ID NO: 8286191 - DNA, 22 bp, Homo sapiens
aagagggctgcaatcttattgc

SEQ ID NO: 8286192 - DNA, 22 bp, Homo sapiens
aagaccttgtctaaacatgtag

SEQ ID NO: 8286193 - DNA, 22 bp, Homo sapiens
aagactaaatgtgttctaaagt

SEQ ID NO: 8286194 - DNA, 22 bp, Homo sapiens
aagactgatgtccagtcccatg

SEQ ID NO: 8286195 - DNA, 22 bp, Homo sapiens
aagatccatgagggcagagatt

SEQ ID NO: 8286196 - DNA, 22 bp, Homo sapiens
aagattaaaggggagacaagct

SEQ ID NO: 8286197 - DNA, 22 bp, Homo sapiens
aagatattcaaagatttattag

SEQ ID NO: 8286198 - DNA, 18 bp, Homo sapiens
aagatcacaaaatagctg

SEQ ID NO: 8286199 - DNA, 22 bp, Homo sapiens
aagcaggcatgggaggccatcc

SEQ ID NO: 8286200 - DNA, 22 bp, Homo sapiens
aagcaggcatgggaggccatcc

SEQ ID NO: 8286201 - DNA, 22 bp, Homo sapiens
aagcaggcatcttggaggtcaa

SEQ ID NO: 8286202 - DNA, 22 bp, Homo sapiens
aaatctcaggcctctatttact

SEQ ID NO: 8286203 - DNA, 22 bp, Homo sapiens
aaatctcagcccttattttaga

SEQ ID NO: 8286204 - DNA, 22 bp, Homo sapiens
aaatctcagtgttctaagcatt

SEQ ID NO: 8286205 - DNA, 22 bp, Homo sapiens
aagcaggccctgggccagggga

SEQ ID NO: 8286206 - DNA, 21 bp, Homo sapiens
aaatctgttcctggctccaaa

SEQ ID NO: 8286207 - DNA, 22 bp, Homo sapiens
aagccgggcctgagaaatgaca

SEQ ID NO: 8286208 - DNA, 22 bp, Homo sapiens
aagcccttttcaagatacaaca

SEQ ID NO: 8286209 - DNA, 22 bp, Homo sapiens
aagcccttggcgcacaccgggc

SEQ ID NO: 8286210 - DNA, 22 bp, Homo sapiens
aagccctgtccggggggaagaa

SEQ ID NO: 8286211 - DNA, 22 bp, Homo sapiens
aatgtgatctgtcatgatggca

SEQ ID NO: 8286212 - DNA, 22 bp, Homo sapiens
aatggttttgctttagtattct

SEQ ID NO: 8286213 - DNA, 22 bp, Homo sapiens
aatggtttttgcatattcaggt

SEQ ID NO: 8286214 - DNA, 22 bp, Homo sapiens
agacaattgttctaagtaaaaa

SEQ ID NO: 8286215 - DNA, 22 bp, Homo sapiens
agacaattgttctaagtaaaaa

SEQ ID NO: 8286216 - DNA, 22 bp, Homo sapiens
aatggcatgacttgcccaaggc

SEQ ID NO: 8286217 - DNA, 22 bp, Homo sapiens
agacaaaccttgttttatgatg

SEQ ID NO: 8286218 - DNA, 22 bp, Homo sapiens
agaagcagaaggaagcagggcc

SEQ ID NO: 8286219 - DNA, 22 bp, Homo sapiens
agaagcagaaggaagcagggcc

SEQ ID NO: 8286220 - DNA, 22 bp, Homo sapiens
aattaaattggtttagagagga

SEQ ID NO: 8286221 - DNA, 23 bp, Homo sapiens
aattaaattgctagatccagggc

SEQ ID NO: 8286222 - DNA, 23 bp, Homo sapiens
aattaaattgctagatccagggc

SEQ ID NO: 8286223 - DNA, 22 bp, Homo sapiens
aattaaatgacaggggaagatg

SEQ ID NO: 8286224 - DNA, 22 bp, Homo sapiens
aattaacagagggcttattact

SEQ ID NO: 8286225 - DNA, 22 bp, Homo sapiens
agagccagttaagcacttacag

SEQ ID NO: 8286226 - DNA, 22 bp, Homo sapiens
agagccaggctcccatggggca

SEQ ID NO: 8286227 - DNA, 22 bp, Homo sapiens
agagccaggctctacctgggtt

SEQ ID NO: 8286228 - DNA, 22 bp, Homo sapiens
agagcctggacttttctgagcc

SEQ ID NO: 8286229 - DNA, 22 bp, Homo sapiens
agagcctggaggttctgctgaa

SEQ ID NO: 8286230 - DNA, 22 bp, Homo sapiens
agagcctggcaaaaggtcctgc

SEQ ID NO: 8286231 - DNA, 22 bp, Homo sapiens
acaacgctaaagggtaccagaa

SEQ ID NO: 8286232 - DNA, 22 bp, Homo sapiens
agataagtactgttattattgc

SEQ ID NO: 8286233 - DNA, 22 bp, Homo sapiens
agataagtcttccatatttcta

SEQ ID NO: 8286234 - DNA, 17 bp, Homo sapiens
acaacagaaatgtattc

SEQ ID NO: 8286235 - DNA, 20 bp, Homo sapiens
acaacaaacttgcttaagga

SEQ ID NO: 8286236 - DNA, 20 bp, Homo sapiens
acaacaaacttgcttaagga

SEQ ID NO: 8286237 - DNA, 22 bp, Homo sapiens
acaacaaagacacttgaaatga

SEQ ID NO: 8286238 - DNA, 22 bp, Homo sapiens
acaacaaagacacttgaaatga

SEQ ID NO: 8286239 - DNA, 22 bp, Homo sapiens
acaatgatgcagatgagtaaga

SEQ ID NO: 8286240 - DNA, 22 bp, Homo sapiens
acaagcagtaaaggccacagtc

SEQ ID NO: 8286241 - DNA, 22 bp, Homo sapiens
acaagattcaatgaattgattg

SEQ ID NO: 8286242 - DNA, 22 bp, Homo sapiens
aattcttaatcccataaagtga

SEQ ID NO: 8286243 - DNA, 22 bp, Homo sapiens
aattcttcagtttctgggactc

SEQ ID NO: 8286244 - DNA, 22 bp, Homo sapiens
aattgaacaagtaatagaagag

SEQ ID NO: 8286245 - DNA, 22 bp, Homo sapiens
aattgaacttgatctttagcta

SEQ ID NO: 8286246 - DNA, 22 bp, Homo sapiens
acaaagaaggaattggtcttta

SEQ ID NO: 8286247 - DNA, 22 bp, Homo sapiens
agaggctgttacactcccagat

SEQ ID NO: 8286248 - DNA, 22 bp, Homo sapiens
agaggggtgggcacagcgccca

SEQ ID NO: 8286249 - DNA, 22 bp, Homo sapiens
agagggggaaaatagaggtgtt

SEQ ID NO: 8286250 - DNA, 22 bp, Homo sapiens
acaaaggcatagtgaatgtttt

SEQ ID NO: 8286251 - DNA, 22 bp, Homo sapiens
acagagaaagtgggctgaagat

SEQ ID NO: 8286252 - DNA, 22 bp, Homo sapiens
acagactgtcatgacactatat

SEQ ID NO: 8286253 - DNA, 22 bp, Homo sapiens
acagactgtgagtatgcatagt

SEQ ID NO: 8286254 - DNA, 22 bp, Homo sapiens
agccagggtgagagggctttgt

SEQ ID NO: 8286255 - DNA, 22 bp, Homo sapiens
agccagggtgagagggctttgt

SEQ ID NO: 8286256 - DNA, 22 bp, Homo sapiens
agccagggtctctcgctctgtt

SEQ ID NO: 8286257 - DNA, 22 bp, Homo sapiens
agccagggtctctcgctctgtt

SEQ ID NO: 8286258 - DNA, 22 bp, Homo sapiens
agccagggggacgctttctggc

SEQ ID NO: 8286259 - DNA, 22 bp, Homo sapiens
agccagggtaaggtacttagta

SEQ ID NO: 8286260 - DNA, 22 bp, Homo sapiens
acagagactgggatgcctgcct

SEQ ID NO: 8286261 - DNA, 22 bp, Homo sapiens
acagagactgggagcaagaggc

SEQ ID NO: 8286262 - DNA, 22 bp, Homo sapiens
acagagactgggagcaagaggc

SEQ ID NO: 8286263 - DNA, 22 bp, Homo sapiens
acagagacctggccttgctttg

SEQ ID NO: 8286264 - DNA, 22 bp, Homo sapiens
acagacagattttgtctgatgt

SEQ ID NO: 8286265 - DNA, 22 bp, Homo sapiens
acagacagattttgtctgatgt

SEQ ID NO: 8286266 - DNA, 22 bp, Homo sapiens
acagacagaggctccatgagga

SEQ ID NO: 8286267 - DNA, 22 bp, Homo sapiens
acagacagacagagaactattc

SEQ ID NO: 8286268 - DNA, 22 bp, Homo sapiens
acagacaagtagttcagacaag

SEQ ID NO: 8286269 - DNA, 22 bp, Homo sapiens
acagatggagctactaggtaaa

SEQ ID NO: 8286270 - DNA, 22 bp, Homo sapiens
acagattatggatatatgtgga

SEQ ID NO: 8286271 - DNA, 19 bp, Homo sapiens
acagcacagaaatatttca

SEQ ID NO: 8286272 - DNA, 22 bp, Homo sapiens
acagcacaggagttgaatgggc

SEQ ID NO: 8286273 - DNA, 22 bp, Homo sapiens
acagagcctccaggagtgctgg

SEQ ID NO: 8286274 - DNA, 22 bp, Homo sapiens
acagatgaggcccatcagtctg

SEQ ID NO: 8286275 - DNA, 22 bp, Homo sapiens
acagagcatttgggacagagag

SEQ ID NO: 8286276 - DNA, 22 bp, Homo sapiens
acagagccactttggtgcctac

SEQ ID NO: 8286277 - DNA, 22 bp, Homo sapiens
agcctctgactgtcagcaaggt

SEQ ID NO: 8286278 - DNA, 22 bp, Homo sapiens
agcctctcactgtcaccctccc

SEQ ID NO: 8286279 - DNA, 22 bp, Homo sapiens
agcctcctgtagccctcaccca

SEQ ID NO: 8286280 - DNA, 20 bp, Homo sapiens
agccctgtttcctggagaga

SEQ ID NO: 8286281 - DNA, 20 bp, Homo sapiens
agccctgtttcctggagaga

SEQ ID NO: 8286282 - DNA, 22 bp, Homo sapiens
acacagaggcatgacagtggct

SEQ ID NO: 8286283 - DNA, 22 bp, Homo sapiens
acacagaggctccagagataga

SEQ ID NO: 8286284 - DNA, 22 bp, Homo sapiens
acacagagttattatgtgaact

SEQ ID NO: 8286285 - DNA, 22 bp, Homo sapiens
acacagagtatttagaaggggt

SEQ ID NO: 8286286 - DNA, 22 bp, Homo sapiens
acacagagtatttagaaggggt

SEQ ID NO: 8286287 - DNA, 22 bp, Homo sapiens
acacagagtccttactgaggta

SEQ ID NO: 8286288 - DNA, 22 bp, Homo sapiens
agcagctgagccccagctgtga

SEQ ID NO: 8286289 - DNA, 22 bp, Homo sapiens
agcagctgggctcagagctggg

SEQ ID NO: 8286290 - DNA, 22 bp, Homo sapiens
agcagctggtgagcaagctcag

SEQ ID NO: 8286291 - DNA, 22 bp, Homo sapiens
agcagatgtttcagagcaggct

SEQ ID NO: 8286292 - DNA, 18 bp, Homo sapiens
agcagagagtgaatggga

SEQ ID NO: 8286293 - DNA, 22 bp, Homo sapiens
acaatgcaccagcatcttcacc

SEQ ID NO: 8286294 - DNA, 22 bp, Homo sapiens
acactcaccctcccactgcctg

SEQ ID NO: 8286295 - DNA, 22 bp, Homo sapiens
acactctgtgaggcatgtaatg

SEQ ID NO: 8286296 - DNA, 22 bp, Homo sapiens
acacccaggaataaggactggg

SEQ ID NO: 8286297 - DNA, 22 bp, Homo sapiens
acacattataggcaatcaaaag

SEQ ID NO: 8286298 - DNA, 22 bp, Homo sapiens
acactgcagatgaaagcataag

SEQ ID NO: 8286299 - DNA, 22 bp, Homo sapiens
acacttcagctccacaaacatt

SEQ ID NO: 8286300 - DNA, 22 bp, Homo sapiens
acactgaatgctgtttagaaat

SEQ ID NO: 8286301 - DNA, 22 bp, Homo sapiens
acacattaaaacgtctacaatg

SEQ ID NO: 8286302 - DNA, 22 bp, Homo sapiens
acacatgtatggcacttacatt

SEQ ID NO: 8286303 - DNA, 22 bp, Homo sapiens
acacatgtatatgcttgtgtgt

SEQ ID NO: 8286304 - DNA, 20 bp, Homo sapiens
acacatgtgcgtgttcagta

SEQ ID NO: 8286305 - DNA, 22 bp, Homo sapiens
acacatgtaaaacacttagcaa

SEQ ID NO: 8286306 - DNA, 22 bp, Homo sapiens
acacagggcagagagctggctc

SEQ ID NO: 8286307 - DNA, 22 bp, Homo sapiens
agcagctggttcccgagggcgt

SEQ ID NO: 8286308 - DNA, 22 bp, Homo sapiens
aagcgccatggttcctgcgcag

SEQ ID NO: 8286309 - DNA, 22 bp, Homo sapiens
aagccctggggttgcacaaggc

SEQ ID NO: 8286310 - DNA, 22 bp, Homo sapiens
aagctcagaggtagataatgtt

SEQ ID NO: 8286311 - DNA, 22 bp, Homo sapiens
aagctcagagtagctcagcgtc

SEQ ID NO: 8286312 - DNA, 22 bp, Homo sapiens
aagctcagcatgtctcctagaa

SEQ ID NO: 8286313 - DNA, 22 bp, Homo sapiens
aagctcaggaaagagtctggtt

SEQ ID NO: 8286314 - DNA, 22 bp, Homo sapiens
aagctcagtgatgcctccaggg

SEQ ID NO: 8286315 - DNA, 22 bp, Homo sapiens
aaggaggaatgtagccagctcc

SEQ ID NO: 8286316 - DNA, 22 bp, Homo sapiens
aaggaggacacccaggactggg

SEQ ID NO: 8286317 - DNA, 22 bp, Homo sapiens
aaggaggaatttcagggtgaat

SEQ ID NO: 8286318 - DNA, 22 bp, Homo sapiens
aaggaggaatttcagggtgaat

SEQ ID NO: 8286319 - DNA, 22 bp, Homo sapiens
aaggaggaattctgagttcatg

SEQ ID NO: 8286320 - DNA, 22 bp, Homo sapiens
aaggaggagcggaggcttgttg

SEQ ID NO: 8286321 - DNA, 22 bp, Homo sapiens
aaggaggagtggggtcctggaa

SEQ ID NO: 8286322 - DNA, 22 bp, Homo sapiens
aaggaggacacccaggactggg

SEQ ID NO: 8286323 - DNA, 22 bp, Homo sapiens
aaggaggagattagtgtttagg

SEQ ID NO: 8286324 - DNA, 22 bp, Homo sapiens
acatatgatattgaggatctca

SEQ ID NO: 8286325 - DNA, 22 bp, Homo sapiens
acagtctttctacattctgtgc

SEQ ID NO: 8286326 - DNA, 22 bp, Homo sapiens
acagtgttgaggtgcttgtttc

SEQ ID NO: 8286327 - DNA, 22 bp, Homo sapiens
aaggaggaaaatattgttgctg

SEQ ID NO: 8286328 - DNA, 22 bp, Homo sapiens
aaggaggaataaagaggtggtg

SEQ ID NO: 8286329 - DNA, 20 bp, Homo sapiens
aaggagaatgacacggctgc

SEQ ID NO: 8286330 - DNA, 22 bp, Homo sapiens
aaggagaatttggcttgtgatg

SEQ ID NO: 8286331 - DNA, 22 bp, Homo sapiens
aaggacaggctaacctgacatt

SEQ ID NO: 8286332 - DNA, 20 bp, Homo sapiens
aaggagaatgacacggctgc

SEQ ID NO: 8286333 - DNA, 22 bp, Homo sapiens
aaggagaagtctgttgagattg

SEQ ID NO: 8286334 - DNA, 22 bp, Homo sapiens
aaggacaggcacagtggtggag

SEQ ID NO: 8286335 - DNA, 22 bp, Homo sapiens
aaggaggaaaatattgttgctg

SEQ ID NO: 8286336 - DNA, 22 bp, Homo sapiens
aaggagctatgcataactgatc

SEQ ID NO: 8286337 - DNA, 22 bp, Homo sapiens
aaggagctcccggcagaccagg

SEQ ID NO: 8286338 - DNA, 22 bp, Homo sapiens
aaggctctgcaaaacctccaag

SEQ ID NO: 8286339 - DNA, 22 bp, Homo sapiens
aaggctctgggtttcataggtg

SEQ ID NO: 8286340 - DNA, 22 bp, Homo sapiens
aaggctctgggtttcataggtg

SEQ ID NO: 8286341 - DNA, 22 bp, Homo sapiens
aaggctctctgatggcagcagt

SEQ ID NO: 8286342 - DNA, 22 bp, Homo sapiens
aaggcctttgccccgatacagg

SEQ ID NO: 8286343 - DNA, 22 bp, Homo sapiens
aaggcccttggaaaatgcagta

SEQ ID NO: 8286344 - DNA, 22 bp, Homo sapiens
aaggccctttagcagaggaggg

SEQ ID NO: 8286345 - DNA, 22 bp, Homo sapiens
aaggccctttagcagaggaggg

SEQ ID NO: 8286346 - DNA, 22 bp, Homo sapiens
aaggcctttcttatcagtagat

SEQ ID NO: 8286347 - DNA, 22 bp, Homo sapiens
acattgttctacttctagttag

SEQ ID NO: 8286348 - DNA, 22 bp, Homo sapiens
acattgttgagcctcttgttca

SEQ ID NO: 8286349 - DNA, 19 bp, Homo sapiens
acatttaaattcagatctc

SEQ ID NO: 8286350 - DNA, 22 bp, Homo sapiens
acattttgagaaatgacaagct

SEQ ID NO: 8286351 - DNA, 22 bp, Homo sapiens
aagggctgtagacaagattgct

SEQ ID NO: 8286352 - DNA, 22 bp, Homo sapiens
aagggcttacatctgtttctaa

SEQ ID NO: 8286353 - DNA, 22 bp, Homo sapiens
aagggctgtagtttgttgatca

SEQ ID NO: 8286354 - DNA, 22 bp, Homo sapiens
aagggctggtctagaaagggag

SEQ ID NO: 8286355 - DNA, 22 bp, Homo sapiens
acccaggaggtggaggctgcag

SEQ ID NO: 8286356 - DNA, 22 bp, Homo sapiens
acccaggaggtgacacagggct

SEQ ID NO: 8286357 - DNA, 22 bp, Homo sapiens
acccaggagctctggggtcctc

SEQ ID NO: 8286358 - DNA, 22 bp, Homo sapiens
acccaggagccgtgagaggtta

SEQ ID NO: 8286359 - DNA, 22 bp, Homo sapiens
acccaggaggcaaggttgcagt

SEQ ID NO: 8286360 - DNA, 22 bp, Homo sapiens
acccaggaggcagaggttgcag

SEQ ID NO: 8286361 - DNA, 22 bp, Homo sapiens
acccaggatagagtgctgcagt

SEQ ID NO: 8286362 - DNA, 22 bp, Homo sapiens
acccaggatagagtgctgcagt

SEQ ID NO: 8286363 - DNA, 22 bp, Homo sapiens
accgctgtgcccctgaaagtag

SEQ ID NO: 8286364 - DNA, 22 bp, Homo sapiens
accgctgtgcccgtctcagtct

SEQ ID NO: 8286365 - DNA, 22 bp, Homo sapiens
aagtctcagaaaactagtgtgg

SEQ ID NO: 8286366 - DNA, 20 bp, Homo sapiens
acgtggccaccagtggctta

SEQ ID NO: 8286367 - DNA, 22 bp, Homo sapiens
acctttatggagaacttgggat

SEQ ID NO: 8286368 - DNA, 22 bp, Homo sapiens
acctttatgtttgattacaatt

SEQ ID NO: 8286369 - DNA, 22 bp, Homo sapiens
acctttatgaaacagctgtcgt

SEQ ID NO: 8286370 - DNA, 22 bp, Homo sapiens
acctttatgattcacaatgtat

SEQ ID NO: 8286371 - DNA, 22 bp, Homo sapiens
acctacatagttaagtaacaaa

SEQ ID NO: 8286372 - DNA, 22 bp, Homo sapiens
actctcactagctctgtgacct

SEQ ID NO: 8286373 - DNA, 22 bp, Homo sapiens
actctcactgcttggctcctgc

SEQ ID NO: 8286374 - DNA, 22 bp, Homo sapiens
actctcacagtctttgacttgg

SEQ ID NO: 8286375 - DNA, 22 bp, Homo sapiens
actctccagggatttaggatgg

SEQ ID NO: 8286376 - DNA, 22 bp, Homo sapiens
actctccacccactcactctgt

SEQ ID NO: 8286377 - DNA, 22 bp, Homo sapiens
actctcccacgttcgactctaa

SEQ ID NO: 8286378 - DNA, 22 bp, Homo sapiens
actctccctgagagggaggcat

SEQ ID NO: 8286379 - DNA, 22 bp, Homo sapiens
actctcccagctatatgtggtg

SEQ ID NO: 8286380 - DNA, 22 bp, Homo sapiens
actctccctgctatccacttcc

SEQ ID NO: 8286381 - DNA, 20 bp, Homo sapiens
actctaccagggcagcagca

SEQ ID NO: 8286382 - DNA, 22 bp, Homo sapiens
actggagctgagagcatgggta

SEQ ID NO: 8286383 - DNA, 22 bp, Homo sapiens
actgaggtttacttgaaggaga

SEQ ID NO: 8286384 - DNA, 21 bp, Homo sapiens
actgatattaaccttataaca

SEQ ID NO: 8286385 - DNA, 22 bp, Homo sapiens
actgcactccagcctgggtaac

SEQ ID NO: 8286386 - DNA, 22 bp, Homo sapiens
actctgctctgtatttcactgt

SEQ ID NO: 8286387 - DNA, 22 bp, Homo sapiens
actctcccttatctaactttac

SEQ ID NO: 8286388 - DNA, 22 bp, Homo sapiens
actctcccttatctaactttac

SEQ ID NO: 8286389 - DNA, 22 bp, Homo sapiens
actgaggtctatcatgagccag

SEQ ID NO: 8286390 - DNA, 22 bp, Homo sapiens
actgaggtagggcacacctagg

SEQ ID NO: 8286391 - DNA, 22 bp, Homo sapiens
actgagagaacgggctgctccc

SEQ ID NO: 8286392 - DNA, 22 bp, Homo sapiens
actttatgatacagggaagggt

SEQ ID NO: 8286393 - DNA, 22 bp, Homo sapiens
actttatttcctattgcatcca

SEQ ID NO: 8286394 - DNA, 22 bp, Homo sapiens
actttcttaggctgtataaatg

SEQ ID NO: 8286395 - DNA, 22 bp, Homo sapiens
actttgaaactaaaattcatta

SEQ ID NO: 8286396 - DNA, 22 bp, Homo sapiens
aatataattttattcctagagt

SEQ ID NO: 8286397 - DNA, 22 bp, Homo sapiens
aatatactatactactttctgg

SEQ ID NO: 8286398 - DNA, 22 bp, Homo sapiens
actgttcacagattagtcgatg

SEQ ID NO: 8286399 - DNA, 22 bp, Homo sapiens
actgttcaagttttatgctgga

SEQ ID NO: 8286400 - DNA, 22 bp, Homo sapiens
actgttcaagcaaatgacattg

SEQ ID NO: 8286401 - DNA, 22 bp, Homo sapiens
actgttcatctcttagaaagta

SEQ ID NO: 8286402 - DNA, 21 bp, Homo sapiens
actgttcatttgatgaactgg

SEQ ID NO: 8286403 - DNA, 22 bp, Homo sapiens
agaaatgaagcaggagttatta

SEQ ID NO: 8286404 - DNA, 22 bp, Homo sapiens
aatcataattcaaataagctta

SEQ ID NO: 8286405 - DNA, 22 bp, Homo sapiens
aatcagtattggtatagaatga

SEQ ID NO: 8286406 - DNA, 22 bp, Homo sapiens
aatcagcaaaggtcagctctaa

SEQ ID NO: 8286407 - DNA, 22 bp, Homo sapiens
aatcagcaaaggtcagctctaa

SEQ ID NO: 8286408 - DNA, 23 bp, Homo sapiens
aatcagcatgctctgtggctggc

SEQ ID NO: 8286409 - DNA, 22 bp, Homo sapiens
aatcagcaggcttctaaatttt

SEQ ID NO: 8286410 - DNA, 22 bp, Homo sapiens
aatcagcagttggaattagata

SEQ ID NO: 8286411 - DNA, 22 bp, Homo sapiens
aatcagcagaagagaggtctta

SEQ ID NO: 8286412 - DNA, 22 bp, Homo sapiens
agaagcagaaaagggcactttt

SEQ ID NO: 8286413 - DNA, 22 bp, Homo sapiens
agaaattattagtgaatagtct

SEQ ID NO: 8286414 - DNA, 22 bp, Homo sapiens
agaaatgacacacatgagacat

SEQ ID NO: 8286415 - DNA, 22 bp, Homo sapiens
ggtggcaggctggcattggcaa

SEQ ID NO: 8286416 - DNA, 22 bp, Homo sapiens
ggtggcagttacaggggcaaat

SEQ ID NO: 8286417 - DNA, 22 bp, Homo sapiens
ggtggccataggaccagcctgg

SEQ ID NO: 8286418 - DNA, 22 bp, Homo sapiens
ggtggccaggccagctctggcc

SEQ ID NO: 8286419 - DNA, 22 bp, Homo sapiens
ggtggcaggccctgagcatccc

SEQ ID NO: 8286420 - DNA, 23 bp, Homo sapiens
ggtggcaggagtggatgctgagc

SEQ ID NO: 8286421 - DNA, 22 bp, Homo sapiens
ggtggcagcgtctatctgacat

SEQ ID NO: 8286422 - DNA, 22 bp, Homo sapiens
ggtggcagaggtgcatcagccc

SEQ ID NO: 8286423 - DNA, 22 bp, Homo sapiens
ggtggcagaggtgcatcagccc

SEQ ID NO: 8286424 - DNA, 22 bp, Homo sapiens
ggtgaggggcgcctctgcccgg

SEQ ID NO: 8286425 - DNA, 22 bp, Homo sapiens
ggtgaggggctcctctgcccgg

SEQ ID NO: 8286426 - DNA, 22 bp, Homo sapiens
ggtgaggggcacctctgcccgg

SEQ ID NO: 8286427 - DNA, 22 bp, Homo sapiens
ggtgaggggcgcctctgcccag

SEQ ID NO: 8286428 - DNA, 22 bp, Homo sapiens
gtacagctaagaatttcatctt

SEQ ID NO: 8286429 - DNA, 22 bp, Homo sapiens
gtataggtgagggacttgatca

SEQ ID NO: 8286430 - DNA, 18 bp, Homo sapiens
gtatggtatggaagcatg

SEQ ID NO: 8286431 - DNA, 21 bp, Homo sapiens
gtatatcagcagtgaattcaa

SEQ ID NO: 8286432 - DNA, 22 bp, Homo sapiens
gtacagtgtgactttggagtga

SEQ ID NO: 8286433 - DNA, 22 bp, Homo sapiens
gtacagtggaggtctgtgttca

SEQ ID NO: 8286434 - DNA, 22 bp, Homo sapiens
gtacagtaatcccgttcttctg

SEQ ID NO: 8286435 - DNA, 22 bp, Homo sapiens
gtacaggtcttatctcctagga

SEQ ID NO: 8286436 - DNA, 22 bp, Homo sapiens
gtacattggcaactctcttaga

SEQ ID NO: 8286437 - DNA, 22 bp, Homo sapiens
gtacatttactgatgaaaagta

SEQ ID NO: 8286438 - DNA, 22 bp, Homo sapiens
gtacatctgtcttgttctgttg

SEQ ID NO: 8286439 - DNA, 22 bp, Homo sapiens
gtacatctttaaattgttcagt

SEQ ID NO: 8286440 - DNA, 22 bp, Homo sapiens
gtccttgtattccaagatacaa

SEQ ID NO: 8286441 - DNA, 22 bp, Homo sapiens
gtcctttttgtaaaatattcat

SEQ ID NO: 8286442 - DNA, 22 bp, Homo sapiens
gtccttggcattctgagtcttg

SEQ ID NO: 8286443 - DNA, 22 bp, Homo sapiens
gtccttggaggtgtggaatctg

SEQ ID NO: 8286444 - DNA, 22 bp, Homo sapiens
gtccttggagtcaggcaaggct

SEQ ID NO: 8286445 - DNA, 22 bp, Homo sapiens
gtccttccccagccagctctgg

SEQ ID NO: 8286446 - DNA, 22 bp, Homo sapiens
gtctctgagctctgagctggct

SEQ ID NO: 8286447 - DNA, 22 bp, Homo sapiens
gtctgaggggtttcccaggaca

SEQ ID NO: 8286448 - DNA, 22 bp, Homo sapiens
gtctgagcccccgggaagctgg

SEQ ID NO: 8286449 - DNA, 22 bp, Homo sapiens
gtctgagctacttaggatataa

SEQ ID NO: 8286450 - DNA, 22 bp, Homo sapiens
gtctgaggaagatgcaggggga

SEQ ID NO: 8286451 - DNA, 22 bp, Homo sapiens
gtctggctccgaggagtggcag

SEQ ID NO: 8286452 - DNA, 22 bp, Homo sapiens
gtctggctgtccagcttatcta

SEQ ID NO: 8286453 - DNA, 20 bp, Homo sapiens
gtctggcttcgtgattctgg

SEQ ID NO: 8286454 - DNA, 22 bp, Homo sapiens
gtctggctccaggatctcatga

SEQ ID NO: 8286455 - DNA, 22 bp, Homo sapiens
gtctggctcccactcttacaaa

SEQ ID NO: 8286456 - DNA, 22 bp, Homo sapiens
gtctggctttatatttgctatt

SEQ ID NO: 8286457 - DNA, 22 bp, Homo sapiens
gtctggctttgctcagatgctg

SEQ ID NO: 8286458 - DNA, 22 bp, Homo sapiens
gtctgggattggggtaaagaag

SEQ ID NO: 8286459 - DNA, 22 bp, Homo sapiens
gtctgggcttagggacatggca

SEQ ID NO: 8286460 - DNA, 22 bp, Homo sapiens
gtccattccttgcctctgggcc

SEQ ID NO: 8286461 - DNA, 22 bp, Homo sapiens
gtcccagaaacatattgctggt

SEQ ID NO: 8286462 - DNA, 22 bp, Homo sapiens
gtcccaggtcccagcacatctg

SEQ ID NO: 8286463 - DNA, 22 bp, Homo sapiens
gtcccataagtagtgcaacttg

SEQ ID NO: 8286464 - DNA, 22 bp, Homo sapiens
gtcccataagtagtgcaacttg

SEQ ID NO: 8286465 - DNA, 22 bp, Homo sapiens
gtcctgtgtgagtgcaccacct

SEQ ID NO: 8286466 - DNA, 22 bp, Homo sapiens
gtcctggtagggctctgtgtct

SEQ ID NO: 8286467 - DNA, 22 bp, Homo sapiens
gtcctgtgtaagccaggacaat

SEQ ID NO: 8286468 - DNA, 22 bp, Homo sapiens
gtcctggtagctggcttggtca

SEQ ID NO: 8286469 - DNA, 19 bp, Homo sapiens
gtcagctggaactctgaaa

SEQ ID NO: 8286470 - DNA, 22 bp, Homo sapiens
gtcagctgggcatctgcagatg

SEQ ID NO: 8286471 - DNA, 22 bp, Homo sapiens
gtcagctgggcatctgcagatg

SEQ ID NO: 8286472 - DNA, 22 bp, Homo sapiens
gtcagctgcagtgggcacagcc

SEQ ID NO: 8286473 - DNA, 22 bp, Homo sapiens
gtcagctgtctccccagagtgg

SEQ ID NO: 8286474 - DNA, 22 bp, Homo sapiens
gtcagctgtctccccagagtgg

SEQ ID NO: 8286475 - DNA, 21 bp, Homo sapiens
gtcagctgtgtgtgaggaccc

SEQ ID NO: 8286476 - DNA, 21 bp, Homo sapiens
gtcagctgtgtgtgaggaccc

SEQ ID NO: 8286477 - DNA, 21 bp, Homo sapiens
gtcagctgtgtgtgaggaccc

SEQ ID NO: 8286478 - DNA, 22 bp, Homo sapiens
gtcagcttccctttggtttatt

SEQ ID NO: 8286479 - DNA, 22 bp, Homo sapiens
gtcaggccctggcagccgtgac

SEQ ID NO: 8286480 - DNA, 22 bp, Homo sapiens
gtcaggagaggccatcagcttt

SEQ ID NO: 8286481 - DNA, 22 bp, Homo sapiens
gtcaggagatagggcaagcttc

SEQ ID NO: 8286482 - DNA, 22 bp, Homo sapiens
gtggcacataggatcctgtggc

SEQ ID NO: 8286483 - DNA, 22 bp, Homo sapiens
gtggcacagagatggggcatga

SEQ ID NO: 8286484 - DNA, 22 bp, Homo sapiens
gtggatggagctggaagccatt

SEQ ID NO: 8286485 - DNA, 18 bp, Homo sapiens
gtggagggttctcagaat

SEQ ID NO: 8286486 - DNA, 22 bp, Homo sapiens
gtggaggaaaagaagttgggtg

SEQ ID NO: 8286487 - DNA, 22 bp, Homo sapiens
gtggaggacaaaagaagccttt

SEQ ID NO: 8286488 - DNA, 22 bp, Homo sapiens
gtgacaatattagctcaggggc

SEQ ID NO: 8286489 - DNA, 22 bp, Homo sapiens
gtgacaggatagtcagctttgt

SEQ ID NO: 8286490 - DNA, 22 bp, Homo sapiens
gtgacagagtgagaccttgtct

SEQ ID NO: 8286491 - DNA, 22 bp, Homo sapiens
gtgcctggaccctctttccgga

SEQ ID NO: 8286492 - DNA, 23 bp, Homo sapiens
gtgcgccaggacaacctgacgga

SEQ ID NO: 8286493 - DNA, 22 bp, Homo sapiens
gtggaaggtaatgcagcttact

SEQ ID NO: 8286494 - DNA, 22 bp, Homo sapiens
gtggaagggactgcctagagga

SEQ ID NO: 8286495 - DNA, 22 bp, Homo sapiens
gtggccaagaggggactggata

SEQ ID NO: 8286496 - DNA, 22 bp, Homo sapiens
gtggccagccagggtgctgatg

SEQ ID NO: 8286497 - DNA, 22 bp, Homo sapiens
gtggccagaatcttgaggcctt

SEQ ID NO: 8286498 - DNA, 22 bp, Homo sapiens
gtggcccagccctacagaggac

SEQ ID NO: 8286499 - DNA, 22 bp, Homo sapiens
gtggccaggagaccttgggcat

SEQ ID NO: 8286500 - DNA, 22 bp, Homo sapiens
gtggctctctggtcccctgcca

SEQ ID NO: 8286501 - DNA, 22 bp, Homo sapiens
gtggctctaggtgagcatggag

SEQ ID NO: 8286502 - DNA, 22 bp, Homo sapiens
gtggcctggcgagctggcgcgg

SEQ ID NO: 8286503 - DNA, 22 bp, Homo sapiens
gtggcctgccagcagatggcgc

SEQ ID NO: 8286504 - DNA, 22 bp, Homo sapiens
gtggcctggaaaggctggtctg

SEQ ID NO: 8286505 - DNA, 22 bp, Homo sapiens
gtggctggtttcctgcatgcaa

SEQ ID NO: 8286506 - DNA, 22 bp, Homo sapiens
gtggctgggctccgagcggctt

SEQ ID NO: 8286507 - DNA, 22 bp, Homo sapiens
gtggctgctgtcctctctggtt

SEQ ID NO: 8286508 - DNA, 22 bp, Homo sapiens
gtggctggccctggaccctaag

SEQ ID NO: 8286509 - DNA, 22 bp, Homo sapiens
gtggctggagtatgaggaaagg

SEQ ID NO: 8286510 - DNA, 22 bp, Homo sapiens
gtggctgcagagggcacagcat

SEQ ID NO: 8286511 - DNA, 22 bp, Homo sapiens
gtggctgctcgggctccggccc

SEQ ID NO: 8286512 - DNA, 22 bp, Homo sapiens
gtggctgctaagtctccttcct

SEQ ID NO: 8286513 - DNA, 22 bp, Homo sapiens
gtgtcaggggcagccaggaaat

SEQ ID NO: 8286514 - DNA, 19 bp, Homo sapiens
gtgtcaggatgtgcagggg

SEQ ID NO: 8286515 - DNA, 22 bp, Homo sapiens
gtgtcacatggtttactgcagc

SEQ ID NO: 8286516 - DNA, 22 bp, Homo sapiens
gtgtcaggcagtcagcatggag

SEQ ID NO: 8286517 - DNA, 22 bp, Homo sapiens
gtgtggggaggagagagccctt

SEQ ID NO: 8286518 - DNA, 22 bp, Homo sapiens
gtgtggggccaggatcagggct

SEQ ID NO: 8286519 - DNA, 22 bp, Homo sapiens
gtgtggggagctgcagccacat

SEQ ID NO: 8286520 - DNA, 22 bp, Homo sapiens
gtgtggggctcagtgggaatgt

SEQ ID NO: 8286521 - DNA, 22 bp, Homo sapiens
gtgtgggggcagctctgatatg

SEQ ID NO: 8286522 - DNA, 22 bp, Homo sapiens
gtgtggggtcttctcttggcct

SEQ ID NO: 8286523 - DNA, 22 bp, Homo sapiens
gtgtgcaggccacaggccaggg

SEQ ID NO: 8286524 - DNA, 22 bp, Homo sapiens
gtgtgcagggggccagcgcagc

SEQ ID NO: 8286525 - DNA, 22 bp, Homo sapiens
gttctccattcagcttcctgtg

SEQ ID NO: 8286526 - DNA, 22 bp, Homo sapiens
gttctccactgcagagtctctc

SEQ ID NO: 8286527 - DNA, 22 bp, Homo sapiens
gttctccaggggctgttcatct

SEQ ID NO: 8286528 - DNA, 22 bp, Homo sapiens
gttctctgccggcacctacccg

SEQ ID NO: 8286529 - DNA, 22 bp, Homo sapiens
gttgttttaaaatactccagaa

SEQ ID NO: 8286530 - DNA, 22 bp, Homo sapiens
gttgttttataattgattgcaa

SEQ ID NO: 8286531 - DNA, 22 bp, Homo sapiens
gttgttttataggctcatgcct

SEQ ID NO: 8286532 - DNA, 22 bp, Homo sapiens
gttgttttcacaaacccatgat

SEQ ID NO: 8286533 - DNA, 22 bp, Homo sapiens
gttgttttataggctcatgcct

SEQ ID NO: 8286534 - DNA, 22 bp, Homo sapiens
gtgtgtccctacaacagcttca

SEQ ID NO: 8286535 - DNA, 22 bp, Homo sapiens
gttattttatctctgagaggtt

SEQ ID NO: 8286536 - DNA, 22 bp, Homo sapiens
gttcaagaccagcctggccaac

SEQ ID NO: 8286537 - DNA, 22 bp, Homo sapiens
gtgggtggagactgggtgcaag

SEQ ID NO: 8286538 - DNA, 22 bp, Homo sapiens
gtgggtggaggcgtcgagggca

SEQ ID NO: 8286539 - DNA, 22 bp, Homo sapiens
gtggtcaaagcatcagagacct

SEQ ID NO: 8286540 - DNA, 22 bp, Homo sapiens
gtggtccatcatgcagagctcc

SEQ ID NO: 8286541 - DNA, 22 bp, Homo sapiens
gtgtacagatatctcacgttct

SEQ ID NO: 8286542 - DNA, 22 bp, Homo sapiens
gtgtaattttgtggtcctgtac

SEQ ID NO: 8286543 - DNA, 22 bp, Homo sapiens
gtgtaatttctaggtaatttga

SEQ ID NO: 8286544 - DNA, 22 bp, Homo sapiens
gtgtaattgaaattgagaacca

SEQ ID NO: 8286545 - DNA, 22 bp, Homo sapiens
gtgtaattagtagtaaattcaa

SEQ ID NO: 8286546 - DNA, 22 bp, Homo sapiens
gtgtaattatataaagatctac

SEQ ID NO: 8286547 - DNA, 22 bp, Homo sapiens
gtggtttttagatttctacagt

SEQ ID NO: 8286548 - DNA, 22 bp, Homo sapiens
gtggggacgggatggctcactg

SEQ ID NO: 8286549 - DNA, 22 bp, Homo sapiens
gtggggaggcattcttctccct

SEQ ID NO: 8286550 - DNA, 22 bp, Homo sapiens
gtggggctggaagatgggtact

SEQ ID NO: 8286551 - DNA, 22 bp, Homo sapiens
gtgggggatgctgagttggaaa

SEQ ID NO: 8286552 - DNA, 22 bp, Homo sapiens
gtgggctggaccctcctgctcc

SEQ ID NO: 8286553 - DNA, 22 bp, Homo sapiens
gtgggctgcccttgaggtcagc

SEQ ID NO: 8286554 - DNA, 22 bp, Homo sapiens
gtgggctgcttcctccttccac

SEQ ID NO: 8286555 - DNA, 22 bp, Homo sapiens
gtgggctcccctggcatgtcca

SEQ ID NO: 8286556 - DNA, 22 bp, Homo sapiens
gtgggctgaggggacaccaagg

SEQ ID NO: 8286557 - DNA, 22 bp, Homo sapiens
gtgggcagtggtttgcgcggtc

SEQ ID NO: 8286558 - DNA, 22 bp, Homo sapiens
gtgggcaggaggccctgccctg

SEQ ID NO: 8286559 - DNA, 22 bp, Homo sapiens
gtgggcagtgtgtcagtatctt

SEQ ID NO: 8286560 - DNA, 22 bp, Homo sapiens
gtgggcagccccttcaaggcca

SEQ ID NO: 8286561 - DNA, 22 bp, Homo sapiens
gtgggccagcattttgaagagt

SEQ ID NO: 8286562 - DNA, 22 bp, Homo sapiens
gtgggccacatcccagggctct

SEQ ID NO: 8286563 - DNA, 22 bp, Homo sapiens
gtgggcagcaccagggaagtgt

SEQ ID NO: 8286564 - DNA, 20 bp, Homo sapiens
gtgggcagcaggcatactgg

SEQ ID NO: 8286565 - DNA, 22 bp, Homo sapiens
gtgggcagatacatttgatatg

SEQ ID NO: 8286566 - DNA, 20 bp, Homo sapiens
gtgggcagatgtgtgcatgg

SEQ ID NO: 8286567 - DNA, 22 bp, Homo sapiens
gtgggcagattaatttctcaat

SEQ ID NO: 8286568 - DNA, 22 bp, Homo sapiens
gtgggcaaggtccctgccagct

SEQ ID NO: 8286569 - DNA, 22 bp, Homo sapiens
gtgggcagaacatttgtaggct

SEQ ID NO: 8286570 - DNA, 22 bp, Homo sapiens
gtgggcagagcaagggaactca

SEQ ID NO: 8286571 - DNA, 20 bp, Homo sapiens
gtgggcagagcaccacctgg

SEQ ID NO: 8286572 - DNA, 22 bp, Homo sapiens
gtttaataatgttgaattacta

SEQ ID NO: 8286573 - DNA, 22 bp, Homo sapiens
gtttttctagaaatctcctcct

SEQ ID NO: 8286574 - DNA, 22 bp, Homo sapiens
gtttaattcccacacctgccct

SEQ ID NO: 8286575 - DNA, 19 bp, Homo sapiens
gttgtttttcttattatgg

SEQ ID NO: 8286576 - DNA, 22 bp, Homo sapiens
gttgttttgcaggatccttaca

SEQ ID NO: 8286577 - DNA, 22 bp, Homo sapiens
gttgttttgctgtctgtcttag

SEQ ID NO: 8286578 - DNA, 20 bp, Homo sapiens
gtttttcttgggcgagctat

SEQ ID NO: 8286579 - DNA, 22 bp, Homo sapiens
gtttttctctgaaatagttgac

SEQ ID NO: 8286580 - DNA, 22 bp, Homo sapiens
gtttttctagactgggagtttg

SEQ ID NO: 8286581 - DNA, 22 bp, Homo sapiens
gtttttctaggaccatgtgatt

SEQ ID NO: 8286582 - DNA, 22 bp, Homo sapiens
taaaacacataaactctctatt

SEQ ID NO: 8286583 - DNA, 22 bp, Homo sapiens
taaaacacataaactctctatt

SEQ ID NO: 8286584 - DNA, 22 bp, Homo sapiens
taaaacactcagcacctagcaa

SEQ ID NO: 8286585 - DNA, 22 bp, Homo sapiens
taaaacacctgtagtgtctgcc

SEQ ID NO: 8286586 - DNA, 22 bp, Homo sapiens
gtttttgtcgagttccttgacc

SEQ ID NO: 8286587 - DNA, 22 bp, Homo sapiens
gttttttcatgagtagttatct

SEQ ID NO: 8286588 - DNA, 22 bp, Homo sapiens
gtttttctttgtgtgaagacaa

SEQ ID NO: 8286589 - DNA, 22 bp, Homo sapiens
taaaggattttgtataatataa

SEQ ID NO: 8286590 - DNA, 22 bp, Homo sapiens
taaaggcagtaattcctgagtt

SEQ ID NO: 8286591 - DNA, 22 bp, Homo sapiens
taaagcttgtattgcaatattt

SEQ ID NO: 8286592 - DNA, 22 bp, Homo sapiens
taaaaccataaggctggaagga

SEQ ID NO: 8286593 - DNA, 22 bp, Homo sapiens
taaaaccaggtcttgggattta

SEQ ID NO: 8286594 - DNA, 22 bp, Homo sapiens
taaatcactcttctctcaccac

SEQ ID NO: 8286595 - DNA, 22 bp, Homo sapiens
taaatcactcctaataatcagt

SEQ ID NO: 8286596 - DNA, 22 bp, Homo sapiens
taaatcactgttcattccacac

SEQ ID NO: 8286597 - DNA, 22 bp, Homo sapiens
taaatcactgttcattccacac

SEQ ID NO: 8286598 - DNA, 22 bp, Homo sapiens
taaatcactgtactttattcct

SEQ ID NO: 8286599 - DNA, 22 bp, Homo sapiens
taaatcacccatctcctaatct

SEQ ID NO: 8286600 - DNA, 22 bp, Homo sapiens
taacactgccatgctggagtca

SEQ ID NO: 8286601 - DNA, 22 bp, Homo sapiens
taacactggtatttcatttagt

SEQ ID NO: 8286602 - DNA, 22 bp, Homo sapiens
taacagaatagcagaaacagaa

SEQ ID NO: 8286603 - DNA, 22 bp, Homo sapiens
taacagaatttgctaaactccg

SEQ ID NO: 8286604 - DNA, 20 bp, Homo sapiens
gggtgagatgtaggagaggg

SEQ ID NO: 8286605 - DNA, 22 bp, Homo sapiens
gggtgaggagctgccagtcatg

SEQ ID NO: 8286606 - DNA, 22 bp, Homo sapiens
gggtggctgagaacaggacccc

SEQ ID NO: 8286607 - DNA, 22 bp, Homo sapiens
gggtgaggagctgccagtcatg

SEQ ID NO: 8286608 - DNA, 23 bp, Homo sapiens
gggtgggccaaattaggtagcct

SEQ ID NO: 8286609 - DNA, 22 bp, Homo sapiens
gggtgggccactgagcagcgtg

SEQ ID NO: 8286610 - DNA, 22 bp, Homo sapiens
gggtgggcctgtctggccatgt

SEQ ID NO: 8286611 - DNA, 22 bp, Homo sapiens
gggtgggcctgtctggccatgt

SEQ ID NO: 8286612 - DNA, 22 bp, Homo sapiens
gggtgggccccaggtatctgta

SEQ ID NO: 8286613 - DNA, 22 bp, Homo sapiens
gggtcttctgatataggtccag

SEQ ID NO: 8286614 - DNA, 22 bp, Homo sapiens
gggtgagacagaaagagcaaaa

SEQ ID NO: 8286615 - DNA, 22 bp, Homo sapiens
gggtgagagtcaggcagagatt

SEQ ID NO: 8286616 - DNA, 22 bp, Homo sapiens
gggtctctccctttagttattt

SEQ ID NO: 8286617 - DNA, 22 bp, Homo sapiens
gggtctctcctccccagctgtg

SEQ ID NO: 8286618 - DNA, 22 bp, Homo sapiens
gggtctctctcggctccacgcg

SEQ ID NO: 8286619 - DNA, 22 bp, Homo sapiens
gggtctctgagcttccaagata

SEQ ID NO: 8286620 - DNA, 22 bp, Homo sapiens
gggtctctcagaaggctgcaat

SEQ ID NO: 8286621 - DNA, 22 bp, Homo sapiens
gggtctctcatgcagttgctgt

SEQ ID NO: 8286622 - DNA, 22 bp, Homo sapiens
gggggctcctcccagctgccag

SEQ ID NO: 8286623 - DNA, 22 bp, Homo sapiens
gggggctggaatatccatcaac

SEQ ID NO: 8286624 - DNA, 18 bp, Homo sapiens
ggggtagagtgtcctatt

SEQ ID NO: 8286625 - DNA, 22 bp, Homo sapiens
ggggtactggctggagccccac

SEQ ID NO: 8286626 - DNA, 22 bp, Homo sapiens
gggctggagacaagtgagccgc

SEQ ID NO: 8286627 - DNA, 22 bp, Homo sapiens
gggctggaccgcgacccctgag

SEQ ID NO: 8286628 - DNA, 21 bp, Homo sapiens
gggctggacatggtggctcat

SEQ ID NO: 8286629 - DNA, 22 bp, Homo sapiens
gggctggcaggacctgggctga

SEQ ID NO: 8286630 - DNA, 17 bp, Homo sapiens
gggctggatggccatgg

SEQ ID NO: 8286631 - DNA, 22 bp, Homo sapiens
gggctggatgggagccttggcc

SEQ ID NO: 8286632 - DNA, 22 bp, Homo sapiens
gggctctggtacttcctggctc

SEQ ID NO: 8286633 - DNA, 22 bp, Homo sapiens
gggctctgggtcgtgtctccat

SEQ ID NO: 8286634 - DNA, 22 bp, Homo sapiens
gggctagcctcttccctgctcc

SEQ ID NO: 8286635 - DNA, 22 bp, Homo sapiens
gggctgagacgatggggtcttc

SEQ ID NO: 8286636 - DNA, 22 bp, Homo sapiens
gggaggcttgagccatactgcc

SEQ ID NO: 8286637 - DNA, 22 bp, Homo sapiens
gggaggctggctctggccacag

SEQ ID NO: 8286638 - DNA, 22 bp, Homo sapiens
gggagggaaggaccttatgaat

SEQ ID NO: 8286639 - DNA, 22 bp, Homo sapiens
gggatggcctagactagcttgg

SEQ ID NO: 8286640 - DNA, 22 bp, Homo sapiens
gggaggctcagtggtgtcctct

SEQ ID NO: 8286641 - DNA, 22 bp, Homo sapiens
gggagaaggaggactgtgctgt

SEQ ID NO: 8286642 - DNA, 20 bp, Homo sapiens
gggagaagggctgatgagag

SEQ ID NO: 8286643 - DNA, 22 bp, Homo sapiens
gggacgagatcttggcagtgtg

SEQ ID NO: 8286644 - DNA, 22 bp, Homo sapiens
gggcagatgtctggacacctca

SEQ ID NO: 8286645 - DNA, 22 bp, Homo sapiens
gggcagcaaatctgagtctggt

SEQ ID NO: 8286646 - DNA, 22 bp, Homo sapiens
gggcagatggggcacaggctga

SEQ ID NO: 8286647 - DNA, 22 bp, Homo sapiens
gggcagcacagacagtgaaggc

SEQ ID NO: 8286648 - DNA, 20 bp, Homo sapiens
gggcagcctcgggagtgggt

SEQ ID NO: 8286649 - DNA, 22 bp, Homo sapiens
gggcagccgcgtgacctgccag

SEQ ID NO: 8286650 - DNA, 22 bp, Homo sapiens
gggcagcagaattggacagaaa

SEQ ID NO: 8286651 - DNA, 22 bp, Homo sapiens
gggcagcccagaactgctgcag

SEQ ID NO: 8286652 - DNA, 22 bp, Homo sapiens
gggcagcacgtttcaggaggat

SEQ ID NO: 8286653 - DNA, 22 bp, Homo sapiens
gggccaggtatcgtctttagta

SEQ ID NO: 8286654 - DNA, 22 bp, Homo sapiens
gggccaggtcggtgaatggtca

SEQ ID NO: 8286655 - DNA, 22 bp, Homo sapiens
gggcagcctcggtgcctgctgc

SEQ ID NO: 8286656 - DNA, 22 bp, Homo sapiens
gggcagcctgctttctgatcca

SEQ ID NO: 8286657 - DNA, 22 bp, Homo sapiens
gggcagctcagccaccatgcag

SEQ ID NO: 8286658 - DNA, 22 bp, Homo sapiens
gggcagctagccctctagccca

SEQ ID NO: 8286659 - DNA, 22 bp, Homo sapiens
gggcggatcatttgaggtcagg

SEQ ID NO: 8286660 - DNA, 22 bp, Homo sapiens
gggcggatcacctgaggtcagg

SEQ ID NO: 8286661 - DNA, 22 bp, Homo sapiens
gggctagaagttagctagagaa

SEQ ID NO: 8286662 - DNA, 22 bp, Homo sapiens
gggctacattgtgagagaagtt

SEQ ID NO: 8286663 - DNA, 22 bp, Homo sapiens
ggctggcttgccaagctcaggg

SEQ ID NO: 8286664 - DNA, 22 bp, Homo sapiens
ggctgtgtccccacctgagcag

SEQ ID NO: 8286665 - DNA, 22 bp, Homo sapiens
ggctgtgtcctgtatgattatt

SEQ ID NO: 8286666 - DNA, 21 bp, Homo sapiens
ggctgtgttcagggcatgcgg

SEQ ID NO: 8286667 - DNA, 22 bp, Homo sapiens
ggcttcaggggtctgtctgcac

SEQ ID NO: 8286668 - DNA, 23 bp, Homo sapiens
ggcttcagtgagagtccctgctg

SEQ ID NO: 8286669 - DNA, 22 bp, Homo sapiens
ggcttcagtgactggtgccctc

SEQ ID NO: 8286670 - DNA, 22 bp, Homo sapiens
ggcttcagtggccagagatgat

SEQ ID NO: 8286671 - DNA, 19 bp, Homo sapiens
ggcttcagtttagcaggct

SEQ ID NO: 8286672 - DNA, 22 bp, Homo sapiens
ggcttcccagcagagggcgcac

SEQ ID NO: 8286673 - DNA, 22 bp, Homo sapiens
ggcttcccaaggagccaggatg

SEQ ID NO: 8286674 - DNA, 22 bp, Homo sapiens
ggcttcccagtccctgctctca

SEQ ID NO: 8286675 - DNA, 22 bp, Homo sapiens
ggcttccctgtttgctgtgcct

SEQ ID NO: 8286676 - DNA, 22 bp, Homo sapiens
ggcttccctgtttgctgtgcct

SEQ ID NO: 8286677 - DNA, 18 bp, Homo sapiens
ggcttccctactcacttc

SEQ ID NO: 8286678 - DNA, 22 bp, Homo sapiens
ggcttccctgcctcacttattc

SEQ ID NO: 8286679 - DNA, 22 bp, Homo sapiens
ggcttccctaaacctttccact

SEQ ID NO: 8286680 - DNA, 22 bp, Homo sapiens
ggcttcccctccagtgctctgt

SEQ ID NO: 8286681 - DNA, 20 bp, Homo sapiens
ggcttccccgccatcttccg

SEQ ID NO: 8286682 - DNA, 22 bp, Homo sapiens
ggcttccccacagtcctgagct

SEQ ID NO: 8286683 - DNA, 22 bp, Homo sapiens
ggcttccccacaaagcacacaa

SEQ ID NO: 8286684 - DNA, 22 bp, Homo sapiens
gggaaatctcgtcctctattta

SEQ ID NO: 8286685 - DNA, 22 bp, Homo sapiens
ggctttgcttctccagatgctt

SEQ ID NO: 8286686 - DNA, 22 bp, Homo sapiens
ggctttgctttggctgtttcag

SEQ ID NO: 8286687 - DNA, 22 bp, Homo sapiens
ggcttcctggggcctcctgcaa

SEQ ID NO: 8286688 - DNA, 22 bp, Homo sapiens
ggcttcctccttcctgctgtca

SEQ ID NO: 8286689 - DNA, 22 bp, Homo sapiens
ggctgagttgagaggattactt

SEQ ID NO: 8286690 - DNA, 22 bp, Homo sapiens
ggctgagttgagaggattactt

SEQ ID NO: 8286691 - DNA, 22 bp, Homo sapiens
ggctctcggcggaccctgggaa

SEQ ID NO: 8286692 - DNA, 22 bp, Homo sapiens
ggctcctgggcagctgctccct

SEQ ID NO: 8286693 - DNA, 22 bp, Homo sapiens
ggctcctgggatgggactgagc

SEQ ID NO: 8286694 - DNA, 22 bp, Homo sapiens
ggctccttcaagcctgtcactg

SEQ ID NO: 8286695 - DNA, 22 bp, Homo sapiens
ggctccttgccaccagctctgc

SEQ ID NO: 8286696 - DNA, 22 bp, Homo sapiens
ggctgcaggcagaggctgtctg

SEQ ID NO: 8286697 - DNA, 22 bp, Homo sapiens
ggctgctcggagcctcctgtga

SEQ ID NO: 8286698 - DNA, 22 bp, Homo sapiens
ggctgctcggcagctcctgagc

SEQ ID NO: 8286699 - DNA, 22 bp, Homo sapiens
ggctgctgaacaagggaaccct

SEQ ID NO: 8286700 - DNA, 23 bp, Homo sapiens
ggctgctcttttcatgctgtttc

SEQ ID NO: 8286701 - DNA, 22 bp, Homo sapiens
ggccatgtttggcagaaggatt

SEQ ID NO: 8286702 - DNA, 19 bp, Homo sapiens
ggcccaagtactgagtgcc

SEQ ID NO: 8286703 - DNA, 22 bp, Homo sapiens
ggcccctcagcatctgagtcag

SEQ ID NO: 8286704 - DNA, 22 bp, Homo sapiens
ggccagaggccacagctgtgtc

SEQ ID NO: 8286705 - DNA, 22 bp, Homo sapiens
ggccagaggacctctcatagcc

SEQ ID NO: 8286706 - DNA, 22 bp, Homo sapiens
ggccagagctcaaacagtcgca

SEQ ID NO: 8286707 - DNA, 22 bp, Homo sapiens
ggccagagagcagccaggattc

SEQ ID NO: 8286708 - DNA, 22 bp, Homo sapiens
ggcaggtgcttgtcgaaggcct

SEQ ID NO: 8286709 - DNA, 22 bp, Homo sapiens
ggccagaagttggaaaagagcc

SEQ ID NO: 8286710 - DNA, 22 bp, Homo sapiens
ggccagaagttggaaaagagcc

SEQ ID NO: 8286711 - DNA, 22 bp, Homo sapiens
ggccacctctgccctactgagt

SEQ ID NO: 8286712 - DNA, 22 bp, Homo sapiens
ggccacctggctgtgggggcag

SEQ ID NO: 8286713 - DNA, 20 bp, Homo sapiens
ggccacctgcttcagacccc

SEQ ID NO: 8286714 - DNA, 22 bp, Homo sapiens
ggccacctgggttcgactgggc

SEQ ID NO: 8286715 - DNA, 22 bp, Homo sapiens
ggccaccttcctgtggtctctg

SEQ ID NO: 8286716 - DNA, 22 bp, Homo sapiens
ggccaccttaagttaaggatat

SEQ ID NO: 8286717 - DNA, 22 bp, Homo sapiens
ggctccaaagggcagtgtgagg

SEQ ID NO: 8286718 - DNA, 22 bp, Homo sapiens
ggctcaggtttccttcccagct

SEQ ID NO: 8286719 - DNA, 22 bp, Homo sapiens
ggctcaggtttaaagtgcttta

SEQ ID NO: 8286720 - DNA, 22 bp, Homo sapiens
ggctcaggtttaaagtgcttta

SEQ ID NO: 8286721 - DNA, 22 bp, Homo sapiens
ggctcaggccagaccacgactc

SEQ ID NO: 8286722 - DNA, 22 bp, Homo sapiens
ggctccaagtctcagagtgaag

SEQ ID NO: 8286723 - DNA, 22 bp, Homo sapiens
ggctcctgcacctgtccctctg

SEQ ID NO: 8286724 - DNA, 22 bp, Homo sapiens
ggctcaggagaggggctaaaag

SEQ ID NO: 8286725 - DNA, 22 bp, Homo sapiens
ggctcaggatgagccttctcat

SEQ ID NO: 8286726 - DNA, 22 bp, Homo sapiens
ggctcaggccagaccacgactc

SEQ ID NO: 8286727 - DNA, 22 bp, Homo sapiens
ggctcaggacacagtggtttag

SEQ ID NO: 8286728 - DNA, 22 bp, Homo sapiens
ggctcaggacctgggattgcca

SEQ ID NO: 8286729 - DNA, 22 bp, Homo sapiens
ggctcaggacacagtggtttag

SEQ ID NO: 8286730 - DNA, 22 bp, Homo sapiens
ggctcagccccgtaacacagca

SEQ ID NO: 8286731 - DNA, 22 bp, Homo sapiens
ggccttgggaggagggtcagaa

SEQ ID NO: 8286732 - DNA, 22 bp, Homo sapiens
ggccctctgctcacttcctatt

SEQ ID NO: 8286733 - DNA, 22 bp, Homo sapiens
ggccctctggcttccgcatggg

SEQ ID NO: 8286734 - DNA, 22 bp, Homo sapiens
ggccctctccaactctgttcca

SEQ ID NO: 8286735 - DNA, 22 bp, Homo sapiens
ggccctctgcctgtgctggcga

SEQ ID NO: 8286736 - DNA, 22 bp, Homo sapiens
ggccttgatcctccagagcact

SEQ ID NO: 8286737 - DNA, 22 bp, Homo sapiens
ggccttggaaagatacccagct

SEQ ID NO: 8286738 - DNA, 21 bp, Homo sapiens
ggccttcccctgcagtctccg

SEQ ID NO: 8286739 - DNA, 22 bp, Homo sapiens
ggccttcctgttgtgtccaccg

SEQ ID NO: 8286740 - DNA, 22 bp, Homo sapiens
ggccttccatctgcctctgttt

SEQ ID NO: 8286741 - DNA, 22 bp, Homo sapiens
ggagtggcagcgaggatcagat

SEQ ID NO: 8286742 - DNA, 22 bp, Homo sapiens
ggagtggctgtttctgccccca

SEQ ID NO: 8286743 - DNA, 19 bp, Homo sapiens
ggagtgggtagttagtggt

SEQ ID NO: 8286744 - DNA, 22 bp, Homo sapiens
ggagtggtggtcaggccatggc

SEQ ID NO: 8286745 - DNA, 22 bp, Homo sapiens
ggagtgggaacaatgacatggt

SEQ ID NO: 8286746 - DNA, 22 bp, Homo sapiens
ggcacacaggcagatggagtgt

SEQ ID NO: 8286747 - DNA, 22 bp, Homo sapiens
ggcaaggccttgcccagcattc

SEQ ID NO: 8286748 - DNA, 22 bp, Homo sapiens
ggcacacagcggaatttgctct

SEQ ID NO: 8286749 - DNA, 22 bp, Homo sapiens
ggcacacagcttggcaggagat

SEQ ID NO: 8286750 - DNA, 22 bp, Homo sapiens
ggagtgtgggatggagctcagg

SEQ ID NO: 8286751 - DNA, 22 bp, Homo sapiens
ggagtgtggagaggacatgggt

SEQ ID NO: 8286752 - DNA, 22 bp, Homo sapiens
ggcagactttttctctgaaggg

SEQ ID NO: 8286753 - DNA, 22 bp, Homo sapiens
ggcagagactgggttggcagag

SEQ ID NO: 8286754 - DNA, 23 bp, Homo sapiens
ggcagagagcatggctggggccc

SEQ ID NO: 8286755 - DNA, 22 bp, Homo sapiens
ggcagacaatctgtctgttagg

SEQ ID NO: 8286756 - DNA, 22 bp, Homo sapiens
ggcaggctcttggccttatgag

SEQ ID NO: 8286757 - DNA, 22 bp, Homo sapiens
ggcaggctccagagccctctcc

SEQ ID NO: 8286758 - DNA, 22 bp, Homo sapiens
ggcaggctccaagcatcctatg

SEQ ID NO: 8286759 - DNA, 22 bp, Homo sapiens
ggcaggctagcactgatgtcct

SEQ ID NO: 8286760 - DNA, 22 bp, Homo sapiens
ggcaggcctgagaggcagggct

SEQ ID NO: 8286761 - DNA, 22 bp, Homo sapiens
ggcaggtgctaagagaggtaaa

SEQ ID NO: 8286762 - DNA, 22 bp, Homo sapiens
ggcagctggggcagtgccctgt

SEQ ID NO: 8286763 - DNA, 22 bp, Homo sapiens
ggcagctgtctctgagttagca

SEQ ID NO: 8286764 - DNA, 22 bp, Homo sapiens
ggcagctgtgaagtgcctcaca

SEQ ID NO: 8286765 - DNA, 22 bp, Homo sapiens
ggcagctgtctcattcacacct

SEQ ID NO: 8286766 - DNA, 22 bp, Homo sapiens
ggcagctgtaagatgagtgaat

SEQ ID NO: 8286767 - DNA, 22 bp, Homo sapiens
ggcagctggcctcctcgcccac

SEQ ID NO: 8286768 - DNA, 20 bp, Homo sapiens
ggcagctctagtcgaggccc

SEQ ID NO: 8286769 - DNA, 22 bp, Homo sapiens
ggagggaagtgagttctcagct

SEQ ID NO: 8286770 - DNA, 22 bp, Homo sapiens
ggaggcttgatgatcttggata

SEQ ID NO: 8286771 - DNA, 22 bp, Homo sapiens
ggagggagagtgaccctaccaa

SEQ ID NO: 8286772 - DNA, 21 bp, Homo sapiens
ggagggcagcccagactggct

SEQ ID NO: 8286773 - DNA, 21 bp, Homo sapiens
ggagggcagcccagactggct

SEQ ID NO: 8286774 - DNA, 20 bp, Homo sapiens
ggagggcagctgagagttgg

SEQ ID NO: 8286775 - DNA, 22 bp, Homo sapiens
ggaggcttcctggctcttgatt

SEQ ID NO: 8286776 - DNA, 22 bp, Homo sapiens
ggaggctctgccatctgtcaca

SEQ ID NO: 8286777 - DNA, 22 bp, Homo sapiens
ggaggctcgctggtcgcacagc

SEQ ID NO: 8286778 - DNA, 22 bp, Homo sapiens
ggaggctcccacgcagctcaca

SEQ ID NO: 8286779 - DNA, 22 bp, Homo sapiens
ggaggctccatgagctcctgca

SEQ ID NO: 8286780 - DNA, 22 bp, Homo sapiens
ggaggtgggagcctccagtggt

SEQ ID NO: 8286781 - DNA, 22 bp, Homo sapiens
ggaggtgggattaggacctaaa

SEQ ID NO: 8286782 - DNA, 22 bp, Homo sapiens
ggaggtggcagggaacataatt

SEQ ID NO: 8286783 - DNA, 22 bp, Homo sapiens
ggaggtggtggcagtgacaatt

SEQ ID NO: 8286784 - DNA, 22 bp, Homo sapiens
ggaggtgggattaggacctaaa

SEQ ID NO: 8286785 - DNA, 22 bp, Homo sapiens
ggaggtgggctaaggactctct

SEQ ID NO: 8286786 - DNA, 20 bp, Homo sapiens
ggagggtggaagaaagcaag

SEQ ID NO: 8286787 - DNA, 20 bp, Homo sapiens
ggagggtggaagaaagcaag

SEQ ID NO: 8286788 - DNA, 22 bp, Homo sapiens
ggagggtgggtcattcttacat

SEQ ID NO: 8286789 - DNA, 22 bp, Homo sapiens
ggagggggaagaagctaaagac

SEQ ID NO: 8286790 - DNA, 22 bp, Homo sapiens
ggaggggagtctcccaaagccg

SEQ ID NO: 8286791 - DNA, 22 bp, Homo sapiens
ggaggggagatgtttgggctca

SEQ ID NO: 8286792 - DNA, 22 bp, Homo sapiens
ggaggggtgagaatggctgcct

SEQ ID NO: 8286793 - DNA, 22 bp, Homo sapiens
ggaggggtctctagcgaggaga

SEQ ID NO: 8286794 - DNA, 22 bp, Homo sapiens
ggaggggtctctagcgaggaga

SEQ ID NO: 8286795 - DNA, 22 bp, Homo sapiens
ggaggggtggaaggagtgcctg

SEQ ID NO: 8286796 - DNA, 22 bp, Homo sapiens
ggaggggtggtcgcgaagagca

SEQ ID NO: 8286797 - DNA, 22 bp, Homo sapiens
ggagggtgcagaccctttgcaa

SEQ ID NO: 8286798 - DNA, 22 bp, Homo sapiens
ggaagtggtagagccatgagtg

SEQ ID NO: 8286799 - DNA, 23 bp, Homo sapiens
ggaagtcagcggagaggtggctg

SEQ ID NO: 8286800 - DNA, 18 bp, Homo sapiens
ggaagtaggaagaggaag

SEQ ID NO: 8286801 - DNA, 22 bp, Homo sapiens
ggagacagcaggaagaaatatc

SEQ ID NO: 8286802 - DNA, 22 bp, Homo sapiens
ggagaaggaagaaagctactat

SEQ ID NO: 8286803 - DNA, 22 bp, Homo sapiens
ggagaaggaatattggagtagg

SEQ ID NO: 8286804 - DNA, 21 bp, Homo sapiens
ggagaaggacaatgttgagta

SEQ ID NO: 8286805 - DNA, 22 bp, Homo sapiens
ggagaggggaacttgttgcttg

SEQ ID NO: 8286806 - DNA, 22 bp, Homo sapiens
ggagagggtaggggtcctgccc

SEQ ID NO: 8286807 - DNA, 22 bp, Homo sapiens
ggagctaggcaaagctcacgga

SEQ ID NO: 8286808 - DNA, 22 bp, Homo sapiens
ggagctagtagtttcatgagtt

SEQ ID NO: 8286809 - DNA, 22 bp, Homo sapiens
ggagatggaatagattctgact

SEQ ID NO: 8286810 - DNA, 22 bp, Homo sapiens
ggaggccatgaggctctaggtg

SEQ ID NO: 8286811 - DNA, 22 bp, Homo sapiens
ggaggccatagtttgggagtca

SEQ ID NO: 8286812 - DNA, 22 bp, Homo sapiens
ggaggccatcagggagggcatt

SEQ ID NO: 8286813 - DNA, 22 bp, Homo sapiens
ggaggccaggatgggaactcaa

SEQ ID NO: 8286814 - DNA, 22 bp, Homo sapiens
ggaggccagggacccagtcagc

SEQ ID NO: 8286815 - DNA, 22 bp, Homo sapiens
ggaggaggcaagtaccagatgc

SEQ ID NO: 8286816 - DNA, 22 bp, Homo sapiens
ggaggcagaatagagtgtgggt

SEQ ID NO: 8286817 - DNA, 22 bp, Homo sapiens
ggaggccaccatggagtcactt

SEQ ID NO: 8286818 - DNA, 22 bp, Homo sapiens
ggaggacggcatgctgggacgt

SEQ ID NO: 8286819 - DNA, 22 bp, Homo sapiens
ggaggaagcacacggcttgtat

SEQ ID NO: 8286820 - DNA, 22 bp, Homo sapiens
ggaggaagccctcggtgcccca

SEQ ID NO: 8286821 - DNA, 22 bp, Homo sapiens
ggaggaagaggttgttctctca

SEQ ID NO: 8286822 - DNA, 22 bp, Homo sapiens
ggaagaaaggtggacaacaggt

SEQ ID NO: 8286823 - DNA, 22 bp, Homo sapiens
ggaagaaagtagaaaaccgtgg

SEQ ID NO: 8286824 - DNA, 22 bp, Homo sapiens
ggaagaaagtagaaaaccgtgg

SEQ ID NO: 8286825 - DNA, 22 bp, Homo sapiens
ggaagaaatctggttaagagat

SEQ ID NO: 8286826 - DNA, 22 bp, Homo sapiens
ggaagaaaatgggcaacaggtg

SEQ ID NO: 8286827 - DNA, 22 bp, Homo sapiens
ggaagaaagacatttattttga

SEQ ID NO: 8286828 - DNA, 22 bp, Homo sapiens
ggaagaaaggtggacaacaggt

SEQ ID NO: 8286829 - DNA, 22 bp, Homo sapiens
ggaagaaagcacacaaacttga

SEQ ID NO: 8286830 - DNA, 22 bp, Homo sapiens
ggaagaaagcacacaaacttga

SEQ ID NO: 8286831 - DNA, 22 bp, Homo sapiens
ggaagaaagacatttattttga

SEQ ID NO: 8286832 - DNA, 22 bp, Homo sapiens
ggaagaaaatgggcaacaggtg

SEQ ID NO: 8286833 - DNA, 17 bp, Homo sapiens
ggaagaaaaggatcatc

SEQ ID NO: 8286834 - DNA, 18 bp, Homo sapiens
ggaagaaaaggaactcag

SEQ ID NO: 8286835 - DNA, 22 bp, Homo sapiens
ggaagaaaagcttccagcgcct

SEQ ID NO: 8286836 - DNA, 17 bp, Homo sapiens
ggaagaaaaggatcatc

SEQ ID NO: 8286837 - DNA, 18 bp, Homo sapiens
ggaagaaaaggaactcag

SEQ ID NO: 8286838 - DNA, 22 bp, Homo sapiens
ggaagaaaagcttccagcgcct

SEQ ID NO: 8286839 - DNA, 22 bp, Homo sapiens
ggaagaaatgctcttctatgcg

SEQ ID NO: 8286840 - DNA, 22 bp, Homo sapiens
ggaagaaatctggttaagagat

SEQ ID NO: 8286841 - DNA, 22 bp, Homo sapiens
ggaagaaatgctcttctatgcg

SEQ ID NO: 8286842 - DNA, 22 bp, Homo sapiens
ggaaggggttaggggtccctga

SEQ ID NO: 8286843 - DNA, 19 bp, Homo sapiens
ggaaggtgacagtggtgaa

SEQ ID NO: 8286844 - DNA, 22 bp, Homo sapiens
ggaaacttggcataattttaag

SEQ ID NO: 8286845 - DNA, 21 bp, Homo sapiens
ggaaaccttccaagcagagac

SEQ ID NO: 8286846 - DNA, 19 bp, Homo sapiens
ggaaacagcacacttttga

SEQ ID NO: 8286847 - DNA, 22 bp, Homo sapiens
gcttctggaggagctgggctga

SEQ ID NO: 8286848 - DNA, 22 bp, Homo sapiens
gcttctggaggagctgggctga

SEQ ID NO: 8286849 - DNA, 17 bp, Homo sapiens
gcttctggagcttctgt

SEQ ID NO: 8286850 - DNA, 22 bp, Homo sapiens
gcttctggaagctgcttctgcc

SEQ ID NO: 8286851 - DNA, 22 bp, Homo sapiens
gcttctggggttctggcatgct

SEQ ID NO: 8286852 - DNA, 20 bp, Homo sapiens
ggaaaaatgcatgctcaaga

SEQ ID NO: 8286853 - DNA, 20 bp, Homo sapiens
ggaaaaatgcatgctcaaga

SEQ ID NO: 8286854 - DNA, 21 bp, Homo sapiens
ggaaagaaggcaaggctcagg

SEQ ID NO: 8286855 - DNA, 22 bp, Homo sapiens
ggaaagaaagtgtgaacaactt

SEQ ID NO: 8286856 - DNA, 23 bp, Homo sapiens
ggaaagagaggagttgtgcatag

SEQ ID NO: 8286857 - DNA, 22 bp, Homo sapiens
ggaaagagctaaaagggtgaga

SEQ ID NO: 8286858 - DNA, 22 bp, Homo sapiens
ggaaagagctaaaagggtgaga

SEQ ID NO: 8286859 - DNA, 22 bp, Homo sapiens
gcttctgccttgcactttgtca

SEQ ID NO: 8286860 - DNA, 22 bp, Homo sapiens
gcttctgcctcttccactttgc

SEQ ID NO: 8286861 - DNA, 22 bp, Homo sapiens
gcttcagggttatgcaagagtg

SEQ ID NO: 8286862 - DNA, 22 bp, Homo sapiens
gcttcagagatttcactagttt

SEQ ID NO: 8286863 - DNA, 22 bp, Homo sapiens
gcttcagactggagcagaggaa

SEQ ID NO: 8286864 - DNA, 22 bp, Homo sapiens
gcttagtcaattataaataggc

SEQ ID NO: 8286865 - DNA, 22 bp, Homo sapiens
gctgggctccaccctcaactgt

SEQ ID NO: 8286866 - DNA, 22 bp, Homo sapiens
gctgggcagtgagtgagtcctt

SEQ ID NO: 8286867 - DNA, 22 bp, Homo sapiens
gatctttgacacagtggattag

SEQ ID NO: 8286868 - DNA, 22 bp, Homo sapiens
gatcccatgtaggagaatgtta

SEQ ID NO: 8286869 - DNA, 22 bp, Homo sapiens
gatcttggaatggcacagctga

SEQ ID NO: 8286870 - DNA, 22 bp, Homo sapiens
gatcttggggggatcaccatgg

SEQ ID NO: 8286871 - DNA, 22 bp, Homo sapiens
gatccgaatcattgctctttta

SEQ ID NO: 8286872 - DNA, 22 bp, Homo sapiens
gatgacaaaagagtaagtaatg

SEQ ID NO: 8286873 - DNA, 22 bp, Homo sapiens
gatgacataaacttaacagtat

SEQ ID NO: 8286874 - DNA, 22 bp, Homo sapiens
gatgacagttctagcatctgaa

SEQ ID NO: 8286875 - DNA, 22 bp, Homo sapiens
gatgacatggctagcactgtga

SEQ ID NO: 8286876 - DNA, 22 bp, Homo sapiens
gatgacatgatggacactcagt

SEQ ID NO: 8286877 - DNA, 22 bp, Homo sapiens
gatgacatctcaatttgttctt

SEQ ID NO: 8286878 - DNA, 20 bp, Homo sapiens
gatgacatactcacttaggg

SEQ ID NO: 8286879 - DNA, 22 bp, Homo sapiens
gatgacataacctaattacagt

SEQ ID NO: 8286880 - DNA, 22 bp, Homo sapiens
gatgatttaagtggccaaagta

SEQ ID NO: 8286881 - DNA, 22 bp, Homo sapiens
gatgatttctccattcccttct

SEQ ID NO: 8286882 - DNA, 22 bp, Homo sapiens
gatgattttagttgactaaact

SEQ ID NO: 8286883 - DNA, 22 bp, Homo sapiens
gatgatttgaggatttcatgag

SEQ ID NO: 8286884 - DNA, 22 bp, Homo sapiens
gatgattttctgtgttagaaga

SEQ ID NO: 8286885 - DNA, 22 bp, Homo sapiens
gatgattttatgtcttgtcatt

SEQ ID NO: 8286886 - DNA, 22 bp, Homo sapiens
gatgatttttgccagtgtgatg

SEQ ID NO: 8286887 - DNA, 22 bp, Homo sapiens
gatgattttgttggtgattcaa

SEQ ID NO: 8286888 - DNA, 22 bp, Homo sapiens
gatgattttgatgcagtaaaga

SEQ ID NO: 8286889 - DNA, 22 bp, Homo sapiens
gatgcaggatagcttcacccag

SEQ ID NO: 8286890 - DNA, 22 bp, Homo sapiens
gatgcacaaagcagagggaatc

SEQ ID NO: 8286891 - DNA, 22 bp, Homo sapiens
gatgcaaagataaaacagacgc

SEQ ID NO: 8286892 - DNA, 22 bp, Homo sapiens
gataataagcacagcaggatgt

SEQ ID NO: 8286893 - DNA, 21 bp, Homo sapiens
gatacagagggccactgattg

SEQ ID NO: 8286894 - DNA, 22 bp, Homo sapiens
gatactgttttgtttgtgaggt

SEQ ID NO: 8286895 - DNA, 22 bp, Homo sapiens
gatactgttagtaaaaggtact

SEQ ID NO: 8286896 - DNA, 22 bp, Homo sapiens
gatactgtaggtgaaagtgttt

SEQ ID NO: 8286897 - DNA, 22 bp, Homo sapiens
gatactgtatcctaaaagcttt

SEQ ID NO: 8286898 - DNA, 22 bp, Homo sapiens
gatagtcacctcccttaacttt

SEQ ID NO: 8286899 - DNA, 19 bp, Homo sapiens
gatagctgatgaccatcat

SEQ ID NO: 8286900 - DNA, 22 bp, Homo sapiens
gatcatcatctttcaggcaagt

SEQ ID NO: 8286901 - DNA, 22 bp, Homo sapiens
gatcatcaagcaagaacctgat

SEQ ID NO: 8286902 - DNA, 22 bp, Homo sapiens
gatatttttagtatttctgcct

SEQ ID NO: 8286903 - DNA, 22 bp, Homo sapiens
gatatatgtaaaagtagacaga

SEQ ID NO: 8286904 - DNA, 22 bp, Homo sapiens
gatattttcgcagggagaattc

SEQ ID NO: 8286905 - DNA, 22 bp, Homo sapiens
gatattttcagtctcctttcaa

SEQ ID NO: 8286906 - DNA, 22 bp, Homo sapiens
gatattttcattcggatgctca

SEQ ID NO: 8286907 - DNA, 22 bp, Homo sapiens
gagtggcttttttatggtaatg

SEQ ID NO: 8286908 - DNA, 22 bp, Homo sapiens
gagtgggcaaaagaaagtaggc

SEQ ID NO: 8286909 - DNA, 22 bp, Homo sapiens
gagtggctgtgtacatgcccag

SEQ ID NO: 8286910 - DNA, 22 bp, Homo sapiens
gagtgctgctaatgcaagggtg

SEQ ID NO: 8286911 - DNA, 22 bp, Homo sapiens
gagtgctgtaggactgagccct

SEQ ID NO: 8286912 - DNA, 22 bp, Homo sapiens
gagtgctggggtgcagagaggt

SEQ ID NO: 8286913 - DNA, 22 bp, Homo sapiens
gagtgagggccaacatccagct

SEQ ID NO: 8286914 - DNA, 22 bp, Homo sapiens
gagtgatgtctgtagtgaagaa

SEQ ID NO: 8286915 - DNA, 22 bp, Homo sapiens
gagtgacaggaatatttatctg

SEQ ID NO: 8286916 - DNA, 22 bp, Homo sapiens
gagtccttttcatagcagtggg

SEQ ID NO: 8286917 - DNA, 22 bp, Homo sapiens
gagtccttttgtgccacaggga

SEQ ID NO: 8286918 - DNA, 22 bp, Homo sapiens
gagtccttccagcaggcattta

SEQ ID NO: 8286919 - DNA, 22 bp, Homo sapiens
gagtccttctggctggcaggat

SEQ ID NO: 8286920 - DNA, 22 bp, Homo sapiens
gagtcctgcccttgtgtagtcc

SEQ ID NO: 8286921 - DNA, 22 bp, Homo sapiens
gagtggggggtccgtctcagtg

SEQ ID NO: 8286922 - DNA, 22 bp, Homo sapiens
gagtggggctttaaaggctcag

SEQ ID NO: 8286923 - DNA, 22 bp, Homo sapiens
gagtggggtctgggcatcagtc

SEQ ID NO: 8286924 - DNA, 22 bp, Homo sapiens
gagtgggtaaaggtgcttggct

SEQ ID NO: 8286925 - DNA, 18 bp, Homo sapiens
gagtgtggcactgggccc

SEQ ID NO: 8286926 - DNA, 22 bp, Homo sapiens
gagtgtgggggtgctgaggaca

SEQ ID NO: 8286927 - DNA, 22 bp, Homo sapiens
gagtgtggtatgctctgaggct

SEQ ID NO: 8286928 - DNA, 22 bp, Homo sapiens
gagtgtgggcacgggggccttg

SEQ ID NO: 8286929 - DNA, 22 bp, Homo sapiens
gagtttgggtggaaggagggta

SEQ ID NO: 8286930 - DNA, 22 bp, Homo sapiens
gagtttctccagtgctagttgt

SEQ ID NO: 8286931 - DNA, 22 bp, Homo sapiens
gagttcttctatatagtatgag

SEQ ID NO: 8286932 - DNA, 22 bp, Homo sapiens
gagttcttaggcaaacaactct

SEQ ID NO: 8286933 - DNA, 22 bp, Homo sapiens
gataaatggctgaagaaatagt

SEQ ID NO: 8286934 - DNA, 22 bp, Homo sapiens
gaggcagctgaagcttcaaaga

SEQ ID NO: 8286935 - DNA, 22 bp, Homo sapiens
gaggcagctcttctgaatgggg

SEQ ID NO: 8286936 - DNA, 22 bp, Homo sapiens
gaggccctggtaggtcagagtg

SEQ ID NO: 8286937 - DNA, 22 bp, Homo sapiens
gaggccctgaagacagctgggg

SEQ ID NO: 8286938 - DNA, 20 bp, Homo sapiens
gaggcctcagcctcagctcc

SEQ ID NO: 8286939 - DNA, 20 bp, Homo sapiens
gaggcctcagcctcagctcc

SEQ ID NO: 8286940 - DNA, 22 bp, Homo sapiens
gaggcccagtcctgcaagcacg

SEQ ID NO: 8286941 - DNA, 22 bp, Homo sapiens
gaggccctccagctgtcagctg

SEQ ID NO: 8286942 - DNA, 21 bp, Homo sapiens
gaggcccatgggacaggggct

SEQ ID NO: 8286943 - DNA, 22 bp, Homo sapiens
gaggcctcatgaggtgagcatt

SEQ ID NO: 8286944 - DNA, 22 bp, Homo sapiens
gaggcctcaggcgtgggaaggg

SEQ ID NO: 8286945 - DNA, 22 bp, Homo sapiens
gaggcagagtcacaaagagtct

SEQ ID NO: 8286946 - DNA, 22 bp, Homo sapiens
gaggagggttggccttaggtag

SEQ ID NO: 8286947 - DNA, 22 bp, Homo sapiens
gaggagggttggccttaggtag

SEQ ID NO: 8286948 - DNA, 22 bp, Homo sapiens
gaggaggtggaattccaggaat

SEQ ID NO: 8286949 - DNA, 22 bp, Homo sapiens
gaggaggtcgctgctgagcccc

SEQ ID NO: 8286950 - DNA, 23 bp, Homo sapiens
gaggagggtctgacaagtgtagc

SEQ ID NO: 8286951 - DNA, 22 bp, Homo sapiens
gaggagggagaattaggcttaa

SEQ ID NO: 8286952 - DNA, 22 bp, Homo sapiens
gaggagggagaattaggcttaa

SEQ ID NO: 8286953 - DNA, 22 bp, Homo sapiens
gagctgggaagatagcttgagc

SEQ ID NO: 8286954 - DNA, 22 bp, Homo sapiens
gagctgggacatgggtcctctc

SEQ ID NO: 8286955 - DNA, 22 bp, Homo sapiens
gagagttccagtaagtggattc

SEQ ID NO: 8286956 - DNA, 22 bp, Homo sapiens
gagagtggatggagctgcgaag

SEQ ID NO: 8286957 - DNA, 22 bp, Homo sapiens
gaggacagcttagggcttcctg

SEQ ID NO: 8286958 - DNA, 22 bp, Homo sapiens
gaggacagctctaactaaagtc

SEQ ID NO: 8286959 - DNA, 22 bp, Homo sapiens
gaggacagagccgcctggcaag

SEQ ID NO: 8286960 - DNA, 22 bp, Homo sapiens
gaggaagggctgcctgccgggc

SEQ ID NO: 8286961 - DNA, 22 bp, Homo sapiens
gaggaaggtcccatcagaattt

SEQ ID NO: 8286962 - DNA, 22 bp, Homo sapiens
gaggaaggtcccatcagaattt

SEQ ID NO: 8286963 - DNA, 22 bp, Homo sapiens
gaggaagggctgcctgccgggc

SEQ ID NO: 8286964 - DNA, 22 bp, Homo sapiens
gagggccaaagagcaagagcct

SEQ ID NO: 8286965 - DNA, 22 bp, Homo sapiens
gagggcagtgaattttgaagct

SEQ ID NO: 8286966 - DNA, 22 bp, Homo sapiens
gagggcagtagcctcgtaccct

SEQ ID NO: 8286967 - DNA, 22 bp, Homo sapiens
gagggcaggggtcttgcacggt

SEQ ID NO: 8286968 - DNA, 20 bp, Homo sapiens
gagggcaggcacccatttca

SEQ ID NO: 8286969 - DNA, 21 bp, Homo sapiens
gaggggcagctcttagcatta

SEQ ID NO: 8286970 - DNA, 22 bp, Homo sapiens
gaggggatgcagagaggcttat

SEQ ID NO: 8286971 - DNA, 22 bp, Homo sapiens
gaggggagtaaagtcatgttac

SEQ ID NO: 8286972 - DNA, 22 bp, Homo sapiens
gaggggagtgtcctccgggccc

SEQ ID NO: 8286973 - DNA, 22 bp, Homo sapiens
gaggctggcagaaaagcacagg

SEQ ID NO: 8286974 - DNA, 22 bp, Homo sapiens
gagtcccaggaatgagcatagt

SEQ ID NO: 8286975 - DNA, 22 bp, Homo sapiens
gagtccagttgttcacagaggc

SEQ ID NO: 8286976 - DNA, 22 bp, Homo sapiens
gagtcaggtccgtggacagtta

SEQ ID NO: 8286977 - DNA, 22 bp, Homo sapiens
gagtcaggtttctgcctataga

SEQ ID NO: 8286978 - DNA, 22 bp, Homo sapiens
gagtcaggcatgaaggtaatta

SEQ ID NO: 8286979 - DNA, 22 bp, Homo sapiens
gaggtgggtgtatcacaggtca

SEQ ID NO: 8286980 - DNA, 22 bp, Homo sapiens
gaggtggggttttgttcttgaa

SEQ ID NO: 8286981 - DNA, 22 bp, Homo sapiens
gaggtgggtgtatcacaggtca

SEQ ID NO: 8286982 - DNA, 22 bp, Homo sapiens
gaggggccggcatgtgcctctc

SEQ ID NO: 8286983 - DNA, 22 bp, Homo sapiens
gaggtgggatgtgtgtgctact

SEQ ID NO: 8286984 - DNA, 22 bp, Homo sapiens
gaggtgggcggatcacaaggtc

SEQ ID NO: 8286985 - DNA, 22 bp, Homo sapiens
gaggtgggcggatcacaaggtc

SEQ ID NO: 8286986 - DNA, 22 bp, Homo sapiens
gaggtgggcggatcacaaggtc

SEQ ID NO: 8286987 - DNA, 22 bp, Homo sapiens
gaggtcattacactttgtttgt

SEQ ID NO: 8286988 - DNA, 22 bp, Homo sapiens
gaggtcaggctcaagctgggcc

SEQ ID NO: 8286989 - DNA, 22 bp, Homo sapiens
gagacagagatcttgctgagtc

SEQ ID NO: 8286990 - DNA, 22 bp, Homo sapiens
gagacagagatcttgctgagtc

SEQ ID NO: 8286991 - DNA, 22 bp, Homo sapiens
gagacagagtgttttttaaggt

SEQ ID NO: 8286992 - DNA, 22 bp, Homo sapiens
gagacagagtttcactcttgtt

SEQ ID NO: 8286993 - DNA, 22 bp, Homo sapiens
gagacagatctcggctccatgc

SEQ ID NO: 8286994 - DNA, 22 bp, Homo sapiens
gagagctatttggcaagcattt

SEQ ID NO: 8286995 - DNA, 22 bp, Homo sapiens
gagacacaagaagacatgcaca

SEQ ID NO: 8286996 - DNA, 22 bp, Homo sapiens
gagacacagttatcaggcatac

SEQ ID NO: 8286997 - DNA, 22 bp, Homo sapiens
gagacacaggcacagaagaggc

SEQ ID NO: 8286998 - DNA, 22 bp, Homo sapiens
gagacacaggtggttcctgtca

SEQ ID NO: 8286999 - DNA, 22 bp, Homo sapiens
gagacacagcagatattcaatc

SEQ ID NO: 8287000 - DNA, 22 bp, Homo sapiens
gagacacaggcacagaagaggc

SEQ ID NO: 8287001 - DNA, 22 bp, Homo sapiens
gagacacaagacgcaactctgt

SEQ ID NO: 8287002 - DNA, 18 bp, Homo sapiens
gagacacaagggcctgga

SEQ ID NO: 8287003 - DNA, 22 bp, Homo sapiens
gagacacaatctcatttacatt

SEQ ID NO: 8287004 - DNA, 22 bp, Homo sapiens
gagacacaatttccccatccta

SEQ ID NO: 8287005 - DNA, 22 bp, Homo sapiens
gagacacacattctggagagaa

SEQ ID NO: 8287006 - DNA, 22 bp, Homo sapiens
gagacacacacaggaggtggca

SEQ ID NO: 8287007 - DNA, 22 bp, Homo sapiens
gagacacacccaaggttatgag

SEQ ID NO: 8287008 - DNA, 22 bp, Homo sapiens
gagacacacccaaggttatgag

SEQ ID NO: 8287009 - DNA, 22 bp, Homo sapiens
gagacacagagaggctgtgtga

SEQ ID NO: 8287010 - DNA, 22 bp, Homo sapiens
gaccatcctggccaacgtggta

SEQ ID NO: 8287011 - DNA, 22 bp, Homo sapiens
gacaggatattatgatagattc

SEQ ID NO: 8287012 - DNA, 22 bp, Homo sapiens
gacaggaggcagagctcaggtg

SEQ ID NO: 8287013 - DNA, 22 bp, Homo sapiens
gacccagcttaagtcacatgtt

SEQ ID NO: 8287014 - DNA, 22 bp, Homo sapiens
gacccagctaaccaggtgggga

SEQ ID NO: 8287015 - DNA, 22 bp, Homo sapiens
gacccagcctggtttttatagg

SEQ ID NO: 8287016 - DNA, 18 bp, Homo sapiens
gacccagcagatgggctt

SEQ ID NO: 8287017 - DNA, 22 bp, Homo sapiens
gacttctgaattcctatcaggt

SEQ ID NO: 8287018 - DNA, 22 bp, Homo sapiens
gacttctgttaacttgtaagag

SEQ ID NO: 8287019 - DNA, 22 bp, Homo sapiens
gacttgtttcaggtttgattgc

SEQ ID NO: 8287020 - DNA, 22 bp, Homo sapiens
gaaggaagtcattagtgcagac

SEQ ID NO: 8287021 - DNA, 22 bp, Homo sapiens
gaaggaagtcattagtgcagac

SEQ ID NO: 8287022 - DNA, 22 bp, Homo sapiens
gaaggaagtcattagtgcagac

SEQ ID NO: 8287023 - DNA, 22 bp, Homo sapiens
gaaggaagggctggctgtcttg

SEQ ID NO: 8287024 - DNA, 22 bp, Homo sapiens
gaaggaagctgtctggatgtgt

SEQ ID NO: 8287025 - DNA, 22 bp, Homo sapiens
gaaggaagccgtttctctccag

SEQ ID NO: 8287026 - DNA, 21 bp, Homo sapiens
gaaggagaaagcaagtgctgc

SEQ ID NO: 8287027 - DNA, 22 bp, Homo sapiens
gaaggagagagacatcgtccct

SEQ ID NO: 8287028 - DNA, 19 bp, Homo sapiens
gaaggagagctgagttagg

SEQ ID NO: 8287029 - DNA, 22 bp, Homo sapiens
gaaggctcctcaacctctcggg

SEQ ID NO: 8287030 - DNA, 22 bp, Homo sapiens
gaaggctctgatttcttgcaaa

SEQ ID NO: 8287031 - DNA, 20 bp, Homo sapiens
gaaggcttggacagtgacag

SEQ ID NO: 8287032 - DNA, 22 bp, Homo sapiens
gaaggctgcgaggggagtgccg

SEQ ID NO: 8287033 - DNA, 22 bp, Homo sapiens
gaagtgtagtcttgagccccca

SEQ ID NO: 8287034 - DNA, 22 bp, Homo sapiens
gacacagagataggcctgtgtt

SEQ ID NO: 8287035 - DNA, 19 bp, Homo sapiens
gacaggaaggctaccagta

SEQ ID NO: 8287036 - DNA, 19 bp, Homo sapiens
gacaggaaggctaccagta

SEQ ID NO: 8287037 - DNA, 22 bp, Homo sapiens
gacaggaacataaatgtaggag

SEQ ID NO: 8287038 - DNA, 22 bp, Homo sapiens
gacaggaacataaatgtaggag

SEQ ID NO: 8287039 - DNA, 22 bp, Homo sapiens
gaattgtaagtaccagcatgct

SEQ ID NO: 8287040 - DNA, 22 bp, Homo sapiens
gaattgtacgctttacataggt

SEQ ID NO: 8287041 - DNA, 22 bp, Homo sapiens
gaattgtattgatttttcagag

SEQ ID NO: 8287042 - DNA, 22 bp, Homo sapiens
gaagttccagtgatataaaact

SEQ ID NO: 8287043 - DNA, 22 bp, Homo sapiens
gaattataaactagtgacttca

SEQ ID NO: 8287044 - DNA, 22 bp, Homo sapiens
gaaaggcttggttttgaatata

SEQ ID NO: 8287045 - DNA, 22 bp, Homo sapiens
gaaaggcttgagacattgatga

SEQ ID NO: 8287046 - DNA, 22 bp, Homo sapiens
gaaaggcttgcttttgctcggt

SEQ ID NO: 8287047 - DNA, 19 bp, Homo sapiens
gaaaggctgctgctacctg

SEQ ID NO: 8287048 - DNA, 22 bp, Homo sapiens
gaaaggctgggatttagcgctg

SEQ ID NO: 8287049 - DNA, 22 bp, Homo sapiens
gaaaggctgcatctcgcctcag

SEQ ID NO: 8287050 - DNA, 22 bp, Homo sapiens
gaaaggctgcatctcgcctcag

SEQ ID NO: 8287051 - DNA, 22 bp, Homo sapiens
gaaaggcttcttaagcttcact

SEQ ID NO: 8287052 - DNA, 22 bp, Homo sapiens
gaaaggcttcttaagcttcact

SEQ ID NO: 8287053 - DNA, 22 bp, Homo sapiens
gaaaggcttaaattgtaagggc

SEQ ID NO: 8287054 - DNA, 23 bp, Homo sapiens
gaaaggctctgggacccccaact

SEQ ID NO: 8287055 - DNA, 22 bp, Homo sapiens
gaaaggctcagattcccccagg

SEQ ID NO: 8287056 - DNA, 22 bp, Homo sapiens
gaaaggctcagaagtttgtatt

SEQ ID NO: 8287057 - DNA, 22 bp, Homo sapiens
gaaaggctcactttagatcatg

SEQ ID NO: 8287058 - DNA, 22 bp, Homo sapiens
gaaaggctatgagtttggtata

SEQ ID NO: 8287059 - DNA, 22 bp, Homo sapiens
gaaaggctactgtcatcaatta

SEQ ID NO: 8287060 - DNA, 22 bp, Homo sapiens
gaaaggctaaaattataagggt

SEQ ID NO: 8287061 - DNA, 22 bp, Homo sapiens
cttttaatgggagcagtatttg

SEQ ID NO: 8287062 - DNA, 22 bp, Homo sapiens
gaaaaggctctcactccctccg

SEQ ID NO: 8287063 - DNA, 22 bp, Homo sapiens
gaaaagccttctcacataagta

SEQ ID NO: 8287064 - DNA, 22 bp, Homo sapiens
gaaaagctaggccagttcagct

SEQ ID NO: 8287065 - DNA, 22 bp, Homo sapiens
gaaaagagacagggtgggtgat

SEQ ID NO: 8287066 - DNA, 22 bp, Homo sapiens
gaaaagagtcctgtgtgaggag

SEQ ID NO: 8287067 - DNA, 22 bp, Homo sapiens
gaacacatcacattttacagtg

SEQ ID NO: 8287068 - DNA, 22 bp, Homo sapiens
gaacacatgattataaatgcta

SEQ ID NO: 8287069 - DNA, 22 bp, Homo sapiens
gaacacatcacattttacagtg

SEQ ID NO: 8287070 - DNA, 22 bp, Homo sapiens
gaacacatgtcctccttggatt

SEQ ID NO: 8287071 - DNA, 22 bp, Homo sapiens
gaacacattagtctgagttggc

SEQ ID NO: 8287072 - DNA, 22 bp, Homo sapiens
gaacacatttctctgactgtag

SEQ ID NO: 8287073 - DNA, 22 bp, Homo sapiens
gaacactgagaaagtcagcttt

SEQ ID NO: 8287074 - DNA, 22 bp, Homo sapiens
gaaattgtgcatttagcaacac

SEQ ID NO: 8287075 - DNA, 22 bp, Homo sapiens
gaaatttacaactttctcatgg

SEQ ID NO: 8287076 - DNA, 22 bp, Homo sapiens
gaaatttacaactttctcatgg

SEQ ID NO: 8287077 - DNA, 22 bp, Homo sapiens
gaaatacaattttgtcccagct

SEQ ID NO: 8287078 - DNA, 22 bp, Homo sapiens
gaaatttattatctacatcatt

SEQ ID NO: 8287079 - DNA, 22 bp, Homo sapiens
gaaagtttcttcattaagatgt

SEQ ID NO: 8287080 - DNA, 22 bp, Homo sapiens
gaaataatacagtgctcttctc

SEQ ID NO: 8287081 - DNA, 22 bp, Homo sapiens
gaaataatttagaaggtattcc

SEQ ID NO: 8287082 - DNA, 22 bp, Homo sapiens
gaaatacaaagccagccatttt

SEQ ID NO: 8287083 - DNA, 22 bp, Homo sapiens
gaactgcatcttaaataatact

SEQ ID NO: 8287084 - DNA, 22 bp, Homo sapiens
gaactgcattgtggtatatgtt

SEQ ID NO: 8287085 - DNA, 22 bp, Homo sapiens
gaactggtcagtttagcccact

SEQ ID NO: 8287086 - DNA, 22 bp, Homo sapiens
gaacctctttaaagaacagaat

SEQ ID NO: 8287087 - DNA, 22 bp, Homo sapiens
gaactaaaagctaacatcaggc

SEQ ID NO: 8287088 - DNA, 22 bp, Homo sapiens
gaaccgctttggagtcagctat

SEQ ID NO: 8287089 - DNA, 22 bp, Homo sapiens
ctttggcagcctctgctattga

SEQ ID NO: 8287090 - DNA, 22 bp, Homo sapiens
ctttggcatggtcctcactata

SEQ ID NO: 8287091 - DNA, 22 bp, Homo sapiens
ctttagatgttgctttaactat

SEQ ID NO: 8287092 - DNA, 22 bp, Homo sapiens
ctttagttagtagataatggca

SEQ ID NO: 8287093 - DNA, 22 bp, Homo sapiens
cttggcacttgggcagtgagca

SEQ ID NO: 8287094 - DNA, 22 bp, Homo sapiens
cttggcaccaccaagtggccat

SEQ ID NO: 8287095 - DNA, 22 bp, Homo sapiens
cttgaagagtgggaaggatttg

SEQ ID NO: 8287096 - DNA, 22 bp, Homo sapiens
cttgaaggacagcatctccgag

SEQ ID NO: 8287097 - DNA, 19 bp, Homo sapiens
cttggcttagcttcttagc

SEQ ID NO: 8287098 - DNA, 22 bp, Homo sapiens
cttctctccctggcactcagac

SEQ ID NO: 8287099 - DNA, 22 bp, Homo sapiens
cttctctcggtgcatccctcac

SEQ ID NO: 8287100 - DNA, 22 bp, Homo sapiens
ctggctggttggggagaagaca

SEQ ID NO: 8287101 - DNA, 22 bp, Homo sapiens
ctggctggttgtctcaatccag

SEQ ID NO: 8287102 - DNA, 22 bp, Homo sapiens
ctggctggtttttaaagctagg

SEQ ID NO: 8287103 - DNA, 22 bp, Homo sapiens
ctggctgtaagcgtgtttccta

SEQ ID NO: 8287104 - DNA, 22 bp, Homo sapiens
ctggctgtattagtttgatcct

SEQ ID NO: 8287105 - DNA, 22 bp, Homo sapiens
ctggctggttccctgctccagg

SEQ ID NO: 8287106 - DNA, 22 bp, Homo sapiens
ctggctggtctgagcagtcgca

SEQ ID NO: 8287107 - DNA, 22 bp, Homo sapiens
ctggctggttactatttctggt

SEQ ID NO: 8287108 - DNA, 22 bp, Homo sapiens
ctggctggtcctcggggacagc

SEQ ID NO: 8287109 - DNA, 22 bp, Homo sapiens
ctggctggtcatgtcatgagcc

SEQ ID NO: 8287110 - DNA, 22 bp, Homo sapiens
ctggctggtcatcagcagtacg

SEQ ID NO: 8287111 - DNA, 22 bp, Homo sapiens
ctggctgggttccaggattcca

SEQ ID NO: 8287112 - DNA, 22 bp, Homo sapiens
ctggctggggtccatcctctaa

SEQ ID NO: 8287113 - DNA, 22 bp, Homo sapiens
ctggctggtaatggaacgacag

SEQ ID NO: 8287114 - DNA, 22 bp, Homo sapiens
ctggctggtagaattgtgacct

SEQ ID NO: 8287115 - DNA, 22 bp, Homo sapiens
ctggctgggccatttctttagg

SEQ ID NO: 8287116 - DNA, 22 bp, Homo sapiens
ctggctgggcagacagaatgct

SEQ ID NO: 8287117 - DNA, 22 bp, Homo sapiens
ctggctgggattttaaagagca

SEQ ID NO: 8287118 - DNA, 22 bp, Homo sapiens
ctggctggggaagtcatttgat

SEQ ID NO: 8287119 - DNA, 22 bp, Homo sapiens
ctggctggggccttagataaga

SEQ ID NO: 8287120 - DNA, 22 bp, Homo sapiens
ctggctggggtaccagttgaac

SEQ ID NO: 8287121 - DNA, 22 bp, Homo sapiens
ctggctggagctgttgtaggct

SEQ ID NO: 8287122 - DNA, 22 bp, Homo sapiens
ctggctgggagctcgcctgcgg

SEQ ID NO: 8287123 - DNA, 22 bp, Homo sapiens
ctggctggaggtgagtcactga

SEQ ID NO: 8287124 - DNA, 22 bp, Homo sapiens
cttctcttgggtgtggtgtctt

SEQ ID NO: 8287125 - DNA, 22 bp, Homo sapiens
cttctctgacagtctgtttcac

SEQ ID NO: 8287126 - DNA, 22 bp, Homo sapiens
cttctctctgcataggcatggg

SEQ ID NO: 8287127 - DNA, 22 bp, Homo sapiens
cttctctctgcataggcatggg

SEQ ID NO: 8287128 - DNA, 22 bp, Homo sapiens
cttctttccttcctccagtggc

SEQ ID NO: 8287129 - DNA, 22 bp, Homo sapiens
cttctttcccaggcatgtttta

SEQ ID NO: 8287130 - DNA, 22 bp, Homo sapiens
cttctttcttttgatcacaggt

SEQ ID NO: 8287131 - DNA, 22 bp, Homo sapiens
gctgagcagggtggggaaaggc

SEQ ID NO: 8287132 - DNA, 22 bp, Homo sapiens
gctgagcacagcaaagagacaa

SEQ ID NO: 8287133 - DNA, 22 bp, Homo sapiens
gctctgtgttttgcccaggaga

SEQ ID NO: 8287134 - DNA, 22 bp, Homo sapiens
gctctgtgttgtcagaggcacc

SEQ ID NO: 8287135 - DNA, 17 bp, Homo sapiens
gctctgccaggaaagag

SEQ ID NO: 8287136 - DNA, 22 bp, Homo sapiens
gctctgtgttccctccaggctc

SEQ ID NO: 8287137 - DNA, 22 bp, Homo sapiens
gctctgtgttccctccaggctc

SEQ ID NO: 8287138 - DNA, 22 bp, Homo sapiens
gctctgtgtccacagctggaaa

SEQ ID NO: 8287139 - DNA, 22 bp, Homo sapiens
gctctgtgtccacagctggaaa

SEQ ID NO: 8287140 - DNA, 22 bp, Homo sapiens
gctctctttaaactgcatggct

SEQ ID NO: 8287141 - DNA, 22 bp, Homo sapiens
gctctctttccatgtggaggat

SEQ ID NO: 8287142 - DNA, 22 bp, Homo sapiens
gctctctttcacagaggtagga

SEQ ID NO: 8287143 - DNA, 22 bp, Homo sapiens
gctctctttaaactgcatggct

SEQ ID NO: 8287144 - DNA, 22 bp, Homo sapiens
gctctctttttccagtggtggt

SEQ ID NO: 8287145 - DNA, 22 bp, Homo sapiens
gctctgagtcacactgccctgt

SEQ ID NO: 8287146 - DNA, 22 bp, Homo sapiens
gctcatgggcccagagcagccc

SEQ ID NO: 8287147 - DNA, 22 bp, Homo sapiens
gctccagctcgtggctcccagc

SEQ ID NO: 8287148 - DNA, 22 bp, Homo sapiens
gctccagagcagagactaggtt

SEQ ID NO: 8287149 - DNA, 22 bp, Homo sapiens
gctccacaaataatggaacctg

SEQ ID NO: 8287150 - DNA, 20 bp, Homo sapiens
gctccaagcccctttagagg

SEQ ID NO: 8287151 - DNA, 22 bp, Homo sapiens
gctcctcttatttcatcagggc

SEQ ID NO: 8287152 - DNA, 22 bp, Homo sapiens
gctcctctcccagagctgcagg

SEQ ID NO: 8287153 - DNA, 22 bp, Homo sapiens
gctcctctcccagagctgcagg

SEQ ID NO: 8287154 - DNA, 22 bp, Homo sapiens
gctgctgctggtctggggccac

SEQ ID NO: 8287155 - DNA, 22 bp, Homo sapiens
gctgctctgggtctgcccagct

SEQ ID NO: 8287156 - DNA, 22 bp, Homo sapiens
gctgctctgggtctgcccagct

SEQ ID NO: 8287157 - DNA, 22 bp, Homo sapiens
gctgctctgttaattgctgtaa

SEQ ID NO: 8287158 - DNA, 22 bp, Homo sapiens
gctgctctgttaattgctgtaa

SEQ ID NO: 8287159 - DNA, 22 bp, Homo sapiens
gctgctctgtgacagcctccgg

SEQ ID NO: 8287160 - DNA, 22 bp, Homo sapiens
gctgctgagaattgcaggcaag

SEQ ID NO: 8287161 - DNA, 21 bp, Homo sapiens
gctgctcgagatccagtgctt

SEQ ID NO: 8287162 - DNA, 19 bp, Homo sapiens
gctgctctgggtctcatct

SEQ ID NO: 8287163 - DNA, 22 bp, Homo sapiens
gctgctctgaaaatgactgttg

SEQ ID NO: 8287164 - DNA, 20 bp, Homo sapiens
gctgctctccacggtctgca

SEQ ID NO: 8287165 - DNA, 22 bp, Homo sapiens
gctgctctcagagctcatgctg

SEQ ID NO: 8287166 - DNA, 22 bp, Homo sapiens
gctgaggcagtccacccttgtg

SEQ ID NO: 8287167 - DNA, 22 bp, Homo sapiens
gctgcctgctcacccggcctgg

SEQ ID NO: 8287168 - DNA, 22 bp, Homo sapiens
gctggagcgggttcgggccgct

SEQ ID NO: 8287169 - DNA, 22 bp, Homo sapiens
gctggagccattggcttggcct

SEQ ID NO: 8287170 - DNA, 22 bp, Homo sapiens
gctggagatgctatgcagaggg

SEQ ID NO: 8287171 - DNA, 22 bp, Homo sapiens
gctggagatgctatgcagaggg

SEQ ID NO: 8287172 - DNA, 22 bp, Homo sapiens
gctggagagtgaggggagcaag

SEQ ID NO: 8287173 - DNA, 22 bp, Homo sapiens
gctggccagggctgctcgcgga

SEQ ID NO: 8287174 - DNA, 22 bp, Homo sapiens
gctgggcactgtcccataggct

SEQ ID NO: 8287175 - DNA, 22 bp, Homo sapiens
gctgggcacctctcccagattg

SEQ ID NO: 8287176 - DNA, 22 bp, Homo sapiens
gctgggcaatgccagagaggag

SEQ ID NO: 8287177 - DNA, 22 bp, Homo sapiens
gctgggcaacggaagagagaaa

SEQ ID NO: 8287178 - DNA, 22 bp, Homo sapiens
gctgggcaaggctgaagctacc

SEQ ID NO: 8287179 - DNA, 22 bp, Homo sapiens
gctgggcaacgggcagaaagat

SEQ ID NO: 8287180 - DNA, 22 bp, Homo sapiens
gctgggcagcccctacagagag

SEQ ID NO: 8287181 - DNA, 22 bp, Homo sapiens
gctgggcagcctggccgctgcc

SEQ ID NO: 8287182 - DNA, 22 bp, Homo sapiens
gcctggaggggccagggtggta

SEQ ID NO: 8287183 - DNA, 22 bp, Homo sapiens
gcctgccttttggaggcacatt

SEQ ID NO: 8287184 - DNA, 22 bp, Homo sapiens
gcctgcctttgtgaggaagcgg

SEQ ID NO: 8287185 - DNA, 23 bp, Homo sapiens
gcctctggagccccagtgctcag

SEQ ID NO: 8287186 - DNA, 22 bp, Homo sapiens
gcctgcctcaaaatcccagttc

SEQ ID NO: 8287187 - DNA, 20 bp, Homo sapiens
gcctgcctcagctagctgag

SEQ ID NO: 8287188 - DNA, 23 bp, Homo sapiens
gcctgcctgacctgtgcaaagtc

SEQ ID NO: 8287189 - DNA, 22 bp, Homo sapiens
gcctgcctgaaggctgtaccag

SEQ ID NO: 8287190 - DNA, 21 bp, Homo sapiens
gcctgcctgcgtgaccctctt

SEQ ID NO: 8287191 - DNA, 22 bp, Homo sapiens
gcctgcctgctgtcatctgcct

SEQ ID NO: 8287192 - DNA, 22 bp, Homo sapiens
gcctgcctgctgtgtgcaagtt

SEQ ID NO: 8287193 - DNA, 19 bp, Homo sapiens
gcctgcctgggtttctgag

SEQ ID NO: 8287194 - DNA, 22 bp, Homo sapiens
gcctgcctgttggctgaggtgc

SEQ ID NO: 8287195 - DNA, 22 bp, Homo sapiens
gcctgcctttgtatgaccctga

SEQ ID NO: 8287196 - DNA, 22 bp, Homo sapiens
gcctgccttcggtgcgcagcgg

SEQ ID NO: 8287197 - DNA, 22 bp, Homo sapiens
gcctggcattggagccggggca

SEQ ID NO: 8287198 - DNA, 22 bp, Homo sapiens
gcctggcattacagcactcctg

SEQ ID NO: 8287199 - DNA, 22 bp, Homo sapiens
gcctggcatatagtagttgtgc

SEQ ID NO: 8287200 - DNA, 22 bp, Homo sapiens
gcctggcagttgacagtttgct

SEQ ID NO: 8287201 - DNA, 22 bp, Homo sapiens
gcctggcagtggggccctggga

SEQ ID NO: 8287202 - DNA, 22 bp, Homo sapiens
gcctggcagtgtaattcctgtc

SEQ ID NO: 8287203 - DNA, 19 bp, Homo sapiens
gcctggcagtgtacaaggc

SEQ ID NO: 8287204 - DNA, 22 bp, Homo sapiens
gcctggcaggggcctgggagtg

SEQ ID NO: 8287205 - DNA, 22 bp, Homo sapiens
gcctggcagggcccggacggca

SEQ ID NO: 8287206 - DNA, 22 bp, Homo sapiens
gcctggcagtgatgtcttttgg

SEQ ID NO: 8287207 - DNA, 21 bp, Homo sapiens
gcctggcaggtggaagggctc

SEQ ID NO: 8287208 - DNA, 22 bp, Homo sapiens
gcctggcaggcctgttggggct

SEQ ID NO: 8287209 - DNA, 22 bp, Homo sapiens
gcctggcagggagattgtaaga

SEQ ID NO: 8287210 - DNA, 22 bp, Homo sapiens
gcctggcaggcctgggccagca

SEQ ID NO: 8287211 - DNA, 22 bp, Homo sapiens
gcctggcaggcctcatgagggg

SEQ ID NO: 8287212 - DNA, 21 bp, Homo sapiens
gcctgtggagcccaagggccc

SEQ ID NO: 8287213 - DNA, 22 bp, Homo sapiens
gcctgtgtcatgtagtagcttc

SEQ ID NO: 8287214 - DNA, 22 bp, Homo sapiens
gcctgtggggctgaggctgcct

SEQ ID NO: 8287215 - DNA, 22 bp, Homo sapiens
gcctgtgggttggagcttggcc

SEQ ID NO: 8287216 - DNA, 22 bp, Homo sapiens
gccctctgatgctcaccgagga

SEQ ID NO: 8287217 - DNA, 22 bp, Homo sapiens
gccctctgccacaggacgccag

SEQ ID NO: 8287218 - DNA, 22 bp, Homo sapiens
gccctttgaagtaagctggtgt

SEQ ID NO: 8287219 - DNA, 22 bp, Homo sapiens
gcccttggaagcggcaggtagc

SEQ ID NO: 8287220 - DNA, 22 bp, Homo sapiens
gccctcagctcctggacacatg

SEQ ID NO: 8287221 - DNA, 22 bp, Homo sapiens
gcctctgccctcctgggactgc

SEQ ID NO: 8287222 - DNA, 22 bp, Homo sapiens
gcctctgccctcctgggactgc

SEQ ID NO: 8287223 - DNA, 22 bp, Homo sapiens
gcctctgccaagggggctgcgg

SEQ ID NO: 8287224 - DNA, 22 bp, Homo sapiens
gccgtggcttctccagctggct

SEQ ID NO: 8287225 - DNA, 22 bp, Homo sapiens
gccgtaaagctacgcttttgcg

SEQ ID NO: 8287226 - DNA, 22 bp, Homo sapiens
gccggggctggggagagacatg

SEQ ID NO: 8287227 - DNA, 22 bp, Homo sapiens
gcctcctgtcccaggctgagga

SEQ ID NO: 8287228 - DNA, 22 bp, Homo sapiens
gccggccagcaagcttcaggtg

SEQ ID NO: 8287229 - DNA, 22 bp, Homo sapiens
gccgaggctctgcccagctgct

SEQ ID NO: 8287230 - DNA, 22 bp, Homo sapiens
gccgctggaaggtgagtgacgt

SEQ ID NO: 8287231 - DNA, 22 bp, Homo sapiens
gccgaggctctgcccagctgct

SEQ ID NO: 8287232 - DNA, 22 bp, Homo sapiens
gccattaaagtgcatgttttgc

SEQ ID NO: 8287233 - DNA, 22 bp, Homo sapiens
gccatgtgggcagaggaggctg

SEQ ID NO: 8287234 - DNA, 18 bp, Homo sapiens
gccatgttctatgcttac

SEQ ID NO: 8287235 - DNA, 21 bp, Homo sapiens
gccatgtttccttactaagag

SEQ ID NO: 8287236 - DNA, 23 bp, Homo sapiens
gccatcacgttcaaccaaagcct

SEQ ID NO: 8287237 - DNA, 21 bp, Homo sapiens
gccatcaccaagctcttcccc

SEQ ID NO: 8287238 - DNA, 22 bp, Homo sapiens
gccatcacatccaggctacctc

SEQ ID NO: 8287239 - DNA, 22 bp, Homo sapiens
gccattcatattttagcattaa

SEQ ID NO: 8287240 - DNA, 22 bp, Homo sapiens
gccattcttaacagtcatcact

SEQ ID NO: 8287241 - DNA, 22 bp, Homo sapiens
gcccaggagttggaggctgcag

SEQ ID NO: 8287242 - DNA, 22 bp, Homo sapiens
gcccaggaggcagaggttgtgg

SEQ ID NO: 8287243 - DNA, 22 bp, Homo sapiens
gccaggctggtgtcacaactct

SEQ ID NO: 8287244 - DNA, 22 bp, Homo sapiens
gccagtgggacccgctgtgggc

SEQ ID NO: 8287245 - DNA, 22 bp, Homo sapiens
gccagtggtagaggggaggccg

SEQ ID NO: 8287246 - DNA, 22 bp, Homo sapiens
gccagtgggtagttggagctgg

SEQ ID NO: 8287247 - DNA, 18 bp, Homo sapiens
gccagtgggtccaggtgc

SEQ ID NO: 8287248 - DNA, 22 bp, Homo sapiens
gccagtggtcagtgggagggtg

SEQ ID NO: 8287249 - DNA, 22 bp, Homo sapiens
gccagtggtcactgaggaagaa

SEQ ID NO: 8287250 - DNA, 22 bp, Homo sapiens
gatgtacaaagagaggatttca

SEQ ID NO: 8287251 - DNA, 22 bp, Homo sapiens
gatgtacaatgtcactatgacc

SEQ ID NO: 8287252 - DNA, 22 bp, Homo sapiens
gatgtacaagtaaaatatgtgt

SEQ ID NO: 8287253 - DNA, 22 bp, Homo sapiens
gatgtacaagattgtaggaatg

SEQ ID NO: 8287254 - DNA, 22 bp, Homo sapiens
gatggggatgagaagtgagcag

SEQ ID NO: 8287255 - DNA, 21 bp, Homo sapiens
gatgtacatcaagcactttgc

SEQ ID NO: 8287256 - DNA, 22 bp, Homo sapiens
gatgtacatgcaagcacttaga

SEQ ID NO: 8287257 - DNA, 22 bp, Homo sapiens
gatgtacactcagaaaagtcat

SEQ ID NO: 8287258 - DNA, 22 bp, Homo sapiens
gatgtacaggagtttttcaagg

SEQ ID NO: 8287259 - DNA, 22 bp, Homo sapiens
gatgcctgcatttcaggagagt

SEQ ID NO: 8287260 - DNA, 22 bp, Homo sapiens
gatggaagaaaaatgcatgtct

SEQ ID NO: 8287261 - DNA, 22 bp, Homo sapiens
gatggcctcagtgcccaaagga

SEQ ID NO: 8287262 - DNA, 22 bp, Homo sapiens
gatgggctggggagaaagcatg

SEQ ID NO: 8287263 - DNA, 18 bp, Homo sapiens
gatgggagcaagagaaga

SEQ ID NO: 8287264 - DNA, 22 bp, Homo sapiens
gatttatagtatgtgctttcag

SEQ ID NO: 8287265 - DNA, 22 bp, Homo sapiens
gatttacaggttaggtcctgta

SEQ ID NO: 8287266 - DNA, 22 bp, Homo sapiens
gatttatagtatgtgctttcag

SEQ ID NO: 8287267 - DNA, 21 bp, Homo sapiens
gatttataagccttaagccta

SEQ ID NO: 8287268 - DNA, 22 bp, Homo sapiens
gatttataaaggttgcactgga

SEQ ID NO: 8287269 - DNA, 22 bp, Homo sapiens
gatttacaaagctctctagtgt

SEQ ID NO: 8287270 - DNA, 22 bp, Homo sapiens
gatttaaagtagacctttgttt

SEQ ID NO: 8287271 - DNA, 19 bp, Homo sapiens
gatttaaacgtggctctat

SEQ ID NO: 8287272 - DNA, 22 bp, Homo sapiens
gattggaaatggaaatggtaaa

SEQ ID NO: 8287273 - DNA, 22 bp, Homo sapiens
gattgtacacatctggtgcctt

SEQ ID NO: 8287274 - DNA, 22 bp, Homo sapiens
gattgtacttattgagctaaac

SEQ ID NO: 8287275 - DNA, 22 bp, Homo sapiens
gattgtaattttcaagaggtaa

SEQ ID NO: 8287276 - DNA, 22 bp, Homo sapiens
gattgaatcatatgaaattgtg

SEQ ID NO: 8287277 - DNA, 22 bp, Homo sapiens
gattctttagcccagaaagtta

SEQ ID NO: 8287278 - DNA, 20 bp, Homo sapiens
gattacaaaatgaaatgcat

SEQ ID NO: 8287279 - DNA, 22 bp, Homo sapiens
gattacaaaactcatctatgac

SEQ ID NO: 8287280 - DNA, 22 bp, Homo sapiens
gattaatagacacaaccaagct

SEQ ID NO: 8287281 - DNA, 22 bp, Homo sapiens
gatgttttctggaaaatgaatg

SEQ ID NO: 8287282 - DNA, 22 bp, Homo sapiens
gcaccctagagttgcctgagga

SEQ ID NO: 8287283 - DNA, 22 bp, Homo sapiens
gcaccctgagtgttcagctcca

SEQ ID NO: 8287284 - DNA, 22 bp, Homo sapiens
gcaccctgctctatccttgcta

SEQ ID NO: 8287285 - DNA, 22 bp, Homo sapiens
gcacacacatgtgagtacatgc

SEQ ID NO: 8287286 - DNA, 22 bp, Homo sapiens
gcacccaggcactttcctttct

SEQ ID NO: 8287287 - DNA, 22 bp, Homo sapiens
gcacccaggcttgggcagcaac

SEQ ID NO: 8287288 - DNA, 22 bp, Homo sapiens
gcacccaggccggcgactgcag

SEQ ID NO: 8287289 - DNA, 22 bp, Homo sapiens
gcacccattgtgtgcagctctg

SEQ ID NO: 8287290 - DNA, 22 bp, Homo sapiens
gcacccagtgggatgcttagca

SEQ ID NO: 8287291 - DNA, 22 bp, Homo sapiens
gcacccagggacttggctggcc

SEQ ID NO: 8287292 - DNA, 22 bp, Homo sapiens
gcagaaccataaattcaggtaa

SEQ ID NO: 8287293 - DNA, 22 bp, Homo sapiens
gcagaagcacaggtgacgggcc

SEQ ID NO: 8287294 - DNA, 22 bp, Homo sapiens
gcagaagcagaggagcctatga

SEQ ID NO: 8287295 - DNA, 22 bp, Homo sapiens
gcagagcagtgcttgcccagcg

SEQ ID NO: 8287296 - DNA, 22 bp, Homo sapiens
gcagagccccattgctggcggg

SEQ ID NO: 8287297 - DNA, 22 bp, Homo sapiens
gcagagccaggagagacccttg

SEQ ID NO: 8287298 - DNA, 21 bp, Homo sapiens
gattttaaagagactgccaca

SEQ ID NO: 8287299 - DNA, 22 bp, Homo sapiens
gatttgtctaggtcatgacttt

SEQ ID NO: 8287300 - DNA, 22 bp, Homo sapiens
gattttaattataggaggtcct

SEQ ID NO: 8287301 - DNA, 22 bp, Homo sapiens
gattttatagtcaggaaaaaga

SEQ ID NO: 8287302 - DNA, 22 bp, Homo sapiens
gattttatatggcatactgtgg

SEQ ID NO: 8287303 - DNA, 22 bp, Homo sapiens
gattttatatggcatactgtgg

SEQ ID NO: 8287304 - DNA, 22 bp, Homo sapiens
gattttatcgtcatccttctgg

SEQ ID NO: 8287305 - DNA, 22 bp, Homo sapiens
gattttattagcccaaactttg

SEQ ID NO: 8287306 - DNA, 22 bp, Homo sapiens
gcaatctttaaaaatcaagtcg

SEQ ID NO: 8287307 - DNA, 22 bp, Homo sapiens
gcaaacataatatgaagacact

SEQ ID NO: 8287308 - DNA, 22 bp, Homo sapiens
gcaaaaaatgcttgttgcttag

SEQ ID NO: 8287309 - DNA, 22 bp, Homo sapiens
gatttttatataaagtgagaaa

SEQ ID NO: 8287310 - DNA, 22 bp, Homo sapiens
gattttctgagccttcaaattt

SEQ ID NO: 8287311 - DNA, 22 bp, Homo sapiens
gattttgaatattaaagaagag

SEQ ID NO: 8287312 - DNA, 21 bp, Homo sapiens
gcatgtgtggtgtgctccaca

SEQ ID NO: 8287313 - DNA, 22 bp, Homo sapiens
gcatgtggaatctctccatggt

SEQ ID NO: 8287314 - DNA, 22 bp, Homo sapiens
gcatggcttcggggtgctgcct

SEQ ID NO: 8287315 - DNA, 22 bp, Homo sapiens
gcagtgttgagccagctggggg

SEQ ID NO: 8287316 - DNA, 22 bp, Homo sapiens
gcatggcttctgccaggcacct

SEQ ID NO: 8287317 - DNA, 22 bp, Homo sapiens
gcatggcttctgccaggcacct

SEQ ID NO: 8287318 - DNA, 22 bp, Homo sapiens
gcatgggaggacagtctgggct

SEQ ID NO: 8287319 - DNA, 22 bp, Homo sapiens
gcatgggcaccagtctctaggt

SEQ ID NO: 8287320 - DNA, 22 bp, Homo sapiens
gcatgtgtccctcagtctgtgc

SEQ ID NO: 8287321 - DNA, 22 bp, Homo sapiens
gcatgtggtgggctggccactc

SEQ ID NO: 8287322 - DNA, 22 bp, Homo sapiens
gcatgtggtgctgaggctgtcg

SEQ ID NO: 8287323 - DNA, 22 bp, Homo sapiens
gcatgtgggagggtcttcccac

SEQ ID NO: 8287324 - DNA, 22 bp, Homo sapiens
gcatgtgggaacacttaggcac

SEQ ID NO: 8287325 - DNA, 22 bp, Homo sapiens
gcatgtggccttcaggctggaa

SEQ ID NO: 8287326 - DNA, 20 bp, Homo sapiens
gccagaggccggcaggggct

SEQ ID NO: 8287327 - DNA, 22 bp, Homo sapiens
gccagaggctcaggttgccatg

SEQ ID NO: 8287328 - DNA, 20 bp, Homo sapiens
gccagaggccggcaggggct

SEQ ID NO: 8287329 - DNA, 22 bp, Homo sapiens
gccacagctccagtcaggtgac

SEQ ID NO: 8287330 - DNA, 22 bp, Homo sapiens
gccacagcggggccgctagagc

SEQ ID NO: 8287331 - DNA, 22 bp, Homo sapiens
gccagcagcccagaaggacttt

SEQ ID NO: 8287332 - DNA, 22 bp, Homo sapiens
gccagcagcccagaaggacttt

SEQ ID NO: 8287333 - DNA, 22 bp, Homo sapiens
gccagcagcgagagtttaacct

SEQ ID NO: 8287334 - DNA, 22 bp, Homo sapiens
gccagcagctcttgggcgggca

SEQ ID NO: 8287335 - DNA, 22 bp, Homo sapiens
gccagcagggaagccttgggct

SEQ ID NO: 8287336 - DNA, 22 bp, Homo sapiens
gccagcagcttcttctcatcct

SEQ ID NO: 8287337 - DNA, 22 bp, Homo sapiens
gccagcagctgtggggtggcca

SEQ ID NO: 8287338 - DNA, 22 bp, Homo sapiens
gccagcagccacagaagtcact

SEQ ID NO: 8287339 - DNA, 22 bp, Homo sapiens
gccagcagccacagaagtcact

SEQ ID NO: 8287340 - DNA, 19 bp, Homo sapiens
gccagcagaatgatgaggc

SEQ ID NO: 8287341 - DNA, 22 bp, Homo sapiens
gcagtgggagcttaggcagtgc

SEQ ID NO: 8287342 - DNA, 22 bp, Homo sapiens
gcaggtgtctgactgccttctt

SEQ ID NO: 8287343 - DNA, 23 bp, Homo sapiens
gcaggtggttcgaacagaagttt

SEQ ID NO: 8287344 - DNA, 22 bp, Homo sapiens
gcagtgttatgttttctataat

SEQ ID NO: 8287345 - DNA, 22 bp, Homo sapiens
gcagtggggaatgctggggaga

SEQ ID NO: 8287346 - DNA, 22 bp, Homo sapiens
gcaggtgggggtcggtgcatct

SEQ ID NO: 8287347 - DNA, 22 bp, Homo sapiens
gcaggtgggggagaagttgtga

SEQ ID NO: 8287348 - DNA, 22 bp, Homo sapiens
gcaggtgggagccgctgcctga

SEQ ID NO: 8287349 - DNA, 22 bp, Homo sapiens
gcaggtggggctgctaccagaa

SEQ ID NO: 8287350 - DNA, 16 bp, Homo sapiens
gcaggtggggcgcgca

SEQ ID NO: 8287351 - DNA, 22 bp, Homo sapiens
gcaggtggtggggctatgatct

SEQ ID NO: 8287352 - DNA, 22 bp, Homo sapiens
gcaggtggtccccgtggagtgg

SEQ ID NO: 8287353 - DNA, 22 bp, Homo sapiens
gcaggtggtgggggagccgttc

SEQ ID NO: 8287354 - DNA, 19 bp, Homo sapiens
gcaggtggatgtggtcagc

SEQ ID NO: 8287355 - DNA, 22 bp, Homo sapiens
gcaggtggagcagtagtctggt

SEQ ID NO: 8287356 - DNA, 22 bp, Homo sapiens
gcaggtggcagaggtgggatct

SEQ ID NO: 8287357 - DNA, 22 bp, Homo sapiens
gcaggtgggagccgctgcctga

SEQ ID NO: 8287358 - DNA, 22 bp, Homo sapiens
gcaggtggattatcagaagtgc

SEQ ID NO: 8287359 - DNA, 22 bp, Homo sapiens
gcagggtgatagtgaggctcag

SEQ ID NO: 8287360 - DNA, 22 bp, Homo sapiens
gcaggtggaagcagcagactca

SEQ ID NO: 8287361 - DNA, 22 bp, Homo sapiens
gcagggtggatggcagggccag

SEQ ID NO: 8287362 - DNA, 22 bp, Homo sapiens
gcagggacgcagcactctccgt

SEQ ID NO: 8287363 - DNA, 22 bp, Homo sapiens
gcagggaccttgcccaccctcc

SEQ ID NO: 8287364 - DNA, 21 bp, Homo sapiens
gcaggggatagaaatggtctg

SEQ ID NO: 8287365 - DNA, 22 bp, Homo sapiens
gcagggtgaaggtcacatagaa

SEQ ID NO: 8287366 - DNA, 22 bp, Homo sapiens
gcagggcacagacagtgccaag

SEQ ID NO: 8287367 - DNA, 22 bp, Homo sapiens
gcagagctcatgcctgcacctc

SEQ ID NO: 8287368 - DNA, 22 bp, Homo sapiens
gcagagctcatgcctgcacctc

SEQ ID NO: 8287369 - DNA, 20 bp, Homo sapiens
gcagagcctcactgcaaggg

SEQ ID NO: 8287370 - DNA, 22 bp, Homo sapiens
gcagagcctgtgtctgagcaaa

SEQ ID NO: 8287371 - DNA, 22 bp, Homo sapiens
gcagctctctggcctgccctgg

SEQ ID NO: 8287372 - DNA, 22 bp, Homo sapiens
gcagctctgacaatgcctggaa

SEQ ID NO: 8287373 - DNA, 22 bp, Homo sapiens
gcagctctggggcaggcctgag

SEQ ID NO: 8287374 - DNA, 22 bp, Homo sapiens
gcagctgaagctgcagttccag

SEQ ID NO: 8287375 - DNA, 18 bp, Homo sapiens
gcagctgacactggagtt

SEQ ID NO: 8287376 - DNA, 22 bp, Homo sapiens
gcaggagccagggattccagga

SEQ ID NO: 8287377 - DNA, 22 bp, Homo sapiens
gcaggagccacttcagggatgc

SEQ ID NO: 8287378 - DNA, 22 bp, Homo sapiens
gcaggagccctggcatgttctt

SEQ ID NO: 8287379 - DNA, 22 bp, Homo sapiens
gcaggagctcgtttccaggctg

SEQ ID NO: 8287380 - DNA, 22 bp, Homo sapiens
gcaggagactggctgtggtagt

SEQ ID NO: 8287381 - DNA, 22 bp, Homo sapiens
gcaggagaaatgaagattgggt

SEQ ID NO: 8287382 - DNA, 22 bp, Homo sapiens
gcaggagaacaaagcaagctgc

SEQ ID NO: 8287383 - DNA, 19 bp, Homo sapiens
gcaggactcccagctcctc

SEQ ID NO: 8287384 - DNA, 22 bp, Homo sapiens
ttgttaaaatattggagaaagg

SEQ ID NO: 8287385 - DNA, 22 bp, Homo sapiens
ttgtgtactcaccagcacatac

SEQ ID NO: 8287386 - DNA, 22 bp, Homo sapiens
ttgtattttgttatgctactgc

SEQ ID NO: 8287387 - DNA, 22 bp, Homo sapiens
ttgttaaatggatgcagaataa

SEQ ID NO: 8287388 - DNA, 22 bp, Homo sapiens
tttaaaaaactagtctgagtct

SEQ ID NO: 8287389 - DNA, 22 bp, Homo sapiens
tttaaaaaactagtctgagtct

SEQ ID NO: 8287390 - DNA, 22 bp, Homo sapiens
ctccagtgcactggtcttttca

SEQ ID NO: 8287391 - DNA, 22 bp, Homo sapiens
ctccagtgcacccagaggattt

SEQ ID NO: 8287392 - DNA, 22 bp, Homo sapiens
ctccagtgagtgagcaggcgac

SEQ ID NO: 8287393 - DNA, 22 bp, Homo sapiens
ctccaggttacttagcctagct

SEQ ID NO: 8287394 - DNA, 22 bp, Homo sapiens
ttgtatttctccactttctgtt

SEQ ID NO: 8287395 - DNA, 22 bp, Homo sapiens
ttgtatttcttccggtctcatt

SEQ ID NO: 8287396 - DNA, 22 bp, Homo sapiens
ttgtatttgattgtcatatcgt

SEQ ID NO: 8287397 - DNA, 22 bp, Homo sapiens
ttgtatttgattgtcatatcgt

SEQ ID NO: 8287398 - DNA, 22 bp, Homo sapiens
ttgtatttgggtagtatagaga

SEQ ID NO: 8287399 - DNA, 22 bp, Homo sapiens
ctccaggggccagaagcctggc

SEQ ID NO: 8287400 - DNA, 22 bp, Homo sapiens
ttggtaattgtgtttattaaat

SEQ ID NO: 8287401 - DNA, 22 bp, Homo sapiens
ttggtcaagctgtcttctttgc

SEQ ID NO: 8287402 - DNA, 22 bp, Homo sapiens
ttgcttttgggaaaacatgcct

SEQ ID NO: 8287403 - DNA, 22 bp, Homo sapiens
ttggcatttatctttaatcaaa

SEQ ID NO: 8287404 - DNA, 22 bp, Homo sapiens
ttggaaaaattgcctgatgtct

SEQ ID NO: 8287405 - DNA, 22 bp, Homo sapiens
ttgatattctgagaagctgaag

SEQ ID NO: 8287406 - DNA, 22 bp, Homo sapiens
ttggccagagaccagagcaggg

SEQ ID NO: 8287407 - DNA, 22 bp, Homo sapiens
ttgggcagcattgcagttccct

SEQ ID NO: 8287408 - DNA, 22 bp, Homo sapiens
ttgggcaggctggcagactgct

SEQ ID NO: 8287409 - DNA, 22 bp, Homo sapiens
ttgggcagaggccaggaggatg

SEQ ID NO: 8287410 - DNA, 22 bp, Homo sapiens
tttacatgtaatgttatacaaa

SEQ ID NO: 8287411 - DNA, 22 bp, Homo sapiens
tttaacacctgtagcaggataa

SEQ ID NO: 8287412 - DNA, 22 bp, Homo sapiens
tttaaaaggcagcttcttttgt

SEQ ID NO: 8287413 - DNA, 22 bp, Homo sapiens
tttaaaaccaaagaaagcctct

SEQ ID NO: 8287414 - DNA, 22 bp, Homo sapiens
tttaaaaggggtattaagtcca

SEQ ID NO: 8287415 - DNA, 22 bp, Homo sapiens
tttaaaaggggtattaagtcca

SEQ ID NO: 8287416 - DNA, 22 bp, Homo sapiens
ctcctctgtctaccacgagggt

SEQ ID NO: 8287417 - DNA, 22 bp, Homo sapiens
ctcctgagaggatctctgttgt

SEQ ID NO: 8287418 - DNA, 22 bp, Homo sapiens
ctcctctccatcagcgccaccc

SEQ ID NO: 8287419 - DNA, 22 bp, Homo sapiens
ctcctctctggagttatgcaga

SEQ ID NO: 8287420 - DNA, 17 bp, Homo sapiens
ctcctctctgggttact

SEQ ID NO: 8287421 - DNA, 22 bp, Homo sapiens
tttagacaagatccttctgaat

SEQ ID NO: 8287422 - DNA, 22 bp, Homo sapiens
tttagaatgtgactgtatttga

SEQ ID NO: 8287423 - DNA, 22 bp, Homo sapiens
tttagacacactttgtatattt

SEQ ID NO: 8287424 - DNA, 22 bp, Homo sapiens
tttagacatagctgaaatcatt

SEQ ID NO: 8287425 - DNA, 22 bp, Homo sapiens
tttagacatctataattgctaa

SEQ ID NO: 8287426 - DNA, 22 bp, Homo sapiens
tttagacagcatctggtgactt

SEQ ID NO: 8287427 - DNA, 22 bp, Homo sapiens
tttagacactagggatgcagtg

SEQ ID NO: 8287428 - DNA, 22 bp, Homo sapiens
tttagacagatgtgaggtgggt

SEQ ID NO: 8287429 - DNA, 22 bp, Homo sapiens
tttagacaggggcaaaataagg

SEQ ID NO: 8287430 - DNA, 22 bp, Homo sapiens
tttagacagcggctctgaacca

SEQ ID NO: 8287431 - DNA, 22 bp, Homo sapiens
ctctcctacatttcattcacaa

SEQ ID NO: 8287432 - DNA, 22 bp, Homo sapiens
ctctccctggccagctgtgcag

SEQ ID NO: 8287433 - DNA, 22 bp, Homo sapiens
ctctcctccaggaactcacagt

SEQ ID NO: 8287434 - DNA, 22 bp, Homo sapiens
ctctcccccacagcagccttct

SEQ ID NO: 8287435 - DNA, 22 bp, Homo sapiens
ctctccctatgcctcccaggag

SEQ ID NO: 8287436 - DNA, 22 bp, Homo sapiens
ctctccagttacctaggtctga

SEQ ID NO: 8287437 - DNA, 21 bp, Homo sapiens
ctctccagtggttcctgattc

SEQ ID NO: 8287438 - DNA, 22 bp, Homo sapiens
ctctccaggagagcactttgag

SEQ ID NO: 8287439 - DNA, 22 bp, Homo sapiens
ctctccaggactttggcccaat

SEQ ID NO: 8287440 - DNA, 22 bp, Homo sapiens
ctctccaggactttggcccaat

SEQ ID NO: 8287441 - DNA, 19 bp, Homo sapiens
ctctccagctccagtagct

SEQ ID NO: 8287442 - DNA, 19 bp, Homo sapiens
ctctccagctccagtagct

SEQ ID NO: 8287443 - DNA, 22 bp, Homo sapiens
ctcctgggctgggaactcagcc

SEQ ID NO: 8287444 - DNA, 19 bp, Homo sapiens
ctctcactcgccacatcct

SEQ ID NO: 8287445 - DNA, 22 bp, Homo sapiens
ctctccagaattattactatta

SEQ ID NO: 8287446 - DNA, 22 bp, Homo sapiens
ctctccagaatatgccgccgtg

SEQ ID NO: 8287447 - DNA, 22 bp, Homo sapiens
ctctccagcctttagcccacgc

SEQ ID NO: 8287448 - DNA, 22 bp, Homo sapiens
ctctccagcctttagcccacgc

SEQ ID NO: 8287449 - DNA, 22 bp, Homo sapiens
ctctccagccacagaagctgct

SEQ ID NO: 8287450 - DNA, 22 bp, Homo sapiens
ctctccagccaggggcttcctg

SEQ ID NO: 8287451 - DNA, 22 bp, Homo sapiens
ctctccagccaggggcttcctg

SEQ ID NO: 8287452 - DNA, 22 bp, Homo sapiens
ctctccagatctgctgagccag

SEQ ID NO: 8287453 - DNA, 22 bp, Homo sapiens
ctctccagagcccttccggccc

SEQ ID NO: 8287454 - DNA, 22 bp, Homo sapiens
ctctccagatctgctgagccag

SEQ ID NO: 8287455 - DNA, 22 bp, Homo sapiens
ctctccagcagatgtagtctgt

SEQ ID NO: 8287456 - DNA, 20 bp, Homo sapiens
ttcattcattccacaacttc

SEQ ID NO: 8287457 - DNA, 19 bp, Homo sapiens
ttcattctcttattgttgt

SEQ ID NO: 8287458 - DNA, 22 bp, Homo sapiens
ttcattcttgtctttgtatagt

SEQ ID NO: 8287459 - DNA, 22 bp, Homo sapiens
cggctgcttctgagccccggcg

SEQ ID NO: 8287460 - DNA, 22 bp, Homo sapiens
ttcagaaacagagtgagtgagt

SEQ ID NO: 8287461 - DNA, 22 bp, Homo sapiens
ttcagaaacatcagtggatgga

SEQ ID NO: 8287462 - DNA, 22 bp, Homo sapiens
ttcactgtttcatcctacttct

SEQ ID NO: 8287463 - DNA, 22 bp, Homo sapiens
ttcagaaaaaacttcaataagt

SEQ ID NO: 8287464 - DNA, 22 bp, Homo sapiens
ttcacttatttcttgagtagca

SEQ ID NO: 8287465 - DNA, 22 bp, Homo sapiens
ttcacattaagcctcctcctac

SEQ ID NO: 8287466 - DNA, 22 bp, Homo sapiens
cggacaggctcctggagctcct

SEQ ID NO: 8287467 - DNA, 22 bp, Homo sapiens
cgcttgttagatgccgttagcc

SEQ ID NO: 8287468 - DNA, 20 bp, Homo sapiens
cgctttgcacgcggcgggca

SEQ ID NO: 8287469 - DNA, 22 bp, Homo sapiens
cgctttgcataacctaacactt

SEQ ID NO: 8287470 - DNA, 22 bp, Homo sapiens
cgctgtgtgcagactgaaaatg

SEQ ID NO: 8287471 - DNA, 21 bp, Homo sapiens
cctgggtgggacccctcttcc

SEQ ID NO: 8287472 - DNA, 22 bp, Homo sapiens
ttcacagacattgcagactgaa

SEQ ID NO: 8287473 - DNA, 22 bp, Homo sapiens
ttcacatctcagcactgcctct

SEQ ID NO: 8287474 - DNA, 22 bp, Homo sapiens
ttcacatataatgtctttaaaa

SEQ ID NO: 8287475 - DNA, 22 bp, Homo sapiens
ttcacataaatagatcacatca

SEQ ID NO: 8287476 - DNA, 22 bp, Homo sapiens
ttcccaaagctttgtctgtgaa

SEQ ID NO: 8287477 - DNA, 22 bp, Homo sapiens
ttcccaaaatataacagttaac

SEQ ID NO: 8287478 - DNA, 22 bp, Homo sapiens
ttccctttgttaaattggaaga

SEQ ID NO: 8287479 - DNA, 22 bp, Homo sapiens
ttccgagtctccaaggggttgt

SEQ ID NO: 8287480 - DNA, 22 bp, Homo sapiens
ctaagaaaatagaagcatgcta

SEQ ID NO: 8287481 - DNA, 22 bp, Homo sapiens
ctaagaaagtattgttttgtgg

SEQ ID NO: 8287482 - DNA, 22 bp, Homo sapiens
ttccggaatggcagggtagctc

SEQ ID NO: 8287483 - DNA, 22 bp, Homo sapiens
ttccgtaagagaaatgattcct

SEQ ID NO: 8287484 - DNA, 22 bp, Homo sapiens
ttccgtaatgttacattctcaa

SEQ ID NO: 8287485 - DNA, 22 bp, Homo sapiens
ttccgtcaggtgcaggtcagtg

SEQ ID NO: 8287486 - DNA, 22 bp, Homo sapiens
ttccgctgtttagttgaagttt

SEQ ID NO: 8287487 - DNA, 22 bp, Homo sapiens
ttcccacacccatattgtgatt

SEQ ID NO: 8287488 - DNA, 22 bp, Homo sapiens
ttccctggttaaccattttctg

SEQ ID NO: 8287489 - DNA, 22 bp, Homo sapiens
ctaattctgtatttggtcattg

SEQ ID NO: 8287490 - DNA, 22 bp, Homo sapiens
ctaatgtggactctatcaaagt

SEQ ID NO: 8287491 - DNA, 22 bp, Homo sapiens
ctaattctgtacctggcacata

SEQ ID NO: 8287492 - DNA, 22 bp, Homo sapiens
ctaattctgaaacagtgtcaat

SEQ ID NO: 8287493 - DNA, 22 bp, Homo sapiens
ctaattctcagcatgaactggt

SEQ ID NO: 8287494 - DNA, 22 bp, Homo sapiens
ctaagttaattttctaaaacta

SEQ ID NO: 8287495 - DNA, 22 bp, Homo sapiens
ctaagggcttgctggagccagg

SEQ ID NO: 8287496 - DNA, 22 bp, Homo sapiens
ctacaaagaaagtatactggac

SEQ ID NO: 8287497 - DNA, 22 bp, Homo sapiens
ttccttctaattttacacctga

SEQ ID NO: 8287498 - DNA, 22 bp, Homo sapiens
ttccttctaatattctgcctgt

SEQ ID NO: 8287499 - DNA, 22 bp, Homo sapiens
ttcctttgggaaatcactaagg

SEQ ID NO: 8287500 - DNA, 22 bp, Homo sapiens
ttcctttctctggactgcagcc

SEQ ID NO: 8287501 - DNA, 22 bp, Homo sapiens
ctaggcagactgagctctaggg

SEQ ID NO: 8287502 - DNA, 22 bp, Homo sapiens
ctagcccactgcaaatgttggc

SEQ ID NO: 8287503 - DNA, 22 bp, Homo sapiens
ctattcaggtgtccattaatcc

SEQ ID NO: 8287504 - DNA, 22 bp, Homo sapiens
ctatttgtcacaactggtgttt

SEQ ID NO: 8287505 - DNA, 21 bp, Homo sapiens
ttctgtagctgttagcttttc

SEQ ID NO: 8287506 - DNA, 22 bp, Homo sapiens
ttgaggaaagagtgcaaagagg

SEQ ID NO: 8287507 - DNA, 22 bp, Homo sapiens
ttgaggagtagaagctttgaat

SEQ ID NO: 8287508 - DNA, 22 bp, Homo sapiens
ttgaggaggtatgactaggtac

SEQ ID NO: 8287509 - DNA, 22 bp, Homo sapiens
ttgagttctggtcttttaaaag

SEQ ID NO: 8287510 - DNA, 22 bp, Homo sapiens
ttgactctggaggtcactgaag

SEQ ID NO: 8287511 - DNA, 22 bp, Homo sapiens
ttgagaaacatctaatctttgt

SEQ ID NO: 8287512 - DNA, 22 bp, Homo sapiens
ttcttgtctttgttatgtagga

SEQ ID NO: 8287513 - DNA, 22 bp, Homo sapiens
ttcttgtatataaaaatcattt

SEQ ID NO: 8287514 - DNA, 22 bp, Homo sapiens
ttcttgttccatgaaagacaga

SEQ ID NO: 8287515 - DNA, 22 bp, Homo sapiens
ttcttggctgggctttgcttcc

SEQ ID NO: 8287516 - DNA, 22 bp, Homo sapiens
ttcttgggaatttttccaacac

SEQ ID NO: 8287517 - DNA, 22 bp, Homo sapiens
ttcttgggtgtgaccagtctga

SEQ ID NO: 8287518 - DNA, 22 bp, Homo sapiens
ttcttgtttattaagatataaa

SEQ ID NO: 8287519 - DNA, 22 bp, Homo sapiens
ttcttgttttgcccaagttgta

SEQ ID NO: 8287520 - DNA, 17 bp, Homo sapiens
ctcagcagggctcactt

SEQ ID NO: 8287521 - DNA, 22 bp, Homo sapiens
ctcagcaggtaccacatgatct

SEQ ID NO: 8287522 - DNA, 23 bp, Homo sapiens
ctcagcaggtcaggccccttcct

SEQ ID NO: 8287523 - DNA, 22 bp, Homo sapiens
ctcagcaggtaccacatgatct

SEQ ID NO: 8287524 - DNA, 22 bp, Homo sapiens
ctcagcaggtaccacatgatct

SEQ ID NO: 8287525 - DNA, 22 bp, Homo sapiens
ctcagcagtaaacgtccggaac

SEQ ID NO: 8287526 - DNA, 22 bp, Homo sapiens
ctcagcagcagggaagaggtca

SEQ ID NO: 8287527 - DNA, 22 bp, Homo sapiens
ctcagcagaggcagtattcagt

SEQ ID NO: 8287528 - DNA, 22 bp, Homo sapiens
ctcagcagaggcagtattcagt

SEQ ID NO: 8287529 - DNA, 22 bp, Homo sapiens
ctcagcagctacaggattcggg

SEQ ID NO: 8287530 - DNA, 23 bp, Homo sapiens
ctcagcagcctgctgcagataag

SEQ ID NO: 8287531 - DNA, 19 bp, Homo sapiens
ctcagcacttttacacagg

SEQ ID NO: 8287532 - DNA, 22 bp, Homo sapiens
ctcagaggggatgcaatcttgc

SEQ ID NO: 8287533 - DNA, 22 bp, Homo sapiens
ctgaaattgatgacagggatgg

SEQ ID NO: 8287534 - DNA, 22 bp, Homo sapiens
ctctgggttttgtcagctgagg

SEQ ID NO: 8287535 - DNA, 22 bp, Homo sapiens
ctctttttcacctctgtcagcg

SEQ ID NO: 8287536 - DNA, 22 bp, Homo sapiens
tttttaagagtctggaaatagt

SEQ ID NO: 8287537 - DNA, 22 bp, Homo sapiens
ttttagtttggatttctaaagc

SEQ ID NO: 8287538 - DNA, 22 bp, Homo sapiens
ctctgggctccttcagcccttt

SEQ ID NO: 8287539 - DNA, 23 bp, Homo sapiens
ctctgggcgggcaggtcagcctc

SEQ ID NO: 8287540 - DNA, 21 bp, Homo sapiens
ctctgggccattttcttccac

SEQ ID NO: 8287541 - DNA, 22 bp, Homo sapiens
ctctgggcacattttccaggac

SEQ ID NO: 8287542 - DNA, 22 bp, Homo sapiens
ctctgggcactgtatgggttct

SEQ ID NO: 8287543 - DNA, 17 bp, Homo sapiens
ctctgggcagcctgggg

SEQ ID NO: 8287544 - DNA, 22 bp, Homo sapiens
ctctgggccaccgctggtgtat

SEQ ID NO: 8287545 - DNA, 22 bp, Homo sapiens
ctctgggcaggacgccaggcct

SEQ ID NO: 8287546 - DNA, 22 bp, Homo sapiens
ctctgggcaaagatgcctcatc

SEQ ID NO: 8287547 - DNA, 22 bp, Homo sapiens
ctctgggcaagtttcttcatga

SEQ ID NO: 8287548 - DNA, 19 bp, Homo sapiens
ctctgggcaagtcacttaa

SEQ ID NO: 8287549 - DNA, 18 bp, Homo sapiens
ctctgggagaggcataca

SEQ ID NO: 8287550 - DNA, 22 bp, Homo sapiens
ctctgggagtggccacttctca

SEQ ID NO: 8287551 - DNA, 22 bp, Homo sapiens
ctctgggaggtgttactatctg

SEQ ID NO: 8287552 - DNA, 22 bp, Homo sapiens
ctctgggatagagcctcggtct

SEQ ID NO: 8287553 - DNA, 22 bp, Homo sapiens
ctctgggatgaggcctaggcac

SEQ ID NO: 8287554 - DNA, 19 bp, Homo sapiens
ctctggctcctgggctgcc

SEQ ID NO: 8287555 - DNA, 22 bp, Homo sapiens
ctctggctgcggggcgcgtgga

SEQ ID NO: 8287556 - DNA, 22 bp, Homo sapiens
ctctggctggcacctgatctga

SEQ ID NO: 8287557 - DNA, 22 bp, Homo sapiens
ctctggcttagtatgctccaaa

SEQ ID NO: 8287558 - DNA, 22 bp, Homo sapiens
ctctggcttagtatgctccaaa

SEQ ID NO: 8287559 - DNA, 22 bp, Homo sapiens
ctctggctggctgggcctcagt

SEQ ID NO: 8287560 - DNA, 22 bp, Homo sapiens
ctctcctcccatgtaggagatg

SEQ ID NO: 8287561 - DNA, 23 bp, Homo sapiens
ctctcctgaaggacaagctgccg

SEQ ID NO: 8287562 - DNA, 23 bp, Homo sapiens
ctctcctgaaggacaagctgccg

SEQ ID NO: 8287563 - DNA, 22 bp, Homo sapiens
ctctcctcccatgtaggagatg

SEQ ID NO: 8287564 - DNA, 22 bp, Homo sapiens
tttgtcttggccaaggttctga

SEQ ID NO: 8287565 - DNA, 22 bp, Homo sapiens
ctgaggtttgtccatccttggt

SEQ ID NO: 8287566 - DNA, 22 bp, Homo sapiens
ctgcaaaagtcattgtggtttt

SEQ ID NO: 8287567 - DNA, 22 bp, Homo sapiens
ctgcagagcatgaggaggtctg

SEQ ID NO: 8287568 - DNA, 22 bp, Homo sapiens
ctgattgagaaggaaggggatc

SEQ ID NO: 8287569 - DNA, 22 bp, Homo sapiens
ctgcaaaagtaattgcaggttt

SEQ ID NO: 8287570 - DNA, 22 bp, Homo sapiens
ctgaggcactggtaatgggcat

SEQ ID NO: 8287571 - DNA, 22 bp, Homo sapiens
ctgagagaagagcgcagtttgt

SEQ ID NO: 8287572 - DNA, 22 bp, Homo sapiens
ctgagagaaacatgactcagga

SEQ ID NO: 8287573 - DNA, 22 bp, Homo sapiens
ctgagagaatcatgctgcaggt

SEQ ID NO: 8287574 - DNA, 17 bp, Homo sapiens
ctgccagtggggaggca

SEQ ID NO: 8287575 - DNA, 22 bp, Homo sapiens
ctgccagtgaaattgtgtcagt

SEQ ID NO: 8287576 - DNA, 22 bp, Homo sapiens
ctgccagtgaaattgtgtcagt

SEQ ID NO: 8287577 - DNA, 22 bp, Homo sapiens
ctgccagtctatgctgctcggc

SEQ ID NO: 8287578 - DNA, 22 bp, Homo sapiens
ctgccagtctatgctgctcggc

SEQ ID NO: 8287579 - DNA, 18 bp, Homo sapiens
ctgccagtgtgctctccg

SEQ ID NO: 8287580 - DNA, 22 bp, Homo sapiens
ctgccaggtgccagggcgcggc

SEQ ID NO: 8287581 - DNA, 22 bp, Homo sapiens
ctgccaggtaaactgcaggaat

SEQ ID NO: 8287582 - DNA, 22 bp, Homo sapiens
ctgccagtctaaagagggcttt

SEQ ID NO: 8287583 - DNA, 22 bp, Homo sapiens
ctgccctggggggcctccttgc

SEQ ID NO: 8287584 - DNA, 22 bp, Homo sapiens
ctgccgtgtttttcatgttaaa

SEQ ID NO: 8287585 - DNA, 22 bp, Homo sapiens
ctgccctgggttttatgggagt

SEQ ID NO: 8287586 - DNA, 22 bp, Homo sapiens
ctgcctataaactgcctcaaat

SEQ ID NO: 8287587 - DNA, 22 bp, Homo sapiens
ctgcctcagcgttgtggcccta

SEQ ID NO: 8287588 - DNA, 22 bp, Homo sapiens
ctgcctcatgctgcctgcagcc

SEQ ID NO: 8287589 - DNA, 22 bp, Homo sapiens
ctgcctcatgctgcctgcagcc

SEQ ID NO: 8287590 - DNA, 22 bp, Homo sapiens
ctgcctcctcacgtccacagtg

SEQ ID NO: 8287591 - DNA, 22 bp, Homo sapiens
ctgcagagctttctgaatgaag

SEQ ID NO: 8287592 - DNA, 22 bp, Homo sapiens
ctgcagagcttgtctggatgtg

SEQ ID NO: 8287593 - DNA, 22 bp, Homo sapiens
ctgcagagctaggctgagtgaa

SEQ ID NO: 8287594 - DNA, 22 bp, Homo sapiens
ctgcagagggtttgagcatcct

SEQ ID NO: 8287595 - DNA, 22 bp, Homo sapiens
ctgcagaggggttgaagggtcc

SEQ ID NO: 8287596 - DNA, 22 bp, Homo sapiens
ctgcagaggcctcgcctcctct

SEQ ID NO: 8287597 - DNA, 22 bp, Homo sapiens
ctgcagatcttgtgtacttgtc

SEQ ID NO: 8287598 - DNA, 22 bp, Homo sapiens
ctgcagagtatagcgagttggg

SEQ ID NO: 8287599 - DNA, 22 bp, Homo sapiens
ctgcagagtggagcctcggctg

SEQ ID NO: 8287600 - DNA, 22 bp, Homo sapiens
ctgcagcaagagaagtgctgac

SEQ ID NO: 8287601 - DNA, 22 bp, Homo sapiens
ctgccagggccctactcagttt

SEQ ID NO: 8287602 - DNA, 22 bp, Homo sapiens
ctgccaggcgatggattggctg

SEQ ID NO: 8287603 - DNA, 22 bp, Homo sapiens
ctgccagggaggctgggaagtt

SEQ ID NO: 8287604 - DNA, 22 bp, Homo sapiens
ctgccaggcctggggtgctgtc

SEQ ID NO: 8287605 - DNA, 22 bp, Homo sapiens
ctgcagccacgagtcacagccc

SEQ ID NO: 8287606 - DNA, 22 bp, Homo sapiens
ctggaccagcctccgccttcac

SEQ ID NO: 8287607 - DNA, 22 bp, Homo sapiens
ctggaggcacccttagagaggc

SEQ ID NO: 8287608 - DNA, 22 bp, Homo sapiens
ctggagggtggagagaagtctc

SEQ ID NO: 8287609 - DNA, 22 bp, Homo sapiens
ctgctttggacaactattcttg

SEQ ID NO: 8287610 - DNA, 22 bp, Homo sapiens
ctgctttgggcagctttgtggc

SEQ ID NO: 8287611 - DNA, 18 bp, Homo sapiens
ctgctttgccttcattcc

SEQ ID NO: 8287612 - DNA, 22 bp, Homo sapiens
ctggacagaaagggctgctgtg

SEQ ID NO: 8287613 - DNA, 22 bp, Homo sapiens
ctggacagaagtggctgggcag

SEQ ID NO: 8287614 - DNA, 22 bp, Homo sapiens
ctggacagtgggcagaggagac

SEQ ID NO: 8287615 - DNA, 22 bp, Homo sapiens
ctggacaggctggggactgcaa

SEQ ID NO: 8287616 - DNA, 22 bp, Homo sapiens
ctggaattatgaccaaaggtcc

SEQ ID NO: 8287617 - DNA, 22 bp, Homo sapiens
ctgcctgctcaccagggctctg

SEQ ID NO: 8287618 - DNA, 22 bp, Homo sapiens
ctgcttctaagaacctgcagct

SEQ ID NO: 8287619 - DNA, 23 bp, Homo sapiens
ctgctttcccactccatgctctt

SEQ ID NO: 8287620 - DNA, 22 bp, Homo sapiens
ctggcacatgctccctgagtgg

SEQ ID NO: 8287621 - DNA, 22 bp, Homo sapiens
ctggcagcagcttctggatcga

SEQ ID NO: 8287622 - DNA, 22 bp, Homo sapiens
ctggatcatgggaaagggatca

SEQ ID NO: 8287623 - DNA, 22 bp, Homo sapiens
ctggatcccgtctgagcctcct

SEQ ID NO: 8287624 - DNA, 22 bp, Homo sapiens
ctggatgcttcctctctgctag

SEQ ID NO: 8287625 - DNA, 22 bp, Homo sapiens
ctggattctggattcttctcat

SEQ ID NO: 8287626 - DNA, 22 bp, Homo sapiens
ctggcatgccttgggtgcctct

SEQ ID NO: 8287627 - DNA, 22 bp, Homo sapiens
ctggcatgcccagggtatgtgg

SEQ ID NO: 8287628 - DNA, 22 bp, Homo sapiens
ctggctccactccctgcctgac

SEQ ID NO: 8287629 - DNA, 22 bp, Homo sapiens
ctggctctctgatttcacattc

SEQ ID NO: 8287630 - DNA, 22 bp, Homo sapiens
ctggctctcgctgggagtactt

SEQ ID NO: 8287631 - DNA, 22 bp, Homo sapiens
ctggctctaagtgtcagctccc

SEQ ID NO: 8287632 - DNA, 22 bp, Homo sapiens
ctggctcctctacacacccaaa

SEQ ID NO: 8287633 - DNA, 22 bp, Homo sapiens
ctggctcctgaggcttggcccc

SEQ ID NO: 8287634 - DNA, 22 bp, Homo sapiens
ctggcctgagcacagcggctgc

SEQ ID NO: 8287635 - DNA, 22 bp, Homo sapiens
tgctccagtgagctggccatcc

SEQ ID NO: 8287636 - DNA, 22 bp, Homo sapiens
tgctccagtgagctggccatcc

SEQ ID NO: 8287637 - DNA, 22 bp, Homo sapiens
tgctccagggctgccagaccct

SEQ ID NO: 8287638 - DNA, 22 bp, Homo sapiens
cccaggctcctagaggcccaga

SEQ ID NO: 8287639 - DNA, 22 bp, Homo sapiens
tgctgacgtcaatgagaacata

SEQ ID NO: 8287640 - DNA, 22 bp, Homo sapiens
tgctcccaaacgacctactgtg

SEQ ID NO: 8287641 - DNA, 20 bp, Homo sapiens
cccagggacctgagctccat

SEQ ID NO: 8287642 - DNA, 22 bp, Homo sapiens
tgctcccagctcctgcagcaac

SEQ ID NO: 8287643 - DNA, 22 bp, Homo sapiens
tgctcccagctgtaggaatgtt

SEQ ID NO: 8287644 - DNA, 22 bp, Homo sapiens
cccccaggggctccgcctcgtg

SEQ ID NO: 8287645 - DNA, 22 bp, Homo sapiens
cccccaccgtgttcctgctcgg

SEQ ID NO: 8287646 - DNA, 22 bp, Homo sapiens
cccccacctgaggacagtctta

SEQ ID NO: 8287647 - DNA, 22 bp, Homo sapiens
ccctcagcttctccctgcagct

SEQ ID NO: 8287648 - DNA, 22 bp, Homo sapiens
ccctcagctccaccctcagcag

SEQ ID NO: 8287649 - DNA, 22 bp, Homo sapiens
ccctcaggagatgtcagctgga

SEQ ID NO: 8287650 - DNA, 22 bp, Homo sapiens
ccctcagggaccactgacttca

SEQ ID NO: 8287651 - DNA, 22 bp, Homo sapiens
ccccagccagcaggacctctga

SEQ ID NO: 8287652 - DNA, 22 bp, Homo sapiens
ccccagccttccatgggaattg

SEQ ID NO: 8287653 - DNA, 22 bp, Homo sapiens
ccccagcccacaagcatattaa

SEQ ID NO: 8287654 - DNA, 22 bp, Homo sapiens
cccaggcagggacgtgctctgg

SEQ ID NO: 8287655 - DNA, 22 bp, Homo sapiens
cccaggcagcggggtctccttg

SEQ ID NO: 8287656 - DNA, 22 bp, Homo sapiens
cccaggcagcccttctgacgca

SEQ ID NO: 8287657 - DNA, 22 bp, Homo sapiens
cccaggcacatccactctgtga

SEQ ID NO: 8287658 - DNA, 22 bp, Homo sapiens
cccaggcagagagctggtgagc

SEQ ID NO: 8287659 - DNA, 22 bp, Homo sapiens
cccaggaggtgtgcccaactcg

SEQ ID NO: 8287660 - DNA, 22 bp, Homo sapiens
cccaggaggttgaggctgcagt

SEQ ID NO: 8287661 - DNA, 22 bp, Homo sapiens
cccaggagggtggcctctgccc

SEQ ID NO: 8287662 - DNA, 22 bp, Homo sapiens
cccaggagggtggcctctgccc

SEQ ID NO: 8287663 - DNA, 22 bp, Homo sapiens
cccaggagggtggcctctgccc

SEQ ID NO: 8287664 - DNA, 22 bp, Homo sapiens
cccaggaggtggaggctgcagt

SEQ ID NO: 8287665 - DNA, 22 bp, Homo sapiens
tgcattcaatgtgccagggaaa

SEQ ID NO: 8287666 - DNA, 22 bp, Homo sapiens
tgcagggagggcccagcaatct

SEQ ID NO: 8287667 - DNA, 22 bp, Homo sapiens
tgcagggaggccccgcagccct

SEQ ID NO: 8287668 - DNA, 22 bp, Homo sapiens
tgcagggacaggctctggggat

SEQ ID NO: 8287669 - DNA, 22 bp, Homo sapiens
tgcagggaccccgaggctctct

SEQ ID NO: 8287670 - DNA, 22 bp, Homo sapiens
tgcagggagctctggggtgcag

SEQ ID NO: 8287671 - DNA, 22 bp, Homo sapiens
tgcagggaatctgtggctggac

SEQ ID NO: 8287672 - DNA, 22 bp, Homo sapiens
tgcagggaatgcttgcagcatg

SEQ ID NO: 8287673 - DNA, 22 bp, Homo sapiens
tgcagggacacgaagacaaata

SEQ ID NO: 8287674 - DNA, 22 bp, Homo sapiens
tctgtggcccaagtgatggctg

SEQ ID NO: 8287675 - DNA, 22 bp, Homo sapiens
tctgtggcatgttgcacttgta

SEQ ID NO: 8287676 - DNA, 22 bp, Homo sapiens
tctgtggcatagtgcttgggaa

SEQ ID NO: 8287677 - DNA, 20 bp, Homo sapiens
tctgtggcaggtggcgcttg

SEQ ID NO: 8287678 - DNA, 22 bp, Homo sapiens
cccagctcttcaagtcaccccc

SEQ ID NO: 8287679 - DNA, 22 bp, Homo sapiens
cccagctcttcctgggagctaa

SEQ ID NO: 8287680 - DNA, 22 bp, Homo sapiens
cccagctcttcctgggagctaa

SEQ ID NO: 8287681 - DNA, 22 bp, Homo sapiens
cccagctcttttagcggcatct

SEQ ID NO: 8287682 - DNA, 22 bp, Homo sapiens
tgcatgtttgtaggttcttcta

SEQ ID NO: 8287683 - DNA, 22 bp, Homo sapiens
tgcattaaaatgatggagaaat

SEQ ID NO: 8287684 - DNA, 22 bp, Homo sapiens
cccagcttgcaaatgggttgct

SEQ ID NO: 8287685 - DNA, 22 bp, Homo sapiens
cccagcttgcccaggactgagg

SEQ ID NO: 8287686 - DNA, 22 bp, Homo sapiens
cccagcttgcgggcggcaggag

SEQ ID NO: 8287687 - DNA, 22 bp, Homo sapiens
cccaggaaaggaaatgaatggg

SEQ ID NO: 8287688 - DNA, 22 bp, Homo sapiens
cccaggaaagagactgctgggt

SEQ ID NO: 8287689 - DNA, 22 bp, Homo sapiens
tggatgagttcaatgaggcaga

SEQ ID NO: 8287690 - DNA, 17 bp, Homo sapiens
tggcaagaatggaaatg

SEQ ID NO: 8287691 - DNA, 22 bp, Homo sapiens
tggcaaggaaattagttctcct

SEQ ID NO: 8287692 - DNA, 22 bp, Homo sapiens
tggcaaggaagagcctggtgca

SEQ ID NO: 8287693 - DNA, 22 bp, Homo sapiens
ccctgctgcagagagctttcca

SEQ ID NO: 8287694 - DNA, 22 bp, Homo sapiens
ccctggactgttcagggcctga

SEQ ID NO: 8287695 - DNA, 22 bp, Homo sapiens
ccctccaggcactgccctcttc

SEQ ID NO: 8287696 - DNA, 22 bp, Homo sapiens
ccctccagctcaaagcaaccgg

SEQ ID NO: 8287697 - DNA, 22 bp, Homo sapiens
ccctccagggagccatgctggg

SEQ ID NO: 8287698 - DNA, 22 bp, Homo sapiens
ccctccaggcctgtcatgttcc

SEQ ID NO: 8287699 - DNA, 22 bp, Homo sapiens
ccctccagagcttgacctgctg

SEQ ID NO: 8287700 - DNA, 20 bp, Homo sapiens
ccctccagcaaccaggactt

SEQ ID NO: 8287701 - DNA, 22 bp, Homo sapiens
ccctccagccatggacccaggt

SEQ ID NO: 8287702 - DNA, 22 bp, Homo sapiens
ccctccagagcctggacattct

SEQ ID NO: 8287703 - DNA, 23 bp, Homo sapiens
tggccaggcataaaggtgggtgg

SEQ ID NO: 8287704 - DNA, 22 bp, Homo sapiens
cctagtttcttaattttgagaa

SEQ ID NO: 8287705 - DNA, 22 bp, Homo sapiens
tggcagctgtgtccaggtagaa

SEQ ID NO: 8287706 - DNA, 22 bp, Homo sapiens
tggcagctgtgtccaggtagaa

SEQ ID NO: 8287707 - DNA, 22 bp, Homo sapiens
tggcagctgtgtccaggtagaa

SEQ ID NO: 8287708 - DNA, 22 bp, Homo sapiens
tggcagctgttaatgttttgtt

SEQ ID NO: 8287709 - DNA, 22 bp, Homo sapiens
tggcagctgtgcttcattcttt

SEQ ID NO: 8287710 - DNA, 22 bp, Homo sapiens
tggcagctgtctgtggggtctc

SEQ ID NO: 8287711 - DNA, 22 bp, Homo sapiens
tggcagctggctctgcgcaggc

SEQ ID NO: 8287712 - DNA, 22 bp, Homo sapiens
tggcagctggtacagtgggtct

SEQ ID NO: 8287713 - DNA, 22 bp, Homo sapiens
tggccagctgtaggttgtgcag

SEQ ID NO: 8287714 - DNA, 22 bp, Homo sapiens
tggcagcttgaatgcagtcttt

SEQ ID NO: 8287715 - DNA, 22 bp, Homo sapiens
tggcagctttttgtttcaggct

SEQ ID NO: 8287716 - DNA, 22 bp, Homo sapiens
tggcacagtcctgggtgcctgc

SEQ ID NO: 8287717 - DNA, 22 bp, Homo sapiens
tggcacaggaatttagatgcag

SEQ ID NO: 8287718 - DNA, 23 bp, Homo sapiens
tggcaaggaatgggatggagact

SEQ ID NO: 8287719 - DNA, 22 bp, Homo sapiens
tggcagatgcgttttcattttc

SEQ ID NO: 8287720 - DNA, 22 bp, Homo sapiens
tggcagcaattagctagagctg

SEQ ID NO: 8287721 - DNA, 22 bp, Homo sapiens
tggcagcaccagcagtgtcctt

SEQ ID NO: 8287722 - DNA, 21 bp, Homo sapiens
tggcagcacccacaccctctg

SEQ ID NO: 8287723 - DNA, 22 bp, Homo sapiens
cctctgaggtgagcccagctgg

SEQ ID NO: 8287724 - DNA, 22 bp, Homo sapiens
cctctctgtagcagcccccagt

SEQ ID NO: 8287725 - DNA, 22 bp, Homo sapiens
cctctctgtaagggtccctccc

SEQ ID NO: 8287726 - DNA, 20 bp, Homo sapiens
cctctctgcatgctccctga

SEQ ID NO: 8287727 - DNA, 22 bp, Homo sapiens
tggctgcctttcacctcatctc

SEQ ID NO: 8287728 - DNA, 22 bp, Homo sapiens
tggctgctactgagggggtctg

SEQ ID NO: 8287729 - DNA, 22 bp, Homo sapiens
cctctctcttgtagtccctgcc

SEQ ID NO: 8287730 - DNA, 23 bp, Homo sapiens
cctctccagacactgggccttgt

SEQ ID NO: 8287731 - DNA, 22 bp, Homo sapiens
tggctgccgactggctcttggc

SEQ ID NO: 8287732 - DNA, 21 bp, Homo sapiens
tggctgcctacatgctgcagg

SEQ ID NO: 8287733 - DNA, 22 bp, Homo sapiens
tggctgcctagtccctcagcct

SEQ ID NO: 8287734 - DNA, 22 bp, Homo sapiens
tggctgcctagtccctcagcct

SEQ ID NO: 8287735 - DNA, 21 bp, Homo sapiens
tggctgcctggctctgtggtt

SEQ ID NO: 8287736 - DNA, 22 bp, Homo sapiens
tggctgcctgaatgcaagacag

SEQ ID NO: 8287737 - DNA, 22 bp, Homo sapiens
tggctcagtttgggggattgaa

SEQ ID NO: 8287738 - DNA, 22 bp, Homo sapiens
tggctcagtttctgcccagctg

SEQ ID NO: 8287739 - DNA, 22 bp, Homo sapiens
tggctcagctgactcggcttct

SEQ ID NO: 8287740 - DNA, 22 bp, Homo sapiens
tggccccatcaagggatgagtt

SEQ ID NO: 8287741 - DNA, 22 bp, Homo sapiens
tggccccattttacagatgaaa

SEQ ID NO: 8287742 - DNA, 22 bp, Homo sapiens
tggccctgctggacacgcctgc

SEQ ID NO: 8287743 - DNA, 22 bp, Homo sapiens
tggccctgctatgatcctgcaa

SEQ ID NO: 8287744 - DNA, 22 bp, Homo sapiens
cctccactctggcctctcaggt

SEQ ID NO: 8287745 - DNA, 22 bp, Homo sapiens
cctccactgcttcccagctttg

SEQ ID NO: 8287746 - DNA, 22 bp, Homo sapiens
cctccactctggcctctcaggt

SEQ ID NO: 8287747 - DNA, 22 bp, Homo sapiens
cctccagcattactggcccatg

SEQ ID NO: 8287748 - DNA, 22 bp, Homo sapiens
cctccagcattactggcccatg

SEQ ID NO: 8287749 - DNA, 22 bp, Homo sapiens
cctccagactttggccatcctc

SEQ ID NO: 8287750 - DNA, 20 bp, Homo sapiens
cctccactgtcactgacctg

SEQ ID NO: 8287751 - DNA, 22 bp, Homo sapiens
cctccagcgcgatccactccgg

SEQ ID NO: 8287752 - DNA, 22 bp, Homo sapiens
cctcctccttatggtggcccag

SEQ ID NO: 8287753 - DNA, 22 bp, Homo sapiens
tgtgggggtacacgtacacatg

SEQ ID NO: 8287754 - DNA, 22 bp, Homo sapiens
tgtgtgggtacagatgattgtt

SEQ ID NO: 8287755 - DNA, 22 bp, Homo sapiens
cctgggcctcacccagctcttg

SEQ ID NO: 8287756 - DNA, 18 bp, Homo sapiens
tgtggctggtccacactg

SEQ ID NO: 8287757 - DNA, 22 bp, Homo sapiens
tgtggctgggaagaaggtaact

SEQ ID NO: 8287758 - DNA, 22 bp, Homo sapiens
tgtggctgggctaataggcaaa

SEQ ID NO: 8287759 - DNA, 15 bp, Homo sapiens
tgtggctggctcctg

SEQ ID NO: 8287760 - DNA, 22 bp, Homo sapiens
tgtggctggattgattttacct

SEQ ID NO: 8287761 - DNA, 22 bp, Homo sapiens
tgtggctgctcctgggtggtca

SEQ ID NO: 8287762 - DNA, 22 bp, Homo sapiens
tgtggctgtgccgtcacacgtg

SEQ ID NO: 8287763 - DNA, 22 bp, Homo sapiens
tgtggctgtctgttctcctagg

SEQ ID NO: 8287764 - DNA, 22 bp, Homo sapiens
tgtggctggtctccgagcgtcg

SEQ ID NO: 8287765 - DNA, 22 bp, Homo sapiens
tgtggctgtgtccacctgctgc

SEQ ID NO: 8287766 - DNA, 22 bp, Homo sapiens
tgtggctgtggttttcataaat

SEQ ID NO: 8287767 - DNA, 22 bp, Homo sapiens
tgtggctgtggatgctttccag

SEQ ID NO: 8287768 - DNA, 22 bp, Homo sapiens
tgtggctgttgaggaccccaag

SEQ ID NO: 8287769 - DNA, 22 bp, Homo sapiens
tgtggcaggcattctgaggctg

SEQ ID NO: 8287770 - DNA, 21 bp, Homo sapiens
tgtggctgcctctggccctgg

SEQ ID NO: 8287771 - DNA, 21 bp, Homo sapiens
tgtggctgcctctggccctgg

SEQ ID NO: 8287772 - DNA, 22 bp, Homo sapiens
tgtggctgctcaggtgcagacc

SEQ ID NO: 8287773 - DNA, 22 bp, Homo sapiens
tgtggcagggatactgaggcag

SEQ ID NO: 8287774 - DNA, 22 bp, Homo sapiens
tgtggcaggaagagcttctgag

SEQ ID NO: 8287775 - DNA, 22 bp, Homo sapiens
tgtgtgggtggtaaggaaggcc

SEQ ID NO: 8287776 - DNA, 22 bp, Homo sapiens
cctgggctttgctggcaaggcc

SEQ ID NO: 8287777 - DNA, 22 bp, Homo sapiens
cctgggccttgacctcgtgggc

SEQ ID NO: 8287778 - DNA, 22 bp, Homo sapiens
cctgggtgcccggcccttctct

SEQ ID NO: 8287779 - DNA, 22 bp, Homo sapiens
cctgggtgaaatagtcctcaag

SEQ ID NO: 8287780 - DNA, 22 bp, Homo sapiens
cctgggtctgtattggtaggta

SEQ ID NO: 8287781 - DNA, 22 bp, Homo sapiens
tgtgaagctggatcctggagct

SEQ ID NO: 8287782 - DNA, 22 bp, Homo sapiens
tgtgagctgaagtgacaggctg

SEQ ID NO: 8287783 - DNA, 22 bp, Homo sapiens
tgtgaggcctctgcaggagcag

SEQ ID NO: 8287784 - DNA, 22 bp, Homo sapiens
tgtgaggataaaaaggaaggag

SEQ ID NO: 8287785 - DNA, 22 bp, Homo sapiens
tgtgaggatgttaaggggatga

SEQ ID NO: 8287786 - DNA, 22 bp, Homo sapiens
tgtgaggcgaggccagtgagct

SEQ ID NO: 8287787 - DNA, 22 bp, Homo sapiens
tgtgaggctacctgccagggtc

SEQ ID NO: 8287788 - DNA, 22 bp, Homo sapiens
tgtgagtaataaagtcattttt

SEQ ID NO: 8287789 - DNA, 22 bp, Homo sapiens
tgtctttacttaataaatatac

SEQ ID NO: 8287790 - DNA, 22 bp, Homo sapiens
cctggctgaaccaatgaagtgg

SEQ ID NO: 8287791 - DNA, 22 bp, Homo sapiens
tgtgcccattacacagaggcat

SEQ ID NO: 8287792 - DNA, 22 bp, Homo sapiens
tgtgcttcaggttgtcgccacg

SEQ ID NO: 8287793 - DNA, 22 bp, Homo sapiens
tgtgcttcatcacttctcagtt

SEQ ID NO: 8287794 - DNA, 22 bp, Homo sapiens
tgtgcttctctttctcacttaa

SEQ ID NO: 8287795 - DNA, 22 bp, Homo sapiens
tgtgcttctctttctcacttaa

SEQ ID NO: 8287796 - DNA, 22 bp, Homo sapiens
tgtgcccagactgcctcagtga

SEQ ID NO: 8287797 - DNA, 22 bp, Homo sapiens
cctgggagagtctgtggtctcc

SEQ ID NO: 8287798 - DNA, 22 bp, Homo sapiens
cctgggaacagtgggttggctc

SEQ ID NO: 8287799 - DNA, 22 bp, Homo sapiens
cctgggaagaccggcagtgggg

SEQ ID NO: 8287800 - DNA, 22 bp, Homo sapiens
cctgggaagcccatagcagctt

SEQ ID NO: 8287801 - DNA, 20 bp, Homo sapiens
cctgggaaggcagccccagc

SEQ ID NO: 8287802 - DNA, 22 bp, Homo sapiens
cctggcttagaggttgcctttc

SEQ ID NO: 8287803 - DNA, 22 bp, Homo sapiens
cctggcttatttttatagcagt

SEQ ID NO: 8287804 - DNA, 22 bp, Homo sapiens
cctggcttcagcattgccctct

SEQ ID NO: 8287805 - DNA, 23 bp, Homo sapiens
cctggcttcattctcttagggtg

SEQ ID NO: 8287806 - DNA, 21 bp, Homo sapiens
cctggcttcagggtgcactgg

SEQ ID NO: 8287807 - DNA, 22 bp, Homo sapiens
cctggcttccatatggcacata

SEQ ID NO: 8287808 - DNA, 18 bp, Homo sapiens
cctggcttccatcttggt

SEQ ID NO: 8287809 - DNA, 22 bp, Homo sapiens
cctggcttcctggagctcacaa

SEQ ID NO: 8287810 - DNA, 22 bp, Homo sapiens
cctggcttttgtttataaattc

SEQ ID NO: 8287811 - DNA, 22 bp, Homo sapiens
cctggcttttgttcccggcgtc

SEQ ID NO: 8287812 - DNA, 18 bp, Homo sapiens
cctggcttttctacttgc

SEQ ID NO: 8287813 - DNA, 22 bp, Homo sapiens
cctggctttgcggatttacagg

SEQ ID NO: 8287814 - DNA, 20 bp, Homo sapiens
cctggctttgcatctgtgat

SEQ ID NO: 8287815 - DNA, 22 bp, Homo sapiens
cctgggaacagcagagtcctgg

SEQ ID NO: 8287816 - DNA, 22 bp, Homo sapiens
cctggctttagctgccttccct

SEQ ID NO: 8287817 - DNA, 22 bp, Homo sapiens
cctggcttctgggtctgtgaga

SEQ ID NO: 8287818 - DNA, 20 bp, Homo sapiens
cctggctttgcagcatgaga

SEQ ID NO: 8287819 - DNA, 22 bp, Homo sapiens
cctggctttgaccttgctgttt

SEQ ID NO: 8287820 - DNA, 22 bp, Homo sapiens
cctggctttctcatttacaggc

SEQ ID NO: 8287821 - DNA, 22 bp, Homo sapiens
cctggcttccttcatgacctgg

SEQ ID NO: 8287822 - DNA, 22 bp, Homo sapiens
cctggcttctataccaccaggt

SEQ ID NO: 8287823 - DNA, 22 bp, Homo sapiens
cctggcttctctgcattgttct

SEQ ID NO: 8287824 - DNA, 22 bp, Homo sapiens
cctggcttctcaccttgttctg

SEQ ID NO: 8287825 - DNA, 22 bp, Homo sapiens
tgtcaggagcaatgataaattt

SEQ ID NO: 8287826 - DNA, 22 bp, Homo sapiens
tgtcatgtaaagagtaaatggt

SEQ ID NO: 8287827 - DNA, 22 bp, Homo sapiens
tgtcatgtggcaattaaagcag

SEQ ID NO: 8287828 - DNA, 22 bp, Homo sapiens
tgtattagagcatataatttga

SEQ ID NO: 8287829 - DNA, 22 bp, Homo sapiens
tgtattagatctgagaacttct

SEQ ID NO: 8287830 - DNA, 22 bp, Homo sapiens
tgtatgtatacactgatcatca

SEQ ID NO: 8287831 - DNA, 22 bp, Homo sapiens
tgtaccaggaggaggacaaatt

SEQ ID NO: 8287832 - DNA, 22 bp, Homo sapiens
tgtaggaatggattctagaagg

SEQ ID NO: 8287833 - DNA, 22 bp, Homo sapiens
tgtaggaatgtttttaagttgg

SEQ ID NO: 8287834 - DNA, 22 bp, Homo sapiens
tgtaccagatggaaaacgtgag

SEQ ID NO: 8287835 - DNA, 22 bp, Homo sapiens
tgtaccagatgtctaaagccat

SEQ ID NO: 8287836 - DNA, 22 bp, Homo sapiens
tgtaggacatgtacttgtaaca

SEQ ID NO: 8287837 - DNA, 22 bp, Homo sapiens
tgtaggaattccagtgacttca

SEQ ID NO: 8287838 - DNA, 22 bp, Homo sapiens
tgtaggtaagttcgtagatttg

SEQ ID NO: 8287839 - DNA, 22 bp, Homo sapiens
tgtaggtagatcccatgtaaga

SEQ ID NO: 8287840 - DNA, 22 bp, Homo sapiens
cctggagcaaaaatctaaggag

SEQ ID NO: 8287841 - DNA, 22 bp, Homo sapiens
cctggagcacatggcaggaggc

SEQ ID NO: 8287842 - DNA, 22 bp, Homo sapiens
tgtagtcacaaaaactgtaagc

SEQ ID NO: 8287843 - DNA, 22 bp, Homo sapiens
cctggagaggagaaagggccca

SEQ ID NO: 8287844 - DNA, 22 bp, Homo sapiens
cctggacttgatattctctttc

SEQ ID NO: 8287845 - DNA, 23 bp, Homo sapiens
tggtggcttgtggtggccaccag

SEQ ID NO: 8287846 - DNA, 22 bp, Homo sapiens
tggtggctgctccctgccttga

SEQ ID NO: 8287847 - DNA, 17 bp, Homo sapiens
tggtccaggtggagcca

SEQ ID NO: 8287848 - DNA, 22 bp, Homo sapiens
tggtccagtagcagggatacca

SEQ ID NO: 8287849 - DNA, 22 bp, Homo sapiens
tggtccctaaagatgtctacat

SEQ ID NO: 8287850 - DNA, 22 bp, Homo sapiens
cctgcccactccaggagcaact

SEQ ID NO: 8287851 - DNA, 22 bp, Homo sapiens
tggtccctttctactgagcaca

SEQ ID NO: 8287852 - DNA, 22 bp, Homo sapiens
cctggcagttttgcccaggatt

SEQ ID NO: 8287853 - DNA, 22 bp, Homo sapiens
cctggcagttttgcccaggatt

SEQ ID NO: 8287854 - DNA, 22 bp, Homo sapiens
cctggccaggctctcagcactg

SEQ ID NO: 8287855 - DNA, 22 bp, Homo sapiens
cctggccagggtctgggctgct

SEQ ID NO: 8287856 - DNA, 22 bp, Homo sapiens
cctggccaggcatggagtcaca

SEQ ID NO: 8287857 - DNA, 22 bp, Homo sapiens
tgtcctcgtccgcctcgaactc

SEQ ID NO: 8287858 - DNA, 22 bp, Homo sapiens
tgtcccagacataagtggacat

SEQ ID NO: 8287859 - DNA, 23 bp, Homo sapiens
tgtcccagagggagggataggct

SEQ ID NO: 8287860 - DNA, 22 bp, Homo sapiens
tgtcccagatactggacataga

SEQ ID NO: 8287861 - DNA, 22 bp, Homo sapiens
tgtcccagatcacaggagggga

SEQ ID NO: 8287862 - DNA, 22 bp, Homo sapiens
cctggcagactgtgagggcagg

SEQ ID NO: 8287863 - DNA, 22 bp, Homo sapiens
tgtcatgtgttcttaaatacat

SEQ ID NO: 8287864 - DNA, 22 bp, Homo sapiens
tgtcatgtgcggggaggtgaag

SEQ ID NO: 8287865 - DNA, 21 bp, Homo sapiens
tgtcatgtttttccaggcatc

SEQ ID NO: 8287866 - DNA, 22 bp, Homo sapiens
cctggcagcaggtgggcccgtg

SEQ ID NO: 8287867 - DNA, 22 bp, Homo sapiens
cctggcaggtggcgccctcggc

SEQ ID NO: 8287868 - DNA, 22 bp, Homo sapiens
cctggcaggcccctcctggatt

SEQ ID NO: 8287869 - DNA, 22 bp, Homo sapiens
cctggctcgctgacctcagggg

SEQ ID NO: 8287870 - DNA, 22 bp, Homo sapiens
cctggctcccggaacagggtct

SEQ ID NO: 8287871 - DNA, 22 bp, Homo sapiens
cctggcctcctggccttctcat

SEQ ID NO: 8287872 - DNA, 22 bp, Homo sapiens
cctggcctggcactccctctgc

SEQ ID NO: 8287873 - DNA, 22 bp, Homo sapiens
tgtctcagaggcaggaagagcc

SEQ ID NO: 8287874 - DNA, 22 bp, Homo sapiens
tgtctcaaggttactctatgat

SEQ ID NO: 8287875 - DNA, 22 bp, Homo sapiens
tgtcctgccatttccatagcct

SEQ ID NO: 8287876 - DNA, 22 bp, Homo sapiens
tgtcctctaattggcctcttgc

SEQ ID NO: 8287877 - DNA, 22 bp, Homo sapiens
tgtcctctccaacagcctctgt

SEQ ID NO: 8287878 - DNA, 22 bp, Homo sapiens
caggagatgacagggaagaacc

SEQ ID NO: 8287879 - DNA, 22 bp, Homo sapiens
caggagataaaagagatgcttt

SEQ ID NO: 8287880 - DNA, 22 bp, Homo sapiens
caggagatgtaagacttctgtt

SEQ ID NO: 8287881 - DNA, 22 bp, Homo sapiens
caggagatgacagggaagaacc

SEQ ID NO: 8287882 - DNA, 22 bp, Homo sapiens
caggagctcttaaggatgtgat

SEQ ID NO: 8287883 - DNA, 22 bp, Homo sapiens
caggagctcttaaggatgtgat

SEQ ID NO: 8287884 - DNA, 22 bp, Homo sapiens
caggagctcactgtctaatggg

SEQ ID NO: 8287885 - DNA, 22 bp, Homo sapiens
caggagctcagatgacatctca

SEQ ID NO: 8287886 - DNA, 22 bp, Homo sapiens
caggagctcacagtctttgggt

SEQ ID NO: 8287887 - DNA, 22 bp, Homo sapiens
taaatcacatcgaaatctgggt

SEQ ID NO: 8287888 - DNA, 22 bp, Homo sapiens
taaatcacaaattttctcattt

SEQ ID NO: 8287889 - DNA, 22 bp, Homo sapiens
taaatcacattttctttgtgtt

SEQ ID NO: 8287890 - DNA, 22 bp, Homo sapiens
taaatcacattcgtctgctcct

SEQ ID NO: 8287891 - DNA, 22 bp, Homo sapiens
taaatatcagtccagctcttcc

SEQ ID NO: 8287892 - DNA, 22 bp, Homo sapiens
taaatagagaatcagcttggag

SEQ ID NO: 8287893 - DNA, 22 bp, Homo sapiens
taaagtgagtacaaaatgaggg

SEQ ID NO: 8287894 - DNA, 22 bp, Homo sapiens
taaagtgaaggtcataatgatt

SEQ ID NO: 8287895 - DNA, 22 bp, Homo sapiens
taaagtgaagttcagaatggct

SEQ ID NO: 8287896 - DNA, 22 bp, Homo sapiens
caggagctggatctccttgcgg

SEQ ID NO: 8287897 - DNA, 22 bp, Homo sapiens
taaatgtataggcactaaacct

SEQ ID NO: 8287898 - DNA, 22 bp, Homo sapiens
taaatgctttctatgaaagagg

SEQ ID NO: 8287899 - DNA, 20 bp, Homo sapiens
caggaggcaaggtcaaggtc

SEQ ID NO: 8287900 - DNA, 22 bp, Homo sapiens
caggaggcagaggatgcccagt

SEQ ID NO: 8287901 - DNA, 22 bp, Homo sapiens
caggaggcagaggatgcccagt

SEQ ID NO: 8287902 - DNA, 22 bp, Homo sapiens
taacaaaggttgccaaactaag

SEQ ID NO: 8287903 - DNA, 22 bp, Homo sapiens
taacaaagtaccatagattggg

SEQ ID NO: 8287904 - DNA, 22 bp, Homo sapiens
caggagtgttgattgctcagga

SEQ ID NO: 8287905 - DNA, 22 bp, Homo sapiens
caggagtgtttgctacagtttc

SEQ ID NO: 8287906 - DNA, 22 bp, Homo sapiens
caggagggcccgagactcttcc

SEQ ID NO: 8287907 - DNA, 22 bp, Homo sapiens
caggagggcccgagactcttcc

SEQ ID NO: 8287908 - DNA, 22 bp, Homo sapiens
caggagggtgtggaaaactggg

SEQ ID NO: 8287909 - DNA, 22 bp, Homo sapiens
caggaggctcctagggctctgt

SEQ ID NO: 8287910 - DNA, 22 bp, Homo sapiens
caggaggctcctagggctctgt

SEQ ID NO: 8287911 - DNA, 22 bp, Homo sapiens
caggaggctttgggatccaagt

SEQ ID NO: 8287912 - DNA, 22 bp, Homo sapiens
caggaggcccggccacagccca

SEQ ID NO: 8287913 - DNA, 18 bp, Homo sapiens
gtttggcataactgatgc

SEQ ID NO: 8287914 - DNA, 18 bp, Homo sapiens
gtttggcataactgatgc

SEQ ID NO: 8287915 - DNA, 22 bp, Homo sapiens
gtttggcataaatattttcacc

SEQ ID NO: 8287916 - DNA, 22 bp, Homo sapiens
gtttggcagttttagagtgcaa

SEQ ID NO: 8287917 - DNA, 22 bp, Homo sapiens
gtttggcagtgttatgtaggtt

SEQ ID NO: 8287918 - DNA, 22 bp, Homo sapiens
gtttggcatctcacttaaaccg

SEQ ID NO: 8287919 - DNA, 22 bp, Homo sapiens
gtttggtgacacatagtttgat

SEQ ID NO: 8287920 - DNA, 22 bp, Homo sapiens
gtttggcactatgatgaggcta

SEQ ID NO: 8287921 - DNA, 22 bp, Homo sapiens
gtttggttggctgtctttaaca

SEQ ID NO: 8287922 - DNA, 22 bp, Homo sapiens
caggaaggaaagggtgtggaga

SEQ ID NO: 8287923 - DNA, 22 bp, Homo sapiens
caggaagctgtgaaggagacgg

SEQ ID NO: 8287924 - DNA, 22 bp, Homo sapiens
caggaagctgccggtgagcgag

SEQ ID NO: 8287925 - DNA, 22 bp, Homo sapiens
caggaagctgtgaaggagacgg

SEQ ID NO: 8287926 - DNA, 22 bp, Homo sapiens
caggacagctcaacacctcctc

SEQ ID NO: 8287927 - DNA, 22 bp, Homo sapiens
caggacagctgggccaccacca

SEQ ID NO: 8287928 - DNA, 22 bp, Homo sapiens
caggacaggagtggggtcaaag

SEQ ID NO: 8287929 - DNA, 22 bp, Homo sapiens
caggacaggccctgtggggtct

SEQ ID NO: 8287930 - DNA, 22 bp, Homo sapiens
caggacaggtgttctagatcag

SEQ ID NO: 8287931 - DNA, 22 bp, Homo sapiens
caggacagtataggctttagga

SEQ ID NO: 8287932 - DNA, 22 bp, Homo sapiens
caggacagtataggctttagga

SEQ ID NO: 8287933 - DNA, 18 bp, Homo sapiens
taaacctttcttgtggca

SEQ ID NO: 8287934 - DNA, 22 bp, Homo sapiens
taaaccttggtagcatcttgct

SEQ ID NO: 8287935 - DNA, 22 bp, Homo sapiens
caggacagtgcaggtccatcct

SEQ ID NO: 8287936 - DNA, 22 bp, Homo sapiens
caggacagttggcatctgctgc

SEQ ID NO: 8287937 - DNA, 22 bp, Homo sapiens
caggagacaatggctgtggggc

SEQ ID NO: 8287938 - DNA, 22 bp, Homo sapiens
caggagaagtctctagggggtg

SEQ ID NO: 8287939 - DNA, 22 bp, Homo sapiens
caggagacaagttagcagctga

SEQ ID NO: 8287940 - DNA, 22 bp, Homo sapiens
caggagaaggtttggagtgcag

SEQ ID NO: 8287941 - DNA, 19 bp, Homo sapiens
caggacagtttgccaagaa

SEQ ID NO: 8287942 - DNA, 19 bp, Homo sapiens
caggacagtttgccaagaa

SEQ ID NO: 8287943 - DNA, 22 bp, Homo sapiens
caggacagttggcatctgctgc

SEQ ID NO: 8287944 - DNA, 22 bp, Homo sapiens
caggacagtttgctttgccctg

SEQ ID NO: 8287945 - DNA, 19 bp, Homo sapiens
taaaaactgaaggaagcag

SEQ ID NO: 8287946 - DNA, 22 bp, Homo sapiens
taaaaagtagtgagaatggcgc

SEQ ID NO: 8287947 - DNA, 22 bp, Homo sapiens
taaaaaacattactctgtcctg

SEQ ID NO: 8287948 - DNA, 22 bp, Homo sapiens
taattgtactccctgtgggaaa

SEQ ID NO: 8287949 - DNA, 22 bp, Homo sapiens
taattgtacgatgttaaatcag

SEQ ID NO: 8287950 - DNA, 22 bp, Homo sapiens
taattgtatggagaaggctgca

SEQ ID NO: 8287951 - DNA, 22 bp, Homo sapiens
taatttaattccatggattcta

SEQ ID NO: 8287952 - DNA, 22 bp, Homo sapiens
taattgtcctcggtccaaatga

SEQ ID NO: 8287953 - DNA, 22 bp, Homo sapiens
taattgtacgatgttaaatcag

SEQ ID NO: 8287954 - DNA, 22 bp, Homo sapiens
caggcagcatcagtctgctgta

SEQ ID NO: 8287955 - DNA, 22 bp, Homo sapiens
caggcagcaggagccctgctcg

SEQ ID NO: 8287956 - DNA, 22 bp, Homo sapiens
caggcagcctgagggatctggg

SEQ ID NO: 8287957 - DNA, 22 bp, Homo sapiens
caggcagctgctgggttcagcc

SEQ ID NO: 8287958 - DNA, 22 bp, Homo sapiens
caggcagctgcgacaagagagc

SEQ ID NO: 8287959 - DNA, 22 bp, Homo sapiens
caggcagctgcgacaagagagc

SEQ ID NO: 8287960 - DNA, 22 bp, Homo sapiens
caggcagctgactgtcagatat

SEQ ID NO: 8287961 - DNA, 22 bp, Homo sapiens
caggcaggagccagggattcca

SEQ ID NO: 8287962 - DNA, 20 bp, Homo sapiens
tacaaattttccatgtttcc

SEQ ID NO: 8287963 - DNA, 22 bp, Homo sapiens
tacaaatgggttaaaatatagt

SEQ ID NO: 8287964 - DNA, 22 bp, Homo sapiens
tacaaactaacatgtctcatcc

SEQ ID NO: 8287965 - DNA, 23 bp, Homo sapiens
tacaaggtagcattagtttcttc

SEQ ID NO: 8287966 - DNA, 22 bp, Homo sapiens
tacaagttccattttgaaagtg

SEQ ID NO: 8287967 - DNA, 21 bp, Homo sapiens
tacaagttcatgttgaaggaa

SEQ ID NO: 8287968 - DNA, 22 bp, Homo sapiens
tacaagtccgtaaagggcagat

SEQ ID NO: 8287969 - DNA, 22 bp, Homo sapiens
tacaagtctcagttttggattc

SEQ ID NO: 8287970 - DNA, 22 bp, Homo sapiens
tacaagtccgtaaagggcagat

SEQ ID NO: 8287971 - DNA, 21 bp, Homo sapiens
tacaagttgcttttgaagtcc

SEQ ID NO: 8287972 - DNA, 20 bp, Homo sapiens
tacaatacacatgcatatga

SEQ ID NO: 8287973 - DNA, 22 bp, Homo sapiens
tacaggtagcaaaacctttcct

SEQ ID NO: 8287974 - DNA, 22 bp, Homo sapiens
tacaggtagagtctctagttta

SEQ ID NO: 8287975 - DNA, 22 bp, Homo sapiens
tacaggtatgcgccaccttgtc

SEQ ID NO: 8287976 - DNA, 22 bp, Homo sapiens
tacaggtagggtctatgttaga

SEQ ID NO: 8287977 - DNA, 22 bp, Homo sapiens
tacaggtaagctgtcggcctag

SEQ ID NO: 8287978 - DNA, 22 bp, Homo sapiens
tacaggtaaatgcaaacagctc

SEQ ID NO: 8287979 - DNA, 22 bp, Homo sapiens
tacaggtagaaatgaagccaga

SEQ ID NO: 8287980 - DNA, 22 bp, Homo sapiens
tacaggtagaatgggtgtacag

SEQ ID NO: 8287981 - DNA, 20 bp, Homo sapiens
tacaggtagaactccctggc

SEQ ID NO: 8287982 - DNA, 22 bp, Homo sapiens
tacaggtaaaattatcagaaac

SEQ ID NO: 8287983 - DNA, 22 bp, Homo sapiens
caggccctggcagggctgagtc

SEQ ID NO: 8287984 - DNA, 22 bp, Homo sapiens
tacagtaaccttatttgtcatt

SEQ ID NO: 8287985 - DNA, 22 bp, Homo sapiens
tacagtaacatgttgtacaagc

SEQ ID NO: 8287986 - DNA, 22 bp, Homo sapiens
tacagtaaccagtctacttaga

SEQ ID NO: 8287987 - DNA, 22 bp, Homo sapiens
tacagtaaccagtctacttaga

SEQ ID NO: 8287988 - DNA, 22 bp, Homo sapiens
tacagtaacatgttgtacaagc

SEQ ID NO: 8287989 - DNA, 22 bp, Homo sapiens
tacagtaaagctgctatgaatt

SEQ ID NO: 8287990 - DNA, 22 bp, Homo sapiens
tacagtaaagctgctatgaatt

SEQ ID NO: 8287991 - DNA, 22 bp, Homo sapiens
tacagtaaatgtggtagaaact

SEQ ID NO: 8287992 - DNA, 22 bp, Homo sapiens
tacagtaaatgtggtagaaact

SEQ ID NO: 8287993 - DNA, 22 bp, Homo sapiens
tacagtaaagctgctatgaatt

SEQ ID NO: 8287994 - DNA, 22 bp, Homo sapiens
tacatattcaacgttcagtatt

SEQ ID NO: 8287995 - DNA, 22 bp, Homo sapiens
tacatattgtccatagttgctt

SEQ ID NO: 8287996 - DNA, 22 bp, Homo sapiens
tacatattcaacgttcagtatt

SEQ ID NO: 8287997 - DNA, 20 bp, Homo sapiens
tacatattatatcagctgca

SEQ ID NO: 8287998 - DNA, 22 bp, Homo sapiens
tacatgtggagttttctagtca

SEQ ID NO: 8287999 - DNA, 22 bp, Homo sapiens
tacatcataataatacttagaa

SEQ ID NO: 8288000 - DNA, 22 bp, Homo sapiens
tacatcatgaaagcatacatca

SEQ ID NO: 8288001 - DNA, 21 bp, Homo sapiens
tacatcagttttcttggctca

SEQ ID NO: 8288002 - DNA, 22 bp, Homo sapiens
tacatcaaggaacacctggtat

SEQ ID NO: 8288003 - DNA, 22 bp, Homo sapiens
taagaaacatttttatgacagt

SEQ ID NO: 8288004 - DNA, 22 bp, Homo sapiens
caggatgaagggcaaaggcaag

SEQ ID NO: 8288005 - DNA, 22 bp, Homo sapiens
caggatgagaggcccagggaag

SEQ ID NO: 8288006 - DNA, 22 bp, Homo sapiens
caggatgaccatatgttccagt

SEQ ID NO: 8288007 - DNA, 22 bp, Homo sapiens
taagaaacatgattaatggcag

SEQ ID NO: 8288008 - DNA, 22 bp, Homo sapiens
taagaaacatgatacttttcct

SEQ ID NO: 8288009 - DNA, 22 bp, Homo sapiens
taagaaacatgatacttttcct

SEQ ID NO: 8288010 - DNA, 22 bp, Homo sapiens
taacatttcggtgacagtggga

SEQ ID NO: 8288011 - DNA, 22 bp, Homo sapiens
taacatttgctgtctcctatgt

SEQ ID NO: 8288012 - DNA, 22 bp, Homo sapiens
taacatttagaaagtgtccatt

SEQ ID NO: 8288013 - DNA, 16 bp, Homo sapiens
taacatttttaaaagg

SEQ ID NO: 8288014 - DNA, 22 bp, Homo sapiens
taacatttaaatttttcacata

SEQ ID NO: 8288015 - DNA, 22 bp, Homo sapiens
taacagaagatgaaacttcttt

SEQ ID NO: 8288016 - DNA, 22 bp, Homo sapiens
taacagaaaggggacagaaata

SEQ ID NO: 8288017 - DNA, 22 bp, Homo sapiens
taacaatacccattctaattac

SEQ ID NO: 8288018 - DNA, 22 bp, Homo sapiens
taacaagtcattttatcagcag

SEQ ID NO: 8288019 - DNA, 22 bp, Homo sapiens
taagacacattggagtagatga

SEQ ID NO: 8288020 - DNA, 22 bp, Homo sapiens
taagacacatgcgtacaagata

SEQ ID NO: 8288021 - DNA, 23 bp, Homo sapiens
taagacacccgactccagagatg

SEQ ID NO: 8288022 - DNA, 22 bp, Homo sapiens
taagcaaaagtcgagtgtgagc

SEQ ID NO: 8288023 - DNA, 22 bp, Homo sapiens
taaggcagaaatatgagcaggg

SEQ ID NO: 8288024 - DNA, 22 bp, Homo sapiens
caggcacagagagaataccttt

SEQ ID NO: 8288025 - DNA, 22 bp, Homo sapiens
caggcaagatccagaggctgct

SEQ ID NO: 8288026 - DNA, 22 bp, Homo sapiens
gtggggcagtggcctgggagca

SEQ ID NO: 8288027 - DNA, 22 bp, Homo sapiens
gtggggagggagatgctgaagt

SEQ ID NO: 8288028 - DNA, 22 bp, Homo sapiens
gtggggctaaaaactgtgcagt

SEQ ID NO: 8288029 - DNA, 22 bp, Homo sapiens
gtggggctgcttaggctgcgca

SEQ ID NO: 8288030 - DNA, 19 bp, Homo sapiens
cagctgcaccgtgaccatc

SEQ ID NO: 8288031 - DNA, 22 bp, Homo sapiens
cagctgcaggagctgagcactt

SEQ ID NO: 8288032 - DNA, 22 bp, Homo sapiens
cagctgcattaattttagtgaa

SEQ ID NO: 8288033 - DNA, 22 bp, Homo sapiens
cagctgcatgtctgtggtggtc

SEQ ID NO: 8288034 - DNA, 22 bp, Homo sapiens
cagctgcctgtattgtcctcat

SEQ ID NO: 8288035 - DNA, 22 bp, Homo sapiens
cagctgctctggtggtctctcc

SEQ ID NO: 8288036 - DNA, 22 bp, Homo sapiens
cagctgctgatggcctgacaga

SEQ ID NO: 8288037 - DNA, 22 bp, Homo sapiens
cagctgctgcccttggctgcag

SEQ ID NO: 8288038 - DNA, 22 bp, Homo sapiens
cagctgctgcccttggctgcag

SEQ ID NO: 8288039 - DNA, 22 bp, Homo sapiens
cagctgctcttctggcctgtca

SEQ ID NO: 8288040 - DNA, 22 bp, Homo sapiens
cagctggccaatcagggcgccc

SEQ ID NO: 8288041 - DNA, 22 bp, Homo sapiens
gtgggtggatcatgaggtcagg

SEQ ID NO: 8288042 - DNA, 22 bp, Homo sapiens
gtgggtggatcacctgaggtca

SEQ ID NO: 8288043 - DNA, 22 bp, Homo sapiens
gtgtcttttctgtctagcacaa

SEQ ID NO: 8288044 - DNA, 22 bp, Homo sapiens
gtgtacagtaagtgaatctagg

SEQ ID NO: 8288045 - DNA, 22 bp, Homo sapiens
gtgggtggggagctctctggag

SEQ ID NO: 8288046 - DNA, 22 bp, Homo sapiens
gtgggtggattccagcaacgct

SEQ ID NO: 8288047 - DNA, 22 bp, Homo sapiens
gtgggtggatggctcacctcca

SEQ ID NO: 8288048 - DNA, 22 bp, Homo sapiens
cagctggggagagacatggcag

SEQ ID NO: 8288049 - DNA, 22 bp, Homo sapiens
cagctgggctaagagtagaggc

SEQ ID NO: 8288050 - DNA, 22 bp, Homo sapiens
cagctgggctaagagtagaggc

SEQ ID NO: 8288051 - DNA, 22 bp, Homo sapiens
cagctgtgaattgtcttatcta

SEQ ID NO: 8288052 - DNA, 17 bp, Homo sapiens
cagctgtgagagcctta

SEQ ID NO: 8288053 - DNA, 22 bp, Homo sapiens
gtggcaggttataagcatctca

SEQ ID NO: 8288054 - DNA, 22 bp, Homo sapiens
gtggcaggtggagcctcctgca

SEQ ID NO: 8288055 - DNA, 22 bp, Homo sapiens
cagctctgtgggagcgtatgtg

SEQ ID NO: 8288056 - DNA, 22 bp, Homo sapiens
cagctctgtgcaggcctgggga

SEQ ID NO: 8288057 - DNA, 22 bp, Homo sapiens
cagctctggctttggggagctt

SEQ ID NO: 8288058 - DNA, 20 bp, Homo sapiens
cagctctgggaaagaggcca

SEQ ID NO: 8288059 - DNA, 22 bp, Homo sapiens
cagctctggctattgaggacca

SEQ ID NO: 8288060 - DNA, 22 bp, Homo sapiens
cagctctggcgtcagggagcga

SEQ ID NO: 8288061 - DNA, 22 bp, Homo sapiens
cagctctgctggtggtgccagg

SEQ ID NO: 8288062 - DNA, 22 bp, Homo sapiens
cagctctgctggtggtgccagg

SEQ ID NO: 8288063 - DNA, 22 bp, Homo sapiens
cagctctgctgggaggatgcag

SEQ ID NO: 8288064 - DNA, 22 bp, Homo sapiens
gtggccagtcccgatgcttgtt

SEQ ID NO: 8288065 - DNA, 22 bp, Homo sapiens
gtggccaggtcagggacttgtg

SEQ ID NO: 8288066 - DNA, 22 bp, Homo sapiens
gtggccagtgggaatgggctca

SEQ ID NO: 8288067 - DNA, 22 bp, Homo sapiens
gtggccagtgggaatgggctca

SEQ ID NO: 8288068 - DNA, 22 bp, Homo sapiens
gtggccatctttggccctgact

SEQ ID NO: 8288069 - DNA, 22 bp, Homo sapiens
gtgggaagtctctcggaggaag

SEQ ID NO: 8288070 - DNA, 22 bp, Homo sapiens
gtggcttgaccatccctgctac

SEQ ID NO: 8288071 - DNA, 22 bp, Homo sapiens
gtggcttggaccagtcacagtg

SEQ ID NO: 8288072 - DNA, 22 bp, Homo sapiens
gtgggacagtcagaagtgagca

SEQ ID NO: 8288073 - DNA, 22 bp, Homo sapiens
gtgggacagtcagaagtgagca

SEQ ID NO: 8288074 - DNA, 22 bp, Homo sapiens
gtgggcaggccctaggcgattt

SEQ ID NO: 8288075 - DNA, 22 bp, Homo sapiens
gtgggcaggtaggcaccagcta

SEQ ID NO: 8288076 - DNA, 22 bp, Homo sapiens
gtggggaggcctaagcaagttg

SEQ ID NO: 8288077 - DNA, 22 bp, Homo sapiens
cagctcttattttctctcctaa

SEQ ID NO: 8288078 - DNA, 22 bp, Homo sapiens
cagctcttaacacagcttgtat

SEQ ID NO: 8288079 - DNA, 22 bp, Homo sapiens
cagctctgttgccctggaaacg

SEQ ID NO: 8288080 - DNA, 22 bp, Homo sapiens
gtggcctgtcagaagccgtggg

SEQ ID NO: 8288081 - DNA, 22 bp, Homo sapiens
cagctgagttactctgaggtct

SEQ ID NO: 8288082 - DNA, 22 bp, Homo sapiens
cagctgagttactctgaggtct

SEQ ID NO: 8288083 - DNA, 22 bp, Homo sapiens
cagctgaggaatactagatgta

SEQ ID NO: 8288084 - DNA, 22 bp, Homo sapiens
cagctgaggaatactagatgta

SEQ ID NO: 8288085 - DNA, 22 bp, Homo sapiens
cagctgagcatcactagtctgg

SEQ ID NO: 8288086 - DNA, 22 bp, Homo sapiens
caggaaagggatgggctgccac

SEQ ID NO: 8288087 - DNA, 22 bp, Homo sapiens
gttggctatagggagatggggc

SEQ ID NO: 8288088 - DNA, 22 bp, Homo sapiens
gttggaaatggtttctatccct

SEQ ID NO: 8288089 - DNA, 22 bp, Homo sapiens
gttggaaatgcagagtctcaga

SEQ ID NO: 8288090 - DNA, 19 bp, Homo sapiens
gttggcactgaaaatggct

SEQ ID NO: 8288091 - DNA, 22 bp, Homo sapiens
gttcctgagaaataaagagaga

SEQ ID NO: 8288092 - DNA, 22 bp, Homo sapiens
gttcctgagaaataaagagaga

SEQ ID NO: 8288093 - DNA, 22 bp, Homo sapiens
gttccgtactgcaaagaatata

SEQ ID NO: 8288094 - DNA, 22 bp, Homo sapiens
gttcacagtctacatagtaaag

SEQ ID NO: 8288095 - DNA, 22 bp, Homo sapiens
gttcttaaccttctttggttgt

SEQ ID NO: 8288096 - DNA, 20 bp, Homo sapiens
gttggaaagttcactctgct

SEQ ID NO: 8288097 - DNA, 22 bp, Homo sapiens
gttgcttttctccatcacatgg

SEQ ID NO: 8288098 - DNA, 21 bp, Homo sapiens
gttgctcttcaagaaaatccc

SEQ ID NO: 8288099 - DNA, 22 bp, Homo sapiens
caggaacatttaaccacagggt

SEQ ID NO: 8288100 - DNA, 22 bp, Homo sapiens
caggaagaggacaggcttcccc

SEQ ID NO: 8288101 - DNA, 22 bp, Homo sapiens
caggaacagcaccaggagctag

SEQ ID NO: 8288102 - DNA, 22 bp, Homo sapiens
caggaacaggggagtgaacctg

SEQ ID NO: 8288103 - DNA, 22 bp, Homo sapiens
caggaacagggtgtcctggcag

SEQ ID NO: 8288104 - DNA, 22 bp, Homo sapiens
caggaacaggctgatgggcagg

SEQ ID NO: 8288105 - DNA, 22 bp, Homo sapiens
caggaacagagtggcattgtct

SEQ ID NO: 8288106 - DNA, 22 bp, Homo sapiens
caggaacacaatgagtctcaaa

SEQ ID NO: 8288107 - DNA, 22 bp, Homo sapiens
caggaacacaagttcagggatg

SEQ ID NO: 8288108 - DNA, 22 bp, Homo sapiens
caggaacaatgtaagtctcatt

SEQ ID NO: 8288109 - DNA, 21 bp, Homo sapiens
gtttacaaggctttgctcctg

SEQ ID NO: 8288110 - DNA, 23 bp, Homo sapiens
caggaagcagatggggtagaaga

SEQ ID NO: 8288111 - DNA, 22 bp, Homo sapiens
gtttacaacatcttgtccttca

SEQ ID NO: 8288112 - DNA, 22 bp, Homo sapiens
caggaagcacagtgaggagacc

SEQ ID NO: 8288113 - DNA, 22 bp, Homo sapiens
gtgttttggccattagtgtgat

SEQ ID NO: 8288114 - DNA, 20 bp, Homo sapiens
gttaaaagagtaatttgagg

SEQ ID NO: 8288115 - DNA, 22 bp, Homo sapiens
gttacacaggaaaacattagca

SEQ ID NO: 8288116 - DNA, 22 bp, Homo sapiens
gttacaatgtccttacatgaaa

SEQ ID NO: 8288117 - DNA, 22 bp, Homo sapiens
cagctgtggctgccactgctcc

SEQ ID NO: 8288118 - DNA, 22 bp, Homo sapiens
cagctgtgggcctgacgtggca

SEQ ID NO: 8288119 - DNA, 22 bp, Homo sapiens
cagctgtgtaaacacatgtgta

SEQ ID NO: 8288120 - DNA, 22 bp, Homo sapiens
cagctgtgtagatgcagggtca

SEQ ID NO: 8288121 - DNA, 22 bp, Homo sapiens
cagctgtggagatggggtgcat

SEQ ID NO: 8288122 - DNA, 22 bp, Homo sapiens
cagctgtgctgattgctcagta

SEQ ID NO: 8288123 - DNA, 18 bp, Homo sapiens
cagctgtgccctgtttgg

SEQ ID NO: 8288124 - DNA, 22 bp, Homo sapiens
cagctgtgagcagccagttgcc

SEQ ID NO: 8288125 - DNA, 20 bp, Homo sapiens
cagcttcaatgtcagcttga

SEQ ID NO: 8288126 - DNA, 22 bp, Homo sapiens
cagcttcagggacagcttcttt

SEQ ID NO: 8288127 - DNA, 22 bp, Homo sapiens
cagcttcagcgtgacaccagtg

SEQ ID NO: 8288128 - DNA, 22 bp, Homo sapiens
cagctgttgtgtatcaggcaga

SEQ ID NO: 8288129 - DNA, 22 bp, Homo sapiens
cagctgttgtgctgggcagtta

SEQ ID NO: 8288130 - DNA, 22 bp, Homo sapiens
cagctgtttgggcatggccaga

SEQ ID NO: 8288131 - DNA, 22 bp, Homo sapiens
cagcttcccttggctgagcaga

SEQ ID NO: 8288132 - DNA, 22 bp, Homo sapiens
cagcttcatgacaaacagtttt

SEQ ID NO: 8288133 - DNA, 22 bp, Homo sapiens
cagcttgcagtacttgtttttg

SEQ ID NO: 8288134 - DNA, 22 bp, Homo sapiens
cagcttggaggaggatctaaga

SEQ ID NO: 8288135 - DNA, 20 bp, Homo sapiens
cagcttggatgagaggctga

SEQ ID NO: 8288136 - DNA, 22 bp, Homo sapiens
cagcttggattttggcacgtgt

SEQ ID NO: 8288137 - DNA, 22 bp, Homo sapiens
cagcttggcgaatgtaggtatg

SEQ ID NO: 8288138 - DNA, 22 bp, Homo sapiens
cagcttggcttcacattctgta

SEQ ID NO: 8288139 - DNA, 22 bp, Homo sapiens
cagcttctccattcttctggct

SEQ ID NO: 8288140 - DNA, 22 bp, Homo sapiens
cagcttctccagatgaccctca

SEQ ID NO: 8288141 - DNA, 22 bp, Homo sapiens
cagcttctatttatctttgtgt

SEQ ID NO: 8288142 - DNA, 22 bp, Homo sapiens
cagcttctgagcaagccagggg

SEQ ID NO: 8288143 - DNA, 20 bp, Homo sapiens
cagctttagatctttgatta

SEQ ID NO: 8288144 - DNA, 22 bp, Homo sapiens
cagcttgtttacatgcttattc

SEQ ID NO: 8288145 - DNA, 22 bp, Homo sapiens
cagcttgtgtcattcatcttgt

SEQ ID NO: 8288146 - DNA, 22 bp, Homo sapiens
cagctttgaaacatggctctag

SEQ ID NO: 8288147 - DNA, 22 bp, Homo sapiens
cagctttgaaacatggctctag

SEQ ID NO: 8288148 - DNA, 22 bp, Homo sapiens
cagctttgacctaaagtaggaa

SEQ ID NO: 8288149 - DNA, 22 bp, Homo sapiens
cagctttgacctaaagtaggaa

SEQ ID NO: 8288150 - DNA, 22 bp, Homo sapiens
cagctttgagagttgcatttta

SEQ ID NO: 8288151 - DNA, 22 bp, Homo sapiens
cagctttgagcagccagtggca

SEQ ID NO: 8288152 - DNA, 22 bp, Homo sapiens
cagctttgagagttgcatttta

SEQ ID NO: 8288153 - DNA, 22 bp, Homo sapiens
cagctttgattctttctgccat

SEQ ID NO: 8288154 - DNA, 22 bp, Homo sapiens
cagctttgattcactgcctagt

SEQ ID NO: 8288155 - DNA, 22 bp, Homo sapiens
cagctttgagcagccagtggca

SEQ ID NO: 8288156 - DNA, 22 bp, Homo sapiens
cagctttgattcactgcctagt

SEQ ID NO: 8288157 - DNA, 22 bp, Homo sapiens
gttcacaatttttactgattgg

SEQ ID NO: 8288158 - DNA, 22 bp, Homo sapiens
caggaaacaaagccttgctcat

SEQ ID NO: 8288159 - DNA, 22 bp, Homo sapiens
ccagagcctgctgagccccatt

SEQ ID NO: 8288160 - DNA, 21 bp, Homo sapiens
ccagagcctgctgagccccct

SEQ ID NO: 8288161 - DNA, 22 bp, Homo sapiens
ccagacaggaacacacatctcc

SEQ ID NO: 8288162 - DNA, 22 bp, Homo sapiens
ccagacagcagttaaaggacat

SEQ ID NO: 8288163 - DNA, 22 bp, Homo sapiens
ccagaatttgaactcaggcaat

SEQ ID NO: 8288164 - DNA, 22 bp, Homo sapiens
ccagaattcagaaagggcataa

SEQ ID NO: 8288165 - DNA, 22 bp, Homo sapiens
tctccagtatctttccaatgaa

SEQ ID NO: 8288166 - DNA, 22 bp, Homo sapiens
tctccagtcccttctctgttag

SEQ ID NO: 8288167 - DNA, 21 bp, Homo sapiens
tctccagtatccttctctgag

SEQ ID NO: 8288168 - DNA, 22 bp, Homo sapiens
tctccatctgtcattcttgtcc

SEQ ID NO: 8288169 - DNA, 22 bp, Homo sapiens
ccagatgggaagaagcatgact

SEQ ID NO: 8288170 - DNA, 22 bp, Homo sapiens
tctctagagcatgtgctgggca

SEQ ID NO: 8288171 - DNA, 20 bp, Homo sapiens
ccagaaggtaggatggaaca

SEQ ID NO: 8288172 - DNA, 19 bp, Homo sapiens
ccagaagggcagctatgga

SEQ ID NO: 8288173 - DNA, 22 bp, Homo sapiens
ccagaagcttctacacaggaga

SEQ ID NO: 8288174 - DNA, 21 bp, Homo sapiens
ccagaagctgcttgcaggcta

SEQ ID NO: 8288175 - DNA, 22 bp, Homo sapiens
ccagaagcagagcctgaggcag

SEQ ID NO: 8288176 - DNA, 20 bp, Homo sapiens
ccagaagcactcttcatgtt

SEQ ID NO: 8288177 - DNA, 22 bp, Homo sapiens
ccactgaggcctgggcccaggg

SEQ ID NO: 8288178 - DNA, 22 bp, Homo sapiens
ccactgcactccagccttggca

SEQ ID NO: 8288179 - DNA, 22 bp, Homo sapiens
ccactgcacttcagcctgggtg

SEQ ID NO: 8288180 - DNA, 22 bp, Homo sapiens
ccactgaaggtcaacatagagc

SEQ ID NO: 8288181 - DNA, 23 bp, Homo sapiens
tcctggtgacatgcctgagcatc

SEQ ID NO: 8288182 - DNA, 22 bp, Homo sapiens
tcctggtgaatgactttttatt

SEQ ID NO: 8288183 - DNA, 19 bp, Homo sapiens
tcctggtgcttgacactga

SEQ ID NO: 8288184 - DNA, 22 bp, Homo sapiens
tcctggtgctgacacccatagc

SEQ ID NO: 8288185 - DNA, 22 bp, Homo sapiens
tcctggtgcctggagctctcca

SEQ ID NO: 8288186 - DNA, 22 bp, Homo sapiens
tcctggtgatcaaaattcattt

SEQ ID NO: 8288187 - DNA, 19 bp, Homo sapiens
tcctggtgaccctgaaatt

SEQ ID NO: 8288188 - DNA, 22 bp, Homo sapiens
tcctggtgaggactccaagata

SEQ ID NO: 8288189 - DNA, 22 bp, Homo sapiens
tcctggtgaggctagaagtgtc

SEQ ID NO: 8288190 - DNA, 22 bp, Homo sapiens
tcctggtggatagaagccaagg

SEQ ID NO: 8288191 - DNA, 22 bp, Homo sapiens
tcctggtggatagaagccaagg

SEQ ID NO: 8288192 - DNA, 20 bp, Homo sapiens
tcctggtggatactgcttaa

SEQ ID NO: 8288193 - DNA, 22 bp, Homo sapiens
tcctggtgcttgtatttgaagt

SEQ ID NO: 8288194 - DNA, 18 bp, Homo sapiens
tcctggtggagaagtggt

SEQ ID NO: 8288195 - DNA, 22 bp, Homo sapiens
tccctgctgggagatgacctta

SEQ ID NO: 8288196 - DNA, 22 bp, Homo sapiens
tccctgctaattggaatgtata

SEQ ID NO: 8288197 - DNA, 22 bp, Homo sapiens
ccaaagtattaaatcttagcaa

SEQ ID NO: 8288198 - DNA, 19 bp, Homo sapiens
ccaaaagcaattccaagta

SEQ ID NO: 8288199 - DNA, 22 bp, Homo sapiens
ccaaagtctggagcagcagagc

SEQ ID NO: 8288200 - DNA, 17 bp, Homo sapiens
catttgctggttggctc

SEQ ID NO: 8288201 - DNA, 22 bp, Homo sapiens
tccctgcctgacagcacccacc

SEQ ID NO: 8288202 - DNA, 22 bp, Homo sapiens
catttgatcctcacaacaatct

SEQ ID NO: 8288203 - DNA, 17 bp, Homo sapiens
tccaggcagcaactgag

SEQ ID NO: 8288204 - DNA, 22 bp, Homo sapiens
tccaggcacagagttggtcagt

SEQ ID NO: 8288205 - DNA, 22 bp, Homo sapiens
tccaggcactatatatactttt

SEQ ID NO: 8288206 - DNA, 20 bp, Homo sapiens
tccaggcagacagctatggg

SEQ ID NO: 8288207 - DNA, 20 bp, Homo sapiens
catttagaaattggcatgga

SEQ ID NO: 8288208 - DNA, 22 bp, Homo sapiens
catttatataaaatgtccagaa

SEQ ID NO: 8288209 - DNA, 22 bp, Homo sapiens
catttatataaaatgtccagaa

SEQ ID NO: 8288210 - DNA, 22 bp, Homo sapiens
catttagtctgatatggatgaa

SEQ ID NO: 8288211 - DNA, 22 bp, Homo sapiens
tcccagggggatgaacactgcc

SEQ ID NO: 8288212 - DNA, 22 bp, Homo sapiens
catttattagttagttcgatgt

SEQ ID NO: 8288213 - DNA, 22 bp, Homo sapiens
ccacaagtttcagcacccagag

SEQ ID NO: 8288214 - DNA, 22 bp, Homo sapiens
ccacacagggggatgagttatt

SEQ ID NO: 8288215 - DNA, 22 bp, Homo sapiens
tcctgcagtgtgtctcctgcac

SEQ ID NO: 8288216 - DNA, 22 bp, Homo sapiens
ccaagggcatcttgcatgctgg

SEQ ID NO: 8288217 - DNA, 23 bp, Homo sapiens
ccacaaaccatttgtgaaggagc

SEQ ID NO: 8288218 - DNA, 22 bp, Homo sapiens
ccaaataatatttcagaaccat

SEQ ID NO: 8288219 - DNA, 23 bp, Homo sapiens
tcctcccaaatttcagcctcatt

SEQ ID NO: 8288220 - DNA, 22 bp, Homo sapiens
tcctccccaaagcccagcctgg

SEQ ID NO: 8288221 - DNA, 22 bp, Homo sapiens
ccacagctgaaagcagaggctc

SEQ ID NO: 8288222 - DNA, 22 bp, Homo sapiens
ccacagctgacaatggatagac

SEQ ID NO: 8288223 - DNA, 23 bp, Homo sapiens
ccacagctatagggtagtgcagt

SEQ ID NO: 8288224 - DNA, 22 bp, Homo sapiens
ccacagctctagctccctccca

SEQ ID NO: 8288225 - DNA, 22 bp, Homo sapiens
ccacagcaccgctgccagtccc

SEQ ID NO: 8288226 - DNA, 22 bp, Homo sapiens
ccacagcatgcaggcctgacac

SEQ ID NO: 8288227 - DNA, 22 bp, Homo sapiens
ccacagaatcgctagtggagca

SEQ ID NO: 8288228 - DNA, 22 bp, Homo sapiens
tcctgcccacagctgctggaca

SEQ ID NO: 8288229 - DNA, 20 bp, Homo sapiens
tcctgcagttcctaggaggg

SEQ ID NO: 8288230 - DNA, 22 bp, Homo sapiens
tctcttaataagtaaatactga

SEQ ID NO: 8288231 - DNA, 22 bp, Homo sapiens
ccagccagtcccgcatgaccgc

SEQ ID NO: 8288232 - DNA, 22 bp, Homo sapiens
ccagccagtcccgcatgaccgc

SEQ ID NO: 8288233 - DNA, 22 bp, Homo sapiens
ccagccagtccagcattggtgt

SEQ ID NO: 8288234 - DNA, 22 bp, Homo sapiens
ccagccagtccagcattggtgt

SEQ ID NO: 8288235 - DNA, 21 bp, Homo sapiens
ccagcccagcctccttctctt

SEQ ID NO: 8288236 - DNA, 21 bp, Homo sapiens
ccagcccagcctccttctctt

SEQ ID NO: 8288237 - DNA, 22 bp, Homo sapiens
ccagcccaaacaagccgccttc

SEQ ID NO: 8288238 - DNA, 22 bp, Homo sapiens
ccagcccctatcctcgctccac

SEQ ID NO: 8288239 - DNA, 22 bp, Homo sapiens
tctgaggcccagttcaactctt

SEQ ID NO: 8288240 - DNA, 22 bp, Homo sapiens
tctgaggcataacctgttctgc

SEQ ID NO: 8288241 - DNA, 22 bp, Homo sapiens
tctgaggcagcttgccactcta

SEQ ID NO: 8288242 - DNA, 22 bp, Homo sapiens
tctgagtcttggggtccctatt

SEQ ID NO: 8288243 - DNA, 22 bp, Homo sapiens
tctgagattaagcagagatgga

SEQ ID NO: 8288244 - DNA, 22 bp, Homo sapiens
ccagccctacagtatcacctgt

SEQ ID NO: 8288245 - DNA, 22 bp, Homo sapiens
ccagctctcagcgggagactca

SEQ ID NO: 8288246 - DNA, 22 bp, Homo sapiens
tctgccactagtggttacctta

SEQ ID NO: 8288247 - DNA, 22 bp, Homo sapiens
tctgccagcaccatgatccttc

SEQ ID NO: 8288248 - DNA, 22 bp, Homo sapiens
tctgccagaagttctgagagta

SEQ ID NO: 8288249 - DNA, 22 bp, Homo sapiens
tctgccacttacctccatgtac

SEQ ID NO: 8288250 - DNA, 20 bp, Homo sapiens
tctgccactgcactctgccc

SEQ ID NO: 8288251 - DNA, 22 bp, Homo sapiens
tctgccacttgaggtcattggc

SEQ ID NO: 8288252 - DNA, 22 bp, Homo sapiens
tctgccacttttgcttactggg

SEQ ID NO: 8288253 - DNA, 20 bp, Homo sapiens
tctgccactttttctgtcac

SEQ ID NO: 8288254 - DNA, 22 bp, Homo sapiens
tctgccaggcattgtgctgctc

SEQ ID NO: 8288255 - DNA, 22 bp, Homo sapiens
tctgccagctctgtgggtctcg

SEQ ID NO: 8288256 - DNA, 22 bp, Homo sapiens
tctgcctcctgcttgtcccgac

SEQ ID NO: 8288257 - DNA, 22 bp, Homo sapiens
tctgcctcgctaacagcagcca

SEQ ID NO: 8288258 - DNA, 22 bp, Homo sapiens
ccagccttgcaccgagccagcc

SEQ ID NO: 8288259 - DNA, 22 bp, Homo sapiens
ccagctccagcatagccaccat

SEQ ID NO: 8288260 - DNA, 23 bp, Homo sapiens
ccagctcatccattacctctctt

SEQ ID NO: 8288261 - DNA, 22 bp, Homo sapiens
ccagctcaagcactgtgtgaag

SEQ ID NO: 8288262 - DNA, 22 bp, Homo sapiens
tctgagtgagtgtaggcctgac

SEQ ID NO: 8288263 - DNA, 22 bp, Homo sapiens
tctgagtgatgttgagtcagaa

SEQ ID NO: 8288264 - DNA, 22 bp, Homo sapiens
tctgagttttctgagaagctta

SEQ ID NO: 8288265 - DNA, 22 bp, Homo sapiens
tctgataggcagaaggcataag

SEQ ID NO: 8288266 - DNA, 22 bp, Homo sapiens
tctgcctttgctttggctgtca

SEQ ID NO: 8288267 - DNA, 22 bp, Homo sapiens
tctgccttgccgaattccaggc

SEQ ID NO: 8288268 - DNA, 19 bp, Homo sapiens
tctgcctctggtcaggctc

SEQ ID NO: 8288269 - DNA, 22 bp, Homo sapiens
tctgcctctttcaggcctggca

SEQ ID NO: 8288270 - DNA, 22 bp, Homo sapiens
tctgcctgaaattcacatgtaa

SEQ ID NO: 8288271 - DNA, 22 bp, Homo sapiens
tctggagccttggatgggaaag

SEQ ID NO: 8288272 - DNA, 21 bp, Homo sapiens
tctggagccctaagctgagaa

SEQ ID NO: 8288273 - DNA, 22 bp, Homo sapiens
tctggcttctcctagagcaatg

SEQ ID NO: 8288274 - DNA, 22 bp, Homo sapiens
tctggcttcgcagctcccagcc

SEQ ID NO: 8288275 - DNA, 22 bp, Homo sapiens
tctggcttctatgaatgtcctt

SEQ ID NO: 8288276 - DNA, 22 bp, Homo sapiens
tctggcttccctctgttctggg

SEQ ID NO: 8288277 - DNA, 23 bp, Homo sapiens
tctggcttccagtgggttcaacc

SEQ ID NO: 8288278 - DNA, 22 bp, Homo sapiens
tctggcttccctacttactatg

SEQ ID NO: 8288279 - DNA, 22 bp, Homo sapiens
tctggcttcccactctgccggg

SEQ ID NO: 8288280 - DNA, 22 bp, Homo sapiens
tctggcttcagtagggttcact

SEQ ID NO: 8288281 - DNA, 22 bp, Homo sapiens
tctggcttcacactgaagtttg

SEQ ID NO: 8288282 - DNA, 22 bp, Homo sapiens
tctggctcatctctccaggtaa

SEQ ID NO: 8288283 - DNA, 22 bp, Homo sapiens
tctggctcataggaaggccatt

SEQ ID NO: 8288284 - DNA, 22 bp, Homo sapiens
tctggcttcaagtcccagctct

SEQ ID NO: 8288285 - DNA, 22 bp, Homo sapiens
tctggcttcaactttactgaaa

SEQ ID NO: 8288286 - DNA, 22 bp, Homo sapiens
tctggcttgctggcttggtccc

SEQ ID NO: 8288287 - DNA, 22 bp, Homo sapiens
tctggcttgagcttcgaccagt

SEQ ID NO: 8288288 - DNA, 22 bp, Homo sapiens
tctggcttctgcaggattacta

SEQ ID NO: 8288289 - DNA, 22 bp, Homo sapiens
tctggcttgaacaattaggtaa

SEQ ID NO: 8288290 - DNA, 22 bp, Homo sapiens
tctggcttgagaggtaattatt

SEQ ID NO: 8288291 - DNA, 22 bp, Homo sapiens
tctggcttggctggcatctctg

SEQ ID NO: 8288292 - DNA, 22 bp, Homo sapiens
tctggcttgggtaggtagttca

SEQ ID NO: 8288293 - DNA, 22 bp, Homo sapiens
tctggcttgtctcagggtctga

SEQ ID NO: 8288294 - DNA, 22 bp, Homo sapiens
tctggcttggacacaatcttcc

SEQ ID NO: 8288295 - DNA, 22 bp, Homo sapiens
tctggcttggcgctgccctctg

SEQ ID NO: 8288296 - DNA, 23 bp, Homo sapiens
tctggctttcacgggtattctta

SEQ ID NO: 8288297 - DNA, 22 bp, Homo sapiens
tctggcttgtgtccttccttgc

SEQ ID NO: 8288298 - DNA, 22 bp, Homo sapiens
tctggctttattttcatcatct

SEQ ID NO: 8288299 - DNA, 22 bp, Homo sapiens
tctggctttattccttcactga

SEQ ID NO: 8288300 - DNA, 22 bp, Homo sapiens
ccagctgtgcctaggagcaggg

SEQ ID NO: 8288301 - DNA, 22 bp, Homo sapiens
ccagcttcatgggcatgcacca

SEQ ID NO: 8288302 - DNA, 23 bp, Homo sapiens
ccaggaagaggccatccacagtc

SEQ ID NO: 8288303 - DNA, 23 bp, Homo sapiens
ccaggaagaggccatccacagtc

SEQ ID NO: 8288304 - DNA, 22 bp, Homo sapiens
ccaggaagcctcagatgctgag

SEQ ID NO: 8288305 - DNA, 22 bp, Homo sapiens
ccaggaaatagtgctgtgatct

SEQ ID NO: 8288306 - DNA, 22 bp, Homo sapiens
ccagcttcggcaagcagacttt

SEQ ID NO: 8288307 - DNA, 22 bp, Homo sapiens
ccaggaagctctgctccacggg

SEQ ID NO: 8288308 - DNA, 22 bp, Homo sapiens
ccaggaagcggtgagggctgcc

SEQ ID NO: 8288309 - DNA, 22 bp, Homo sapiens
ccaggaagctgtgagattccaa

SEQ ID NO: 8288310 - DNA, 21 bp, Homo sapiens
ccaggaaggactgagctccct

SEQ ID NO: 8288311 - DNA, 22 bp, Homo sapiens
ccaggaaggaagcaggggtttc

SEQ ID NO: 8288312 - DNA, 22 bp, Homo sapiens
ccaggaggcagaagttgcagtg

SEQ ID NO: 8288313 - DNA, 22 bp, Homo sapiens
ccaggaggcagaagttgcagtg

SEQ ID NO: 8288314 - DNA, 22 bp, Homo sapiens
ccaggagcgcgtgaacaggctg

SEQ ID NO: 8288315 - DNA, 21 bp, Homo sapiens
ccaggaaggactgagctccct

SEQ ID NO: 8288316 - DNA, 22 bp, Homo sapiens
ccaggagcctgggccaggctgg

SEQ ID NO: 8288317 - DNA, 22 bp, Homo sapiens
ccaggaggcggaggttgcagcg

SEQ ID NO: 8288318 - DNA, 22 bp, Homo sapiens
tctgtcacttttatttactgaa

SEQ ID NO: 8288319 - DNA, 22 bp, Homo sapiens
tctgtcaggagattggcagctg

SEQ ID NO: 8288320 - DNA, 17 bp, Homo sapiens
tctgtctgtggtccact

SEQ ID NO: 8288321 - DNA, 21 bp, Homo sapiens
tctgtctggttttagagtggc

SEQ ID NO: 8288322 - DNA, 22 bp, Homo sapiens
tctgtctggtccaggaagatgt

SEQ ID NO: 8288323 - DNA, 22 bp, Homo sapiens
tctgtggcacgattgcactgca

SEQ ID NO: 8288324 - DNA, 18 bp, Homo sapiens
tctgtggcagcagtgcac

SEQ ID NO: 8288325 - DNA, 19 bp, Homo sapiens
tctgtggcacctgggaggg

SEQ ID NO: 8288326 - DNA, 22 bp, Homo sapiens
catgtcttatttatgcttctta

SEQ ID NO: 8288327 - DNA, 22 bp, Homo sapiens
catgtctttgttatgctcacca

SEQ ID NO: 8288328 - DNA, 22 bp, Homo sapiens
tccaggcaaagtgctgggctgc

SEQ ID NO: 8288329 - DNA, 22 bp, Homo sapiens
tccaggcaaaaaccaactacag

SEQ ID NO: 8288330 - DNA, 22 bp, Homo sapiens
tccagccacttgcacagttaaa

SEQ ID NO: 8288331 - DNA, 22 bp, Homo sapiens
tccagccatgactcggacagtg

SEQ ID NO: 8288332 - DNA, 22 bp, Homo sapiens
tccagcccagctcctctcagaa

SEQ ID NO: 8288333 - DNA, 22 bp, Homo sapiens
catgtacatgcctactatcaat

SEQ ID NO: 8288334 - DNA, 23 bp, Homo sapiens
catgtctgctttcatgctacaac

SEQ ID NO: 8288335 - DNA, 22 bp, Homo sapiens
catgtacatgcctactatcaat

SEQ ID NO: 8288336 - DNA, 20 bp, Homo sapiens
catgcaacagattatttccc

SEQ ID NO: 8288337 - DNA, 22 bp, Homo sapiens
catgattttgtcttgtgttaat

SEQ ID NO: 8288338 - DNA, 23 bp, Homo sapiens
catggctgatttcaagctaccac

SEQ ID NO: 8288339 - DNA, 22 bp, Homo sapiens
catggctgaacactcagtgact

SEQ ID NO: 8288340 - DNA, 22 bp, Homo sapiens
catgcacaacatactcaagagg

SEQ ID NO: 8288341 - DNA, 22 bp, Homo sapiens
catccattcattaattctaaag

SEQ ID NO: 8288342 - DNA, 22 bp, Homo sapiens
tcaggtggcttggagggggacg

SEQ ID NO: 8288343 - DNA, 22 bp, Homo sapiens
tcaggtggcttcggggagtggc

SEQ ID NO: 8288344 - DNA, 22 bp, Homo sapiens
tcaggtgggcagtgggttgagc

SEQ ID NO: 8288345 - DNA, 22 bp, Homo sapiens
tcagttgcatgggaagttcaga

SEQ ID NO: 8288346 - DNA, 22 bp, Homo sapiens
catctttgcccatccacttcca

SEQ ID NO: 8288347 - DNA, 22 bp, Homo sapiens
catgatggatgtgcacttcgct

SEQ ID NO: 8288348 - DNA, 22 bp, Homo sapiens
catgatcaccacttgacagccc

SEQ ID NO: 8288349 - DNA, 22 bp, Homo sapiens
catgatcagaaagagaagctag

SEQ ID NO: 8288350 - DNA, 22 bp, Homo sapiens
catgatacttgaatttggaagg

SEQ ID NO: 8288351 - DNA, 22 bp, Homo sapiens
tcagcagtgcagggtgaggcag

SEQ ID NO: 8288352 - DNA, 22 bp, Homo sapiens
tcagcagtcctccaggatcaag

SEQ ID NO: 8288353 - DNA, 22 bp, Homo sapiens
tcagcagtgagaattaatgttg

SEQ ID NO: 8288354 - DNA, 22 bp, Homo sapiens
tcagcagtggctctcatgcagt

SEQ ID NO: 8288355 - DNA, 22 bp, Homo sapiens
cagtttctgttttaaatagcag

SEQ ID NO: 8288356 - DNA, 22 bp, Homo sapiens
cagtttcttcatcagttaagca

SEQ ID NO: 8288357 - DNA, 20 bp, Homo sapiens
tcagaaggctccagagcaga

SEQ ID NO: 8288358 - DNA, 22 bp, Homo sapiens
tcagaagtccccagtcaaggag

SEQ ID NO: 8288359 - DNA, 22 bp, Homo sapiens
tcagaagtcacttaggaaaggg

SEQ ID NO: 8288360 - DNA, 22 bp, Homo sapiens
catacattgaaggagaaaggaa

SEQ ID NO: 8288361 - DNA, 22 bp, Homo sapiens
tcagctgcataacaaagtatga

SEQ ID NO: 8288362 - DNA, 22 bp, Homo sapiens
tcagctgcataagtcaccttgc

SEQ ID NO: 8288363 - DNA, 22 bp, Homo sapiens
tcagctgcagtttcacaagcac

SEQ ID NO: 8288364 - DNA, 22 bp, Homo sapiens
tcagctgcagcaggcaccattt

SEQ ID NO: 8288365 - DNA, 22 bp, Homo sapiens
catactgtaagtgcaaaagtgt

SEQ ID NO: 8288366 - DNA, 22 bp, Homo sapiens
catacattttgcatatttacca

SEQ ID NO: 8288367 - DNA, 22 bp, Homo sapiens
tcagctctggttcatgtggtct

SEQ ID NO: 8288368 - DNA, 22 bp, Homo sapiens
tcagctctgttttgagtggaac

SEQ ID NO: 8288369 - DNA, 20 bp, Homo sapiens
tcagctcttagaggtcgctt

SEQ ID NO: 8288370 - DNA, 22 bp, Homo sapiens
tcagctgcactgttctgaccca

SEQ ID NO: 8288371 - DNA, 22 bp, Homo sapiens
catcacaggcattttgagtgtc

SEQ ID NO: 8288372 - DNA, 22 bp, Homo sapiens
tcagggccctcacttgcatagg

SEQ ID NO: 8288373 - DNA, 22 bp, Homo sapiens
tcagggccatcttttgcctcaa

SEQ ID NO: 8288374 - DNA, 22 bp, Homo sapiens
tcagggcccagagctcaggcaa

SEQ ID NO: 8288375 - DNA, 19 bp, Homo sapiens
tcagggccatgagcgccac

SEQ ID NO: 8288376 - DNA, 22 bp, Homo sapiens
tcagggccatcttttgcctcaa

SEQ ID NO: 8288377 - DNA, 22 bp, Homo sapiens
catatgtatttctcataattag

SEQ ID NO: 8288378 - DNA, 20 bp, Homo sapiens
catatatacctagaagtgga

SEQ ID NO: 8288379 - DNA, 22 bp, Homo sapiens
catatattctggttttcactgg

SEQ ID NO: 8288380 - DNA, 22 bp, Homo sapiens
catatattctggttttcactgg

SEQ ID NO: 8288381 - DNA, 22 bp, Homo sapiens
catatccaatatgactagtgtt

SEQ ID NO: 8288382 - DNA, 22 bp, Homo sapiens
catataatgtttgaagatgtgg

SEQ ID NO: 8288383 - DNA, 22 bp, Homo sapiens
tcactcaggctggagtgcagtg

SEQ ID NO: 8288384 - DNA, 22 bp, Homo sapiens
tcactcatattatctctccaca

SEQ ID NO: 8288385 - DNA, 22 bp, Homo sapiens
tcacccagacttgtgaatgtgt

SEQ ID NO: 8288386 - DNA, 22 bp, Homo sapiens
tcacccagaaaagacagcagat

SEQ ID NO: 8288387 - DNA, 22 bp, Homo sapiens
tcactcagagatagcctcattt

SEQ ID NO: 8288388 - DNA, 22 bp, Homo sapiens
tcactcagcattcactgggcct

SEQ ID NO: 8288389 - DNA, 22 bp, Homo sapiens
tcactatgttcggagaactctg

SEQ ID NO: 8288390 - DNA, 22 bp, Homo sapiens
tcagaaatagtctttaaaatga

SEQ ID NO: 8288391 - DNA, 22 bp, Homo sapiens
tcagaaatcttgtcaaggcatc

SEQ ID NO: 8288392 - DNA, 22 bp, Homo sapiens
cagtgaggaagctgtctggacc

SEQ ID NO: 8288393 - DNA, 20 bp, Homo sapiens
cagtgaggaggtgctggggg

SEQ ID NO: 8288394 - DNA, 22 bp, Homo sapiens
cagtgagttgtgctgaggacca

SEQ ID NO: 8288395 - DNA, 22 bp, Homo sapiens
cagtgcaagctgatactgaggt

SEQ ID NO: 8288396 - DNA, 22 bp, Homo sapiens
cagtgattcacgcccttgggcc

SEQ ID NO: 8288397 - DNA, 22 bp, Homo sapiens
cagtgattattgattgcattca

SEQ ID NO: 8288398 - DNA, 19 bp, Homo sapiens
cagtgattaattcatctta

SEQ ID NO: 8288399 - DNA, 22 bp, Homo sapiens
cagtgattaagatacccaggct

SEQ ID NO: 8288400 - DNA, 22 bp, Homo sapiens
cagtgattaaaacatgacagcc

SEQ ID NO: 8288401 - DNA, 22 bp, Homo sapiens
cagtgatgaatgaaccacaggt

SEQ ID NO: 8288402 - DNA, 22 bp, Homo sapiens
cagtgattttggtctgccttag

SEQ ID NO: 8288403 - DNA, 22 bp, Homo sapiens
cagtgatttcagaatggattat

SEQ ID NO: 8288404 - DNA, 20 bp, Homo sapiens
cagtgcaactgaagaactga

SEQ ID NO: 8288405 - DNA, 20 bp, Homo sapiens
tatttacaacttagagcctc

SEQ ID NO: 8288406 - DNA, 22 bp, Homo sapiens
tattggcagcatgagctcctgg

SEQ ID NO: 8288407 - DNA, 22 bp, Homo sapiens
tattggattgagacattttaga

SEQ ID NO: 8288408 - DNA, 22 bp, Homo sapiens
tattggaagtgaacaccaggct

SEQ ID NO: 8288409 - DNA, 22 bp, Homo sapiens
tattggaatttagttagagaat

SEQ ID NO: 8288410 - DNA, 22 bp, Homo sapiens
tattggaatgcactgggagaga

SEQ ID NO: 8288411 - DNA, 22 bp, Homo sapiens
tattggaatgcactgggagaga

SEQ ID NO: 8288412 - DNA, 22 bp, Homo sapiens
tattggaatagttaaggaagat

SEQ ID NO: 8288413 - DNA, 22 bp, Homo sapiens
tatttacttttaaattgagaac

SEQ ID NO: 8288414 - DNA, 22 bp, Homo sapiens
tatttagaacagacaatagaaa

SEQ ID NO: 8288415 - DNA, 22 bp, Homo sapiens
cagtcctgtgtcccttggtggg

SEQ ID NO: 8288416 - DNA, 22 bp, Homo sapiens
cagtcctgggcaggtcaggcca

SEQ ID NO: 8288417 - DNA, 22 bp, Homo sapiens
cagtcctggggaccaggctgag

SEQ ID NO: 8288418 - DNA, 22 bp, Homo sapiens
tatacagattaacagatttaaa

SEQ ID NO: 8288419 - DNA, 22 bp, Homo sapiens
tataatatgaggcaggagtgat

SEQ ID NO: 8288420 - DNA, 22 bp, Homo sapiens
tataagtagcattggaacttca

SEQ ID NO: 8288421 - DNA, 22 bp, Homo sapiens
caggggccggctgtccgtgccc

SEQ ID NO: 8288422 - DNA, 22 bp, Homo sapiens
caggggccaggctgtctgctgt

SEQ ID NO: 8288423 - DNA, 22 bp, Homo sapiens
caggggccaagggtccagacct

SEQ ID NO: 8288424 - DNA, 22 bp, Homo sapiens
caggggcctggctgtctaggaa

SEQ ID NO: 8288425 - DNA, 22 bp, Homo sapiens
caggggcctggctgtctaggaa

SEQ ID NO: 8288426 - DNA, 20 bp, Homo sapiens
caggtcttcatgtggctgtc

SEQ ID NO: 8288427 - DNA, 22 bp, Homo sapiens
tatgtacatgttaaagggcaaa

SEQ ID NO: 8288428 - DNA, 22 bp, Homo sapiens
caggtcttttctactggtggag

SEQ ID NO: 8288429 - DNA, 22 bp, Homo sapiens
tatggctactacgaataatgct

SEQ ID NO: 8288430 - DNA, 22 bp, Homo sapiens
tatggcagttacccttgatgat

SEQ ID NO: 8288431 - DNA, 22 bp, Homo sapiens
tattgcatttcccacgttcact

SEQ ID NO: 8288432 - DNA, 22 bp, Homo sapiens
tattggaaggcattagtgaata

SEQ ID NO: 8288433 - DNA, 22 bp, Homo sapiens
tattggaaggaagcaagagagg

SEQ ID NO: 8288434 - DNA, 22 bp, Homo sapiens
tattggaagattcaggattgca

SEQ ID NO: 8288435 - DNA, 22 bp, Homo sapiens
tatgttttaggaattaattgtt

SEQ ID NO: 8288436 - DNA, 22 bp, Homo sapiens
tatgtttttaagagaatgcatt

SEQ ID NO: 8288437 - DNA, 22 bp, Homo sapiens
tatgtgcattatctagttcatt

SEQ ID NO: 8288438 - DNA, 19 bp, Homo sapiens
tatgtgcatgtgtgcatat

SEQ ID NO: 8288439 - DNA, 22 bp, Homo sapiens
tatgtactaactttcattctag

SEQ ID NO: 8288440 - DNA, 22 bp, Homo sapiens
tatgtgcattattaccagtgga

SEQ ID NO: 8288441 - DNA, 22 bp, Homo sapiens
tgtttcaaaacagtgataattt

SEQ ID NO: 8288442 - DNA, 22 bp, Homo sapiens
tgtttcaactgttaagatatgc

SEQ ID NO: 8288443 - DNA, 17 bp, Homo sapiens
tgtttggttgattggtg

SEQ ID NO: 8288444 - DNA, 22 bp, Homo sapiens
tgtttggttccagagggcctct

SEQ ID NO: 8288445 - DNA, 22 bp, Homo sapiens
tgttttatgagccatataacct

SEQ ID NO: 8288446 - DNA, 22 bp, Homo sapiens
tgttttaagctctagaagggga

SEQ ID NO: 8288447 - DNA, 22 bp, Homo sapiens
tgttttaagagcgcactttata

SEQ ID NO: 8288448 - DNA, 22 bp, Homo sapiens
tgtttttgttcaatgctaggtc

SEQ ID NO: 8288449 - DNA, 17 bp, Homo sapiens
tgttttttccctgttct

SEQ ID NO: 8288450 - DNA, 22 bp, Homo sapiens
tgttttttccttatgcaatctg

SEQ ID NO: 8288451 - DNA, 22 bp, Homo sapiens
ttaaaaaccatcttcctttcct

SEQ ID NO: 8288452 - DNA, 22 bp, Homo sapiens
tgtttttttatatacctgaagt

SEQ ID NO: 8288453 - DNA, 22 bp, Homo sapiens
ttaaaaaccatcttcctttcct

SEQ ID NO: 8288454 - DNA, 22 bp, Homo sapiens
ttaaaagacctgttgaggttag

SEQ ID NO: 8288455 - DNA, 22 bp, Homo sapiens
ttaaaagaatcctgttatcctc

SEQ ID NO: 8288456 - DNA, 17 bp, Homo sapiens
ttaaaccataaagaagg

SEQ ID NO: 8288457 - DNA, 22 bp, Homo sapiens
ttaaaatgtacaggggaaagtg

SEQ ID NO: 8288458 - DNA, 22 bp, Homo sapiens
ttaaacacactgagatttatgt

SEQ ID NO: 8288459 - DNA, 22 bp, Homo sapiens
ttaaacacctgtctagtgtagc

SEQ ID NO: 8288460 - DNA, 22 bp, Homo sapiens
tgttgattagtgtttagactta

SEQ ID NO: 8288461 - DNA, 18 bp, Homo sapiens
tgttggtgttcactcact

SEQ ID NO: 8288462 - DNA, 23 bp, Homo sapiens
tgttggtggcggtaattttgtcc

SEQ ID NO: 8288463 - DNA, 19 bp, Homo sapiens
tgttggtgcggatgtggag

SEQ ID NO: 8288464 - DNA, 22 bp, Homo sapiens
tgttggtgaacttccacttgct

SEQ ID NO: 8288465 - DNA, 22 bp, Homo sapiens
tgttggtgaagtctctctgctg

SEQ ID NO: 8288466 - DNA, 22 bp, Homo sapiens
tgttcttttctctaaactgata

SEQ ID NO: 8288467 - DNA, 22 bp, Homo sapiens
tgttagaagttaatcactaatt

SEQ ID NO: 8288468 - DNA, 22 bp, Homo sapiens
tgttcttaacttttgtgtatat

SEQ ID NO: 8288469 - DNA, 22 bp, Homo sapiens
tgttcttaggtatttgacagtc

SEQ ID NO: 8288470 - DNA, 22 bp, Homo sapiens
tgttcttatggctatttctccc

SEQ ID NO: 8288471 - DNA, 22 bp, Homo sapiens
tgttcttagcaggagcatctat

SEQ ID NO: 8288472 - DNA, 22 bp, Homo sapiens
tgttctttgctgttgatgtaga

SEQ ID NO: 8288473 - DNA, 22 bp, Homo sapiens
tgttctttgccagtgatttaat

SEQ ID NO: 8288474 - DNA, 22 bp, Homo sapiens
tgttctttggcttcacagctct

SEQ ID NO: 8288475 - DNA, 22 bp, Homo sapiens
tgttctttggcttcacagctct

SEQ ID NO: 8288476 - DNA, 22 bp, Homo sapiens
tgttctttcagttagacacagt

SEQ ID NO: 8288477 - DNA, 22 bp, Homo sapiens
tgttcttgggaatcttacagtt

SEQ ID NO: 8288478 - DNA, 22 bp, Homo sapiens
tgttctttagcagaccatgttg

SEQ ID NO: 8288479 - DNA, 22 bp, Homo sapiens
tgttaaatgagattggaatttg

SEQ ID NO: 8288480 - DNA, 22 bp, Homo sapiens
tgttaacacaattctggagaga

SEQ ID NO: 8288481 - DNA, 22 bp, Homo sapiens
tgtggaatgtcctcagcatcct

SEQ ID NO: 8288482 - DNA, 22 bp, Homo sapiens
tgtggacaccactgggaggtct

SEQ ID NO: 8288483 - DNA, 22 bp, Homo sapiens
tgtggaagtgccaatgacaaat

SEQ ID NO: 8288484 - DNA, 21 bp, Homo sapiens
tgtggctgacaccctttggga

SEQ ID NO: 8288485 - DNA, 22 bp, Homo sapiens
tgtggctgatcaaagcgctcag

SEQ ID NO: 8288486 - DNA, 19 bp, Homo sapiens
tgtggctgagcactcctta

SEQ ID NO: 8288487 - DNA, 22 bp, Homo sapiens
tgtggctgactcctggtcccca

SEQ ID NO: 8288488 - DNA, 23 bp, Homo sapiens
tgtggctgagaaattgacaactt

SEQ ID NO: 8288489 - DNA, 22 bp, Homo sapiens
tgtgggaggaacacagccagaa

SEQ ID NO: 8288490 - DNA, 22 bp, Homo sapiens
tgtgggaggaacacagccagaa

SEQ ID NO: 8288491 - DNA, 22 bp, Homo sapiens
tgtgggagaaggaagcaagctg

SEQ ID NO: 8288492 - DNA, 22 bp, Homo sapiens
tgtgggaggaattagaatggga

SEQ ID NO: 8288493 - DNA, 22 bp, Homo sapiens
tgtgggagaaggaagcaagctg

SEQ ID NO: 8288494 - DNA, 22 bp, Homo sapiens
tgtggctgcagacactggagcc

SEQ ID NO: 8288495 - DNA, 22 bp, Homo sapiens
tgtggctgcaaaggaaggctgc

SEQ ID NO: 8288496 - DNA, 22 bp, Homo sapiens
tgtggctgcaggcgatggagga

SEQ ID NO: 8288497 - DNA, 22 bp, Homo sapiens
tgtggctgccaccctgaagccg

SEQ ID NO: 8288498 - DNA, 23 bp, Homo sapiens
tgtgggcgcattgtaagggtagc

SEQ ID NO: 8288499 - DNA, 19 bp, Homo sapiens
tgtgggcaagggatggcag

SEQ ID NO: 8288500 - DNA, 19 bp, Homo sapiens
tgtgggcaagggatggcag

SEQ ID NO: 8288501 - DNA, 22 bp, Homo sapiens
tgtgggcaggagcacaagtcag

SEQ ID NO: 8288502 - DNA, 22 bp, Homo sapiens
tgtgggcaaagggtagctgggt

SEQ ID NO: 8288503 - DNA, 22 bp, Homo sapiens
tgtgggaggattcagaattggg

SEQ ID NO: 8288504 - DNA, 22 bp, Homo sapiens
tgtgggaggaattagaatggga

SEQ ID NO: 8288505 - DNA, 22 bp, Homo sapiens
tgtggggacccatgccatgggc

SEQ ID NO: 8288506 - DNA, 22 bp, Homo sapiens
tgtgtacacgagaggttatata

SEQ ID NO: 8288507 - DNA, 22 bp, Homo sapiens
tgtgtacatatctatcctagat

SEQ ID NO: 8288508 - DNA, 22 bp, Homo sapiens
tgtgtcagaaatcagtgcctcg

SEQ ID NO: 8288509 - DNA, 22 bp, Homo sapiens
tgtgtgccagatacaagcactg

SEQ ID NO: 8288510 - DNA, 22 bp, Homo sapiens
tgtgtgccagggcatgcacagg

SEQ ID NO: 8288511 - DNA, 22 bp, Homo sapiens
tgtgtggattcatctcaaagag

SEQ ID NO: 8288512 - DNA, 22 bp, Homo sapiens
tgtgttaagtatttgatacact

SEQ ID NO: 8288513 - DNA, 22 bp, Homo sapiens
tgtgttaaggcactgatatctg

SEQ ID NO: 8288514 - DNA, 19 bp, Homo sapiens
tgtgttaacaggaattggt

SEQ ID NO: 8288515 - DNA, 22 bp, Homo sapiens
tgtgttaacactgcatgataat

SEQ ID NO: 8288516 - DNA, 22 bp, Homo sapiens
tgtgactgtgctgtggagggag

SEQ ID NO: 8288517 - DNA, 22 bp, Homo sapiens
tgtgactctggcacatggtgag

SEQ ID NO: 8288518 - DNA, 22 bp, Homo sapiens
tgtgactggcagaggtgtctgg

SEQ ID NO: 8288519 - DNA, 22 bp, Homo sapiens
tgtgacctcatcttaactggaa

SEQ ID NO: 8288520 - DNA, 21 bp, Homo sapiens
tgtgataaactccaagtggga

SEQ ID NO: 8288521 - DNA, 21 bp, Homo sapiens
tgtgagtccatctgagcagaa

SEQ ID NO: 8288522 - DNA, 22 bp, Homo sapiens
tgtgagtctaggtcagggtgtt

SEQ ID NO: 8288523 - DNA, 22 bp, Homo sapiens
tgtgagcactatggctaggctc

SEQ ID NO: 8288524 - DNA, 22 bp, Homo sapiens
tgtgagcaagattcagagattc

SEQ ID NO: 8288525 - DNA, 22 bp, Homo sapiens
tgtgataagttaaattaaacct

SEQ ID NO: 8288526 - DNA, 22 bp, Homo sapiens
tgtgattatttgattaacatgt

SEQ ID NO: 8288527 - DNA, 22 bp, Homo sapiens
tgtgaaatgctattgtgacaaa

SEQ ID NO: 8288528 - DNA, 21 bp, Homo sapiens
tgtgacagaggcggtgcctac

SEQ ID NO: 8288529 - DNA, 22 bp, Homo sapiens
tgtgacagaattggtctgttct

SEQ ID NO: 8288530 - DNA, 22 bp, Homo sapiens
tgtgcaatttcaatttacacag

SEQ ID NO: 8288531 - DNA, 22 bp, Homo sapiens
tgtgcaatcttgagcaatttat

SEQ ID NO: 8288532 - DNA, 22 bp, Homo sapiens
tgtgcaatcatattttaaaatg

SEQ ID NO: 8288533 - DNA, 22 bp, Homo sapiens
tgtgcagtgtgaccagggctgc

SEQ ID NO: 8288534 - DNA, 22 bp, Homo sapiens
tgtgcagtgtgaccagggctgc

SEQ ID NO: 8288535 - DNA, 22 bp, Homo sapiens
tgtgcagagtaaggcagctgtt

SEQ ID NO: 8288536 - DNA, 22 bp, Homo sapiens
tgtgcagatagtgatttcagaa

SEQ ID NO: 8288537 - DNA, 19 bp, Homo sapiens
tgtgcctctatagcatgtg

SEQ ID NO: 8288538 - DNA, 22 bp, Homo sapiens
tgtgcctctgcctcatgccctg

SEQ ID NO: 8288539 - DNA, 22 bp, Homo sapiens
tgtgcatgttgcttgaactcct

SEQ ID NO: 8288540 - DNA, 22 bp, Homo sapiens
tgtgcatgtctgggcctgtaag

SEQ ID NO: 8288541 - DNA, 22 bp, Homo sapiens
tgtgcagttttaagtggtctaa

SEQ ID NO: 8288542 - DNA, 17 bp, Homo sapiens
tgtgcatagaataatga

SEQ ID NO: 8288543 - DNA, 22 bp, Homo sapiens
tgtgccttgtacagcattcaaa

SEQ ID NO: 8288544 - DNA, 22 bp, Homo sapiens
tgtctggctcattttctgcagt

SEQ ID NO: 8288545 - DNA, 22 bp, Homo sapiens
tgtcttcactcaagtctcttgg

SEQ ID NO: 8288546 - DNA, 22 bp, Homo sapiens
tgtcttctgtattcaagtctat

SEQ ID NO: 8288547 - DNA, 22 bp, Homo sapiens
tgtcttctgtattcaagtctat

SEQ ID NO: 8288548 - DNA, 22 bp, Homo sapiens
tgtcttggattatctgtgcaac

SEQ ID NO: 8288549 - DNA, 22 bp, Homo sapiens
tgtcttcagtgtgttaccatgg

SEQ ID NO: 8288550 - DNA, 22 bp, Homo sapiens
tgtcttttggagcatctttctt

SEQ ID NO: 8288551 - DNA, 22 bp, Homo sapiens
tgtctttgttattgtggacagg

SEQ ID NO: 8288552 - DNA, 22 bp, Homo sapiens
tgtctagggagctgctcaggct

SEQ ID NO: 8288553 - DNA, 19 bp, Homo sapiens
tgtctacataatagattga

SEQ ID NO: 8288554 - DNA, 22 bp, Homo sapiens
tgtctactgctgacactaacag

SEQ ID NO: 8288555 - DNA, 22 bp, Homo sapiens
tgtctacaaacgtgtacacatt

SEQ ID NO: 8288556 - DNA, 22 bp, Homo sapiens
tgtctccaactcactgtatact

SEQ ID NO: 8288557 - DNA, 20 bp, Homo sapiens
tgtctccagggctgagtgga

SEQ ID NO: 8288558 - DNA, 20 bp, Homo sapiens
tgtctctcagtgtcagtgca

SEQ ID NO: 8288559 - DNA, 22 bp, Homo sapiens
tgtctctcatttagttttgcac

SEQ ID NO: 8288560 - DNA, 18 bp, Homo sapiens
tgtctctcctttctgtgt

SEQ ID NO: 8288561 - DNA, 20 bp, Homo sapiens
tgtctctcggttttgtgact

SEQ ID NO: 8288562 - DNA, 22 bp, Homo sapiens
tgtctctcctgatgatctggtg

SEQ ID NO: 8288563 - DNA, 22 bp, Homo sapiens
tgtctctccacacagccagtgc

SEQ ID NO: 8288564 - DNA, 22 bp, Homo sapiens
tgtctcctgggtcccttccacc

SEQ ID NO: 8288565 - DNA, 22 bp, Homo sapiens
tgtctcccaggtgtgcccagtg

SEQ ID NO: 8288566 - DNA, 22 bp, Homo sapiens
tgtctctctgcccccattgctc

SEQ ID NO: 8288567 - DNA, 22 bp, Homo sapiens
tgtctctctagctcttggtttg

SEQ ID NO: 8288568 - DNA, 22 bp, Homo sapiens
tgtctcttggctctatcactta

SEQ ID NO: 8288569 - DNA, 22 bp, Homo sapiens
tgtctctgctgcaccttctggg

SEQ ID NO: 8288570 - DNA, 22 bp, Homo sapiens
tgtctcttttcaagctaccctt

SEQ ID NO: 8288571 - DNA, 22 bp, Homo sapiens
tgtctctttggcctcccatatg

SEQ ID NO: 8288572 - DNA, 22 bp, Homo sapiens
tgtctctttgggttcctcttgg

SEQ ID NO: 8288573 - DNA, 22 bp, Homo sapiens
tgtctgccaaagcttcctcctg

SEQ ID NO: 8288574 - DNA, 22 bp, Homo sapiens
tgtctgccaccccatcaagctc

SEQ ID NO: 8288575 - DNA, 22 bp, Homo sapiens
tgtctgcaccctgtgattgttt

SEQ ID NO: 8288576 - DNA, 21 bp, Homo sapiens
tgtctgcccctgtttaccaga

SEQ ID NO: 8288577 - DNA, 22 bp, Homo sapiens
tgtctgccctcaacccagaggc

SEQ ID NO: 8288578 - DNA, 21 bp, Homo sapiens
tgtctgcctgcttcttcactc

SEQ ID NO: 8288579 - DNA, 21 bp, Homo sapiens
tgtctgcctgcttcttcactc

SEQ ID NO: 8288580 - DNA, 22 bp, Homo sapiens
tgtctgcctgtctctgtgcaaa

SEQ ID NO: 8288581 - DNA, 22 bp, Homo sapiens
tgtctgcctgtctctgtgcaaa

SEQ ID NO: 8288582 - DNA, 22 bp, Homo sapiens
ttagcagctaagtcatgctgca

SEQ ID NO: 8288583 - DNA, 22 bp, Homo sapiens
ttagcaggaagagttggctgga

SEQ ID NO: 8288584 - DNA, 22 bp, Homo sapiens
ttagcaggaagagttggctgga

SEQ ID NO: 8288585 - DNA, 22 bp, Homo sapiens
ttagattattgagcatccactg

SEQ ID NO: 8288586 - DNA, 17 bp, Homo sapiens
ttagcaaaatagcactt

SEQ ID NO: 8288587 - DNA, 22 bp, Homo sapiens
ttagcaaacaaatgaaatggtt

SEQ ID NO: 8288588 - DNA, 22 bp, Homo sapiens
ttagcaaacccttgctggtgag

SEQ ID NO: 8288589 - DNA, 22 bp, Homo sapiens
ttagcaaacctggactacagat

SEQ ID NO: 8288590 - DNA, 22 bp, Homo sapiens
ttaggtgtgacattttgttcct

SEQ ID NO: 8288591 - DNA, 22 bp, Homo sapiens
ttaggtcattccctgagcagat

SEQ ID NO: 8288592 - DNA, 22 bp, Homo sapiens
ttagtacattgattcattatgt

SEQ ID NO: 8288593 - DNA, 22 bp, Homo sapiens
ttagtaagcactcacacattcc

SEQ ID NO: 8288594 - DNA, 22 bp, Homo sapiens
ttagtacaagagattaattact

SEQ ID NO: 8288595 - DNA, 22 bp, Homo sapiens
ttagaaaggggtgaatcaatgg

SEQ ID NO: 8288596 - DNA, 22 bp, Homo sapiens
ttagaaaggggtgaatcaatgg

SEQ ID NO: 8288597 - DNA, 22 bp, Homo sapiens
ttacattttgcacagatgtccc

SEQ ID NO: 8288598 - DNA, 22 bp, Homo sapiens
ttagaaaggagcttatttcttt

SEQ ID NO: 8288599 - DNA, 22 bp, Homo sapiens
ttagaagcactaattactcaca

SEQ ID NO: 8288600 - DNA, 22 bp, Homo sapiens
ttagataatgttattgtaattt

SEQ ID NO: 8288601 - DNA, 22 bp, Homo sapiens
ttagaacactgagaaagtgatg

SEQ ID NO: 8288602 - DNA, 22 bp, Homo sapiens
ttatgaagttcctgttacagtg

SEQ ID NO: 8288603 - DNA, 22 bp, Homo sapiens
ttatgaaggatcaggtacttgg

SEQ ID NO: 8288604 - DNA, 22 bp, Homo sapiens
ttatgatttgccacagattggt

SEQ ID NO: 8288605 - DNA, 22 bp, Homo sapiens
ttatgatttgccacagattggt

SEQ ID NO: 8288606 - DNA, 22 bp, Homo sapiens
ttattattccccaagtcattat

SEQ ID NO: 8288607 - DNA, 22 bp, Homo sapiens
ttattattccccaagtcattat

SEQ ID NO: 8288608 - DNA, 18 bp, Homo sapiens
ttatgcaaaactgttttc

SEQ ID NO: 8288609 - DNA, 22 bp, Homo sapiens
ttattccacagctcagaatttt

SEQ ID NO: 8288610 - DNA, 22 bp, Homo sapiens
ttaaagatgcagctttagagaa

SEQ ID NO: 8288611 - DNA, 22 bp, Homo sapiens
ttaataaagtatgaattggaaa

SEQ ID NO: 8288612 - DNA, 22 bp, Homo sapiens
ttaataaagtatgaattggaaa

SEQ ID NO: 8288613 - DNA, 22 bp, Homo sapiens
ttaatacagaagcaagacactg

SEQ ID NO: 8288614 - DNA, 22 bp, Homo sapiens
ttaataaagtatgaattggaaa

SEQ ID NO: 8288615 - DNA, 22 bp, Homo sapiens
ttaattaattagttaagcatgt

SEQ ID NO: 8288616 - DNA, 22 bp, Homo sapiens
ttaattaaattcatgagcattg

SEQ ID NO: 8288617 - DNA, 22 bp, Homo sapiens
ttaatgttttaagttatagaga

SEQ ID NO: 8288618 - DNA, 22 bp, Homo sapiens
ttacaaccccagaggtgccgtt

SEQ ID NO: 8288619 - DNA, 22 bp, Homo sapiens
ttacaacctaattttactctcc

SEQ ID NO: 8288620 - DNA, 22 bp, Homo sapiens
ttacaacttgcagaggatgttg

SEQ ID NO: 8288621 - DNA, 22 bp, Homo sapiens
ttacagaggtatgtatgtctct

SEQ ID NO: 8288622 - DNA, 22 bp, Homo sapiens
ttacagaaaagggctttaagag

SEQ ID NO: 8288623 - DNA, 22 bp, Homo sapiens
ttacaaggtaagttgttaagtc

SEQ ID NO: 8288624 - DNA, 21 bp, Homo sapiens
ttacaatgcattttctttggc

SEQ ID NO: 8288625 - DNA, 22 bp, Homo sapiens
ttacatttcccccttggaggct

SEQ ID NO: 8288626 - DNA, 22 bp, Homo sapiens
ttacattttagttaacctgtga

SEQ ID NO: 8288627 - DNA, 22 bp, Homo sapiens
ttacatttggctatgtcctcta

SEQ ID NO: 8288628 - DNA, 22 bp, Homo sapiens
ttacattcattgaagtgattca

SEQ ID NO: 8288629 - DNA, 21 bp, Homo sapiens
ttcagctattcagaaggggag

SEQ ID NO: 8288630 - DNA, 22 bp, Homo sapiens
ttcagctattatacccactttt

SEQ ID NO: 8288631 - DNA, 22 bp, Homo sapiens
ttcagctatggagtcttagtta

SEQ ID NO: 8288632 - DNA, 22 bp, Homo sapiens
ttcagctatgcgctttgggcaa

SEQ ID NO: 8288633 - DNA, 22 bp, Homo sapiens
ttcagctaaggagtttcactgt

SEQ ID NO: 8288634 - DNA, 22 bp, Homo sapiens
ttcagctaaaggaaactcagat

SEQ ID NO: 8288635 - DNA, 22 bp, Homo sapiens
ttcagctaaaaatgcccacttg

SEQ ID NO: 8288636 - DNA, 22 bp, Homo sapiens
ttcagctataacattgagactt

SEQ ID NO: 8288637 - DNA, 17 bp, Homo sapiens
ttcagctactcaacaca

SEQ ID NO: 8288638 - DNA, 22 bp, Homo sapiens
ttcagctagcatctcacttggt

SEQ ID NO: 8288639 - DNA, 22 bp, Homo sapiens
ttcagctacccttggcttaata

SEQ ID NO: 8288640 - DNA, 20 bp, Homo sapiens
ttcagctaccaggtatcttc

SEQ ID NO: 8288641 - DNA, 22 bp, Homo sapiens
ttcagctaatgggaataagagt

SEQ ID NO: 8288642 - DNA, 22 bp, Homo sapiens
ttcaccattctaagacattggt

SEQ ID NO: 8288643 - DNA, 22 bp, Homo sapiens
ttcaccctggaccagaaattgg

SEQ ID NO: 8288644 - DNA, 22 bp, Homo sapiens
ttcactatgcttggaaacttct

SEQ ID NO: 8288645 - DNA, 19 bp, Homo sapiens
ttcactaattgtaagattt

SEQ ID NO: 8288646 - DNA, 22 bp, Homo sapiens
ttcactgcagcccatgaaggga

SEQ ID NO: 8288647 - DNA, 22 bp, Homo sapiens
ttcagcagtttctgagaagcaa

SEQ ID NO: 8288648 - DNA, 17 bp, Homo sapiens
ttcagcagtgtttctcc

SEQ ID NO: 8288649 - DNA, 22 bp, Homo sapiens
ttcagcagtcgtccaggaaaag

SEQ ID NO: 8288650 - DNA, 21 bp, Homo sapiens
ttcagcagtcctctagagata

SEQ ID NO: 8288651 - DNA, 22 bp, Homo sapiens
ttcagcagtgcagacacccagt

SEQ ID NO: 8288652 - DNA, 19 bp, Homo sapiens
ttcagcagtgtctgctctt

SEQ ID NO: 8288653 - DNA, 22 bp, Homo sapiens
ttcagcagcttttagtacattg

SEQ ID NO: 8288654 - DNA, 21 bp, Homo sapiens
ttcagcagcatgttgtctgtt

SEQ ID NO: 8288655 - DNA, 22 bp, Homo sapiens
ttcactgctgggtgattgggtt

SEQ ID NO: 8288656 - DNA, 22 bp, Homo sapiens
ttcagcaggcggtagctgccac

SEQ ID NO: 8288657 - DNA, 19 bp, Homo sapiens
ttcagcaggctgaagcttc

SEQ ID NO: 8288658 - DNA, 22 bp, Homo sapiens
ttcagcaggtggtgagttctgc

SEQ ID NO: 8288659 - DNA, 22 bp, Homo sapiens
ttcacattgttttaatgtgaat

SEQ ID NO: 8288660 - DNA, 19 bp, Homo sapiens
ttcacatttttgtggcact

SEQ ID NO: 8288661 - DNA, 22 bp, Homo sapiens
ttcattcacccaggaaacatct

SEQ ID NO: 8288662 - DNA, 22 bp, Homo sapiens
ttcattcatcacatgcagctgg

SEQ ID NO: 8288663 - DNA, 22 bp, Homo sapiens
ttcattaattcattcagtgact

SEQ ID NO: 8288664 - DNA, 17 bp, Homo sapiens
ttcattaataaaagcaa

SEQ ID NO: 8288665 - DNA, 22 bp, Homo sapiens
ttcattaagtataaaatgtggt

SEQ ID NO: 8288666 - DNA, 21 bp, Homo sapiens
ttcaggacaggaaaaacaggg

SEQ ID NO: 8288667 - DNA, 22 bp, Homo sapiens
ttcattcattcatgaatgttaa

SEQ ID NO: 8288668 - DNA, 19 bp, Homo sapiens
ttcattctttctacttacc

SEQ ID NO: 8288669 - DNA, 22 bp, Homo sapiens
ttccagagctttgcgcttggaa

SEQ ID NO: 8288670 - DNA, 23 bp, Homo sapiens
ttccagaggaagaagtcatgact

SEQ ID NO: 8288671 - DNA, 22 bp, Homo sapiens
ttcattgagctgtacacttagg

SEQ ID NO: 8288672 - DNA, 22 bp, Homo sapiens
ttccagcagcgtgggagaagta

SEQ ID NO: 8288673 - DNA, 22 bp, Homo sapiens
ttccagcaggcagacaggagat

SEQ ID NO: 8288674 - DNA, 22 bp, Homo sapiens
ttccagagttgggggagtggtt

SEQ ID NO: 8288675 - DNA, 22 bp, Homo sapiens
ttccagagtccatgttggctca

SEQ ID NO: 8288676 - DNA, 22 bp, Homo sapiens
ttccagagtctggttccatggt

SEQ ID NO: 8288677 - DNA, 22 bp, Homo sapiens
ttccagaggttctcagccctgt

SEQ ID NO: 8288678 - DNA, 23 bp, Homo sapiens
ttccagagtccacatctgccacc

SEQ ID NO: 8288679 - DNA, 22 bp, Homo sapiens
ttccagaggtagcaatgacttg

SEQ ID NO: 8288680 - DNA, 22 bp, Homo sapiens
ttccagaggggaggtggcagcc

SEQ ID NO: 8288681 - DNA, 22 bp, Homo sapiens
ttccagaggcttcagggaagaa

SEQ ID NO: 8288682 - DNA, 22 bp, Homo sapiens
tgggattcaccatgggcttcag

SEQ ID NO: 8288683 - DNA, 22 bp, Homo sapiens
tgggcacaaacatctgcctgtt

SEQ ID NO: 8288684 - DNA, 18 bp, Homo sapiens
tgggcacaatgaacagca

SEQ ID NO: 8288685 - DNA, 22 bp, Homo sapiens
tgggcacagaatagatggccca

SEQ ID NO: 8288686 - DNA, 22 bp, Homo sapiens
tgggcacagaatagatggccca

SEQ ID NO: 8288687 - DNA, 22 bp, Homo sapiens
tgggcagagatctggatcaaac

SEQ ID NO: 8288688 - DNA, 22 bp, Homo sapiens
tgggcagagtcatacaggagac

SEQ ID NO: 8288689 - DNA, 22 bp, Homo sapiens
tgggcagagtcatacaggagac

SEQ ID NO: 8288690 - DNA, 21 bp, Homo sapiens
tgggcaccaaaacctaggagt

SEQ ID NO: 8288691 - DNA, 20 bp, Homo sapiens
tgggcaccagatgggatgcc

SEQ ID NO: 8288692 - DNA, 22 bp, Homo sapiens
tgggcacctagcaacccttctc

SEQ ID NO: 8288693 - DNA, 22 bp, Homo sapiens
tgggcacagtgagttgccttta

SEQ ID NO: 8288694 - DNA, 22 bp, Homo sapiens
tgggcacaggggaatggatgaa

SEQ ID NO: 8288695 - DNA, 22 bp, Homo sapiens
tgggcacctgaggcctggcagg

SEQ ID NO: 8288696 - DNA, 22 bp, Homo sapiens
tgggcagagagtagaggcaacg

SEQ ID NO: 8288697 - DNA, 22 bp, Homo sapiens
tgggagtgcacctgggacacga

SEQ ID NO: 8288698 - DNA, 22 bp, Homo sapiens
tgggaggcccaggcctggcagg

SEQ ID NO: 8288699 - DNA, 22 bp, Homo sapiens
tgggaggcccaggcctggcagg

SEQ ID NO: 8288700 - DNA, 22 bp, Homo sapiens
tgggaggccgaggcaggtggat

SEQ ID NO: 8288701 - DNA, 22 bp, Homo sapiens
tgggaggccaaggcaggcggat

SEQ ID NO: 8288702 - DNA, 22 bp, Homo sapiens
tgggaggcttccagaccttgct

SEQ ID NO: 8288703 - DNA, 22 bp, Homo sapiens
tgggcagcaaagactgtgtgct

SEQ ID NO: 8288704 - DNA, 20 bp, Homo sapiens
tgggcagcactgctggctgg

SEQ ID NO: 8288705 - DNA, 22 bp, Homo sapiens
tgggcagattaatgcagtggct

SEQ ID NO: 8288706 - DNA, 20 bp, Homo sapiens
tgggcagcactgctggctgg

SEQ ID NO: 8288707 - DNA, 22 bp, Homo sapiens
tgggcagcagcaaagccagact

SEQ ID NO: 8288708 - DNA, 22 bp, Homo sapiens
tgggcagatctttggtggctag

SEQ ID NO: 8288709 - DNA, 21 bp, Homo sapiens
tgggcagatggcagtgtggct

SEQ ID NO: 8288710 - DNA, 22 bp, Homo sapiens
tgggcagattaatgcagtggct

SEQ ID NO: 8288711 - DNA, 22 bp, Homo sapiens
tgggcagggagctggaaccaca

SEQ ID NO: 8288712 - DNA, 22 bp, Homo sapiens
tgggcagggagctggaaccaca

SEQ ID NO: 8288713 - DNA, 22 bp, Homo sapiens
tgggcagggagctggaaccaca

SEQ ID NO: 8288714 - DNA, 22 bp, Homo sapiens
tgggcagggatctcttttgcaa

SEQ ID NO: 8288715 - DNA, 22 bp, Homo sapiens
tgggcagggatctcttttgcaa

SEQ ID NO: 8288716 - DNA, 22 bp, Homo sapiens
tgggcaggagagaagctaaaga

SEQ ID NO: 8288717 - DNA, 19 bp, Homo sapiens
tgggcagtgccagggctta

SEQ ID NO: 8288718 - DNA, 23 bp, Homo sapiens
tgggcatctcctctgtgccaggc

SEQ ID NO: 8288719 - DNA, 22 bp, Homo sapiens
tgggcaggggccctgcttccgt

SEQ ID NO: 8288720 - DNA, 19 bp, Homo sapiens
tgggcaggttcagtaatgg

SEQ ID NO: 8288721 - DNA, 22 bp, Homo sapiens
tgggctagcagggaagagagac

SEQ ID NO: 8288722 - DNA, 22 bp, Homo sapiens
tgggcgaggcccagggctgcgt

SEQ ID NO: 8288723 - DNA, 22 bp, Homo sapiens
tgggcgacagagcaagactccg

SEQ ID NO: 8288724 - DNA, 22 bp, Homo sapiens
tgggctgcccaaggtggccatg

SEQ ID NO: 8288725 - DNA, 22 bp, Homo sapiens
tgggctctcctggaggacaaca

SEQ ID NO: 8288726 - DNA, 22 bp, Homo sapiens
tgggctctcgtccctgcagaag

SEQ ID NO: 8288727 - DNA, 17 bp, Homo sapiens
tgggccagtagaaggga

SEQ ID NO: 8288728 - DNA, 21 bp, Homo sapiens
tgggccagtagaaaggaaggc

SEQ ID NO: 8288729 - DNA, 22 bp, Homo sapiens
tgggggagagtgcaagcatgaa

SEQ ID NO: 8288730 - DNA, 22 bp, Homo sapiens
tgggggcatggaccagcctggc

SEQ ID NO: 8288731 - DNA, 22 bp, Homo sapiens
tgggggagctcagtccagccca

SEQ ID NO: 8288732 - DNA, 22 bp, Homo sapiens
tgggggagtatagtctggcctc

SEQ ID NO: 8288733 - DNA, 22 bp, Homo sapiens
tggggcacttatgatgtgccac

SEQ ID NO: 8288734 - DNA, 22 bp, Homo sapiens
tggggacaggagacttacagct

SEQ ID NO: 8288735 - DNA, 22 bp, Homo sapiens
tggggaggatatgtgagttatt

SEQ ID NO: 8288736 - DNA, 23 bp, Homo sapiens
tggggagggaagtcatttctgta

SEQ ID NO: 8288737 - DNA, 22 bp, Homo sapiens
tggggcaagaagtgccctgaag

SEQ ID NO: 8288738 - DNA, 22 bp, Homo sapiens
tggggcaaagtaggtatttagt

SEQ ID NO: 8288739 - DNA, 22 bp, Homo sapiens
tggggaaggcggagcttgcagc

SEQ ID NO: 8288740 - DNA, 22 bp, Homo sapiens
tggggaagaataatgtatgtac

SEQ ID NO: 8288741 - DNA, 22 bp, Homo sapiens
tggggaagcactttgaacttaa

SEQ ID NO: 8288742 - DNA, 22 bp, Homo sapiens
tggggaaagatagttttctcta

SEQ ID NO: 8288743 - DNA, 22 bp, Homo sapiens
tgggctggcgtggagagtttag

SEQ ID NO: 8288744 - DNA, 22 bp, Homo sapiens
tgggtctccagttcagggcagg

SEQ ID NO: 8288745 - DNA, 23 bp, Homo sapiens
tgggtctctagtacaggcaggca

SEQ ID NO: 8288746 - DNA, 22 bp, Homo sapiens
tgggtccagtgtcctggctatg

SEQ ID NO: 8288747 - DNA, 22 bp, Homo sapiens
tgggtagcagggctgagctgtg

SEQ ID NO: 8288748 - DNA, 22 bp, Homo sapiens
tgggtagagcaggctggggctt

SEQ ID NO: 8288749 - DNA, 22 bp, Homo sapiens
tgggtagaaacaaggctggact

SEQ ID NO: 8288750 - DNA, 22 bp, Homo sapiens
tgggtactcctattagttcagt

SEQ ID NO: 8288751 - DNA, 22 bp, Homo sapiens
tgggggtgactatctcgggaat

SEQ ID NO: 8288752 - DNA, 22 bp, Homo sapiens
tgggggtgaaagtctggacagt

SEQ ID NO: 8288753 - DNA, 22 bp, Homo sapiens
tgggggtgctgagaagacagga

SEQ ID NO: 8288754 - DNA, 22 bp, Homo sapiens
tgggggtgccctatgaggaagc

SEQ ID NO: 8288755 - DNA, 21 bp, Homo sapiens
tgggggtgaggcctaggaatc

SEQ ID NO: 8288756 - DNA, 23 bp, Homo sapiens
tgggttcattcttgaagtcagtg

SEQ ID NO: 8288757 - DNA, 22 bp, Homo sapiens
tggtaagggtattatttcatcc

SEQ ID NO: 8288758 - DNA, 22 bp, Homo sapiens
tggtaaggggtggaaccagagc

SEQ ID NO: 8288759 - DNA, 22 bp, Homo sapiens
tggtaaggcccagctggagtcc

SEQ ID NO: 8288760 - DNA, 22 bp, Homo sapiens
tggtaagggctctctttctggc

SEQ ID NO: 8288761 - DNA, 22 bp, Homo sapiens
tggtaaggacttagttatcaat

SEQ ID NO: 8288762 - DNA, 22 bp, Homo sapiens
tggtaaggattgtagaaacgaa

SEQ ID NO: 8288763 - DNA, 22 bp, Homo sapiens
tggtcaaaagaaagctcagaac

SEQ ID NO: 8288764 - DNA, 22 bp, Homo sapiens
tggtaaggtcttcactcagatt

SEQ ID NO: 8288765 - DNA, 16 bp, Homo sapiens
tggtaaggttaccaga

SEQ ID NO: 8288766 - DNA, 16 bp, Homo sapiens
tggtagtcacttagag

SEQ ID NO: 8288767 - DNA, 22 bp, Homo sapiens
tgggtgagcggctgcacacccg

SEQ ID NO: 8288768 - DNA, 22 bp, Homo sapiens
tgggtgggagcgccctgtctgg

SEQ ID NO: 8288769 - DNA, 22 bp, Homo sapiens
tgggtggttgctgaggctcctt

SEQ ID NO: 8288770 - DNA, 22 bp, Homo sapiens
tgtagaaggctatagactagga

SEQ ID NO: 8288771 - DNA, 22 bp, Homo sapiens
tgtagatacacacatatagtgg

SEQ ID NO: 8288772 - DNA, 23 bp, Homo sapiens
tgtagctttatacaagatctgtt

SEQ ID NO: 8288773 - DNA, 22 bp, Homo sapiens
tgtagctttatattgtgttggg

SEQ ID NO: 8288774 - DNA, 22 bp, Homo sapiens
tgtaggaagatataaaatatct

SEQ ID NO: 8288775 - DNA, 22 bp, Homo sapiens
tgtaggaactcacagatattct

SEQ ID NO: 8288776 - DNA, 22 bp, Homo sapiens
tgtaggaaagttgtgagtctgg

SEQ ID NO: 8288777 - DNA, 22 bp, Homo sapiens
tgtaggaaaaacaatgatctgc

SEQ ID NO: 8288778 - DNA, 20 bp, Homo sapiens
tgtaggaaggaccctgtctg

SEQ ID NO: 8288779 - DNA, 22 bp, Homo sapiens
tgtagcttcagtctgatctcat

SEQ ID NO: 8288780 - DNA, 22 bp, Homo sapiens
tgtagcatgtaaattggttatt

SEQ ID NO: 8288781 - DNA, 22 bp, Homo sapiens
tgtatattgttctgtctcttca

SEQ ID NO: 8288782 - DNA, 22 bp, Homo sapiens
tgtatattgcctgagtctttcc

SEQ ID NO: 8288783 - DNA, 22 bp, Homo sapiens
tgtatgaggcatacatcaggca

SEQ ID NO: 8288784 - DNA, 22 bp, Homo sapiens
tgtatctttctactgtctagtt

SEQ ID NO: 8288785 - DNA, 22 bp, Homo sapiens
tgtataaatttaaattcctgct

SEQ ID NO: 8288786 - DNA, 22 bp, Homo sapiens
tgtcaccatgccagcttctgcc

SEQ ID NO: 8288787 - DNA, 22 bp, Homo sapiens
tgtcaccagctgctcctcagga

SEQ ID NO: 8288788 - DNA, 22 bp, Homo sapiens
tgtatttttagacctttagacc

SEQ ID NO: 8288789 - DNA, 22 bp, Homo sapiens
tgtatttattcttctggtgttt

SEQ ID NO: 8288790 - DNA, 22 bp, Homo sapiens
tgtatttagtccagtctctcat

SEQ ID NO: 8288791 - DNA, 17 bp, Homo sapiens
tgtatttatcatgtcag

SEQ ID NO: 8288792 - DNA, 17 bp, Homo sapiens
tgtatttatcatgtcag

SEQ ID NO: 8288793 - DNA, 22 bp, Homo sapiens
tgtatttattcaggatgtaact

SEQ ID NO: 8288794 - DNA, 18 bp, Homo sapiens
tgtatttctaacagctaa

SEQ ID NO: 8288795 - DNA, 22 bp, Homo sapiens
tgtatttgaaacagtgcatggg

SEQ ID NO: 8288796 - DNA, 22 bp, Homo sapiens
tgtatttgagttatgaaagaga

SEQ ID NO: 8288797 - DNA, 22 bp, Homo sapiens
tgtatttgggtcacaagatggg

SEQ ID NO: 8288798 - DNA, 22 bp, Homo sapiens
tgtatttggtgtatttaatgag

SEQ ID NO: 8288799 - DNA, 22 bp, Homo sapiens
tgtatttgttgttaaatggaga

SEQ ID NO: 8288800 - DNA, 22 bp, Homo sapiens
tgtattttctgaagataatcaa

SEQ ID NO: 8288801 - DNA, 22 bp, Homo sapiens
tgtattttgagtccaatctcct

SEQ ID NO: 8288802 - DNA, 22 bp, Homo sapiens
tgtattttctgaagataatcaa

SEQ ID NO: 8288803 - DNA, 22 bp, Homo sapiens
tgtatttatattagaatggttg

SEQ ID NO: 8288804 - DNA, 20 bp, Homo sapiens
tgtatttaatgaaggctttt

SEQ ID NO: 8288805 - DNA, 22 bp, Homo sapiens
tgtatttaattgtatcatcaca

SEQ ID NO: 8288806 - DNA, 22 bp, Homo sapiens
tgtatttaagctttacctaaaa

SEQ ID NO: 8288807 - DNA, 20 bp, Homo sapiens
tgtatttaatgaaggctttt

SEQ ID NO: 8288808 - DNA, 20 bp, Homo sapiens
tgtattctttgctctccact

SEQ ID NO: 8288809 - DNA, 22 bp, Homo sapiens
tgtattgtaagtggttatatgc

SEQ ID NO: 8288810 - DNA, 22 bp, Homo sapiens
tgtcctgttctggcgtgagtgg

SEQ ID NO: 8288811 - DNA, 22 bp, Homo sapiens
tgtcctgttcttgctgtgtcct

SEQ ID NO: 8288812 - DNA, 22 bp, Homo sapiens
tgtcctgttatatgttgggtag

SEQ ID NO: 8288813 - DNA, 22 bp, Homo sapiens
tgtcctgtacgaagccggagaa

SEQ ID NO: 8288814 - DNA, 19 bp, Homo sapiens
tgtcctgtcctgctctgac

SEQ ID NO: 8288815 - DNA, 22 bp, Homo sapiens
tgtccaggcactgggactctag

SEQ ID NO: 8288816 - DNA, 22 bp, Homo sapiens
tgtccaggtggcctctgctgct

SEQ ID NO: 8288817 - DNA, 20 bp, Homo sapiens
tgtccaggggatcgttggcc

SEQ ID NO: 8288818 - DNA, 22 bp, Homo sapiens
tgtccaggtcagcagcagggac

SEQ ID NO: 8288819 - DNA, 22 bp, Homo sapiens
tgtcccagtttatctgggactg

SEQ ID NO: 8288820 - DNA, 22 bp, Homo sapiens
tgtcccagttgggtattgaatt

SEQ ID NO: 8288821 - DNA, 22 bp, Homo sapiens
tgtcccagtttatctgggactg

SEQ ID NO: 8288822 - DNA, 22 bp, Homo sapiens
tgtcccagttcccagggttgct

SEQ ID NO: 8288823 - DNA, 22 bp, Homo sapiens
tgtccctttgtgttctgaaact

SEQ ID NO: 8288824 - DNA, 22 bp, Homo sapiens
tgtccctggactccaggagcca

SEQ ID NO: 8288825 - DNA, 22 bp, Homo sapiens
tgtccccagagcctgttcctgc

SEQ ID NO: 8288826 - DNA, 22 bp, Homo sapiens
tgtccccagcactcactctcca

SEQ ID NO: 8288827 - DNA, 22 bp, Homo sapiens
tgtcccctttctttccttcgta

SEQ ID NO: 8288828 - DNA, 22 bp, Homo sapiens
tgtccctaaagaaacagacatt

SEQ ID NO: 8288829 - DNA, 22 bp, Homo sapiens
tgtccccaggtcctctgccgtc

SEQ ID NO: 8288830 - DNA, 22 bp, Homo sapiens
tgtccccattctaagaggtggc

SEQ ID NO: 8288831 - DNA, 20 bp, Homo sapiens
tgtcccctagatcccagctc

SEQ ID NO: 8288832 - DNA, 22 bp, Homo sapiens
tgtcaggagggtccagagaaaa

SEQ ID NO: 8288833 - DNA, 22 bp, Homo sapiens
tgtcactttttataggtgttga

SEQ ID NO: 8288834 - DNA, 22 bp, Homo sapiens
tgtcactcgctcagtccctgtg

SEQ ID NO: 8288835 - DNA, 22 bp, Homo sapiens
tgtcagtgatttgtagggaatt

SEQ ID NO: 8288836 - DNA, 22 bp, Homo sapiens
tgtcagtgctatagtgggaata

SEQ ID NO: 8288837 - DNA, 22 bp, Homo sapiens
tgtcatagtgtggtagcagtgg

SEQ ID NO: 8288838 - DNA, 22 bp, Homo sapiens
tgtcatagtgtggtagcagtgg

SEQ ID NO: 8288839 - DNA, 22 bp, Homo sapiens
tgtcatttattttgctgtctgt

SEQ ID NO: 8288840 - DNA, 22 bp, Homo sapiens
tgtcatttaaagctttccagat

SEQ ID NO: 8288841 - DNA, 22 bp, Homo sapiens
tgtcatttatcttatagtaatc

SEQ ID NO: 8288842 - DNA, 22 bp, Homo sapiens
tggtggaattgtaaaatagtgt

SEQ ID NO: 8288843 - DNA, 22 bp, Homo sapiens
tggtgccattagccctgctgtt

SEQ ID NO: 8288844 - DNA, 22 bp, Homo sapiens
tggtgcaggccaagctgcgagc

SEQ ID NO: 8288845 - DNA, 22 bp, Homo sapiens
tggtgggcacagtgcccaggct

SEQ ID NO: 8288846 - DNA, 22 bp, Homo sapiens
tggtgggagtgagggcatgcca

SEQ ID NO: 8288847 - DNA, 22 bp, Homo sapiens
tggtctctgcaggccaggctca

SEQ ID NO: 8288848 - DNA, 22 bp, Homo sapiens
tggtcctgtgttcttcctgcct

SEQ ID NO: 8288849 - DNA, 22 bp, Homo sapiens
tggtcctgtagcacttgattag

SEQ ID NO: 8288850 - DNA, 22 bp, Homo sapiens
tggtgaggccaaagccatgaca

SEQ ID NO: 8288851 - DNA, 22 bp, Homo sapiens
tggtgaggccaaagccatgaca

SEQ ID NO: 8288852 - DNA, 22 bp, Homo sapiens
tggtgacagcatggaagaagtg

SEQ ID NO: 8288853 - DNA, 22 bp, Homo sapiens
tggtcctggaaggtcctgaggg

SEQ ID NO: 8288854 - DNA, 22 bp, Homo sapiens
tggtcctggagagtgttccata

SEQ ID NO: 8288855 - DNA, 22 bp, Homo sapiens
tggtccagggtgtagtacagag

SEQ ID NO: 8288856 - DNA, 22 bp, Homo sapiens
tggtccagggtgtagtacagag

SEQ ID NO: 8288857 - DNA, 20 bp, Homo sapiens
tggtccaggacctggtgtcc

SEQ ID NO: 8288858 - DNA, 22 bp, Homo sapiens
tggtcctgaggcttgtttccac

SEQ ID NO: 8288859 - DNA, 22 bp, Homo sapiens
tggtccaagtgaggtggcctct

SEQ ID NO: 8288860 - DNA, 22 bp, Homo sapiens
tggtcagttgtgactagaacac

SEQ ID NO: 8288861 - DNA, 22 bp, Homo sapiens
tggtcagtgtgacattttttaa

SEQ ID NO: 8288862 - DNA, 22 bp, Homo sapiens
tggtcacccactgggactgcgg

SEQ ID NO: 8288863 - DNA, 23 bp, Homo sapiens
tggtggttgatctggggcacagc

SEQ ID NO: 8288864 - DNA, 22 bp, Homo sapiens
tggtgttgaacctcagcagggg

SEQ ID NO: 8288865 - DNA, 21 bp, Homo sapiens
tggtgttgacatcaagttata

SEQ ID NO: 8288866 - DNA, 22 bp, Homo sapiens
tggtgttgcaaataaagtccaa

SEQ ID NO: 8288867 - DNA, 22 bp, Homo sapiens
tggtgttggagatggttgcatt

SEQ ID NO: 8288868 - DNA, 22 bp, Homo sapiens
tggttctaaaggactatacaga

SEQ ID NO: 8288869 - DNA, 23 bp, Homo sapiens
tggttctaggcctataattatat

SEQ ID NO: 8288870 - DNA, 22 bp, Homo sapiens
tggttacacaagtgtgtgcagt

SEQ ID NO: 8288871 - DNA, 21 bp, Homo sapiens
tggtttctaagctgtcagtct

SEQ ID NO: 8288872 - DNA, 22 bp, Homo sapiens
tggtttctcagactctttgcag

SEQ ID NO: 8288873 - DNA, 22 bp, Homo sapiens
tggttttctggtggtggcagtg

SEQ ID NO: 8288874 - DNA, 17 bp, Homo sapiens
tggttttgtttaaaggc

SEQ ID NO: 8288875 - DNA, 22 bp, Homo sapiens
tgtaaaagacatttctaagcaa

SEQ ID NO: 8288876 - DNA, 22 bp, Homo sapiens
tgtaaaataccattccttgtca

SEQ ID NO: 8288877 - DNA, 23 bp, Homo sapiens
tgtaaaagcatttgtcagcctgg

SEQ ID NO: 8288878 - DNA, 22 bp, Homo sapiens
tgtaaaaggaaatcaaagcact

SEQ ID NO: 8288879 - DNA, 22 bp, Homo sapiens
tgtaaaaggttgttctttcgtt

SEQ ID NO: 8288880 - DNA, 22 bp, Homo sapiens
tgtaaaagacatttctaagcaa

SEQ ID NO: 8288881 - DNA, 23 bp, Homo sapiens
tgtaacaatttcatatacatgca

SEQ ID NO: 8288882 - DNA, 17 bp, Homo sapiens
tgtaacaactcctatta

SEQ ID NO: 8288883 - DNA, 23 bp, Homo sapiens
tgtaaattttgtagtcacatttt

SEQ ID NO: 8288884 - DNA, 22 bp, Homo sapiens
tgtaaattgtcacctaaatgct

SEQ ID NO: 8288885 - DNA, 22 bp, Homo sapiens
tgtaattttctcaagtttctac

SEQ ID NO: 8288886 - DNA, 22 bp, Homo sapiens
tgtacaaagagtatagctttga

SEQ ID NO: 8288887 - DNA, 22 bp, Homo sapiens
tgtacaaagccagaactcccaa

SEQ ID NO: 8288888 - DNA, 22 bp, Homo sapiens
tgtaactggacaagatattcat

SEQ ID NO: 8288889 - DNA, 22 bp, Homo sapiens
tgtaccaggccctgtggacatg

SEQ ID NO: 8288890 - DNA, 22 bp, Homo sapiens
tgtaccaggtgatggagtcata

SEQ ID NO: 8288891 - DNA, 23 bp, Homo sapiens
tgtaccaggagtttcagcagact

SEQ ID NO: 8288892 - DNA, 22 bp, Homo sapiens
tgtacagtcatgctttctgttc

SEQ ID NO: 8288893 - DNA, 22 bp, Homo sapiens
tgtacagtattggtgttagtag

SEQ ID NO: 8288894 - DNA, 22 bp, Homo sapiens
tgtaccagtgttgagaatgaga

SEQ ID NO: 8288895 - DNA, 22 bp, Homo sapiens
tgtacagtaggaacttgttatt

SEQ ID NO: 8288896 - DNA, 22 bp, Homo sapiens
tgtacagtatatttcaaagcca

SEQ ID NO: 8288897 - DNA, 22 bp, Homo sapiens
tgtacagtacatgtgtagtgat

SEQ ID NO: 8288898 - DNA, 22 bp, Homo sapiens
tgtacacatttttatgttaaca

SEQ ID NO: 8288899 - DNA, 22 bp, Homo sapiens
tgtacacatgcccacttgaagc

SEQ ID NO: 8288900 - DNA, 22 bp, Homo sapiens
tgtacacatatcatttgtggga

SEQ ID NO: 8288901 - DNA, 22 bp, Homo sapiens
tgtacacataccactgagtgaa

SEQ ID NO: 8288902 - DNA, 20 bp, Homo sapiens
tgtacacagtactttacaat

SEQ ID NO: 8288903 - DNA, 22 bp, Homo sapiens
tgtacaagcaaatagaccttca

SEQ ID NO: 8288904 - DNA, 22 bp, Homo sapiens
tgtacaaattcattgaactgta

SEQ ID NO: 8288905 - DNA, 22 bp, Homo sapiens
tgtacaaattcagttctagggt

SEQ ID NO: 8288906 - DNA, 22 bp, Homo sapiens
tgtacaatagctattatctcca

SEQ ID NO: 8288907 - DNA, 22 bp, Homo sapiens
tgtacaagttgcctgctatctc

SEQ ID NO: 8288908 - DNA, 22 bp, Homo sapiens
tgtacaagtgaaagatgtgggc

SEQ ID NO: 8288909 - DNA, 22 bp, Homo sapiens
tgctcagacaagctgaacagta

SEQ ID NO: 8288910 - DNA, 22 bp, Homo sapiens
tgctcacattaggcatccatgg

SEQ ID NO: 8288911 - DNA, 22 bp, Homo sapiens
tgctcacagcccagaacataat

SEQ ID NO: 8288912 - DNA, 22 bp, Homo sapiens
tgctcacactcatgtccacgct

SEQ ID NO: 8288913 - DNA, 22 bp, Homo sapiens
tgctccagaaaaacttgagact

SEQ ID NO: 8288914 - DNA, 22 bp, Homo sapiens
tgctccagaacctgaccatgct

SEQ ID NO: 8288915 - DNA, 22 bp, Homo sapiens
tgctccagcaacaggcttagct

SEQ ID NO: 8288916 - DNA, 22 bp, Homo sapiens
tgctccagcaacaggcttagct

SEQ ID NO: 8288917 - DNA, 22 bp, Homo sapiens
tgctcagtgagtctgtgacagg

SEQ ID NO: 8288918 - DNA, 22 bp, Homo sapiens
tgctcatgctggggacagatgt

SEQ ID NO: 8288919 - DNA, 22 bp, Homo sapiens
tgctcatgatgccttttaaaag

SEQ ID NO: 8288920 - DNA, 22 bp, Homo sapiens
tgctatgtccagcacagagtgg

SEQ ID NO: 8288921 - DNA, 22 bp, Homo sapiens
tgcctgggtgccctctgctcct

SEQ ID NO: 8288922 - DNA, 22 bp, Homo sapiens
tgcctggtatttgaataaagag

SEQ ID NO: 8288923 - DNA, 22 bp, Homo sapiens
tgcctgtctcctctgcagggtg

SEQ ID NO: 8288924 - DNA, 22 bp, Homo sapiens
tgcctgtcttggagtcctggcc

SEQ ID NO: 8288925 - DNA, 19 bp, Homo sapiens
tgcctgtggcgagcatctt

SEQ ID NO: 8288926 - DNA, 22 bp, Homo sapiens
tgcctgtggaaaggctggtgct

SEQ ID NO: 8288927 - DNA, 22 bp, Homo sapiens
tgcctgtgcccttcttggcatt

SEQ ID NO: 8288928 - DNA, 22 bp, Homo sapiens
tgccttcttctccctggctcag

SEQ ID NO: 8288929 - DNA, 22 bp, Homo sapiens
tgccttcttgaatatggttctt

SEQ ID NO: 8288930 - DNA, 22 bp, Homo sapiens
tgctgaggaaaaatgtgactct

SEQ ID NO: 8288931 - DNA, 22 bp, Homo sapiens
tgctgagcgcatccggcggccg

SEQ ID NO: 8288932 - DNA, 22 bp, Homo sapiens
tgctgagcgcatccggcggccg

SEQ ID NO: 8288933 - DNA, 22 bp, Homo sapiens
tgctgaggaggtggctgtgctt

SEQ ID NO: 8288934 - DNA, 19 bp, Homo sapiens
tgctgaggatgcaagatcc

SEQ ID NO: 8288935 - DNA, 22 bp, Homo sapiens
tgctgaggaggtggctgtgctt

SEQ ID NO: 8288936 - DNA, 22 bp, Homo sapiens
tgctgaggagggcacccggggg

SEQ ID NO: 8288937 - DNA, 22 bp, Homo sapiens
tgctgaggaaaaatgtgactct

SEQ ID NO: 8288938 - DNA, 22 bp, Homo sapiens
tgctgaggaataattgttcctg

SEQ ID NO: 8288939 - DNA, 22 bp, Homo sapiens
tgctgaggacacctagccttct

SEQ ID NO: 8288940 - DNA, 22 bp, Homo sapiens
tgctgaggacacctagccttct

SEQ ID NO: 8288941 - DNA, 22 bp, Homo sapiens
tgctgagtctgaaacagctcag

SEQ ID NO: 8288942 - DNA, 22 bp, Homo sapiens
tgctgaggttgtggagtgcatt

SEQ ID NO: 8288943 - DNA, 22 bp, Homo sapiens
tgctgaggttgtggagtgcatt

SEQ ID NO: 8288944 - DNA, 22 bp, Homo sapiens
tgctgaggtttctgactatgga

SEQ ID NO: 8288945 - DNA, 22 bp, Homo sapiens
tgctgaggtttcgtctgcttgc

SEQ ID NO: 8288946 - DNA, 22 bp, Homo sapiens
tgctgagtacactaaagaacat

SEQ ID NO: 8288947 - DNA, 22 bp, Homo sapiens
tgctgaggcccaggagcacttt

SEQ ID NO: 8288948 - DNA, 20 bp, Homo sapiens
tgctgaggcctgaggcctgg

SEQ ID NO: 8288949 - DNA, 22 bp, Homo sapiens
tgctgaggcatttggacagagt

SEQ ID NO: 8288950 - DNA, 22 bp, Homo sapiens
tgctgaggcagtcctaacagga

SEQ ID NO: 8288951 - DNA, 22 bp, Homo sapiens
tgctgaggcagatgtctgtgac

SEQ ID NO: 8288952 - DNA, 22 bp, Homo sapiens
tgctgaggcagatgtctgtgac

SEQ ID NO: 8288953 - DNA, 22 bp, Homo sapiens
tgctgaggtcaccttgctgcta

SEQ ID NO: 8288954 - DNA, 22 bp, Homo sapiens
tgctgaggtcacggcggccaga

SEQ ID NO: 8288955 - DNA, 22 bp, Homo sapiens
tgctgaggtcaccttgctgcta

SEQ ID NO: 8288956 - DNA, 20 bp, Homo sapiens
tgctgaggttgacatgccca

SEQ ID NO: 8288957 - DNA, 20 bp, Homo sapiens
tgctgaggttgacatgccca

SEQ ID NO: 8288958 - DNA, 22 bp, Homo sapiens
tgctgaggtcatttccaagtga

SEQ ID NO: 8288959 - DNA, 22 bp, Homo sapiens
tgctgagggagcatcaaagaaa

SEQ ID NO: 8288960 - DNA, 22 bp, Homo sapiens
tgctgagggaggggttttccag

SEQ ID NO: 8288961 - DNA, 22 bp, Homo sapiens
tgctgagggagcatcaaagaaa

SEQ ID NO: 8288962 - DNA, 21 bp, Homo sapiens
tgctcctttaccccacaagac

SEQ ID NO: 8288963 - DNA, 22 bp, Homo sapiens
tgctcctgggctgaagcacact

SEQ ID NO: 8288964 - DNA, 22 bp, Homo sapiens
tgctctgggctcaatggcagct

SEQ ID NO: 8288965 - DNA, 22 bp, Homo sapiens
tgctctggctgggatgagtgca

SEQ ID NO: 8288966 - DNA, 22 bp, Homo sapiens
tgctctggctggagcaatgact

SEQ ID NO: 8288967 - DNA, 22 bp, Homo sapiens
tgctctcctgctcctcagccca

SEQ ID NO: 8288968 - DNA, 22 bp, Homo sapiens
tgctctccggcttccgtggcct

SEQ ID NO: 8288969 - DNA, 22 bp, Homo sapiens
tgctcccaggcattctctgttg

SEQ ID NO: 8288970 - DNA, 22 bp, Homo sapiens
tgctccagggcctccagtgggg

SEQ ID NO: 8288971 - DNA, 22 bp, Homo sapiens
tgctccagggcctccagtgggg

SEQ ID NO: 8288972 - DNA, 22 bp, Homo sapiens
tgctccctgctcagagaggcca

SEQ ID NO: 8288973 - DNA, 22 bp, Homo sapiens
tgctcccatgtgtgggtacaga

SEQ ID NO: 8288974 - DNA, 22 bp, Homo sapiens
tgctcccagggactctggctgg

SEQ ID NO: 8288975 - DNA, 23 bp, Homo sapiens
tgctcccaggtgacgctgctgtt

SEQ ID NO: 8288976 - DNA, 22 bp, Homo sapiens
tgctcccttgccagaggggaag

SEQ ID NO: 8288977 - DNA, 22 bp, Homo sapiens
tgctcctgagcggtttccatga

SEQ ID NO: 8288978 - DNA, 18 bp, Homo sapiens
tgctccaggcccatgggc

SEQ ID NO: 8288979 - DNA, 18 bp, Homo sapiens
tgctccaggcccatgggc

SEQ ID NO: 8288980 - DNA, 22 bp, Homo sapiens
tgctccaggagcactttccatt

SEQ ID NO: 8288981 - DNA, 22 bp, Homo sapiens
tgctccaggctgctgaagatct

SEQ ID NO: 8288982 - DNA, 21 bp, Homo sapiens
tgctccagggcagcttccagc

SEQ ID NO: 8288983 - DNA, 19 bp, Homo sapiens
tgctccaggccttgccgca

SEQ ID NO: 8288984 - DNA, 20 bp, Homo sapiens
tgctccaggaacactggccg

SEQ ID NO: 8288985 - DNA, 20 bp, Homo sapiens
tgctccaggaacactggccg

SEQ ID NO: 8288986 - DNA, 22 bp, Homo sapiens
tgctccaggagcaacctttgag

SEQ ID NO: 8288987 - DNA, 20 bp, Homo sapiens
tgctccaggaacactggccg

SEQ ID NO: 8288988 - DNA, 22 bp, Homo sapiens
tgctccagcgctgccaccagtt

SEQ ID NO: 8288989 - DNA, 23 bp, Homo sapiens
tgctccagcctctttgatagtgt

SEQ ID NO: 8288990 - DNA, 22 bp, Homo sapiens
tgctccagcctatgctctccgg

SEQ ID NO: 8288991 - DNA, 22 bp, Homo sapiens
tgctccagcatgaccctcaatg

SEQ ID NO: 8288992 - DNA, 22 bp, Homo sapiens
tgctgggtggttgctcctcccg

SEQ ID NO: 8288993 - DNA, 22 bp, Homo sapiens
tgctgggtagaagtattagtct

SEQ ID NO: 8288994 - DNA, 21 bp, Homo sapiens
tgctgggctgcaggggatgca

SEQ ID NO: 8288995 - DNA, 22 bp, Homo sapiens
tgctgggctggagctgccaggg

SEQ ID NO: 8288996 - DNA, 22 bp, Homo sapiens
tgctgggcttgaaagctgctaa

SEQ ID NO: 8288997 - DNA, 22 bp, Homo sapiens
tgctgggcttcaactgcctgag

SEQ ID NO: 8288998 - DNA, 22 bp, Homo sapiens
tgctgggctagaagctgaggcc

SEQ ID NO: 8288999 - DNA, 22 bp, Homo sapiens
tgctgggctagggtggagctct

SEQ ID NO: 8289000 - DNA, 22 bp, Homo sapiens
tgctgggcctttacctccaggg

SEQ ID NO: 8289001 - DNA, 22 bp, Homo sapiens
tgctggcttcctgtgcacagca

SEQ ID NO: 8289002 - DNA, 23 bp, Homo sapiens
tgctgggcagagctggtgctgag

SEQ ID NO: 8289003 - DNA, 22 bp, Homo sapiens
tgctgggcatttatgcagatgg

SEQ ID NO: 8289004 - DNA, 23 bp, Homo sapiens
tgcttctctgcttgacagttctg

SEQ ID NO: 8289005 - DNA, 22 bp, Homo sapiens
tgcttctctctaggaagacgct

SEQ ID NO: 8289006 - DNA, 22 bp, Homo sapiens
tgcttctcccaaccagggcctg

SEQ ID NO: 8289007 - DNA, 22 bp, Homo sapiens
tgcttctcaaaaggaggtaggt

SEQ ID NO: 8289008 - DNA, 22 bp, Homo sapiens
tgcttctcaaagaagcataatg

SEQ ID NO: 8289009 - DNA, 22 bp, Homo sapiens
tgcttctcagcctgtctggaaa

SEQ ID NO: 8289010 - DNA, 22 bp, Homo sapiens
tgcttatttatagtcaatagag

SEQ ID NO: 8289011 - DNA, 22 bp, Homo sapiens
tgctgtgaggttgagaaggaag

SEQ ID NO: 8289012 - DNA, 22 bp, Homo sapiens
tgctgtgagaccatttgttgag

SEQ ID NO: 8289013 - DNA, 22 bp, Homo sapiens
tgctgtgataattcaatgagct

SEQ ID NO: 8289014 - DNA, 22 bp, Homo sapiens
tgctgtctgtttactggctata

SEQ ID NO: 8289015 - DNA, 22 bp, Homo sapiens
tgcttaaaccctgatcatgtgt

SEQ ID NO: 8289016 - DNA, 22 bp, Homo sapiens
tgctggaattatagaaaaatag

SEQ ID NO: 8289017 - DNA, 22 bp, Homo sapiens
tgctggaaagagagtttcaatg

SEQ ID NO: 8289018 - DNA, 22 bp, Homo sapiens
tgctgcctccttcctgccagga

SEQ ID NO: 8289019 - DNA, 20 bp, Homo sapiens
tgctgcctactaagccctca

SEQ ID NO: 8289020 - DNA, 22 bp, Homo sapiens
tgctggcagccatgccttggaa

SEQ ID NO: 8289021 - DNA, 22 bp, Homo sapiens
tgctggcatgcatgctgtagga

SEQ ID NO: 8289022 - DNA, 22 bp, Homo sapiens
tgctggctccaacctggcatct

SEQ ID NO: 8289023 - DNA, 22 bp, Homo sapiens
tgctggctactgatggcaggcc

SEQ ID NO: 8289024 - DNA, 21 bp, Homo sapiens
tgctggctgaaaggcacagag

SEQ ID NO: 8289025 - DNA, 22 bp, Homo sapiens
tgctggctgccaggttccctgt

SEQ ID NO: 8289026 - DNA, 22 bp, Homo sapiens
tgctggctgcagtgctgtcaaa

SEQ ID NO: 8289027 - DNA, 22 bp, Homo sapiens
tgctggctgcagtgctgtcaaa

SEQ ID NO: 8289028 - DNA, 22 bp, Homo sapiens
tgctggctgtatatgtgagagt

SEQ ID NO: 8289029 - DNA, 22 bp, Homo sapiens
tgctggcttagatatcactgcc

SEQ ID NO: 8289030 - DNA, 22 bp, Homo sapiens
tgctggcttatttagtaaatgt

SEQ ID NO: 8289031 - DNA, 23 bp, Homo sapiens
tgctggcttccagctgctccctc

SEQ ID NO: 8289032 - DNA, 22 bp, Homo sapiens
tgctggctgtccctacctggct

SEQ ID NO: 8289033 - DNA, 21 bp, Homo sapiens
tggaaatggaatactttggat

SEQ ID NO: 8289034 - DNA, 21 bp, Homo sapiens
tggaaatgagcgttcagcttt

SEQ ID NO: 8289035 - DNA, 23 bp, Homo sapiens
tggaaatctgggtgaggacagaa

SEQ ID NO: 8289036 - DNA, 22 bp, Homo sapiens
tggaagaaaattcaatcgagtt

SEQ ID NO: 8289037 - DNA, 22 bp, Homo sapiens
tggaaatttattcatcattcat

SEQ ID NO: 8289038 - DNA, 22 bp, Homo sapiens
tggaaattttgaacagtttcta

SEQ ID NO: 8289039 - DNA, 22 bp, Homo sapiens
tggaaattactaacacttagag

SEQ ID NO: 8289040 - DNA, 22 bp, Homo sapiens
tggaaacagatcataactaagc

SEQ ID NO: 8289041 - DNA, 22 bp, Homo sapiens
tggaaagatgaagatgtttaag

SEQ ID NO: 8289042 - DNA, 22 bp, Homo sapiens
tggaaagagatgttgtttctga

SEQ ID NO: 8289043 - DNA, 17 bp, Homo sapiens
tggaaacaaaacttatt

SEQ ID NO: 8289044 - DNA, 22 bp, Homo sapiens
tggaaaaaaattggctagcttc

SEQ ID NO: 8289045 - DNA, 22 bp, Homo sapiens
tggaaaaaaattggctagcttc

SEQ ID NO: 8289046 - DNA, 22 bp, Homo sapiens
tggaaaaactgagacttagaca

SEQ ID NO: 8289047 - DNA, 21 bp, Homo sapiens
tggaaaaatgtggcctagtga

SEQ ID NO: 8289048 - DNA, 22 bp, Homo sapiens
tgctttgctttggagagccagc

SEQ ID NO: 8289049 - DNA, 19 bp, Homo sapiens
tgctttgctcttggactca

SEQ ID NO: 8289050 - DNA, 22 bp, Homo sapiens
tgctttgctggcactcctggct

SEQ ID NO: 8289051 - DNA, 18 bp, Homo sapiens
tgctttctagcttcagat

SEQ ID NO: 8289052 - DNA, 22 bp, Homo sapiens
tgctttctgtttttcatataat

SEQ ID NO: 8289053 - DNA, 22 bp, Homo sapiens
tgctttctttagctcctgagtc

SEQ ID NO: 8289054 - DNA, 22 bp, Homo sapiens
tgctttgcaaaagaacatagtg

SEQ ID NO: 8289055 - DNA, 22 bp, Homo sapiens
tgctttgcactgactccttcct

SEQ ID NO: 8289056 - DNA, 22 bp, Homo sapiens
tgctttgcaaataatagaatgt

SEQ ID NO: 8289057 - DNA, 22 bp, Homo sapiens
tgctttgcacatagaagctcag

SEQ ID NO: 8289058 - DNA, 22 bp, Homo sapiens
tgctttgcaggaaccctaagca

SEQ ID NO: 8289059 - DNA, 21 bp, Homo sapiens
tgctttgcaggtggatttagt

SEQ ID NO: 8289060 - DNA, 22 bp, Homo sapiens
tgctttgcagtgtctaacagaa

SEQ ID NO: 8289061 - DNA, 21 bp, Homo sapiens
tgctttgctcgttcccagagt

SEQ ID NO: 8289062 - DNA, 22 bp, Homo sapiens
tgctttgctctcactgtaaggt

SEQ ID NO: 8289063 - DNA, 22 bp, Homo sapiens
tgctttgctctgtctctagcta

SEQ ID NO: 8289064 - DNA, 23 bp, Homo sapiens
tgctttgccagagcaaaagtcta

SEQ ID NO: 8289065 - DNA, 22 bp, Homo sapiens
tgctttgcctgctttgactcat

SEQ ID NO: 8289066 - DNA, 19 bp, Homo sapiens
tgctttgccttgattagct

SEQ ID NO: 8289067 - DNA, 19 bp, Homo sapiens
tgctttgcatctgattgtt

SEQ ID NO: 8289068 - DNA, 22 bp, Homo sapiens
tgctttgccagacagttccctt

SEQ ID NO: 8289069 - DNA, 19 bp, Homo sapiens
tgctttctaaacacatgca

SEQ ID NO: 8289070 - DNA, 22 bp, Homo sapiens
tgcttgacttagtttctcattt

SEQ ID NO: 8289071 - DNA, 22 bp, Homo sapiens
tgcttgttcatggcctagtggc

SEQ ID NO: 8289072 - DNA, 22 bp, Homo sapiens
tgctttaagagattgttagtac

SEQ ID NO: 8289073 - DNA, 22 bp, Homo sapiens
tgctttaacataagatatcttt

SEQ ID NO: 8289074 - DNA, 22 bp, Homo sapiens
tgcttctgggtaggcctcagga

SEQ ID NO: 8289075 - DNA, 22 bp, Homo sapiens
tgcttctggggacaggctgcct

SEQ ID NO: 8289076 - DNA, 22 bp, Homo sapiens
tggacaggatctgagactgaga

SEQ ID NO: 8289077 - DNA, 22 bp, Homo sapiens
tggacaggcaagcaagacatac

SEQ ID NO: 8289078 - DNA, 22 bp, Homo sapiens
tggacaggatagtgcagtacgc

SEQ ID NO: 8289079 - DNA, 23 bp, Homo sapiens
tggacaggacccccttcggaccc

SEQ ID NO: 8289080 - DNA, 22 bp, Homo sapiens
tggaatgcatggctctgtgacg

SEQ ID NO: 8289081 - DNA, 22 bp, Homo sapiens
tggaatgcagtgggagcttacc

SEQ ID NO: 8289082 - DNA, 22 bp, Homo sapiens
tggaatgatctgatgtatttta

SEQ ID NO: 8289083 - DNA, 22 bp, Homo sapiens
tggaatgaagacatgttgtttg

SEQ ID NO: 8289084 - DNA, 22 bp, Homo sapiens
tggaattctgaacagctcagtt

SEQ ID NO: 8289085 - DNA, 22 bp, Homo sapiens
tggaattcttattctgacttca

SEQ ID NO: 8289086 - DNA, 22 bp, Homo sapiens
tggaattcccaagtaactttta

SEQ ID NO: 8289087 - DNA, 22 bp, Homo sapiens
tggacaggtgagtgactcaggg

SEQ ID NO: 8289088 - DNA, 22 bp, Homo sapiens
tggacagggcagagaccgagtc

SEQ ID NO: 8289089 - DNA, 20 bp, Homo sapiens
tggacaggggcataggttgc

SEQ ID NO: 8289090 - DNA, 20 bp, Homo sapiens
tggacaggggcataggttgc

SEQ ID NO: 8289091 - DNA, 22 bp, Homo sapiens
tggacaggctcctaggggttcc

SEQ ID NO: 8289092 - DNA, 23 bp, Homo sapiens
tggacagggtaactggtggtttt

SEQ ID NO: 8289093 - DNA, 22 bp, Homo sapiens
tggacaggggctgctgttgtca

SEQ ID NO: 8289094 - DNA, 18 bp, Homo sapiens
tggacagggtggagaaaa

SEQ ID NO: 8289095 - DNA, 22 bp, Homo sapiens
tggactctgaactggcactgac

SEQ ID NO: 8289096 - DNA, 22 bp, Homo sapiens
tggactccagtgtctgtgttct

SEQ ID NO: 8289097 - DNA, 22 bp, Homo sapiens
tggaagcagagagctatcacca

SEQ ID NO: 8289098 - DNA, 18 bp, Homo sapiens
tggaagctggcagatttt

SEQ ID NO: 8289099 - DNA, 17 bp, Homo sapiens
tggaagcttcatgttgg

SEQ ID NO: 8289100 - DNA, 22 bp, Homo sapiens
tggaagcttttgagattgttgc

SEQ ID NO: 8289101 - DNA, 22 bp, Homo sapiens
tggaaggaaaggtagcagagaa

SEQ ID NO: 8289102 - DNA, 22 bp, Homo sapiens
tggaagatgaataaagattcta

SEQ ID NO: 8289103 - DNA, 22 bp, Homo sapiens
tggaagatcaaccaggattgac

SEQ ID NO: 8289104 - DNA, 22 bp, Homo sapiens
tggaatactgtaaagaaaaatc

SEQ ID NO: 8289105 - DNA, 22 bp, Homo sapiens
tggaatccaattatcagcatgg

SEQ ID NO: 8289106 - DNA, 21 bp, Homo sapiens
tggaatccccaagaaagcagc

SEQ ID NO: 8289107 - DNA, 22 bp, Homo sapiens
tggaaggaagccaaggaaggtt

SEQ ID NO: 8289108 - DNA, 22 bp, Homo sapiens
tggagcaggacggggagtggta

SEQ ID NO: 8289109 - DNA, 22 bp, Homo sapiens
tggagcaggaagtctatggctg

SEQ ID NO: 8289110 - DNA, 22 bp, Homo sapiens
tggagcagctgaacagagttga

SEQ ID NO: 8289111 - DNA, 18 bp, Homo sapiens
tggagcaggaagcctggc

SEQ ID NO: 8289112 - DNA, 18 bp, Homo sapiens
tggagcaggaagcctggc

SEQ ID NO: 8289113 - DNA, 22 bp, Homo sapiens
tggagcagtggtcctggagatg

SEQ ID NO: 8289114 - DNA, 22 bp, Homo sapiens
tggagcaggtgctcagggtaat

SEQ ID NO: 8289115 - DNA, 22 bp, Homo sapiens
tggagccagaagagccagttca

SEQ ID NO: 8289116 - DNA, 22 bp, Homo sapiens
tggagccagagcgcagcctggg

SEQ ID NO: 8289117 - DNA, 22 bp, Homo sapiens
tggagccagcaggactcagagg

SEQ ID NO: 8289118 - DNA, 22 bp, Homo sapiens
tggagccagcgagccgaggcgg

SEQ ID NO: 8289119 - DNA, 22 bp, Homo sapiens
tggagccagggtagaagcagag

SEQ ID NO: 8289120 - DNA, 22 bp, Homo sapiens
tggagcagccttttctaagcaa

SEQ ID NO: 8289121 - DNA, 22 bp, Homo sapiens
tggagcagccatgatgacagag

SEQ ID NO: 8289122 - DNA, 22 bp, Homo sapiens
tggagcagcacaagaaagggga

SEQ ID NO: 8289123 - DNA, 22 bp, Homo sapiens
tggagcagaggaagaaggcttt

SEQ ID NO: 8289124 - DNA, 22 bp, Homo sapiens
tggagcagaggaagaaggcttt

SEQ ID NO: 8289125 - DNA, 21 bp, Homo sapiens
tggagagtgatttcagtgtgg

SEQ ID NO: 8289126 - DNA, 22 bp, Homo sapiens
tggagagctatttggacctcca

SEQ ID NO: 8289127 - DNA, 22 bp, Homo sapiens
tggagagcaagtcgcagacatg

SEQ ID NO: 8289128 - DNA, 22 bp, Homo sapiens
tggagagaaaaaagacagttct

SEQ ID NO: 8289129 - DNA, 22 bp, Homo sapiens
tggactttcacatagcaaagga

SEQ ID NO: 8289130 - DNA, 22 bp, Homo sapiens
tggagagagtcgggatagtaca

SEQ ID NO: 8289131 - DNA, 22 bp, Homo sapiens
tggagagaagaggcagtgtgct

SEQ ID NO: 8289132 - DNA, 22 bp, Homo sapiens
tggaggcagtcaaatgactgac

SEQ ID NO: 8289133 - DNA, 22 bp, Homo sapiens
tggaggcagtaactgagcaaca

SEQ ID NO: 8289134 - DNA, 22 bp, Homo sapiens
tggaggcaggtggaggagtgaa

SEQ ID NO: 8289135 - DNA, 22 bp, Homo sapiens
tggaggcaggagacagggcaaa

SEQ ID NO: 8289136 - DNA, 18 bp, Homo sapiens
tggaggcagagttctggc

SEQ ID NO: 8289137 - DNA, 22 bp, Homo sapiens
tggaggcaactgaagatgtagt

SEQ ID NO: 8289138 - DNA, 22 bp, Homo sapiens
tggaggcactaaatggccacaa

SEQ ID NO: 8289139 - DNA, 22 bp, Homo sapiens
tggaggagaatttatggtcgaa

SEQ ID NO: 8289140 - DNA, 22 bp, Homo sapiens
tggaggagggctggtgtctgta

SEQ ID NO: 8289141 - DNA, 22 bp, Homo sapiens
tggagctgtcactcagaaccaa

SEQ ID NO: 8289142 - DNA, 22 bp, Homo sapiens
tggagcttgggactcttggtag

SEQ ID NO: 8289143 - DNA, 22 bp, Homo sapiens
tggagttcctttgaaaggctct

SEQ ID NO: 8289144 - DNA, 22 bp, Homo sapiens
tggaggctgtgtgcatgagacc

SEQ ID NO: 8289145 - DNA, 22 bp, Homo sapiens
tggaggctggtttctgctgagg

SEQ ID NO: 8289146 - DNA, 22 bp, Homo sapiens
tggagggatacaaagatgaaaa

SEQ ID NO: 8289147 - DNA, 22 bp, Homo sapiens
tggagggcatagctgttctttc

SEQ ID NO: 8289148 - DNA, 22 bp, Homo sapiens
tggaggtggagttggaaactga

SEQ ID NO: 8289149 - DNA, 22 bp, Homo sapiens
tggctccagatctgtctcctgt

SEQ ID NO: 8289150 - DNA, 22 bp, Homo sapiens
tggctccactctccaggagttt

SEQ ID NO: 8289151 - DNA, 22 bp, Homo sapiens
tggctccactactgggtgtgtt

SEQ ID NO: 8289152 - DNA, 22 bp, Homo sapiens
tggctccagccctgagcaagct

SEQ ID NO: 8289153 - DNA, 22 bp, Homo sapiens
tggctccagatttcctgctgca

SEQ ID NO: 8289154 - DNA, 22 bp, Homo sapiens
tggctccagctcaagtatggca

SEQ ID NO: 8289155 - DNA, 22 bp, Homo sapiens
tggctccacaggccagggtgtg

SEQ ID NO: 8289156 - DNA, 22 bp, Homo sapiens
tggctccaaatcaactgctgtt

SEQ ID NO: 8289157 - DNA, 22 bp, Homo sapiens
tggctccaaaaacaaatgacat

SEQ ID NO: 8289158 - DNA, 22 bp, Homo sapiens
tggctccatgatagttcttaca

SEQ ID NO: 8289159 - DNA, 22 bp, Homo sapiens
tggctccattctttatgagttg

SEQ ID NO: 8289160 - DNA, 22 bp, Homo sapiens
tggctcagtcatggatgagtaa

SEQ ID NO: 8289161 - DNA, 22 bp, Homo sapiens
tggctcagtgacattcctccca

SEQ ID NO: 8289162 - DNA, 22 bp, Homo sapiens
tggctcagtgcattcacagtaa

SEQ ID NO: 8289163 - DNA, 22 bp, Homo sapiens
tggctcaggggtctggctctgt

SEQ ID NO: 8289164 - DNA, 22 bp, Homo sapiens
tggctcagcattcactggtctt

SEQ ID NO: 8289165 - DNA, 22 bp, Homo sapiens
tggctcaggataattttcccaa

SEQ ID NO: 8289166 - DNA, 22 bp, Homo sapiens
tggctcagctttccccatctgg

SEQ ID NO: 8289167 - DNA, 22 bp, Homo sapiens
tggccttgttctctctcccatc

SEQ ID NO: 8289168 - DNA, 22 bp, Homo sapiens
tggcgaggccaggccagggcct

SEQ ID NO: 8289169 - DNA, 22 bp, Homo sapiens
tggccttgtctctcagaaccgc

SEQ ID NO: 8289170 - DNA, 20 bp, Homo sapiens
tggccttggggagctcacac

SEQ ID NO: 8289171 - DNA, 20 bp, Homo sapiens
tggccttggggagctcacac

SEQ ID NO: 8289172 - DNA, 22 bp, Homo sapiens
tggccttgagatgcagcagcca

SEQ ID NO: 8289173 - DNA, 22 bp, Homo sapiens
tggccttgagatgcagcagcca

SEQ ID NO: 8289174 - DNA, 22 bp, Homo sapiens
tggccttggcagtgagaagagt

SEQ ID NO: 8289175 - DNA, 21 bp, Homo sapiens
tggctaaaccctagtaaatta

SEQ ID NO: 8289176 - DNA, 22 bp, Homo sapiens
tggctaaacttgggtcagatgt

SEQ ID NO: 8289177 - DNA, 22 bp, Homo sapiens
tggctaaaccctagtaaattaa

SEQ ID NO: 8289178 - DNA, 22 bp, Homo sapiens
tggctagtccgttagaggcgtg

SEQ ID NO: 8289179 - DNA, 19 bp, Homo sapiens
tggctataattccagagct

SEQ ID NO: 8289180 - DNA, 22 bp, Homo sapiens
tggcggctcaggaggggcagtt

SEQ ID NO: 8289181 - DNA, 22 bp, Homo sapiens
tggctatactctcagttaatac

SEQ ID NO: 8289182 - DNA, 18 bp, Homo sapiens
tggctcagatggctttaa

SEQ ID NO: 8289183 - DNA, 22 bp, Homo sapiens
tggctcagatttttgtaggctt

SEQ ID NO: 8289184 - DNA, 22 bp, Homo sapiens
tggctcagatgctcttccagtg

SEQ ID NO: 8289185 - DNA, 22 bp, Homo sapiens
tggctcagaaggctgccttcac

SEQ ID NO: 8289186 - DNA, 22 bp, Homo sapiens
tggctcagagccttgagagctg

SEQ ID NO: 8289187 - DNA, 22 bp, Homo sapiens
tggctcagagcagggactctgg

SEQ ID NO: 8289188 - DNA, 19 bp, Homo sapiens
tggctctgtttctctggag

SEQ ID NO: 8289189 - DNA, 22 bp, Homo sapiens
tggctctgttgtgctgagccag

SEQ ID NO: 8289190 - DNA, 22 bp, Homo sapiens
tggctcttggtgctagtttctg

SEQ ID NO: 8289191 - DNA, 22 bp, Homo sapiens
tggctctgttcgccatcaggag

SEQ ID NO: 8289192 - DNA, 22 bp, Homo sapiens
tggctctgggaatctgttgctt

SEQ ID NO: 8289193 - DNA, 22 bp, Homo sapiens
tggctctgggcaccgtgtccac

SEQ ID NO: 8289194 - DNA, 23 bp, Homo sapiens
tggctctgtggatccctcaggag

SEQ ID NO: 8289195 - DNA, 22 bp, Homo sapiens
tggctctgtgaacagacgactg

SEQ ID NO: 8289196 - DNA, 23 bp, Homo sapiens
tggctctgagaggttcagatgct

SEQ ID NO: 8289197 - DNA, 20 bp, Homo sapiens
tggctcctggctcctccctc

SEQ ID NO: 8289198 - DNA, 22 bp, Homo sapiens
tggctccttccgcagcatgcct

SEQ ID NO: 8289199 - DNA, 22 bp, Homo sapiens
tggctccttcattctcctgcca

SEQ ID NO: 8289200 - DNA, 22 bp, Homo sapiens
tggctccttcattctcctgcca

SEQ ID NO: 8289201 - DNA, 22 bp, Homo sapiens
tggctctcaatggctgtactat

SEQ ID NO: 8289202 - DNA, 22 bp, Homo sapiens
tggctctgatcagatgtccagt

SEQ ID NO: 8289203 - DNA, 18 bp, Homo sapiens
tggctctgccactcaccg

SEQ ID NO: 8289204 - DNA, 22 bp, Homo sapiens
tggctctgctgaacctagtgca

SEQ ID NO: 8289205 - DNA, 22 bp, Homo sapiens
tggctctggagctcctgggccc

SEQ ID NO: 8289206 - DNA, 22 bp, Homo sapiens
tggctgagttctccaggagtag

SEQ ID NO: 8289207 - DNA, 22 bp, Homo sapiens
tggctgctgagaaggcagctgt

SEQ ID NO: 8289208 - DNA, 22 bp, Homo sapiens
tggctgccagctcctcgccttg

SEQ ID NO: 8289209 - DNA, 22 bp, Homo sapiens
tggctgccaagcaggtcagaga

SEQ ID NO: 8289210 - DNA, 21 bp, Homo sapiens
tggctgctggccctctctcca

SEQ ID NO: 8289211 - DNA, 18 bp, Homo sapiens
tggctgctggagtagggt

SEQ ID NO: 8289212 - DNA, 22 bp, Homo sapiens
tggctgctgctcactcagcctc

SEQ ID NO: 8289213 - DNA, 18 bp, Homo sapiens
tggctgcttccaggtaca

SEQ ID NO: 8289214 - DNA, 22 bp, Homo sapiens
tggctgctgtgggtagagggat

SEQ ID NO: 8289215 - DNA, 22 bp, Homo sapiens
tggctctttctagacttaatta

SEQ ID NO: 8289216 - DNA, 22 bp, Homo sapiens
tggctgagagcaattgactctg

SEQ ID NO: 8289217 - DNA, 22 bp, Homo sapiens
tggctgggtgctatccagtact

SEQ ID NO: 8289218 - DNA, 19 bp, Homo sapiens
tggctgggtgccaatggcc

SEQ ID NO: 8289219 - DNA, 19 bp, Homo sapiens
tggctgggcgtgcctccgt

SEQ ID NO: 8289220 - DNA, 22 bp, Homo sapiens
tggctgtgtccctgtccagagt

SEQ ID NO: 8289221 - DNA, 20 bp, Homo sapiens
tggctgtgggcatctgtttc

SEQ ID NO: 8289222 - DNA, 22 bp, Homo sapiens
tggctgtggtttatcccagttc

SEQ ID NO: 8289223 - DNA, 22 bp, Homo sapiens
tggctgtgatttgcacgagatg

SEQ ID NO: 8289224 - DNA, 22 bp, Homo sapiens
tggctggcaaggctggagtcag

SEQ ID NO: 8289225 - DNA, 22 bp, Homo sapiens
tggctggaggaaggaactgagg

SEQ ID NO: 8289226 - DNA, 22 bp, Homo sapiens
tggctggcgttggggccagtga

SEQ ID NO: 8289227 - DNA, 22 bp, Homo sapiens
tggctggctagaatggaaatgt

SEQ ID NO: 8289228 - DNA, 22 bp, Homo sapiens
tggctggcgccgggctagccac

SEQ ID NO: 8289229 - DNA, 22 bp, Homo sapiens
tggctggcagtaggctagtggc

SEQ ID NO: 8289230 - DNA, 22 bp, Homo sapiens
tggcttcctggacagatgcggt

SEQ ID NO: 8289231 - DNA, 18 bp, Homo sapiens
tggcttcctgcgggctgc

SEQ ID NO: 8289232 - DNA, 22 bp, Homo sapiens
tggcttcctgtttcccagaaag

SEQ ID NO: 8289233 - DNA, 18 bp, Homo sapiens
tggcttctcaaagcccag

SEQ ID NO: 8289234 - DNA, 17 bp, Homo sapiens
tggcttccctgggccac

SEQ ID NO: 8289235 - DNA, 22 bp, Homo sapiens
tggcttccgccgcgggcctcgg

SEQ ID NO: 8289236 - DNA, 22 bp, Homo sapiens
tggcttccgccgcgggcctcgg

SEQ ID NO: 8289237 - DNA, 22 bp, Homo sapiens
tggcttcctaggagcccgtgct

SEQ ID NO: 8289238 - DNA, 19 bp, Homo sapiens
tggcttcctgactctcatc

SEQ ID NO: 8289239 - DNA, 22 bp, Homo sapiens
tggcttcctgcacagtgtctgc

SEQ ID NO: 8289240 - DNA, 22 bp, Homo sapiens
tggcttcctgcatggatcctct

SEQ ID NO: 8289241 - DNA, 22 bp, Homo sapiens
tggcttcactgctcaagtgatt

SEQ ID NO: 8289242 - DNA, 22 bp, Homo sapiens
tggcttctgctcccagaatgat

SEQ ID NO: 8289243 - DNA, 19 bp, Homo sapiens
tggcttctggcaacagatg

SEQ ID NO: 8289244 - DNA, 23 bp, Homo sapiens
tggcttctgccccattctctcca

SEQ ID NO: 8289245 - DNA, 22 bp, Homo sapiens
tggctttatgtgttacgaaaat

SEQ ID NO: 8289246 - DNA, 20 bp, Homo sapiens
tggctttagtgagggaacat

SEQ ID NO: 8289247 - DNA, 19 bp, Homo sapiens
tgggaaagtaacatacaaa

SEQ ID NO: 8289248 - DNA, 22 bp, Homo sapiens
tgggaaagtaattgtcatcctt

SEQ ID NO: 8289249 - DNA, 20 bp, Homo sapiens
tgggaaagtctaagtgcctc

SEQ ID NO: 8289250 - DNA, 22 bp, Homo sapiens
tgggaaagccagcagtgtcacc

SEQ ID NO: 8289251 - DNA, 22 bp, Homo sapiens
tgggaaagactcaggacaggag

SEQ ID NO: 8289252 - DNA, 22 bp, Homo sapiens
tgggaaagctgcagaaattctc

SEQ ID NO: 8289253 - DNA, 22 bp, Homo sapiens
tggctttgatggacagaggtca

SEQ ID NO: 8289254 - DNA, 22 bp, Homo sapiens
tgggaacaacatgcactgccac

SEQ ID NO: 8289255 - DNA, 18 bp, Homo sapiens
tgggaaagtttatagaat

SEQ ID NO: 8289256 - DNA, 22 bp, Homo sapiens
tgggaaagtgttgaggtgtctt

SEQ ID NO: 8289257 - DNA, 22 bp, Homo sapiens
tgggaaagtctttatttctctt

SEQ ID NO: 8289258 - DNA, 22 bp, Homo sapiens
tgggaaagtgtagcctgcaggc

SEQ ID NO: 8289259 - DNA, 22 bp, Homo sapiens
tgggaagactcctcaggaggcg

SEQ ID NO: 8289260 - DNA, 22 bp, Homo sapiens
tgggaacagtagctgctgagct

SEQ ID NO: 8289261 - DNA, 22 bp, Homo sapiens
tgggaacattttgagctgagag

SEQ ID NO: 8289262 - DNA, 22 bp, Homo sapiens
tgggaagaagcagagaactgga

SEQ ID NO: 8289263 - DNA, 22 bp, Homo sapiens
tgggagcagctgggaacacagc

SEQ ID NO: 8289264 - DNA, 22 bp, Homo sapiens
tgggagcagccaacatggcctt

SEQ ID NO: 8289265 - DNA, 22 bp, Homo sapiens
tgggagcaccttgagggcagaa

SEQ ID NO: 8289266 - DNA, 22 bp, Homo sapiens
tgggaggatctcttgaggccag

SEQ ID NO: 8289267 - DNA, 22 bp, Homo sapiens
tgggaggaatgtcactgagcca

SEQ ID NO: 8289268 - DNA, 22 bp, Homo sapiens
tgggaggaatgtcactgagcca

SEQ ID NO: 8289269 - DNA, 22 bp, Homo sapiens
tgggagaacactgctctggatg

SEQ ID NO: 8289270 - DNA, 19 bp, Homo sapiens
tgggagaggcaacagagta

SEQ ID NO: 8289271 - DNA, 22 bp, Homo sapiens
tgggaagggtcaacagctggaa

SEQ ID NO: 8289272 - DNA, 22 bp, Homo sapiens
tgggaaggggagctggaaagga

SEQ ID NO: 8289273 - DNA, 22 bp, Homo sapiens
tgggaagggcctgcccttcctc

SEQ ID NO: 8289274 - DNA, 22 bp, Homo sapiens
tgggaagggccgatggagcctc

SEQ ID NO: 8289275 - DNA, 22 bp, Homo sapiens
tgggaagcacgctcagcagaaa

SEQ ID NO: 8289276 - DNA, 22 bp, Homo sapiens
tgggaagaggcgggaggctgtt

SEQ ID NO: 8289277 - DNA, 22 bp, Homo sapiens
tgggaagagttagagacagctg

SEQ ID NO: 8289278 - DNA, 22 bp, Homo sapiens
tgggaagtaggacagtgcagtt

SEQ ID NO: 8289279 - DNA, 22 bp, Homo sapiens
tgggacacattagtcaccttac

SEQ ID NO: 8289280 - DNA, 22 bp, Homo sapiens
tgggacacacaaggtcagctct

SEQ ID NO: 8289281 - DNA, 22 bp, Homo sapiens
tgggacaggttggagagaagca

SEQ ID NO: 8289282 - DNA, 22 bp, Homo sapiens
tgggacagtgaccccagaggtc

SEQ ID NO: 8289283 - DNA, 22 bp, Homo sapiens
tgggaccacactttgaacaaca

SEQ ID NO: 8289284 - DNA, 17 bp, Homo sapiens
tggcatcttttgctcat

SEQ ID NO: 8289285 - DNA, 22 bp, Homo sapiens
tggcatctttgtcccagaagct

SEQ ID NO: 8289286 - DNA, 22 bp, Homo sapiens
tggcatctcaaacaggcagatt

SEQ ID NO: 8289287 - DNA, 23 bp, Homo sapiens
tggcatcttggcatcttgctgct

SEQ ID NO: 8289288 - DNA, 22 bp, Homo sapiens
tggcatctgtgttgcggttgtc

SEQ ID NO: 8289289 - DNA, 19 bp, Homo sapiens
tggcatctgggccctccag

SEQ ID NO: 8289290 - DNA, 22 bp, Homo sapiens
tggcatctccgacagtcttgat

SEQ ID NO: 8289291 - DNA, 22 bp, Homo sapiens
tggcatgcaagaggaggctccc

SEQ ID NO: 8289292 - DNA, 22 bp, Homo sapiens
tggcagtgatgcggcaggacat

SEQ ID NO: 8289293 - DNA, 19 bp, Homo sapiens
tggcaggtagtgagcagtc

SEQ ID NO: 8289294 - DNA, 22 bp, Homo sapiens
tggcaggtggcacagcctggga

SEQ ID NO: 8289295 - DNA, 22 bp, Homo sapiens
tggcaggtggagacagcagagc

SEQ ID NO: 8289296 - DNA, 22 bp, Homo sapiens
tggcaggtccactcacagatct

SEQ ID NO: 8289297 - DNA, 22 bp, Homo sapiens
tggccagccttgtcatcgcttt

SEQ ID NO: 8289298 - DNA, 21 bp, Homo sapiens
tggccagctgctcgtctcctc

SEQ ID NO: 8289299 - DNA, 21 bp, Homo sapiens
tggccagctgctcgtctcctc

SEQ ID NO: 8289300 - DNA, 22 bp, Homo sapiens
tggccagcccttcagccatgcc

SEQ ID NO: 8289301 - DNA, 22 bp, Homo sapiens
tggccagattcatgcatgtatc

SEQ ID NO: 8289302 - DNA, 22 bp, Homo sapiens
tggccagcagagttcactctct

SEQ ID NO: 8289303 - DNA, 23 bp, Homo sapiens
tggccaggtagaggaggtagtga

SEQ ID NO: 8289304 - DNA, 22 bp, Homo sapiens
tggcatttcacctttcatttcc

SEQ ID NO: 8289305 - DNA, 22 bp, Homo sapiens
tggcatgttaaagtagtattaa

SEQ ID NO: 8289306 - DNA, 22 bp, Homo sapiens
tggcatgtttcatggctgcaaa

SEQ ID NO: 8289307 - DNA, 22 bp, Homo sapiens
tggcatgttaaataagatcata

SEQ ID NO: 8289308 - DNA, 22 bp, Homo sapiens
tggccaccttatggctattgga

SEQ ID NO: 8289309 - DNA, 22 bp, Homo sapiens
tggccagacctgactgtcaggg

SEQ ID NO: 8289310 - DNA, 22 bp, Homo sapiens
tggccacagtgtccagcagcag

SEQ ID NO: 8289311 - DNA, 22 bp, Homo sapiens
tggccacccctttctctgcact

SEQ ID NO: 8289312 - DNA, 22 bp, Homo sapiens
tggccacccctttctctgcact

SEQ ID NO: 8289313 - DNA, 22 bp, Homo sapiens
tggccctgaaggccttgagcat

SEQ ID NO: 8289314 - DNA, 22 bp, Homo sapiens
tggccctgaggggctgtgcccc

SEQ ID NO: 8289315 - DNA, 22 bp, Homo sapiens
tggccctgcagaactagcctgg

SEQ ID NO: 8289316 - DNA, 22 bp, Homo sapiens
tggcccagctgcagatggtgga

SEQ ID NO: 8289317 - DNA, 22 bp, Homo sapiens
tggccctgtgtcctgctgccag

SEQ ID NO: 8289318 - DNA, 22 bp, Homo sapiens
tggccctggtggcacagcctgc

SEQ ID NO: 8289319 - DNA, 22 bp, Homo sapiens
tggccctgggtggaatgtccca

SEQ ID NO: 8289320 - DNA, 22 bp, Homo sapiens
tggcctgccttcgctgagctga

SEQ ID NO: 8289321 - DNA, 22 bp, Homo sapiens
tggcctgcctgggagcagcagg

SEQ ID NO: 8289322 - DNA, 22 bp, Homo sapiens
tggcctggccacatccagcagg

SEQ ID NO: 8289323 - DNA, 22 bp, Homo sapiens
tggcctgagttgtctgcaggcc

SEQ ID NO: 8289324 - DNA, 22 bp, Homo sapiens
tggcctgcccaagtcaatcgga

SEQ ID NO: 8289325 - DNA, 22 bp, Homo sapiens
tggcctgcccagagcagctctg

SEQ ID NO: 8289326 - DNA, 22 bp, Homo sapiens
tggcctcttaggacatcctcta

SEQ ID NO: 8289327 - DNA, 22 bp, Homo sapiens
tggcctctgtgggagctgagca

SEQ ID NO: 8289328 - DNA, 20 bp, Homo sapiens
tggcctctgtagaggccaag

SEQ ID NO: 8289329 - DNA, 22 bp, Homo sapiens
tggcaactactaatcatttaac

SEQ ID NO: 8289330 - DNA, 23 bp, Homo sapiens
tggcaagtttgactttcctttac

SEQ ID NO: 8289331 - DNA, 22 bp, Homo sapiens
tggcaatacataatcttaatgg

SEQ ID NO: 8289332 - DNA, 22 bp, Homo sapiens
tggcaatatccacaattacttt

SEQ ID NO: 8289333 - DNA, 22 bp, Homo sapiens
tggcaaattcatctttagttct

SEQ ID NO: 8289334 - DNA, 22 bp, Homo sapiens
tggattctaatgcacttcaaat

SEQ ID NO: 8289335 - DNA, 22 bp, Homo sapiens
tggattctcatgggaccagtag

SEQ ID NO: 8289336 - DNA, 22 bp, Homo sapiens
tggattctgggagagttctata

SEQ ID NO: 8289337 - DNA, 22 bp, Homo sapiens
tggattctgggctgtttgcatt

SEQ ID NO: 8289338 - DNA, 22 bp, Homo sapiens
tggcaattcctgagctctgaga

SEQ ID NO: 8289339 - DNA, 22 bp, Homo sapiens
tggcaattcccttggtcaacag

SEQ ID NO: 8289340 - DNA, 22 bp, Homo sapiens
tggcaattctctacctttctca

SEQ ID NO: 8289341 - DNA, 23 bp, Homo sapiens
tggcaattcctgagctctgagaa

SEQ ID NO: 8289342 - DNA, 22 bp, Homo sapiens
tggcaattgtccactgtctgcc

SEQ ID NO: 8289343 - DNA, 22 bp, Homo sapiens
tggcaattggcaatttcgtatg

SEQ ID NO: 8289344 - DNA, 22 bp, Homo sapiens
tggcacaaaagtaattgcagtt

SEQ ID NO: 8289345 - DNA, 22 bp, Homo sapiens
tggcaattttaggtggtttagt

SEQ ID NO: 8289346 - DNA, 22 bp, Homo sapiens
tggcaattatatttttggctga

SEQ ID NO: 8289347 - DNA, 22 bp, Homo sapiens
tggcaatttgtagagtaaatta

SEQ ID NO: 8289348 - DNA, 22 bp, Homo sapiens
tggcaatttcacatggcttaac

SEQ ID NO: 8289349 - DNA, 22 bp, Homo sapiens
tggcaatttcagaaaatagaat

SEQ ID NO: 8289350 - DNA, 22 bp, Homo sapiens
tggcaatttcatatggttcaag

SEQ ID NO: 8289351 - DNA, 22 bp, Homo sapiens
tggcaatttcatatggttcata

SEQ ID NO: 8289352 - DNA, 22 bp, Homo sapiens
tggcaatttcatgtggttcaac

SEQ ID NO: 8289353 - DNA, 22 bp, Homo sapiens
tggcaatttcttatggttcaac

SEQ ID NO: 8289354 - DNA, 22 bp, Homo sapiens
tggcacagacagatcaggagtc

SEQ ID NO: 8289355 - DNA, 22 bp, Homo sapiens
tggcaattttctagcagatggc

SEQ ID NO: 8289356 - DNA, 21 bp, Homo sapiens
tggcacagaaaggaaagttca

SEQ ID NO: 8289357 - DNA, 22 bp, Homo sapiens
tggcacagacagcacagcaatg

SEQ ID NO: 8289358 - DNA, 23 bp, Homo sapiens
tggcacagcaggtgtgctttgtt

SEQ ID NO: 8289359 - DNA, 22 bp, Homo sapiens
tggcacagccactgaatcggga

SEQ ID NO: 8289360 - DNA, 21 bp, Homo sapiens
tggcacagcaagtgggctcat

SEQ ID NO: 8289361 - DNA, 22 bp, Homo sapiens
tggcacagcctttaaagtacca

SEQ ID NO: 8289362 - DNA, 22 bp, Homo sapiens
tggcacagcccattcagagaag

SEQ ID NO: 8289363 - DNA, 22 bp, Homo sapiens
tggcacagcctccatgtcgtcc

SEQ ID NO: 8289364 - DNA, 16 bp, Homo sapiens
tggcacagagcagata

SEQ ID NO: 8289365 - DNA, 17 bp, Homo sapiens
tggcacagaggtgctat

SEQ ID NO: 8289366 - DNA, 22 bp, Homo sapiens
tggcacttccatttctttagtg

SEQ ID NO: 8289367 - DNA, 22 bp, Homo sapiens
tggcaccatgttggcaaatgtt

SEQ ID NO: 8289368 - DNA, 22 bp, Homo sapiens
tggcactgaagctggaaagcct

SEQ ID NO: 8289369 - DNA, 22 bp, Homo sapiens
tggcactcactctcagagtctg

SEQ ID NO: 8289370 - DNA, 22 bp, Homo sapiens
tggcacatggttaatcataatt

SEQ ID NO: 8289371 - DNA, 22 bp, Homo sapiens
tggcaccaccagacaccaggag

SEQ ID NO: 8289372 - DNA, 22 bp, Homo sapiens
tggcaccagcacctagatgggg

SEQ ID NO: 8289373 - DNA, 22 bp, Homo sapiens
tggcaccaaaagcagacgtatt

SEQ ID NO: 8289374 - DNA, 22 bp, Homo sapiens
tggcaccatcaaggctgagaac

SEQ ID NO: 8289375 - DNA, 20 bp, Homo sapiens
tggcaccaggtggtggcccc

SEQ ID NO: 8289376 - DNA, 22 bp, Homo sapiens
tggcaccagggaacaagcattt

SEQ ID NO: 8289377 - DNA, 23 bp, Homo sapiens
tggcaccaggcattctaggggta

SEQ ID NO: 8289378 - DNA, 22 bp, Homo sapiens
tggcaccaggcggggtggctgt

SEQ ID NO: 8289379 - DNA, 22 bp, Homo sapiens
tggcacagttaaagttgtagaa

SEQ ID NO: 8289380 - DNA, 22 bp, Homo sapiens
tggcacatgatgttgtggcatc

SEQ ID NO: 8289381 - DNA, 22 bp, Homo sapiens
tggcagagccttgccaaactcc

SEQ ID NO: 8289382 - DNA, 22 bp, Homo sapiens
tggcagagtctgggcttgggca

SEQ ID NO: 8289383 - DNA, 22 bp, Homo sapiens
tggcagagtaggatggccctgt

SEQ ID NO: 8289384 - DNA, 20 bp, Homo sapiens
tggcagagttgtcccaccca

SEQ ID NO: 8289385 - DNA, 22 bp, Homo sapiens
tggcagagttggaggtggaaga

SEQ ID NO: 8289386 - DNA, 22 bp, Homo sapiens
tggcagccatctgagggtgggg

SEQ ID NO: 8289387 - DNA, 22 bp, Homo sapiens
tggcagcctgcgtgaaggagct

SEQ ID NO: 8289388 - DNA, 22 bp, Homo sapiens
tggcagccacatctcgtggatt

SEQ ID NO: 8289389 - DNA, 19 bp, Homo sapiens
tggcagcattggtaccttg

SEQ ID NO: 8289390 - DNA, 22 bp, Homo sapiens
tggcagctcccagagcttccaa

SEQ ID NO: 8289391 - DNA, 22 bp, Homo sapiens
tggcagctcctggggccagcac

SEQ ID NO: 8289392 - DNA, 22 bp, Homo sapiens
tggcagctcctggggccagcac

SEQ ID NO: 8289393 - DNA, 22 bp, Homo sapiens
tggcagctccgggtaggggctg

SEQ ID NO: 8289394 - DNA, 22 bp, Homo sapiens
tggcagctatggtctaagggcc

SEQ ID NO: 8289395 - DNA, 22 bp, Homo sapiens
tggcagctagatagtgtgttta

SEQ ID NO: 8289396 - DNA, 22 bp, Homo sapiens
tggcagctacagacagaggtga

SEQ ID NO: 8289397 - DNA, 22 bp, Homo sapiens
tggcagccttctctgagaaggt

SEQ ID NO: 8289398 - DNA, 22 bp, Homo sapiens
tggcagctacagacagaggtga

SEQ ID NO: 8289399 - DNA, 22 bp, Homo sapiens
tggcagcagcaaatggcatatc

SEQ ID NO: 8289400 - DNA, 22 bp, Homo sapiens
tggcagcagccatggaaggccc

SEQ ID NO: 8289401 - DNA, 18 bp, Homo sapiens
tggcagcaggaagccatt

SEQ ID NO: 8289402 - DNA, 22 bp, Homo sapiens
tggcagcagggcccctggagga

SEQ ID NO: 8289403 - DNA, 22 bp, Homo sapiens
tggcagcagtagccaccccagc

SEQ ID NO: 8289404 - DNA, 22 bp, Homo sapiens
tggcagcagtggaggtagaaag

SEQ ID NO: 8289405 - DNA, 22 bp, Homo sapiens
tggcaggaaggagactcagccc

SEQ ID NO: 8289406 - DNA, 20 bp, Homo sapiens
tggcaggactggctccaccc

SEQ ID NO: 8289407 - DNA, 20 bp, Homo sapiens
tggcaggaggcagcagtgga

SEQ ID NO: 8289408 - DNA, 20 bp, Homo sapiens
tggcaggagccactggaagc

SEQ ID NO: 8289409 - DNA, 22 bp, Homo sapiens
tggcaggaaccttaaccacaaa

SEQ ID NO: 8289410 - DNA, 22 bp, Homo sapiens
tggcagctgagtgcaccccctc

SEQ ID NO: 8289411 - DNA, 22 bp, Homo sapiens
tggcagctgaggggaggctttg

SEQ ID NO: 8289412 - DNA, 22 bp, Homo sapiens
tggcagctgcgttgtgtttctg

SEQ ID NO: 8289413 - DNA, 22 bp, Homo sapiens
tggcagctgccatgtccacgtg

SEQ ID NO: 8289414 - DNA, 22 bp, Homo sapiens
tggcagctgcaggcctcctgag

SEQ ID NO: 8289415 - DNA, 22 bp, Homo sapiens
tggcaggatctttgagagtgaa

SEQ ID NO: 8289416 - DNA, 22 bp, Homo sapiens
tggcaggcagagagcggccttt

SEQ ID NO: 8289417 - DNA, 22 bp, Homo sapiens
tgaggaagtggttgtatggttt

SEQ ID NO: 8289418 - DNA, 22 bp, Homo sapiens
tgaggaagttgatctcatcagt

SEQ ID NO: 8289419 - DNA, 22 bp, Homo sapiens
tgaggaaggaattgaggtttta

SEQ ID NO: 8289420 - DNA, 22 bp, Homo sapiens
tgaggaagggtgtgacggcacc

SEQ ID NO: 8289421 - DNA, 22 bp, Homo sapiens
tgaggaagccaaacagctacac

SEQ ID NO: 8289422 - DNA, 22 bp, Homo sapiens
tgaggaagcaaaggcttgtgtg

SEQ ID NO: 8289423 - DNA, 22 bp, Homo sapiens
tgaggaggtcagagtctggctg

SEQ ID NO: 8289424 - DNA, 22 bp, Homo sapiens
tgaggaggcccaggttggggct

SEQ ID NO: 8289425 - DNA, 22 bp, Homo sapiens
tgaggagcgggcagggatgcag

SEQ ID NO: 8289426 - DNA, 22 bp, Homo sapiens
tgaggaggtgggcacacagagt

SEQ ID NO: 8289427 - DNA, 22 bp, Homo sapiens
tgaggatggtcccgaggacact

SEQ ID NO: 8289428 - DNA, 19 bp, Homo sapiens
tgaggcacagtggtgaaat

SEQ ID NO: 8289429 - DNA, 22 bp, Homo sapiens
tgaggcagctttttctgtgtgt

SEQ ID NO: 8289430 - DNA, 22 bp, Homo sapiens
tgaggcagctttttctgtgtgt

SEQ ID NO: 8289431 - DNA, 22 bp, Homo sapiens
tgaggccagcttcagcagtgga

SEQ ID NO: 8289432 - DNA, 22 bp, Homo sapiens
tgaggccagcttcagcagtgga

SEQ ID NO: 8289433 - DNA, 22 bp, Homo sapiens
tgaggccaggacccccagcagg

SEQ ID NO: 8289434 - DNA, 22 bp, Homo sapiens
tgaggccagccacagccaccct

SEQ ID NO: 8289435 - DNA, 22 bp, Homo sapiens
tgaggccagccacagccaccct

SEQ ID NO: 8289436 - DNA, 22 bp, Homo sapiens
tgaggccacttccccacagccc

SEQ ID NO: 8289437 - DNA, 22 bp, Homo sapiens
tgaggccacagtatcagaacag

SEQ ID NO: 8289438 - DNA, 22 bp, Homo sapiens
tgaggccaatgaccctgggcag

SEQ ID NO: 8289439 - DNA, 22 bp, Homo sapiens
tgaggcctacccccctgtgttt

SEQ ID NO: 8289440 - DNA, 22 bp, Homo sapiens
tgaggcccgggtggaggaatgc

SEQ ID NO: 8289441 - DNA, 21 bp, Homo sapiens
tgaggcctgccagtctcagaa

SEQ ID NO: 8289442 - DNA, 22 bp, Homo sapiens
tgaggcaggagttaatgtgctc

SEQ ID NO: 8289443 - DNA, 22 bp, Homo sapiens
tgaggcaggagttcaggctgcg

SEQ ID NO: 8289444 - DNA, 22 bp, Homo sapiens
tgaggcaggaggattgcaggat

SEQ ID NO: 8289445 - DNA, 20 bp, Homo sapiens
tgaggcaggagaatggcatg

SEQ ID NO: 8289446 - DNA, 22 bp, Homo sapiens
tgaggcagttgagcttcctgag

SEQ ID NO: 8289447 - DNA, 19 bp, Homo sapiens
tgaggccaaggtcacagat

SEQ ID NO: 8289448 - DNA, 19 bp, Homo sapiens
tgaggccaaggtcacagat

SEQ ID NO: 8289449 - DNA, 22 bp, Homo sapiens
tgagggacttgctagttctctg

SEQ ID NO: 8289450 - DNA, 22 bp, Homo sapiens
tgagggagagggcgaaaatgaa

SEQ ID NO: 8289451 - DNA, 23 bp, Homo sapiens
tgagggacatggtggcttctgag

SEQ ID NO: 8289452 - DNA, 22 bp, Homo sapiens
tgagggagcacacactgaagtg

SEQ ID NO: 8289453 - DNA, 22 bp, Homo sapiens
tgagggaggccctttgagcaga

SEQ ID NO: 8289454 - DNA, 22 bp, Homo sapiens
tgagggagttgggtgtatagga

SEQ ID NO: 8289455 - DNA, 22 bp, Homo sapiens
tgagggagtcatgattaaggaa

SEQ ID NO: 8289456 - DNA, 22 bp, Homo sapiens
tgagggagtcatgattaaggaa

SEQ ID NO: 8289457 - DNA, 22 bp, Homo sapiens
tgaggggaaggcatgataaata

SEQ ID NO: 8289458 - DNA, 22 bp, Homo sapiens
tgaggggagaagcagcagcctg

SEQ ID NO: 8289459 - DNA, 22 bp, Homo sapiens
tgaggggagctagcatgccttg

SEQ ID NO: 8289460 - DNA, 22 bp, Homo sapiens
tgaggccttagtaaccctgcac

SEQ ID NO: 8289461 - DNA, 22 bp, Homo sapiens
tgaggctgccttgggaagaggg

SEQ ID NO: 8289462 - DNA, 22 bp, Homo sapiens
tgaggcttgatttgcccgagag

SEQ ID NO: 8289463 - DNA, 22 bp, Homo sapiens
tgaggctgttctaccagggcca

SEQ ID NO: 8289464 - DNA, 22 bp, Homo sapiens
tgaggtgagtcatgcattggag

SEQ ID NO: 8289465 - DNA, 22 bp, Homo sapiens
tgagggtagctggatcacggag

SEQ ID NO: 8289466 - DNA, 21 bp, Homo sapiens
tgaggggttataacagggtgg

SEQ ID NO: 8289467 - DNA, 22 bp, Homo sapiens
tgaggggccagaccccacctag

SEQ ID NO: 8289468 - DNA, 22 bp, Homo sapiens
tgagtattttaagttctcaatc

SEQ ID NO: 8289469 - DNA, 22 bp, Homo sapiens
tgagtatttctaatattccagt

SEQ ID NO: 8289470 - DNA, 22 bp, Homo sapiens
tgagtattttccctatcaatgt

SEQ ID NO: 8289471 - DNA, 22 bp, Homo sapiens
tgagtattccttatctgaaatg

SEQ ID NO: 8289472 - DNA, 22 bp, Homo sapiens
tgagtattgaagcgatttcaat

SEQ ID NO: 8289473 - DNA, 22 bp, Homo sapiens
tgagtattgaccagaaaattta

SEQ ID NO: 8289474 - DNA, 22 bp, Homo sapiens
tgagtattctgaatttcaaact

SEQ ID NO: 8289475 - DNA, 22 bp, Homo sapiens
tgaggtgggtgtcaggtcagag

SEQ ID NO: 8289476 - DNA, 22 bp, Homo sapiens
tgaggtggccgaggagcaggac

SEQ ID NO: 8289477 - DNA, 22 bp, Homo sapiens
tgagctttgtgggtaaagagag

SEQ ID NO: 8289478 - DNA, 22 bp, Homo sapiens
tgagctggttcttgaggcatga

SEQ ID NO: 8289479 - DNA, 22 bp, Homo sapiens
tgagctggtcactccttctgaa

SEQ ID NO: 8289480 - DNA, 22 bp, Homo sapiens
tgagctggatccaactccgttt

SEQ ID NO: 8289481 - DNA, 23 bp, Homo sapiens
tgagcccagttttccctcttgcc

SEQ ID NO: 8289482 - DNA, 22 bp, Homo sapiens
tgagccagtctctcagaaccct

SEQ ID NO: 8289483 - DNA, 22 bp, Homo sapiens
tgagccagtctgtctgggtgaa

SEQ ID NO: 8289484 - DNA, 22 bp, Homo sapiens
tgagccagtctgtctgggtgaa

SEQ ID NO: 8289485 - DNA, 22 bp, Homo sapiens
tgagccagtggaagatggcagt

SEQ ID NO: 8289486 - DNA, 22 bp, Homo sapiens
tgagccaggttaagacaggagc

SEQ ID NO: 8289487 - DNA, 22 bp, Homo sapiens
tgagccaggttaagacaggagc

SEQ ID NO: 8289488 - DNA, 20 bp, Homo sapiens
tgagccagtcaagctacatt

SEQ ID NO: 8289489 - DNA, 20 bp, Homo sapiens
tgagccagtcaagctacatt

SEQ ID NO: 8289490 - DNA, 22 bp, Homo sapiens
tgagccaggttaagacaggagc

SEQ ID NO: 8289491 - DNA, 22 bp, Homo sapiens
tgagctagggctggtgaggagc

SEQ ID NO: 8289492 - DNA, 22 bp, Homo sapiens
tgagctaggtcctgtgtcagct

SEQ ID NO: 8289493 - DNA, 22 bp, Homo sapiens
tgagctaggtcctgtgtcagct

SEQ ID NO: 8289494 - DNA, 22 bp, Homo sapiens
tgagctaggtgtgcagatatga

SEQ ID NO: 8289495 - DNA, 22 bp, Homo sapiens
tgagcagggagctgggctgagc

SEQ ID NO: 8289496 - DNA, 22 bp, Homo sapiens
tgagcagggactttggagtctg

SEQ ID NO: 8289497 - DNA, 22 bp, Homo sapiens
tgagcatctactatgaactggg

SEQ ID NO: 8289498 - DNA, 22 bp, Homo sapiens
tgagccagagaggttgaggcta

SEQ ID NO: 8289499 - DNA, 22 bp, Homo sapiens
tgagccagagaggttgaggcta

SEQ ID NO: 8289500 - DNA, 22 bp, Homo sapiens
tgagccagaggaggctgtgtgg

SEQ ID NO: 8289501 - DNA, 22 bp, Homo sapiens
tgagccagagtggagtgtgcct

SEQ ID NO: 8289502 - DNA, 22 bp, Homo sapiens
tgagccagagtggagtgtgcct

SEQ ID NO: 8289503 - DNA, 22 bp, Homo sapiens
tgagccagataagggctcacgc

SEQ ID NO: 8289504 - DNA, 22 bp, Homo sapiens
tgagccagataagggctcacgc

SEQ ID NO: 8289505 - DNA, 22 bp, Homo sapiens
tgagccaggagtttgaggctgt

SEQ ID NO: 8289506 - DNA, 22 bp, Homo sapiens
tgagccaggcactgctcctgga

SEQ ID NO: 8289507 - DNA, 22 bp, Homo sapiens
tgagccaggagtttgaggctgt

SEQ ID NO: 8289508 - DNA, 22 bp, Homo sapiens
tgagccagctccttgcctgtca

SEQ ID NO: 8289509 - DNA, 22 bp, Homo sapiens
tgagccaggagtttgaggctgt

SEQ ID NO: 8289510 - DNA, 22 bp, Homo sapiens
tgagccaggagtttgaggctgt

SEQ ID NO: 8289511 - DNA, 22 bp, Homo sapiens
tgagccagcctcagaagtcacg

SEQ ID NO: 8289512 - DNA, 22 bp, Homo sapiens
tgagccagccttgcagctgtgc

SEQ ID NO: 8289513 - DNA, 22 bp, Homo sapiens
tgagccagcctcagaagtcacg

SEQ ID NO: 8289514 - DNA, 20 bp, Homo sapiens
tgagccaggctaggaagggc

SEQ ID NO: 8289515 - DNA, 20 bp, Homo sapiens
tgagccaggctaggaagggc

SEQ ID NO: 8289516 - DNA, 22 bp, Homo sapiens
tgagccaggctcaagtgatcct

SEQ ID NO: 8289517 - DNA, 22 bp, Homo sapiens
tgagccaggctccatgccacct

SEQ ID NO: 8289518 - DNA, 19 bp, Homo sapiens
tgagccagggaggccatgc

SEQ ID NO: 8289519 - DNA, 22 bp, Homo sapiens
tgagccagggtttccggctgct

SEQ ID NO: 8289520 - DNA, 19 bp, Homo sapiens
tgagccagggaggccatgc

SEQ ID NO: 8289521 - DNA, 19 bp, Homo sapiens
tgagccagggaggccatgc

SEQ ID NO: 8289522 - DNA, 21 bp, Homo sapiens
tgagccaggctgacggctgtg

SEQ ID NO: 8289523 - DNA, 22 bp, Homo sapiens
tgagccaggctccatgccacct

SEQ ID NO: 8289524 - DNA, 21 bp, Homo sapiens
tgagccaggctgacggctgtg

SEQ ID NO: 8289525 - DNA, 22 bp, Homo sapiens
tgagcacagctcgcaccagctt

SEQ ID NO: 8289526 - DNA, 22 bp, Homo sapiens
tgagcaggctcccacttcagtg

SEQ ID NO: 8289527 - DNA, 22 bp, Homo sapiens
tgagcaggattcgcctcttgca

SEQ ID NO: 8289528 - DNA, 22 bp, Homo sapiens
tgagcaggcgcagcaggaggtc

SEQ ID NO: 8289529 - DNA, 22 bp, Homo sapiens
tgagaaatattgcacagtgagg

SEQ ID NO: 8289530 - DNA, 22 bp, Homo sapiens
tgagaaatccagatgtgcagtt

SEQ ID NO: 8289531 - DNA, 23 bp, Homo sapiens
tgagaaattttgattcagtagga

SEQ ID NO: 8289532 - DNA, 23 bp, Homo sapiens
tgagaaattttgattcagtagga

SEQ ID NO: 8289533 - DNA, 22 bp, Homo sapiens
tgagaaattacttcagtgatgg

SEQ ID NO: 8289534 - DNA, 22 bp, Homo sapiens
tgagaactggtagcacttgtga

SEQ ID NO: 8289535 - DNA, 22 bp, Homo sapiens
tgagaagagcaaggaactggtt

SEQ ID NO: 8289536 - DNA, 22 bp, Homo sapiens
tgagaacatttgcagggagagt

SEQ ID NO: 8289537 - DNA, 20 bp, Homo sapiens
tgagacaaggctggagagac

SEQ ID NO: 8289538 - DNA, 22 bp, Homo sapiens
tgagacagcagtcagggaaata

SEQ ID NO: 8289539 - DNA, 22 bp, Homo sapiens
tgagacagtcccatgatctgca

SEQ ID NO: 8289540 - DNA, 22 bp, Homo sapiens
tgagaggaacaggcagtaggtt

SEQ ID NO: 8289541 - DNA, 22 bp, Homo sapiens
tgagagctgggaaatgttagct

SEQ ID NO: 8289542 - DNA, 19 bp, Homo sapiens
tgagaggcttaaggcagct

SEQ ID NO: 8289543 - DNA, 22 bp, Homo sapiens
tgagagggcccagagcacacca

SEQ ID NO: 8289544 - DNA, 21 bp, Homo sapiens
tgagagactggtggatacagg

SEQ ID NO: 8289545 - DNA, 22 bp, Homo sapiens
tgagagacacactgtgcatgta

SEQ ID NO: 8289546 - DNA, 22 bp, Homo sapiens
tgagagagtaattgagtggtaa

SEQ ID NO: 8289547 - DNA, 21 bp, Homo sapiens
tgagagagtagcaggacatat

SEQ ID NO: 8289548 - DNA, 22 bp, Homo sapiens
tgagataattaaatcaaaacct

SEQ ID NO: 8289549 - DNA, 22 bp, Homo sapiens
tgagatggagtctcgctctgtt

SEQ ID NO: 8289550 - DNA, 22 bp, Homo sapiens
tgagatggagtctcactctgtt

SEQ ID NO: 8289551 - DNA, 22 bp, Homo sapiens
tgagatggagccactgcactct

SEQ ID NO: 8289552 - DNA, 22 bp, Homo sapiens
tgagatggagttctgctcttgt

SEQ ID NO: 8289553 - DNA, 22 bp, Homo sapiens
tgagatggagtcttgctctgtt

SEQ ID NO: 8289554 - DNA, 22 bp, Homo sapiens
tgagatggaaggtgaggcagta

SEQ ID NO: 8289555 - DNA, 17 bp, Homo sapiens
tgagatggaagaagact

SEQ ID NO: 8289556 - DNA, 21 bp, Homo sapiens
tgagatgctagaaggcaggga

SEQ ID NO: 8289557 - DNA, 22 bp, Homo sapiens
tgagatggttcacagagaaggc

SEQ ID NO: 8289558 - DNA, 22 bp, Homo sapiens
tgagatggttgaccagagagca

SEQ ID NO: 8289559 - DNA, 22 bp, Homo sapiens
tgagatggtgaagaagacagca

SEQ ID NO: 8289560 - DNA, 22 bp, Homo sapiens
tgagatgggtgtccagggagga

SEQ ID NO: 8289561 - DNA, 22 bp, Homo sapiens
tgagatgggtgggtagccaagg

SEQ ID NO: 8289562 - DNA, 22 bp, Homo sapiens
tgagatggttcacagagaaggc

SEQ ID NO: 8289563 - DNA, 22 bp, Homo sapiens
tgagatgggtcatcaggtttgg

SEQ ID NO: 8289564 - DNA, 22 bp, Homo sapiens
tgagatgggtggggagctcagg

SEQ ID NO: 8289565 - DNA, 22 bp, Homo sapiens
tgagatggggtcatgctttgtc

SEQ ID NO: 8289566 - DNA, 22 bp, Homo sapiens
tgagatggggagggctgcagaa

SEQ ID NO: 8289567 - DNA, 22 bp, Homo sapiens
tgagatgggatgtgcacttggc

SEQ ID NO: 8289568 - DNA, 22 bp, Homo sapiens
tgagatggctgggccccaggag

SEQ ID NO: 8289569 - DNA, 22 bp, Homo sapiens
tgagatggagttttggggatat

SEQ ID NO: 8289570 - DNA, 22 bp, Homo sapiens
tgagatggcaacaccagctttg

SEQ ID NO: 8289571 - DNA, 22 bp, Homo sapiens
tgagatggattgggttggttcc

SEQ ID NO: 8289572 - DNA, 22 bp, Homo sapiens
tgagatttgagggttaatctga

SEQ ID NO: 8289573 - DNA, 22 bp, Homo sapiens
tgagatttggaaaatttgatat

SEQ ID NO: 8289574 - DNA, 22 bp, Homo sapiens
tgagatttcgccgacagtattt

SEQ ID NO: 8289575 - DNA, 21 bp, Homo sapiens
tgagcaaaatttagagtgatg

SEQ ID NO: 8289576 - DNA, 22 bp, Homo sapiens
tgagattttcctaaatataatg

SEQ ID NO: 8289577 - DNA, 20 bp, Homo sapiens
tgagatttgtattataagtc

SEQ ID NO: 8289578 - DNA, 22 bp, Homo sapiens
tgaaagaagtgtcacattgcca

SEQ ID NO: 8289579 - DNA, 17 bp, Homo sapiens
tgaaagaatcagggaga

SEQ ID NO: 8289580 - DNA, 17 bp, Homo sapiens
tgaaagaatcagggaga

SEQ ID NO: 8289581 - DNA, 22 bp, Homo sapiens
tgaaagaactagcatcttcaag

SEQ ID NO: 8289582 - DNA, 22 bp, Homo sapiens
tgaaaccccagattaccacaaa

SEQ ID NO: 8289583 - DNA, 22 bp, Homo sapiens
tgaaacgtgcagggtaatttta

SEQ ID NO: 8289584 - DNA, 22 bp, Homo sapiens
tgaaacttataagaatatgaat

SEQ ID NO: 8289585 - DNA, 22 bp, Homo sapiens
tgaaacttattcagtttctacc

SEQ ID NO: 8289586 - DNA, 22 bp, Homo sapiens
tgaaacttatatatcccaggtt

SEQ ID NO: 8289587 - DNA, 22 bp, Homo sapiens
tgaaacttctaatatgaatagt

SEQ ID NO: 8289588 - DNA, 22 bp, Homo sapiens
tgaaacttttgaggttcttcca

SEQ ID NO: 8289589 - DNA, 22 bp, Homo sapiens
tgaaacttgctaattgcacgta

SEQ ID NO: 8289590 - DNA, 22 bp, Homo sapiens
tgaaacttgagtatatatggat

SEQ ID NO: 8289591 - DNA, 22 bp, Homo sapiens
tgaaagaaacaggtatattggg

SEQ ID NO: 8289592 - DNA, 22 bp, Homo sapiens
tgaaagaaacaggtatattggg

SEQ ID NO: 8289593 - DNA, 22 bp, Homo sapiens
tgaaacaaaagtatgtagcttg

SEQ ID NO: 8289594 - DNA, 22 bp, Homo sapiens
tgaaacagtctccagacttgga

SEQ ID NO: 8289595 - DNA, 22 bp, Homo sapiens
tgaaaaaacaagttggcccatt

SEQ ID NO: 8289596 - DNA, 22 bp, Homo sapiens
tgaaaaactttaatccataaag

SEQ ID NO: 8289597 - DNA, 22 bp, Homo sapiens
tcttttgttgcctacttattaa

SEQ ID NO: 8289598 - DNA, 22 bp, Homo sapiens
tgaaaatgcacgctggaaagca

SEQ ID NO: 8289599 - DNA, 22 bp, Homo sapiens
tgaaaatgcacgctggaaagca

SEQ ID NO: 8289600 - DNA, 22 bp, Homo sapiens
tgaaaattgttgtacttgataa

SEQ ID NO: 8289601 - DNA, 22 bp, Homo sapiens
tgaaaattctcaggctcacccc

SEQ ID NO: 8289602 - DNA, 22 bp, Homo sapiens
tgaaaattaagcagatgaatga

SEQ ID NO: 8289603 - DNA, 20 bp, Homo sapiens
tctttgttaattttatctcc

SEQ ID NO: 8289604 - DNA, 22 bp, Homo sapiens
tctttgtgttcaggagccacgt

SEQ ID NO: 8289605 - DNA, 22 bp, Homo sapiens
tctttgtgttcaggagccacgt

SEQ ID NO: 8289606 - DNA, 22 bp, Homo sapiens
tctttgttattgctttatctat

SEQ ID NO: 8289607 - DNA, 22 bp, Homo sapiens
tctttgttggagtccaaggata

SEQ ID NO: 8289608 - DNA, 22 bp, Homo sapiens
tctttgtttgcctttatcaaga

SEQ ID NO: 8289609 - DNA, 23 bp, Homo sapiens
tcttttcaatggttctttatgtg

SEQ ID NO: 8289610 - DNA, 22 bp, Homo sapiens
tcttttctagcaaatccaggag

SEQ ID NO: 8289611 - DNA, 22 bp, Homo sapiens
tcttttgttgatggaattaatg

SEQ ID NO: 8289612 - DNA, 22 bp, Homo sapiens
tctttgtactttctggctgtcc

SEQ ID NO: 8289613 - DNA, 22 bp, Homo sapiens
tctttggaatgctagcattcta

SEQ ID NO: 8289614 - DNA, 22 bp, Homo sapiens
tctttgcagaacgatgaagatg

SEQ ID NO: 8289615 - DNA, 22 bp, Homo sapiens
tctttgcagaatttaactttgc

SEQ ID NO: 8289616 - DNA, 22 bp, Homo sapiens
tctttgcagccccaggaagtgg

SEQ ID NO: 8289617 - DNA, 22 bp, Homo sapiens
tctttgcaggagccctttgaac

SEQ ID NO: 8289618 - DNA, 22 bp, Homo sapiens
tctttgcagttctgattaaata

SEQ ID NO: 8289619 - DNA, 21 bp, Homo sapiens
tctttgcatcagttgttttct

SEQ ID NO: 8289620 - DNA, 22 bp, Homo sapiens
tctttgcaggccaaattgttaa

SEQ ID NO: 8289621 - DNA, 22 bp, Homo sapiens
tctttgcagtggtgaataaaga

SEQ ID NO: 8289622 - DNA, 22 bp, Homo sapiens
tctttgcagtctgggcttgttt

SEQ ID NO: 8289623 - DNA, 22 bp, Homo sapiens
tctttgcaactcccatttccat

SEQ ID NO: 8289624 - DNA, 17 bp, Homo sapiens
tctttgcaatgagactg

SEQ ID NO: 8289625 - DNA, 22 bp, Homo sapiens
tctttgcacacagcgattcttc

SEQ ID NO: 8289626 - DNA, 22 bp, Homo sapiens
tctttgcactgtgcaagcagaa

SEQ ID NO: 8289627 - DNA, 22 bp, Homo sapiens
tctttgcacacatcccttcccg

SEQ ID NO: 8289628 - DNA, 22 bp, Homo sapiens
tctttgcaaaatacaacaatgg

SEQ ID NO: 8289629 - DNA, 22 bp, Homo sapiens
tctttgcaaactatggagtgtg

SEQ ID NO: 8289630 - DNA, 22 bp, Homo sapiens
tctttgcaaatgttattatctt

SEQ ID NO: 8289631 - DNA, 22 bp, Homo sapiens
tctttgattttgttactaagac

SEQ ID NO: 8289632 - DNA, 22 bp, Homo sapiens
tctttgatttagaaggaaatga

SEQ ID NO: 8289633 - DNA, 22 bp, Homo sapiens
tctttgatttgacaatatcttg

SEQ ID NO: 8289634 - DNA, 22 bp, Homo sapiens
tctttgcatcccttccatagtt

SEQ ID NO: 8289635 - DNA, 22 bp, Homo sapiens
tctttgcatgcattttccctta

SEQ ID NO: 8289636 - DNA, 22 bp, Homo sapiens
tctttgcatggacatgtgtttt

SEQ ID NO: 8289637 - DNA, 22 bp, Homo sapiens
tctttgcatgagttccctctgt

SEQ ID NO: 8289638 - DNA, 22 bp, Homo sapiens
tctttgcattcctgtgtgcttt

SEQ ID NO: 8289639 - DNA, 22 bp, Homo sapiens
tctttgcattcctgtgtgcttt

SEQ ID NO: 8289640 - DNA, 22 bp, Homo sapiens
tctttgcattttatgccgttat

SEQ ID NO: 8289641 - DNA, 22 bp, Homo sapiens
tctttgcatgtgcttcttggcc

SEQ ID NO: 8289642 - DNA, 22 bp, Homo sapiens
tgaagaaaatatgattacccca

SEQ ID NO: 8289643 - DNA, 22 bp, Homo sapiens
tgaagaaacgcagagaggtagg

SEQ ID NO: 8289644 - DNA, 22 bp, Homo sapiens
tgaagaaacagaccaagaggat

SEQ ID NO: 8289645 - DNA, 22 bp, Homo sapiens
tgaagaaaggtgtgggatactc

SEQ ID NO: 8289646 - DNA, 19 bp, Homo sapiens
tgaagcaggcagagaagat

SEQ ID NO: 8289647 - DNA, 22 bp, Homo sapiens
tgaagcagcaaatgatgggaga

SEQ ID NO: 8289648 - DNA, 22 bp, Homo sapiens
tgaagcagcaaatgatgggaga

SEQ ID NO: 8289649 - DNA, 22 bp, Homo sapiens
tgaagcagagtgaaggtgaatt

SEQ ID NO: 8289650 - DNA, 22 bp, Homo sapiens
tgaagcacaggcatacacaacc

SEQ ID NO: 8289651 - DNA, 22 bp, Homo sapiens
tgaagcaatagagacaagacca

SEQ ID NO: 8289652 - DNA, 18 bp, Homo sapiens
tgaactggcatcagaatc

SEQ ID NO: 8289653 - DNA, 22 bp, Homo sapiens
tgaaattatgcattgttgtacc

SEQ ID NO: 8289654 - DNA, 22 bp, Homo sapiens
tgaaattattcttaccaaggtg

SEQ ID NO: 8289655 - DNA, 20 bp, Homo sapiens
tgaaatagatactcagagat

SEQ ID NO: 8289656 - DNA, 22 bp, Homo sapiens
tgaaatagacttgcactatatg

SEQ ID NO: 8289657 - DNA, 22 bp, Homo sapiens
tgaaataggaaacagatgtttc

SEQ ID NO: 8289658 - DNA, 22 bp, Homo sapiens
tgaaataatatctggatcaatc

SEQ ID NO: 8289659 - DNA, 22 bp, Homo sapiens
tgaaatgcttaggaccagaagg

SEQ ID NO: 8289660 - DNA, 22 bp, Homo sapiens
tgaaatgcttctctgaaaatac

SEQ ID NO: 8289661 - DNA, 22 bp, Homo sapiens
tgaaatgaaacagaacatatca

SEQ ID NO: 8289662 - DNA, 22 bp, Homo sapiens
tgaaatgcttgggaccagaagt

SEQ ID NO: 8289663 - DNA, 22 bp, Homo sapiens
tgaaatctaccctattcagggt

SEQ ID NO: 8289664 - DNA, 22 bp, Homo sapiens
tgaaatgtgtaatgtggatgcc

SEQ ID NO: 8289665 - DNA, 22 bp, Homo sapiens
tgaaatgttggtaattttatat

SEQ ID NO: 8289666 - DNA, 22 bp, Homo sapiens
tgaattccattgccaaagtttt

SEQ ID NO: 8289667 - DNA, 22 bp, Homo sapiens
tgaattccctaagacaggtctt

SEQ ID NO: 8289668 - DNA, 20 bp, Homo sapiens
tgaattctagatgactggag

SEQ ID NO: 8289669 - DNA, 22 bp, Homo sapiens
tgaattcctaatctaaactaag

SEQ ID NO: 8289670 - DNA, 22 bp, Homo sapiens
tgaattcttttagaattcagtg

SEQ ID NO: 8289671 - DNA, 22 bp, Homo sapiens
tgaattgtggctttttccaatt

SEQ ID NO: 8289672 - DNA, 22 bp, Homo sapiens
tgacacaattttctgaccttca

SEQ ID NO: 8289673 - DNA, 22 bp, Homo sapiens
tgacaaaactgcaattactttt

SEQ ID NO: 8289674 - DNA, 22 bp, Homo sapiens
tgacaaagaccttcaacaagat

SEQ ID NO: 8289675 - DNA, 22 bp, Homo sapiens
tgaattatcttgtaattttgaa

SEQ ID NO: 8289676 - DNA, 19 bp, Homo sapiens
tgaattaaagattaaagtc

SEQ ID NO: 8289677 - DNA, 22 bp, Homo sapiens
tgaatccttcgcacttagacat

SEQ ID NO: 8289678 - DNA, 19 bp, Homo sapiens
tgaatgacgggcatgagca

SEQ ID NO: 8289679 - DNA, 22 bp, Homo sapiens
tgaatcctaattctatcactta

SEQ ID NO: 8289680 - DNA, 22 bp, Homo sapiens
tgaatcctagttgaagataagg

SEQ ID NO: 8289681 - DNA, 22 bp, Homo sapiens
tgaatcaatgaattgcacttca

SEQ ID NO: 8289682 - DNA, 22 bp, Homo sapiens
tgaataaattgagagcgaatgt

SEQ ID NO: 8289683 - DNA, 22 bp, Homo sapiens
tgaaggcatttgagttggtgag

SEQ ID NO: 8289684 - DNA, 22 bp, Homo sapiens
tgaaggcctaacttccagtgct

SEQ ID NO: 8289685 - DNA, 22 bp, Homo sapiens
tgaaggcaacctctgtggtcct

SEQ ID NO: 8289686 - DNA, 19 bp, Homo sapiens
tgaaggagggggatggcca

SEQ ID NO: 8289687 - DNA, 22 bp, Homo sapiens
tgaaggaggaatgtggcctcca

SEQ ID NO: 8289688 - DNA, 22 bp, Homo sapiens
tgaaggagggaagaaggctctg

SEQ ID NO: 8289689 - DNA, 22 bp, Homo sapiens
tgaaggagctgatgtaaggggt

SEQ ID NO: 8289690 - DNA, 22 bp, Homo sapiens
tgaaggagctcaatgatgatgc

SEQ ID NO: 8289691 - DNA, 22 bp, Homo sapiens
tgaaggagctcaggagatagtc

SEQ ID NO: 8289692 - DNA, 22 bp, Homo sapiens
tgaaggagctcaggagatagtc

SEQ ID NO: 8289693 - DNA, 22 bp, Homo sapiens
tgaagctggcttgacatggcct

SEQ ID NO: 8289694 - DNA, 22 bp, Homo sapiens
tgaagcctgaaagctggacagg

SEQ ID NO: 8289695 - DNA, 22 bp, Homo sapiens
tgaagcgtgacccctcacctct

SEQ ID NO: 8289696 - DNA, 19 bp, Homo sapiens
tgaagcgtcgctcctcttc

SEQ ID NO: 8289697 - DNA, 17 bp, Homo sapiens
tgaagcgtgcctttgaa

SEQ ID NO: 8289698 - DNA, 22 bp, Homo sapiens
tgaagccatccctcagatggcc

SEQ ID NO: 8289699 - DNA, 22 bp, Homo sapiens
tgaagccaccgaaccagaagag

SEQ ID NO: 8289700 - DNA, 22 bp, Homo sapiens
tgaagccataggacagaggata

SEQ ID NO: 8289701 - DNA, 22 bp, Homo sapiens
tgaagccagctttggaagacac

SEQ ID NO: 8289702 - DNA, 22 bp, Homo sapiens
tgaagccaatctgccaggcaga

SEQ ID NO: 8289703 - DNA, 22 bp, Homo sapiens
tgaagccaatctgccaggcaga

SEQ ID NO: 8289704 - DNA, 22 bp, Homo sapiens
tgacacagttgtcgactctaca

SEQ ID NO: 8289705 - DNA, 22 bp, Homo sapiens
tgacacaggtcaaatctacttt

SEQ ID NO: 8289706 - DNA, 22 bp, Homo sapiens
tgacacagtatcaaacatgatt

SEQ ID NO: 8289707 - DNA, 22 bp, Homo sapiens
tgacacagtgggggatcctttt

SEQ ID NO: 8289708 - DNA, 22 bp, Homo sapiens
tgacacagattagagacatacc

SEQ ID NO: 8289709 - DNA, 22 bp, Homo sapiens
tgacacagggcatgcagcagaa

SEQ ID NO: 8289710 - DNA, 23 bp, Homo sapiens
tgacagaccttcccagacagtca

SEQ ID NO: 8289711 - DNA, 22 bp, Homo sapiens
tgacagacatggaagccagagt

SEQ ID NO: 8289712 - DNA, 20 bp, Homo sapiens
tgacacttgatattgtcagt

SEQ ID NO: 8289713 - DNA, 22 bp, Homo sapiens
tgacaggcttgctaagacatag

SEQ ID NO: 8289714 - DNA, 22 bp, Homo sapiens
tgacagggacagtggagatgga

SEQ ID NO: 8289715 - DNA, 22 bp, Homo sapiens
tgacaggtgaaatgtccttatt

SEQ ID NO: 8289716 - DNA, 22 bp, Homo sapiens
tgacaggtcatataagcttgca

SEQ ID NO: 8289717 - DNA, 22 bp, Homo sapiens
tgacaggtcatataagcttgca

SEQ ID NO: 8289718 - DNA, 21 bp, Homo sapiens
tgacaggtatttatctggaaa

SEQ ID NO: 8289719 - DNA, 22 bp, Homo sapiens
tgacatgtatgtatttgtttat

SEQ ID NO: 8289720 - DNA, 22 bp, Homo sapiens
tgacatgtatatcttacgctat

SEQ ID NO: 8289721 - DNA, 22 bp, Homo sapiens
tgacatgtaagatggaaaagcg

SEQ ID NO: 8289722 - DNA, 22 bp, Homo sapiens
tgacagtgcatgtgacaaagga

SEQ ID NO: 8289723 - DNA, 22 bp, Homo sapiens
tgacaggttgtgtaggtggcca

SEQ ID NO: 8289724 - DNA, 19 bp, Homo sapiens
tgacaggttttatgtgttt

SEQ ID NO: 8289725 - DNA, 21 bp, Homo sapiens
tgacaggtttaggattaaaat

SEQ ID NO: 8289726 - DNA, 22 bp, Homo sapiens
tgacaggttcgttagtcatgtt

SEQ ID NO: 8289727 - DNA, 22 bp, Homo sapiens
tgacaggtgctgggggcagtgt

SEQ ID NO: 8289728 - DNA, 22 bp, Homo sapiens
tgacaggtgattgtgaactaag

SEQ ID NO: 8289729 - DNA, 22 bp, Homo sapiens
tgactcatatttcatggatacg

SEQ ID NO: 8289730 - DNA, 22 bp, Homo sapiens
tgactccacaatttgacttata

SEQ ID NO: 8289731 - DNA, 22 bp, Homo sapiens
tgactaaacgcatgaatagctc

SEQ ID NO: 8289732 - DNA, 22 bp, Homo sapiens
tgaccttatttgaaaatagaga

SEQ ID NO: 8289733 - DNA, 21 bp, Homo sapiens
tgactgaggcttcttcacaca

SEQ ID NO: 8289734 - DNA, 21 bp, Homo sapiens
tgactgaggcttcttcacaca

SEQ ID NO: 8289735 - DNA, 22 bp, Homo sapiens
tgactggattgtcattacgacg

SEQ ID NO: 8289736 - DNA, 22 bp, Homo sapiens
tgacttgtctctttgggagaca

SEQ ID NO: 8289737 - DNA, 22 bp, Homo sapiens
tgacttccagcaacttcctcca

SEQ ID NO: 8289738 - DNA, 22 bp, Homo sapiens
tgacatgtggctttgacccagg

SEQ ID NO: 8289739 - DNA, 22 bp, Homo sapiens
tgacatgtgctcatcttggcta

SEQ ID NO: 8289740 - DNA, 22 bp, Homo sapiens
tgacatgtgtctccttccgtct

SEQ ID NO: 8289741 - DNA, 22 bp, Homo sapiens
tgacatgtgtaatcagctccgt

SEQ ID NO: 8289742 - DNA, 22 bp, Homo sapiens
tgacatgttagggaaatgtgat

SEQ ID NO: 8289743 - DNA, 22 bp, Homo sapiens
tgacatgtcctgagaagatggc

SEQ ID NO: 8289744 - DNA, 22 bp, Homo sapiens
tgacatgtccaggtggtcctgt

SEQ ID NO: 8289745 - DNA, 22 bp, Homo sapiens
tgacatgtatgttgttggcatg

SEQ ID NO: 8289746 - DNA, 22 bp, Homo sapiens
tgacattattatcatgtcacca

SEQ ID NO: 8289747 - DNA, 22 bp, Homo sapiens
tgacattgtgtgcatttaaagt

SEQ ID NO: 8289748 - DNA, 22 bp, Homo sapiens
tgcagaggagctggaaggctgg

SEQ ID NO: 8289749 - DNA, 22 bp, Homo sapiens
tgcagaggagtcagcctgggca

SEQ ID NO: 8289750 - DNA, 21 bp, Homo sapiens
tgcagaggcacaaacaagccc

SEQ ID NO: 8289751 - DNA, 22 bp, Homo sapiens
tgcagaggcatttattgatgta

SEQ ID NO: 8289752 - DNA, 22 bp, Homo sapiens
tgcagaggctggctcgccgggt

SEQ ID NO: 8289753 - DNA, 22 bp, Homo sapiens
tgcagaggcgccgtgggtgggg

SEQ ID NO: 8289754 - DNA, 22 bp, Homo sapiens
tgcagatggggatcagtggctc

SEQ ID NO: 8289755 - DNA, 22 bp, Homo sapiens
tgcagatgcctgggctgcacca

SEQ ID NO: 8289756 - DNA, 22 bp, Homo sapiens
tgcagcaacaagatagaatggc

SEQ ID NO: 8289757 - DNA, 22 bp, Homo sapiens
tgcagcactgttcacaatagcc

SEQ ID NO: 8289758 - DNA, 22 bp, Homo sapiens
tgcagcagaatatggctgcagg

SEQ ID NO: 8289759 - DNA, 22 bp, Homo sapiens
tgcagcagaatatggctgcagg

SEQ ID NO: 8289760 - DNA, 21 bp, Homo sapiens
tgcagcagaagtctctgtgtc

SEQ ID NO: 8289761 - DNA, 20 bp, Homo sapiens
tgcagcagaagcccatgctc

SEQ ID NO: 8289762 - DNA, 23 bp, Homo sapiens
tgcagagggactgaagccagctt

SEQ ID NO: 8289763 - DNA, 22 bp, Homo sapiens
tgcagagggacagccacagctc

SEQ ID NO: 8289764 - DNA, 22 bp, Homo sapiens
tgcagagggaaaaggtgctcct

SEQ ID NO: 8289765 - DNA, 22 bp, Homo sapiens
tgcagagtaacgatcacatata

SEQ ID NO: 8289766 - DNA, 22 bp, Homo sapiens
tgcagagtaacgatcacatata

SEQ ID NO: 8289767 - DNA, 22 bp, Homo sapiens
tgcagagtagtgaggggacaga

SEQ ID NO: 8289768 - DNA, 22 bp, Homo sapiens
tgcagagtagctataccatttt

SEQ ID NO: 8289769 - DNA, 22 bp, Homo sapiens
tgcagagtcacccagataatta

SEQ ID NO: 8289770 - DNA, 22 bp, Homo sapiens
tgcagagtcccaggacccagag

SEQ ID NO: 8289771 - DNA, 22 bp, Homo sapiens
tgcagagtcctctggagggact

SEQ ID NO: 8289772 - DNA, 19 bp, Homo sapiens
tgcagagggtaggaaggcc

SEQ ID NO: 8289773 - DNA, 22 bp, Homo sapiens
tgcagagtgaggaagaactgca

SEQ ID NO: 8289774 - DNA, 22 bp, Homo sapiens
tgcagagtgaagacatcacccc

SEQ ID NO: 8289775 - DNA, 22 bp, Homo sapiens
tgcagagtgggagaggtgcggg

SEQ ID NO: 8289776 - DNA, 22 bp, Homo sapiens
tgcagagtggattctgtatacc

SEQ ID NO: 8289777 - DNA, 22 bp, Homo sapiens
tgcagagttgctttgatagtcc

SEQ ID NO: 8289778 - DNA, 23 bp, Homo sapiens
tgcagagtgtcacttgaaaacca

SEQ ID NO: 8289779 - DNA, 22 bp, Homo sapiens
tgcacttttatatcactctggc

SEQ ID NO: 8289780 - DNA, 22 bp, Homo sapiens
tgcacgtgggctctctgctctt

SEQ ID NO: 8289781 - DNA, 22 bp, Homo sapiens
tgcaccttgtccatttttggcc

SEQ ID NO: 8289782 - DNA, 22 bp, Homo sapiens
tgcagaacgggtcttctagcac

SEQ ID NO: 8289783 - DNA, 22 bp, Homo sapiens
tgcacaggccttgaagggagag

SEQ ID NO: 8289784 - DNA, 22 bp, Homo sapiens
tgcacaggtatgcaaagcatgt

SEQ ID NO: 8289785 - DNA, 22 bp, Homo sapiens
tgcacaggtgagactcaggaag

SEQ ID NO: 8289786 - DNA, 20 bp, Homo sapiens
tgcacagggtgggaagcaac

SEQ ID NO: 8289787 - DNA, 22 bp, Homo sapiens
tgcacaggtatgcaaagcatgt

SEQ ID NO: 8289788 - DNA, 23 bp, Homo sapiens
tgcacaggacggccttataagta

SEQ ID NO: 8289789 - DNA, 22 bp, Homo sapiens
tgcacagcgggtgtctgtcagg

SEQ ID NO: 8289790 - DNA, 18 bp, Homo sapiens
tgcaccctaagggcccca

SEQ ID NO: 8289791 - DNA, 22 bp, Homo sapiens
tgcacagttggctacatcgtgg

SEQ ID NO: 8289792 - DNA, 22 bp, Homo sapiens
tgcacagtgtaatgaatcagaa

SEQ ID NO: 8289793 - DNA, 22 bp, Homo sapiens
tgcagctttgctctggtcccca

SEQ ID NO: 8289794 - DNA, 22 bp, Homo sapiens
tgcagcttctccatctccttgt

SEQ ID NO: 8289795 - DNA, 22 bp, Homo sapiens
tgcaggagacataatagggact

SEQ ID NO: 8289796 - DNA, 22 bp, Homo sapiens
tgcaggagcccaggaatactat

SEQ ID NO: 8289797 - DNA, 22 bp, Homo sapiens
tgcaggagcaccagctcaccct

SEQ ID NO: 8289798 - DNA, 22 bp, Homo sapiens
tgcaggagagctggtctggccc

SEQ ID NO: 8289799 - DNA, 21 bp, Homo sapiens
tgcaggctacttctgactcta

SEQ ID NO: 8289800 - DNA, 23 bp, Homo sapiens
tgcaggctaggaagagagccttc

SEQ ID NO: 8289801 - DNA, 22 bp, Homo sapiens
tgcaggctatcctttgctgcaa

SEQ ID NO: 8289802 - DNA, 22 bp, Homo sapiens
tgcaggctccaggtgcacatat

SEQ ID NO: 8289803 - DNA, 22 bp, Homo sapiens
tgcaggctcaccctggagctga

SEQ ID NO: 8289804 - DNA, 22 bp, Homo sapiens
tgcagctgctcttcatttcccc

SEQ ID NO: 8289805 - DNA, 22 bp, Homo sapiens
tgcagctgaggccagctatgcc

SEQ ID NO: 8289806 - DNA, 22 bp, Homo sapiens
tgcagctggtatcccatggatt

SEQ ID NO: 8289807 - DNA, 22 bp, Homo sapiens
tgcagctggtatcccatggatt

SEQ ID NO: 8289808 - DNA, 22 bp, Homo sapiens
tgcagcagcagggaggaggctc

SEQ ID NO: 8289809 - DNA, 21 bp, Homo sapiens
tgcagcagagtaagcagggga

SEQ ID NO: 8289810 - DNA, 22 bp, Homo sapiens
tgcagcagggcccaggcacaga

SEQ ID NO: 8289811 - DNA, 22 bp, Homo sapiens
tgcagcagctccaggttaccct

SEQ ID NO: 8289812 - DNA, 22 bp, Homo sapiens
tgcagcaggagccaggcctggt

SEQ ID NO: 8289813 - DNA, 22 bp, Homo sapiens
tgcagcagcagggaggaggctc

SEQ ID NO: 8289814 - DNA, 22 bp, Homo sapiens
tgcagcagcagggaggaggctc

SEQ ID NO: 8289815 - DNA, 23 bp, Homo sapiens
tgcagccactcaggagctcagtg

SEQ ID NO: 8289816 - DNA, 22 bp, Homo sapiens
tgcagccagcaagtgaatacat

SEQ ID NO: 8289817 - DNA, 22 bp, Homo sapiens
tgcagcagggcccaggcacaga

SEQ ID NO: 8289818 - DNA, 23 bp, Homo sapiens
tgcagcagggtggtctacttctc

SEQ ID NO: 8289819 - DNA, 22 bp, Homo sapiens
tgcagccatcgcagagtctgta

SEQ ID NO: 8289820 - DNA, 22 bp, Homo sapiens
tgcagccatttgaaaagcagtt

SEQ ID NO: 8289821 - DNA, 22 bp, Homo sapiens
tgcagcccctgaaaatggcagc

SEQ ID NO: 8289822 - DNA, 22 bp, Homo sapiens
tgattctaggtccattatttgc

SEQ ID NO: 8289823 - DNA, 22 bp, Homo sapiens
tgattctgccctttcttctgac

SEQ ID NO: 8289824 - DNA, 22 bp, Homo sapiens
tgattctcaaaggtagactggg

SEQ ID NO: 8289825 - DNA, 22 bp, Homo sapiens
tgattgtataggggttattaat

SEQ ID NO: 8289826 - DNA, 22 bp, Homo sapiens
tgattgtatgattgaaatattt

SEQ ID NO: 8289827 - DNA, 18 bp, Homo sapiens
tgattcaagttgccctcc

SEQ ID NO: 8289828 - DNA, 22 bp, Homo sapiens
tgatggtattaggaggtgaggc

SEQ ID NO: 8289829 - DNA, 22 bp, Homo sapiens
tgatggaagagctaacaatatc

SEQ ID NO: 8289830 - DNA, 22 bp, Homo sapiens
tgatgcccccaaatctggctca

SEQ ID NO: 8289831 - DNA, 22 bp, Homo sapiens
tgatattttatgagctttcata

SEQ ID NO: 8289832 - DNA, 22 bp, Homo sapiens
tgatcaaaacattactccacca

SEQ ID NO: 8289833 - DNA, 22 bp, Homo sapiens
tgatctgagagcagatcaccat

SEQ ID NO: 8289834 - DNA, 22 bp, Homo sapiens
tgatatcagctggcagcagtgg

SEQ ID NO: 8289835 - DNA, 22 bp, Homo sapiens
tgagttctagtggctgcagatt

SEQ ID NO: 8289836 - DNA, 20 bp, Homo sapiens
tgagtggccactgggtcgca

SEQ ID NO: 8289837 - DNA, 22 bp, Homo sapiens
tgagtgggttatcaggaaaggt

SEQ ID NO: 8289838 - DNA, 22 bp, Homo sapiens
tgcaaggaagggacagctgaga

SEQ ID NO: 8289839 - DNA, 22 bp, Homo sapiens
tgcaagattttgacactcgtct

SEQ ID NO: 8289840 - DNA, 22 bp, Homo sapiens
tgcaagggtagaagtgatggca

SEQ ID NO: 8289841 - DNA, 21 bp, Homo sapiens
tgcaatccagcctgggcgaca

SEQ ID NO: 8289842 - DNA, 22 bp, Homo sapiens
tgcaagagggtgttcagtttgt

SEQ ID NO: 8289843 - DNA, 22 bp, Homo sapiens
tgcaagagcccagggccaggaa

SEQ ID NO: 8289844 - DNA, 22 bp, Homo sapiens
tgcaagaggaattctagaagca

SEQ ID NO: 8289845 - DNA, 22 bp, Homo sapiens
tgcaagagcagaaagaactgag

SEQ ID NO: 8289846 - DNA, 22 bp, Homo sapiens
tgcaagagcccaaactatatac

SEQ ID NO: 8289847 - DNA, 22 bp, Homo sapiens
tgcaagagcagaaagaactgag

SEQ ID NO: 8289848 - DNA, 22 bp, Homo sapiens
tgcaaattgcatgatgtgtatc

SEQ ID NO: 8289849 - DNA, 23 bp, Homo sapiens
tgcaacaatgaggaaagctactg

SEQ ID NO: 8289850 - DNA, 22 bp, Homo sapiens
tgcaacagactttattaactct

SEQ ID NO: 8289851 - DNA, 22 bp, Homo sapiens
tgcaacattattaaactaagca

SEQ ID NO: 8289852 - DNA, 23 bp, Homo sapiens
tgcaactgtgtcagaagttagaa

SEQ ID NO: 8289853 - DNA, 19 bp, Homo sapiens
tgcacacagataagtatct

SEQ ID NO: 8289854 - DNA, 22 bp, Homo sapiens
tgcacacacaggagtctcctcc

SEQ ID NO: 8289855 - DNA, 20 bp, Homo sapiens
tgcacacaccctgtcctcca

SEQ ID NO: 8289856 - DNA, 22 bp, Homo sapiens
tgcaatttgacgtcagcacagt

SEQ ID NO: 8289857 - DNA, 22 bp, Homo sapiens
tgcaatttcaggcatatattgt

SEQ ID NO: 8289858 - DNA, 22 bp, Homo sapiens
tgcaatttatgtgcaagtggtt

SEQ ID NO: 8289859 - DNA, 21 bp, Homo sapiens
tgcaatttagacttgaacatt

SEQ ID NO: 8289860 - DNA, 22 bp, Homo sapiens
tgcaatttcaaatatcagaaag

SEQ ID NO: 8289861 - DNA, 22 bp, Homo sapiens
tgcaatctcggcactttgggag

SEQ ID NO: 8289862 - DNA, 22 bp, Homo sapiens
tgcaatctcggcactttgggag

SEQ ID NO: 8289863 - DNA, 22 bp, Homo sapiens
tgcaatcttgtggtttcaagga

SEQ ID NO: 8289864 - DNA, 22 bp, Homo sapiens
tgcacaagtcagagtaacattt

SEQ ID NO: 8289865 - DNA, 22 bp, Homo sapiens
tgcaatttttatcaattcagca

SEQ ID NO: 8289866 - DNA, 22 bp, Homo sapiens
tgcaattttcagaaattccaaa

SEQ ID NO: 8289867 - DNA, 22 bp, Homo sapiens
tgcaattttaatacattagagg

SEQ ID NO: 8289868 - DNA, 22 bp, Homo sapiens
tgcaatttggggaagaaagaga

SEQ ID NO: 8289869 - DNA, 22 bp, Homo sapiens
tgcaaacaatttcctataaagt

SEQ ID NO: 8289870 - DNA, 20 bp, Homo sapiens
tgcaaacacagagtgtatga

SEQ ID NO: 8289871 - DNA, 22 bp, Homo sapiens
tgcaaatgtgtggtgaggcatt

SEQ ID NO: 8289872 - DNA, 22 bp, Homo sapiens
tgcaaatgtgtggtgaggcatt

SEQ ID NO: 8289873 - DNA, 22 bp, Homo sapiens
tgcaaatgtgttttaaaccaaa

SEQ ID NO: 8289874 - DNA, 22 bp, Homo sapiens
tgcaaatgatgaaactaacttt

SEQ ID NO: 8289875 - DNA, 22 bp, Homo sapiens
tgcaaagatgaaatattaaagg

SEQ ID NO: 8289876 - DNA, 21 bp, Homo sapiens
tgatttatgcccaagtccctg

SEQ ID NO: 8289877 - DNA, 22 bp, Homo sapiens
tgatttaaaagaaacattgtct

SEQ ID NO: 8289878 - DNA, 22 bp, Homo sapiens
tgattttgtcatgtttctgata

SEQ ID NO: 8289879 - DNA, 22 bp, Homo sapiens
tgcccacagctcagggctgctc

SEQ ID NO: 8289880 - DNA, 22 bp, Homo sapiens
tgcccaagccgagctctctgtt

SEQ ID NO: 8289881 - DNA, 22 bp, Homo sapiens
tgcccaagcagaggagtgattc

SEQ ID NO: 8289882 - DNA, 22 bp, Homo sapiens
tgcccaagtgtttggctgagtc

SEQ ID NO: 8289883 - DNA, 22 bp, Homo sapiens
tgcccaaggatccattggctgg

SEQ ID NO: 8289884 - DNA, 22 bp, Homo sapiens
tgcccaaggtggccttttactc

SEQ ID NO: 8289885 - DNA, 22 bp, Homo sapiens
tgcccaaggtcacctagttagt

SEQ ID NO: 8289886 - DNA, 23 bp, Homo sapiens
tgccattttccatctcatgcaga

SEQ ID NO: 8289887 - DNA, 22 bp, Homo sapiens
tgccatggagtgggtcaactat

SEQ ID NO: 8289888 - DNA, 20 bp, Homo sapiens
tgcccagcaagagtgcagtt

SEQ ID NO: 8289889 - DNA, 22 bp, Homo sapiens
tgcccagcactgtgccagtcac

SEQ ID NO: 8289890 - DNA, 18 bp, Homo sapiens
tgcccaccagaagaggga

SEQ ID NO: 8289891 - DNA, 22 bp, Homo sapiens
tgcccacctttactgtgattta

SEQ ID NO: 8289892 - DNA, 22 bp, Homo sapiens
tgcccacctaacagtgtttgga

SEQ ID NO: 8289893 - DNA, 18 bp, Homo sapiens
tgcccagaaaagcaggga

SEQ ID NO: 8289894 - DNA, 22 bp, Homo sapiens
tgcccagggtggagtgcagcgg

SEQ ID NO: 8289895 - DNA, 22 bp, Homo sapiens
tgcccctctcctgtgatccaag

SEQ ID NO: 8289896 - DNA, 20 bp, Homo sapiens
tgccccaggcctgcacctgc

SEQ ID NO: 8289897 - DNA, 19 bp, Homo sapiens
tgcccaggccaggttgggc

SEQ ID NO: 8289898 - DNA, 22 bp, Homo sapiens
tgcccaggctggagtacagtgg

SEQ ID NO: 8289899 - DNA, 22 bp, Homo sapiens
tgccagggccatagggagtcta

SEQ ID NO: 8289900 - DNA, 22 bp, Homo sapiens
tgccagggtgtcaggagagcta

SEQ ID NO: 8289901 - DNA, 22 bp, Homo sapiens
tgccatcacctttctgaacgtt

SEQ ID NO: 8289902 - DNA, 22 bp, Homo sapiens
tgccagtccattgcctgcgttc

SEQ ID NO: 8289903 - DNA, 22 bp, Homo sapiens
tgccatcactgaacttctgaaa

SEQ ID NO: 8289904 - DNA, 22 bp, Homo sapiens
tgccatcagctgactccaaggt

SEQ ID NO: 8289905 - DNA, 22 bp, Homo sapiens
tgccatctgcacccacctgccc

SEQ ID NO: 8289906 - DNA, 22 bp, Homo sapiens
tgccagggaccctgtcggccct

SEQ ID NO: 8289907 - DNA, 22 bp, Homo sapiens
tgccagggaccctgtcggccct

SEQ ID NO: 8289908 - DNA, 22 bp, Homo sapiens
tgccgtggggctgaggctggag

SEQ ID NO: 8289909 - DNA, 22 bp, Homo sapiens
tgccgcagtgcggggagggccc

SEQ ID NO: 8289910 - DNA, 22 bp, Homo sapiens
tgcctaggctggagtgtagtgg

SEQ ID NO: 8289911 - DNA, 22 bp, Homo sapiens
tgcctagaactttattctttat

SEQ ID NO: 8289912 - DNA, 22 bp, Homo sapiens
tgcctcagagacctgacagtac

SEQ ID NO: 8289913 - DNA, 22 bp, Homo sapiens
tgcctcaagccctccactgcac

SEQ ID NO: 8289914 - DNA, 22 bp, Homo sapiens
tgccctgtgccagacttcctgg

SEQ ID NO: 8289915 - DNA, 22 bp, Homo sapiens
tgccctgtgggtatctgatggc

SEQ ID NO: 8289916 - DNA, 22 bp, Homo sapiens
tgccctgtgctggaatcttccc

SEQ ID NO: 8289917 - DNA, 22 bp, Homo sapiens
tgccctgtgtgtgcaagcactg

SEQ ID NO: 8289918 - DNA, 22 bp, Homo sapiens
tgccccttctacccgtctctgt

SEQ ID NO: 8289919 - DNA, 22 bp, Homo sapiens
tgcccctcttgagaagctcagc

SEQ ID NO: 8289920 - DNA, 22 bp, Homo sapiens
tgcccctcttgctggccctgtc

SEQ ID NO: 8289921 - DNA, 22 bp, Homo sapiens
tgcccctgacctcaggcgaagg

SEQ ID NO: 8289922 - DNA, 22 bp, Homo sapiens
tgcccgctgctgctcagtctgt

SEQ ID NO: 8289923 - DNA, 22 bp, Homo sapiens
tgcctgctttctgggctgccat

SEQ ID NO: 8289924 - DNA, 21 bp, Homo sapiens
tgcctgcattctatcagacca

SEQ ID NO: 8289925 - DNA, 22 bp, Homo sapiens
tgcctgcagcgtctccagcagg

SEQ ID NO: 8289926 - DNA, 22 bp, Homo sapiens
tgcctgcatcttggaggcccca

SEQ ID NO: 8289927 - DNA, 22 bp, Homo sapiens
tgcctcagagtgggcttgctat

SEQ ID NO: 8289928 - DNA, 22 bp, Homo sapiens
tgcctccattcctgggtcattg

SEQ ID NO: 8289929 - DNA, 22 bp, Homo sapiens
tgcctcagtctaaagtctctca

SEQ ID NO: 8289930 - DNA, 22 bp, Homo sapiens
tgcctccttcaggagggcccgg

SEQ ID NO: 8289931 - DNA, 23 bp, Homo sapiens
tgcctctgcctccctagtctgca

SEQ ID NO: 8289932 - DNA, 22 bp, Homo sapiens
tgcctctgaggaagattgtgtt

SEQ ID NO: 8289933 - DNA, 22 bp, Homo sapiens
tgcctctgttgagccttggctg

SEQ ID NO: 8289934 - DNA, 22 bp, Homo sapiens
tgcctctgttgagccttggctg

SEQ ID NO: 8289935 - DNA, 22 bp, Homo sapiens
tgcctctgtgtgcaggtgagca

SEQ ID NO: 8289936 - DNA, 22 bp, Homo sapiens
tgcctctggttatctggtacct

SEQ ID NO: 8289937 - DNA, 22 bp, Homo sapiens
tgcctctgtggaaatggtggtc

SEQ ID NO: 8289938 - DNA, 22 bp, Homo sapiens
tgcctctgctgctgtggcatca

SEQ ID NO: 8289939 - DNA, 22 bp, Homo sapiens
tgcctctggcctttggtgccca

SEQ ID NO: 8289940 - DNA, 22 bp, Homo sapiens
tgcctctgtgggccttcctggc

SEQ ID NO: 8289941 - DNA, 22 bp, Homo sapiens
tgcctctgtgggccttcctggc

SEQ ID NO: 8289942 - DNA, 22 bp, Homo sapiens
tgcctctgtgggcagagctgcc

SEQ ID NO: 8289943 - DNA, 22 bp, Homo sapiens
tgcagggaaaacccaggatgct

SEQ ID NO: 8289944 - DNA, 22 bp, Homo sapiens
tgcaggcttggatcacatctcc

SEQ ID NO: 8289945 - DNA, 22 bp, Homo sapiens
tgcaggctgtttggtggatctc

SEQ ID NO: 8289946 - DNA, 21 bp, Homo sapiens
tgcaggctgtgcgctcctgcc

SEQ ID NO: 8289947 - DNA, 21 bp, Homo sapiens
tgcaggctgtttaagaggcaa

SEQ ID NO: 8289948 - DNA, 22 bp, Homo sapiens
tgcagggaacttggacagctag

SEQ ID NO: 8289949 - DNA, 22 bp, Homo sapiens
tgcagggaaagggcactgggct

SEQ ID NO: 8289950 - DNA, 22 bp, Homo sapiens
tgcagggaaagtgttggcagca

SEQ ID NO: 8289951 - DNA, 22 bp, Homo sapiens
tgcagggaagtcccagctcctg

SEQ ID NO: 8289952 - DNA, 22 bp, Homo sapiens
tgcagggaagcaagggtggctc

SEQ ID NO: 8289953 - DNA, 22 bp, Homo sapiens
tgcagggaatccagtctagggt

SEQ ID NO: 8289954 - DNA, 22 bp, Homo sapiens
tgcaggctggaggagggactaa

SEQ ID NO: 8289955 - DNA, 22 bp, Homo sapiens
tgcaggctgggaagagggacaa

SEQ ID NO: 8289956 - DNA, 22 bp, Homo sapiens
tgcaggctgtaatctgaggcta

SEQ ID NO: 8289957 - DNA, 22 bp, Homo sapiens
tgcaggctctctgctgccagat

SEQ ID NO: 8289958 - DNA, 22 bp, Homo sapiens
tgcaggctccatgaggacaggc

SEQ ID NO: 8289959 - DNA, 22 bp, Homo sapiens
tgcaggctgcagtctcaggtgg

SEQ ID NO: 8289960 - DNA, 22 bp, Homo sapiens
tgcaggctgaggctggctcaac

SEQ ID NO: 8289961 - DNA, 22 bp, Homo sapiens
tgcaggctgcacccctgccctg

SEQ ID NO: 8289962 - DNA, 22 bp, Homo sapiens
tgcaggctctgtgtgtgcctgg

SEQ ID NO: 8289963 - DNA, 22 bp, Homo sapiens
tgcaggctcttggtgacgtggg

SEQ ID NO: 8289964 - DNA, 22 bp, Homo sapiens
tgcagggattgttggcatccat

SEQ ID NO: 8289965 - DNA, 22 bp, Homo sapiens
tgcagggattagaggccgggga

SEQ ID NO: 8289966 - DNA, 22 bp, Homo sapiens
tgcagggattatgtaggggttg

SEQ ID NO: 8289967 - DNA, 22 bp, Homo sapiens
tgcagggatgctagaggtaaga

SEQ ID NO: 8289968 - DNA, 21 bp, Homo sapiens
tgcagggatctttctgcctga

SEQ ID NO: 8289969 - DNA, 22 bp, Homo sapiens
tgcagggccgctggaggtcatg

SEQ ID NO: 8289970 - DNA, 22 bp, Homo sapiens
tgcagggctataactccattct

SEQ ID NO: 8289971 - DNA, 23 bp, Homo sapiens
tgcagtcaactctaactgctaag

SEQ ID NO: 8289972 - DNA, 21 bp, Homo sapiens
tgcagtatgtatttgtatcca

SEQ ID NO: 8289973 - DNA, 22 bp, Homo sapiens
tgcagtgggccggaggccaggg

SEQ ID NO: 8289974 - DNA, 22 bp, Homo sapiens
tgcagtggtggtaaagatgctc

SEQ ID NO: 8289975 - DNA, 23 bp, Homo sapiens
tgcagtgtttaacaatgacttga

SEQ ID NO: 8289976 - DNA, 23 bp, Homo sapiens
tgcagtgtttaacaatgacttga

SEQ ID NO: 8289977 - DNA, 22 bp, Homo sapiens
tgcagtggttgagagcccagac

SEQ ID NO: 8289978 - DNA, 22 bp, Homo sapiens
tgcagtgtagaaaaagagtgag

SEQ ID NO: 8289979 - DNA, 22 bp, Homo sapiens
tgcaggtgtgtgcaagggaggg

SEQ ID NO: 8289980 - DNA, 22 bp, Homo sapiens
tgcaggtgtaaattttcaagag

SEQ ID NO: 8289981 - DNA, 22 bp, Homo sapiens
tgcaggtgtctccagggcaggt

SEQ ID NO: 8289982 - DNA, 22 bp, Homo sapiens
tgcaggtggtttggacactgct

SEQ ID NO: 8289983 - DNA, 22 bp, Homo sapiens
tgcaggtggtttggacactgct

SEQ ID NO: 8289984 - DNA, 22 bp, Homo sapiens
tgcagggtggagcggaagcgga

SEQ ID NO: 8289985 - DNA, 22 bp, Homo sapiens
tgcagggctcctggctccaatc

SEQ ID NO: 8289986 - DNA, 20 bp, Homo sapiens
tgcagggctgcctcccagct

SEQ ID NO: 8289987 - DNA, 22 bp, Homo sapiens
tgcaggtggctccagggactgc

SEQ ID NO: 8289988 - DNA, 22 bp, Homo sapiens
tgcaggtggacacgggagacgg

SEQ ID NO: 8289989 - DNA, 22 bp, Homo sapiens
tgcaggtagcaggtacggttgt

SEQ ID NO: 8289990 - DNA, 22 bp, Homo sapiens
tgcaggtacttgacaacttggg

SEQ ID NO: 8289991 - DNA, 23 bp, Homo sapiens
tgcagggtgttcctgcctttgct

SEQ ID NO: 8289992 - DNA, 19 bp, Homo sapiens
tgccaaatccatgcccagg

SEQ ID NO: 8289993 - DNA, 22 bp, Homo sapiens
tgccaaaatgggctttataccg

SEQ ID NO: 8289994 - DNA, 22 bp, Homo sapiens
tgccaaaatggccaaaagctag

SEQ ID NO: 8289995 - DNA, 22 bp, Homo sapiens
tgcatttattaccaggctttca

SEQ ID NO: 8289996 - DNA, 22 bp, Homo sapiens
tgcatttattaccaggctttca

SEQ ID NO: 8289997 - DNA, 22 bp, Homo sapiens
tgcatttccagatttctggagt

SEQ ID NO: 8289998 - DNA, 22 bp, Homo sapiens
tgcatttatttgaattgatcta

SEQ ID NO: 8289999 - DNA, 22 bp, Homo sapiens
tgcattgagtcatttcagtatg

SEQ ID NO: 8290000 - DNA, 22 bp, Homo sapiens
tgcatttacggtacaacagcag

SEQ ID NO: 8290001 - DNA, 22 bp, Homo sapiens
tgccagagagtggctgggtgtc

SEQ ID NO: 8290002 - DNA, 22 bp, Homo sapiens
tgccagagagtggctgggtgtc

SEQ ID NO: 8290003 - DNA, 22 bp, Homo sapiens
tgccagagaagacccagtcact

SEQ ID NO: 8290004 - DNA, 22 bp, Homo sapiens
tgccagccagggaagctcaccc

SEQ ID NO: 8290005 - DNA, 22 bp, Homo sapiens
tgccaccttgtgcagcaggagg

SEQ ID NO: 8290006 - DNA, 20 bp, Homo sapiens
tgccacctggtttaagtgtg

SEQ ID NO: 8290007 - DNA, 22 bp, Homo sapiens
tgccacctcctctaacaagtgg

SEQ ID NO: 8290008 - DNA, 22 bp, Homo sapiens
tgccacctggacaaccttatgc

SEQ ID NO: 8290009 - DNA, 22 bp, Homo sapiens
tgccactggggctaggactgtt

SEQ ID NO: 8290010 - DNA, 22 bp, Homo sapiens
tgccacatggtgcatttcctag

SEQ ID NO: 8290011 - DNA, 22 bp, Homo sapiens
tgcatggataaaagtatattat

SEQ ID NO: 8290012 - DNA, 22 bp, Homo sapiens
tgcatggaggataataattgag

SEQ ID NO: 8290013 - DNA, 22 bp, Homo sapiens
tgcatggtgaatacagttcatt

SEQ ID NO: 8290014 - DNA, 20 bp, Homo sapiens
tgcatggcgcacatctgtgg

SEQ ID NO: 8290015 - DNA, 22 bp, Homo sapiens
tgcatgtttctgtatgttaatg

SEQ ID NO: 8290016 - DNA, 22 bp, Homo sapiens
tgcatgttatagaattttaact

SEQ ID NO: 8290017 - DNA, 22 bp, Homo sapiens
tgcatgttccaactccatcact

SEQ ID NO: 8290018 - DNA, 19 bp, Homo sapiens
tgcatgtgttctcccattg

SEQ ID NO: 8290019 - DNA, 22 bp, Homo sapiens
tgcatgtgtttcccagcaagct

SEQ ID NO: 8290020 - DNA, 22 bp, Homo sapiens
tgcatgtggacccctggtgcct

SEQ ID NO: 8290021 - DNA, 22 bp, Homo sapiens
tgcatgtgtcgggcctgtgcta

SEQ ID NO: 8290022 - DNA, 22 bp, Homo sapiens
tgcatggagatatactatttga

SEQ ID NO: 8290023 - DNA, 22 bp, Homo sapiens
tgcatgcatgtttttacccaca

SEQ ID NO: 8290024 - DNA, 22 bp, Homo sapiens
tgcatgcacttggctggcacgt

SEQ ID NO: 8290025 - DNA, 22 bp, Homo sapiens
tgcatgcagctggtcgggcgcc

SEQ ID NO: 8290026 - DNA, 22 bp, Homo sapiens
tgcatgcataaatgtacacaca

SEQ ID NO: 8290027 - DNA, 22 bp, Homo sapiens
tgcatgcatgctactgggaggt

SEQ ID NO: 8290028 - DNA, 22 bp, Homo sapiens
tgcatgcacgtatctgcgtgtg

SEQ ID NO: 8290029 - DNA, 22 bp, Homo sapiens
tgcatgcacccagccgggtatt

SEQ ID NO: 8290030 - DNA, 22 bp, Homo sapiens
tgcatgcacatgtaggtatggt

SEQ ID NO: 8290031 - DNA, 22 bp, Homo sapiens
tgcatgcactatctagatgatg

SEQ ID NO: 8290032 - DNA, 22 bp, Homo sapiens
tgcatgcagcatatgaggcctc

SEQ ID NO: 8290033 - DNA, 22 bp, Homo sapiens
tgcatgcacttggctggcacgt

SEQ ID NO: 8290034 - DNA, 22 bp, Homo sapiens
tgcatgcaaaaaaatctgcatt

SEQ ID NO: 8290035 - DNA, 22 bp, Homo sapiens
tgcatctttctgcatatgtaaa

SEQ ID NO: 8290036 - DNA, 22 bp, Homo sapiens
tgcagttcaaggttgtacagct

SEQ ID NO: 8290037 - DNA, 22 bp, Homo sapiens
tgcagttctaagtagacaagtc

SEQ ID NO: 8290038 - DNA, 19 bp, Homo sapiens
tgcataaattatatacttt

SEQ ID NO: 8290039 - DNA, 22 bp, Homo sapiens
tgcataaagtgccatagtatta

SEQ ID NO: 8290040 - DNA, 22 bp, Homo sapiens
tctcccaggtcatacacagaga

SEQ ID NO: 8290041 - DNA, 22 bp, Homo sapiens
tctcccaggctggagtgcagtg

SEQ ID NO: 8290042 - DNA, 22 bp, Homo sapiens
tctcccaggtgggtgcctggag

SEQ ID NO: 8290043 - DNA, 22 bp, Homo sapiens
tctcccagtcctctgtgcttac

SEQ ID NO: 8290044 - DNA, 22 bp, Homo sapiens
tctcccaggcaggagtgcagtg

SEQ ID NO: 8290045 - DNA, 22 bp, Homo sapiens
tctcccaggctgccctgtggac

SEQ ID NO: 8290046 - DNA, 22 bp, Homo sapiens
tctcccaggctgccctgtggac

SEQ ID NO: 8290047 - DNA, 23 bp, Homo sapiens
tctccctcatgcctaggcctggg

SEQ ID NO: 8290048 - DNA, 22 bp, Homo sapiens
tctcccagtggtgcagaaagca

SEQ ID NO: 8290049 - DNA, 22 bp, Homo sapiens
tctcccagtgtctggcagtcag

SEQ ID NO: 8290050 - DNA, 22 bp, Homo sapiens
tctcccattacttatggcccac

SEQ ID NO: 8290051 - DNA, 22 bp, Homo sapiens
tctccccagctgagctgccctt

SEQ ID NO: 8290052 - DNA, 22 bp, Homo sapiens
tctccaggggctgctgtgccac

SEQ ID NO: 8290053 - DNA, 22 bp, Homo sapiens
tctccaggggctgctgtgccac

SEQ ID NO: 8290054 - DNA, 22 bp, Homo sapiens
tctccaggtaaatggcatcctg

SEQ ID NO: 8290055 - DNA, 22 bp, Homo sapiens
tctccaggtaaatggcatcctg

SEQ ID NO: 8290056 - DNA, 22 bp, Homo sapiens
tctccagggtgagctaggccag

SEQ ID NO: 8290057 - DNA, 22 bp, Homo sapiens
tctccagggcccccgagcgttg

SEQ ID NO: 8290058 - DNA, 22 bp, Homo sapiens
tctccagggcccccgagcgttg

SEQ ID NO: 8290059 - DNA, 22 bp, Homo sapiens
tctccaggggcagggtctggag

SEQ ID NO: 8290060 - DNA, 22 bp, Homo sapiens
tctccaggggcagggtctggag

SEQ ID NO: 8290061 - DNA, 22 bp, Homo sapiens
tctccagggcagagaatagcaa

SEQ ID NO: 8290062 - DNA, 22 bp, Homo sapiens
tctccagggaggtagcccagtg

SEQ ID NO: 8290063 - DNA, 22 bp, Homo sapiens
tctccagggacatgtttctgga

SEQ ID NO: 8290064 - DNA, 22 bp, Homo sapiens
tctccaggctttttgtgaattg

SEQ ID NO: 8290065 - DNA, 22 bp, Homo sapiens
tctccaggctttttgtgaattg

SEQ ID NO: 8290066 - DNA, 22 bp, Homo sapiens
tctccagggactgaggctggag

SEQ ID NO: 8290067 - DNA, 22 bp, Homo sapiens
tctccagggactgaggctggag

SEQ ID NO: 8290068 - DNA, 22 bp, Homo sapiens
tctccaggcctttcccatctta

SEQ ID NO: 8290069 - DNA, 22 bp, Homo sapiens
tctccaggcctttcccatctta

SEQ ID NO: 8290070 - DNA, 23 bp, Homo sapiens
tctccaggccttactccaggcct

SEQ ID NO: 8290071 - DNA, 22 bp, Homo sapiens
tctccaggcttaatctcagctt

SEQ ID NO: 8290072 - DNA, 22 bp, Homo sapiens
tctccaggcttaatctcagctt

SEQ ID NO: 8290073 - DNA, 22 bp, Homo sapiens
tctccaggttcagtcgatggaa

SEQ ID NO: 8290074 - DNA, 22 bp, Homo sapiens
tctccaggttcagtcgatggaa

SEQ ID NO: 8290075 - DNA, 22 bp, Homo sapiens
tctcccagaggatcccagtgga

SEQ ID NO: 8290076 - DNA, 22 bp, Homo sapiens
tctccaggtggcttgggcttct

SEQ ID NO: 8290077 - DNA, 22 bp, Homo sapiens
tctccaggtgctaagtgtgcct

SEQ ID NO: 8290078 - DNA, 22 bp, Homo sapiens
tctccaggtgctaagtgtgcct

SEQ ID NO: 8290079 - DNA, 22 bp, Homo sapiens
tctccaggtgagggtggttaga

SEQ ID NO: 8290080 - DNA, 22 bp, Homo sapiens
tctccaggtgactctgatgtat

SEQ ID NO: 8290081 - DNA, 22 bp, Homo sapiens
tctccaggtgactctgatgtat

SEQ ID NO: 8290082 - DNA, 22 bp, Homo sapiens
tctccaggtgaaacttgcaggg

SEQ ID NO: 8290083 - DNA, 22 bp, Homo sapiens
tctccaggtgaaacttgcaggg

SEQ ID NO: 8290084 - DNA, 22 bp, Homo sapiens
tctccaggtagatatgtcagga

SEQ ID NO: 8290085 - DNA, 22 bp, Homo sapiens
tctccaggtagatatgtcagga

SEQ ID NO: 8290086 - DNA, 22 bp, Homo sapiens
tctcgctctgtcgcccaggctg

SEQ ID NO: 8290087 - DNA, 22 bp, Homo sapiens
tctctagtctcctttaacctga

SEQ ID NO: 8290088 - DNA, 22 bp, Homo sapiens
tctcctggtcacctcagaagtc

SEQ ID NO: 8290089 - DNA, 23 bp, Homo sapiens
tctcctcctagatacagtcatgg

SEQ ID NO: 8290090 - DNA, 22 bp, Homo sapiens
tctcctccagaggctgtgggga

SEQ ID NO: 8290091 - DNA, 22 bp, Homo sapiens
tctcctctactgggtctgcaga

SEQ ID NO: 8290092 - DNA, 22 bp, Homo sapiens
tctcctctcctttcatgttgtt

SEQ ID NO: 8290093 - DNA, 22 bp, Homo sapiens
tctcctgatgatggtactggca

SEQ ID NO: 8290094 - DNA, 22 bp, Homo sapiens
tctcctggagcccagatgctgg

SEQ ID NO: 8290095 - DNA, 22 bp, Homo sapiens
tctcctggatggaccttctctt

SEQ ID NO: 8290096 - DNA, 22 bp, Homo sapiens
tctcctggatagatactatcca

SEQ ID NO: 8290097 - DNA, 22 bp, Homo sapiens
tctcattcataccctacatgct

SEQ ID NO: 8290098 - DNA, 22 bp, Homo sapiens
tctcattaaaacattttaatta

SEQ ID NO: 8290099 - DNA, 22 bp, Homo sapiens
tctcattattatttgtatgggt

SEQ ID NO: 8290100 - DNA, 22 bp, Homo sapiens
tctcattattgtattcttagtt

SEQ ID NO: 8290101 - DNA, 19 bp, Homo sapiens
tctccaaaaccaatcacta

SEQ ID NO: 8290102 - DNA, 19 bp, Homo sapiens
tctccaaaaccaatcacta

SEQ ID NO: 8290103 - DNA, 22 bp, Homo sapiens
tctccaaactcagactaagtat

SEQ ID NO: 8290104 - DNA, 22 bp, Homo sapiens
tctccaggactgagctccagcc

SEQ ID NO: 8290105 - DNA, 22 bp, Homo sapiens
tctccaggaagccctccctgac

SEQ ID NO: 8290106 - DNA, 17 bp, Homo sapiens
tctccaggacgagctca

SEQ ID NO: 8290107 - DNA, 17 bp, Homo sapiens
tctccaggacgagctca

SEQ ID NO: 8290108 - DNA, 22 bp, Homo sapiens
tctccaggaagccctccctgac

SEQ ID NO: 8290109 - DNA, 22 bp, Homo sapiens
tctccacaagctgatgctagga

SEQ ID NO: 8290110 - DNA, 22 bp, Homo sapiens
tctccaggcactacctgggtaa

SEQ ID NO: 8290111 - DNA, 22 bp, Homo sapiens
tctccaggcactacctgggtaa

SEQ ID NO: 8290112 - DNA, 22 bp, Homo sapiens
tctccaggagcaagtcacccag

SEQ ID NO: 8290113 - DNA, 19 bp, Homo sapiens
tctccaggcaggtgagcga

SEQ ID NO: 8290114 - DNA, 22 bp, Homo sapiens
tctccaggcacttggctgctac

SEQ ID NO: 8290115 - DNA, 22 bp, Homo sapiens
tctccaggcacttggctgctac

SEQ ID NO: 8290116 - DNA, 23 bp, Homo sapiens
tctccaggccttactccaggcct

SEQ ID NO: 8290117 - DNA, 22 bp, Homo sapiens
tctcatcagcccaaacatgaca

SEQ ID NO: 8290118 - DNA, 22 bp, Homo sapiens
tctcaggtggcccccatgagtg

SEQ ID NO: 8290119 - DNA, 22 bp, Homo sapiens
tctcaggtaaaagggtatctac

SEQ ID NO: 8290120 - DNA, 22 bp, Homo sapiens
tctcactgggtataaatgagta

SEQ ID NO: 8290121 - DNA, 22 bp, Homo sapiens
tctcacagttgtccactgaaaa

SEQ ID NO: 8290122 - DNA, 22 bp, Homo sapiens
tctgaaagtatctggatctttt

SEQ ID NO: 8290123 - DNA, 22 bp, Homo sapiens
tctgaaagcataatttgtccca

SEQ ID NO: 8290124 - DNA, 22 bp, Homo sapiens
tctgaaatactgcaggttctct

SEQ ID NO: 8290125 - DNA, 22 bp, Homo sapiens
tctgaaataaatgcactgttag

SEQ ID NO: 8290126 - DNA, 22 bp, Homo sapiens
tctcttctttggggtgggctca

SEQ ID NO: 8290127 - DNA, 22 bp, Homo sapiens
tctcttctttggggtgggctca

SEQ ID NO: 8290128 - DNA, 22 bp, Homo sapiens
tctctttctattgcaccatgct

SEQ ID NO: 8290129 - DNA, 22 bp, Homo sapiens
tctgaaattccttccagacttt

SEQ ID NO: 8290130 - DNA, 22 bp, Homo sapiens
tctgaagctggaggaagctttg

SEQ ID NO: 8290131 - DNA, 22 bp, Homo sapiens
tctgaaggcatcctcactgcaa

SEQ ID NO: 8290132 - DNA, 22 bp, Homo sapiens
tctgaagggctgagtggaggag

SEQ ID NO: 8290133 - DNA, 22 bp, Homo sapiens
tctgaattttaactacacaaag

SEQ ID NO: 8290134 - DNA, 22 bp, Homo sapiens
tctgaattttccacagatttgg

SEQ ID NO: 8290135 - DNA, 22 bp, Homo sapiens
tctgaatttgcattttaacaag

SEQ ID NO: 8290136 - DNA, 22 bp, Homo sapiens
tctcttcacatgcttgctccaa

SEQ ID NO: 8290137 - DNA, 22 bp, Homo sapiens
tctcttaatccggtgctttctg

SEQ ID NO: 8290138 - DNA, 21 bp, Homo sapiens
tctcttcccatcaggacacta

SEQ ID NO: 8290139 - DNA, 22 bp, Homo sapiens
tctcttcctagtgatgggcttt

SEQ ID NO: 8290140 - DNA, 22 bp, Homo sapiens
tctcttctctagtgagcaactg

SEQ ID NO: 8290141 - DNA, 22 bp, Homo sapiens
tctcttctagcttcttgtggtt

SEQ ID NO: 8290142 - DNA, 22 bp, Homo sapiens
tctcttctatttgagactattt

SEQ ID NO: 8290143 - DNA, 22 bp, Homo sapiens
tctcttctgaaacctgtcttta

SEQ ID NO: 8290144 - DNA, 18 bp, Homo sapiens
tctcttcttggcagtcaa

SEQ ID NO: 8290145 - DNA, 22 bp, Homo sapiens
tctctggtcccacctggccatt

SEQ ID NO: 8290146 - DNA, 18 bp, Homo sapiens
tctctgaatattttatgt

SEQ ID NO: 8290147 - DNA, 22 bp, Homo sapiens
tctctgaataatgctattcttt

SEQ ID NO: 8290148 - DNA, 22 bp, Homo sapiens
tctctgaagatatttattatta

SEQ ID NO: 8290149 - DNA, 22 bp, Homo sapiens
tctctgagacagtagcctctgc

SEQ ID NO: 8290150 - DNA, 22 bp, Homo sapiens
tctctgagatcagccactgact

SEQ ID NO: 8290151 - DNA, 22 bp, Homo sapiens
tctctgagtaagtgacagttca

SEQ ID NO: 8290152 - DNA, 22 bp, Homo sapiens
tctctgagtatcctgaactgcc

SEQ ID NO: 8290153 - DNA, 22 bp, Homo sapiens
tctctcagaggccagggtcctg

SEQ ID NO: 8290154 - DNA, 22 bp, Homo sapiens
tctctcagtcagatgctaaaga

SEQ ID NO: 8290155 - DNA, 22 bp, Homo sapiens
tctctccaacatggtggtgctg

SEQ ID NO: 8290156 - DNA, 22 bp, Homo sapiens
tctctcagggggaaggctgaag

SEQ ID NO: 8290157 - DNA, 22 bp, Homo sapiens
tctctcaggctggagtgcagtg

SEQ ID NO: 8290158 - DNA, 22 bp, Homo sapiens
tctctcactggtgcctctgttg

SEQ ID NO: 8290159 - DNA, 22 bp, Homo sapiens
tctctcagaggaagaggcagtg

SEQ ID NO: 8290160 - DNA, 22 bp, Homo sapiens
tctctctcagccattacagaac

SEQ ID NO: 8290161 - DNA, 22 bp, Homo sapiens
tctctcctgtgttctgatgttt

SEQ ID NO: 8290162 - DNA, 18 bp, Homo sapiens
tctctccatctatttgtt

SEQ ID NO: 8290163 - DNA, 22 bp, Homo sapiens
tctctcccctggccgctacgcg

SEQ ID NO: 8290164 - DNA, 22 bp, Homo sapiens
tctctcccaaatctgcagatag

SEQ ID NO: 8290165 - DNA, 22 bp, Homo sapiens
tctctccctttccttatcagtt

SEQ ID NO: 8290166 - DNA, 22 bp, Homo sapiens
tctctccctttccttatcagtt

SEQ ID NO: 8290167 - DNA, 22 bp, Homo sapiens
tctctcctgcactgaattatgt

SEQ ID NO: 8290168 - DNA, 22 bp, Homo sapiens
tctctcctctagtcagggtggt

SEQ ID NO: 8290169 - DNA, 21 bp, Homo sapiens
tctctcctcaagctcgacccc

SEQ ID NO: 8290170 - DNA, 21 bp, Homo sapiens
tctctcctcaagctcgacccc

SEQ ID NO: 8290171 - DNA, 22 bp, Homo sapiens
tctctcctaatttcaggtgctt

SEQ ID NO: 8290172 - DNA, 18 bp, Homo sapiens
tcctttctccctcatctt

SEQ ID NO: 8290173 - DNA, 22 bp, Homo sapiens
tccttgggaaatcactagcact

SEQ ID NO: 8290174 - DNA, 22 bp, Homo sapiens
tcctttccctttccatcctggc

SEQ ID NO: 8290175 - DNA, 22 bp, Homo sapiens
tcgcaccattgcactccagcca

SEQ ID NO: 8290176 - DNA, 22 bp, Homo sapiens
tcgcccaggatggagtgcagta

SEQ ID NO: 8290177 - DNA, 22 bp, Homo sapiens
tctaaacttgtaaacaagcata

SEQ ID NO: 8290178 - DNA, 22 bp, Homo sapiens
tctaaacttcactttaagtgct

SEQ ID NO: 8290179 - DNA, 22 bp, Homo sapiens
tctaaactgctagctgactgag

SEQ ID NO: 8290180 - DNA, 22 bp, Homo sapiens
tctaaactgcgagcatgccccc

SEQ ID NO: 8290181 - DNA, 22 bp, Homo sapiens
tctaaactacgtcaaaactagt

SEQ ID NO: 8290182 - DNA, 22 bp, Homo sapiens
tctaaactagggttaaaggaaa

SEQ ID NO: 8290183 - DNA, 22 bp, Homo sapiens
tctaaactctctttgaattatg

SEQ ID NO: 8290184 - DNA, 19 bp, Homo sapiens
tctaaactctatactggta

SEQ ID NO: 8290185 - DNA, 22 bp, Homo sapiens
tctaaactctgcaatttacggt

SEQ ID NO: 8290186 - DNA, 22 bp, Homo sapiens
tctaaactctgattaatccaca

SEQ ID NO: 8290187 - DNA, 19 bp, Homo sapiens
tctaaactagtcccataac

SEQ ID NO: 8290188 - DNA, 22 bp, Homo sapiens
tctaaactcctttacccagacc

SEQ ID NO: 8290189 - DNA, 20 bp, Homo sapiens
tctaaacagttggcatgggg

SEQ ID NO: 8290190 - DNA, 22 bp, Homo sapiens
tctaaaaaagtctgttcacttg

SEQ ID NO: 8290191 - DNA, 22 bp, Homo sapiens
tccttctttcacctcatagtca

SEQ ID NO: 8290192 - DNA, 22 bp, Homo sapiens
tccttctctggtttttactgta

SEQ ID NO: 8290193 - DNA, 21 bp, Homo sapiens
tccttctctatgattgtctga

SEQ ID NO: 8290194 - DNA, 22 bp, Homo sapiens
tccttctctacaaatccaggca

SEQ ID NO: 8290195 - DNA, 22 bp, Homo sapiens
tccttctcctccttgagtgaca

SEQ ID NO: 8290196 - DNA, 21 bp, Homo sapiens
tccttccttgaggtcctttcc

SEQ ID NO: 8290197 - DNA, 22 bp, Homo sapiens
tccttcctggggtctctgctgc

SEQ ID NO: 8290198 - DNA, 22 bp, Homo sapiens
tccttaggcaatttgggagagt

SEQ ID NO: 8290199 - DNA, 22 bp, Homo sapiens
tccttaattggcttattggcat

SEQ ID NO: 8290200 - DNA, 22 bp, Homo sapiens
tccttaaatgtgatctagattt

SEQ ID NO: 8290201 - DNA, 22 bp, Homo sapiens
tccttacatagtgctgaaatat

SEQ ID NO: 8290202 - DNA, 22 bp, Homo sapiens
tctatttttatagttgaagtgc

SEQ ID NO: 8290203 - DNA, 23 bp, Homo sapiens
tctcaaacagtgagttcaccaga

SEQ ID NO: 8290204 - DNA, 22 bp, Homo sapiens
tctattttcttgccaaaactgc

SEQ ID NO: 8290205 - DNA, 22 bp, Homo sapiens
tctcacactaatgctctatcag

SEQ ID NO: 8290206 - DNA, 22 bp, Homo sapiens
tctcacactatttattctgctt

SEQ ID NO: 8290207 - DNA, 22 bp, Homo sapiens
tctcacagggctaggccctgcc

SEQ ID NO: 8290208 - DNA, 23 bp, Homo sapiens
tctcacagcgatctaggaagagg

SEQ ID NO: 8290209 - DNA, 22 bp, Homo sapiens
tctaggtattgtagttgctaat

SEQ ID NO: 8290210 - DNA, 22 bp, Homo sapiens
tctaggttagaacccagaaaag

SEQ ID NO: 8290211 - DNA, 22 bp, Homo sapiens
tctaggttcatgggattcagtg

SEQ ID NO: 8290212 - DNA, 22 bp, Homo sapiens
tctagggaacatgggtcaagct

SEQ ID NO: 8290213 - DNA, 22 bp, Homo sapiens
tctagttaattcctttggtgtt

SEQ ID NO: 8290214 - DNA, 22 bp, Homo sapiens
tctatgtatggaccttttctgt

SEQ ID NO: 8290215 - DNA, 22 bp, Homo sapiens
tctatgtcaaccttgcagtgca

SEQ ID NO: 8290216 - DNA, 22 bp, Homo sapiens
tctatgtaaatgtgagttggtg

SEQ ID NO: 8290217 - DNA, 22 bp, Homo sapiens
tctatgtaaagccatattgata

SEQ ID NO: 8290218 - DNA, 21 bp, Homo sapiens
tctatgtacgcatctatgcct

SEQ ID NO: 8290219 - DNA, 22 bp, Homo sapiens
tctatgtaggagagagcttgac

SEQ ID NO: 8290220 - DNA, 22 bp, Homo sapiens
tctatgtagtgccagctagtat

SEQ ID NO: 8290221 - DNA, 22 bp, Homo sapiens
tctattaatgattcaatagtgt

SEQ ID NO: 8290222 - DNA, 22 bp, Homo sapiens
tctacaaataaattactatgta

SEQ ID NO: 8290223 - DNA, 19 bp, Homo sapiens
tctacaaagtggcatcagg

SEQ ID NO: 8290224 - DNA, 22 bp, Homo sapiens
tctacaaataaattactatgta

SEQ ID NO: 8290225 - DNA, 22 bp, Homo sapiens
tctacatagaattaggtaattt

SEQ ID NO: 8290226 - DNA, 22 bp, Homo sapiens
tctacagtgtcaatgtgtcttg

SEQ ID NO: 8290227 - DNA, 22 bp, Homo sapiens
tctaattttaggcatttgttca

SEQ ID NO: 8290228 - DNA, 23 bp, Homo sapiens
tctacaaagctgtgtcaggaccc

SEQ ID NO: 8290229 - DNA, 23 bp, Homo sapiens
tctacaaagctgtgtcaggaccc

SEQ ID NO: 8290230 - DNA, 22 bp, Homo sapiens
tctacaaagccattcaggatct

SEQ ID NO: 8290231 - DNA, 22 bp, Homo sapiens
tctacaaagaagaattaatgtc

SEQ ID NO: 8290232 - DNA, 22 bp, Homo sapiens
tctaaatcccaacatgatatca

SEQ ID NO: 8290233 - DNA, 22 bp, Homo sapiens
tctagctgtggtcgagtgagga

SEQ ID NO: 8290234 - DNA, 22 bp, Homo sapiens
tctagctgccccgaggcagggt

SEQ ID NO: 8290235 - DNA, 19 bp, Homo sapiens
tctagcaacccactgcatg

SEQ ID NO: 8290236 - DNA, 22 bp, Homo sapiens
tctagaaaaccaatattacatg

SEQ ID NO: 8290237 - DNA, 22 bp, Homo sapiens
tctagaaacaggtttctagaaa

SEQ ID NO: 8290238 - DNA, 22 bp, Homo sapiens
tctagaaaaccaatattacatg

SEQ ID NO: 8290239 - DNA, 23 bp, Homo sapiens
tctaccagctagtctccccagca

SEQ ID NO: 8290240 - DNA, 22 bp, Homo sapiens
tctacccagagctatgacctga

SEQ ID NO: 8290241 - DNA, 21 bp, Homo sapiens
tcctgtaagcttgggtggctc

SEQ ID NO: 8290242 - DNA, 22 bp, Homo sapiens
tcctgtccacagccctgacctc

SEQ ID NO: 8290243 - DNA, 22 bp, Homo sapiens
tcctgtcctctgggtgccccat

SEQ ID NO: 8290244 - DNA, 22 bp, Homo sapiens
tcctggtgtcctggtctgctag

SEQ ID NO: 8290245 - DNA, 22 bp, Homo sapiens
tcctggtgtcgcctggtcagtt

SEQ ID NO: 8290246 - DNA, 22 bp, Homo sapiens
tcctggttcctaccttcagctg

SEQ ID NO: 8290247 - DNA, 22 bp, Homo sapiens
tcctggtgtttatgtcacatag

SEQ ID NO: 8290248 - DNA, 22 bp, Homo sapiens
tcctggtgttactaaattgaaa

SEQ ID NO: 8290249 - DNA, 22 bp, Homo sapiens
tcctggtgttactaaattgaaa

SEQ ID NO: 8290250 - DNA, 22 bp, Homo sapiens
tcctggtgggacagaaaacctc

SEQ ID NO: 8290251 - DNA, 22 bp, Homo sapiens
tcctggtggtctgtgcttcttc

SEQ ID NO: 8290252 - DNA, 22 bp, Homo sapiens
tcctggtggtgccagctgcagg

SEQ ID NO: 8290253 - DNA, 22 bp, Homo sapiens
tcctggtggtttgaaaactgaa

SEQ ID NO: 8290254 - DNA, 22 bp, Homo sapiens
tcctggtgtaatggtaagcatg

SEQ ID NO: 8290255 - DNA, 22 bp, Homo sapiens
tcctggtgtaatggtaagcatg

SEQ ID NO: 8290256 - DNA, 22 bp, Homo sapiens
tcctggtggtgccggtgcccgg

SEQ ID NO: 8290257 - DNA, 22 bp, Homo sapiens
tcctggtggtttgaaaactgaa

SEQ ID NO: 8290258 - DNA, 22 bp, Homo sapiens
tcctggtggctttccctgcctt

SEQ ID NO: 8290259 - DNA, 22 bp, Homo sapiens
tcctggtggctctttgggaagg

SEQ ID NO: 8290260 - DNA, 22 bp, Homo sapiens
tcctggtggcagattttaggtc

SEQ ID NO: 8290261 - DNA, 22 bp, Homo sapiens
taagaatagtccctagatgtgt

SEQ ID NO: 8290262 - DNA, 22 bp, Homo sapiens
taagaatacctctcagctcttt

SEQ ID NO: 8290263 - DNA, 22 bp, Homo sapiens
taagaagggtacaataaggcat

SEQ ID NO: 8290264 - DNA, 22 bp, Homo sapiens
taagaatagtgtttgcctttgg

SEQ ID NO: 8290265 - DNA, 22 bp, Homo sapiens
taagaatattgggaatggatgg

SEQ ID NO: 8290266 - DNA, 22 bp, Homo sapiens
taagaattgtgttgaatagagt

SEQ ID NO: 8290267 - DNA, 22 bp, Homo sapiens
taagaattatctcatggataat

SEQ ID NO: 8290268 - DNA, 22 bp, Homo sapiens
tcctggagccaatgtgctgctg

SEQ ID NO: 8290269 - DNA, 22 bp, Homo sapiens
tcctggagccaatgtgctgctg

SEQ ID NO: 8290270 - DNA, 20 bp, Homo sapiens
tcctggaggcttcatccata

SEQ ID NO: 8290271 - DNA, 20 bp, Homo sapiens
tcctggagtattccatgctt

SEQ ID NO: 8290272 - DNA, 22 bp, Homo sapiens
tcctggagtaggccttagccat

SEQ ID NO: 8290273 - DNA, 22 bp, Homo sapiens
tcctggagggaggcggtgctac

SEQ ID NO: 8290274 - DNA, 22 bp, Homo sapiens
tcctggagagtgggcgagcaca

SEQ ID NO: 8290275 - DNA, 22 bp, Homo sapiens
tcctggagaagaggggcttgga

SEQ ID NO: 8290276 - DNA, 22 bp, Homo sapiens
tcctggagaaactcagagatct

SEQ ID NO: 8290277 - DNA, 22 bp, Homo sapiens
tcctggagttgtctgtactcat

SEQ ID NO: 8290278 - DNA, 22 bp, Homo sapiens
tcctggagtatttctgtggtgt

SEQ ID NO: 8290279 - DNA, 22 bp, Homo sapiens
tcctggccaagttactctctgc

SEQ ID NO: 8290280 - DNA, 22 bp, Homo sapiens
tcctggcccactcctagcttct

SEQ ID NO: 8290281 - DNA, 22 bp, Homo sapiens
tcctggcctccgttctctgcat

SEQ ID NO: 8290282 - DNA, 22 bp, Homo sapiens
tctgcccaggacacctgccact

SEQ ID NO: 8290283 - DNA, 22 bp, Homo sapiens
tctgcccagggacaggacacag

SEQ ID NO: 8290284 - DNA, 22 bp, Homo sapiens
tctgcccacagtccaatagttg

SEQ ID NO: 8290285 - DNA, 22 bp, Homo sapiens
tctgcccacagcctcctgtcca

SEQ ID NO: 8290286 - DNA, 22 bp, Homo sapiens
tctgcccagtttgtgctcaggt

SEQ ID NO: 8290287 - DNA, 22 bp, Homo sapiens
tctgcccctgctgggcacagag

SEQ ID NO: 8290288 - DNA, 22 bp, Homo sapiens
tctgccctcattgctgcctgga

SEQ ID NO: 8290289 - DNA, 22 bp, Homo sapiens
tctgccctgccattcactggaa

SEQ ID NO: 8290290 - DNA, 22 bp, Homo sapiens
tctgccctggggtcagcctcca

SEQ ID NO: 8290291 - DNA, 22 bp, Homo sapiens
tctgcctgagggagctgaggaa

SEQ ID NO: 8290292 - DNA, 22 bp, Homo sapiens
tctgccttagcaattgtcaagg

SEQ ID NO: 8290293 - DNA, 20 bp, Homo sapiens
tctgccttatgaccttcgcc

SEQ ID NO: 8290294 - DNA, 22 bp, Homo sapiens
tctgcctgttcccgattccatg

SEQ ID NO: 8290295 - DNA, 22 bp, Homo sapiens
tctgccttcttttagtcatctt

SEQ ID NO: 8290296 - DNA, 22 bp, Homo sapiens
tctgccttgatggcattgagaa

SEQ ID NO: 8290297 - DNA, 22 bp, Homo sapiens
tctgcctggattttggaaagct

SEQ ID NO: 8290298 - DNA, 22 bp, Homo sapiens
tctgcctggcctggagggcaca

SEQ ID NO: 8290299 - DNA, 22 bp, Homo sapiens
tctgcctgggtgtggagcagag

SEQ ID NO: 8290300 - DNA, 22 bp, Homo sapiens
tctgcctgcttcttcatagtct

SEQ ID NO: 8290301 - DNA, 22 bp, Homo sapiens
tctgcctgctaactcctgcacc

SEQ ID NO: 8290302 - DNA, 22 bp, Homo sapiens
tctgcactgggagcatgtctgg

SEQ ID NO: 8290303 - DNA, 22 bp, Homo sapiens
tctgcaagtttatcacttggga

SEQ ID NO: 8290304 - DNA, 22 bp, Homo sapiens
tctgcacatggcgctggtcctg

SEQ ID NO: 8290305 - DNA, 22 bp, Homo sapiens
tctgcaggcatttttggttgtc

SEQ ID NO: 8290306 - DNA, 22 bp, Homo sapiens
tctgcaggcctcgacaaggcca

SEQ ID NO: 8290307 - DNA, 22 bp, Homo sapiens
tctgcaggatggatgctcagaa

SEQ ID NO: 8290308 - DNA, 22 bp, Homo sapiens
tctgcaggatgcaaagtgtaca

SEQ ID NO: 8290309 - DNA, 22 bp, Homo sapiens
tctgcaggatcagagccagagg

SEQ ID NO: 8290310 - DNA, 22 bp, Homo sapiens
tctgcaggaggctggctgcagg

SEQ ID NO: 8290311 - DNA, 22 bp, Homo sapiens
tctgcaggagcagggcgtggag

SEQ ID NO: 8290312 - DNA, 22 bp, Homo sapiens
tctgcaggagagtgccctagag

SEQ ID NO: 8290313 - DNA, 22 bp, Homo sapiens
tctgcaggagagtgccctagag

SEQ ID NO: 8290314 - DNA, 18 bp, Homo sapiens
tctgcaggacctcagggc

SEQ ID NO: 8290315 - DNA, 22 bp, Homo sapiens
tctgcaggactgaggcctgttt

SEQ ID NO: 8290316 - DNA, 22 bp, Homo sapiens
tctgcaggaaaaaagtgcctgg

SEQ ID NO: 8290317 - DNA, 22 bp, Homo sapiens
tctgcaggaaaaaagtgcctgg

SEQ ID NO: 8290318 - DNA, 18 bp, Homo sapiens
tctgcaggacctcagggc

SEQ ID NO: 8290319 - DNA, 22 bp, Homo sapiens
tctgcaggaagctggcggctga

SEQ ID NO: 8290320 - DNA, 21 bp, Homo sapiens
tctgcccacactggccactgc

SEQ ID NO: 8290321 - DNA, 23 bp, Homo sapiens
tctgccagtgtgtgccaggagcc

SEQ ID NO: 8290322 - DNA, 22 bp, Homo sapiens
tctgccaggtggggagaggcca

SEQ ID NO: 8290323 - DNA, 22 bp, Homo sapiens
tctgccagtggtttggccctga

SEQ ID NO: 8290324 - DNA, 22 bp, Homo sapiens
tctgccaggcattgtgctgctc

SEQ ID NO: 8290325 - DNA, 22 bp, Homo sapiens
tctgccaccaactgtcactaca

SEQ ID NO: 8290326 - DNA, 22 bp, Homo sapiens
tctgccacactggttcagtgga

SEQ ID NO: 8290327 - DNA, 22 bp, Homo sapiens
tctgcatcatttttcagagccg

SEQ ID NO: 8290328 - DNA, 22 bp, Homo sapiens
tctgcaggtgggcccctagaat

SEQ ID NO: 8290329 - DNA, 22 bp, Homo sapiens
tctgcaggtgttggaagggtca

SEQ ID NO: 8290330 - DNA, 22 bp, Homo sapiens
tctgcaggtagagctcaggaat

SEQ ID NO: 8290331 - DNA, 22 bp, Homo sapiens
tctgcaggtcacgctccagcct

SEQ ID NO: 8290332 - DNA, 22 bp, Homo sapiens
tctgcaggtcacgctccagcct

SEQ ID NO: 8290333 - DNA, 22 bp, Homo sapiens
tctgcaggtgggcccctagaat

SEQ ID NO: 8290334 - DNA, 22 bp, Homo sapiens
tctgcaggctgtacaggaagca

SEQ ID NO: 8290335 - DNA, 22 bp, Homo sapiens
tctgcaggctctagatgaggtt

SEQ ID NO: 8290336 - DNA, 22 bp, Homo sapiens
tctgcaggctctagatgaggtt

SEQ ID NO: 8290337 - DNA, 22 bp, Homo sapiens
tctgcaggcttggagtggcagc

SEQ ID NO: 8290338 - DNA, 22 bp, Homo sapiens
tctgcaggcttggagtggcagc

SEQ ID NO: 8290339 - DNA, 22 bp, Homo sapiens
tctgcaggcttataggatgggt

SEQ ID NO: 8290340 - DNA, 22 bp, Homo sapiens
tctgcaggtaagcgttcttgga

SEQ ID NO: 8290341 - DNA, 22 bp, Homo sapiens
tctgcagggtcccagcctcagc

SEQ ID NO: 8290342 - DNA, 22 bp, Homo sapiens
tctgcagggtcccagcctcagc

SEQ ID NO: 8290343 - DNA, 17 bp, Homo sapiens
tctgcagggggccgtgt

SEQ ID NO: 8290344 - DNA, 22 bp, Homo sapiens
tctgcagggcccttggctcctg

SEQ ID NO: 8290345 - DNA, 22 bp, Homo sapiens
tctgcagggcccttggctcctg

SEQ ID NO: 8290346 - DNA, 22 bp, Homo sapiens
tctgcagggatgtgaggggtga

SEQ ID NO: 8290347 - DNA, 22 bp, Homo sapiens
tctgacaggtcattttctatag

SEQ ID NO: 8290348 - DNA, 21 bp, Homo sapiens
tctgacaatctcatttcaaac

SEQ ID NO: 8290349 - DNA, 22 bp, Homo sapiens
tctgagcttctgcatttccaac

SEQ ID NO: 8290350 - DNA, 22 bp, Homo sapiens
tctgagctaatcctgttgccga

SEQ ID NO: 8290351 - DNA, 22 bp, Homo sapiens
tctgagctgcagagtggggtgg

SEQ ID NO: 8290352 - DNA, 21 bp, Homo sapiens
tctgagctgagtcctctaggt

SEQ ID NO: 8290353 - DNA, 22 bp, Homo sapiens
tctgagccacctgagcccatgg

SEQ ID NO: 8290354 - DNA, 22 bp, Homo sapiens
tctgagccacctgccagtgctg

SEQ ID NO: 8290355 - DNA, 22 bp, Homo sapiens
tctgaggttaatcctgctgcat

SEQ ID NO: 8290356 - DNA, 22 bp, Homo sapiens
tctgaggttattgtctgccatt

SEQ ID NO: 8290357 - DNA, 22 bp, Homo sapiens
tctgaggttactgctttgtaga

SEQ ID NO: 8290358 - DNA, 22 bp, Homo sapiens
tctgatgtatcctaagaatcta

SEQ ID NO: 8290359 - DNA, 23 bp, Homo sapiens
tctgaggtccaccagtttgcaga

SEQ ID NO: 8290360 - DNA, 22 bp, Homo sapiens
tctgaggtctatgactttgctt

SEQ ID NO: 8290361 - DNA, 23 bp, Homo sapiens
tctgaggtggctcttgctttgaa

SEQ ID NO: 8290362 - DNA, 21 bp, Homo sapiens
tctgatgtgtttaatggtggg

SEQ ID NO: 8290363 - DNA, 21 bp, Homo sapiens
tctgatgttcacaccctgtat

SEQ ID NO: 8290364 - DNA, 22 bp, Homo sapiens
tctgcaagatcattaaagcaga

SEQ ID NO: 8290365 - DNA, 22 bp, Homo sapiens
tctgaggctaagagacagaggc

SEQ ID NO: 8290366 - DNA, 22 bp, Homo sapiens
tctgaggccttggcagctaagg

SEQ ID NO: 8290367 - DNA, 22 bp, Homo sapiens
tctgaggccctaccctgagcct

SEQ ID NO: 8290368 - DNA, 22 bp, Homo sapiens
tctgagctttagctgggatttt

SEQ ID NO: 8290369 - DNA, 22 bp, Homo sapiens
tctgaggctgtctctgggctcc

SEQ ID NO: 8290370 - DNA, 19 bp, Homo sapiens
tctgaggcttctccccttg

SEQ ID NO: 8290371 - DNA, 20 bp, Homo sapiens
tctgaggctgagcccagcgt

SEQ ID NO: 8290372 - DNA, 22 bp, Homo sapiens
tctgagggttcttggtagttgg

SEQ ID NO: 8290373 - DNA, 22 bp, Homo sapiens
tctgagggttggctggctgtag

SEQ ID NO: 8290374 - DNA, 22 bp, Homo sapiens
tctgaggtaccagctggtttat

SEQ ID NO: 8290375 - DNA, 22 bp, Homo sapiens
tctggaagttagaggaggaaag

SEQ ID NO: 8290376 - DNA, 22 bp, Homo sapiens
tctggaagacattaatttggtt

SEQ ID NO: 8290377 - DNA, 22 bp, Homo sapiens
tctggaaggcttcaaggtctaa

SEQ ID NO: 8290378 - DNA, 23 bp, Homo sapiens
tctggaatggtactcactggagt

SEQ ID NO: 8290379 - DNA, 22 bp, Homo sapiens
tctgctctagttgcttcctgcc

SEQ ID NO: 8290380 - DNA, 22 bp, Homo sapiens
tctgctggtgatgacctcataa

SEQ ID NO: 8290381 - DNA, 21 bp, Homo sapiens
tctggaagaaaaaagtattat

SEQ ID NO: 8290382 - DNA, 22 bp, Homo sapiens
tctggccagtagatgtgggttg

SEQ ID NO: 8290383 - DNA, 22 bp, Homo sapiens
tctggcagagatatccatccca

SEQ ID NO: 8290384 - DNA, 23 bp, Homo sapiens
tctggctgctcctttcaatgctc

SEQ ID NO: 8290385 - DNA, 22 bp, Homo sapiens
tctggctggcagtgatggtgtg

SEQ ID NO: 8290386 - DNA, 22 bp, Homo sapiens
tctggctttcctggagcaagaa

SEQ ID NO: 8290387 - DNA, 22 bp, Homo sapiens
tctggctttcatttgtttaaag

SEQ ID NO: 8290388 - DNA, 22 bp, Homo sapiens
tctggctttctgactctacaac

SEQ ID NO: 8290389 - DNA, 22 bp, Homo sapiens
tctggctttctcagcatggcat

SEQ ID NO: 8290390 - DNA, 23 bp, Homo sapiens
tctggctttcacgggtattctta

SEQ ID NO: 8290391 - DNA, 21 bp, Homo sapiens
tctggctttcattccccttct

SEQ ID NO: 8290392 - DNA, 22 bp, Homo sapiens
tctggctgtgtaaggtagcacc

SEQ ID NO: 8290393 - DNA, 22 bp, Homo sapiens
tctgggaaccaaagggtgctta

SEQ ID NO: 8290394 - DNA, 22 bp, Homo sapiens
tctgggaacattttgagggcaa

SEQ ID NO: 8290395 - DNA, 22 bp, Homo sapiens
tctgggaacatggcttggaatc

SEQ ID NO: 8290396 - DNA, 22 bp, Homo sapiens
tctgggaaccattggtggggat

SEQ ID NO: 8290397 - DNA, 22 bp, Homo sapiens
tctgggaaccagtgcggctggg

SEQ ID NO: 8290398 - DNA, 22 bp, Homo sapiens
tctgggaacgaaggctaatatg

SEQ ID NO: 8290399 - DNA, 22 bp, Homo sapiens
tctgggaactctgtcatttccc

SEQ ID NO: 8290400 - DNA, 22 bp, Homo sapiens
tctgggaactgagctcccctag

SEQ ID NO: 8290401 - DNA, 22 bp, Homo sapiens
tctgggaagctgcgtgcctgtt

SEQ ID NO: 8290402 - DNA, 22 bp, Homo sapiens
tctgggaaggagcctgagaatt

SEQ ID NO: 8290403 - DNA, 22 bp, Homo sapiens
tctgggaagctggtcctgttct

SEQ ID NO: 8290404 - DNA, 22 bp, Homo sapiens
tctgggaaggctctgcagatat

SEQ ID NO: 8290405 - DNA, 22 bp, Homo sapiens
tctgggaagcaaatatgtaaga

SEQ ID NO: 8290406 - DNA, 19 bp, Homo sapiens
tctgggaagccgggctcca

SEQ ID NO: 8290407 - DNA, 22 bp, Homo sapiens
tctgggaagcctgtatgcagaa

SEQ ID NO: 8290408 - DNA, 22 bp, Homo sapiens
tctgggaagacggatggaccct

SEQ ID NO: 8290409 - DNA, 22 bp, Homo sapiens
tctgggaactatatctggtggt

SEQ ID NO: 8290410 - DNA, 22 bp, Homo sapiens
tctgggaagatgtttcaaaggt

SEQ ID NO: 8290411 - DNA, 21 bp, Homo sapiens
tctgggaaattgggaaagaag

SEQ ID NO: 8290412 - DNA, 22 bp, Homo sapiens
tctgggaaatgggcagcttcgc

SEQ ID NO: 8290413 - DNA, 22 bp, Homo sapiens
tctgggaaatggctacttgtca

SEQ ID NO: 8290414 - DNA, 22 bp, Homo sapiens
tctgggaacacacgtcacttca

SEQ ID NO: 8290415 - DNA, 22 bp, Homo sapiens
tctgggaacactttgtgagctc

SEQ ID NO: 8290416 - DNA, 22 bp, Homo sapiens
tctgggaacagcttagctccag

SEQ ID NO: 8290417 - DNA, 22 bp, Homo sapiens
tctgggaacagcctggctgtgt

SEQ ID NO: 8290418 - DNA, 22 bp, Homo sapiens
tctggcttttatgggatgagag

SEQ ID NO: 8290419 - DNA, 18 bp, Homo sapiens
tctggctttgttccttgt

SEQ ID NO: 8290420 - DNA, 22 bp, Homo sapiens
tctggcttttattcagttggca

SEQ ID NO: 8290421 - DNA, 23 bp, Homo sapiens
tctggctttgctggaagttttga

SEQ ID NO: 8290422 - DNA, 22 bp, Homo sapiens
tctggctttggatttgaagggt

SEQ ID NO: 8290423 - DNA, 22 bp, Homo sapiens
tctgggaaatgctgttccttgt

SEQ ID NO: 8290424 - DNA, 22 bp, Homo sapiens
tctgggaaatagaggaccctag

SEQ ID NO: 8290425 - DNA, 22 bp, Homo sapiens
tctgggaaagtaaatgtaaagg

SEQ ID NO: 8290426 - DNA, 22 bp, Homo sapiens
tctggcttttctcttggatggt

SEQ ID NO: 8290427 - DNA, 22 bp, Homo sapiens
tctgggaaacactgcatcccca

SEQ ID NO: 8290428 - DNA, 22 bp, Homo sapiens
tctggctccactttcttcattt

SEQ ID NO: 8290429 - DNA, 22 bp, Homo sapiens
tctggctccctggagctccaca

SEQ ID NO: 8290430 - DNA, 22 bp, Homo sapiens
tctggcccctggcagtcctgga

SEQ ID NO: 8290431 - DNA, 22 bp, Homo sapiens
tctggctgaattagccttgggt

SEQ ID NO: 8290432 - DNA, 22 bp, Homo sapiens
tctggctgaaaggggctgtgcc

SEQ ID NO: 8290433 - DNA, 22 bp, Homo sapiens
tctggctgaaaggggctgtgcc

SEQ ID NO: 8290434 - DNA, 20 bp, Homo sapiens
tctggctctttgctcctccc

SEQ ID NO: 8290435 - DNA, 22 bp, Homo sapiens
tctggctctaactaggcatcag

SEQ ID NO: 8290436 - DNA, 22 bp, Homo sapiens
tctggctctaactaggcatcag

SEQ ID NO: 8290437 - DNA, 19 bp, Homo sapiens
tctggctcctgccaggctg

SEQ ID NO: 8290438 - DNA, 22 bp, Homo sapiens
tctggctcctggctccactgcc

SEQ ID NO: 8290439 - DNA, 23 bp, Homo sapiens
tctgggcaccttgttgacatgat

SEQ ID NO: 8290440 - DNA, 18 bp, Homo sapiens
tctgggcaatctcagtat

SEQ ID NO: 8290441 - DNA, 22 bp, Homo sapiens
tctgggcacacaccatgcccac

SEQ ID NO: 8290442 - DNA, 22 bp, Homo sapiens
tctgggcagcctcaggccaggg

SEQ ID NO: 8290443 - DNA, 20 bp, Homo sapiens
tctgggcagggcacatggaa

SEQ ID NO: 8290444 - DNA, 19 bp, Homo sapiens
tctgggcagggccagcacc

SEQ ID NO: 8290445 - DNA, 19 bp, Homo sapiens
tctgggcagggccagcacc

SEQ ID NO: 8290446 - DNA, 23 bp, Homo sapiens
tctgggcatatctagtcacatcg

SEQ ID NO: 8290447 - DNA, 21 bp, Homo sapiens
tctgggcagcccagtcctgag

SEQ ID NO: 8290448 - DNA, 22 bp, Homo sapiens
tctgggcagcagcagctagtag

SEQ ID NO: 8290449 - DNA, 22 bp, Homo sapiens
tctgggcagcagcagctagtag

SEQ ID NO: 8290450 - DNA, 22 bp, Homo sapiens
tctgggcagaagcagtgcaaag

SEQ ID NO: 8290451 - DNA, 22 bp, Homo sapiens
tctgggcactgctgagcctgta

SEQ ID NO: 8290452 - DNA, 22 bp, Homo sapiens
tctgggcagagggtcttagtca

SEQ ID NO: 8290453 - DNA, 22 bp, Homo sapiens
tctgggcatgtctgtgaacacg

SEQ ID NO: 8290454 - DNA, 22 bp, Homo sapiens
tctgggagagggaaagaagact

SEQ ID NO: 8290455 - DNA, 22 bp, Homo sapiens
tctgggagagtcacaggcattg

SEQ ID NO: 8290456 - DNA, 22 bp, Homo sapiens
tctgggagagctgctgtcagag

SEQ ID NO: 8290457 - DNA, 22 bp, Homo sapiens
tctgggaagttggcagccagct

SEQ ID NO: 8290458 - DNA, 22 bp, Homo sapiens
tctgggaataaaactagggact

SEQ ID NO: 8290459 - DNA, 22 bp, Homo sapiens
tctgggaatacacactgattta

SEQ ID NO: 8290460 - DNA, 22 bp, Homo sapiens
tctgggaagtgagatgctgtgt

SEQ ID NO: 8290461 - DNA, 22 bp, Homo sapiens
tctgggaagtcctctgtcatgc

SEQ ID NO: 8290462 - DNA, 19 bp, Homo sapiens
tctgggaatgatgccagca

SEQ ID NO: 8290463 - DNA, 22 bp, Homo sapiens
tctgggaatgaggcttgggcaa

SEQ ID NO: 8290464 - DNA, 22 bp, Homo sapiens
tctgggaatgaggcccagcgat

SEQ ID NO: 8290465 - DNA, 22 bp, Homo sapiens
tctgggaatgaataagacctgt

SEQ ID NO: 8290466 - DNA, 22 bp, Homo sapiens
tctgggaatttattggcacttt

SEQ ID NO: 8290467 - DNA, 22 bp, Homo sapiens
tctgggaatggttgatccacac

SEQ ID NO: 8290468 - DNA, 23 bp, Homo sapiens
tctgggaattggctgtccacagg

SEQ ID NO: 8290469 - DNA, 22 bp, Homo sapiens
tcttccagaatgcattctcttt

SEQ ID NO: 8290470 - DNA, 22 bp, Homo sapiens
tcttatttagagaggactagag

SEQ ID NO: 8290471 - DNA, 22 bp, Homo sapiens
tcttcacacacagtcctctttc

SEQ ID NO: 8290472 - DNA, 22 bp, Homo sapiens
tcttcacaccgggcagcaggaa

SEQ ID NO: 8290473 - DNA, 22 bp, Homo sapiens
tcttcacatcatgttttttaat

SEQ ID NO: 8290474 - DNA, 22 bp, Homo sapiens
tcttcacatggaacatgaagct

SEQ ID NO: 8290475 - DNA, 22 bp, Homo sapiens
tcttcacatgaccttcatgtct

SEQ ID NO: 8290476 - DNA, 22 bp, Homo sapiens
tcttcagcaactccccaatctg

SEQ ID NO: 8290477 - DNA, 22 bp, Homo sapiens
tcttctctacaccagcagcccc

SEQ ID NO: 8290478 - DNA, 22 bp, Homo sapiens
tcttctcctttgccatgtgttt

SEQ ID NO: 8290479 - DNA, 22 bp, Homo sapiens
tcttctccagtgcttctgcaca

SEQ ID NO: 8290480 - DNA, 22 bp, Homo sapiens
tcttctcccagggtcgcccaag

SEQ ID NO: 8290481 - DNA, 22 bp, Homo sapiens
tcttctcccatcggccgcaggg

SEQ ID NO: 8290482 - DNA, 22 bp, Homo sapiens
tcttctcccatcggccgcaggg

SEQ ID NO: 8290483 - DNA, 22 bp, Homo sapiens
tcttctcccatctccaggcagg

SEQ ID NO: 8290484 - DNA, 22 bp, Homo sapiens
tcttcctgaaaccctgttccag

SEQ ID NO: 8290485 - DNA, 21 bp, Homo sapiens
tcttcctgctccacactcccc

SEQ ID NO: 8290486 - DNA, 21 bp, Homo sapiens
tcttcctgacatatgcaaggc

SEQ ID NO: 8290487 - DNA, 22 bp, Homo sapiens
tcttcctccctacagagctcag

SEQ ID NO: 8290488 - DNA, 22 bp, Homo sapiens
tcttcctctctaattgatcaga

SEQ ID NO: 8290489 - DNA, 22 bp, Homo sapiens
tcttccttttgtaccttctgaa

SEQ ID NO: 8290490 - DNA, 22 bp, Homo sapiens
tcttcctgtcaatgagaattaa

SEQ ID NO: 8290491 - DNA, 22 bp, Homo sapiens
tcttcctggtttctgggccatc

SEQ ID NO: 8290492 - DNA, 22 bp, Homo sapiens
tcttcctggcattgatgctgca

SEQ ID NO: 8290493 - DNA, 22 bp, Homo sapiens
tcttcctggatgggggttgatg

SEQ ID NO: 8290494 - DNA, 22 bp, Homo sapiens
tctttagtgctgcttttggatt

SEQ ID NO: 8290495 - DNA, 17 bp, Homo sapiens
tctttcctgccatgctc

SEQ ID NO: 8290496 - DNA, 22 bp, Homo sapiens
tctttctctctaatcaagcaca

SEQ ID NO: 8290497 - DNA, 22 bp, Homo sapiens
tctttctggttatgtatagaga

SEQ ID NO: 8290498 - DNA, 22 bp, Homo sapiens
tctttctgaatatttgacctca

SEQ ID NO: 8290499 - DNA, 22 bp, Homo sapiens
tctttgatcagcctttcactga

SEQ ID NO: 8290500 - DNA, 22 bp, Homo sapiens
tctttgatggagagatagatat

SEQ ID NO: 8290501 - DNA, 22 bp, Homo sapiens
tctttgatgggagatctgagag

SEQ ID NO: 8290502 - DNA, 22 bp, Homo sapiens
tctttgatgtggttaattatga

SEQ ID NO: 8290503 - DNA, 22 bp, Homo sapiens
tcttgaaaggagattggaggca

SEQ ID NO: 8290504 - DNA, 22 bp, Homo sapiens
tcttgaagtccttacatttgat

SEQ ID NO: 8290505 - DNA, 22 bp, Homo sapiens
tcttgaattgtactcccataag

SEQ ID NO: 8290506 - DNA, 22 bp, Homo sapiens
tcttgattacttattttgtgcc

SEQ ID NO: 8290507 - DNA, 22 bp, Homo sapiens
tcttgagggatcttcagtgtgt

SEQ ID NO: 8290508 - DNA, 22 bp, Homo sapiens
tcttgctccacatgctgagatg

SEQ ID NO: 8290509 - DNA, 20 bp, Homo sapiens
tcttggcaaatgggagtgtc

SEQ ID NO: 8290510 - DNA, 22 bp, Homo sapiens
tctttaatgtgattgtaattat

SEQ ID NO: 8290511 - DNA, 22 bp, Homo sapiens
tctttaattcagcatgatgcgg

SEQ ID NO: 8290512 - DNA, 22 bp, Homo sapiens
tctttaattgtggaagagcagc

SEQ ID NO: 8290513 - DNA, 22 bp, Homo sapiens
tctttaatcataaccaagatgg

SEQ ID NO: 8290514 - DNA, 22 bp, Homo sapiens
tctttaatcataaccaagatgg

SEQ ID NO: 8290515 - DNA, 22 bp, Homo sapiens
tctttaatgtactttctttcac

SEQ ID NO: 8290516 - DNA, 22 bp, Homo sapiens
tctttacagtcctctgtcaatc

SEQ ID NO: 8290517 - DNA, 22 bp, Homo sapiens
tctttagacatccagtttctct

SEQ ID NO: 8290518 - DNA, 22 bp, Homo sapiens
tcttggctgcagagccggcaag

SEQ ID NO: 8290519 - DNA, 22 bp, Homo sapiens
tctgtcattttgtatctacatg

SEQ ID NO: 8290520 - DNA, 18 bp, Homo sapiens
tctgtccaccctgtgctg

SEQ ID NO: 8290521 - DNA, 22 bp, Homo sapiens
tctgtccattttccattttggc

SEQ ID NO: 8290522 - DNA, 22 bp, Homo sapiens
tctgtcctccggagctcccagt

SEQ ID NO: 8290523 - DNA, 22 bp, Homo sapiens
tctgtcctgtttcctcctgaca

SEQ ID NO: 8290524 - DNA, 22 bp, Homo sapiens
tctgtctgactaccatgaggca

SEQ ID NO: 8290525 - DNA, 22 bp, Homo sapiens
tctgtcacatacacttttcagg

SEQ ID NO: 8290526 - DNA, 21 bp, Homo sapiens
tctgtagatctgagtctgtct

SEQ ID NO: 8290527 - DNA, 22 bp, Homo sapiens
tctgtaatcagagtagcagata

SEQ ID NO: 8290528 - DNA, 22 bp, Homo sapiens
tctgtaatcaagatatttgaga

SEQ ID NO: 8290529 - DNA, 20 bp, Homo sapiens
tctgtaattatgccatcact

SEQ ID NO: 8290530 - DNA, 22 bp, Homo sapiens
tctgtaaacacccgtaagcttt

SEQ ID NO: 8290531 - DNA, 22 bp, Homo sapiens
tctgtaaagccctggtacctgg

SEQ ID NO: 8290532 - DNA, 20 bp, Homo sapiens
tctgtacactcatcttctgc

SEQ ID NO: 8290533 - DNA, 22 bp, Homo sapiens
tctgggcttggattggctctgc

SEQ ID NO: 8290534 - DNA, 22 bp, Homo sapiens
tctgggggaggaggcatggccc

SEQ ID NO: 8290535 - DNA, 22 bp, Homo sapiens
tctgtgaaatcacccaggttta

SEQ ID NO: 8290536 - DNA, 22 bp, Homo sapiens
tctgtctgccttgtgagggcac

SEQ ID NO: 8290537 - DNA, 22 bp, Homo sapiens
tctgtgaaacagctctggcatg

SEQ ID NO: 8290538 - DNA, 22 bp, Homo sapiens
tctgtgctaatgcttcacaata

SEQ ID NO: 8290539 - DNA, 21 bp, Homo sapiens
tctgtgcctcaaccctcatct

SEQ ID NO: 8290540 - DNA, 22 bp, Homo sapiens
tctgtgtctgcagaagttcagc

SEQ ID NO: 8290541 - DNA, 22 bp, Homo sapiens
tctgtgtcgttctgtgctctgg

SEQ ID NO: 8290542 - DNA, 22 bp, Homo sapiens
tctgtgtatttgtgacctgtat

SEQ ID NO: 8290543 - DNA, 21 bp, Homo sapiens
tctgtgctgccgtcaacatcc

SEQ ID NO: 8290544 - DNA, 22 bp, Homo sapiens
tctgtgctagcacgcagcaagg

SEQ ID NO: 8290545 - DNA, 22 bp, Homo sapiens
tctgtgctcatgcatgtgaatt

SEQ ID NO: 8290546 - DNA, 22 bp, Homo sapiens
tctgtggctgtgctgggccaga

SEQ ID NO: 8290547 - DNA, 23 bp, Homo sapiens
tctgtggctccttcaggctgctg

SEQ ID NO: 8290548 - DNA, 22 bp, Homo sapiens
tctgttcttggtgcagctggga

SEQ ID NO: 8290549 - DNA, 22 bp, Homo sapiens
tctgttcttggtgcagctggga

SEQ ID NO: 8290550 - DNA, 20 bp, Homo sapiens
tcttatacagaaaacatttt

SEQ ID NO: 8290551 - DNA, 22 bp, Homo sapiens
tcttaagaaagtgacaaatagg

SEQ ID NO: 8290552 - DNA, 22 bp, Homo sapiens
tcttaacagtgctacagagcag

SEQ ID NO: 8290553 - DNA, 22 bp, Homo sapiens
tctgttttgtaccagatacagc

SEQ ID NO: 8290554 - DNA, 22 bp, Homo sapiens
tctgttttgtgtctctctggtg

SEQ ID NO: 8290555 - DNA, 22 bp, Homo sapiens
tcttaaaagtatgccaattgga

SEQ ID NO: 8290556 - DNA, 22 bp, Homo sapiens
tcttaaaagtatgccaattgga

SEQ ID NO: 8290557 - DNA, 22 bp, Homo sapiens
tctgttttctctgtattttgac

SEQ ID NO: 8290558 - DNA, 22 bp, Homo sapiens
agaacaaatcgatggaagcctg

SEQ ID NO: 8290559 - DNA, 22 bp, Homo sapiens
agaacaaaattagaggagtgca

SEQ ID NO: 8290560 - DNA, 22 bp, Homo sapiens
actcagaatgactgatgctgtg

SEQ ID NO: 8290561 - DNA, 18 bp, Homo sapiens
aagctcttaaatggttca

SEQ ID NO: 8290562 - DNA, 22 bp, Homo sapiens
aagcatttttgaaatggtagga

SEQ ID NO: 8290563 - DNA, 22 bp, Homo sapiens
acaaaggcaggattgacttagt

SEQ ID NO: 8290564 - DNA, 18 bp, Homo sapiens
agaggctcgatactagaa

SEQ ID NO: 8290565 - DNA, 22 bp, Homo sapiens
agaggctctaaggttggatcaa

SEQ ID NO: 8290566 - DNA, 22 bp, Homo sapiens
agaggctcttgcccttcccaca

SEQ ID NO: 8290567 - DNA, 22 bp, Homo sapiens
agaggctctgccgcctcaggta

SEQ ID NO: 8290568 - DNA, 22 bp, Homo sapiens
agaggctctaataccagcatgg

SEQ ID NO: 8290569 - DNA, 22 bp, Homo sapiens
agaggctctaatcccctccaca

SEQ ID NO: 8290570 - DNA, 22 bp, Homo sapiens
aaaaggcatggaggttgatagt

SEQ ID NO: 8290571 - DNA, 22 bp, Homo sapiens
aaggcactgtactagttagtta

SEQ ID NO: 8290572 - DNA, 22 bp, Homo sapiens
aaggaagacacagatgaagtga

SEQ ID NO: 8290573 - DNA, 22 bp, Homo sapiens
aactagaaaacaagatgctgat

SEQ ID NO: 8290574 - DNA, 22 bp, Homo sapiens
aagaaaagaaacctgaggcttt

SEQ ID NO: 8290575 - DNA, 22 bp, Homo sapiens
actttggggaacttttctcctc

SEQ ID NO: 8290576 - DNA, 22 bp, Homo sapiens
actttggggatctacggctgga

SEQ ID NO: 8290577 - DNA, 20 bp, Homo sapiens
actttggggtctttctcaga

SEQ ID NO: 8290578 - DNA, 22 bp, Homo sapiens
actttgggtaagccaggtgcta

SEQ ID NO: 8290579 - DNA, 21 bp, Homo sapiens
actttgggcactttcctgccc

SEQ ID NO: 8290580 - DNA, 22 bp, Homo sapiens
actttgggcacagtgaggccag

SEQ ID NO: 8290581 - DNA, 21 bp, Homo sapiens
actttgggaggtgtgaggggc

SEQ ID NO: 8290582 - DNA, 22 bp, Homo sapiens
actttgggtaagttgattaatc

SEQ ID NO: 8290583 - DNA, 22 bp, Homo sapiens
agtctcttgcacattgtattaa

SEQ ID NO: 8290584 - DNA, 22 bp, Homo sapiens
atgcttgcccatgtttctgaag

SEQ ID NO: 8290585 - DNA, 22 bp, Homo sapiens
agaagagtagtaacagaaatta

SEQ ID NO: 8290586 - DNA, 22 bp, Homo sapiens
agagggtatgagtggggctaaa

SEQ ID NO: 8290587 - DNA, 22 bp, Homo sapiens
agcaaacagtgtgctaagaaat

SEQ ID NO: 8290588 - DNA, 22 bp, Homo sapiens
agcttgttgttactgatgcatt

SEQ ID NO: 8290589 - DNA, 22 bp, Homo sapiens
agcttgttataaatgcagaatg

SEQ ID NO: 8290590 - DNA, 22 bp, Homo sapiens
agcttgttagggcagtggtcgc

SEQ ID NO: 8290591 - DNA, 22 bp, Homo sapiens
agcttgttcaaatgcagaatac

SEQ ID NO: 8290592 - DNA, 22 bp, Homo sapiens
agcttgttagaaatgtagactc

SEQ ID NO: 8290593 - DNA, 22 bp, Homo sapiens
cctccccacccacggctggtgg

SEQ ID NO: 8290594 - DNA, 22 bp, Homo sapiens
cctccccacagcccaggagact

SEQ ID NO: 8290595 - DNA, 23 bp, Homo sapiens
cctccccaccagactctaacata

SEQ ID NO: 8290596 - DNA, 22 bp, Homo sapiens
cctccccacaggccaaataggc

SEQ ID NO: 8290597 - DNA, 20 bp, Homo sapiens
aggccccaggaaactctcag

SEQ ID NO: 8290598 - DNA, 22 bp, Homo sapiens
aggccaggatagcatggatcag

SEQ ID NO: 8290599 - DNA, 22 bp, Homo sapiens
atcccttgtgctcagcctcttg

SEQ ID NO: 8290600 - DNA, 22 bp, Homo sapiens
ctgggagacaagagagggctga

SEQ ID NO: 8290601 - DNA, 20 bp, Homo sapiens
ggcactggaagcacacagga

SEQ ID NO: 8290602 - DNA, 22 bp, Homo sapiens
ggcactggaaggatcatgtgag

SEQ ID NO: 8290603 - DNA, 22 bp, Homo sapiens
ggcactggagactgttatgaga

SEQ ID NO: 8290604 - DNA, 22 bp, Homo sapiens
ggcactggaagtcccattgtct

SEQ ID NO: 8290605 - DNA, 16 bp, Homo sapiens
ggcactggcaggtcct

SEQ ID NO: 8290606 - DNA, 22 bp, Homo sapiens
ggcactggcaaagcaaagtctg

SEQ ID NO: 8290607 - DNA, 22 bp, Homo sapiens
ggcactggcctggggccaagag

SEQ ID NO: 8290608 - DNA, 22 bp, Homo sapiens
ggcactgggcaccggctgaggg

SEQ ID NO: 8290609 - DNA, 22 bp, Homo sapiens
ggcactgggagaggtgagacgg

SEQ ID NO: 8290610 - DNA, 22 bp, Homo sapiens
ggcactgggaatgcagtgatga

SEQ ID NO: 8290611 - DNA, 21 bp, Homo sapiens
ggaaaactttccttgtctgaa

SEQ ID NO: 8290612 - DNA, 22 bp, Homo sapiens
gggacttaatgcagagagggac

SEQ ID NO: 8290613 - DNA, 22 bp, Homo sapiens
gggagggccagtgctctctaga

SEQ ID NO: 8290614 - DNA, 22 bp, Homo sapiens
gggagggcttggacccagatgt

SEQ ID NO: 8290615 - DNA, 20 bp, Homo sapiens
gggaggccagcctcagagaa

SEQ ID NO: 8290616 - DNA, 22 bp, Homo sapiens
gggcacttctaagcatggggct

SEQ ID NO: 8290617 - DNA, 22 bp, Homo sapiens
gggcacttgtgttcttcacttt

SEQ ID NO: 8290618 - DNA, 22 bp, Homo sapiens
gggcacttactgccaaggcgag

SEQ ID NO: 8290619 - DNA, 22 bp, Homo sapiens
gggcacttaatgggcacagaga

SEQ ID NO: 8290620 - DNA, 22 bp, Homo sapiens
gggcactttgtgcctcactgtg

SEQ ID NO: 8290621 - DNA, 22 bp, Homo sapiens
gggcactgtgctgggtgcttta

SEQ ID NO: 8290622 - DNA, 22 bp, Homo sapiens
gggcactgtgctaggtgctgag

SEQ ID NO: 8290623 - DNA, 21 bp, Homo sapiens
gggcgaggcctgatgtggctc

SEQ ID NO: 8290624 - DNA, 22 bp, Homo sapiens
gacagatggtcagtgttgaagt

SEQ ID NO: 8290625 - DNA, 20 bp, Homo sapiens
cttgttgattctaggaatga

SEQ ID NO: 8290626 - DNA, 22 bp, Homo sapiens
atgcagaatgagttcacgatct

SEQ ID NO: 8290627 - DNA, 22 bp, Homo sapiens
atgcagaacgtttgtgaaactt

SEQ ID NO: 8290628 - DNA, 22 bp, Homo sapiens
attggaagtatttcatcaaaag

SEQ ID NO: 8290629 - DNA, 22 bp, Homo sapiens
tattggaatgcactgggagaga

SEQ ID NO: 8290630 - DNA, 22 bp, Homo sapiens
tattggaaggcattagtgaata

SEQ ID NO: 8290631 - DNA, 22 bp, Homo sapiens
ccagaagagatcacagttcttg

SEQ ID NO: 8290632 - DNA, 22 bp, Homo sapiens
ccagaagaggacacagtgtgga

SEQ ID NO: 8290633 - DNA, 23 bp, Homo sapiens
ccagaatctactcattggaatga

SEQ ID NO: 8290634 - DNA, 22 bp, Homo sapiens
ccagaatctcaatacctttcaa

SEQ ID NO: 8290635 - DNA, 22 bp, Homo sapiens
ccagaatcccattgtcacttca

SEQ ID NO: 8290636 - DNA, 22 bp, Homo sapiens
ccagaatccacattccccagag

SEQ ID NO: 8290637 - DNA, 22 bp, Homo sapiens
ccagaatcatcatctgaagcct

SEQ ID NO: 8290638 - DNA, 22 bp, Homo sapiens
ccagaatccaaaacgttttgag

SEQ ID NO: 8290639 - DNA, 22 bp, Homo sapiens
gttcacagctgggacaagactg

SEQ ID NO: 8290640 - DNA, 22 bp, Homo sapiens
gttcacaggttctctttctaag

SEQ ID NO: 8290641 - DNA, 20 bp, Homo sapiens
gttcacaggcttcctttcag

SEQ ID NO: 8290642 - DNA, 22 bp, Homo sapiens
gttcacagttttatacctgaga

SEQ ID NO: 8290643 - DNA, 22 bp, Homo sapiens
gttcacagtgttttctttgcat

SEQ ID NO: 8290644 - DNA, 22 bp, Homo sapiens
gtggggagggagatgctgaagt

SEQ ID NO: 8290645 - DNA, 22 bp, Homo sapiens
taattggatgttctctggaagc

SEQ ID NO: 8290646 - DNA, 22 bp, Homo sapiens
tggtccctgagacctttgggag

SEQ ID NO: 8290647 - DNA, 22 bp, Homo sapiens
ttttagttgtagttggtgagga

SEQ ID NO: 8290648 - DNA, 22 bp, Homo sapiens
ttcccagaatgaatggatggag

SEQ ID NO: 8290649 - DNA, 22 bp, Homo sapiens
ttgggcactgtgggttgtctgt

SEQ ID NO: 8290650 - DNA, 22 bp, Homo sapiens
ttgggcacactttgctggggag

SEQ ID NO: 8290651 - DNA, 22 bp, Homo sapiens
ttgggcaccagtgcactgacag

SEQ ID NO: 8290652 - DNA, 22 bp, Homo sapiens
ttgggcacggacaggtggggat

SEQ ID NO: 8290653 - DNA, 22 bp, Homo sapiens
gcacaaggagaattcattagtg

SEQ ID NO: 8290654 - DNA, 22 bp, Homo sapiens
gcacaaggagcagtgtatgaaa

SEQ ID NO: 8290655 - DNA, 22 bp, Homo sapiens
gcacttggcctttatctgggga

SEQ ID NO: 8290656 - DNA, 22 bp, Homo sapiens
gatgtgtttccaggatttgttt

SEQ ID NO: 8290657 - DNA, 22 bp, Homo sapiens
gatgctccttggtgatagaata

SEQ ID NO: 8290658 - DNA, 19 bp, Homo sapiens
cttgggcatatctgaggca

SEQ ID NO: 8290659 - DNA, 22 bp, Homo sapiens
gagaggtacggaaagagcgtgg

SEQ ID NO: 8290660 - DNA, 22 bp, Homo sapiens
gagagtgaggcatcaggggcag

SEQ ID NO: 8290661 - DNA, 22 bp, Homo sapiens
ggagaggcttggcccagcctgg

SEQ ID NO: 8290662 - DNA, 22 bp, Homo sapiens
ggaggctccatgagctcctgca

SEQ ID NO: 8290663 - DNA, 22 bp, Homo sapiens
ggaggctccactgctcttcctg

SEQ ID NO: 8290664 - DNA, 22 bp, Homo sapiens
ggaggctcagtgaggaaatgga

SEQ ID NO: 8290665 - DNA, 22 bp, Homo sapiens
ggaggctcagactccatcctca

SEQ ID NO: 8290666 - DNA, 23 bp, Homo sapiens
ggaggctcaagtatcacgggcag

SEQ ID NO: 8290667 - DNA, 22 bp, Homo sapiens
ggaggctcccacgcagctcaca

SEQ ID NO: 8290668 - DNA, 22 bp, Homo sapiens
ggaggctcctaagctgacttga

SEQ ID NO: 8290669 - DNA, 22 bp, Homo sapiens
ggaggctcgctggtcgcacagc

SEQ ID NO: 8290670 - DNA, 22 bp, Homo sapiens
ggaggctctaaactttccttgg

SEQ ID NO: 8290671 - DNA, 22 bp, Homo sapiens
ggaggctctgccatctgtcaca

SEQ ID NO: 8290672 - DNA, 22 bp, Homo sapiens
ggaggctctgctccgtgtgttc

SEQ ID NO: 8290673 - DNA, 22 bp, Homo sapiens
ggaggctctgcttatgaaaggc

SEQ ID NO: 8290674 - DNA, 22 bp, Homo sapiens
ggaggctctcctggccttgtct

SEQ ID NO: 8290675 - DNA, 22 bp, Homo sapiens
ggaggctctgaccatttaccca

SEQ ID NO: 8290676 - DNA, 22 bp, Homo sapiens
ggaggctcttatttgttcaaca

SEQ ID NO: 8290677 - DNA, 18 bp, Homo sapiens
ggaggctctgtggtttcc

SEQ ID NO: 8290678 - DNA, 22 bp, Homo sapiens
ggaggctcttgagaggggagta

SEQ ID NO: 8290679 - DNA, 22 bp, Homo sapiens
ggagggctcgtcatccaccact

SEQ ID NO: 8290680 - DNA, 22 bp, Homo sapiens
ggctccttgccaccagctctgc

SEQ ID NO: 8290681 - DNA, 23 bp, Homo sapiens
ggctccttgcccatccagcagcc

SEQ ID NO: 8290682 - DNA, 22 bp, Homo sapiens
ggctccttatctctcctatgcc

SEQ ID NO: 8290683 - DNA, 22 bp, Homo sapiens
ggctccttcaaagcacctggct

SEQ ID NO: 8290684 - DNA, 22 bp, Homo sapiens
gggctactgagctggaactggg

SEQ ID NO: 8290685 - DNA, 22 bp, Homo sapiens
gggaggctcagtggtgtcctct

SEQ ID NO: 8290686 - DNA, 22 bp, Homo sapiens
gggaggctctgctcagcccccg

SEQ ID NO: 8290687 - DNA, 22 bp, Homo sapiens
gggaggctgccatccttcagga

SEQ ID NO: 8290688 - DNA, 22 bp, Homo sapiens
gggaggctggctctggccacag

SEQ ID NO: 8290689 - DNA, 22 bp, Homo sapiens
gggaggcttgagccatactgcc

SEQ ID NO: 8290690 - DNA, 22 bp, Homo sapiens
gggggctctgactccctcagct

SEQ ID NO: 8290691 - DNA, 22 bp, Homo sapiens
gggggctcctcccagctgccag

SEQ ID NO: 8290692 - DNA, 22 bp, Homo sapiens
gtgggggatgctgagttggaaa

SEQ ID NO: 8290693 - DNA, 22 bp, Homo sapiens
gtgggggacccaggtgctgtcc

SEQ ID NO: 8290694 - DNA, 22 bp, Homo sapiens
gtggggaggcattcttctccct

SEQ ID NO: 8290695 - DNA, 22 bp, Homo sapiens
gtggggagcagccttagcccct

SEQ ID NO: 8290696 - DNA, 22 bp, Homo sapiens
gggtggggccaggcaatttgca

SEQ ID NO: 8290697 - DNA, 22 bp, Homo sapiens
gggtggggcccaggaaatctat

SEQ ID NO: 8290698 - DNA, 22 bp, Homo sapiens
gggtggggtgtatcggatccta

SEQ ID NO: 8290699 - DNA, 22 bp, Homo sapiens
gggtggggttcaggaatcttca

SEQ ID NO: 8290700 - DNA, 22 bp, Homo sapiens
tcttgggccaatattctgggta

SEQ ID NO: 8290701 - DNA, 22 bp, Homo sapiens
tcttgggcacgatgggaggctt

SEQ ID NO: 8290702 - DNA, 22 bp, Homo sapiens
tcttgggctgagagatggggta

SEQ ID NO: 8290703 - DNA, 22 bp, Homo sapiens
tcttgggctagaatagcaggag

SEQ ID NO: 8290704 - DNA, 21 bp, Homo sapiens
tctctgggccctcctgtgggg

SEQ ID NO: 8290705 - DNA, 22 bp, Homo sapiens
tctccccaaccatggcactcac

SEQ ID NO: 8290706 - DNA, 22 bp, Homo sapiens
tgcacgaaatctttctagtctt

SEQ ID NO: 8290707 - DNA, 22 bp, Homo sapiens
tgcagcaagtaaccatcttcct

SEQ ID NO: 8290708 - DNA, 22 bp, Homo sapiens
tgaatagtaagagaatatttgc

SEQ ID NO: 8290709 - DNA, 22 bp, Homo sapiens
tgaatagtgttctataatatgg

SEQ ID NO: 8290710 - DNA, 22 bp, Homo sapiens
tgaatggtgattggtgcttctc

SEQ ID NO: 8290711 - DNA, 22 bp, Homo sapiens
tgaatggtcactgagcatctgt

SEQ ID NO: 8290712 - DNA, 21 bp, Homo sapiens
tgagagagtagcaggacatat

SEQ ID NO: 8290713 - DNA, 22 bp, Homo sapiens
tgggactcactcttttggccag

SEQ ID NO: 8290714 - DNA, 22 bp, Homo sapiens
tgggagaggctgccatcttgca

SEQ ID NO: 8290715 - DNA, 19 bp, Homo sapiens
tgggagaggcaacagagta

SEQ ID NO: 8290716 - DNA, 21 bp, Homo sapiens
tgggagagggctcagctaccc

SEQ ID NO: 8290717 - DNA, 22 bp, Homo sapiens
tgggagagtctaaaaccgaggt

SEQ ID NO: 8290718 - DNA, 22 bp, Homo sapiens
tgggagagtaaccaattccttc

SEQ ID NO: 8290719 - DNA, 22 bp, Homo sapiens
tgggagagtgctcaatgtgcaa

SEQ ID NO: 8290720 - DNA, 22 bp, Homo sapiens
tgggagagtttgtttagagtga

SEQ ID NO: 8290721 - DNA, 22 bp, Homo sapiens
tgggagagcttcatgccttcag

SEQ ID NO: 8290722 - DNA, 22 bp, Homo sapiens
tgggaggacttgtgggcttcat

SEQ ID NO: 8290723 - DNA, 22 bp, Homo sapiens
tgggaagactcctcaggaggcg

SEQ ID NO: 8290724 - DNA, 22 bp, Homo sapiens
tgggaagaggcgggaggctgtt

SEQ ID NO: 8290725 - DNA, 22 bp, Homo sapiens
tggaggctggagtgcagtggcg

SEQ ID NO: 8290726 - DNA, 22 bp, Homo sapiens
tggaggctgtgtgcatgagacc

SEQ ID NO: 8290727 - DNA, 22 bp, Homo sapiens
tggagaggagcaccatggccat

SEQ ID NO: 8290728 - DNA, 20 bp, Homo sapiens
tgctgctttgccactagttg

SEQ ID NO: 8290729 - DNA, 19 bp, Homo sapiens
tgctgcttccagctcactc

SEQ ID NO: 8290730 - DNA, 22 bp, Homo sapiens
tggtgggtcggctgggagagct

SEQ ID NO: 8290731 - DNA, 22 bp, Homo sapiens
tggtggggtcatcgtcagatgc

SEQ ID NO: 8290732 - DNA, 23 bp, Homo sapiens
tggtggggtcttggagacagcac

SEQ ID NO: 8290733 - DNA, 16 bp, Homo sapiens
tggtggggaggacagc

SEQ ID NO: 8290734 - DNA, 22 bp, Homo sapiens
tggtgggggaggctgtctagca

SEQ ID NO: 8290735 - DNA, 22 bp, Homo sapiens
tggtggggctttccttctgctt

SEQ ID NO: 8290736 - DNA, 22 bp, Homo sapiens
tgtccctcattgacgctgtgcc

SEQ ID NO: 8290737 - DNA, 22 bp, Homo sapiens
tgtccctctgaggcttccctgg

SEQ ID NO: 8290738 - DNA, 21 bp, Homo sapiens
tgggtgggcagagtctcttca

SEQ ID NO: 8290739 - DNA, 22 bp, Homo sapiens
tggggagtgatgcctcggataa

SEQ ID NO: 8290740 - DNA, 21 bp, Homo sapiens
tggggaggggacctgattatg

SEQ ID NO: 8290741 - DNA, 22 bp, Homo sapiens
tggggaggtaacaatttcaggc

SEQ ID NO: 8290742 - DNA, 22 bp, Homo sapiens
tggggaggatatgtgagttatt

SEQ ID NO: 8290743 - DNA, 22 bp, Homo sapiens
tggggaggaagtcagatttcag

SEQ ID NO: 8290744 - DNA, 22 bp, Homo sapiens
tgggggagattgtgcatctcta

SEQ ID NO: 8290745 - DNA, 22 bp, Homo sapiens
tgggcctgagctcaccaggggc

SEQ ID NO: 8290746 - DNA, 22 bp, Homo sapiens
tgggcctgagtttgggaactgg

SEQ ID NO: 8290747 - DNA, 22 bp, Homo sapiens
tgggcctggggcagcccaaatc

SEQ ID NO: 8290748 - DNA, 22 bp, Homo sapiens
tgggcctgggctggacagcctg

SEQ ID NO: 8290749 - DNA, 23 bp, Homo sapiens
tgggcctggaaagccttagagag

SEQ ID NO: 8290750 - DNA, 22 bp, Homo sapiens
tgggcctgattcttgaatcctg

SEQ ID NO: 8290751 - DNA, 21 bp, Homo sapiens
tgggcctgattcccagggtca

SEQ ID NO: 8290752 - DNA, 22 bp, Homo sapiens
tgggctctggaattgagtggcc

SEQ ID NO: 8290753 - DNA, 22 bp, Homo sapiens
tgggctctgtgccaggttggtg

SEQ ID NO: 8290754 - DNA, 22 bp, Homo sapiens
tgggcctgttgcctgagtccat

SEQ ID NO: 8290755 - DNA, 22 bp, Homo sapiens
tgggcctgtggggatcttgaag

SEQ ID NO: 8290756 - DNA, 22 bp, Homo sapiens
tgggcctgttggggttgagtta

SEQ ID NO: 8290757 - DNA, 23 bp, Homo sapiens
tgggcgaggcaggagtggagcac

SEQ ID NO: 8290758 - DNA, 22 bp, Homo sapiens
tgggagtgcacctgggacacga

SEQ ID NO: 8290759 - DNA, 22 bp, Homo sapiens
tgggcactatggctctgtgcac

SEQ ID NO: 8290760 - DNA, 22 bp, Homo sapiens
tgggcactcagagttttcaaga

SEQ ID NO: 8290761 - DNA, 22 bp, Homo sapiens
tgggcactcaggctgaggccgt

SEQ ID NO: 8290762 - DNA, 22 bp, Homo sapiens
tgtgaatggacaattaaatcta

SEQ ID NO: 8290763 - DNA, 22 bp, Homo sapiens
tgtgaatgcttgttatggagtg

SEQ ID NO: 8290764 - DNA, 22 bp, Homo sapiens
tgtgaatgttaatattggatta

SEQ ID NO: 8290765 - DNA, 20 bp, Homo sapiens
tgtgagagggtggcttgccc

SEQ ID NO: 8290766 - DNA, 22 bp, Homo sapiens
tgtgagagaagtgtgtgctccc

SEQ ID NO: 8290767 - DNA, 22 bp, Homo sapiens
tgtggggacctggctgccaccc

SEQ ID NO: 8290768 - DNA, 22 bp, Homo sapiens
tgtggggactgagtggaggctt

SEQ ID NO: 8290769 - DNA, 22 bp, Homo sapiens
tgtggggaagagtatgacttgg

SEQ ID NO: 8290770 - DNA, 22 bp, Homo sapiens
tgtgggaggtctggaaggctcc

SEQ ID NO: 8290771 - DNA, 22 bp, Homo sapiens
tgtgggagaaggaagcaagctg

SEQ ID NO: 8290772 - DNA, 18 bp, Homo sapiens
tgtttatttttctcttac

SEQ ID NO: 8290773 - DNA, 22 bp, Homo sapiens
agagggctaaggtttgggagat

SEQ ID NO: 8290774 - DNA, 22 bp, Homo sapiens
agagggtaacaagaggcctgga

SEQ ID NO: 8290775 - DNA, 22 bp, Homo sapiens
aatggaatacctaggtggccca

SEQ ID NO: 8290776 - DNA, 22 bp, Homo sapiens
agaatccctgcttgtcttcaaa

SEQ ID NO: 8290777 - DNA, 22 bp, Homo sapiens
agaatccctggggagctgcagc

SEQ ID NO: 8290778 - DNA, 19 bp, Homo sapiens
agaatcccaggccccactg

SEQ ID NO: 8290779 - DNA, 22 bp, Homo sapiens
aaatcatgtgcagagatcagga

SEQ ID NO: 8290780 - DNA, 22 bp, Homo sapiens
aagtcaaagctttcagaggaaa

SEQ ID NO: 8290781 - DNA, 21 bp, Homo sapiens
aagcttttcctgagagttgtc

SEQ ID NO: 8290782 - DNA, 22 bp, Homo sapiens
aagcttttgacttggtagggaa

SEQ ID NO: 8290783 - DNA, 22 bp, Homo sapiens
aagctttttggatttgcttcag

SEQ ID NO: 8290784 - DNA, 22 bp, Homo sapiens
acagaagaccaagaaagcttcc

SEQ ID NO: 8290785 - DNA, 22 bp, Homo sapiens
agctctttggaaggtgtgcact

SEQ ID NO: 8290786 - DNA, 22 bp, Homo sapiens
cactggtgacttctgagctgga

SEQ ID NO: 8290787 - DNA, 22 bp, Homo sapiens
cactggtgaaagtttaattgtt

SEQ ID NO: 8290788 - DNA, 22 bp, Homo sapiens
cactgtgggcctgtcgtgggtg

SEQ ID NO: 8290789 - DNA, 22 bp, Homo sapiens
agatgctggatggaaaatgatc

SEQ ID NO: 8290790 - DNA, 22 bp, Homo sapiens
agaggctccttcactctggcac

SEQ ID NO: 8290791 - DNA, 22 bp, Homo sapiens
agagggctttgattctcagttc

SEQ ID NO: 8290792 - DNA, 19 bp, Homo sapiens
agacaagtttccagaagcc

SEQ ID NO: 8290793 - DNA, 22 bp, Homo sapiens
aggaggctgtggagcactccat

SEQ ID NO: 8290794 - DNA, 22 bp, Homo sapiens
aggctccagcagccagaggaag

SEQ ID NO: 8290795 - DNA, 22 bp, Homo sapiens
aggctccaggcccttcaccagc

SEQ ID NO: 8290796 - DNA, 22 bp, Homo sapiens
actttgggaagctgcaattgcc

SEQ ID NO: 8290797 - DNA, 22 bp, Homo sapiens
actttgggacccagccaaccct

SEQ ID NO: 8290798 - DNA, 22 bp, Homo sapiens
agaaaaagtcaaggaattggac

SEQ ID NO: 8290799 - DNA, 22 bp, Homo sapiens
agaaagatccttctggctgcct

SEQ ID NO: 8290800 - DNA, 22 bp, Homo sapiens
ctgggagaggctgctccgctct

SEQ ID NO: 8290801 - DNA, 21 bp, Homo sapiens
atctcgggcttctcgcccagc

SEQ ID NO: 8290802 - DNA, 22 bp, Homo sapiens
aggcactgaagaactctttttg

SEQ ID NO: 8290803 - DNA, 22 bp, Homo sapiens
aggcactgaaaggtggccagag

SEQ ID NO: 8290804 - DNA, 22 bp, Homo sapiens
aggcactgaagtggtaaatgta

SEQ ID NO: 8290805 - DNA, 22 bp, Homo sapiens
aggcactgaatatccagtaaaa

SEQ ID NO: 8290806 - DNA, 22 bp, Homo sapiens
aggcactgaaggaagcttgcgc

SEQ ID NO: 8290807 - DNA, 22 bp, Homo sapiens
aggcactgacaattctggactg

SEQ ID NO: 8290808 - DNA, 22 bp, Homo sapiens
aggcactgacagattctgtgtc

SEQ ID NO: 8290809 - DNA, 23 bp, Homo sapiens
aggcactgaatgtgtcagtgagt

SEQ ID NO: 8290810 - DNA, 22 bp, Homo sapiens
aggcactgacctgcttccttga

SEQ ID NO: 8290811 - DNA, 22 bp, Homo sapiens
aggcactgactcaagggagcca

SEQ ID NO: 8290812 - DNA, 22 bp, Homo sapiens
aggcactgagaggctgtgttgc

SEQ ID NO: 8290813 - DNA, 22 bp, Homo sapiens
aggcactgattctcagagttac

SEQ ID NO: 8290814 - DNA, 22 bp, Homo sapiens
aggcactgattctgttttccat

SEQ ID NO: 8290815 - DNA, 22 bp, Homo sapiens
aggcactttccttgaggagttt

SEQ ID NO: 8290816 - DNA, 22 bp, Homo sapiens
aggcactttctgtatgctagtt

SEQ ID NO: 8290817 - DNA, 22 bp, Homo sapiens
aggaggctgcaaccctgaggcc

SEQ ID NO: 8290818 - DNA, 22 bp, Homo sapiens
aggaggctgggcacagtggcct

SEQ ID NO: 8290819 - DNA, 22 bp, Homo sapiens
aggaggctggttcaggccatat

SEQ ID NO: 8290820 - DNA, 22 bp, Homo sapiens
ccagaagaacttaattcaaaac

SEQ ID NO: 8290821 - DNA, 22 bp, Homo sapiens
ccagaagacaagaatgttctta

SEQ ID NO: 8290822 - DNA, 22 bp, Homo sapiens
aggcgtggttgaggcgagcata

SEQ ID NO: 8290823 - DNA, 22 bp, Homo sapiens
agggcgtggtggtgctggagca

SEQ ID NO: 8290824 - DNA, 19 bp, Homo sapiens
ccccacttccatgggctcc

SEQ ID NO: 8290825 - DNA, 22 bp, Homo sapiens
ccccacttgctcagcatgtcca

SEQ ID NO: 8290826 - DNA, 22 bp, Homo sapiens
ccccactttgagtagcacttga

SEQ ID NO: 8290827 - DNA, 22 bp, Homo sapiens
attgttgagtgcttcagctgta

SEQ ID NO: 8290828 - DNA, 22 bp, Homo sapiens
attgttgatcttctggtaagcc

SEQ ID NO: 8290829 - DNA, 22 bp, Homo sapiens
gcactggtttatttaagaacaa

SEQ ID NO: 8290830 - DNA, 22 bp, Homo sapiens
gcactggttaccctgagtggct

SEQ ID NO: 8290831 - DNA, 22 bp, Homo sapiens
gcactggtgtgttagtaaggga

SEQ ID NO: 8290832 - DNA, 22 bp, Homo sapiens
gcactggtgtgaaacagtagat

SEQ ID NO: 8290833 - DNA, 22 bp, Homo sapiens
gcactggtcagcatgtttcgca

SEQ ID NO: 8290834 - DNA, 20 bp, Homo sapiens
gcactggtctggatctcctg

SEQ ID NO: 8290835 - DNA, 22 bp, Homo sapiens
gcactggtcttcccagcgaact

SEQ ID NO: 8290836 - DNA, 22 bp, Homo sapiens
gcactggtatcacctgagagct

SEQ ID NO: 8290837 - DNA, 22 bp, Homo sapiens
gaaatcttccaatggtcacatc

SEQ ID NO: 8290838 - DNA, 22 bp, Homo sapiens
cttgagaatcttgatgtctacc

SEQ ID NO: 8290839 - DNA, 22 bp, Homo sapiens
cagaagatgctttgtaaaatga

SEQ ID NO: 8290840 - DNA, 23 bp, Homo sapiens
cagaagcacctgttgactgctgc

SEQ ID NO: 8290841 - DNA, 22 bp, Homo sapiens
gggggaggtgaatgcaataagg

SEQ ID NO: 8290842 - DNA, 22 bp, Homo sapiens
gtccgtagtggctgatgctttg

SEQ ID NO: 8290843 - DNA, 17 bp, Homo sapiens
gtgaatggcatagtcgg

SEQ ID NO: 8290844 - DNA, 22 bp, Homo sapiens
gtgaatggttgtgaacatcttt

SEQ ID NO: 8290845 - DNA, 22 bp, Homo sapiens
cattttatgtttatggagtgct

SEQ ID NO: 8290846 - DNA, 22 bp, Homo sapiens
tgggagagaattctggtgactg

SEQ ID NO: 8290847 - DNA, 22 bp, Homo sapiens
tgggagagaataatcaataggt

SEQ ID NO: 8290848 - DNA, 22 bp, Homo sapiens
tgggagagataggcttctggac

SEQ ID NO: 8290849 - DNA, 22 bp, Homo sapiens
tgggagagagaattcccagtgg

SEQ ID NO: 8290850 - DNA, 22 bp, Homo sapiens
tgggcacttatcgaaattgagg

SEQ ID NO: 8290851 - DNA, 22 bp, Homo sapiens
tgggcactgaagctttgagcag

SEQ ID NO: 8290852 - DNA, 22 bp, Homo sapiens
tgggcactcctggggacagctg

SEQ ID NO: 8290853 - DNA, 22 bp, Homo sapiens
tgggcactcttctgtgcaaaca

SEQ ID NO: 8290854 - DNA, 22 bp, Homo sapiens
tgggcactgactgttagtgatg

SEQ ID NO: 8290855 - DNA, 21 bp, Homo sapiens
tgggcactgagggtgctgctc

SEQ ID NO: 8290856 - DNA, 22 bp, Homo sapiens
tgggcactggaagcctgctgtg

SEQ ID NO: 8290857 - DNA, 22 bp, Homo sapiens
tgggcactggggctccagaggt

SEQ ID NO: 8290858 - DNA, 22 bp, Homo sapiens
tgggcactgtgtgtggtaaaat

SEQ ID NO: 8290859 - DNA, 22 bp, Homo sapiens
tgggcactgtagctggtgctgg

SEQ ID NO: 8290860 - DNA, 22 bp, Homo sapiens
tgggagagcagagaaccctctt

SEQ ID NO: 8290861 - DNA, 22 bp, Homo sapiens
tgggagagcactgcagccccgg

SEQ ID NO: 8290862 - DNA, 22 bp, Homo sapiens
tgggcctggccctgtggaggag

SEQ ID NO: 8290863 - DNA, 22 bp, Homo sapiens
tgggcctgggagggcagacgct

SEQ ID NO: 8290864 - DNA, 22 bp, Homo sapiens
tgggcctggagccctggagagt

SEQ ID NO: 8290865 - DNA, 22 bp, Homo sapiens
ccctccccacaaagcttcacac

SEQ ID NO: 8290866 - DNA, 22 bp, Homo sapiens
ccctccccagggtcatattgaa

SEQ ID NO: 8290867 - DNA, 22 bp, Homo sapiens
ctgggagatctcctgagggcag

SEQ ID NO: 8290868 - DNA, 22 bp, Homo sapiens
ctgggcactgcagggtgttgag

SEQ ID NO: 8290869 - DNA, 20 bp, Homo sapiens
ctggggagctgctcccacga

SEQ ID NO: 8290870 - DNA, 22 bp, Homo sapiens
gaatcccttgcattatcccttt

SEQ ID NO: 8290871 - DNA, 22 bp, Homo sapiens
gaatccctaagatttttataaa

SEQ ID NO: 8290872 - DNA, 22 bp, Homo sapiens
gaatcccttgcaagttgttgta

SEQ ID NO: 8290873 - DNA, 22 bp, Homo sapiens
gaggctcaacccacaggggttg

SEQ ID NO: 8290874 - DNA, 22 bp, Homo sapiens
gaggctcactgggcaaagactc

SEQ ID NO: 8290875 - DNA, 22 bp, Homo sapiens
gaggctcactttcatcctcttc

SEQ ID NO: 8290876 - DNA, 22 bp, Homo sapiens
gaggctcagagaagtcatggta

SEQ ID NO: 8290877 - DNA, 22 bp, Homo sapiens
gaggctcacctagggagcactg

SEQ ID NO: 8290878 - DNA, 22 bp, Homo sapiens
gaggctcacgacgggacgaact

SEQ ID NO: 8290879 - DNA, 22 bp, Homo sapiens
gaggctcactaggcatcctggg

SEQ ID NO: 8290880 - DNA, 22 bp, Homo sapiens
gaggcagggtgttgattacaga

SEQ ID NO: 8290881 - DNA, 22 bp, Homo sapiens
gaggctcagagactttaagttt

SEQ ID NO: 8290882 - DNA, 22 bp, Homo sapiens
gaggctcagagaggtccacata

SEQ ID NO: 8290883 - DNA, 22 bp, Homo sapiens
gaggctcagagggactttcaag

SEQ ID NO: 8290884 - DNA, 22 bp, Homo sapiens
gaggctcagagtggttaaataa

SEQ ID NO: 8290885 - DNA, 22 bp, Homo sapiens
gaggctcagagggagcatggtc

SEQ ID NO: 8290886 - DNA, 22 bp, Homo sapiens
gaggctcagttatgtcatcagg

SEQ ID NO: 8290887 - DNA, 22 bp, Homo sapiens
gaggctcagttattttagcctg

SEQ ID NO: 8290888 - DNA, 22 bp, Homo sapiens
gaggctcagggaaacagcgcag

SEQ ID NO: 8290889 - DNA, 22 bp, Homo sapiens
gaggctcagggagtatatgaat

SEQ ID NO: 8290890 - DNA, 22 bp, Homo sapiens
gaggctcattgcattgtgcatt

SEQ ID NO: 8290891 - DNA, 22 bp, Homo sapiens
gaggaacagagacgggatcgct

SEQ ID NO: 8290892 - DNA, 22 bp, Homo sapiens
ctccccacatttctccctgtct

SEQ ID NO: 8290893 - DNA, 22 bp, Homo sapiens
ctccccacacactaggcctgat

SEQ ID NO: 8290894 - DNA, 22 bp, Homo sapiens
ctccccacgcctggactaagag

SEQ ID NO: 8290895 - DNA, 22 bp, Homo sapiens
ctccccaccttcgcggtccctg

SEQ ID NO: 8290896 - DNA, 22 bp, Homo sapiens
ttgtttatggattgtagaaact

SEQ ID NO: 8290897 - DNA, 22 bp, Homo sapiens
ctgagaggtaagcagcgcagtg

SEQ ID NO: 8290898 - DNA, 22 bp, Homo sapiens
cctttggggctttactgtggaa

SEQ ID NO: 8290899 - DNA, 22 bp, Homo sapiens
cctttgggaataggttccggct

SEQ ID NO: 8290900 - DNA, 22 bp, Homo sapiens
cgaggctcagagagggtgactt

SEQ ID NO: 8290901 - DNA, 22 bp, Homo sapiens
ccttgtcctctggtttcctgtt

SEQ ID NO: 8290902 - DNA, 22 bp, Homo sapiens
ttgcacagatgcacatggttgc

SEQ ID NO: 8290903 - DNA, 23 bp, Homo sapiens
ttgcaaaatgagtcttgagtgaa

SEQ ID NO: 8290904 - DNA, 22 bp, Homo sapiens
ttgcaaaagccgaggcactcca

SEQ ID NO: 8290905 - DNA, 22 bp, Homo sapiens
gggggaaagctcaggagcctgt

SEQ ID NO: 8290906 - DNA, 22 bp, Homo sapiens
gggggaaagtggaggttcgtga

SEQ ID NO: 8290907 - DNA, 22 bp, Homo sapiens
gggggaaatagaaatgcttaga

SEQ ID NO: 8290908 - DNA, 22 bp, Homo sapiens
gggcctgattagcaggctagct

SEQ ID NO: 8290909 - DNA, 18 bp, Homo sapiens
ggcactggtgatgcagag

SEQ ID NO: 8290910 - DNA, 22 bp, Homo sapiens
ggcactgggtgagggtcactgg

SEQ ID NO: 8290911 - DNA, 22 bp, Homo sapiens
ggcactgggttgtaggaattaa

SEQ ID NO: 8290912 - DNA, 19 bp, Homo sapiens
ggcactggggccaggacca

SEQ ID NO: 8290913 - DNA, 21 bp, Homo sapiens
gggcactgaaagggaatagca

SEQ ID NO: 8290914 - DNA, 22 bp, Homo sapiens
gggcactggaggccaaggagct

SEQ ID NO: 8290915 - DNA, 18 bp, Homo sapiens
gggcactggggactggag

SEQ ID NO: 8290916 - DNA, 22 bp, Homo sapiens
gggagggccaggctcacccagg

SEQ ID NO: 8290917 - DNA, 22 bp, Homo sapiens
ggagaggcgatgagtcacagcc

SEQ ID NO: 8290918 - DNA, 22 bp, Homo sapiens
ggaaatctggtggtagatggga

SEQ ID NO: 8290919 - DNA, 22 bp, Homo sapiens
ggaaatctcttttgtggtgttt

SEQ ID NO: 8290920 - DNA, 22 bp, Homo sapiens
ggaaatctctactttgtcattt

SEQ ID NO: 8290921 - DNA, 22 bp, Homo sapiens
ggaaatctcagatctcccagat

SEQ ID NO: 8290922 - DNA, 20 bp, Homo sapiens
gcttcccaattcttgatctg

SEQ ID NO: 8290923 - DNA, 22 bp, Homo sapiens
gctcaagccttctgcccacctc

SEQ ID NO: 8290924 - DNA, 22 bp, Homo sapiens
taggctcattaagtccccaggg

SEQ ID NO: 8290925 - DNA, 22 bp, Homo sapiens
gttttatttccatgagagaccg

SEQ ID NO: 8290926 - DNA, 22 bp, Homo sapiens
tcccagaaaaaggaggctatga

SEQ ID NO: 8290927 - DNA, 22 bp, Homo sapiens
tcccagaaacgcatatgttcat

SEQ ID NO: 8290928 - DNA, 22 bp, Homo sapiens
tcccagaatctccagtgctaca

SEQ ID NO: 8290929 - DNA, 22 bp, Homo sapiens
tcccagaatggcccagctgccc

SEQ ID NO: 8290930 - DNA, 22 bp, Homo sapiens
tcccagaatctttggaagagca

SEQ ID NO: 8290931 - DNA, 22 bp, Homo sapiens
tcccagaaccctgccaggtcct

SEQ ID NO: 8290932 - DNA, 22 bp, Homo sapiens
tcccagaacctcagagtgtgac

SEQ ID NO: 8290933 - DNA, 22 bp, Homo sapiens
tcccagaacgggttcttcccag

SEQ ID NO: 8290934 - DNA, 22 bp, Homo sapiens
tcccagaaccttttagcttcac

SEQ ID NO: 8290935 - DNA, 22 bp, Homo sapiens
tcccagaagagatgccacttga

SEQ ID NO: 8290936 - DNA, 22 bp, Homo sapiens
tcccagaagtccagccatgggc

SEQ ID NO: 8290937 - DNA, 22 bp, Homo sapiens
tcccagaatcctcactctatca

SEQ ID NO: 8290938 - DNA, 22 bp, Homo sapiens
tcccagaagtgaaatttctaga

SEQ ID NO: 8290939 - DNA, 22 bp, Homo sapiens
tcccttgtcacctcacactatg

SEQ ID NO: 8290940 - DNA, 22 bp, Homo sapiens
tcccttgtcctcttcgtcactg

SEQ ID NO: 8290941 - DNA, 22 bp, Homo sapiens
tcccttgtcctgtgggaagagc

SEQ ID NO: 8290942 - DNA, 22 bp, Homo sapiens
tcccttgtgagaacatgtgttg

SEQ ID NO: 8290943 - DNA, 22 bp, Homo sapiens
tttgggcatgttgtggccagct

SEQ ID NO: 8290944 - DNA, 22 bp, Homo sapiens
tttgggcattagaatattcttt

SEQ ID NO: 8290945 - DNA, 22 bp, Homo sapiens
tttgggcatatagctgttccct

SEQ ID NO: 8290946 - DNA, 22 bp, Homo sapiens
tttgggcattagtaagttaagc

SEQ ID NO: 8290947 - DNA, 22 bp, Homo sapiens
tttgggcaggcttttccctaga

SEQ ID NO: 8290948 - DNA, 22 bp, Homo sapiens
tttgggcagtcctggaatttgt

SEQ ID NO: 8290949 - DNA, 22 bp, Homo sapiens
tttgggcagtagatgtatcact

SEQ ID NO: 8290950 - DNA, 22 bp, Homo sapiens
tttgggcagtgggcttagcggc

SEQ ID NO: 8290951 - DNA, 22 bp, Homo sapiens
ttcccagaattgttgggaactg

SEQ ID NO: 8290952 - DNA, 22 bp, Homo sapiens
ttcccagacctgtaggatcaga

SEQ ID NO: 8290953 - DNA, 19 bp, Homo sapiens
ttcccagagccatgagtga

SEQ ID NO: 8290954 - DNA, 22 bp, Homo sapiens
ttcccagaggcaaagtctggat

SEQ ID NO: 8290955 - DNA, 22 bp, Homo sapiens
ttcccagaggagatttgcttat

SEQ ID NO: 8290956 - DNA, 22 bp, Homo sapiens
ttcccagactccacactgaggc

SEQ ID NO: 8290957 - DNA, 22 bp, Homo sapiens
ttcccagagataagacgtctta

SEQ ID NO: 8290958 - DNA, 22 bp, Homo sapiens
ttcccagagaaggatgaaaaag

SEQ ID NO: 8290959 - DNA, 22 bp, Homo sapiens
ttcccagattggagggcagggg

SEQ ID NO: 8290960 - DNA, 22 bp, Homo sapiens
ttggaagaaatatcaatagtgt

SEQ ID NO: 8290961 - DNA, 22 bp, Homo sapiens
ttggaagacagccgtctttatt

SEQ ID NO: 8290962 - DNA, 22 bp, Homo sapiens
ttggaagagtagagttgaataa

SEQ ID NO: 8290963 - DNA, 22 bp, Homo sapiens
ttggaagagagccacagttaat

SEQ ID NO: 8290964 - DNA, 22 bp, Homo sapiens
ttggaagacattaaagagagtg

SEQ ID NO: 8290965 - DNA, 22 bp, Homo sapiens
ttgttcactatgaagaggttgg

SEQ ID NO: 8290966 - DNA, 22 bp, Homo sapiens
ttggggagttaatgccaaagat

SEQ ID NO: 8290967 - DNA, 22 bp, Homo sapiens
ttggggagaaatgaaatgaagt

SEQ ID NO: 8290968 - DNA, 22 bp, Homo sapiens
ttgttgcatttcaagtatgaga

SEQ ID NO: 8290969 - DNA, 22 bp, Homo sapiens
ttgttgcataaagtaggaaata

SEQ ID NO: 8290970 - DNA, 22 bp, Homo sapiens
aatcccttcccttctctgggac

SEQ ID NO: 8290971 - DNA, 20 bp, Homo sapiens
aatcccttctctggactctt

SEQ ID NO: 8290972 - DNA, 22 bp, Homo sapiens
aatccctttttcatttaataga

SEQ ID NO: 8290973 - DNA, 22 bp, Homo sapiens
aaggaaatgaggttgatggatg

SEQ ID NO: 8290974 - DNA, 22 bp, Homo sapiens
aaggaaatgaagctgatgttgg

SEQ ID NO: 8290975 - DNA, 22 bp, Homo sapiens
aaggaaatctttgtaacatctt

SEQ ID NO: 8290976 - DNA, 22 bp, Homo sapiens
aaggcactacgctgctggggcg

SEQ ID NO: 8290977 - DNA, 22 bp, Homo sapiens
aaggcacttaacgtgggaggat

SEQ ID NO: 8290978 - DNA, 22 bp, Homo sapiens
aaggcacttgcccagagctgca

SEQ ID NO: 8290979 - DNA, 22 bp, Homo sapiens
aaggcacttttctaaagacctt

SEQ ID NO: 8290980 - DNA, 22 bp, Homo sapiens
aaggcacttttcctgagatgat

SEQ ID NO: 8290981 - DNA, 22 bp, Homo sapiens
aattggaaaaagacttaattgc

SEQ ID NO: 8290982 - DNA, 22 bp, Homo sapiens
acaagtttatttgattagaaca

SEQ ID NO: 8290983 - DNA, 22 bp, Homo sapiens
acagcaaaggacgaacactctg

SEQ ID NO: 8290984 - DNA, 22 bp, Homo sapiens
aagctcttgttgaatcttgtca

SEQ ID NO: 8290985 - DNA, 22 bp, Homo sapiens
aagctcttgagtaaactagttt

SEQ ID NO: 8290986 - DNA, 22 bp, Homo sapiens
aaagctttgggtaggaatggga

SEQ ID NO: 8290987 - DNA, 22 bp, Homo sapiens
aaagctttgctggaaggaagag

SEQ ID NO: 8290988 - DNA, 22 bp, Homo sapiens
aacaaaagccgaagtaggtgtc

SEQ ID NO: 8290989 - DNA, 22 bp, Homo sapiens
aaagatcagaggatagctgagt

SEQ ID NO: 8290990 - DNA, 23 bp, Homo sapiens
aaacaagccctaatgaagagtcc

SEQ ID NO: 8290991 - DNA, 22 bp, Homo sapiens
agaggctcactcttggaaccca

SEQ ID NO: 8290992 - DNA, 22 bp, Homo sapiens
agaggctcagaggcctggtcct

SEQ ID NO: 8290993 - DNA, 22 bp, Homo sapiens
agaggctcctagccactggctt

SEQ ID NO: 8290994 - DNA, 22 bp, Homo sapiens
cagaatccacaacagaagttga

SEQ ID NO: 8290995 - DNA, 22 bp, Homo sapiens
cagaatccagaattgctgaggt

SEQ ID NO: 8290996 - DNA, 22 bp, Homo sapiens
cagaatccatgacagacgttga

SEQ ID NO: 8290997 - DNA, 21 bp, Homo sapiens
cagaatccagtctcttattac

SEQ ID NO: 8290998 - DNA, 22 bp, Homo sapiens
agggcacttcctctgggtccct

SEQ ID NO: 8290999 - DNA, 22 bp, Homo sapiens
aggcactgggggatgagcaagg

SEQ ID NO: 8291000 - DNA, 20 bp, Homo sapiens
aggcactggggataggtaag

SEQ ID NO: 8291001 - DNA, 20 bp, Homo sapiens
aggcactggatttcttatat

SEQ ID NO: 8291002 - DNA, 18 bp, Homo sapiens
aggcactggaattaaggg

SEQ ID NO: 8291003 - DNA, 22 bp, Homo sapiens
aggcactgggaatatgctgagg

SEQ ID NO: 8291004 - DNA, 22 bp, Homo sapiens
aggcactgcttctaagtaggaa

SEQ ID NO: 8291005 - DNA, 22 bp, Homo sapiens
agtttattctctggtcttagta

SEQ ID NO: 8291006 - DNA, 20 bp, Homo sapiens
agtttattccaggagaactg

SEQ ID NO: 8291007 - DNA, 22 bp, Homo sapiens
agtttattgtatatggtagttt

SEQ ID NO: 8291008 - DNA, 22 bp, Homo sapiens
agtttattctgcttggccctcc

SEQ ID NO: 8291009 - DNA, 22 bp, Homo sapiens
agtttatttctccatttaccta

SEQ ID NO: 8291010 - DNA, 17 bp, Homo sapiens
agtttatttagccttct

SEQ ID NO: 8291011 - DNA, 22 bp, Homo sapiens
agtttatttttgataagtcttg

SEQ ID NO: 8291012 - DNA, 19 bp, Homo sapiens
agtttattataggtgattc

SEQ ID NO: 8291013 - DNA, 22 bp, Homo sapiens
atagtgaaaatgctgtcagcat

SEQ ID NO: 8291014 - DNA, 22 bp, Homo sapiens
ctggggagtgaaattcttaaat

SEQ ID NO: 8291015 - DNA, 22 bp, Homo sapiens
ctggggaggatgctacgacctg

SEQ ID NO: 8291016 - DNA, 22 bp, Homo sapiens
ctggggaggcagggctgcccct

SEQ ID NO: 8291017 - DNA, 22 bp, Homo sapiens
ctggtgggaagatggaaaacat

SEQ ID NO: 8291018 - DNA, 22 bp, Homo sapiens
ctggtgggagataattgaatca

SEQ ID NO: 8291019 - DNA, 22 bp, Homo sapiens
ctggtgggaggcaaggtggaag

SEQ ID NO: 8291020 - DNA, 22 bp, Homo sapiens
ctggtgggagcagcaggcagct

SEQ ID NO: 8291021 - DNA, 22 bp, Homo sapiens
agtctctttaatcacagtgtct

SEQ ID NO: 8291022 - DNA, 22 bp, Homo sapiens
agtctcttttgcgaagagtgtt

SEQ ID NO: 8291023 - DNA, 22 bp, Homo sapiens
agtctctttctaaataaggtca

SEQ ID NO: 8291024 - DNA, 22 bp, Homo sapiens
aggcactgcagattacaggcgc

SEQ ID NO: 8291025 - DNA, 21 bp, Homo sapiens
aggagggcacaaggccaggaa

SEQ ID NO: 8291026 - DNA, 15 bp, Homo sapiens
aggcactgtgggacc

SEQ ID NO: 8291027 - DNA, 22 bp, Homo sapiens
aggcactgtgctgatgtcttat

SEQ ID NO: 8291028 - DNA, 22 bp, Homo sapiens
aggcactgtgcttcttatatgt

SEQ ID NO: 8291029 - DNA, 22 bp, Homo sapiens
aggcactgtggaagacatggtt

SEQ ID NO: 8291030 - DNA, 22 bp, Homo sapiens
aggcactgtactaggtacaggg

SEQ ID NO: 8291031 - DNA, 22 bp, Homo sapiens
aggcactgtgcagtcccaagca

SEQ ID NO: 8291032 - DNA, 22 bp, Homo sapiens
aggcactggtctaccccttagt

SEQ ID NO: 8291033 - DNA, 21 bp, Homo sapiens
aggaggctgtctctttcagct

SEQ ID NO: 8291034 - DNA, 22 bp, Homo sapiens
cagggctccctctggctcccag

SEQ ID NO: 8291035 - DNA, 22 bp, Homo sapiens
agggctcctccccggcctccac

SEQ ID NO: 8291036 - DNA, 22 bp, Homo sapiens
cctccccacgggcagccggcgc

SEQ ID NO: 8291037 - DNA, 22 bp, Homo sapiens
attgcacaaagagggaaactga

SEQ ID NO: 8291038 - DNA, 22 bp, Homo sapiens
ctttgggatttcatgagagcta

SEQ ID NO: 8291039 - DNA, 22 bp, Homo sapiens
ctttgggcaaagggccaattcg

SEQ ID NO: 8291040 - DNA, 22 bp, Homo sapiens
ctttgggcactgaagtatgggt

SEQ ID NO: 8291041 - DNA, 16 bp, Homo sapiens
atgctgctattagagg

SEQ ID NO: 8291042 - DNA, 23 bp, Homo sapiens
atgctagctgtgccaacaccata

SEQ ID NO: 8291043 - DNA, 22 bp, Homo sapiens
gaggctccggtagtagccttga

SEQ ID NO: 8291044 - DNA, 22 bp, Homo sapiens
gaggctccagcgacacctaggc

SEQ ID NO: 8291045 - DNA, 22 bp, Homo sapiens
ggggaggaagctctcagttcca

SEQ ID NO: 8291046 - DNA, 22 bp, Homo sapiens
ggggccttggatctgtgccccg

SEQ ID NO: 8291047 - DNA, 22 bp, Homo sapiens
ggggccttttctgaatgtggaa

SEQ ID NO: 8291048 - DNA, 22 bp, Homo sapiens
gtgagagggctgggctcatgat

SEQ ID NO: 8291049 - DNA, 22 bp, Homo sapiens
gtgagaggttcctgttagaact

SEQ ID NO: 8291050 - DNA, 22 bp, Homo sapiens
cactggtgatgaggcagttagg

SEQ ID NO: 8291051 - DNA, 22 bp, Homo sapiens
cactggtgagtccagaagtcat

SEQ ID NO: 8291052 - DNA, 22 bp, Homo sapiens
cactggtgtattagagctagaa

SEQ ID NO: 8291053 - DNA, 22 bp, Homo sapiens
cactggtgtctgagcagggtga

SEQ ID NO: 8291054 - DNA, 22 bp, Homo sapiens
cactggtgtacaggaggtaaaa

SEQ ID NO: 8291055 - DNA, 23 bp, Homo sapiens
cactggtggggtttaaaagaagc

SEQ ID NO: 8291056 - DNA, 22 bp, Homo sapiens
cactggtgccagagaacagaat

SEQ ID NO: 8291057 - DNA, 22 bp, Homo sapiens
gtgagggcagcttggtcagtgt

SEQ ID NO: 8291058 - DNA, 22 bp, Homo sapiens
tccccactgggcctcctctttc

SEQ ID NO: 8291059 - DNA, 22 bp, Homo sapiens
tccccactcctgggcagatgcg

SEQ ID NO: 8291060 - DNA, 22 bp, Homo sapiens
tccccactctctcctggagctt

SEQ ID NO: 8291061 - DNA, 22 bp, Homo sapiens
tccccactctgggccaccacaa

SEQ ID NO: 8291062 - DNA, 22 bp, Homo sapiens
ccactttgaaccactgaggtgg

SEQ ID NO: 8291063 - DNA, 22 bp, Homo sapiens
ccactttgagaagctgatgaaa

SEQ ID NO: 8291064 - DNA, 22 bp, Homo sapiens
ccactttgcaagatattcagag

SEQ ID NO: 8291065 - DNA, 19 bp, Homo sapiens
ccactttgcagatagtgag

SEQ ID NO: 8291066 - DNA, 18 bp, Homo sapiens
ccactttgcagcctggcc

SEQ ID NO: 8291067 - DNA, 22 bp, Homo sapiens
ccactttggcaccttctgccta

SEQ ID NO: 8291068 - DNA, 22 bp, Homo sapiens
ccactttgtaatgtgttatgtt

SEQ ID NO: 8291069 - DNA, 19 bp, Homo sapiens
ccactttgcttctctgggt

SEQ ID NO: 8291070 - DNA, 21 bp, Homo sapiens
tcttgtccttgctctcccact

SEQ ID NO: 8291071 - DNA, 22 bp, Homo sapiens
cctccccatgacccggtgctgg

SEQ ID NO: 8291072 - DNA, 22 bp, Homo sapiens
tgggtcacaaaggccagatgat

SEQ ID NO: 8291073 - DNA, 21 bp, Homo sapiens
tgggagagcgttgctgtcctc

SEQ ID NO: 8291074 - DNA, 22 bp, Homo sapiens
ttgcagaaaacagttttcttgt

SEQ ID NO: 8291075 - DNA, 22 bp, Homo sapiens
ttggaagattacttagttttct

SEQ ID NO: 8291076 - DNA, 22 bp, Homo sapiens
cctttgggttcaatctcggtct

SEQ ID NO: 8291077 - DNA, 22 bp, Homo sapiens
cttcccagaccttagagtgcag

SEQ ID NO: 8291078 - DNA, 22 bp, Homo sapiens
cttcccagaacaatgtaggctt

SEQ ID NO: 8291079 - DNA, 22 bp, Homo sapiens
cttcccagcacctcagtctggc

SEQ ID NO: 8291080 - DNA, 22 bp, Homo sapiens
cttcccagacggggtggcagcc

SEQ ID NO: 8291081 - DNA, 22 bp, Homo sapiens
cttcccaggtgctcttagcatg

SEQ ID NO: 8291082 - DNA, 22 bp, Homo sapiens
cttcccagttctgcttgagggg

SEQ ID NO: 8291083 - DNA, 22 bp, Homo sapiens
gaaagactaactagaaagtgca

SEQ ID NO: 8291084 - DNA, 22 bp, Homo sapiens
ctggtggggagtcctggtctcc

SEQ ID NO: 8291085 - DNA, 22 bp, Homo sapiens
ctggtgggtagagggcatcagg

SEQ ID NO: 8291086 - DNA, 22 bp, Homo sapiens
ctgtgggcatttgagtgtgggt

SEQ ID NO: 8291087 - DNA, 22 bp, Homo sapiens
ctgtgggattcatgacattaat

SEQ ID NO: 8291088 - DNA, 22 bp, Homo sapiens
ctgtccctcagttctgggcaaa

SEQ ID NO: 8291089 - DNA, 22 bp, Homo sapiens
gaggctcaaacctggacagagc

SEQ ID NO: 8291090 - DNA, 19 bp, Homo sapiens
gactcacaccttccgctgt

SEQ ID NO: 8291091 - DNA, 22 bp, Homo sapiens
gagagacagcagaacgtgcagc

SEQ ID NO: 8291092 - DNA, 22 bp, Homo sapiens
tattgtgaatttggaagcaatg

SEQ ID NO: 8291093 - DNA, 22 bp, Homo sapiens
tagttcaaagtctgtcaaagga

SEQ ID NO: 8291094 - DNA, 18 bp, Homo sapiens
tccctccctgctgtggcc

SEQ ID NO: 8291095 - DNA, 19 bp, Homo sapiens
tccctccctgtaatctcac

SEQ ID NO: 8291096 - DNA, 20 bp, Homo sapiens
tccctccctccagctctggg

SEQ ID NO: 8291097 - DNA, 22 bp, Homo sapiens
tccctccccacttctgagcttt

SEQ ID NO: 8291098 - DNA, 22 bp, Homo sapiens
gctttgggtgtcctctgggcct

SEQ ID NO: 8291099 - DNA, 22 bp, Homo sapiens
gtcttgttaagattttggaata

SEQ ID NO: 8291100 - DNA, 22 bp, Homo sapiens
gtcttgttggagttcttgcagc

SEQ ID NO: 8291101 - DNA, 22 bp, Homo sapiens
ggggagaattaccaaaagcgct

SEQ ID NO: 8291102 - DNA, 22 bp, Homo sapiens
ggggaggccagtggaccgtccc

SEQ ID NO: 8291103 - DNA, 22 bp, Homo sapiens
ggggaggctgatgtgggcaaag

SEQ ID NO: 8291104 - DNA, 22 bp, Homo sapiens
ggggaggcaagatgaagtgagg

SEQ ID NO: 8291105 - DNA, 22 bp, Homo sapiens
gggctctgggattcagagcaag

SEQ ID NO: 8291106 - DNA, 21 bp, Homo sapiens
gggtggggttccagccttttc

SEQ ID NO: 8291107 - DNA, 22 bp, Homo sapiens
ggtgagaggcctgagagctgga

SEQ ID NO: 8291108 - DNA, 22 bp, Homo sapiens
ggtggggattcctgatcactgt

SEQ ID NO: 8291109 - DNA, 22 bp, Homo sapiens
gggcactgtacactgtgcatgg

SEQ ID NO: 8291110 - DNA, 22 bp, Homo sapiens
gggctctggacccaggcaagag

SEQ ID NO: 8291111 - DNA, 22 bp, Homo sapiens
ttgtcccttcagtaagagtgga

SEQ ID NO: 8291112 - DNA, 22 bp, Homo sapiens
ttgtccctgcccctgcttgctt

SEQ ID NO: 8291113 - DNA, 22 bp, Homo sapiens
ttgggcctcactctagaaggca

SEQ ID NO: 8291114 - DNA, 22 bp, Homo sapiens
ttgggcctctcaaagtgctggg

SEQ ID NO: 8291115 - DNA, 22 bp, Homo sapiens
ttgcagcatattgatctcctgt

SEQ ID NO: 8291116 - DNA, 22 bp, Homo sapiens
ttgcacaaaaaattgttgaata

SEQ ID NO: 8291117 - DNA, 22 bp, Homo sapiens
ttgcagaatctcaggaaggaga

SEQ ID NO: 8291118 - DNA, 22 bp, Homo sapiens
ttgcagaagcctgttgttcctg

SEQ ID NO: 8291119 - DNA, 22 bp, Homo sapiens
ttgcagaatacttattctgtat

SEQ ID NO: 8291120 - DNA, 22 bp, Homo sapiens
ttgctgaaaacaggtcatcagg

SEQ ID NO: 8291121 - DNA, 22 bp, Homo sapiens
acaaaagcttttggagggttgt

SEQ ID NO: 8291122 - DNA, 22 bp, Homo sapiens
aaggcactagcaagctgcctgg

SEQ ID NO: 8291123 - DNA, 22 bp, Homo sapiens
aaggcactagcagaattagtga

SEQ ID NO: 8291124 - DNA, 22 bp, Homo sapiens
aaggcactcagccttgggacag

SEQ ID NO: 8291125 - DNA, 20 bp, Homo sapiens
aaggcactatgtctgctagc

SEQ ID NO: 8291126 - DNA, 22 bp, Homo sapiens
aaggcactcattcaaggagata

SEQ ID NO: 8291127 - DNA, 22 bp, Homo sapiens
aaggcactgagccagccgtctc

SEQ ID NO: 8291128 - DNA, 22 bp, Homo sapiens
aaggcactgactgtgcagggga

SEQ ID NO: 8291129 - DNA, 22 bp, Homo sapiens
aaggcactgaacttaaattctg

SEQ ID NO: 8291130 - DNA, 22 bp, Homo sapiens
aaggcactgaaaaattgtgtgt

SEQ ID NO: 8291131 - DNA, 22 bp, Homo sapiens
aaggcactgctttgctgcgccc

SEQ ID NO: 8291132 - DNA, 22 bp, Homo sapiens
aaagcagtgcaccttaattgat

SEQ ID NO: 8291133 - DNA, 22 bp, Homo sapiens
atgattgaccatctgctgggct

SEQ ID NO: 8291134 - DNA, 22 bp, Homo sapiens
atgattgaaaatgacattgcca

SEQ ID NO: 8291135 - DNA, 20 bp, Homo sapiens
cactttggacctgatgtatc

SEQ ID NO: 8291136 - DNA, 22 bp, Homo sapiens
atagttcactaatagcaaaagc

SEQ ID NO: 8291137 - DNA, 20 bp, Homo sapiens
actggtggactgttcattga

SEQ ID NO: 8291138 - DNA, 22 bp, Homo sapiens
actggtggccctcagtgttctc

SEQ ID NO: 8291139 - DNA, 22 bp, Homo sapiens
actggtggctttcagacagaaa

SEQ ID NO: 8291140 - DNA, 22 bp, Homo sapiens
actggtggtttctccccagaga

SEQ ID NO: 8291141 - DNA, 22 bp, Homo sapiens
agtgagagtattaatgtgaact

SEQ ID NO: 8291142 - DNA, 22 bp, Homo sapiens
aggcactggtccattttctgca

SEQ ID NO: 8291143 - DNA, 22 bp, Homo sapiens
aggcactgggtaattagtagct

SEQ ID NO: 8291144 - DNA, 22 bp, Homo sapiens
accagaagttctccaaaaagat

SEQ ID NO: 8291145 - DNA, 23 bp, Homo sapiens
agggcactgaagctggaattggg

SEQ ID NO: 8291146 - DNA, 22 bp, Homo sapiens
agggcactgcaagggttgaagg

SEQ ID NO: 8291147 - DNA, 21 bp, Homo sapiens
aggcactgtttgtggtttggg

SEQ ID NO: 8291148 - DNA, 20 bp, Homo sapiens
aggcactgttgtctgtatcc

SEQ ID NO: 8291149 - DNA, 22 bp, Homo sapiens
aggcactgttcccagttatcct

SEQ ID NO: 8291150 - DNA, 22 bp, Homo sapiens
aggcactgtgggtgtggccgga

SEQ ID NO: 8291151 - DNA, 22 bp, Homo sapiens
aggcactttacaatgtgtgaca

SEQ ID NO: 8291152 - DNA, 22 bp, Homo sapiens
aggcacttggaggtctctgccc

SEQ ID NO: 8291153 - DNA, 22 bp, Homo sapiens
aggcacttaacctactaactga

SEQ ID NO: 8291154 - DNA, 22 bp, Homo sapiens
aggcacttaataaggattcaat

SEQ ID NO: 8291155 - DNA, 22 bp, Homo sapiens
aggcacttgcattgatgaggtc

SEQ ID NO: 8291156 - DNA, 22 bp, Homo sapiens
aggaggctctcaggtcctcccc

SEQ ID NO: 8291157 - DNA, 20 bp, Homo sapiens
agggcacttttgctggagca

SEQ ID NO: 8291158 - DNA, 22 bp, Homo sapiens
agggcactttacccatagcttg

SEQ ID NO: 8291159 - DNA, 19 bp, Homo sapiens
ccagtagagacagctgcag

SEQ ID NO: 8291160 - DNA, 22 bp, Homo sapiens
ctgtgggaaaggatgagattgc

SEQ ID NO: 8291161 - DNA, 22 bp, Homo sapiens
cttcccaccaaagcccttgttg

SEQ ID NO: 8291162 - DNA, 22 bp, Homo sapiens
cttcccactaaagcccttgttg

SEQ ID NO: 8291163 - DNA, 22 bp, Homo sapiens
ctctgggcttcctttgtgggtt

SEQ ID NO: 8291164 - DNA, 17 bp, Homo sapiens
cgggcatggagggcagg

SEQ ID NO: 8291165 - DNA, 22 bp, Homo sapiens
ctacccacaaggctttgggcac

SEQ ID NO: 8291166 - DNA, 22 bp, Homo sapiens
cacaggaatctgcattttgacc

SEQ ID NO: 8291167 - DNA, 22 bp, Homo sapiens
cactttggttcacctgagtttc

SEQ ID NO: 8291168 - DNA, 22 bp, Homo sapiens
cactttggtagctgttttggga

SEQ ID NO: 8291169 - DNA, 22 bp, Homo sapiens
cactttggggtatgacaagttt

SEQ ID NO: 8291170 - DNA, 22 bp, Homo sapiens
cactttgggtttatgtcaatca

SEQ ID NO: 8291171 - DNA, 22 bp, Homo sapiens
cactttggatgccactggtcta

SEQ ID NO: 8291172 - DNA, 22 bp, Homo sapiens
gtcccagagagcactagtccat

SEQ ID NO: 8291173 - DNA, 22 bp, Homo sapiens
ggggagagtcctttccagttcc

SEQ ID NO: 8291174 - DNA, 22 bp, Homo sapiens
gacaattgcttttgccgaataa

SEQ ID NO: 8291175 - DNA, 22 bp, Homo sapiens
gagggcgttcagtcagtgtctc

SEQ ID NO: 8291176 - DNA, 22 bp, Homo sapiens
attgtgaatagtgccgcagtaa

SEQ ID NO: 8291177 - DNA, 22 bp, Homo sapiens
attgtgaattgagagtacttct

SEQ ID NO: 8291178 - DNA, 22 bp, Homo sapiens
gcactaggtaagtgggtggcaa

SEQ ID NO: 8291179 - DNA, 22 bp, Homo sapiens
cccagaataggtaagcccaggg

SEQ ID NO: 8291180 - DNA, 22 bp, Homo sapiens
cccagaattattctcttctcct

SEQ ID NO: 8291181 - DNA, 22 bp, Homo sapiens
cccagaatgattcagcgacagt

SEQ ID NO: 8291182 - DNA, 22 bp, Homo sapiens
cccagaatgttatagtgcccct

SEQ ID NO: 8291183 - DNA, 22 bp, Homo sapiens
cccactttggttgcactctgcc

SEQ ID NO: 8291184 - DNA, 22 bp, Homo sapiens
tgaatgatgtataatattgaga

SEQ ID NO: 8291185 - DNA, 22 bp, Homo sapiens
tctggtggtatacatctaggag

SEQ ID NO: 8291186 - DNA, 22 bp, Homo sapiens
tctttggggcatctgggagatt

SEQ ID NO: 8291187 - DNA, 22 bp, Homo sapiens
tgggagtgttcttggcttgctt

SEQ ID NO: 8291188 - DNA, 19 bp, Homo sapiens
tgggagtggggaaggtcct

SEQ ID NO: 8291189 - DNA, 18 bp, Homo sapiens
tgggagtgggagtggata

SEQ ID NO: 8291190 - DNA, 22 bp, Homo sapiens
tacaaaagtaattacggttttt

SEQ ID NO: 8291191 - DNA, 22 bp, Homo sapiens
tacaaaaggaagagggatctta

SEQ ID NO: 8291192 - DNA, 17 bp, Homo sapiens
ctctttataaagagtta

SEQ ID NO: 8291193 - DNA, 22 bp, Homo sapiens
tttgggcaaaggtagaaggaga

SEQ ID NO: 8291194 - DNA, 21 bp, Homo sapiens
tttgggcaaaattaaatgaga

SEQ ID NO: 8291195 - DNA, 22 bp, Homo sapiens
tttgggcaaggtccagattcct

SEQ ID NO: 8291196 - DNA, 22 bp, Homo sapiens
tttgggcaagctcactgattca

SEQ ID NO: 8291197 - DNA, 20 bp, Homo sapiens
tttgggcacggctagatttt

SEQ ID NO: 8291198 - DNA, 22 bp, Homo sapiens
tttgggcacagatattaagtat

SEQ ID NO: 8291199 - DNA, 22 bp, Homo sapiens
tttgggcacacaaatattttat

SEQ ID NO: 8291200 - DNA, 22 bp, Homo sapiens
tttgggcaattcagtgggacct

SEQ ID NO: 8291201 - DNA, 22 bp, Homo sapiens
tttgggcagaaacatgcgcccc

SEQ ID NO: 8291202 - DNA, 22 bp, Homo sapiens
tttgggcagaagctgaatgtct

SEQ ID NO: 8291203 - DNA, 22 bp, Homo sapiens
tggggcagtggcttttcaccct

SEQ ID NO: 8291204 - DNA, 22 bp, Homo sapiens
tgggggaactgttgcgcgcggg

SEQ ID NO: 8291205 - DNA, 21 bp, Homo sapiens
tgggggagaattggttgcttt

SEQ ID NO: 8291206 - DNA, 22 bp, Homo sapiens
gaggcactgagagtgggggatg

SEQ ID NO: 8291207 - DNA, 22 bp, Homo sapiens
cttgtccccagcaggttggttt

SEQ ID NO: 8291208 - DNA, 22 bp, Homo sapiens
ggggtgggcgtgcagggacacc

SEQ ID NO: 8291209 - DNA, 22 bp, Homo sapiens
ggtgtgggccctgatgtcagca

SEQ ID NO: 8291210 - DNA, 22 bp, Homo sapiens
ggtggctctcaggcttctcgga

SEQ ID NO: 8291211 - DNA, 22 bp, Homo sapiens
gggatggggagctggaaagggg

SEQ ID NO: 8291212 - DNA, 22 bp, Homo sapiens
gggagaggttacccgagcaact

SEQ ID NO: 8291213 - DNA, 22 bp, Homo sapiens
ggcgaggccgggacaggctgga

SEQ ID NO: 8291214 - DNA, 22 bp, Homo sapiens
ggagactcaccccgcattctag

SEQ ID NO: 8291215 - DNA, 22 bp, Homo sapiens
gcttgcagtggttggcatgacc

SEQ ID NO: 8291216 - DNA, 22 bp, Homo sapiens
gctgtgggtaaacgctgagggt

SEQ ID NO: 8291217 - DNA, 22 bp, Homo sapiens
gttgcacactggctataacaag

SEQ ID NO: 8291218 - DNA, 22 bp, Homo sapiens
gttgcacagttcctcaagcagg

SEQ ID NO: 8291219 - DNA, 22 bp, Homo sapiens
gttgcagacactccacagtcga

SEQ ID NO: 8291220 - DNA, 22 bp, Homo sapiens
tcacagaaatctgttttttcta

SEQ ID NO: 8291221 - DNA, 22 bp, Homo sapiens
tcacagaaataagatagttatt

SEQ ID NO: 8291222 - DNA, 22 bp, Homo sapiens
tccccactcaccactggccaaa

SEQ ID NO: 8291223 - DNA, 22 bp, Homo sapiens
tttgcacacattcttagaaatg

SEQ ID NO: 8291224 - DNA, 22 bp, Homo sapiens
tttgcacagcctttctggctgc

SEQ ID NO: 8291225 - DNA, 22 bp, Homo sapiens
tttaattgttgtgggtacatag

SEQ ID NO: 8291226 - DNA, 22 bp, Homo sapiens
ttgtgaatggtgccgcaataaa

SEQ ID NO: 8291227 - DNA, 22 bp, Homo sapiens
ttgtgaatagtgccgcaataaa

SEQ ID NO: 8291228 - DNA, 22 bp, Homo sapiens
ttgtgaatagtgccgctataaa

SEQ ID NO: 8291229 - DNA, 22 bp, Homo sapiens
ttggtgggcacaggggagaagt

SEQ ID NO: 8291230 - DNA, 22 bp, Homo sapiens
tgttcacaacgtgcaggtttgt

SEQ ID NO: 8291231 - DNA, 22 bp, Homo sapiens
tgtggggaggctgcagtgctgc

SEQ ID NO: 8291232 - DNA, 22 bp, Homo sapiens
tgtggagatgtgagcaagggga

SEQ ID NO: 8291233 - DNA, 22 bp, Homo sapiens
tgtggatgagggagtgaacaaa

SEQ ID NO: 8291234 - DNA, 22 bp, Homo sapiens
attcaagattaattctatgtca

SEQ ID NO: 8291235 - DNA, 22 bp, Homo sapiens
attcataacggcaaatgtcacc

SEQ ID NO: 8291236 - DNA, 22 bp, Homo sapiens
attcaacatattctgagtaaaa

SEQ ID NO: 8291237 - DNA, 22 bp, Homo sapiens
attacaatcgagagaaacaaat

SEQ ID NO: 8291238 - DNA, 22 bp, Homo sapiens
attgtctgaatccaaagctctg

SEQ ID NO: 8291239 - DNA, 22 bp, Homo sapiens
gccaagagaatgtgagagaaat

SEQ ID NO: 8291240 - DNA, 22 bp, Homo sapiens
attcttggcaaggagatttaaa

SEQ ID NO: 8291241 - DNA, 22 bp, Homo sapiens
caaaattgttgatgctgctttg

SEQ ID NO: 8291242 - DNA, 22 bp, Homo sapiens
caaaattgatgaatgtatgatt

SEQ ID NO: 8291243 - DNA, 22 bp, Homo sapiens
caaaattgatgaatgtatgatt

SEQ ID NO: 8291244 - DNA, 22 bp, Homo sapiens
caaaatgttctggcacctttaa

SEQ ID NO: 8291245 - DNA, 22 bp, Homo sapiens
caaaatgtgagtcccacctcaa

SEQ ID NO: 8291246 - DNA, 22 bp, Homo sapiens
caaatactaaacataagatttt

SEQ ID NO: 8291247 - DNA, 22 bp, Homo sapiens
caaatactgggtaagttaattt

SEQ ID NO: 8291248 - DNA, 22 bp, Homo sapiens
caaatgctggccctgctactta

SEQ ID NO: 8291249 - DNA, 22 bp, Homo sapiens
caaatgcatgagaaataagagg

SEQ ID NO: 8291250 - DNA, 22 bp, Homo sapiens
caaatgcatagtttataagaag

SEQ ID NO: 8291251 - DNA, 22 bp, Homo sapiens
caaatgcatagaaagatgaaac

SEQ ID NO: 8291252 - DNA, 22 bp, Homo sapiens
atttctgataaacgtaagctgc

SEQ ID NO: 8291253 - DNA, 22 bp, Homo sapiens
atgtgaaagaggtgttcagtgg

SEQ ID NO: 8291254 - DNA, 22 bp, Homo sapiens
atgtgacaatatttggtcttat

SEQ ID NO: 8291255 - DNA, 22 bp, Homo sapiens
atgtgaaatattaagccgagga

SEQ ID NO: 8291256 - DNA, 22 bp, Homo sapiens
atgtgaaatagctggatatgaa

SEQ ID NO: 8291257 - DNA, 21 bp, Homo sapiens
atgtgaaatatcatcagagca

SEQ ID NO: 8291258 - DNA, 22 bp, Homo sapiens
atgtagcagatatttgtgcaca

SEQ ID NO: 8291259 - DNA, 22 bp, Homo sapiens
atgtagcatgaggcactgtgcc

SEQ ID NO: 8291260 - DNA, 22 bp, Homo sapiens
atgtagcagaagatgttttcct

SEQ ID NO: 8291261 - DNA, 22 bp, Homo sapiens
atgtctaaaagataaagtttaa

SEQ ID NO: 8291262 - DNA, 22 bp, Homo sapiens
gatacaaattcatgtctgaatt

SEQ ID NO: 8291263 - DNA, 22 bp, Homo sapiens
atgttgtagcatatgaaatata

SEQ ID NO: 8291264 - DNA, 22 bp, Homo sapiens
atggtgtagcatgtgatatgac

SEQ ID NO: 8291265 - DNA, 22 bp, Homo sapiens
gacactaaagtatagggtatct

SEQ ID NO: 8291266 - DNA, 22 bp, Homo sapiens
gacatttcaatctcattatggg

SEQ ID NO: 8291267 - DNA, 22 bp, Homo sapiens
atgcacagacccaaaggccatc

SEQ ID NO: 8291268 - DNA, 22 bp, Homo sapiens
atgcacagcagtgagttcagtg

SEQ ID NO: 8291269 - DNA, 22 bp, Homo sapiens
gaacaaattctcatcaacttgt

SEQ ID NO: 8291270 - DNA, 22 bp, Homo sapiens
gacaataaagtgatacatggga

SEQ ID NO: 8291271 - DNA, 22 bp, Homo sapiens
gaatacaaacttaaggctttac

SEQ ID NO: 8291272 - DNA, 22 bp, Homo sapiens
atgaaacagtgaattagtcaag

SEQ ID NO: 8291273 - DNA, 22 bp, Homo sapiens
atgaaacagtgtgtatagcaaa

SEQ ID NO: 8291274 - DNA, 23 bp, Homo sapiens
atgaacattagtttcagatattg

SEQ ID NO: 8291275 - DNA, 22 bp, Homo sapiens
gaaacattcagtcaacagtgtt

SEQ ID NO: 8291276 - DNA, 20 bp, Homo sapiens
gaaacattggcagcaactga

SEQ ID NO: 8291277 - DNA, 19 bp, Homo sapiens
gaaagtcatagagcttgtc

SEQ ID NO: 8291278 - DNA, 18 bp, Homo sapiens
atgatcttagcaaatatt

SEQ ID NO: 8291279 - DNA, 22 bp, Homo sapiens
gaaatagaggacagctggatca

SEQ ID NO: 8291280 - DNA, 22 bp, Homo sapiens
gaaatagatctctgggatgcaa

SEQ ID NO: 8291281 - DNA, 22 bp, Homo sapiens
cagaggtacaagctaagttggg

SEQ ID NO: 8291282 - DNA, 22 bp, Homo sapiens
ggtcacaggggagaagagtgat

SEQ ID NO: 8291283 - DNA, 22 bp, Homo sapiens
cagaggtaccagcagcctctgg

SEQ ID NO: 8291284 - DNA, 22 bp, Homo sapiens
cagaaataaagtggacagagta

SEQ ID NO: 8291285 - DNA, 22 bp, Homo sapiens
cagaaataaacttctcacatcg

SEQ ID NO: 8291286 - DNA, 22 bp, Homo sapiens
ggcaggcaggagctctgtctcc

SEQ ID NO: 8291287 - DNA, 22 bp, Homo sapiens
ggcaggcaggagcgtgcttggg

SEQ ID NO: 8291288 - DNA, 20 bp, Homo sapiens
ggcaggcaggaggtttccag

SEQ ID NO: 8291289 - DNA, 22 bp, Homo sapiens
ggcaggcaggtcttcatggccc

SEQ ID NO: 8291290 - DNA, 22 bp, Homo sapiens
ggcaggcatcatcagttgatca

SEQ ID NO: 8291291 - DNA, 22 bp, Homo sapiens
ggcaggcagtgtggtgtgaaac

SEQ ID NO: 8291292 - DNA, 22 bp, Homo sapiens
ggcaggcatggggtctgccatt

SEQ ID NO: 8291293 - DNA, 22 bp, Homo sapiens
ggcaggcatcatgtggtcatta

SEQ ID NO: 8291294 - DNA, 22 bp, Homo sapiens
ggcaggcatggccactccctag

SEQ ID NO: 8291295 - DNA, 22 bp, Homo sapiens
cacatttagaggttagcatggt

SEQ ID NO: 8291296 - DNA, 22 bp, Homo sapiens
cacataagtgggttccattgca

SEQ ID NO: 8291297 - DNA, 22 bp, Homo sapiens
ggccaagatggaaggagagatg

SEQ ID NO: 8291298 - DNA, 22 bp, Homo sapiens
cacgagaacctctcatttgatt

SEQ ID NO: 8291299 - DNA, 22 bp, Homo sapiens
cacagaattaagggagaaatat

SEQ ID NO: 8291300 - DNA, 22 bp, Homo sapiens
cacagaatctgtgactccaaga

SEQ ID NO: 8291301 - DNA, 22 bp, Homo sapiens
cacagaataaattggtatcaga

SEQ ID NO: 8291302 - DNA, 22 bp, Homo sapiens
caatgtgtgtgtttttctcaac

SEQ ID NO: 8291303 - DNA, 22 bp, Homo sapiens
caatgtgtgcttacaggccagt

SEQ ID NO: 8291304 - DNA, 22 bp, Homo sapiens
caatgtgtcaggaaaagggcca

SEQ ID NO: 8291305 - DNA, 22 bp, Homo sapiens
caatgtgtttgcatattaaaat

SEQ ID NO: 8291306 - DNA, 22 bp, Homo sapiens
caagtttacaatgtgtatgtgt

SEQ ID NO: 8291307 - DNA, 22 bp, Homo sapiens
caagtaaagaatcacatttctt

SEQ ID NO: 8291308 - DNA, 22 bp, Homo sapiens
caagtaaagaatcacatttctt

SEQ ID NO: 8291309 - DNA, 22 bp, Homo sapiens
caaatgtggtttctcagcattc

SEQ ID NO: 8291310 - DNA, 22 bp, Homo sapiens
caaatgtgtaaggaagtgttag

SEQ ID NO: 8291311 - DNA, 22 bp, Homo sapiens
caaatgtgacttttgggcttct

SEQ ID NO: 8291312 - DNA, 22 bp, Homo sapiens
ctagaaatattttacagtcaag

SEQ ID NO: 8291313 - DNA, 22 bp, Homo sapiens
ctagaaatgctcaagagaaagt

SEQ ID NO: 8291314 - DNA, 22 bp, Homo sapiens
agtatgtagtgcaatcagtcag

SEQ ID NO: 8291315 - DNA, 22 bp, Homo sapiens
agtatgtattttatacttacag

SEQ ID NO: 8291316 - DNA, 22 bp, Homo sapiens
agtatgtcagagtgaaaatggt

SEQ ID NO: 8291317 - DNA, 22 bp, Homo sapiens
agtatttagagacacaagatgg

SEQ ID NO: 8291318 - DNA, 22 bp, Homo sapiens
aggtacagcaatataagaggtc

SEQ ID NO: 8291319 - DNA, 22 bp, Homo sapiens
aggtacagggtgaaagtttatg

SEQ ID NO: 8291320 - DNA, 22 bp, Homo sapiens
ctgaaaggtataaataagactt

SEQ ID NO: 8291321 - DNA, 22 bp, Homo sapiens
ctgaaagggttacatagtaagt

SEQ ID NO: 8291322 - DNA, 22 bp, Homo sapiens
agttatataactatctagatgc

SEQ ID NO: 8291323 - DNA, 22 bp, Homo sapiens
ctgacttgcctaggtcattgtg

SEQ ID NO: 8291324 - DNA, 20 bp, Homo sapiens
cttagaaatttttaccctgg

SEQ ID NO: 8291325 - DNA, 22 bp, Homo sapiens
cttagaaattgttactcattca

SEQ ID NO: 8291326 - DNA, 22 bp, Homo sapiens
atccagtttatgtcatattctt

SEQ ID NO: 8291327 - DNA, 22 bp, Homo sapiens
atccagttctcagtgcttacag

SEQ ID NO: 8291328 - DNA, 22 bp, Homo sapiens
atcaacatactgctcaggcatt

SEQ ID NO: 8291329 - DNA, 22 bp, Homo sapiens
atcaacatgaatttctctgaag

SEQ ID NO: 8291330 - DNA, 22 bp, Homo sapiens
atcacattgccagtgattaccc

SEQ ID NO: 8291331 - DNA, 22 bp, Homo sapiens
atcagaaactcttagagcaggg

SEQ ID NO: 8291332 - DNA, 23 bp, Homo sapiens
atcaaactggtgagaatgtcagt

SEQ ID NO: 8291333 - DNA, 23 bp, Homo sapiens
atcaaaggatgtagagaagaagc

SEQ ID NO: 8291334 - DNA, 20 bp, Homo sapiens
atcaaaggctgattcagtcc

SEQ ID NO: 8291335 - DNA, 22 bp, Homo sapiens
atcaaagtaggcatatgttttt

SEQ ID NO: 8291336 - DNA, 23 bp, Homo sapiens
atcaaagtggaaatcaattatct

SEQ ID NO: 8291337 - DNA, 22 bp, Homo sapiens
atcaaagtggaagtttactagg

SEQ ID NO: 8291338 - DNA, 22 bp, Homo sapiens
atattgaaccctacagactgta

SEQ ID NO: 8291339 - DNA, 22 bp, Homo sapiens
atattgtactagggttacatgt

SEQ ID NO: 8291340 - DNA, 22 bp, Homo sapiens
atatttaaacagggtaccaata

SEQ ID NO: 8291341 - DNA, 22 bp, Homo sapiens
atatgcacactctgcccacaga

SEQ ID NO: 8291342 - DNA, 22 bp, Homo sapiens
atatgcacatacatacataggt

SEQ ID NO: 8291343 - DNA, 22 bp, Homo sapiens
atatgcataccctcaccaacta

SEQ ID NO: 8291344 - DNA, 22 bp, Homo sapiens
atatgccattagctagaaataa

SEQ ID NO: 8291345 - DNA, 22 bp, Homo sapiens
ctgcagagacctaggtcaggtt

SEQ ID NO: 8291346 - DNA, 22 bp, Homo sapiens
ctgcaagattggaagatgcaat

SEQ ID NO: 8291347 - DNA, 22 bp, Homo sapiens
agttatattccatagattcaga

SEQ ID NO: 8291348 - DNA, 22 bp, Homo sapiens
agttatcaggtgttttcatgga

SEQ ID NO: 8291349 - DNA, 22 bp, Homo sapiens
agttatattccatagattcaga

SEQ ID NO: 8291350 - DNA, 22 bp, Homo sapiens
ataagaaacattattctttcca

SEQ ID NO: 8291351 - DNA, 22 bp, Homo sapiens
ataacagatgtgaagtgctaat

SEQ ID NO: 8291352 - DNA, 22 bp, Homo sapiens
ataacagatactctctgtgagg

SEQ ID NO: 8291353 - DNA, 22 bp, Homo sapiens
ataacagatactctctgtgagg

SEQ ID NO: 8291354 - DNA, 22 bp, Homo sapiens
ataacagagttgggaagtgaaa

SEQ ID NO: 8291355 - DNA, 22 bp, Homo sapiens
atacatagctgaaaacttgtag

SEQ ID NO: 8291356 - DNA, 22 bp, Homo sapiens
atacatacatgtacacataaat

SEQ ID NO: 8291357 - DNA, 22 bp, Homo sapiens
atacagtattacctgttcagga

SEQ ID NO: 8291358 - DNA, 22 bp, Homo sapiens
ataccttttagacatgtagttg

SEQ ID NO: 8291359 - DNA, 22 bp, Homo sapiens
atacattgagttttgatgttct

SEQ ID NO: 8291360 - DNA, 17 bp, Homo sapiens
atacattgttaaagtat

SEQ ID NO: 8291361 - DNA, 22 bp, Homo sapiens
atacataggagaataacttcag

SEQ ID NO: 8291362 - DNA, 22 bp, Homo sapiens
ctgctgcattactcttctcaag

SEQ ID NO: 8291363 - DNA, 22 bp, Homo sapiens
ctgctgcattcctctttatgag

SEQ ID NO: 8291364 - DNA, 22 bp, Homo sapiens
ctggaagagcatttgcataggg

SEQ ID NO: 8291365 - DNA, 22 bp, Homo sapiens
ctggagagaaatgacaaagcta

SEQ ID NO: 8291366 - DNA, 22 bp, Homo sapiens
atactagactgttctgttatca

SEQ ID NO: 8291367 - DNA, 22 bp, Homo sapiens
ccagaggtgctgggagaggtct

SEQ ID NO: 8291368 - DNA, 22 bp, Homo sapiens
catacatatgcatgtgtgtata

SEQ ID NO: 8291369 - DNA, 22 bp, Homo sapiens
cataagaatattccatcctttg

SEQ ID NO: 8291370 - DNA, 22 bp, Homo sapiens
cataagaaggtaacatccttaa

SEQ ID NO: 8291371 - DNA, 19 bp, Homo sapiens
cataatacagtggatctga

SEQ ID NO: 8291372 - DNA, 22 bp, Homo sapiens
cataactagagtgaaatgttga

SEQ ID NO: 8291373 - DNA, 22 bp, Homo sapiens
cataagaaatttaacagaactt

SEQ ID NO: 8291374 - DNA, 22 bp, Homo sapiens
cataagaaataatgatgatgac

SEQ ID NO: 8291375 - DNA, 22 bp, Homo sapiens
cataagaaataatgatgatgac

SEQ ID NO: 8291376 - DNA, 22 bp, Homo sapiens
cataagaaatttaacagaactt

SEQ ID NO: 8291377 - DNA, 22 bp, Homo sapiens
aggagctgtgaatgggaggggt

SEQ ID NO: 8291378 - DNA, 22 bp, Homo sapiens
cagtgtgctatctggaagtctc

SEQ ID NO: 8291379 - DNA, 22 bp, Homo sapiens
catttacatttaaggttaatat

SEQ ID NO: 8291380 - DNA, 22 bp, Homo sapiens
catttactgttgaatccctagc

SEQ ID NO: 8291381 - DNA, 22 bp, Homo sapiens
catttctgattacagaatacta

SEQ ID NO: 8291382 - DNA, 22 bp, Homo sapiens
cattgctgttaattgtctctag

SEQ ID NO: 8291383 - DNA, 22 bp, Homo sapiens
cattgctgtgggcatttgctgc

SEQ ID NO: 8291384 - DNA, 23 bp, Homo sapiens
catttctgggagatttataaaat

SEQ ID NO: 8291385 - DNA, 22 bp, Homo sapiens
catttctgcagaattgctcttc

SEQ ID NO: 8291386 - DNA, 22 bp, Homo sapiens
catttctgggagacatgctaga

SEQ ID NO: 8291387 - DNA, 22 bp, Homo sapiens
catttctgtacatgttttggtg

SEQ ID NO: 8291388 - DNA, 22 bp, Homo sapiens
catttctgtgacacttccatct

SEQ ID NO: 8291389 - DNA, 22 bp, Homo sapiens
catttctgtcacgttcttttat

SEQ ID NO: 8291390 - DNA, 22 bp, Homo sapiens
catttctgttctcttcctgtac

SEQ ID NO: 8291391 - DNA, 22 bp, Homo sapiens
caggcagggagctggaaaggat

SEQ ID NO: 8291392 - DNA, 22 bp, Homo sapiens
agctggttcattcattcatggt

SEQ ID NO: 8291393 - DNA, 22 bp, Homo sapiens
cagtatttatggcttgagtatt

SEQ ID NO: 8291394 - DNA, 22 bp, Homo sapiens
cagtatgtttgggagacatgac

SEQ ID NO: 8291395 - DNA, 22 bp, Homo sapiens
cagtatgtactcttatcatgta

SEQ ID NO: 8291396 - DNA, 22 bp, Homo sapiens
cagtatgtctactggacaaagt

SEQ ID NO: 8291397 - DNA, 22 bp, Homo sapiens
cagtaaatataggaacgtggaa

SEQ ID NO: 8291398 - DNA, 22 bp, Homo sapiens
accactgcccatggtgaaaact

SEQ ID NO: 8291399 - DNA, 22 bp, Homo sapiens
acatttctcagggagttttgct

SEQ ID NO: 8291400 - DNA, 22 bp, Homo sapiens
acatttctcctacttgttattt

SEQ ID NO: 8291401 - DNA, 22 bp, Homo sapiens
acatttctcattctcccctaac

SEQ ID NO: 8291402 - DNA, 22 bp, Homo sapiens
acatttctccctgcatgcctgc

SEQ ID NO: 8291403 - DNA, 22 bp, Homo sapiens
acatttctcaggtaagtcattt

SEQ ID NO: 8291404 - DNA, 22 bp, Homo sapiens
acatttctcataggagagccac

SEQ ID NO: 8291405 - DNA, 22 bp, Homo sapiens
acatttctcatctagtagagta

SEQ ID NO: 8291406 - DNA, 22 bp, Homo sapiens
acatttctccttgcaggagtca

SEQ ID NO: 8291407 - DNA, 18 bp, Homo sapiens
acatttctccttctgacc

SEQ ID NO: 8291408 - DNA, 18 bp, Homo sapiens
acatttctctctgcgtga

SEQ ID NO: 8291409 - DNA, 22 bp, Homo sapiens
acatgtattgacattatattct

SEQ ID NO: 8291410 - DNA, 22 bp, Homo sapiens
acatgtaggagagtcacaatgc

SEQ ID NO: 8291411 - DNA, 22 bp, Homo sapiens
acagtgagcggtagtgattgct

SEQ ID NO: 8291412 - DNA, 21 bp, Homo sapiens
acagtgagaaataaatggaaa

SEQ ID NO: 8291413 - DNA, 22 bp, Homo sapiens
aggcagtgtattgctagcggct

SEQ ID NO: 8291414 - DNA, 22 bp, Homo sapiens
agttacaaccatgacacaagca

SEQ ID NO: 8291415 - DNA, 19 bp, Homo sapiens
agtgtgtactgaaagcact

SEQ ID NO: 8291416 - DNA, 22 bp, Homo sapiens
agtaactatgcttgagaatcag

SEQ ID NO: 8291417 - DNA, 23 bp, Homo sapiens
agtaacatgcaaataacagtctg

SEQ ID NO: 8291418 - DNA, 20 bp, Homo sapiens
ataggaaagggaggggcttt

SEQ ID NO: 8291419 - DNA, 22 bp, Homo sapiens
atagaatagcatagaaaattga

SEQ ID NO: 8291420 - DNA, 22 bp, Homo sapiens
atagaatagcatagaaaattga

SEQ ID NO: 8291421 - DNA, 22 bp, Homo sapiens
atagaataaggcacagattctt

SEQ ID NO: 8291422 - DNA, 23 bp, Homo sapiens
actttagataaattatgtgcaca

SEQ ID NO: 8291423 - DNA, 22 bp, Homo sapiens
atacttaactgtggagtcattg

SEQ ID NO: 8291424 - DNA, 23 bp, Homo sapiens
atagaagattattgcaacagtcc

SEQ ID NO: 8291425 - DNA, 22 bp, Homo sapiens
atagaacagaaacagatgcaca

SEQ ID NO: 8291426 - DNA, 22 bp, Homo sapiens
atacaatgaagtatagatgaaa

SEQ ID NO: 8291427 - DNA, 22 bp, Homo sapiens
atacaatgataatagtacttta

SEQ ID NO: 8291428 - DNA, 22 bp, Homo sapiens
atacaatgagtgagtgaatggg

SEQ ID NO: 8291429 - DNA, 22 bp, Homo sapiens
atacacagcgatgagaggaggc

SEQ ID NO: 8291430 - DNA, 22 bp, Homo sapiens
atacaagttgtgataatgtaaa

SEQ ID NO: 8291431 - DNA, 22 bp, Homo sapiens
atacaagttgtgataatgtaaa

SEQ ID NO: 8291432 - DNA, 22 bp, Homo sapiens
atacaagttgtgataatgtaaa

SEQ ID NO: 8291433 - DNA, 22 bp, Homo sapiens
atacaaagacaaatctcaatct

SEQ ID NO: 8291434 - DNA, 20 bp, Homo sapiens
atacaaagagattgatgtat

SEQ ID NO: 8291435 - DNA, 22 bp, Homo sapiens
ataaggtatgaaaagtaaatgg

SEQ ID NO: 8291436 - DNA, 22 bp, Homo sapiens
ataacagagagctactgaactg

SEQ ID NO: 8291437 - DNA, 22 bp, Homo sapiens
agttcacattccgaggtactgg

SEQ ID NO: 8291438 - DNA, 22 bp, Homo sapiens
agttcacagaatggccagaact

SEQ ID NO: 8291439 - DNA, 22 bp, Homo sapiens
agttcactgcttaagcctttga

SEQ ID NO: 8291440 - DNA, 23 bp, Homo sapiens
agttcactgaggttgaccactgg

SEQ ID NO: 8291441 - DNA, 22 bp, Homo sapiens
agttgcagacgcagagatgttg

SEQ ID NO: 8291442 - DNA, 22 bp, Homo sapiens
agaaatgtggatcgttttaaaa

SEQ ID NO: 8291443 - DNA, 22 bp, Homo sapiens
agaaatgttacagttgttattt

SEQ ID NO: 8291444 - DNA, 22 bp, Homo sapiens
agaaatgttgaatacacaaaat

SEQ ID NO: 8291445 - DNA, 22 bp, Homo sapiens
agaaatgtgaatttcatttcct

SEQ ID NO: 8291446 - DNA, 22 bp, Homo sapiens
agaaatgtggaggaacagggct

SEQ ID NO: 8291447 - DNA, 22 bp, Homo sapiens
agaaatgtggaggaacagggct

SEQ ID NO: 8291448 - DNA, 22 bp, Homo sapiens
agaaatgtgagccccttatcaa

SEQ ID NO: 8291449 - DNA, 22 bp, Homo sapiens
agaaatgtgaatttcatttcct

SEQ ID NO: 8291450 - DNA, 20 bp, Homo sapiens
agaaatgtgaaaggctgagt

SEQ ID NO: 8291451 - DNA, 22 bp, Homo sapiens
agaaatgtattctgtatgtttt

SEQ ID NO: 8291452 - DNA, 22 bp, Homo sapiens
agaaatgtattctgtatgtttt

SEQ ID NO: 8291453 - DNA, 22 bp, Homo sapiens
agaaatgtatagtgaatttttc

SEQ ID NO: 8291454 - DNA, 21 bp, Homo sapiens
agaaatgtatcattcttttcc

SEQ ID NO: 8291455 - DNA, 22 bp, Homo sapiens
agaaatgtcaggaaagaagtcc

SEQ ID NO: 8291456 - DNA, 22 bp, Homo sapiens
agaaatgtacgatgttatgcag

SEQ ID NO: 8291457 - DNA, 22 bp, Homo sapiens
agaaatgtatagtgaatttttc

SEQ ID NO: 8291458 - DNA, 22 bp, Homo sapiens
agaaatgtaattgcaactgtct

SEQ ID NO: 8291459 - DNA, 22 bp, Homo sapiens
agaaatgttgtgggttttgtta

SEQ ID NO: 8291460 - DNA, 22 bp, Homo sapiens
agaaatgttgaatacatcagga

SEQ ID NO: 8291461 - DNA, 22 bp, Homo sapiens
agaaatgtttatggctgcctat

SEQ ID NO: 8291462 - DNA, 22 bp, Homo sapiens
agaaagaacgcacttgtgctgc

SEQ ID NO: 8291463 - DNA, 22 bp, Homo sapiens
agaaagaacgttggttatctta

SEQ ID NO: 8291464 - DNA, 22 bp, Homo sapiens
atattaatgagcaagtaagtga

SEQ ID NO: 8291465 - DNA, 22 bp, Homo sapiens
agaaatcagaaccctgaagttc

SEQ ID NO: 8291466 - DNA, 22 bp, Homo sapiens
agaaatcacaggaggcagaagg

SEQ ID NO: 8291467 - DNA, 22 bp, Homo sapiens
agaaatatgctgattagatgaa

SEQ ID NO: 8291468 - DNA, 22 bp, Homo sapiens
agaaatcaatatctatatgttg

SEQ ID NO: 8291469 - DNA, 22 bp, Homo sapiens
atattaattatttacacatgag

SEQ ID NO: 8291470 - DNA, 22 bp, Homo sapiens
agaaatgcattagcacatatag

SEQ ID NO: 8291471 - DNA, 22 bp, Homo sapiens
agaaatgctcttcctgaccaga

SEQ ID NO: 8291472 - DNA, 22 bp, Homo sapiens
atcaattcttaggaaaatagct

SEQ ID NO: 8291473 - DNA, 22 bp, Homo sapiens
agcatttagttagtaaatgttt

SEQ ID NO: 8291474 - DNA, 22 bp, Homo sapiens
agcatttaggagaatttgagaa

SEQ ID NO: 8291475 - DNA, 22 bp, Homo sapiens
agcatttatgactaatgtaaaa

SEQ ID NO: 8291476 - DNA, 22 bp, Homo sapiens
agcatttatttcttagaaattg

SEQ ID NO: 8291477 - DNA, 22 bp, Homo sapiens
agcatttatttcttagaaattg

SEQ ID NO: 8291478 - DNA, 22 bp, Homo sapiens
cacattgaacttgtctggtggg

SEQ ID NO: 8291479 - DNA, 22 bp, Homo sapiens
cacatttaaaggttgaagctga

SEQ ID NO: 8291480 - DNA, 22 bp, Homo sapiens
cacagaaaaaggcttgaaaatc

SEQ ID NO: 8291481 - DNA, 22 bp, Homo sapiens
caagtcattactgaaatgtcac

SEQ ID NO: 8291482 - DNA, 22 bp, Homo sapiens
agcaattttcccttagtctttg

SEQ ID NO: 8291483 - DNA, 22 bp, Homo sapiens
cagcccagagatgttatctagt

SEQ ID NO: 8291484 - DNA, 22 bp, Homo sapiens
atgattgaaaatgacattgcca

SEQ ID NO: 8291485 - DNA, 22 bp, Homo sapiens
atgattgaaaatgacattgcca

SEQ ID NO: 8291486 - DNA, 22 bp, Homo sapiens
atcttaaacagaggaatgactt

SEQ ID NO: 8291487 - DNA, 22 bp, Homo sapiens
atgacccctaaaatttactgtc

SEQ ID NO: 8291488 - DNA, 22 bp, Homo sapiens
atgctgcacaagccacatgtag

SEQ ID NO: 8291489 - DNA, 22 bp, Homo sapiens
agacatatattgcaattcactg

SEQ ID NO: 8291490 - DNA, 22 bp, Homo sapiens
agagaacaaattaaaggtggtt

SEQ ID NO: 8291491 - DNA, 22 bp, Homo sapiens
agagaacacgtgcatctgcaat

SEQ ID NO: 8291492 - DNA, 22 bp, Homo sapiens
agagaacagacagatgcaatga

SEQ ID NO: 8291493 - DNA, 22 bp, Homo sapiens
agacataagcgagcatcacagg

SEQ ID NO: 8291494 - DNA, 22 bp, Homo sapiens
agacataagtgctatgacattg

SEQ ID NO: 8291495 - DNA, 22 bp, Homo sapiens
agacataagtgctatgacattg

SEQ ID NO: 8291496 - DNA, 22 bp, Homo sapiens
atgtgcattaaatgtcaatgtt

SEQ ID NO: 8291497 - DNA, 22 bp, Homo sapiens
atgtgcatgcacttacatgtgt

SEQ ID NO: 8291498 - DNA, 21 bp, Homo sapiens
agagactgtcactgcagtacc

SEQ ID NO: 8291499 - DNA, 17 bp, Homo sapiens
atgtatattaactctga

SEQ ID NO: 8291500 - DNA, 22 bp, Homo sapiens
atgtatatgaagctagtatttt

SEQ ID NO: 8291501 - DNA, 22 bp, Homo sapiens
atgtagtatttggaaatgtaaa

SEQ ID NO: 8291502 - DNA, 22 bp, Homo sapiens
atgtataatgctaattagctag

SEQ ID NO: 8291503 - DNA, 22 bp, Homo sapiens
atgtagtgtagagattagtctc

SEQ ID NO: 8291504 - DNA, 22 bp, Homo sapiens
caaaggtagtatatatattgtt

SEQ ID NO: 8291505 - DNA, 22 bp, Homo sapiens
caaaggtataagttaatataca

SEQ ID NO: 8291506 - DNA, 22 bp, Homo sapiens
caaaggtaaagatctgctgtgg

SEQ ID NO: 8291507 - DNA, 22 bp, Homo sapiens
caaagtttggctctcatgacat

SEQ ID NO: 8291508 - DNA, 22 bp, Homo sapiens
caaagttatcaactgcaacatt

SEQ ID NO: 8291509 - DNA, 22 bp, Homo sapiens
caaagttatgaatgataagatt

SEQ ID NO: 8291510 - DNA, 22 bp, Homo sapiens
caaagtttaaagtagatttcag

SEQ ID NO: 8291511 - DNA, 19 bp, Homo sapiens
atttgaaagctgtgcttgc

SEQ ID NO: 8291512 - DNA, 22 bp, Homo sapiens
atttacagatgatgctatttga

SEQ ID NO: 8291513 - DNA, 22 bp, Homo sapiens
agatttagactgccttaatcat

SEQ ID NO: 8291514 - DNA, 22 bp, Homo sapiens
agatttagtggtggaattttgg

SEQ ID NO: 8291515 - DNA, 21 bp, Homo sapiens
agattgtatggaggtgagagg

SEQ ID NO: 8291516 - DNA, 22 bp, Homo sapiens
agattgtagaaactgtagcatt

SEQ ID NO: 8291517 - DNA, 22 bp, Homo sapiens
agattggatcaagcagcagttg

SEQ ID NO: 8291518 - DNA, 22 bp, Homo sapiens
agataaattcctaagatttcag

SEQ ID NO: 8291519 - DNA, 22 bp, Homo sapiens
agataattatttacttcaaagt

SEQ ID NO: 8291520 - DNA, 22 bp, Homo sapiens
agataatttgagtaaattaatt

SEQ ID NO: 8291521 - DNA, 22 bp, Homo sapiens
attgagaatccatttgagatga

SEQ ID NO: 8291522 - DNA, 22 bp, Homo sapiens
attgtatgcagcattaagcaat

SEQ ID NO: 8291523 - DNA, 22 bp, Homo sapiens
attgtatcttgtcattatgcat

SEQ ID NO: 8291524 - DNA, 22 bp, Homo sapiens
aaagcagtatattggtagttgt

SEQ ID NO: 8291525 - DNA, 22 bp, Homo sapiens
aacatgaaagttgctaagtgca

SEQ ID NO: 8291526 - DNA, 22 bp, Homo sapiens
aacatgaaggtaggatggtttt

SEQ ID NO: 8291527 - DNA, 22 bp, Homo sapiens
aaagcatttcatgtctagaaag

SEQ ID NO: 8291528 - DNA, 20 bp, Homo sapiens
aaagtcttatggttaatttt

SEQ ID NO: 8291529 - DNA, 22 bp, Homo sapiens
aaagttctgggggagaagaacg

SEQ ID NO: 8291530 - DNA, 22 bp, Homo sapiens
aaaggctatgagatagaagata

SEQ ID NO: 8291531 - DNA, 22 bp, Homo sapiens
aacatgaagttttctatagtga

SEQ ID NO: 8291532 - DNA, 22 bp, Homo sapiens
aaaggcatgattaattctgtgt

SEQ ID NO: 8291533 - DNA, 23 bp, Homo sapiens
aaagttgatttgcagtttaagag

SEQ ID NO: 8291534 - DNA, 22 bp, Homo sapiens
aaatatagtaaatgcatagttc

SEQ ID NO: 8291535 - DNA, 22 bp, Homo sapiens
aagagttttctataatcttggc

SEQ ID NO: 8291536 - DNA, 22 bp, Homo sapiens
aaatataatttctgcctcaata

SEQ ID NO: 8291537 - DNA, 22 bp, Homo sapiens
aaatattggtaggatgcttgtt

SEQ ID NO: 8291538 - DNA, 22 bp, Homo sapiens
aaatcaaaagacatgtgtttta

SEQ ID NO: 8291539 - DNA, 22 bp, Homo sapiens
aaatcactaagttatagtgtgg

SEQ ID NO: 8291540 - DNA, 23 bp, Homo sapiens
aaatgacatatggtttctgaagg

SEQ ID NO: 8291541 - DNA, 22 bp, Homo sapiens
aaatgaacagttgcattctctg

SEQ ID NO: 8291542 - DNA, 22 bp, Homo sapiens
aaatgaccagaatacaggcttc

SEQ ID NO: 8291543 - DNA, 22 bp, Homo sapiens
aaatgcacaggagaaccaattc

SEQ ID NO: 8291544 - DNA, 22 bp, Homo sapiens
aaatgcacagaggccagagagg

SEQ ID NO: 8291545 - DNA, 22 bp, Homo sapiens
aaatgcatttttaattagaccc

SEQ ID NO: 8291546 - DNA, 22 bp, Homo sapiens
aaatgcacaataaagtaaaggc

SEQ ID NO: 8291547 - DNA, 22 bp, Homo sapiens
aaatgcacacaccaggaaacta

SEQ ID NO: 8291548 - DNA, 22 bp, Homo sapiens
aaatgcacagagccttagagat

SEQ ID NO: 8291549 - DNA, 22 bp, Homo sapiens
aaatgcacagaaaggatgtgga

SEQ ID NO: 8291550 - DNA, 22 bp, Homo sapiens
aaatgcaattgtatgtactcca

SEQ ID NO: 8291551 - DNA, 22 bp, Homo sapiens
aaatgcacaaagtaagtgtaat

SEQ ID NO: 8291552 - DNA, 22 bp, Homo sapiens
aaatgcaacgggctttccttat

SEQ ID NO: 8291553 - DNA, 22 bp, Homo sapiens
aaatgcttgtaaattttccatg

SEQ ID NO: 8291554 - DNA, 22 bp, Homo sapiens
aaatgctgtaactgatattctg

SEQ ID NO: 8291555 - DNA, 22 bp, Homo sapiens
aaatgctgtgttttaacataga

SEQ ID NO: 8291556 - DNA, 22 bp, Homo sapiens
aaatgcttattagtgtcacaaa

SEQ ID NO: 8291557 - DNA, 22 bp, Homo sapiens
aaatgcttagaggtgttcaaat

SEQ ID NO: 8291558 - DNA, 22 bp, Homo sapiens
aaaacagacagccagtgtagag

SEQ ID NO: 8291559 - DNA, 22 bp, Homo sapiens
aaaacagtttttgctaactgct

SEQ ID NO: 8291560 - DNA, 22 bp, Homo sapiens
aaaagaggagtggtttatgaca

SEQ ID NO: 8291561 - DNA, 22 bp, Homo sapiens
aaaacagtttaggcatcacagt

SEQ ID NO: 8291562 - DNA, 22 bp, Homo sapiens
aaaaatgtgaccacagggtgtt

SEQ ID NO: 8291563 - DNA, 22 bp, Homo sapiens
aaaaatgttatctactgtccga

SEQ ID NO: 8291564 - DNA, 22 bp, Homo sapiens
aaaaatgttatctactgtccga

SEQ ID NO: 8291565 - DNA, 22 bp, Homo sapiens
aaaaatgttatctactgtccga

SEQ ID NO: 8291566 - DNA, 22 bp, Homo sapiens
aaaacatgtccatacagaaact

SEQ ID NO: 8291567 - DNA, 22 bp, Homo sapiens
aaaatgctgggaaagttggaat

SEQ ID NO: 8291568 - DNA, 22 bp, Homo sapiens
aaaatgtaaagcttgagtgtag

SEQ ID NO: 8291569 - DNA, 22 bp, Homo sapiens
aaaatggtctcagctggcacca

SEQ ID NO: 8291570 - DNA, 22 bp, Homo sapiens
aaaatgctatttcatggaggag

SEQ ID NO: 8291571 - DNA, 22 bp, Homo sapiens
aaaatgcatgagaatgtgctcg

SEQ ID NO: 8291572 - DNA, 18 bp, Homo sapiens
aaaatgcaggcgacatgg

SEQ ID NO: 8291573 - DNA, 22 bp, Homo sapiens
aaaatgaggtcaatatcctttt

SEQ ID NO: 8291574 - DNA, 22 bp, Homo sapiens
aaaatacacatactaggggaaa

SEQ ID NO: 8291575 - DNA, 22 bp, Homo sapiens
aaaataacttctactatttgca

SEQ ID NO: 8291576 - DNA, 18 bp, Homo sapiens
aaaataacaaagttggct

SEQ ID NO: 8291577 - DNA, 22 bp, Homo sapiens
aaaagtgttcaggaagaataat

SEQ ID NO: 8291578 - DNA, 22 bp, Homo sapiens
aaaagtttaagactcattctag

SEQ ID NO: 8291579 - DNA, 22 bp, Homo sapiens
aaaagttccctggttagaaaag

SEQ ID NO: 8291580 - DNA, 22 bp, Homo sapiens
aaaagttacctctgtaatataa

SEQ ID NO: 8291581 - DNA, 22 bp, Homo sapiens
aaactgtgcttcccaaatgccc

SEQ ID NO: 8291582 - DNA, 22 bp, Homo sapiens
aaatgaactcttcctgcatccc

SEQ ID NO: 8291583 - DNA, 22 bp, Homo sapiens
aaatacagagttgcttaaaagc

SEQ ID NO: 8291584 - DNA, 21 bp, Homo sapiens
aaatacagatgcaaatctgtt

SEQ ID NO: 8291585 - DNA, 22 bp, Homo sapiens
aaatgtctttgagtatttctgc

SEQ ID NO: 8291586 - DNA, 22 bp, Homo sapiens
aaatgtctttcttctgctacgt

SEQ ID NO: 8291587 - DNA, 22 bp, Homo sapiens
aaatgtctttcaatagagaaat

SEQ ID NO: 8291588 - DNA, 22 bp, Homo sapiens
aaagacatcagaaccagctgag

SEQ ID NO: 8291589 - DNA, 22 bp, Homo sapiens
aaagacatatttctaagtttat

SEQ ID NO: 8291590 - DNA, 22 bp, Homo sapiens
aaatgtctttatctcatgtaac

SEQ ID NO: 8291591 - DNA, 22 bp, Homo sapiens
aaatgtctttatctcatgtaac

SEQ ID NO: 8291592 - DNA, 22 bp, Homo sapiens
aaatgtctgttagtcatatcat

SEQ ID NO: 8291593 - DNA, 22 bp, Homo sapiens
aaatgtctgagacttctgaact

SEQ ID NO: 8291594 - DNA, 22 bp, Homo sapiens
aaatggtgtttctaatgctaga

SEQ ID NO: 8291595 - DNA, 22 bp, Homo sapiens
aaaggttaaggtgttcaagaaa

SEQ ID NO: 8291596 - DNA, 22 bp, Homo sapiens
aaagctatgaggcatgcatttc

SEQ ID NO: 8291597 - DNA, 22 bp, Homo sapiens
aaataaactgaagcacagagag

SEQ ID NO: 8291598 - DNA, 22 bp, Homo sapiens
aaagtcattgctgttatcaatg

SEQ ID NO: 8291599 - DNA, 22 bp, Homo sapiens
aaagtcattggaatattaatga

SEQ ID NO: 8291600 - DNA, 22 bp, Homo sapiens
aaagtcattgtaatatatgcta

SEQ ID NO: 8291601 - DNA, 22 bp, Homo sapiens
aaagtcatctaggagcagattt

SEQ ID NO: 8291602 - DNA, 22 bp, Homo sapiens
aaagtcatccaaatttttatgt

SEQ ID NO: 8291603 - DNA, 22 bp, Homo sapiens
aaagtcatcatttcttttcaaa

SEQ ID NO: 8291604 - DNA, 22 bp, Homo sapiens
aaagtcatgatgaaccaccgta

SEQ ID NO: 8291605 - DNA, 22 bp, Homo sapiens
aaagtcatgcagttgaactttt

SEQ ID NO: 8291606 - DNA, 22 bp, Homo sapiens
aaagtcatggaaaatcttggaa

SEQ ID NO: 8291607 - DNA, 22 bp, Homo sapiens
aaagtcatgtaatgatatgatt

SEQ ID NO: 8291608 - DNA, 22 bp, Homo sapiens
aaagtcatcagaaccttccaga

SEQ ID NO: 8291609 - DNA, 22 bp, Homo sapiens
aaagtcatacatggtgcttact

SEQ ID NO: 8291610 - DNA, 22 bp, Homo sapiens
aaggccattattctgatatatt

SEQ ID NO: 8291611 - DNA, 22 bp, Homo sapiens
aaggccatgaccacttgctgtg

SEQ ID NO: 8291612 - DNA, 22 bp, Homo sapiens
aaggccatgcacatcctaggca

SEQ ID NO: 8291613 - DNA, 22 bp, Homo sapiens
aatacagaggggtcacaattca

SEQ ID NO: 8291614 - DNA, 22 bp, Homo sapiens
aagttacaggagaaagagatca

SEQ ID NO: 8291615 - DNA, 22 bp, Homo sapiens
aatacatatggaattccatgtt

SEQ ID NO: 8291616 - DNA, 22 bp, Homo sapiens
aatattgtttcaagatcacaga

SEQ ID NO: 8291617 - DNA, 22 bp, Homo sapiens
aatgcacatgttgtaataaata

SEQ ID NO: 8291618 - DNA, 22 bp, Homo sapiens
aatgcacatgtcttggcctcac

SEQ ID NO: 8291619 - DNA, 22 bp, Homo sapiens
aatgcacatgccacatgtggta

SEQ ID NO: 8291620 - DNA, 22 bp, Homo sapiens
aatgcacatatatgtgtataca

SEQ ID NO: 8291621 - DNA, 22 bp, Homo sapiens
aatgcacataaatatggtctta

SEQ ID NO: 8291622 - DNA, 22 bp, Homo sapiens
aatgcacagctaaagtggttcc

SEQ ID NO: 8291623 - DNA, 22 bp, Homo sapiens
aatgcacagcgttccatgcttg

SEQ ID NO: 8291624 - DNA, 22 bp, Homo sapiens
aatgcacacatttggtactgaa

SEQ ID NO: 8291625 - DNA, 18 bp, Homo sapiens
aatgcacacatttactcc

SEQ ID NO: 8291626 - DNA, 22 bp, Homo sapiens
aatgaacaaaatatgctttgca

SEQ ID NO: 8291627 - DNA, 22 bp, Homo sapiens
aatgaaatgtagcttatccata

SEQ ID NO: 8291628 - DNA, 22 bp, Homo sapiens
aatgaaatgaagatatgatcag

SEQ ID NO: 8291629 - DNA, 18 bp, Homo sapiens
aatgaaatgtacaccttt

SEQ ID NO: 8291630 - DNA, 22 bp, Homo sapiens
aatgtacaaaagtcagccaact

SEQ ID NO: 8291631 - DNA, 22 bp, Homo sapiens
aatgcagtgagccattaaatgg

SEQ ID NO: 8291632 - DNA, 22 bp, Homo sapiens
aatgcagtttcatttgtagaat

SEQ ID NO: 8291633 - DNA, 22 bp, Homo sapiens
aatgcttatacctaatgatctt

SEQ ID NO: 8291634 - DNA, 22 bp, Homo sapiens
aatgcttaattcaatactgtgt

SEQ ID NO: 8291635 - DNA, 22 bp, Homo sapiens
acaaaagtgtaggaattcctta

SEQ ID NO: 8291636 - DNA, 22 bp, Homo sapiens
aagaatcatcctgcaagagtct

SEQ ID NO: 8291637 - DNA, 22 bp, Homo sapiens
aatgtacaagggttccagtttt

SEQ ID NO: 8291638 - DNA, 22 bp, Homo sapiens
aagaacaggttctagaaccatt

SEQ ID NO: 8291639 - DNA, 22 bp, Homo sapiens
aagaacatgttaaaagattcac

SEQ ID NO: 8291640 - DNA, 22 bp, Homo sapiens
aagaacattcgaactattttct

SEQ ID NO: 8291641 - DNA, 22 bp, Homo sapiens
aagaacatttatgatggcattt

SEQ ID NO: 8291642 - DNA, 22 bp, Homo sapiens
aagaacatttatgatggcattt

SEQ ID NO: 8291643 - DNA, 22 bp, Homo sapiens
aagaacattttgtagaatgaca

SEQ ID NO: 8291644 - DNA, 22 bp, Homo sapiens
aagaacattttgtagaatgaca

SEQ ID NO: 8291645 - DNA, 22 bp, Homo sapiens
acaaaaattagctgggcatggt

SEQ ID NO: 8291646 - DNA, 22 bp, Homo sapiens
acaatatagtccatgagcatgc

SEQ ID NO: 8291647 - DNA, 20 bp, Homo sapiens
acaatatgtagatgaatagc

SEQ ID NO: 8291648 - DNA, 22 bp, Homo sapiens
acaatgtaggatatgtacttgt

SEQ ID NO: 8291649 - DNA, 22 bp, Homo sapiens
acaatagagttctcataggaca

SEQ ID NO: 8291650 - DNA, 22 bp, Homo sapiens
aagcccagctgaaagcattttt

SEQ ID NO: 8291651 - DNA, 22 bp, Homo sapiens
aagatacataaaggtagagtct

SEQ ID NO: 8291652 - DNA, 22 bp, Homo sapiens
acacatagaaaataaatagtta

SEQ ID NO: 8291653 - DNA, 21 bp, Homo sapiens
acacttcagtttttaaaggga

SEQ ID NO: 8291654 - DNA, 22 bp, Homo sapiens
acacttcatttacattataggc

SEQ ID NO: 8291655 - DNA, 22 bp, Homo sapiens
acacttctattccctgcacaaa

SEQ ID NO: 8291656 - DNA, 22 bp, Homo sapiens
acacttgataggtcaaatcagt

SEQ ID NO: 8291657 - DNA, 22 bp, Homo sapiens
acagagatgcaagtgtgtattt

SEQ ID NO: 8291658 - DNA, 23 bp, Homo sapiens
acagagatcttgacttgtatgga

SEQ ID NO: 8291659 - DNA, 23 bp, Homo sapiens
acagacattccataatgtacacc

SEQ ID NO: 8291660 - DNA, 22 bp, Homo sapiens
acagacattttctgtattgcct

SEQ ID NO: 8291661 - DNA, 22 bp, Homo sapiens
acagaaataactttttatgttt

SEQ ID NO: 8291662 - DNA, 18 bp, Homo sapiens
acagaaatagctgtgcct

SEQ ID NO: 8291663 - DNA, 22 bp, Homo sapiens
acagaaatatagaaggtaggaa

SEQ ID NO: 8291664 - DNA, 22 bp, Homo sapiens
acagaaatattcgtggtgcttg

SEQ ID NO: 8291665 - DNA, 22 bp, Homo sapiens
aatttgcatgatgagaacaata

SEQ ID NO: 8291666 - DNA, 22 bp, Homo sapiens
aatttgtatacatgttacattt

SEQ ID NO: 8291667 - DNA, 22 bp, Homo sapiens
acaaagtttgtggtattccaag

SEQ ID NO: 8291668 - DNA, 22 bp, Homo sapiens
acaaagttattctttcagagga

SEQ ID NO: 8291669 - DNA, 22 bp, Homo sapiens
acaaagttaacagttggatagt

SEQ ID NO: 8291670 - DNA, 22 bp, Homo sapiens
aatgtgtgttcggggcccagag

SEQ ID NO: 8291671 - DNA, 22 bp, Homo sapiens
aatgtgtgtatttctaggcgag

SEQ ID NO: 8291672 - DNA, 21 bp, Homo sapiens
aatgtgtgctatttatctttt

SEQ ID NO: 8291673 - DNA, 22 bp, Homo sapiens
aatgtgtatactggcaattaag

SEQ ID NO: 8291674 - DNA, 22 bp, Homo sapiens
aatgtgtatatgaacatacagg

SEQ ID NO: 8291675 - DNA, 22 bp, Homo sapiens
aatgtgtactttttcatgctca

SEQ ID NO: 8291676 - DNA, 22 bp, Homo sapiens
aatgtgtagatgttgcattcct

SEQ ID NO: 8291677 - DNA, 22 bp, Homo sapiens
aatgtgtagcatttaatgcagt

SEQ ID NO: 8291678 - DNA, 22 bp, Homo sapiens
aatgtgtagggtgcctgttttt

SEQ ID NO: 8291679 - DNA, 20 bp, Homo sapiens
aatgtatattttatgccagg

SEQ ID NO: 8291680 - DNA, 22 bp, Homo sapiens
aatgctagtgtgatatgtaagg

SEQ ID NO: 8291681 - DNA, 22 bp, Homo sapiens
aatgcctttccactgggtatca

SEQ ID NO: 8291682 - DNA, 22 bp, Homo sapiens
agacatgagaaacccaccagag

SEQ ID NO: 8291683 - DNA, 22 bp, Homo sapiens
aatgctgctctcataattatag

SEQ ID NO: 8291684 - DNA, 22 bp, Homo sapiens
aatgctgcaagaggtgaaaaga

SEQ ID NO: 8291685 - DNA, 22 bp, Homo sapiens
acacaagattgtgtattgaatt

SEQ ID NO: 8291686 - DNA, 20 bp, Homo sapiens
acacagtgacaggaaagaga

SEQ ID NO: 8291687 - DNA, 22 bp, Homo sapiens
acacagtgccaaattgcagtta

SEQ ID NO: 8291688 - DNA, 22 bp, Homo sapiens
acacagtggtgtttacaaaatt

SEQ ID NO: 8291689 - DNA, 22 bp, Homo sapiens
agcatttaattacagtttaatt

SEQ ID NO: 8291690 - DNA, 22 bp, Homo sapiens
acagatatatgattgtgtaaat

SEQ ID NO: 8291691 - DNA, 22 bp, Homo sapiens
acagatataaactatagtagtg

SEQ ID NO: 8291692 - DNA, 22 bp, Homo sapiens
acagaatactacagactggtta

SEQ ID NO: 8291693 - DNA, 22 bp, Homo sapiens
acagaacttcctgctggagtgg

SEQ ID NO: 8291694 - DNA, 22 bp, Homo sapiens
acagaattaaagtgtttgtgga

SEQ ID NO: 8291695 - DNA, 22 bp, Homo sapiens
acagaatattggttactgttgc

SEQ ID NO: 8291696 - DNA, 20 bp, Homo sapiens
acagaatatgctggttgtgg

SEQ ID NO: 8291697 - DNA, 22 bp, Homo sapiens
acagaggtcatggagagttctc

SEQ ID NO: 8291698 - DNA, 22 bp, Homo sapiens
acagaggtaggacatgagatat

SEQ ID NO: 8291699 - DNA, 22 bp, Homo sapiens
aataaaatgaactggtagagtt

SEQ ID NO: 8291700 - DNA, 22 bp, Homo sapiens
aataaaatgaactggtagagtt

SEQ ID NO: 8291701 - DNA, 20 bp, Homo sapiens
aataaaagaagccttcaccc

SEQ ID NO: 8291702 - DNA, 22 bp, Homo sapiens
aataataagatactaagggagt

SEQ ID NO: 8291703 - DNA, 22 bp, Homo sapiens
aatagaatgtaatctaatacat

SEQ ID NO: 8291704 - DNA, 22 bp, Homo sapiens
aatagaatgtaatctaatacat

SEQ ID NO: 8291705 - DNA, 22 bp, Homo sapiens
aagttcaaggcaggtcctgagg

SEQ ID NO: 8291706 - DNA, 22 bp, Homo sapiens
aagttcaaggctctagagttcc

SEQ ID NO: 8291707 - DNA, 22 bp, Homo sapiens
aagttcaaggtgatagtggcag

SEQ ID NO: 8291708 - DNA, 22 bp, Homo sapiens
aagttcaatggaaaagctttag

SEQ ID NO: 8291709 - DNA, 22 bp, Homo sapiens
aagttcaatcagatgaaaaagc

SEQ ID NO: 8291710 - DNA, 22 bp, Homo sapiens
aagttcaagtgtaatctttatt

SEQ ID NO: 8291711 - DNA, 22 bp, Homo sapiens
aagttcaagtctgcatcttttt

SEQ ID NO: 8291712 - DNA, 22 bp, Homo sapiens
aagttcaagtctcctgagtata

SEQ ID NO: 8291713 - DNA, 23 bp, Homo sapiens
aagttcaagtcacagcctgtctt

SEQ ID NO: 8291714 - DNA, 22 bp, Homo sapiens
aagttcaagtagtgttacatgg

SEQ ID NO: 8291715 - DNA, 22 bp, Homo sapiens
aagtgtgtattgtttatgctgc

SEQ ID NO: 8291716 - DNA, 22 bp, Homo sapiens
aagtgttaaagacttgaacact

SEQ ID NO: 8291717 - DNA, 22 bp, Homo sapiens
aagtgttaaaagattaaatgct

SEQ ID NO: 8291718 - DNA, 22 bp, Homo sapiens
actttgaaggggaacattttaa

SEQ ID NO: 8291719 - DNA, 22 bp, Homo sapiens
acttttaaatgagtttcagttg

SEQ ID NO: 8291720 - DNA, 22 bp, Homo sapiens
acttttaaggggccttgattta

SEQ ID NO: 8291721 - DNA, 22 bp, Homo sapiens
aataggtagccagatatataaa

SEQ ID NO: 8291722 - DNA, 21 bp, Homo sapiens
aatccttaatgaggagttggt

SEQ ID NO: 8291723 - DNA, 22 bp, Homo sapiens
aatcacagccagcttccgctat

SEQ ID NO: 8291724 - DNA, 22 bp, Homo sapiens
aatcacaattacttttgcacca

SEQ ID NO: 8291725 - DNA, 22 bp, Homo sapiens
agaaactgaattatttctgagg

SEQ ID NO: 8291726 - DNA, 22 bp, Homo sapiens
agaacttaggaacaacagctta

SEQ ID NO: 8291727 - DNA, 22 bp, Homo sapiens
aatgaataccgtttcactcagt

SEQ ID NO: 8291728 - DNA, 22 bp, Homo sapiens
aatgccttcaagtatctgagga

SEQ ID NO: 8291729 - DNA, 22 bp, Homo sapiens
aatgcacaaaaattgtatgtaa

SEQ ID NO: 8291730 - DNA, 22 bp, Homo sapiens
acatgcatacacgtacatacct

SEQ ID NO: 8291731 - DNA, 22 bp, Homo sapiens
acatttcagcgtgcatgacatg

SEQ ID NO: 8291732 - DNA, 22 bp, Homo sapiens
aaggtacaaagtattatttaaa

SEQ ID NO: 8291733 - DNA, 22 bp, Homo sapiens
aaggtacaccaaagttcaagtt

SEQ ID NO: 8291734 - DNA, 22 bp, Homo sapiens
aaggtacagaaattaacaagga

SEQ ID NO: 8291735 - DNA, 22 bp, Homo sapiens
aaggtacagttttaagaataag

SEQ ID NO: 8291736 - DNA, 22 bp, Homo sapiens
aagtcatagtcgggaaagacat

SEQ ID NO: 8291737 - DNA, 22 bp, Homo sapiens
tccccaagcaggcaatctcccg

SEQ ID NO: 8291738 - DNA, 22 bp, Homo sapiens
tcccagtttttctccactaagg

SEQ ID NO: 8291739 - DNA, 22 bp, Homo sapiens
tccaggctaggtttacaggaca

SEQ ID NO: 8291740 - DNA, 22 bp, Homo sapiens
tcacagaaataagatagttatt

SEQ ID NO: 8291741 - DNA, 22 bp, Homo sapiens
tatttctgtcagccagatatgg

SEQ ID NO: 8291742 - DNA, 22 bp, Homo sapiens
tatttctgtatgcataaaagga

SEQ ID NO: 8291743 - DNA, 22 bp, Homo sapiens
tatttctgtaactcagggtctg

SEQ ID NO: 8291744 - DNA, 22 bp, Homo sapiens
tatttctgaggcccaggaagtg

SEQ ID NO: 8291745 - DNA, 22 bp, Homo sapiens
tatttctggctttgagggtgat

SEQ ID NO: 8291746 - DNA, 22 bp, Homo sapiens
tatttctgattgctcatgaggc

SEQ ID NO: 8291747 - DNA, 20 bp, Homo sapiens
tatttctgggcaaccattta

SEQ ID NO: 8291748 - DNA, 22 bp, Homo sapiens
tatttctgggagttcagaaatt

SEQ ID NO: 8291749 - DNA, 22 bp, Homo sapiens
tcaagacatcactgtgcatttt

SEQ ID NO: 8291750 - DNA, 22 bp, Homo sapiens
tcaataaaattgttttcctatc

SEQ ID NO: 8291751 - DNA, 22 bp, Homo sapiens
tcaataaatccctctgaccctg

SEQ ID NO: 8291752 - DNA, 23 bp, Homo sapiens
tcagagaactcgggcagatgacc

SEQ ID NO: 8291753 - DNA, 22 bp, Homo sapiens
tcagagaactccacaccttagg

SEQ ID NO: 8291754 - DNA, 22 bp, Homo sapiens
tcagagaagctgccaggcgagc

SEQ ID NO: 8291755 - DNA, 22 bp, Homo sapiens
tcagaaaagagaaaatcttata

SEQ ID NO: 8291756 - DNA, 22 bp, Homo sapiens
tcacttgcctagcccagttcag

SEQ ID NO: 8291757 - DNA, 22 bp, Homo sapiens
tcactgtgctctctagataggc

SEQ ID NO: 8291758 - DNA, 22 bp, Homo sapiens
tcatataagtttaaaactatct

SEQ ID NO: 8291759 - DNA, 22 bp, Homo sapiens
tcatgccacttacaaaataatg

SEQ ID NO: 8291760 - DNA, 20 bp, Homo sapiens
tcaggcagtggggaaaggca

SEQ ID NO: 8291761 - DNA, 22 bp, Homo sapiens
gttcacatccttgtgaggattt

SEQ ID NO: 8291762 - DNA, 22 bp, Homo sapiens
gttcatttatgatgtaacatgt

SEQ ID NO: 8291763 - DNA, 22 bp, Homo sapiens
gttcatattactttgagtgcag

SEQ ID NO: 8291764 - DNA, 22 bp, Homo sapiens
taaaggtacgaagtgagggatt

SEQ ID NO: 8291765 - DNA, 22 bp, Homo sapiens
taaaggtaacatgaactgcttt

SEQ ID NO: 8291766 - DNA, 22 bp, Homo sapiens
taaaggtagcatgaaactgcaa

SEQ ID NO: 8291767 - DNA, 22 bp, Homo sapiens
taaaggtagtgtgacatattgt

SEQ ID NO: 8291768 - DNA, 22 bp, Homo sapiens
taaaggtagttttaaaggtgct

SEQ ID NO: 8291769 - DNA, 22 bp, Homo sapiens
taaaggtatgtcttaatcaaac

SEQ ID NO: 8291770 - DNA, 22 bp, Homo sapiens
taaagtgtcctagctaggaggc

SEQ ID NO: 8291771 - DNA, 22 bp, Homo sapiens
taaattcccaactctgctcttc

SEQ ID NO: 8291772 - DNA, 22 bp, Homo sapiens
taacattacagacaccttgtgt

SEQ ID NO: 8291773 - DNA, 22 bp, Homo sapiens
taacattacggacatctgtcag

SEQ ID NO: 8291774 - DNA, 22 bp, Homo sapiens
taactaactagtgttcaaaata

SEQ ID NO: 8291775 - DNA, 22 bp, Homo sapiens
gtttccatggctctgttaatgg

SEQ ID NO: 8291776 - DNA, 22 bp, Homo sapiens
gttttctttgaatgcttctaga

SEQ ID NO: 8291777 - DNA, 22 bp, Homo sapiens
taaaatgtagcttctaggctgg

SEQ ID NO: 8291778 - DNA, 19 bp, Homo sapiens
taaaatgtctgtggtcagt

SEQ ID NO: 8291779 - DNA, 22 bp, Homo sapiens
taaaatgcacagcagttgaaag

SEQ ID NO: 8291780 - DNA, 22 bp, Homo sapiens
taaaagttttagttgtacataa

SEQ ID NO: 8291781 - DNA, 22 bp, Homo sapiens
taaaattgcggtgaatatttcc

SEQ ID NO: 8291782 - DNA, 22 bp, Homo sapiens
taaaatgtttgcaagagaccag

SEQ ID NO: 8291783 - DNA, 22 bp, Homo sapiens
taaaatgtttgcaagagaccag

SEQ ID NO: 8291784 - DNA, 22 bp, Homo sapiens
taaaatgtgtttctgtatggtt

SEQ ID NO: 8291785 - DNA, 22 bp, Homo sapiens
taaaatgtttgcaagagaccag

SEQ ID NO: 8291786 - DNA, 22 bp, Homo sapiens
taaacagaaagcagatgtactt

SEQ ID NO: 8291787 - DNA, 22 bp, Homo sapiens
taaacagaatgcgtaagaagtg

SEQ ID NO: 8291788 - DNA, 22 bp, Homo sapiens
taaggcattctcatgctgtgaa

SEQ ID NO: 8291789 - DNA, 22 bp, Homo sapiens
taagtaaatttataatgtgatt

SEQ ID NO: 8291790 - DNA, 22 bp, Homo sapiens
taattatagccgctattttgct

SEQ ID NO: 8291791 - DNA, 22 bp, Homo sapiens
taatagaatagtggaaacattg

SEQ ID NO: 8291792 - DNA, 22 bp, Homo sapiens
tacaaagatagtgttagagtaa

SEQ ID NO: 8291793 - DNA, 22 bp, Homo sapiens
tacaaagcctggtagatatctg

SEQ ID NO: 8291794 - DNA, 22 bp, Homo sapiens
tacaaagctgtatagcctggtc

SEQ ID NO: 8291795 - DNA, 22 bp, Homo sapiens
tacaaacttgttttaagtaagt

SEQ ID NO: 8291796 - DNA, 22 bp, Homo sapiens
tacatagaacatgtttaatgtc

SEQ ID NO: 8291797 - DNA, 22 bp, Homo sapiens
tacatagaacatgtttaatgtc

SEQ ID NO: 8291798 - DNA, 22 bp, Homo sapiens
tacatagagaagttacagtgga

SEQ ID NO: 8291799 - DNA, 22 bp, Homo sapiens
tacatagagggtaatagcatca

SEQ ID NO: 8291800 - DNA, 22 bp, Homo sapiens
tacatagattttgaaactggac

SEQ ID NO: 8291801 - DNA, 22 bp, Homo sapiens
tacagtaaccttatttgtcatt

SEQ ID NO: 8291802 - DNA, 22 bp, Homo sapiens
tacaggaggattatcaaaggat

SEQ ID NO: 8291803 - DNA, 22 bp, Homo sapiens
tacatagcaaggaaatgacaga

SEQ ID NO: 8291804 - DNA, 22 bp, Homo sapiens
tacactttttactacagattct

SEQ ID NO: 8291805 - DNA, 22 bp, Homo sapiens
tacagaaaaactggcattgaag

SEQ ID NO: 8291806 - DNA, 20 bp, Homo sapiens
tacagaaacaggacttttgg

SEQ ID NO: 8291807 - DNA, 20 bp, Homo sapiens
tacagaaacaggacttttgg

SEQ ID NO: 8291808 - DNA, 22 bp, Homo sapiens
tacaaagtttgagaatgctttc

SEQ ID NO: 8291809 - DNA, 22 bp, Homo sapiens
tacagatacagatctagataca

SEQ ID NO: 8291810 - DNA, 22 bp, Homo sapiens
tacagataactgaatgcagact

SEQ ID NO: 8291811 - DNA, 22 bp, Homo sapiens
tacagataaattttaagtagaa

SEQ ID NO: 8291812 - DNA, 22 bp, Homo sapiens
tacagaaatcacatcgctttga

SEQ ID NO: 8291813 - DNA, 22 bp, Homo sapiens
tacagaaatcacatcgctttga

SEQ ID NO: 8291814 - DNA, 22 bp, Homo sapiens
taggaaaacgtgattttctcac

SEQ ID NO: 8291815 - DNA, 22 bp, Homo sapiens
tagctttacaaagtgctgcacc

SEQ ID NO: 8291816 - DNA, 22 bp, Homo sapiens
tagctttaccatagaagagtat

SEQ ID NO: 8291817 - DNA, 22 bp, Homo sapiens
tagaaacacagatctggtgtca

SEQ ID NO: 8291818 - DNA, 22 bp, Homo sapiens
tagaaacatgttctgttctgtt

SEQ ID NO: 8291819 - DNA, 22 bp, Homo sapiens
tagaaacatcagctaaccaaaa

SEQ ID NO: 8291820 - DNA, 22 bp, Homo sapiens
tagaaactgatagtcttgtgct

SEQ ID NO: 8291821 - DNA, 22 bp, Homo sapiens
tagaaactcaggatactcttcc

SEQ ID NO: 8291822 - DNA, 22 bp, Homo sapiens
taccaaaagcttgtttcataca

SEQ ID NO: 8291823 - DNA, 22 bp, Homo sapiens
taccaaaaccaagccattatct

SEQ ID NO: 8291824 - DNA, 22 bp, Homo sapiens
tactttggatccttacaatagc

SEQ ID NO: 8291825 - DNA, 22 bp, Homo sapiens
tagaaaagataacattctgtgc

SEQ ID NO: 8291826 - DNA, 22 bp, Homo sapiens
tagaaaagaattttatttgata

SEQ ID NO: 8291827 - DNA, 22 bp, Homo sapiens
tagaaagtgaaggttaattaat

SEQ ID NO: 8291828 - DNA, 22 bp, Homo sapiens
tagaaatcagcaggcatatgta

SEQ ID NO: 8291829 - DNA, 20 bp, Homo sapiens
tagaaatcttataaaagact

SEQ ID NO: 8291830 - DNA, 22 bp, Homo sapiens
tagaaatctacttagactttct

SEQ ID NO: 8291831 - DNA, 22 bp, Homo sapiens
tagaaatccccagtctcatagt

SEQ ID NO: 8291832 - DNA, 22 bp, Homo sapiens
tagaaatcaggtttttagaaag

SEQ ID NO: 8291833 - DNA, 21 bp, Homo sapiens
tagaaatcagctggtgcctct

SEQ ID NO: 8291834 - DNA, 22 bp, Homo sapiens
tagaaatcatttagaagtattg

SEQ ID NO: 8291835 - DNA, 22 bp, Homo sapiens
tagaaatgattttgatgcttca

SEQ ID NO: 8291836 - DNA, 22 bp, Homo sapiens
tagaaatgattttgatgcttca

SEQ ID NO: 8291837 - DNA, 22 bp, Homo sapiens
tagaaatgattttgatgcttca

SEQ ID NO: 8291838 - DNA, 22 bp, Homo sapiens
tagaaatgcccagattctgcta

SEQ ID NO: 8291839 - DNA, 22 bp, Homo sapiens
tagaaatgcagtgtactgtgtc

SEQ ID NO: 8291840 - DNA, 22 bp, Homo sapiens
tagaaagcttggggtgtttaaa

SEQ ID NO: 8291841 - DNA, 22 bp, Homo sapiens
tagaaagtaaatcagttttatt

SEQ ID NO: 8291842 - DNA, 19 bp, Homo sapiens
tagaatgcccacttaaaaa

SEQ ID NO: 8291843 - DNA, 22 bp, Homo sapiens
tagaatgtaaattccaagggca

SEQ ID NO: 8291844 - DNA, 22 bp, Homo sapiens
tagaatgtaaattccaagggca

SEQ ID NO: 8291845 - DNA, 22 bp, Homo sapiens
tatttataccaggtgatcggag

SEQ ID NO: 8291846 - DNA, 22 bp, Homo sapiens
tatttctgaatccaaaaggtca

SEQ ID NO: 8291847 - DNA, 22 bp, Homo sapiens
tattgacaatttgtgaaactat

SEQ ID NO: 8291848 - DNA, 22 bp, Homo sapiens
tatgtacaccggggaaggtggg

SEQ ID NO: 8291849 - DNA, 22 bp, Homo sapiens
tatgtacacatacacttgtaat

SEQ ID NO: 8291850 - DNA, 22 bp, Homo sapiens
tatgtacagggatagaacttga

SEQ ID NO: 8291851 - DNA, 22 bp, Homo sapiens
tatgtacataacatgaaatgca

SEQ ID NO: 8291852 - DNA, 22 bp, Homo sapiens
tatgtacaatcagcagttcata

SEQ ID NO: 8291853 - DNA, 22 bp, Homo sapiens
tatgagtacaaggactctgtct

SEQ ID NO: 8291854 - DNA, 20 bp, Homo sapiens
tatgagtattactttcagga

SEQ ID NO: 8291855 - DNA, 22 bp, Homo sapiens
tatgtgcagtttgctcttaaca

SEQ ID NO: 8291856 - DNA, 22 bp, Homo sapiens
tatgtgaatacagcagtggatg

SEQ ID NO: 8291857 - DNA, 22 bp, Homo sapiens
tatacaatggctgaatcatcca

SEQ ID NO: 8291858 - DNA, 22 bp, Homo sapiens
tatacaatgagtacattctggg

SEQ ID NO: 8291859 - DNA, 22 bp, Homo sapiens
tataacaggaagtattcaaaca

SEQ ID NO: 8291860 - DNA, 20 bp, Homo sapiens
tataacagtgttgggtgtgt

SEQ ID NO: 8291861 - DNA, 22 bp, Homo sapiens
tataacagtttaggtggtgtca

SEQ ID NO: 8291862 - DNA, 20 bp, Homo sapiens
tataacagtgttgggtgtgt

SEQ ID NO: 8291863 - DNA, 22 bp, Homo sapiens
tatctacaggtgtcaggtaaga

SEQ ID NO: 8291864 - DNA, 22 bp, Homo sapiens
tatatcatggagattaacattc

SEQ ID NO: 8291865 - DNA, 22 bp, Homo sapiens
tatatcttatatgtgcaggtac

SEQ ID NO: 8291866 - DNA, 22 bp, Homo sapiens
tatagtaaaattttcatttatg

SEQ ID NO: 8291867 - DNA, 22 bp, Homo sapiens
gctttatgtaagtccaaaggca

SEQ ID NO: 8291868 - DNA, 22 bp, Homo sapiens
ggagagaaattgaggtagcaag

SEQ ID NO: 8291869 - DNA, 22 bp, Homo sapiens
gcagtggcatgatgtgggctca

SEQ ID NO: 8291870 - DNA, 22 bp, Homo sapiens
gcagtggccacatggaggagga

SEQ ID NO: 8291871 - DNA, 22 bp, Homo sapiens
gcagtggctaagctcgcatgca

SEQ ID NO: 8291872 - DNA, 22 bp, Homo sapiens
gcagagaacccagcagattggc

SEQ ID NO: 8291873 - DNA, 22 bp, Homo sapiens
gcacagaacagagaaatagcca

SEQ ID NO: 8291874 - DNA, 22 bp, Homo sapiens
gcacaggttgcaaaagttcaca

SEQ ID NO: 8291875 - DNA, 22 bp, Homo sapiens
gcaaaggtagccaaggagctca

SEQ ID NO: 8291876 - DNA, 15 bp, Homo sapiens
gcaggcagatcaccg

SEQ ID NO: 8291877 - DNA, 22 bp, Homo sapiens
gcaggcagatcacctgtcagga

SEQ ID NO: 8291878 - DNA, 14 bp, Homo sapiens
gcaggcagatcact

SEQ ID NO: 8291879 - DNA, 14 bp, Homo sapiens
gcaggcagatcatt

SEQ ID NO: 8291880 - DNA, 22 bp, Homo sapiens
gcaggcagccacgattcccttg

SEQ ID NO: 8291881 - DNA, 22 bp, Homo sapiens
gcaggcagaggtggaggagaca

SEQ ID NO: 8291882 - DNA, 16 bp, Homo sapiens
gcaggcagatcacatg

SEQ ID NO: 8291883 - DNA, 14 bp, Homo sapiens
gcaggcagatcacc

SEQ ID NO: 8291884 - DNA, 22 bp, Homo sapiens
gcaggcagagtcaatttgatcc

SEQ ID NO: 8291885 - DNA, 22 bp, Homo sapiens
gcaggcagttatttagtagaat

SEQ ID NO: 8291886 - DNA, 22 bp, Homo sapiens
gcaggcagtcatctttcatatt

SEQ ID NO: 8291887 - DNA, 19 bp, Homo sapiens
gcaggcagtggcattcgga

SEQ ID NO: 8291888 - DNA, 22 bp, Homo sapiens
gcaggcaggtggcatcttgtga

SEQ ID NO: 8291889 - DNA, 22 bp, Homo sapiens
gcaggaaaggttgagactttgc

SEQ ID NO: 8291890 - DNA, 19 bp, Homo sapiens
gcaggaaatgagtgattgc

SEQ ID NO: 8291891 - DNA, 22 bp, Homo sapiens
ggcatgtttcatcacatcaaga

SEQ ID NO: 8291892 - DNA, 22 bp, Homo sapiens
ggcaggcagaggctgagacagg

SEQ ID NO: 8291893 - DNA, 22 bp, Homo sapiens
ggcaggaggtgagtggcgggtg

SEQ ID NO: 8291894 - DNA, 22 bp, Homo sapiens
ggcaggcacagtaatacatgtt

SEQ ID NO: 8291895 - DNA, 22 bp, Homo sapiens
ggcaggcacatttgggggccgt

SEQ ID NO: 8291896 - DNA, 22 bp, Homo sapiens
ggcaggcaatgaggatgggaag

SEQ ID NO: 8291897 - DNA, 22 bp, Homo sapiens
ggcaggcactgtgatagattct

SEQ ID NO: 8291898 - DNA, 22 bp, Homo sapiens
ggcaggcaccagctcagcaata

SEQ ID NO: 8291899 - DNA, 22 bp, Homo sapiens
ggcaggcactgtgctaggcgct

SEQ ID NO: 8291900 - DNA, 22 bp, Homo sapiens
ggcaggcagaaaaatagaatat

SEQ ID NO: 8291901 - DNA, 22 bp, Homo sapiens
ggcaggcactgtgttttgtgtt

SEQ ID NO: 8291902 - DNA, 22 bp, Homo sapiens
ggcaggcaaggcagcctggtga

SEQ ID NO: 8291903 - DNA, 22 bp, Homo sapiens
ggcaggcaagtctgctctgtga

SEQ ID NO: 8291904 - DNA, 22 bp, Homo sapiens
ggcaggcaacggaccactagtc

SEQ ID NO: 8291905 - DNA, 22 bp, Homo sapiens
ggcaaagttttcatctcataac

SEQ ID NO: 8291906 - DNA, 19 bp, Homo sapiens
ggtcacaggggttacaagg

SEQ ID NO: 8291907 - DNA, 22 bp, Homo sapiens
gtaaaacatgttttaactagga

SEQ ID NO: 8291908 - DNA, 22 bp, Homo sapiens
gtacatttcatttaaatgatgt

SEQ ID NO: 8291909 - DNA, 22 bp, Homo sapiens
gtacattttactttgtttgaat

SEQ ID NO: 8291910 - DNA, 22 bp, Homo sapiens
gtacattttgaggttaaaacaa

SEQ ID NO: 8291911 - DNA, 22 bp, Homo sapiens
gtattcttggttatcaaaatac

SEQ ID NO: 8291912 - DNA, 21 bp, Homo sapiens
gtattctttatgaagtgaaaa

SEQ ID NO: 8291913 - DNA, 22 bp, Homo sapiens
gtatttaattccattaagttag

SEQ ID NO: 8291914 - DNA, 22 bp, Homo sapiens
gtatttataggggaatgagagt

SEQ ID NO: 8291915 - DNA, 22 bp, Homo sapiens
gtagaagtgatgtcatgttata

SEQ ID NO: 8291916 - DNA, 22 bp, Homo sapiens
gtgcatatatgcacatatgtgt

SEQ ID NO: 8291917 - DNA, 22 bp, Homo sapiens
gtgcatttgacgaatactcact

SEQ ID NO: 8291918 - DNA, 22 bp, Homo sapiens
gtgcatttggtgactctcaccc

SEQ ID NO: 8291919 - DNA, 22 bp, Homo sapiens
gtgcatttctcatacactaaat

SEQ ID NO: 8291920 - DNA, 20 bp, Homo sapiens
gtgcatttcacctgtactgt

SEQ ID NO: 8291921 - DNA, 22 bp, Homo sapiens
gtgcatttgtgcatgcacatgt

SEQ ID NO: 8291922 - DNA, 22 bp, Homo sapiens
gtgaccatcagagaataacaaa

SEQ ID NO: 8291923 - DNA, 22 bp, Homo sapiens
gtgaaagcactgaacaaagtaa

SEQ ID NO: 8291924 - DNA, 22 bp, Homo sapiens
ctttatgtccaccagactgcaa

SEQ ID NO: 8291925 - DNA, 22 bp, Homo sapiens
cttatattttaggaacagacaa

SEQ ID NO: 8291926 - DNA, 22 bp, Homo sapiens
cttcaaacccagattaaatgca

SEQ ID NO: 8291927 - DNA, 22 bp, Homo sapiens
cttcaaaccacatgctgaaaat

SEQ ID NO: 8291928 - DNA, 22 bp, Homo sapiens
cttcaaacccagattaaatgca

SEQ ID NO: 8291929 - DNA, 22 bp, Homo sapiens
ctgttcatgctgattctgtatg

SEQ ID NO: 8291930 - DNA, 22 bp, Homo sapiens
ctgtgcattgtcttgtctgtag

SEQ ID NO: 8291931 - DNA, 21 bp, Homo sapiens
gagatttagaaggatcaattt

SEQ ID NO: 8291932 - DNA, 22 bp, Homo sapiens
gagatgtacaatgtgtattaat

SEQ ID NO: 8291933 - DNA, 22 bp, Homo sapiens
gagatgaatgtaaacaaaggca

SEQ ID NO: 8291934 - DNA, 22 bp, Homo sapiens
gaatattagtatcagttatacc

SEQ ID NO: 8291935 - DNA, 22 bp, Homo sapiens
ctttcacacacatacatttgga

SEQ ID NO: 8291936 - DNA, 18 bp, Homo sapiens
ctttatgtgcagagcttt

SEQ ID NO: 8291937 - DNA, 22 bp, Homo sapiens
ctttatgtccttgaagagttgt

SEQ ID NO: 8291938 - DNA, 23 bp, Homo sapiens
ctttcattgtggtttcacagagc

SEQ ID NO: 8291939 - DNA, 22 bp, Homo sapiens
gaaatatttctcttgagcccct

SEQ ID NO: 8291940 - DNA, 22 bp, Homo sapiens
gaacagtaaatttatgcagcac

SEQ ID NO: 8291941 - DNA, 22 bp, Homo sapiens
gaacagtatcagtagtgccagt

SEQ ID NO: 8291942 - DNA, 22 bp, Homo sapiens
gaaatgcatggatcttggcaga

SEQ ID NO: 8291943 - DNA, 22 bp, Homo sapiens
gaaatgcataatcttagtagat

SEQ ID NO: 8291944 - DNA, 22 bp, Homo sapiens
gaaatgcaggcttggattcagc

SEQ ID NO: 8291945 - DNA, 22 bp, Homo sapiens
gaaatgcagaacctgagaccat

SEQ ID NO: 8291946 - DNA, 22 bp, Homo sapiens
gaaatgcagattctgattctgt

SEQ ID NO: 8291947 - DNA, 22 bp, Homo sapiens
gaaatgcaaattctctctcgct

SEQ ID NO: 8291948 - DNA, 22 bp, Homo sapiens
gaagacatgtttttaatatgta

SEQ ID NO: 8291949 - DNA, 22 bp, Homo sapiens
gaagacattaagtctatgtcac

SEQ ID NO: 8291950 - DNA, 22 bp, Homo sapiens
gaagacatgtggattctagttt

SEQ ID NO: 8291951 - DNA, 22 bp, Homo sapiens
gaagacattttatgcatactct

SEQ ID NO: 8291952 - DNA, 22 bp, Homo sapiens
gaagacatttgtaacacttgca

SEQ ID NO: 8291953 - DNA, 22 bp, Homo sapiens
gaagacatcatggagaggatag

SEQ ID NO: 8291954 - DNA, 22 bp, Homo sapiens
gaagacatcgtgtggactaaca

SEQ ID NO: 8291955 - DNA, 22 bp, Homo sapiens
tgttcagccctctattaatcag

SEQ ID NO: 8291956 - DNA, 22 bp, Homo sapiens
tgttaatcaatcaacagtatta

SEQ ID NO: 8291957 - DNA, 22 bp, Homo sapiens
tgttacaaggaagaatgtaggt

SEQ ID NO: 8291958 - DNA, 23 bp, Homo sapiens
ttaaaggcagatgttgagtatta

SEQ ID NO: 8291959 - DNA, 22 bp, Homo sapiens
ttaaagtccctgccttaattcc

SEQ ID NO: 8291960 - DNA, 22 bp, Homo sapiens
ttaaagttcattaaatgagcca

SEQ ID NO: 8291961 - DNA, 22 bp, Homo sapiens
ttagaaaaaggctgtggtctta

SEQ ID NO: 8291962 - DNA, 22 bp, Homo sapiens
ttagaaaacataagtggtaaag

SEQ ID NO: 8291963 - DNA, 22 bp, Homo sapiens
ttagaaaaaacgtcttctagtg

SEQ ID NO: 8291964 - DNA, 22 bp, Homo sapiens
ccttctagcaaatcaacataaa

SEQ ID NO: 8291965 - DNA, 22 bp, Homo sapiens
ctactttaattttctgcagaga

SEQ ID NO: 8291966 - DNA, 22 bp, Homo sapiens
ctattatttcctcatctataaa

SEQ ID NO: 8291967 - DNA, 21 bp, Homo sapiens
ttcaatactatttcaatagtc

SEQ ID NO: 8291968 - DNA, 22 bp, Homo sapiens
ttcaatacaaagaaaggaattt

SEQ ID NO: 8291969 - DNA, 22 bp, Homo sapiens
ttcaataggatgcatgatataa

SEQ ID NO: 8291970 - DNA, 22 bp, Homo sapiens
ttcacagaattgtcttgactgg

SEQ ID NO: 8291971 - DNA, 22 bp, Homo sapiens
ttcagaaagtgaatcttgttat

SEQ ID NO: 8291972 - DNA, 22 bp, Homo sapiens
ctaaataatccctctggtctta

SEQ ID NO: 8291973 - DNA, 22 bp, Homo sapiens
ctaaataatccctctggtctta

SEQ ID NO: 8291974 - DNA, 22 bp, Homo sapiens
ttttaatactgctattgtagga

SEQ ID NO: 8291975 - DNA, 22 bp, Homo sapiens
ttttagattgggaaatgtaaag

SEQ ID NO: 8291976 - DNA, 22 bp, Homo sapiens
ctgaccatcatggtgaaacccc

SEQ ID NO: 8291977 - DNA, 20 bp, Homo sapiens
ctgcaaaatgacattaggaa

SEQ ID NO: 8291978 - DNA, 22 bp, Homo sapiens
ctgcaaaagtcattgtggtttt

SEQ ID NO: 8291979 - DNA, 22 bp, Homo sapiens
ctgcaaaattgttctttgctcc

SEQ ID NO: 8291980 - DNA, 22 bp, Homo sapiens
ctgcactgagaccctctttgct

SEQ ID NO: 8291981 - DNA, 22 bp, Homo sapiens
tttcacatacagtgtatagtag

SEQ ID NO: 8291982 - DNA, 22 bp, Homo sapiens
tttagtaagttcactgcaaagc

SEQ ID NO: 8291983 - DNA, 22 bp, Homo sapiens
tttaatcaggcaaagcataata

SEQ ID NO: 8291984 - DNA, 22 bp, Homo sapiens
tttattgttgttagtcataagt

SEQ ID NO: 8291985 - DNA, 22 bp, Homo sapiens
tttaatactatggggatgaaca

SEQ ID NO: 8291986 - DNA, 22 bp, Homo sapiens
tacaaaagtaattacggttttt

SEQ ID NO: 8291987 - DNA, 22 bp, Homo sapiens
caggccaggtggcaggcaaaac

SEQ ID NO: 8291988 - DNA, 22 bp, Homo sapiens
caggccagggttgagaagagaa

SEQ ID NO: 8291989 - DNA, 22 bp, Homo sapiens
taatccacaatagagattatct

SEQ ID NO: 8291990 - DNA, 22 bp, Homo sapiens
taatccaaaactgaatctgtgg

SEQ ID NO: 8291991 - DNA, 22 bp, Homo sapiens
taatcacatcagggtaaatggg

SEQ ID NO: 8291992 - DNA, 22 bp, Homo sapiens
taatatctacttcatagagttt

SEQ ID NO: 8291993 - DNA, 22 bp, Homo sapiens
taatgtgtcctgaaagcttctg

SEQ ID NO: 8291994 - DNA, 22 bp, Homo sapiens
taatgtgttgaatatttgtaca

SEQ ID NO: 8291995 - DNA, 22 bp, Homo sapiens
taatgtgtgtcatcagtagagt

SEQ ID NO: 8291996 - DNA, 21 bp, Homo sapiens
taataattccactacagagta

SEQ ID NO: 8291997 - DNA, 22 bp, Homo sapiens
gtgcttcaagttcttaatgttt

SEQ ID NO: 8291998 - DNA, 22 bp, Homo sapiens
taagtcatcacattgcagagat

SEQ ID NO: 8291999 - DNA, 22 bp, Homo sapiens
taagtcataagtcatgatgtta

SEQ ID NO: 8292000 - DNA, 18 bp, Homo sapiens
taagtcattttgccagca

SEQ ID NO: 8292001 - DNA, 22 bp, Homo sapiens
tagaaaatagggcctgtggagc

SEQ ID NO: 8292002 - DNA, 22 bp, Homo sapiens
tacattgtgatgtttcaataca

SEQ ID NO: 8292003 - DNA, 22 bp, Homo sapiens
tacattgtgatgtttcaataca

SEQ ID NO: 8292004 - DNA, 22 bp, Homo sapiens
tactttagaaggaaataagttc

SEQ ID NO: 8292005 - DNA, 22 bp, Homo sapiens
caggtacactcccttgtgctga

SEQ ID NO: 8292006 - DNA, 22 bp, Homo sapiens
tattatcattaactgttgaatt

SEQ ID NO: 8292007 - DNA, 22 bp, Homo sapiens
tattatcattggtaatatggtc

SEQ ID NO: 8292008 - DNA, 22 bp, Homo sapiens
tattatgtagagtaagggttaa

SEQ ID NO: 8292009 - DNA, 20 bp, Homo sapiens
tatttgaaatggccaagtgt

SEQ ID NO: 8292010 - DNA, 22 bp, Homo sapiens
tcaaaacaatcattggatgtgc

SEQ ID NO: 8292011 - DNA, 19 bp, Homo sapiens
tcaaaacacaaatggttga

SEQ ID NO: 8292012 - DNA, 22 bp, Homo sapiens
tcaaaacactattacctttaat

SEQ ID NO: 8292013 - DNA, 22 bp, Homo sapiens
cattagaactaagatgtccagg

SEQ ID NO: 8292014 - DNA, 22 bp, Homo sapiens
cattagaagaacagttatatta

SEQ ID NO: 8292015 - DNA, 22 bp, Homo sapiens
cattctgtgattctaaatccct

SEQ ID NO: 8292016 - DNA, 22 bp, Homo sapiens
cataacatccttgctactttga

SEQ ID NO: 8292017 - DNA, 22 bp, Homo sapiens
catagaaactgagacaaggatt

SEQ ID NO: 8292018 - DNA, 22 bp, Homo sapiens
catagaaactgagacaaggatt

SEQ ID NO: 8292019 - DNA, 22 bp, Homo sapiens
catagaatatgtgtgattgtta

SEQ ID NO: 8292020 - DNA, 22 bp, Homo sapiens
tcaatcacgtgttccatgttct

SEQ ID NO: 8292021 - DNA, 22 bp, Homo sapiens
tcaatgaaagagcatgcatttt

SEQ ID NO: 8292022 - DNA, 23 bp, Homo sapiens
cataaaatattagtatggtagca

SEQ ID NO: 8292023 - DNA, 22 bp, Homo sapiens
catgagaaccaggtctgtgttt

SEQ ID NO: 8292024 - DNA, 22 bp, Homo sapiens
cctaagaattaatgaatacacc

SEQ ID NO: 8292025 - DNA, 22 bp, Homo sapiens
cccatttaaacacaagctttca

SEQ ID NO: 8292026 - DNA, 22 bp, Homo sapiens
cccatttagataacagttcaaa

SEQ ID NO: 8292027 - DNA, 22 bp, Homo sapiens
cccatttatcccaaggttactc

SEQ ID NO: 8292028 - DNA, 22 bp, Homo sapiens
tgctgttatacttagctggtta

SEQ ID NO: 8292029 - DNA, 22 bp, Homo sapiens
tcttagaatgtcaactgatgtt

SEQ ID NO: 8292030 - DNA, 22 bp, Homo sapiens
tctggttagccaataatgccaa

SEQ ID NO: 8292031 - DNA, 22 bp, Homo sapiens
tgacataagttggtagaaagga

SEQ ID NO: 8292032 - DNA, 22 bp, Homo sapiens
tgacataaatctaaaggaaagg

SEQ ID NO: 8292033 - DNA, 22 bp, Homo sapiens
tgacataaaccagtgagcaaaa

SEQ ID NO: 8292034 - DNA, 22 bp, Homo sapiens
tgagaaaaggttgagatgataa

SEQ ID NO: 8292035 - DNA, 22 bp, Homo sapiens
tgacataagttggtagaaagga

SEQ ID NO: 8292036 - DNA, 21 bp, Homo sapiens
tgacataatccatagtacaaa

SEQ ID NO: 8292037 - DNA, 22 bp, Homo sapiens
ccattgtaaagagtatactttg

SEQ ID NO: 8292038 - DNA, 22 bp, Homo sapiens
tgtgtaaatttatttacataaa

SEQ ID NO: 8292039 - DNA, 22 bp, Homo sapiens
tgtgtaaatggcatctctcagc

SEQ ID NO: 8292040 - DNA, 21 bp, Homo sapiens
tgtgtaaagttgaaatcctgt

SEQ ID NO: 8292041 - DNA, 19 bp, Homo sapiens
tgtgtaaagtctgtggtca

SEQ ID NO: 8292042 - DNA, 22 bp, Homo sapiens
tgtgtaaaatctgattaatact

SEQ ID NO: 8292043 - DNA, 22 bp, Homo sapiens
tgtgtgaatggattattctatt

SEQ ID NO: 8292044 - DNA, 22 bp, Homo sapiens
tgtgtgaatctattgaatatat

SEQ ID NO: 8292045 - DNA, 22 bp, Homo sapiens
tgtgtgaaggaatatatactca

SEQ ID NO: 8292046 - DNA, 22 bp, Homo sapiens
tgttcacaagatgtctgtggct

SEQ ID NO: 8292047 - DNA, 22 bp, Homo sapiens
tgttcacaaggtgatgctttga

SEQ ID NO: 8292048 - DNA, 22 bp, Homo sapiens
tgttcacatcgatggattttgc

SEQ ID NO: 8292049 - DNA, 22 bp, Homo sapiens
tgtgttttgaactcatctactg

SEQ ID NO: 8292050 - DNA, 22 bp, Homo sapiens
tgtgtgcagcctctgtctttgg

SEQ ID NO: 8292051 - DNA, 20 bp, Homo sapiens
tgtgtgcacacatgacattc

SEQ ID NO: 8292052 - DNA, 22 bp, Homo sapiens
tgtttaatctataaaatggaga

SEQ ID NO: 8292053 - DNA, 22 bp, Homo sapiens
tgttctagcaacacagttttgg

SEQ ID NO: 8292054 - DNA, 22 bp, Homo sapiens
tgtttacatgcataagcttaag

SEQ ID NO: 8292055 - DNA, 20 bp, Homo sapiens
tgtttcttttaatgagcggc

SEQ ID NO: 8292056 - DNA, 22 bp, Homo sapiens
ttaaatattttcagcagggtca

SEQ ID NO: 8292057 - DNA, 22 bp, Homo sapiens
ttaaatgagatgttcagatatt

SEQ ID NO: 8292058 - DNA, 22 bp, Homo sapiens
ttaaatattatgttgtctgcaa

SEQ ID NO: 8292059 - DNA, 22 bp, Homo sapiens
ttaagtcatttctgattataga

SEQ ID NO: 8292060 - DNA, 22 bp, Homo sapiens
ttaagtccttggtaattttctt

SEQ ID NO: 8292061 - DNA, 22 bp, Homo sapiens
ttaagtcacttatctaaagaca

SEQ ID NO: 8292062 - DNA, 22 bp, Homo sapiens
ttaattcagtcaaagaaaccat

SEQ ID NO: 8292063 - DNA, 22 bp, Homo sapiens
ttaataaacaggtgcagctgaa

SEQ ID NO: 8292064 - DNA, 22 bp, Homo sapiens
ttaatttatacataatcacagg

SEQ ID NO: 8292065 - DNA, 22 bp, Homo sapiens
ttaatttatgtccaaaccagat

SEQ ID NO: 8292066 - DNA, 22 bp, Homo sapiens
ttaacagagaacatagaagtag

SEQ ID NO: 8292067 - DNA, 22 bp, Homo sapiens
ttaacagagtgcctggcatgta

SEQ ID NO: 8292068 - DNA, 22 bp, Homo sapiens
ttaacagacatatatatttgta

SEQ ID NO: 8292069 - DNA, 22 bp, Homo sapiens
ttaacagatgtttatggagcat

SEQ ID NO: 8292070 - DNA, 22 bp, Homo sapiens
ttacagtattgttaaactcttt

SEQ ID NO: 8292071 - DNA, 22 bp, Homo sapiens
ttacagtatgatcaacttttca

SEQ ID NO: 8292072 - DNA, 23 bp, Homo sapiens
ttacagtaggagttggaaaacca

SEQ ID NO: 8292073 - DNA, 21 bp, Homo sapiens
ttaatttattcatgatagcta

SEQ ID NO: 8292074 - DNA, 22 bp, Homo sapiens
ttaatttttatgtatagtgtgt

SEQ ID NO: 8292075 - DNA, 22 bp, Homo sapiens
ttagagaaattctggtaatgta

SEQ ID NO: 8292076 - DNA, 22 bp, Homo sapiens
ttagaaaatttgcttctttgga

SEQ ID NO: 8292077 - DNA, 22 bp, Homo sapiens
ttagaaacccagactcttaggt

SEQ ID NO: 8292078 - DNA, 19 bp, Homo sapiens
ttagaaactgttgacactg

SEQ ID NO: 8292079 - DNA, 22 bp, Homo sapiens
ttactttgttctcaagatatgt

SEQ ID NO: 8292080 - DNA, 22 bp, Homo sapiens
ttactttggatggtcaagaaag

SEQ ID NO: 8292081 - DNA, 22 bp, Homo sapiens
ttcaattcaattctaaatatat

SEQ ID NO: 8292082 - DNA, 22 bp, Homo sapiens
ttcaattctaaactaatattct

SEQ ID NO: 8292083 - DNA, 22 bp, Homo sapiens
ttcaacacaggaacatgatata

SEQ ID NO: 8292084 - DNA, 22 bp, Homo sapiens
ttcaacatcaagaatgcatgga

SEQ ID NO: 8292085 - DNA, 22 bp, Homo sapiens
ttcaacatagctgaggcatata

SEQ ID NO: 8292086 - DNA, 22 bp, Homo sapiens
ttcaacatgcaaacatgtttgt

SEQ ID NO: 8292087 - DNA, 22 bp, Homo sapiens
ttcaacatcattgtaagcctct

SEQ ID NO: 8292088 - DNA, 22 bp, Homo sapiens
ttcaacatgctttatttctaaa

SEQ ID NO: 8292089 - DNA, 19 bp, Homo sapiens
ttcaacatgctgaggcagc

SEQ ID NO: 8292090 - DNA, 22 bp, Homo sapiens
ttcaactagatttatacaattc

SEQ ID NO: 8292091 - DNA, 22 bp, Homo sapiens
ttcaactagatttatacaattc

SEQ ID NO: 8292092 - DNA, 22 bp, Homo sapiens
ttcaacattacacaggcaattc

SEQ ID NO: 8292093 - DNA, 22 bp, Homo sapiens
ttcaacatgttctacataaggg

SEQ ID NO: 8292094 - DNA, 22 bp, Homo sapiens
ttcaacatttgatacaagtcag

SEQ ID NO: 8292095 - DNA, 22 bp, Homo sapiens
ttcaacatttgaaatgaatgaa

SEQ ID NO: 8292096 - DNA, 22 bp, Homo sapiens
ttcaaagtaaaaatgtgttcac

SEQ ID NO: 8292097 - DNA, 22 bp, Homo sapiens
ttcaaaggcaggatagcagctg

SEQ ID NO: 8292098 - DNA, 22 bp, Homo sapiens
ttagataaattaagactttaca

SEQ ID NO: 8292099 - DNA, 22 bp, Homo sapiens
ttcacattagtggttctatata

SEQ ID NO: 8292100 - DNA, 22 bp, Homo sapiens
ttcacattataatcagttctgc

SEQ ID NO: 8292101 - DNA, 22 bp, Homo sapiens
ttcacattatcaggattgtttc

SEQ ID NO: 8292102 - DNA, 21 bp, Homo sapiens
ttcatcattggtaaaaagtgg

SEQ ID NO: 8292103 - DNA, 22 bp, Homo sapiens
ttcatcattacagtcatgttat

SEQ ID NO: 8292104 - DNA, 22 bp, Homo sapiens
ttcatcatcagaactgttcact

SEQ ID NO: 8292105 - DNA, 22 bp, Homo sapiens
ttcatgtaattccataaggtaa

SEQ ID NO: 8292106 - DNA, 22 bp, Homo sapiens
ttcatgtatttatcatgtaaat

SEQ ID NO: 8292107 - DNA, 20 bp, Homo sapiens
ttccagagatctgcatttta

SEQ ID NO: 8292108 - DNA, 23 bp, Homo sapiens
ttccttaactgttaagattgtct

SEQ ID NO: 8292109 - DNA, 22 bp, Homo sapiens
ttgatcatctaagagtaatagt

SEQ ID NO: 8292110 - DNA, 22 bp, Homo sapiens
ttggtggagtcattggcatatg

SEQ ID NO: 8292111 - DNA, 22 bp, Homo sapiens
ttggtggacctcatcagaaccg

SEQ ID NO: 8292112 - DNA, 22 bp, Homo sapiens
ttgtgaaatgtttcaaaatagt

SEQ ID NO: 8292113 - DNA, 22 bp, Homo sapiens
ttgtctaatgagctccacttca

SEQ ID NO: 8292114 - DNA, 22 bp, Homo sapiens
ttgttttcacagctttgcccgg

SEQ ID NO: 8292115 - DNA, 22 bp, Homo sapiens
tttacaacctcatattctgatg

SEQ ID NO: 8292116 - DNA, 22 bp, Homo sapiens
tttagaaattcatctatggcct

SEQ ID NO: 8292117 - DNA, 22 bp, Homo sapiens
tttagaaattgcagagtgggtg

SEQ ID NO: 8292118 - DNA, 22 bp, Homo sapiens
tttattattctctggagaatgt

SEQ ID NO: 8292119 - DNA, 22 bp, Homo sapiens
tttattattctctggagaatgt

SEQ ID NO: 8292120 - DNA, 21 bp, Homo sapiens
tttagttcaagtacagaacca

SEQ ID NO: 8292121 - DNA, 22 bp, Homo sapiens
tttataaaatagactgggtcta

SEQ ID NO: 8292122 - DNA, 22 bp, Homo sapiens
tttataaacagtaccacggtgc

SEQ ID NO: 8292123 - DNA, 22 bp, Homo sapiens
tttatacatggagaatttttgc

SEQ ID NO: 8292124 - DNA, 23 bp, Homo sapiens
tttctgttgggtatatatccaag

SEQ ID NO: 8292125 - DNA, 22 bp, Homo sapiens
tttctgtatttaaaagatctgg

SEQ ID NO: 8292126 - DNA, 22 bp, Homo sapiens
tttctgtaattaaaagggcagg

SEQ ID NO: 8292127 - DNA, 22 bp, Homo sapiens
tttcagatgcaattaattttca

SEQ ID NO: 8292128 - DNA, 22 bp, Homo sapiens
tttcagatcattttttaagtac

SEQ ID NO: 8292129 - DNA, 22 bp, Homo sapiens
tttcagatggaggtttaggaca

SEQ ID NO: 8292130 - DNA, 23 bp, Homo sapiens
tttgcaaattggacacaaccaca

SEQ ID NO: 8292131 - DNA, 22 bp, Homo sapiens
tttgcaaataccatgaaacttg

SEQ ID NO: 8292132 - DNA, 22 bp, Homo sapiens
tttgtagattcattgaactttt

SEQ ID NO: 8292133 - DNA, 22 bp, Homo sapiens
ttttatatggcacattggttgg

SEQ ID NO: 8292134 - DNA, 22 bp, Homo sapiens
ttttgaaagccaggtttgtatg

SEQ ID NO: 8292135 - DNA, 22 bp, Homo sapiens
tttttcatgagactagaagtca

SEQ ID NO: 8292136 - DNA, 22 bp, Homo sapiens
cactgtatcttttccaaagtct

SEQ ID NO: 8292137 - DNA, 22 bp, Homo sapiens
cacttaagcagttaatttatct

SEQ ID NO: 8292138 - DNA, 22 bp, Homo sapiens
cacagtgattgatttttacttt

SEQ ID NO: 8292139 - DNA, 22 bp, Homo sapiens
cacatgaggtgacttccaagct

SEQ ID NO: 8292140 - DNA, 22 bp, Homo sapiens
cacatgagagcccccaagagca

SEQ ID NO: 8292141 - DNA, 22 bp, Homo sapiens
cacatgagacaattaaagactt

SEQ ID NO: 8292142 - DNA, 22 bp, Homo sapiens
cacatgagtgagaacatgcagt

SEQ ID NO: 8292143 - DNA, 22 bp, Homo sapiens
cacatgagtcctgccaggtatg

SEQ ID NO: 8292144 - DNA, 22 bp, Homo sapiens
cacattcaggtggcatgttaga

SEQ ID NO: 8292145 - DNA, 22 bp, Homo sapiens
cacattcagggcagaccactca

SEQ ID NO: 8292146 - DNA, 22 bp, Homo sapiens
cacattcaggattttccatgtc

SEQ ID NO: 8292147 - DNA, 22 bp, Homo sapiens
cacattcagggaacattggagg

SEQ ID NO: 8292148 - DNA, 22 bp, Homo sapiens
cacatgtgcagttacatgaatt

SEQ ID NO: 8292149 - DNA, 22 bp, Homo sapiens
cacatgtgcaaatactgaggct

SEQ ID NO: 8292150 - DNA, 22 bp, Homo sapiens
cacattaaaatcctaacttcca

SEQ ID NO: 8292151 - DNA, 22 bp, Homo sapiens
cacattaagaataatgagacta

SEQ ID NO: 8292152 - DNA, 22 bp, Homo sapiens
cacattcacttctctgtccacc

SEQ ID NO: 8292153 - DNA, 22 bp, Homo sapiens
caaattttgtgtgttctctagt

SEQ ID NO: 8292154 - DNA, 22 bp, Homo sapiens
caagaaatctagaagtcagtgg

SEQ ID NO: 8292155 - DNA, 22 bp, Homo sapiens
caagaaatgggatttgactgcc

SEQ ID NO: 8292156 - DNA, 22 bp, Homo sapiens
caagaaatgtttactgagcatc

SEQ ID NO: 8292157 - DNA, 22 bp, Homo sapiens
caagaaatttcttaagaactaa

SEQ ID NO: 8292158 - DNA, 22 bp, Homo sapiens
caagaacagtttgccaaattgg

SEQ ID NO: 8292159 - DNA, 22 bp, Homo sapiens
caagaacattgtgatcacttca

SEQ ID NO: 8292160 - DNA, 22 bp, Homo sapiens
caagaattgtacaaactgggtg

SEQ ID NO: 8292161 - DNA, 22 bp, Homo sapiens
caatagaaaactcaatacttaa

SEQ ID NO: 8292162 - DNA, 22 bp, Homo sapiens
caatagaaaactcaatacttaa

SEQ ID NO: 8292163 - DNA, 22 bp, Homo sapiens
caatagcagcttctgaatgcaa

SEQ ID NO: 8292164 - DNA, 22 bp, Homo sapiens
caatatgcaagctattaagtat

SEQ ID NO: 8292165 - DNA, 22 bp, Homo sapiens
cagatttaagagataaacagtg

SEQ ID NO: 8292166 - DNA, 22 bp, Homo sapiens
gtagaaatagtggttgacagga

SEQ ID NO: 8292167 - DNA, 20 bp, Homo sapiens
gtacacatatatgtatgtgt

SEQ ID NO: 8292168 - DNA, 22 bp, Homo sapiens
gtacacattatgcttctctaaa

SEQ ID NO: 8292169 - DNA, 22 bp, Homo sapiens
ggtatgaattcactacttccaa

SEQ ID NO: 8292170 - DNA, 22 bp, Homo sapiens
cagaatttttcgaatgtactgt

SEQ ID NO: 8292171 - DNA, 22 bp, Homo sapiens
cagaatttgaagtaatattcca

SEQ ID NO: 8292172 - DNA, 22 bp, Homo sapiens
cagaatttagcacaatgtatgg

SEQ ID NO: 8292173 - DNA, 22 bp, Homo sapiens
atgtatgttagtgtattatcta

SEQ ID NO: 8292174 - DNA, 22 bp, Homo sapiens
atgtatcagataaagcatgtgg

SEQ ID NO: 8292175 - DNA, 22 bp, Homo sapiens
atgtatcatgcagggtccatga

SEQ ID NO: 8292176 - DNA, 22 bp, Homo sapiens
atgtatcagaaatagcattggc

SEQ ID NO: 8292177 - DNA, 22 bp, Homo sapiens
atgtatcaattatctgtctgca

SEQ ID NO: 8292178 - DNA, 22 bp, Homo sapiens
atgtatcaacaaattgtacagt

SEQ ID NO: 8292179 - DNA, 22 bp, Homo sapiens
gaggttcacaggctatcacagt

SEQ ID NO: 8292180 - DNA, 22 bp, Homo sapiens
atgcttaactctgtacatagtt

SEQ ID NO: 8292181 - DNA, 22 bp, Homo sapiens
gagaaggtggacctgaaggagc

SEQ ID NO: 8292182 - DNA, 22 bp, Homo sapiens
atgctgtagatcttagcctcta

SEQ ID NO: 8292183 - DNA, 22 bp, Homo sapiens
gagctgcagcggctgacgcaac

SEQ ID NO: 8292184 - DNA, 22 bp, Homo sapiens
gagctgcactgggggtggaatg

SEQ ID NO: 8292185 - DNA, 22 bp, Homo sapiens
atgctatactcaaagaaattca

SEQ ID NO: 8292186 - DNA, 22 bp, Homo sapiens
atgctaaatggccagtaccaaa

SEQ ID NO: 8292187 - DNA, 22 bp, Homo sapiens
atgatgtgtgctgatcaagctt

SEQ ID NO: 8292188 - DNA, 22 bp, Homo sapiens
atgcagtaaatgttaagaaaaa

SEQ ID NO: 8292189 - DNA, 22 bp, Homo sapiens
atctttgaagaggacttgaagt

SEQ ID NO: 8292190 - DNA, 22 bp, Homo sapiens
ctttatgttcagtacaatgctt

SEQ ID NO: 8292191 - DNA, 22 bp, Homo sapiens
ctttatgttggggtgtcttagt

SEQ ID NO: 8292192 - DNA, 22 bp, Homo sapiens
atctttcaatcaggaaaaatct

SEQ ID NO: 8292193 - DNA, 22 bp, Homo sapiens
attgcacaaacacagtcagact

SEQ ID NO: 8292194 - DNA, 19 bp, Homo sapiens
gcatgcttggtggcttctg

SEQ ID NO: 8292195 - DNA, 20 bp, Homo sapiens
gcaggcagggaatgggggtg

SEQ ID NO: 8292196 - DNA, 15 bp, Homo sapiens
gcaggcaggtcacct

SEQ ID NO: 8292197 - DNA, 22 bp, Homo sapiens
gcaggcaggcttccttgaactg

SEQ ID NO: 8292198 - DNA, 22 bp, Homo sapiens
gcaggcaggagcccaactgcct

SEQ ID NO: 8292199 - DNA, 19 bp, Homo sapiens
gcaggcagctggggtatcc

SEQ ID NO: 8292200 - DNA, 22 bp, Homo sapiens
gcaggcaggaaggactaagtaa

SEQ ID NO: 8292201 - DNA, 19 bp, Homo sapiens
attcatttttgccttctaa

SEQ ID NO: 8292202 - DNA, 22 bp, Homo sapiens
gattcttacttctaagcaagct

SEQ ID NO: 8292203 - DNA, 22 bp, Homo sapiens
attatgtatttggtatagtttg

SEQ ID NO: 8292204 - DNA, 22 bp, Homo sapiens
attatgtaactgtggttcagca

SEQ ID NO: 8292205 - DNA, 22 bp, Homo sapiens
attatgtaggttaggtggttgt

SEQ ID NO: 8292206 - DNA, 22 bp, Homo sapiens
attatgtagctaaaaattgtgt

SEQ ID NO: 8292207 - DNA, 22 bp, Homo sapiens
attcaagtggctgctatgttaa

SEQ ID NO: 8292208 - DNA, 22 bp, Homo sapiens
gcagagactagtagtgcagact

SEQ ID NO: 8292209 - DNA, 22 bp, Homo sapiens
attatataggacttgcccttcc

SEQ ID NO: 8292210 - DNA, 22 bp, Homo sapiens
attaagatcattgtagaagatt

SEQ ID NO: 8292211 - DNA, 22 bp, Homo sapiens
atttagtttaggaaaagtaggt

SEQ ID NO: 8292212 - DNA, 22 bp, Homo sapiens
atttatcaccagttagctgact

SEQ ID NO: 8292213 - DNA, 22 bp, Homo sapiens
atttcttacataacaaattgtt

SEQ ID NO: 8292214 - DNA, 22 bp, Homo sapiens
caaaagatacttgcatctaact

SEQ ID NO: 8292215 - DNA, 22 bp, Homo sapiens
atttgtagtgaagtgaaaataa

SEQ ID NO: 8292216 - DNA, 22 bp, Homo sapiens
atttgtaatttcttatctgtgt

SEQ ID NO: 8292217 - DNA, 22 bp, Homo sapiens
aggcaggggagctggaagggta

SEQ ID NO: 8292218 - DNA, 19 bp, Homo sapiens
agctgcagaccagaagtgc

SEQ ID NO: 8292219 - DNA, 22 bp, Homo sapiens
agctgcaaagatgatttgttgt

SEQ ID NO: 8292220 - DNA, 22 bp, Homo sapiens
agctgcaaagatctgtcagtca

SEQ ID NO: 8292221 - DNA, 22 bp, Homo sapiens
agctgcaaaggcacacttgggc

SEQ ID NO: 8292222 - DNA, 20 bp, Homo sapiens
agctgcaacagactgtatgg

SEQ ID NO: 8292223 - DNA, 22 bp, Homo sapiens
agctgcaaaccaggccggcgcg

SEQ ID NO: 8292224 - DNA, 19 bp, Homo sapiens
agctgcaaaaggtggaact

SEQ ID NO: 8292225 - DNA, 21 bp, Homo sapiens
agctgcaaaaacatacagttc

SEQ ID NO: 8292226 - DNA, 22 bp, Homo sapiens
agctgcaaccttagctataggc

SEQ ID NO: 8292227 - DNA, 22 bp, Homo sapiens
agctgcaacatctgcttgtccc

SEQ ID NO: 8292228 - DNA, 23 bp, Homo sapiens
agctgcaagactccctgtctgag

SEQ ID NO: 8292229 - DNA, 22 bp, Homo sapiens
agctgcaagaagaggtccctga

SEQ ID NO: 8292230 - DNA, 22 bp, Homo sapiens
agctgcaactgtccttgccttg

SEQ ID NO: 8292231 - DNA, 22 bp, Homo sapiens
agctgcaagtgttgcctcctac

SEQ ID NO: 8292232 - DNA, 22 bp, Homo sapiens
agctgcaatacccttcttcctt

SEQ ID NO: 8292233 - DNA, 22 bp, Homo sapiens
agctgcaattaaagactgtgaa

SEQ ID NO: 8292234 - DNA, 22 bp, Homo sapiens
agctgcaattctggacatagtc

SEQ ID NO: 8292235 - DNA, 22 bp, Homo sapiens
agctgcaagtctgtgtggggag

SEQ ID NO: 8292236 - DNA, 22 bp, Homo sapiens
agctgcaagtccaaaggaatta

SEQ ID NO: 8292237 - DNA, 22 bp, Homo sapiens
agctgcaagtaagcttgctcct

SEQ ID NO: 8292238 - DNA, 14 bp, Homo sapiens
agctgcaagcatcc

SEQ ID NO: 8292239 - DNA, 22 bp, Homo sapiens
agctgcaagatttcttttgtat

SEQ ID NO: 8292240 - DNA, 22 bp, Homo sapiens
agctgcaagataaaagtgatgt

SEQ ID NO: 8292241 - DNA, 21 bp, Homo sapiens
agctgcaagagcaacatcttt

SEQ ID NO: 8292242 - DNA, 22 bp, Homo sapiens
caggccagggagaatatgaagc

SEQ ID NO: 8292243 - DNA, 22 bp, Homo sapiens
caggccagcttcctgacatcct

SEQ ID NO: 8292244 - DNA, 22 bp, Homo sapiens
catattaaggtctgtaaggggt

SEQ ID NO: 8292245 - DNA, 22 bp, Homo sapiens
catataaatacaacatgtgtta

SEQ ID NO: 8292246 - DNA, 22 bp, Homo sapiens
cagtttctacgacttaagcaca

SEQ ID NO: 8292247 - DNA, 22 bp, Homo sapiens
cagtttcagaatcaaaacatca

SEQ ID NO: 8292248 - DNA, 22 bp, Homo sapiens
cagtttctctcaataagcatcg

SEQ ID NO: 8292249 - DNA, 22 bp, Homo sapiens
cagtgcctggatagcaacatga

SEQ ID NO: 8292250 - DNA, 22 bp, Homo sapiens
cattaaatatcaacctagacta

SEQ ID NO: 8292251 - DNA, 22 bp, Homo sapiens
cattaaattccttgttctcaaa

SEQ ID NO: 8292252 - DNA, 22 bp, Homo sapiens
cattaaattccttgttctcaaa

SEQ ID NO: 8292253 - DNA, 20 bp, Homo sapiens
ccaataaagctctataggga

SEQ ID NO: 8292254 - DNA, 22 bp, Homo sapiens
catgtatagttggaactacatc

SEQ ID NO: 8292255 - DNA, 22 bp, Homo sapiens
catgtacattctgtagatggag

SEQ ID NO: 8292256 - DNA, 22 bp, Homo sapiens
agtcattttgccagtcttcagg

SEQ ID NO: 8292257 - DNA, 22 bp, Homo sapiens
agtcttaactatgcaagtacta

SEQ ID NO: 8292258 - DNA, 22 bp, Homo sapiens
agtcttaatagagaaaaactgt

SEQ ID NO: 8292259 - DNA, 22 bp, Homo sapiens
agtgcacaccttagtacaaagt

SEQ ID NO: 8292260 - DNA, 22 bp, Homo sapiens
agtgcacagcgtgatgtattgg

SEQ ID NO: 8292261 - DNA, 22 bp, Homo sapiens
ctcttaatgaccttaattcaag

SEQ ID NO: 8292262 - DNA, 19 bp, Homo sapiens
ctcttacagaatagacaca

SEQ ID NO: 8292263 - DNA, 22 bp, Homo sapiens
aggtatagaattgaaagggttt

SEQ ID NO: 8292264 - DNA, 22 bp, Homo sapiens
aggtattattagcatctctatt

SEQ ID NO: 8292265 - DNA, 22 bp, Homo sapiens
agtcataaagccagtgggaggc

SEQ ID NO: 8292266 - DNA, 22 bp, Homo sapiens
ctaaacaagggattataattga

SEQ ID NO: 8292267 - DNA, 22 bp, Homo sapiens
agtaatgtgcctgaaatacttg

SEQ ID NO: 8292268 - DNA, 22 bp, Homo sapiens
agtaatgtcccttaaatgtggt

SEQ ID NO: 8292269 - DNA, 22 bp, Homo sapiens
agtaataatttatattagggag

SEQ ID NO: 8292270 - DNA, 22 bp, Homo sapiens
aggttatatgtcatactgaagt

SEQ ID NO: 8292271 - DNA, 20 bp, Homo sapiens
ctgtatcaggttacaaagta

SEQ ID NO: 8292272 - DNA, 22 bp, Homo sapiens
atattttgaagttaataatgtg

SEQ ID NO: 8292273 - DNA, 22 bp, Homo sapiens
atatcacaaacaagtctgtact

SEQ ID NO: 8292274 - DNA, 22 bp, Homo sapiens
atatcaaagctagtggaaattt

SEQ ID NO: 8292275 - DNA, 22 bp, Homo sapiens
atcattactcctgtaaaattgt

SEQ ID NO: 8292276 - DNA, 22 bp, Homo sapiens
ctgtttattacactggatagca

SEQ ID NO: 8292277 - DNA, 22 bp, Homo sapiens
ctgtttatctaggagttgcagg

SEQ ID NO: 8292278 - DNA, 22 bp, Homo sapiens
ctgtttatccctttggtcagca

SEQ ID NO: 8292279 - DNA, 22 bp, Homo sapiens
cttcatcaactctaacaaatgt

SEQ ID NO: 8292280 - DNA, 22 bp, Homo sapiens
atctattatgctgagaaactgt

SEQ ID NO: 8292281 - DNA, 22 bp, Homo sapiens
cttcagaggggactcaaagtca

SEQ ID NO: 8292282 - DNA, 22 bp, Homo sapiens
agtttatgtagaattggcaata

SEQ ID NO: 8292283 - DNA, 22 bp, Homo sapiens
agtttatgtaaaattagtaatg

SEQ ID NO: 8292284 - DNA, 22 bp, Homo sapiens
agtgttcatttattcattcact

SEQ ID NO: 8292285 - DNA, 22 bp, Homo sapiens
agtgttagattcttactcagtt

SEQ ID NO: 8292286 - DNA, 22 bp, Homo sapiens
agtttcagttctgtcatttata

SEQ ID NO: 8292287 - DNA, 22 bp, Homo sapiens
ataataaaccaggatgggtctg

SEQ ID NO: 8292288 - DNA, 23 bp, Homo sapiens
ataataacgtctgtcttgtctct

SEQ ID NO: 8292289 - DNA, 22 bp, Homo sapiens
ataataacacctgaataggaaa

SEQ ID NO: 8292290 - DNA, 22 bp, Homo sapiens
ataagttcaggtaaagaaatca

SEQ ID NO: 8292291 - DNA, 22 bp, Homo sapiens
atagaaacagatgcacttctct

SEQ ID NO: 8292292 - DNA, 22 bp, Homo sapiens
atactttgggggttagtgtaga

SEQ ID NO: 8292293 - DNA, 21 bp, Homo sapiens
atactttgaattacagccttg

SEQ ID NO: 8292294 - DNA, 22 bp, Homo sapiens
atagaaatggcagctggtgcta

SEQ ID NO: 8292295 - DNA, 19 bp, Homo sapiens
atagaaagggttaaagaca

SEQ ID NO: 8292296 - DNA, 22 bp, Homo sapiens
atagtaactggcatgtttatga

SEQ ID NO: 8292297 - DNA, 22 bp, Homo sapiens
atagacattttgcattcaagca

SEQ ID NO: 8292298 - DNA, 22 bp, Homo sapiens
atacagaagaactatagccact

SEQ ID NO: 8292299 - DNA, 22 bp, Homo sapiens
ataatgtaggtatgtgtattta

SEQ ID NO: 8292300 - DNA, 22 bp, Homo sapiens
atacagaaaatgatgcagagtt

SEQ ID NO: 8292301 - DNA, 22 bp, Homo sapiens
ataatttacaactgcttttaat

SEQ ID NO: 8292302 - DNA, 22 bp, Homo sapiens
acagtttctccatttacacctt

SEQ ID NO: 8292303 - DNA, 22 bp, Homo sapiens
acatagaacttcgatgtctttt

SEQ ID NO: 8292304 - DNA, 22 bp, Homo sapiens
acagtaaatcaacagaatatct

SEQ ID NO: 8292305 - DNA, 18 bp, Homo sapiens
acagtaaagaaaggaatt

SEQ ID NO: 8292306 - DNA, 22 bp, Homo sapiens
acagtgtgtgggaaatgtgact

SEQ ID NO: 8292307 - DNA, 22 bp, Homo sapiens
acagtgtgacaattgtgtcaga

SEQ ID NO: 8292308 - DNA, 22 bp, Homo sapiens
acagtgtggggtgagatggaac

SEQ ID NO: 8292309 - DNA, 22 bp, Homo sapiens
aggacacaccaggtccagctgt

SEQ ID NO: 8292310 - DNA, 22 bp, Homo sapiens
acatgctttctaggtccttctg

SEQ ID NO: 8292311 - DNA, 22 bp, Homo sapiens
acatgcatacaagcacatgtag

SEQ ID NO: 8292312 - DNA, 22 bp, Homo sapiens
acatcagattatgctttgctta

SEQ ID NO: 8292313 - DNA, 22 bp, Homo sapiens
acatcagagggctcacatgatc

SEQ ID NO: 8292314 - DNA, 22 bp, Homo sapiens
acatttcttttcatctctatat

SEQ ID NO: 8292315 - DNA, 22 bp, Homo sapiens
acatttctttgctagacagcag

SEQ ID NO: 8292316 - DNA, 22 bp, Homo sapiens
acatttctttctattcagtagc

SEQ ID NO: 8292317 - DNA, 22 bp, Homo sapiens
acatttctcttagagttggact

SEQ ID NO: 8292318 - DNA, 22 bp, Homo sapiens
acatttcttcctaattatccct

SEQ ID NO: 8292319 - DNA, 22 bp, Homo sapiens
acatttcttgatgcctctgtga

SEQ ID NO: 8292320 - DNA, 18 bp, Homo sapiens
acatttctatgcttctgg

SEQ ID NO: 8292321 - DNA, 22 bp, Homo sapiens
acatttctatagtgcatctgtt

SEQ ID NO: 8292322 - DNA, 22 bp, Homo sapiens
acatttctatcatcctgtaatg

SEQ ID NO: 8292323 - DNA, 22 bp, Homo sapiens
acatttctagttgttcatctcc

SEQ ID NO: 8292324 - DNA, 22 bp, Homo sapiens
acatttctaatttaatgtaaca

SEQ ID NO: 8292325 - DNA, 18 bp, Homo sapiens
acatttctaggtgaaagc

SEQ ID NO: 8292326 - DNA, 22 bp, Homo sapiens
agtatacatatattagccttcg

SEQ ID NO: 8292327 - DNA, 22 bp, Homo sapiens
agtaaaaattgaggtgcaaaat

SEQ ID NO: 8292328 - DNA, 22 bp, Homo sapiens
agtaaacactaaaatgactgcg

SEQ ID NO: 8292329 - DNA, 22 bp, Homo sapiens
agtaaaatttctgctgaggaga

SEQ ID NO: 8292330 - DNA, 22 bp, Homo sapiens
actgcagaggtggggtgcagag

SEQ ID NO: 8292331 - DNA, 22 bp, Homo sapiens
agtgtacatgtttacagcatct

SEQ ID NO: 8292332 - DNA, 22 bp, Homo sapiens
agtgtttagcatgaagttcatt

SEQ ID NO: 8292333 - DNA, 22 bp, Homo sapiens
agtgtttatattatggaaatat

SEQ ID NO: 8292334 - DNA, 22 bp, Homo sapiens
agtgtttaccccaatcagttta

SEQ ID NO: 8292335 - DNA, 22 bp, Homo sapiens
agtgtttaaactgaagtgatga

SEQ ID NO: 8292336 - DNA, 22 bp, Homo sapiens
atatgaaagtaagcatgtgtgt

SEQ ID NO: 8292337 - DNA, 22 bp, Homo sapiens
atatgaaagtaagcatgtgtgt

SEQ ID NO: 8292338 - DNA, 22 bp, Homo sapiens
atattcttccaaaacatcattt

SEQ ID NO: 8292339 - DNA, 21 bp, Homo sapiens
agaaaagtagagttttcagag

SEQ ID NO: 8292340 - DNA, 22 bp, Homo sapiens
atcatcttcgaaaaaagtcaga

SEQ ID NO: 8292341 - DNA, 22 bp, Homo sapiens
atctaagagttaacatcaagaa

SEQ ID NO: 8292342 - DNA, 22 bp, Homo sapiens
atctaagatgtattgagcactt

SEQ ID NO: 8292343 - DNA, 22 bp, Homo sapiens
atctaaagtgtttcatgaaaga

SEQ ID NO: 8292344 - DNA, 22 bp, Homo sapiens
agaacagatgtgggcagacctg

SEQ ID NO: 8292345 - DNA, 22 bp, Homo sapiens
agaacagaggccttatgtttca

SEQ ID NO: 8292346 - DNA, 22 bp, Homo sapiens
agaacagaagggaggaaggcct

SEQ ID NO: 8292347 - DNA, 22 bp, Homo sapiens
agaaagttctgtgagttgttca

SEQ ID NO: 8292348 - DNA, 22 bp, Homo sapiens
agaaagttcactggtatatttt

SEQ ID NO: 8292349 - DNA, 22 bp, Homo sapiens
ataaaatgtctccactgggctc

SEQ ID NO: 8292350 - DNA, 22 bp, Homo sapiens
ataaaatggtaaacgaagctga

SEQ ID NO: 8292351 - DNA, 22 bp, Homo sapiens
ataaaatttgctactgttaaat

SEQ ID NO: 8292352 - DNA, 22 bp, Homo sapiens
actgtgcacaattctaagtcct

SEQ ID NO: 8292353 - DNA, 22 bp, Homo sapiens
actgtgcaatgagtaataaact

SEQ ID NO: 8292354 - DNA, 22 bp, Homo sapiens
ataaacagtagagaaaggtggt

SEQ ID NO: 8292355 - DNA, 22 bp, Homo sapiens
ataaacagtagagaaaggtggt

SEQ ID NO: 8292356 - DNA, 22 bp, Homo sapiens
ataaacagctccatttagtgcc

SEQ ID NO: 8292357 - DNA, 22 bp, Homo sapiens
actgtgcatgaaccgaaacaaa

SEQ ID NO: 8292358 - DNA, 22 bp, Homo sapiens
actgtactgtgtattgtagaat

SEQ ID NO: 8292359 - DNA, 22 bp, Homo sapiens
atactgaattaggtaaagcata

SEQ ID NO: 8292360 - DNA, 22 bp, Homo sapiens
atactgtaatacctaaatgaac

SEQ ID NO: 8292361 - DNA, 22 bp, Homo sapiens
acttagaacaggcagaattcca

SEQ ID NO: 8292362 - DNA, 22 bp, Homo sapiens
cagaatatgacaagattttcct

SEQ ID NO: 8292363 - DNA, 22 bp, Homo sapiens
cagaatgcaaattttataatat

SEQ ID NO: 8292364 - DNA, 22 bp, Homo sapiens
cagacatatccctgctccctta

SEQ ID NO: 8292365 - DNA, 22 bp, Homo sapiens
cagacatatgttttaacagatt

SEQ ID NO: 8292366 - DNA, 22 bp, Homo sapiens
agcatatacaaactcatataca

SEQ ID NO: 8292367 - DNA, 18 bp, Homo sapiens
cagaaatcacaccagcac

SEQ ID NO: 8292368 - DNA, 22 bp, Homo sapiens
cagaggtattgcaaaagcctag

SEQ ID NO: 8292369 - DNA, 22 bp, Homo sapiens
caaaagtctgtcctttaacttc

SEQ ID NO: 8292370 - DNA, 22 bp, Homo sapiens
caacagaaggaagcagggtcag

SEQ ID NO: 8292371 - DNA, 22 bp, Homo sapiens
caaatatctttggcaaagagaa

SEQ ID NO: 8292372 - DNA, 22 bp, Homo sapiens
caacagaaggtgtactactgaa

SEQ ID NO: 8292373 - DNA, 22 bp, Homo sapiens
agcacattcttgccttaacctc

SEQ ID NO: 8292374 - DNA, 22 bp, Homo sapiens
cacaagaaataagctgcctttc

SEQ ID NO: 8292375 - DNA, 22 bp, Homo sapiens
attcagtaggtctagaataaga

SEQ ID NO: 8292376 - DNA, 22 bp, Homo sapiens
attcattagccactaactagca

SEQ ID NO: 8292377 - DNA, 22 bp, Homo sapiens
attccagttctcctctctaaag

SEQ ID NO: 8292378 - DNA, 22 bp, Homo sapiens
attgcagctggtcagggtaatt

SEQ ID NO: 8292379 - DNA, 22 bp, Homo sapiens
attattcaacacttgagaaatt

SEQ ID NO: 8292380 - DNA, 22 bp, Homo sapiens
atgtgtatacttgtgcttactc

SEQ ID NO: 8292381 - DNA, 22 bp, Homo sapiens
atgtgtaggtgaatcgaggctg

SEQ ID NO: 8292382 - DNA, 22 bp, Homo sapiens
atgtgtagaactgtaatgccca

SEQ ID NO: 8292383 - DNA, 22 bp, Homo sapiens
agataaattcctaagatttcag

SEQ ID NO: 8292384 - DNA, 22 bp, Homo sapiens
agaggtcagaacaggaaagtgt

SEQ ID NO: 8292385 - DNA, 22 bp, Homo sapiens
agaggtcatatctcagaagaga

SEQ ID NO: 8292386 - DNA, 22 bp, Homo sapiens
caaaagcagttctatctgagtt

SEQ ID NO: 8292387 - DNA, 22 bp, Homo sapiens
atgtgtacaaccaagcactaaa

SEQ ID NO: 8292388 - DNA, 22 bp, Homo sapiens
atgaacaataatcatgtctatg

SEQ ID NO: 8292389 - DNA, 21 bp, Homo sapiens
agaagtcaattgaactgaaat

SEQ ID NO: 8292390 - DNA, 22 bp, Homo sapiens
agaagtcaatagttgtttgatg

SEQ ID NO: 8292391 - DNA, 22 bp, Homo sapiens
agaagtcaagtggtctatgaaa

SEQ ID NO: 8292392 - DNA, 22 bp, Homo sapiens
atgcacgccccacactggtgtg

SEQ ID NO: 8292393 - DNA, 22 bp, Homo sapiens
atgcacccagtgtctggactat

SEQ ID NO: 8292394 - DNA, 22 bp, Homo sapiens
agacatttattgaacacctagc

SEQ ID NO: 8292395 - DNA, 22 bp, Homo sapiens
agacatttggaagatacacata

SEQ ID NO: 8292396 - DNA, 22 bp, Homo sapiens
aaagacattagattaacgtaca

SEQ ID NO: 8292397 - DNA, 22 bp, Homo sapiens
aaagacattagattaacgtaca

SEQ ID NO: 8292398 - DNA, 22 bp, Homo sapiens
aaagacattagcttagatgtca

SEQ ID NO: 8292399 - DNA, 22 bp, Homo sapiens
aaagacattagcttagatgtca

SEQ ID NO: 8292400 - DNA, 22 bp, Homo sapiens
aaagacattgaagaaggactta

SEQ ID NO: 8292401 - DNA, 22 bp, Homo sapiens
aaaatcctgctgactcgagatg

SEQ ID NO: 8292402 - DNA, 22 bp, Homo sapiens
aaagacatggaactagagatgg

SEQ ID NO: 8292403 - DNA, 22 bp, Homo sapiens
aaagacatggaactagagatgg

SEQ ID NO: 8292404 - DNA, 22 bp, Homo sapiens
aaagacatggaactagagatgg

SEQ ID NO: 8292405 - DNA, 22 bp, Homo sapiens
aaaagtattggccaccatttct

SEQ ID NO: 8292406 - DNA, 20 bp, Homo sapiens
aaaaacagtaatgctgaaga

SEQ ID NO: 8292407 - DNA, 22 bp, Homo sapiens
aaacagaagggtaggtaaacat

SEQ ID NO: 8292408 - DNA, 22 bp, Homo sapiens
aaacagactgcactgccagtca

SEQ ID NO: 8292409 - DNA, 22 bp, Homo sapiens
aaacagaaatttcctcatgctc

SEQ ID NO: 8292410 - DNA, 22 bp, Homo sapiens
aaaatgacattccagtgatatt

SEQ ID NO: 8292411 - DNA, 22 bp, Homo sapiens
aaaatgacattccagtgatatt

SEQ ID NO: 8292412 - DNA, 22 bp, Homo sapiens
aaaaatagcttctcttgtccct

SEQ ID NO: 8292413 - DNA, 22 bp, Homo sapiens
aaaaataggtcaaccgtgtatg

SEQ ID NO: 8292414 - DNA, 22 bp, Homo sapiens
aaaaatcacttttataggcagc

SEQ ID NO: 8292415 - DNA, 22 bp, Homo sapiens
aaatgcagcagctaattgaaaa

SEQ ID NO: 8292416 - DNA, 22 bp, Homo sapiens
aaatgcagattgtcattcagga

SEQ ID NO: 8292417 - DNA, 22 bp, Homo sapiens
aaatgcagattttgatgcagca

SEQ ID NO: 8292418 - DNA, 22 bp, Homo sapiens
aaatgcagatccctgaatctca

SEQ ID NO: 8292419 - DNA, 22 bp, Homo sapiens
aaatgcaccttgctgtgagact

SEQ ID NO: 8292420 - DNA, 22 bp, Homo sapiens
aaatgcactctgcttctgtgac

SEQ ID NO: 8292421 - DNA, 22 bp, Homo sapiens
aaatgcactgaacacatgttgt

SEQ ID NO: 8292422 - DNA, 21 bp, Homo sapiens
aaagaggttaatattgtaagt

SEQ ID NO: 8292423 - DNA, 22 bp, Homo sapiens
aaactctggagatgtttatgca

SEQ ID NO: 8292424 - DNA, 21 bp, Homo sapiens
aaagaacaggcagatgttctt

SEQ ID NO: 8292425 - DNA, 22 bp, Homo sapiens
aaagaacatcggagtgggcggg

SEQ ID NO: 8292426 - DNA, 22 bp, Homo sapiens
aaactgataaaataagtacatt

SEQ ID NO: 8292427 - DNA, 22 bp, Homo sapiens
aaagaatttgtacaccctacta

SEQ ID NO: 8292428 - DNA, 22 bp, Homo sapiens
aaaggtagtacttctagaaggg

SEQ ID NO: 8292429 - DNA, 22 bp, Homo sapiens
aaagttactatcacaatgaaat

SEQ ID NO: 8292430 - DNA, 22 bp, Homo sapiens
aaagttagaatgatatcaacga

SEQ ID NO: 8292431 - DNA, 22 bp, Homo sapiens
aaagttcagattagactcaaga

SEQ ID NO: 8292432 - DNA, 22 bp, Homo sapiens
aaagttcagtgccttctataca

SEQ ID NO: 8292433 - DNA, 22 bp, Homo sapiens
aaagttcatggtgttatagaaa

SEQ ID NO: 8292434 - DNA, 21 bp, Homo sapiens
aaagttcatgctttaatattc

SEQ ID NO: 8292435 - DNA, 22 bp, Homo sapiens
aaagatatgtctccaaagagat

SEQ ID NO: 8292436 - DNA, 22 bp, Homo sapiens
aaagccatcagtaaaatgattt

SEQ ID NO: 8292437 - DNA, 22 bp, Homo sapiens
aaagccataagcctaatactaa

SEQ ID NO: 8292438 - DNA, 22 bp, Homo sapiens
aaattgtgctcacactgatatt

SEQ ID NO: 8292439 - DNA, 22 bp, Homo sapiens
aaattgtgagctatagatctag

SEQ ID NO: 8292440 - DNA, 22 bp, Homo sapiens
aaattgtggcgtctgtaagagt

SEQ ID NO: 8292441 - DNA, 22 bp, Homo sapiens
aaagctgccctacacggaagca

SEQ ID NO: 8292442 - DNA, 22 bp, Homo sapiens
aaagctgcccagctgcctgttt

SEQ ID NO: 8292443 - DNA, 22 bp, Homo sapiens
aaagctgcaagctcctgaggaa

SEQ ID NO: 8292444 - DNA, 22 bp, Homo sapiens
aaagctgccaaggagaatacta

SEQ ID NO: 8292445 - DNA, 22 bp, Homo sapiens
aaagctgctttggtttctggaa

SEQ ID NO: 8292446 - DNA, 22 bp, Homo sapiens
aaagctgctttaaacatctatg

SEQ ID NO: 8292447 - DNA, 22 bp, Homo sapiens
aaagctgctgtgaatggtttgg

SEQ ID NO: 8292448 - DNA, 22 bp, Homo sapiens
aaagctgctgccaatcaggctt

SEQ ID NO: 8292449 - DNA, 22 bp, Homo sapiens
aaagctgctatgaacattctat

SEQ ID NO: 8292450 - DNA, 22 bp, Homo sapiens
aaagctgcccttgtgaaacaag

SEQ ID NO: 8292451 - DNA, 22 bp, Homo sapiens
aaagccatgaatgttatagagg

SEQ ID NO: 8292452 - DNA, 22 bp, Homo sapiens
aaagccatctgtattaagtgaa

SEQ ID NO: 8292453 - DNA, 22 bp, Homo sapiens
aaaggttagttcttagaagtgc

SEQ ID NO: 8292454 - DNA, 22 bp, Homo sapiens
aaaggtttgcatggaatttacc

SEQ ID NO: 8292455 - DNA, 22 bp, Homo sapiens
aactaaatctggcatttagagc

SEQ ID NO: 8292456 - DNA, 22 bp, Homo sapiens
aactaaatctggcatttagagc

SEQ ID NO: 8292457 - DNA, 22 bp, Homo sapiens
aactaacagtcattaaaagaac

SEQ ID NO: 8292458 - DNA, 22 bp, Homo sapiens
aactaacagtcattaaaagaac

SEQ ID NO: 8292459 - DNA, 22 bp, Homo sapiens
aaagtggtttatgatattccaa

SEQ ID NO: 8292460 - DNA, 22 bp, Homo sapiens
aaagtggttgctgtcagcctct

SEQ ID NO: 8292461 - DNA, 22 bp, Homo sapiens
aaagtggtttcccagttcagta

SEQ ID NO: 8292462 - DNA, 22 bp, Homo sapiens
aaagtggtttttcagactttga

SEQ ID NO: 8292463 - DNA, 21 bp, Homo sapiens
aaagtggtaaggattattttg

SEQ ID NO: 8292464 - DNA, 22 bp, Homo sapiens
aaagtggtcaccttctcatttc

SEQ ID NO: 8292465 - DNA, 22 bp, Homo sapiens
aaagtggtcaccttctcatttc

SEQ ID NO: 8292466 - DNA, 22 bp, Homo sapiens
aaagtggtctgcatcccttctg

SEQ ID NO: 8292467 - DNA, 22 bp, Homo sapiens
aaagtggttcttacatccgtgg

SEQ ID NO: 8292468 - DNA, 22 bp, Homo sapiens
aaagtggtgggcgaactcatca

SEQ ID NO: 8292469 - DNA, 21 bp, Homo sapiens
aaagtggtaaggattattttg

SEQ ID NO: 8292470 - DNA, 22 bp, Homo sapiens
aaagtgtaaaagcatgttaggg

SEQ ID NO: 8292471 - DNA, 20 bp, Homo sapiens
aaagtgtaagcatataatta

SEQ ID NO: 8292472 - DNA, 22 bp, Homo sapiens
aaagtgtaaggaatttaagtaa

SEQ ID NO: 8292473 - DNA, 22 bp, Homo sapiens
aaagtgtactatgtcatgaaca

SEQ ID NO: 8292474 - DNA, 22 bp, Homo sapiens
aaagtgtactatgtcatgaaca

SEQ ID NO: 8292475 - DNA, 22 bp, Homo sapiens
aaagtgtagagactttggaacc

SEQ ID NO: 8292476 - DNA, 22 bp, Homo sapiens
aaatgtagtatgttgcatgtat

SEQ ID NO: 8292477 - DNA, 18 bp, Homo sapiens
aaatgtactgtccatggc

SEQ ID NO: 8292478 - DNA, 22 bp, Homo sapiens
aaatgtagacctatagggacct

SEQ ID NO: 8292479 - DNA, 22 bp, Homo sapiens
aaatgcacaggttttaaatcct

SEQ ID NO: 8292480 - DNA, 22 bp, Homo sapiens
aaatgcaggaaattatgctttt

SEQ ID NO: 8292481 - DNA, 22 bp, Homo sapiens
aaatgcaggtagtatttatttt

SEQ ID NO: 8292482 - DNA, 23 bp, Homo sapiens
aaatgcagggtcgcaggttacag

SEQ ID NO: 8292483 - DNA, 22 bp, Homo sapiens
aagcatcaacctgtatgctgca

SEQ ID NO: 8292484 - DNA, 22 bp, Homo sapiens
aaatgcatcagctcataagaga

SEQ ID NO: 8292485 - DNA, 22 bp, Homo sapiens
aaatgcatatcaaagacttgaa

SEQ ID NO: 8292486 - DNA, 22 bp, Homo sapiens
aaatccttttctatacagcata

SEQ ID NO: 8292487 - DNA, 22 bp, Homo sapiens
aaatcctttggaggacatgatg

SEQ ID NO: 8292488 - DNA, 23 bp, Homo sapiens
aaataggagtatctggatcatga

SEQ ID NO: 8292489 - DNA, 22 bp, Homo sapiens
aaataggagcttaagcacttct

SEQ ID NO: 8292490 - DNA, 22 bp, Homo sapiens
aaatagcataaaataggaagct

SEQ ID NO: 8292491 - DNA, 22 bp, Homo sapiens
aaatactgtagataatagagtt

SEQ ID NO: 8292492 - DNA, 22 bp, Homo sapiens
aaatagacacttggacagacaa

SEQ ID NO: 8292493 - DNA, 22 bp, Homo sapiens
aaatagatttaacatccatccc

SEQ ID NO: 8292494 - DNA, 22 bp, Homo sapiens
aaatagattgctgaggcattac

SEQ ID NO: 8292495 - DNA, 21 bp, Homo sapiens
aaagtgttcagaccagttctg

SEQ ID NO: 8292496 - DNA, 23 bp, Homo sapiens
aaagtgtagccaggttaagaacc

SEQ ID NO: 8292497 - DNA, 23 bp, Homo sapiens
aaagtgtagccaggttaagaacc

SEQ ID NO: 8292498 - DNA, 22 bp, Homo sapiens
aaagtgtggagattgaactaaa

SEQ ID NO: 8292499 - DNA, 22 bp, Homo sapiens
aaataacttatgatcgtctggc

SEQ ID NO: 8292500 - DNA, 22 bp, Homo sapiens
aaagtgttgggattacaggtgt

SEQ ID NO: 8292501 - DNA, 22 bp, Homo sapiens
aaataattatagcgagtctatc

SEQ ID NO: 8292502 - DNA, 22 bp, Homo sapiens
aaataatgttaggcctttgctc

SEQ ID NO: 8292503 - DNA, 22 bp, Homo sapiens
aaataacttggtttcatcagag

SEQ ID NO: 8292504 - DNA, 21 bp, Homo sapiens
aacaaagggatgctcatcttt

SEQ ID NO: 8292505 - DNA, 22 bp, Homo sapiens
aaattcttcaggtaattttgat

SEQ ID NO: 8292506 - DNA, 22 bp, Homo sapiens
aaattgcaaaagtacttttagg

SEQ ID NO: 8292507 - DNA, 22 bp, Homo sapiens
aaattgaatttgggaaacattg

SEQ ID NO: 8292508 - DNA, 21 bp, Homo sapiens
aaatgtgttccataatgcttt

SEQ ID NO: 8292509 - DNA, 22 bp, Homo sapiens
aaatgtgtgtatgtacatatat

SEQ ID NO: 8292510 - DNA, 22 bp, Homo sapiens
aaatgtgtcatattcaaagtca

SEQ ID NO: 8292511 - DNA, 22 bp, Homo sapiens
aaatgtgtgcacaaagacagct

SEQ ID NO: 8292512 - DNA, 22 bp, Homo sapiens
aaatgtgcttgtgatcagctgt

SEQ ID NO: 8292513 - DNA, 22 bp, Homo sapiens
aaatgtgtatatgaaacatgat

SEQ ID NO: 8292514 - DNA, 22 bp, Homo sapiens
aaatgtgtcagtttcattctct

SEQ ID NO: 8292515 - DNA, 22 bp, Homo sapiens
aaatgtctatctggcatattcc

SEQ ID NO: 8292516 - DNA, 22 bp, Homo sapiens
aaatgtgtttctttgtgaatgg

SEQ ID NO: 8292517 - DNA, 22 bp, Homo sapiens
aaatgtgtttgataggaatatt

SEQ ID NO: 8292518 - DNA, 22 bp, Homo sapiens
aaatgttaggttgtactgagtc

SEQ ID NO: 8292519 - DNA, 22 bp, Homo sapiens
aaatgtgttcctttgctacaga

SEQ ID NO: 8292520 - DNA, 22 bp, Homo sapiens
aaatgtgtttagatggtttatt

SEQ ID NO: 8292521 - DNA, 22 bp, Homo sapiens
aaatgtgtttcgaaaactggtg

SEQ ID NO: 8292522 - DNA, 22 bp, Homo sapiens
aacacatagacgtttgatatca

SEQ ID NO: 8292523 - DNA, 22 bp, Homo sapiens
aacaaatgtaaaatgcagatgc

SEQ ID NO: 8292524 - DNA, 22 bp, Homo sapiens
aacaaatgataccagttctcaa

SEQ ID NO: 8292525 - DNA, 22 bp, Homo sapiens
aacaaatgattgttggttggag

SEQ ID NO: 8292526 - DNA, 22 bp, Homo sapiens
aacaaatggggccttgtatgaa

SEQ ID NO: 8292527 - DNA, 22 bp, Homo sapiens
aacaaatggaacacaaatcttt

SEQ ID NO: 8292528 - DNA, 22 bp, Homo sapiens
aacaaatgacctgatttcttcc

SEQ ID NO: 8292529 - DNA, 22 bp, Homo sapiens
aacactgacgacgtgaactaaa

SEQ ID NO: 8292530 - DNA, 22 bp, Homo sapiens
aacagcatgctgggtaacattg

SEQ ID NO: 8292531 - DNA, 22 bp, Homo sapiens
aagtcattggtagcttgatagg

SEQ ID NO: 8292532 - DNA, 22 bp, Homo sapiens
aacttaaacccactcatgtaga

SEQ ID NO: 8292533 - DNA, 21 bp, Homo sapiens
aactgctggtcttttctgtct

SEQ ID NO: 8292534 - DNA, 20 bp, Homo sapiens
aatataattctctgaattta

SEQ ID NO: 8292535 - DNA, 22 bp, Homo sapiens
aactgcattgtactaaacttgt

SEQ ID NO: 8292536 - DNA, 22 bp, Homo sapiens
aactgcataatatatcatgcag

SEQ ID NO: 8292537 - DNA, 22 bp, Homo sapiens
aacatgtaaatatcattgtact

SEQ ID NO: 8292538 - DNA, 22 bp, Homo sapiens
aataagaaagagtcagcttcag

SEQ ID NO: 8292539 - DNA, 21 bp, Homo sapiens
aacatttcaggatccaaattg

SEQ ID NO: 8292540 - DNA, 22 bp, Homo sapiens
aaccaccattctctcctcttcc

SEQ ID NO: 8292541 - DNA, 22 bp, Homo sapiens
aatagtgttgttcactcaggag

SEQ ID NO: 8292542 - DNA, 18 bp, Homo sapiens
aacatgcattagaactgc

SEQ ID NO: 8292543 - DNA, 22 bp, Homo sapiens
aagacatacagacagtgagcca

SEQ ID NO: 8292544 - DNA, 22 bp, Homo sapiens
aagagctggatggaatctggga

SEQ ID NO: 8292545 - DNA, 22 bp, Homo sapiens
aattgtaactacattgagaaca

SEQ ID NO: 8292546 - DNA, 22 bp, Homo sapiens
aagacagtgacagtcacaattg

SEQ ID NO: 8292547 - DNA, 22 bp, Homo sapiens
aagacagtgatctctgagagat

SEQ ID NO: 8292548 - DNA, 23 bp, Homo sapiens
aagaataaatgacattaaaggtg

SEQ ID NO: 8292549 - DNA, 22 bp, Homo sapiens
aagaaatattgggccttataaa

SEQ ID NO: 8292550 - DNA, 22 bp, Homo sapiens
aagaaatattgggccttataaa

SEQ ID NO: 8292551 - DNA, 18 bp, Homo sapiens
aacttcaactacaatgga

SEQ ID NO: 8292552 - DNA, 18 bp, Homo sapiens
aacttcaactacaatgga

SEQ ID NO: 8292553 - DNA, 22 bp, Homo sapiens
aagaaatgcagaaatgtgctgg

SEQ ID NO: 8292554 - DNA, 22 bp, Homo sapiens
aagcatcaacactatattgatg

SEQ ID NO: 8292555 - DNA, 22 bp, Homo sapiens
aagcatttatagataagaattt

SEQ ID NO: 8292556 - DNA, 22 bp, Homo sapiens
aagcatttgtgaaattcagatg

SEQ ID NO: 8292557 - DNA, 22 bp, Homo sapiens
aagcatttggttctgaagactc

SEQ ID NO: 8292558 - DNA, 22 bp, Homo sapiens
acagaattgatggaaatctcag

SEQ ID NO: 8292559 - DNA, 22 bp, Homo sapiens
acagaattgaaagtataatctg

SEQ ID NO: 8292560 - DNA, 22 bp, Homo sapiens
acagaattctagtatgtggctt

SEQ ID NO: 8292561 - DNA, 22 bp, Homo sapiens
acagaattctctctgcagaggc

SEQ ID NO: 8292562 - DNA, 22 bp, Homo sapiens
acagaattatcaggaaatgtta

SEQ ID NO: 8292563 - DNA, 17 bp, Homo sapiens
acagaggttatacagac

SEQ ID NO: 8292564 - DNA, 22 bp, Homo sapiens
acagaggtgtgtgtaggacagt

SEQ ID NO: 8292565 - DNA, 22 bp, Homo sapiens
acagaggtgttccagacctagg

SEQ ID NO: 8292566 - DNA, 22 bp, Homo sapiens
aagatttagggccagtttacat

SEQ ID NO: 8292567 - DNA, 22 bp, Homo sapiens
aagatttactagcataatagct

SEQ ID NO: 8292568 - DNA, 22 bp, Homo sapiens
acactgctcacttcttcccttg

SEQ ID NO: 8292569 - DNA, 22 bp, Homo sapiens
aagatttaccactttattcaag

SEQ ID NO: 8292570 - DNA, 22 bp, Homo sapiens
acagattgatcttgagaattat

SEQ ID NO: 8292571 - DNA, 22 bp, Homo sapiens
agctagttcagagagatatgta

SEQ ID NO: 8292572 - DNA, 23 bp, Homo sapiens
acagaggtccaaacagtataagc

SEQ ID NO: 8292573 - DNA, 22 bp, Homo sapiens
acacattatctcattaaatact

SEQ ID NO: 8292574 - DNA, 19 bp, Homo sapiens
acagaaatgtaagtgagac

SEQ ID NO: 8292575 - DNA, 22 bp, Homo sapiens
acagaaattgggcaaatggaag

SEQ ID NO: 8292576 - DNA, 19 bp, Homo sapiens
acagaaattagttattttc

SEQ ID NO: 8292577 - DNA, 22 bp, Homo sapiens
acagaaattagcagtgagttta

SEQ ID NO: 8292578 - DNA, 22 bp, Homo sapiens
acagaaattctgggacagaaaa

SEQ ID NO: 8292579 - DNA, 23 bp, Homo sapiens
acacatatattcagatacagatg

SEQ ID NO: 8292580 - DNA, 22 bp, Homo sapiens
acacataagaaactacaaagag

SEQ ID NO: 8292581 - DNA, 22 bp, Homo sapiens
acacataagaaactacaaagag

SEQ ID NO: 8292582 - DNA, 22 bp, Homo sapiens
acaattctgggtatttatatag

SEQ ID NO: 8292583 - DNA, 19 bp, Homo sapiens
acaagtcacttacttagta

SEQ ID NO: 8292584 - DNA, 18 bp, Homo sapiens
acaaatgtagtgtcttaa

SEQ ID NO: 8292585 - DNA, 22 bp, Homo sapiens
acaaatgtggacatggataatg

SEQ ID NO: 8292586 - DNA, 22 bp, Homo sapiens
acaattctctcatatcttatta

SEQ ID NO: 8292587 - DNA, 22 bp, Homo sapiens
acaaactacctacagatgttca

SEQ ID NO: 8292588 - DNA, 23 bp, Homo sapiens
acaaatgcccatacatctagttc

SEQ ID NO: 8292589 - DNA, 22 bp, Homo sapiens
acaaatgcttagttcaccaaaa

SEQ ID NO: 8292590 - DNA, 22 bp, Homo sapiens
acaaatgccatatataaattct

SEQ ID NO: 8292591 - DNA, 22 bp, Homo sapiens
acaaatgcagcataaagtgaac

SEQ ID NO: 8292592 - DNA, 20 bp, Homo sapiens
acaaatgcattctgtgacat

SEQ ID NO: 8292593 - DNA, 22 bp, Homo sapiens
acaaatgcaagttttatgtcaa

SEQ ID NO: 8292594 - DNA, 22 bp, Homo sapiens
acaaaattacctagttattttc

SEQ ID NO: 8292595 - DNA, 22 bp, Homo sapiens
acaaaattgtgttaaactttat

SEQ ID NO: 8292596 - DNA, 22 bp, Homo sapiens
agaggccaggtccagagtttgt

SEQ ID NO: 8292597 - DNA, 22 bp, Homo sapiens
aatttagattgataaacatgga

SEQ ID NO: 8292598 - DNA, 22 bp, Homo sapiens
aatttatatgtaattaggcaca

SEQ ID NO: 8292599 - DNA, 22 bp, Homo sapiens
aatttagaattcgctagctaat

SEQ ID NO: 8292600 - DNA, 20 bp, Homo sapiens
aatttactcacagaatgaat

SEQ ID NO: 8292601 - DNA, 22 bp, Homo sapiens
aatgttcaaacagatcacttag

SEQ ID NO: 8292602 - DNA, 22 bp, Homo sapiens
aatgttcagtagaataggaatg

SEQ ID NO: 8292603 - DNA, 22 bp, Homo sapiens
aatgttcattgattaaatgaat

SEQ ID NO: 8292604 - DNA, 22 bp, Homo sapiens
aatgttgtttttctgcatgtct

SEQ ID NO: 8292605 - DNA, 22 bp, Homo sapiens
aatgtctgagtctctgtatccc

SEQ ID NO: 8292606 - DNA, 22 bp, Homo sapiens
aatgtctgcctgaactttatat

SEQ ID NO: 8292607 - DNA, 22 bp, Homo sapiens
aatgtcttcagtgtatacatgg

SEQ ID NO: 8292608 - DNA, 22 bp, Homo sapiens
aagctgcaggttgaatccaggt

SEQ ID NO: 8292609 - DNA, 22 bp, Homo sapiens
aagctgcatgaagttgagtaga

SEQ ID NO: 8292610 - DNA, 22 bp, Homo sapiens
aagctgcagcacagagaggtgg

SEQ ID NO: 8292611 - DNA, 22 bp, Homo sapiens
aagctgcactacttgagggacc

SEQ ID NO: 8292612 - DNA, 22 bp, Homo sapiens
aagctgcagaccccctgtctca

SEQ ID NO: 8292613 - DNA, 22 bp, Homo sapiens
aagctgcagatgtgcctgtgga

SEQ ID NO: 8292614 - DNA, 22 bp, Homo sapiens
aagctgcaaaaaatttctgtct

SEQ ID NO: 8292615 - DNA, 22 bp, Homo sapiens
aagctgcaaggaagtgtgccag

SEQ ID NO: 8292616 - DNA, 22 bp, Homo sapiens
acatgtgtatagcctgtataga

SEQ ID NO: 8292617 - DNA, 22 bp, Homo sapiens
aaggcataggacaaatcagtga

SEQ ID NO: 8292618 - DNA, 22 bp, Homo sapiens
aaggcataggacaaatcagtga

SEQ ID NO: 8292619 - DNA, 22 bp, Homo sapiens
aaggctgcctctgccagaggag

SEQ ID NO: 8292620 - DNA, 22 bp, Homo sapiens
aagtacatgctgtaatgattgg

SEQ ID NO: 8292621 - DNA, 22 bp, Homo sapiens
aagtacatgttgttcaaaagcc

SEQ ID NO: 8292622 - DNA, 22 bp, Homo sapiens
aagtacatgttgctcaacagcc

SEQ ID NO: 8292623 - DNA, 23 bp, Homo sapiens
aagtacatatatttagatagtga

SEQ ID NO: 8292624 - DNA, 23 bp, Homo sapiens
aagtaacagggataatagcagtt

SEQ ID NO: 8292625 - DNA, 22 bp, Homo sapiens
aatacaatcaaattcactagca

SEQ ID NO: 8292626 - DNA, 22 bp, Homo sapiens
aatacaatcaaattcactagca

SEQ ID NO: 8292627 - DNA, 22 bp, Homo sapiens
aatgaacaggtgaatgtcagat

SEQ ID NO: 8292628 - DNA, 22 bp, Homo sapiens
aatgaacatcaaatgcctacca

SEQ ID NO: 8292629 - DNA, 22 bp, Homo sapiens
agaaatacaaagtactaagata

SEQ ID NO: 8292630 - DNA, 22 bp, Homo sapiens
aatgaacacagccctctacttt

SEQ ID NO: 8292631 - DNA, 22 bp, Homo sapiens
agaaaaatcttggcgcttgtct

SEQ ID NO: 8292632 - DNA, 22 bp, Homo sapiens
aagtcacagctaaatagctaag

SEQ ID NO: 8292633 - DNA, 22 bp, Homo sapiens
actaacatgttaatcaaaagaa

SEQ ID NO: 8292634 - DNA, 22 bp, Homo sapiens
actaacatgttaatcaaaagaa

SEQ ID NO: 8292635 - DNA, 22 bp, Homo sapiens
aagttcaaggaagcctccagtt

SEQ ID NO: 8292636 - DNA, 22 bp, Homo sapiens
aagttcaagatcaaggttccag

SEQ ID NO: 8292637 - DNA, 22 bp, Homo sapiens
aagttcaagctctgcctaaaat

SEQ ID NO: 8292638 - DNA, 22 bp, Homo sapiens
aagttcaagagtgacatattag

SEQ ID NO: 8292639 - DNA, 22 bp, Homo sapiens
aagttatatcatctcattgacg

SEQ ID NO: 8292640 - DNA, 22 bp, Homo sapiens
aataagattgacacaagtacct

SEQ ID NO: 8292641 - DNA, 22 bp, Homo sapiens
aataagattgacacaagtacct

SEQ ID NO: 8292642 - DNA, 22 bp, Homo sapiens
aatacaagatttatagttgttt

SEQ ID NO: 8292643 - DNA, 22 bp, Homo sapiens
aataattagtgggacagagaac

SEQ ID NO: 8292644 - DNA, 22 bp, Homo sapiens
aataatgttgacgatagtctta

SEQ ID NO: 8292645 - DNA, 22 bp, Homo sapiens
aagttctaattttgcattcagg

SEQ ID NO: 8292646 - DNA, 22 bp, Homo sapiens
aagttctactgtgggtaaaatg

SEQ ID NO: 8292647 - DNA, 22 bp, Homo sapiens
aagttgtatataccgctttaag

SEQ ID NO: 8292648 - DNA, 22 bp, Homo sapiens
aagtttaaggtggaagtggtgg

SEQ ID NO: 8292649 - DNA, 22 bp, Homo sapiens
aagtttcatgtggaggtagact

SEQ ID NO: 8292650 - DNA, 22 bp, Homo sapiens
aagtttcattgttcatgtaaca

SEQ ID NO: 8292651 - DNA, 22 bp, Homo sapiens
aataagatcctgaagatatgtt

SEQ ID NO: 8292652 - DNA, 22 bp, Homo sapiens
aataacttcagttcttacatta

SEQ ID NO: 8292653 - DNA, 22 bp, Homo sapiens
ggctggcatccagggaaatcca

SEQ ID NO: 8292654 - DNA, 22 bp, Homo sapiens
ggcagtgggaaataagtgagaa

SEQ ID NO: 8292655 - DNA, 17 bp, Homo sapiens
ggcagtggaggaagaga

SEQ ID NO: 8292656 - DNA, 22 bp, Homo sapiens
ggttcacactaagcttaagtgg

SEQ ID NO: 8292657 - DNA, 22 bp, Homo sapiens
ggttcacactttcatgatttca

SEQ ID NO: 8292658 - DNA, 22 bp, Homo sapiens
ggttcacatattgagagtattc

SEQ ID NO: 8292659 - DNA, 22 bp, Homo sapiens
gtctttatttgagattgtcatt

SEQ ID NO: 8292660 - DNA, 22 bp, Homo sapiens
gtgctgcagagtctcgtgccgc

SEQ ID NO: 8292661 - DNA, 22 bp, Homo sapiens
gtattttcaagagcagtagtat

SEQ ID NO: 8292662 - DNA, 22 bp, Homo sapiens
gtcaaacaaattaacatatcca

SEQ ID NO: 8292663 - DNA, 22 bp, Homo sapiens
gtcaaacagcctcctgttctaa

SEQ ID NO: 8292664 - DNA, 22 bp, Homo sapiens
gtcaaacatagggactttgtgg

SEQ ID NO: 8292665 - DNA, 22 bp, Homo sapiens
gtcaaacaaattaacatatcca

SEQ ID NO: 8292666 - DNA, 22 bp, Homo sapiens
gtacaaagtggacctgatagta

SEQ ID NO: 8292667 - DNA, 19 bp, Homo sapiens
gctttttgttgtcaaaggt

SEQ ID NO: 8292668 - DNA, 19 bp, Homo sapiens
gctgtattaaagatacatg

SEQ ID NO: 8292669 - DNA, 22 bp, Homo sapiens
gcatttaaatttgaacttcaga

SEQ ID NO: 8292670 - DNA, 22 bp, Homo sapiens
gcatttagctttaaaatatttc

SEQ ID NO: 8292671 - DNA, 22 bp, Homo sapiens
gcatttatttctttactgcatc

SEQ ID NO: 8292672 - DNA, 19 bp, Homo sapiens
gcataaaatgtcaatgtgt

SEQ ID NO: 8292673 - DNA, 22 bp, Homo sapiens
gcaggcagtttgcttttccctc

SEQ ID NO: 8292674 - DNA, 22 bp, Homo sapiens
gcaggcagttgcagttttctag

SEQ ID NO: 8292675 - DNA, 22 bp, Homo sapiens
gcaataaaatgtaatgattggg

SEQ ID NO: 8292676 - DNA, 22 bp, Homo sapiens
gcaataaagattttactgtcag

SEQ ID NO: 8292677 - DNA, 22 bp, Homo sapiens
gcaataaataacatggaagaca

SEQ ID NO: 8292678 - DNA, 22 bp, Homo sapiens
gcacagaagtaaaatacaagtc

SEQ ID NO: 8292679 - DNA, 22 bp, Homo sapiens
gcacagaacttctcttagtagg

SEQ ID NO: 8292680 - DNA, 22 bp, Homo sapiens
gcacagaagagctttggaatga

SEQ ID NO: 8292681 - DNA, 22 bp, Homo sapiens
gcacagcaatttctataagctc

SEQ ID NO: 8292682 - DNA, 22 bp, Homo sapiens
tccatttagctggcaaacaatg

SEQ ID NO: 8292683 - DNA, 22 bp, Homo sapiens
tccatttactattctcatatcg

SEQ ID NO: 8292684 - DNA, 22 bp, Homo sapiens
tcccaaagctactcttctgact

SEQ ID NO: 8292685 - DNA, 22 bp, Homo sapiens
tcaggagagaaagaatacaatt

SEQ ID NO: 8292686 - DNA, 22 bp, Homo sapiens
tcataaagttacccaaatttta

SEQ ID NO: 8292687 - DNA, 22 bp, Homo sapiens
tcataaagttatcaccaaatcc

SEQ ID NO: 8292688 - DNA, 22 bp, Homo sapiens
tcataaagttctaagaattgta

SEQ ID NO: 8292689 - DNA, 22 bp, Homo sapiens
tcagtatccacaaatgctcaaa

SEQ ID NO: 8292690 - DNA, 22 bp, Homo sapiens
tcatttctcccggccaaaaact

SEQ ID NO: 8292691 - DNA, 22 bp, Homo sapiens
tccaaagtaatttcacttctgt

SEQ ID NO: 8292692 - DNA, 22 bp, Homo sapiens
tccaaacaccctccatgctgca

SEQ ID NO: 8292693 - DNA, 22 bp, Homo sapiens
tcaaatgcacgtagagaaaata

SEQ ID NO: 8292694 - DNA, 22 bp, Homo sapiens
tcaaatgcaggtctggtcttgg

SEQ ID NO: 8292695 - DNA, 22 bp, Homo sapiens
tcaacacaacagagaaatgctg

SEQ ID NO: 8292696 - DNA, 22 bp, Homo sapiens
tcaacagaagtgatagctatta

SEQ ID NO: 8292697 - DNA, 18 bp, Homo sapiens
tcacagtgctcttgccta

SEQ ID NO: 8292698 - DNA, 22 bp, Homo sapiens
tcacatgctactgagccagacc

SEQ ID NO: 8292699 - DNA, 22 bp, Homo sapiens
tcacatgctcacctaagccaca

SEQ ID NO: 8292700 - DNA, 22 bp, Homo sapiens
tcacattgccgtctgtgcactt

SEQ ID NO: 8292701 - DNA, 22 bp, Homo sapiens
tcacattgctcccatagtggat

SEQ ID NO: 8292702 - DNA, 22 bp, Homo sapiens
tcacattttatctattttaagt

SEQ ID NO: 8292703 - DNA, 23 bp, Homo sapiens
tcagaatgcactgaatttaccct

SEQ ID NO: 8292704 - DNA, 22 bp, Homo sapiens
tagtttcatctccaccctgccc

SEQ ID NO: 8292705 - DNA, 22 bp, Homo sapiens
tagtgcacacgcatgtagcagt

SEQ ID NO: 8292706 - DNA, 22 bp, Homo sapiens
tagttacagagaaatgatttga

SEQ ID NO: 8292707 - DNA, 22 bp, Homo sapiens
tagacagatttcttgttagaca

SEQ ID NO: 8292708 - DNA, 22 bp, Homo sapiens
tagaacatgctcatgtataaat

SEQ ID NO: 8292709 - DNA, 22 bp, Homo sapiens
tagaacatgtgaaaatatagcc

SEQ ID NO: 8292710 - DNA, 22 bp, Homo sapiens
tagaaatgggttacatttagag

SEQ ID NO: 8292711 - DNA, 22 bp, Homo sapiens
tagagtggttaacagtttagaa

SEQ ID NO: 8292712 - DNA, 22 bp, Homo sapiens
tattgtctgtccgggtcaaagc

SEQ ID NO: 8292713 - DNA, 22 bp, Homo sapiens
tcaaataccagcaatttcatgt

SEQ ID NO: 8292714 - DNA, 22 bp, Homo sapiens
tcaaatacatggtcaatcaact

SEQ ID NO: 8292715 - DNA, 22 bp, Homo sapiens
tcaaatcagcaagcagcttccc

SEQ ID NO: 8292716 - DNA, 22 bp, Homo sapiens
tcaaagtcatggcaggctcaga

SEQ ID NO: 8292717 - DNA, 22 bp, Homo sapiens
tcaaataatgccattcatcatc

SEQ ID NO: 8292718 - DNA, 22 bp, Homo sapiens
tcaaataatgccattcatcatc

SEQ ID NO: 8292719 - DNA, 22 bp, Homo sapiens
tcaaataaggagtcatgaccat

SEQ ID NO: 8292720 - DNA, 22 bp, Homo sapiens
tcaaagtttttgagaattacat

SEQ ID NO: 8292721 - DNA, 22 bp, Homo sapiens
tcaaagtttgtggcaatttatt

SEQ ID NO: 8292722 - DNA, 22 bp, Homo sapiens
tcaaactgtttacagtgagata

SEQ ID NO: 8292723 - DNA, 22 bp, Homo sapiens
tattttgactattaaaccaaca

SEQ ID NO: 8292724 - DNA, 22 bp, Homo sapiens
tatggaaactaattcatttttc

SEQ ID NO: 8292725 - DNA, 22 bp, Homo sapiens
tatggaaaaatgtatcttgtca

SEQ ID NO: 8292726 - DNA, 22 bp, Homo sapiens
tatggaaagggagtttaatttg

SEQ ID NO: 8292727 - DNA, 22 bp, Homo sapiens
tatggaaataattagacaagtg

SEQ ID NO: 8292728 - DNA, 22 bp, Homo sapiens
tatgtagaagctgctcaaagaa

SEQ ID NO: 8292729 - DNA, 22 bp, Homo sapiens
tatgtaaagtagatggcaggta

SEQ ID NO: 8292730 - DNA, 17 bp, Homo sapiens
tatgtagtacttataaa

SEQ ID NO: 8292731 - DNA, 22 bp, Homo sapiens
tattaacattttatgaaaataa

SEQ ID NO: 8292732 - DNA, 22 bp, Homo sapiens
tattaaattatggatttaggag

SEQ ID NO: 8292733 - DNA, 21 bp, Homo sapiens
tatcagaagagaaagaatgat

SEQ ID NO: 8292734 - DNA, 22 bp, Homo sapiens
tataaagctgactcatgaaact

SEQ ID NO: 8292735 - DNA, 18 bp, Homo sapiens
tataaacacacttaggtt

SEQ ID NO: 8292736 - DNA, 22 bp, Homo sapiens
tataaaattctcagtttggggt

SEQ ID NO: 8292737 - DNA, 22 bp, Homo sapiens
tataaaatggcatcagctccaa

SEQ ID NO: 8292738 - DNA, 22 bp, Homo sapiens
tataaaacagaaagcactacct

SEQ ID NO: 8292739 - DNA, 22 bp, Homo sapiens
tatgaaagaatctcagagcaca

SEQ ID NO: 8292740 - DNA, 22 bp, Homo sapiens
tatgaaatttaaacacagatca

SEQ ID NO: 8292741 - DNA, 22 bp, Homo sapiens
tacagagatttattgctaaggc

SEQ ID NO: 8292742 - DNA, 22 bp, Homo sapiens
tacagtatcttctggcaagcat

SEQ ID NO: 8292743 - DNA, 22 bp, Homo sapiens
tacagtattatgagtgattgaa

SEQ ID NO: 8292744 - DNA, 22 bp, Homo sapiens
tacagtgacctagaataaatac

SEQ ID NO: 8292745 - DNA, 22 bp, Homo sapiens
tacatgcatgtcacagaatgaa

SEQ ID NO: 8292746 - DNA, 18 bp, Homo sapiens
tacatgcataaatgaagc

SEQ ID NO: 8292747 - DNA, 22 bp, Homo sapiens
tacttaatgccactgaattgta

SEQ ID NO: 8292748 - DNA, 22 bp, Homo sapiens
taagcttcaaagaacatattgg

SEQ ID NO: 8292749 - DNA, 22 bp, Homo sapiens
taattgaaatcatttcaattca

SEQ ID NO: 8292750 - DNA, 22 bp, Homo sapiens
taatttatgatgcaaagaaaag

SEQ ID NO: 8292751 - DNA, 22 bp, Homo sapiens
taatttacttgcaaataacaat

SEQ ID NO: 8292752 - DNA, 22 bp, Homo sapiens
taatttacttgcaaataacaat

SEQ ID NO: 8292753 - DNA, 22 bp, Homo sapiens
tacaagaggtatatagaaacag

SEQ ID NO: 8292754 - DNA, 22 bp, Homo sapiens
tacaagaatgtcttaaaagctc

SEQ ID NO: 8292755 - DNA, 22 bp, Homo sapiens
tacaagaaggaaaactagcaat

SEQ ID NO: 8292756 - DNA, 22 bp, Homo sapiens
tacacatacattgcttacaagg

SEQ ID NO: 8292757 - DNA, 22 bp, Homo sapiens
tacacataggagggtaataaaa

SEQ ID NO: 8292758 - DNA, 22 bp, Homo sapiens
tacacataggtctgaataaaaa

SEQ ID NO: 8292759 - DNA, 22 bp, Homo sapiens
gttataaatacctaataggatt

SEQ ID NO: 8292760 - DNA, 22 bp, Homo sapiens
gtgttgactcttggacttcaag

SEQ ID NO: 8292761 - DNA, 22 bp, Homo sapiens
gttataaatgactgcaaaagtt

SEQ ID NO: 8292762 - DNA, 22 bp, Homo sapiens
gttataaatgactgcaaaagtt

SEQ ID NO: 8292763 - DNA, 22 bp, Homo sapiens
gttatgtactttttaaatcttg

SEQ ID NO: 8292764 - DNA, 22 bp, Homo sapiens
gttatgtatcttgattgggtgg

SEQ ID NO: 8292765 - DNA, 22 bp, Homo sapiens
gttatgtatgagggaatgatta

SEQ ID NO: 8292766 - DNA, 22 bp, Homo sapiens
gttattgcagtatagaggtcta

SEQ ID NO: 8292767 - DNA, 22 bp, Homo sapiens
gttatgtaatctaacactcagt

SEQ ID NO: 8292768 - DNA, 22 bp, Homo sapiens
taaagacatggtgtaggtgaac

SEQ ID NO: 8292769 - DNA, 22 bp, Homo sapiens
taaatgcagtacaaattgttct

SEQ ID NO: 8292770 - DNA, 22 bp, Homo sapiens
taaatgcagcagtttctgttct

SEQ ID NO: 8292771 - DNA, 22 bp, Homo sapiens
taaatgcaatgtgctttaccag

SEQ ID NO: 8292772 - DNA, 22 bp, Homo sapiens
taaatgcagattcctgagccta

SEQ ID NO: 8292773 - DNA, 22 bp, Homo sapiens
taaatgcagttagtacttgcca

SEQ ID NO: 8292774 - DNA, 22 bp, Homo sapiens
taaatgcaagtgctcctgggag

SEQ ID NO: 8292775 - DNA, 22 bp, Homo sapiens
taaatgatttatgtatgtgaaa

SEQ ID NO: 8292776 - DNA, 22 bp, Homo sapiens
taaagcacgtctatttaatgat

SEQ ID NO: 8292777 - DNA, 22 bp, Homo sapiens
taaaactgaatacatactgagg

SEQ ID NO: 8292778 - DNA, 22 bp, Homo sapiens
taaaactgaatacatactgagg

SEQ ID NO: 8292779 - DNA, 22 bp, Homo sapiens
taaagacactggttttaatcat

SEQ ID NO: 8292780 - DNA, 22 bp, Homo sapiens
taaaagtggataagctgtagga

SEQ ID NO: 8292781 - DNA, 22 bp, Homo sapiens
taacatgagagctaagacatta

SEQ ID NO: 8292782 - DNA, 20 bp, Homo sapiens
taacatagtccagagaacga

SEQ ID NO: 8292783 - DNA, 20 bp, Homo sapiens
taacatagtccagagaacga

SEQ ID NO: 8292784 - DNA, 22 bp, Homo sapiens
taaatgtttagtcttatttggg

SEQ ID NO: 8292785 - DNA, 18 bp, Homo sapiens
taaatgcatgttaataac

SEQ ID NO: 8292786 - DNA, 22 bp, Homo sapiens
taaatgtgcactttacttttca

SEQ ID NO: 8292787 - DNA, 22 bp, Homo sapiens
taaatgtggagactcaggagtc

SEQ ID NO: 8292788 - DNA, 22 bp, Homo sapiens
taaatgtgcacaggttagaagg

SEQ ID NO: 8292789 - DNA, 22 bp, Homo sapiens
taaatgtgttagtcatggtttt

SEQ ID NO: 8292790 - DNA, 22 bp, Homo sapiens
taaatgtgtgtagccatctgtg

SEQ ID NO: 8292791 - DNA, 22 bp, Homo sapiens
taaatgtgtctatggacccgcc

SEQ ID NO: 8292792 - DNA, 22 bp, Homo sapiens
taaatgtgtctttttaaggcct

SEQ ID NO: 8292793 - DNA, 22 bp, Homo sapiens
taaatgtgtaaacctccattac

SEQ ID NO: 8292794 - DNA, 22 bp, Homo sapiens
taaatgtgggggccacgggctt

SEQ ID NO: 8292795 - DNA, 22 bp, Homo sapiens
taaatgttactttcctttcaca

SEQ ID NO: 8292796 - DNA, 22 bp, Homo sapiens
taaatgtgttgtggatgaagtt

SEQ ID NO: 8292797 - DNA, 22 bp, Homo sapiens
gacatcaatattctgcagggat

SEQ ID NO: 8292798 - DNA, 22 bp, Homo sapiens
gacatacagcatggtctatgaa

SEQ ID NO: 8292799 - DNA, 22 bp, Homo sapiens
gaatgcacacgtgtgtgcatgc

SEQ ID NO: 8292800 - DNA, 22 bp, Homo sapiens
gaatgcacttccaacatctatt

SEQ ID NO: 8292801 - DNA, 22 bp, Homo sapiens
gaatgcactcacccatcactca

SEQ ID NO: 8292802 - DNA, 22 bp, Homo sapiens
gaatgcagatggctggtgtatg

SEQ ID NO: 8292803 - DNA, 22 bp, Homo sapiens
ctggttcatccccttccaggaa

SEQ ID NO: 8292804 - DNA, 22 bp, Homo sapiens
ctggtttagctgtaaggttccc

SEQ ID NO: 8292805 - DNA, 21 bp, Homo sapiens
ctggtgtagcactcaggtgct

SEQ ID NO: 8292806 - DNA, 22 bp, Homo sapiens
gaaatattcttgtcttgttttc

SEQ ID NO: 8292807 - DNA, 22 bp, Homo sapiens
gaaatattacagtggaggggat

SEQ ID NO: 8292808 - DNA, 22 bp, Homo sapiens
gaaatattgggactcagagctt

SEQ ID NO: 8292809 - DNA, 22 bp, Homo sapiens
gaaatattgtactggagatgtt

SEQ ID NO: 8292810 - DNA, 20 bp, Homo sapiens
gaaatgtctatgataatgat

SEQ ID NO: 8292811 - DNA, 22 bp, Homo sapiens
gaaatgtgacctacttccttgt

SEQ ID NO: 8292812 - DNA, 22 bp, Homo sapiens
gaaatgtctttgacaagagagg

SEQ ID NO: 8292813 - DNA, 18 bp, Homo sapiens
gaaatgtgattctagggc

SEQ ID NO: 8292814 - DNA, 20 bp, Homo sapiens
gaaatgtgacctcttctgtg

SEQ ID NO: 8292815 - DNA, 22 bp, Homo sapiens
gaaatgtgcagaatgtgttaga

SEQ ID NO: 8292816 - DNA, 22 bp, Homo sapiens
gaaatgtgtgacaagtttcaat

SEQ ID NO: 8292817 - DNA, 22 bp, Homo sapiens
gaaatgtgggtcatgacccatt

SEQ ID NO: 8292818 - DNA, 22 bp, Homo sapiens
gaagaacacttcatgattcatt

SEQ ID NO: 8292819 - DNA, 22 bp, Homo sapiens
gaagaacacctgctgcccagtg

SEQ ID NO: 8292820 - DNA, 22 bp, Homo sapiens
gaagaacaagcagtgctttcct

SEQ ID NO: 8292821 - DNA, 22 bp, Homo sapiens
gaactttaaaacaaagtacagt

SEQ ID NO: 8292822 - DNA, 22 bp, Homo sapiens
gaaatgttatgagatatgtact

SEQ ID NO: 8292823 - DNA, 22 bp, Homo sapiens
gaaatgtgttgttcatttctaa

SEQ ID NO: 8292824 - DNA, 22 bp, Homo sapiens
gaaactgtatgtagtttttggg

SEQ ID NO: 8292825 - DNA, 22 bp, Homo sapiens
gaaaaatgagctgatgtcaggg

SEQ ID NO: 8292826 - DNA, 22 bp, Homo sapiens
gaaaaatgctccaaatctgtgg

SEQ ID NO: 8292827 - DNA, 22 bp, Homo sapiens
ctttggaagtgaccacaatcct

SEQ ID NO: 8292828 - DNA, 20 bp, Homo sapiens
ctttggcaatgagaacaggg

SEQ ID NO: 8292829 - DNA, 22 bp, Homo sapiens
cttcacagccaacatgggcaca

SEQ ID NO: 8292830 - DNA, 22 bp, Homo sapiens
cttcacatgttggagtcctttg

SEQ ID NO: 8292831 - DNA, 22 bp, Homo sapiens
cttcacattgggcttgatatga

SEQ ID NO: 8292832 - DNA, 22 bp, Homo sapiens
cttgctggggtaagtctgtgct

SEQ ID NO: 8292833 - DNA, 22 bp, Homo sapiens
ctttgcatacaatttttagaaa

SEQ ID NO: 8292834 - DNA, 22 bp, Homo sapiens
ttattgcctgattgaggtcatt

SEQ ID NO: 8292835 - DNA, 22 bp, Homo sapiens
ttcaaatacattctttgccact

SEQ ID NO: 8292836 - DNA, 22 bp, Homo sapiens
ttacaaagagtgttcttttcca

SEQ ID NO: 8292837 - DNA, 22 bp, Homo sapiens
ttacaaagagtgccagagtgtg

SEQ ID NO: 8292838 - DNA, 22 bp, Homo sapiens
ccttaaaagaactatctcttct

SEQ ID NO: 8292839 - DNA, 22 bp, Homo sapiens
ttataacaacagtttactttaa

SEQ ID NO: 8292840 - DNA, 22 bp, Homo sapiens
ttataacatcaatcagagttaa

SEQ ID NO: 8292841 - DNA, 22 bp, Homo sapiens
ttatcatagtgcagttttctga

SEQ ID NO: 8292842 - DNA, 22 bp, Homo sapiens
ttatcataagtaattgaaataa

SEQ ID NO: 8292843 - DNA, 22 bp, Homo sapiens
ccttcaatcttaagtcagccca

SEQ ID NO: 8292844 - DNA, 22 bp, Homo sapiens
ccttcaatcagcagtctagctt

SEQ ID NO: 8292845 - DNA, 21 bp, Homo sapiens
ttagcaaagcaaacacatgct

SEQ ID NO: 8292846 - DNA, 21 bp, Homo sapiens
ctcagagaaatgtctgggagc

SEQ ID NO: 8292847 - DNA, 22 bp, Homo sapiens
ctagaaatacaggcacgtgcca

SEQ ID NO: 8292848 - DNA, 22 bp, Homo sapiens
cgtgtacagtctatcttttttc

SEQ ID NO: 8292849 - DNA, 22 bp, Homo sapiens
ctggagaggccccaagatattt

SEQ ID NO: 8292850 - DNA, 22 bp, Homo sapiens
ctggagagaccgaaagaggctg

SEQ ID NO: 8292851 - DNA, 22 bp, Homo sapiens
ctgaggctcaagggcaggtggg

SEQ ID NO: 8292852 - DNA, 22 bp, Homo sapiens
ctgaggctccctcgggtctgct

SEQ ID NO: 8292853 - DNA, 22 bp, Homo sapiens
tttatgtaagtggaatgatgcc

SEQ ID NO: 8292854 - DNA, 22 bp, Homo sapiens
tttcatgtttatggaaaatgag

SEQ ID NO: 8292855 - DNA, 22 bp, Homo sapiens
tttcatgttttcttaaatggca

SEQ ID NO: 8292856 - DNA, 22 bp, Homo sapiens
ctctgtgcctcagttttcttct

SEQ ID NO: 8292857 - DNA, 22 bp, Homo sapiens
tgtacatgtgtctgtatatctt

SEQ ID NO: 8292858 - DNA, 22 bp, Homo sapiens
tgtacattgtcactcatcaagt

SEQ ID NO: 8292859 - DNA, 22 bp, Homo sapiens
tgtaatcattacagtacatgga

SEQ ID NO: 8292860 - DNA, 22 bp, Homo sapiens
tgctttatttataaaatagcaa

SEQ ID NO: 8292861 - DNA, 22 bp, Homo sapiens
tgaaagctgtacatgtggtaca

SEQ ID NO: 8292862 - DNA, 22 bp, Homo sapiens
tgaaagctttgggacagtgtga

SEQ ID NO: 8292863 - DNA, 22 bp, Homo sapiens
tgaaagcttgttggaaatgtag

SEQ ID NO: 8292864 - DNA, 22 bp, Homo sapiens
tgaaagcagtgccatgattatg

SEQ ID NO: 8292865 - DNA, 21 bp, Homo sapiens
tgaacacagatttgtctgatt

SEQ ID NO: 8292866 - DNA, 22 bp, Homo sapiens
tgaacacatttgggaaaatctt

SEQ ID NO: 8292867 - DNA, 22 bp, Homo sapiens
tgaacagatcaatagaactgac

SEQ ID NO: 8292868 - DNA, 18 bp, Homo sapiens
tgaacagatgagttgaag

SEQ ID NO: 8292869 - DNA, 22 bp, Homo sapiens
ccattgtagtatctgttttagt

SEQ ID NO: 8292870 - DNA, 22 bp, Homo sapiens
cccaaagtacaagtaaacatgt

SEQ ID NO: 8292871 - DNA, 22 bp, Homo sapiens
tgattatattctaacttcataa

SEQ ID NO: 8292872 - DNA, 22 bp, Homo sapiens
tgcagcaggttccaaagggtta

SEQ ID NO: 8292873 - DNA, 22 bp, Homo sapiens
tgcatattttataaagatggaa

SEQ ID NO: 8292874 - DNA, 22 bp, Homo sapiens
tgcatattgtgaaaatgtagat

SEQ ID NO: 8292875 - DNA, 22 bp, Homo sapiens
tgcatatttgtatgatgtttag

SEQ ID NO: 8292876 - DNA, 22 bp, Homo sapiens
tgcatattatgtgtatctgtct

SEQ ID NO: 8292877 - DNA, 22 bp, Homo sapiens
tctcttaactggttcagcaatt

SEQ ID NO: 8292878 - DNA, 22 bp, Homo sapiens
tctcttaactggttcagcaatt

SEQ ID NO: 8292879 - DNA, 22 bp, Homo sapiens
catttgtatgttcctccttagg

SEQ ID NO: 8292880 - DNA, 22 bp, Homo sapiens
cattcattctgtaagtaactat

SEQ ID NO: 8292881 - DNA, 21 bp, Homo sapiens
tcatttattgagaaatgactg

SEQ ID NO: 8292882 - DNA, 22 bp, Homo sapiens
cataacagtggcttcagcaagt

SEQ ID NO: 8292883 - DNA, 22 bp, Homo sapiens
tactgtatttgataagtgaagt

SEQ ID NO: 8292884 - DNA, 22 bp, Homo sapiens
tactgtgacagagtacttaaac

SEQ ID NO: 8292885 - DNA, 22 bp, Homo sapiens
tagaatatacactacagcttaa

SEQ ID NO: 8292886 - DNA, 22 bp, Homo sapiens
tagaatatgattaattttctta

SEQ ID NO: 8292887 - DNA, 22 bp, Homo sapiens
tagataaattagaaagtttact

SEQ ID NO: 8292888 - DNA, 22 bp, Homo sapiens
tagaatatgtggtgtatacttt

SEQ ID NO: 8292889 - DNA, 22 bp, Homo sapiens
tagaatatgtggtaggatctgg

SEQ ID NO: 8292890 - DNA, 22 bp, Homo sapiens
tagaatatgtggtgtatacttt

SEQ ID NO: 8292891 - DNA, 22 bp, Homo sapiens
tatcataagttaattaaacagt

SEQ ID NO: 8292892 - DNA, 22 bp, Homo sapiens
tagtgattaaaggcagaatgtt

SEQ ID NO: 8292893 - DNA, 22 bp, Homo sapiens
tagctattcacttgttgatgga

SEQ ID NO: 8292894 - DNA, 22 bp, Homo sapiens
tcacaacttgaagctgatttaa

SEQ ID NO: 8292895 - DNA, 22 bp, Homo sapiens
cagtgcatgaaacaatatgcag

SEQ ID NO: 8292896 - DNA, 22 bp, Homo sapiens
tcagagaaataattgctgagtt

SEQ ID NO: 8292897 - DNA, 22 bp, Homo sapiens
tcagagaaatgaagtagggatt

SEQ ID NO: 8292898 - DNA, 21 bp, Homo sapiens
tcagagaacccggcaggcaag

SEQ ID NO: 8292899 - DNA, 22 bp, Homo sapiens
cataaaatggcttgttctttaa

SEQ ID NO: 8292900 - DNA, 22 bp, Homo sapiens
cataaactctctgtaccaatat

SEQ ID NO: 8292901 - DNA, 22 bp, Homo sapiens
cataaactcttgagattcttgt

SEQ ID NO: 8292902 - DNA, 22 bp, Homo sapiens
cagttaaaggcccaatatctgg

SEQ ID NO: 8292903 - DNA, 22 bp, Homo sapiens
ttgcatgttatttaatctgtat

SEQ ID NO: 8292904 - DNA, 22 bp, Homo sapiens
ttgcatgtgtaatttttctaaa

SEQ ID NO: 8292905 - DNA, 22 bp, Homo sapiens
ttgacacaaacagtgatgtagt

SEQ ID NO: 8292906 - DNA, 22 bp, Homo sapiens
ttgcagcagggtgaattcactc

SEQ ID NO: 8292907 - DNA, 20 bp, Homo sapiens
ttgcagcagtgaggtgaagg

SEQ ID NO: 8292908 - DNA, 23 bp, Homo sapiens
ttgcatgtagcccatgagtaact

SEQ ID NO: 8292909 - DNA, 22 bp, Homo sapiens
ttgtaacaggcactctgtgcca

SEQ ID NO: 8292910 - DNA, 22 bp, Homo sapiens
ttgtaacaggtactaaataact

SEQ ID NO: 8292911 - DNA, 22 bp, Homo sapiens
ttgtaacagctgtttatatagt

SEQ ID NO: 8292912 - DNA, 22 bp, Homo sapiens
ttgtaacagctgcttaatagag

SEQ ID NO: 8292913 - DNA, 22 bp, Homo sapiens
ttgtacacaattcttaacatac

SEQ ID NO: 8292914 - DNA, 22 bp, Homo sapiens
ttggagagattatcagaccagc

SEQ ID NO: 8292915 - DNA, 22 bp, Homo sapiens
ttggagagaggctgctcaggct

SEQ ID NO: 8292916 - DNA, 22 bp, Homo sapiens
tttcaagagggaactgaacaca

SEQ ID NO: 8292917 - DNA, 22 bp, Homo sapiens
tttcaacaggatgataataggc

SEQ ID NO: 8292918 - DNA, 22 bp, Homo sapiens
tttcaacatataccataatgcc

SEQ ID NO: 8292919 - DNA, 22 bp, Homo sapiens
tttattctataggcattaagca

SEQ ID NO: 8292920 - DNA, 22 bp, Homo sapiens
tttattctgtgctacatgaaga

SEQ ID NO: 8292921 - DNA, 22 bp, Homo sapiens
tttattcttgagagtgagaaga

SEQ ID NO: 8292922 - DNA, 22 bp, Homo sapiens
tttattcttgagagtgagaaga

SEQ ID NO: 8292923 - DNA, 22 bp, Homo sapiens
tttcaacagctctcaaatgatc

SEQ ID NO: 8292924 - DNA, 23 bp, Homo sapiens
tttcaacaatgcttagagaaaac

SEQ ID NO: 8292925 - DNA, 22 bp, Homo sapiens
tttcacattttatacttaagcc

SEQ ID NO: 8292926 - DNA, 22 bp, Homo sapiens
tttcattgaactaaagaatctg

SEQ ID NO: 8292927 - DNA, 22 bp, Homo sapiens
tttcatgtgcaattagcaatat

SEQ ID NO: 8292928 - DNA, 22 bp, Homo sapiens
tttaagatggtattttataaag

SEQ ID NO: 8292929 - DNA, 22 bp, Homo sapiens
tttagagttgagtattcattgg

SEQ ID NO: 8292930 - DNA, 22 bp, Homo sapiens
ttccagttggtagaatgtaagg

SEQ ID NO: 8292931 - DNA, 17 bp, Homo sapiens
ttccagtttagtattgt

SEQ ID NO: 8292932 - DNA, 22 bp, Homo sapiens
ttctgtgactcctcagagattt

SEQ ID NO: 8292933 - DNA, 22 bp, Homo sapiens
ttcttagatgattaatgatggg

SEQ ID NO: 8292934 - DNA, 22 bp, Homo sapiens
ttcttcaaaatccagcatgatt

SEQ ID NO: 8292935 - DNA, 22 bp, Homo sapiens
ttgaacattttctatgttatag

SEQ ID NO: 8292936 - DNA, 22 bp, Homo sapiens
ttgaacattggcaatttcatat

SEQ ID NO: 8292937 - DNA, 22 bp, Homo sapiens
ttgaacattagaataagtaatt

SEQ ID NO: 8292938 - DNA, 22 bp, Homo sapiens
ttgaacattaacttcagtctat

SEQ ID NO: 8292939 - DNA, 22 bp, Homo sapiens
ttatatgagtatcatatcactt

SEQ ID NO: 8292940 - DNA, 22 bp, Homo sapiens
ttcaaacagtgtagaatatatg

SEQ ID NO: 8292941 - DNA, 22 bp, Homo sapiens
ttcaaacagtgtagaatatatg

SEQ ID NO: 8292942 - DNA, 22 bp, Homo sapiens
ttcaaacattcaaataaaccgg

SEQ ID NO: 8292943 - DNA, 22 bp, Homo sapiens
ttcaaacattcaaataaaccgg

SEQ ID NO: 8292944 - DNA, 22 bp, Homo sapiens
ttcaaacacagacagcagcatg

SEQ ID NO: 8292945 - DNA, 22 bp, Homo sapiens
ttagctgcattatcaaagttat

SEQ ID NO: 8292946 - DNA, 22 bp, Homo sapiens
ttagctaaactgtaactagaat

SEQ ID NO: 8292947 - DNA, 22 bp, Homo sapiens
tcctgctgagcgtctgtcattt

SEQ ID NO: 8292948 - DNA, 22 bp, Homo sapiens
ttaggaaacgctgctattgact

SEQ ID NO: 8292949 - DNA, 22 bp, Homo sapiens
ttaggaaagggttttctaacag

SEQ ID NO: 8292950 - DNA, 22 bp, Homo sapiens
ttatataaagataacttttctt

SEQ ID NO: 8292951 - DNA, 21 bp, Homo sapiens
ttcataaaccattctcatgca

SEQ ID NO: 8292952 - DNA, 22 bp, Homo sapiens
ttcatttgccatcagtgtaatg

SEQ ID NO: 8292953 - DNA, 22 bp, Homo sapiens
ttcatttgttgacagagacatg

SEQ ID NO: 8292954 - DNA, 22 bp, Homo sapiens
ttccagttcccatgaggattaa

SEQ ID NO: 8292955 - DNA, 22 bp, Homo sapiens
ttccagttaaggaagctattct

SEQ ID NO: 8292956 - DNA, 22 bp, Homo sapiens
ttcagagaagcaaaggcagatt

SEQ ID NO: 8292957 - DNA, 22 bp, Homo sapiens
ttcaaagctgcagactcctggg

SEQ ID NO: 8292958 - DNA, 22 bp, Homo sapiens
ttcacagagagtatgcagagaa

SEQ ID NO: 8292959 - DNA, 22 bp, Homo sapiens
tttgtaaaaggaggaagcatgg

SEQ ID NO: 8292960 - DNA, 22 bp, Homo sapiens
tttgtaaatagcagtactcatg

SEQ ID NO: 8292961 - DNA, 22 bp, Homo sapiens
tttgtaaagtctgttctgagtt

SEQ ID NO: 8292962 - DNA, 22 bp, Homo sapiens
ttttaatcatgcttctatgtcc

SEQ ID NO: 8292963 - DNA, 22 bp, Homo sapiens
ttttcatttttgtagatgcaag

SEQ ID NO: 8292964 - DNA, 22 bp, Homo sapiens
ttttcttatggtgaagcacaaa

SEQ ID NO: 8292965 - DNA, 22 bp, Homo sapiens
tttgagttgcttatttaatagg

SEQ ID NO: 8292966 - DNA, 22 bp, Homo sapiens
tttggaaagtgtacaaatttga

SEQ ID NO: 8292967 - DNA, 22 bp, Homo sapiens
tttggaaagttgtcactttaga

SEQ ID NO: 8292968 - DNA, 22 bp, Homo sapiens
tttgaatatcacaaactttcaa

SEQ ID NO: 8292969 - DNA, 22 bp, Homo sapiens
gtgcaaaagtaattgtggtttt

SEQ ID NO: 8292970 - DNA, 22 bp, Homo sapiens
gtgcaaaagtcattgtggtttt

SEQ ID NO: 8292971 - DNA, 22 bp, Homo sapiens
cagataaatagatagataaact

SEQ ID NO: 8292972 - DNA, 22 bp, Homo sapiens
cagataaaggcttactagtagt

SEQ ID NO: 8292973 - DNA, 22 bp, Homo sapiens
gtaagcatctgtctcttctgca

SEQ ID NO: 8292974 - DNA, 22 bp, Homo sapiens
gtaactgaggcagcttttaaga

SEQ ID NO: 8292975 - DNA, 18 bp, Homo sapiens
cagcagagacattcaaaa

SEQ ID NO: 8292976 - DNA, 22 bp, Homo sapiens
gctggttaggtgagggtgcgcc

SEQ ID NO: 8292977 - DNA, 22 bp, Homo sapiens
gctggttagaaaacagagctca

SEQ ID NO: 8292978 - DNA, 20 bp, Homo sapiens
caatgcacacagctgcttct

SEQ ID NO: 8292979 - DNA, 22 bp, Homo sapiens
cagaaattcccatttcagattc

SEQ ID NO: 8292980 - DNA, 22 bp, Homo sapiens
cagaaatgtttatatgtggtgt

SEQ ID NO: 8292981 - DNA, 22 bp, Homo sapiens
cagaaatgttctaatgattcag

SEQ ID NO: 8292982 - DNA, 22 bp, Homo sapiens
cagaaatggaattttccatcac

SEQ ID NO: 8292983 - DNA, 22 bp, Homo sapiens
cagaacattcactcatatgtgg

SEQ ID NO: 8292984 - DNA, 20 bp, Homo sapiens
ggcaggaccccagtggcatc

SEQ ID NO: 8292985 - DNA, 22 bp, Homo sapiens
cacatgcataaggataattact

SEQ ID NO: 8292986 - DNA, 22 bp, Homo sapiens
cacatttctaggaaattaaatg

SEQ ID NO: 8292987 - DNA, 22 bp, Homo sapiens
cacatttctctacctcacacaa

SEQ ID NO: 8292988 - DNA, 22 bp, Homo sapiens
cacatttctgtgagtcaatatt

SEQ ID NO: 8292989 - DNA, 22 bp, Homo sapiens
atcttcaaggaaaaaatacagt

SEQ ID NO: 8292990 - DNA, 22 bp, Homo sapiens
gaaaatgtgtcatccctactgt

SEQ ID NO: 8292991 - DNA, 22 bp, Homo sapiens
gaaaatgtgtcatccctactgt

SEQ ID NO: 8292992 - DNA, 22 bp, Homo sapiens
gaaaatgtgcctttgggtattg

SEQ ID NO: 8292993 - DNA, 23 bp, Homo sapiens
atgcaagagtttctcaaactgga

SEQ ID NO: 8292994 - DNA, 22 bp, Homo sapiens
gaactttaccatttaggtaact

SEQ ID NO: 8292995 - DNA, 22 bp, Homo sapiens
gaacatcatgaagaaaacatat

SEQ ID NO: 8292996 - DNA, 22 bp, Homo sapiens
gacataaaattcaataatttgt

SEQ ID NO: 8292997 - DNA, 22 bp, Homo sapiens
atgctttacagttttccaaaca

SEQ ID NO: 8292998 - DNA, 22 bp, Homo sapiens
atgcacaagaggctagaaaaga

SEQ ID NO: 8292999 - DNA, 22 bp, Homo sapiens
gaatgtaatagtcagtagaaca

SEQ ID NO: 8293000 - DNA, 22 bp, Homo sapiens
gaatgtgtactgagtgcccctt

SEQ ID NO: 8293001 - DNA, 22 bp, Homo sapiens
gaatgtgtgactctattgagca

SEQ ID NO: 8293002 - DNA, 22 bp, Homo sapiens
gaatgtgtcaccctgtcccatg

SEQ ID NO: 8293003 - DNA, 22 bp, Homo sapiens
atgcccaatgtcacaatttttg

SEQ ID NO: 8293004 - DNA, 22 bp, Homo sapiens
atgtacaaaatgccactgaatt

SEQ ID NO: 8293005 - DNA, 22 bp, Homo sapiens
atgtcacagctcccattcctcc

SEQ ID NO: 8293006 - DNA, 22 bp, Homo sapiens
atgtcacagtctgactcagtga

SEQ ID NO: 8293007 - DNA, 22 bp, Homo sapiens
atgtaatttgccctcaagttaa

SEQ ID NO: 8293008 - DNA, 22 bp, Homo sapiens
atgtaattgtagcaaaatgatg

SEQ ID NO: 8293009 - DNA, 22 bp, Homo sapiens
atgtaactgttatattttgttg

SEQ ID NO: 8293010 - DNA, 22 bp, Homo sapiens
atgtaacttctgtgaatctgac

SEQ ID NO: 8293011 - DNA, 22 bp, Homo sapiens
atgtaacaggtgaagctctgag

SEQ ID NO: 8293012 - DNA, 22 bp, Homo sapiens
atgcttttcctaaaatgatgcc

SEQ ID NO: 8293013 - DNA, 22 bp, Homo sapiens
atgtttcatttagatatcaggc

SEQ ID NO: 8293014 - DNA, 22 bp, Homo sapiens
atgtttcaaatatatagagttg

SEQ ID NO: 8293015 - DNA, 22 bp, Homo sapiens
atgtttcaccagcaaattacct

SEQ ID NO: 8293016 - DNA, 22 bp, Homo sapiens
gaggtagccacagatagagact

SEQ ID NO: 8293017 - DNA, 22 bp, Homo sapiens
gaggtagcatgctggaagggac

SEQ ID NO: 8293018 - DNA, 22 bp, Homo sapiens
gaggtacagagtgttccaatgt

SEQ ID NO: 8293019 - DNA, 23 bp, Homo sapiens
gaggtacagcaccagtgaatagg

SEQ ID NO: 8293020 - DNA, 22 bp, Homo sapiens
gaggtacatgaggatacacagg

SEQ ID NO: 8293021 - DNA, 22 bp, Homo sapiens
gcaaatgctctccttggtcagg

SEQ ID NO: 8293022 - DNA, 22 bp, Homo sapiens
gcaactgaacatgtgtgtggcc

SEQ ID NO: 8293023 - DNA, 22 bp, Homo sapiens
gcaaaacagtcgatgcctccca

SEQ ID NO: 8293024 - DNA, 22 bp, Homo sapiens
gatttctgtaacacttcagata

SEQ ID NO: 8293025 - DNA, 22 bp, Homo sapiens
gcattattaatagctgcatgag

SEQ ID NO: 8293026 - DNA, 18 bp, Homo sapiens
attgttaatagagtactt

SEQ ID NO: 8293027 - DNA, 22 bp, Homo sapiens
attgttaatgttgcactaaggt

SEQ ID NO: 8293028 - DNA, 22 bp, Homo sapiens
attgtacaatgcctggaacatt

SEQ ID NO: 8293029 - DNA, 22 bp, Homo sapiens
attgtaattttagagaaagtgg

SEQ ID NO: 8293030 - DNA, 22 bp, Homo sapiens
attgtaattttagagaaagtgg

SEQ ID NO: 8293031 - DNA, 22 bp, Homo sapiens
atttaaatgcttaagagggttt

SEQ ID NO: 8293032 - DNA, 22 bp, Homo sapiens
caaatgtgttttttcttctaca

SEQ ID NO: 8293033 - DNA, 22 bp, Homo sapiens
caaatgtgtagagcttttgggg

SEQ ID NO: 8293034 - DNA, 22 bp, Homo sapiens
caaatgaagaaccttctcacct

SEQ ID NO: 8293035 - DNA, 22 bp, Homo sapiens
caaatccagatcccagtcgtag

SEQ ID NO: 8293036 - DNA, 22 bp, Homo sapiens
atttcttcctctgtcagtaact

SEQ ID NO: 8293037 - DNA, 22 bp, Homo sapiens
attttgaaaagcatttgagtaa

SEQ ID NO: 8293038 - DNA, 22 bp, Homo sapiens
attttgaaaccaagttatttcc

SEQ ID NO: 8293039 - DNA, 18 bp, Homo sapiens
attttgaacaatgctgta

SEQ ID NO: 8293040 - DNA, 23 bp, Homo sapiens
atttgagaaagtatttttaagac

SEQ ID NO: 8293041 - DNA, 22 bp, Homo sapiens
atttgagatggtaaataacttt

SEQ ID NO: 8293042 - DNA, 18 bp, Homo sapiens
ccatttcatgattattac

SEQ ID NO: 8293043 - DNA, 22 bp, Homo sapiens
catcagaagaaagacaaatgat

SEQ ID NO: 8293044 - DNA, 22 bp, Homo sapiens
aggcaggccctctggaaaggta

SEQ ID NO: 8293045 - DNA, 22 bp, Homo sapiens
ccaaacaaatccccattcttag

SEQ ID NO: 8293046 - DNA, 22 bp, Homo sapiens
agctttattcatgatttcaggg

SEQ ID NO: 8293047 - DNA, 22 bp, Homo sapiens
agctttatttgtcattcacggc

SEQ ID NO: 8293048 - DNA, 22 bp, Homo sapiens
aggaaaaataaggcagcagggc

SEQ ID NO: 8293049 - DNA, 22 bp, Homo sapiens
cttcttaaattggattgctatt

SEQ ID NO: 8293050 - DNA, 22 bp, Homo sapiens
cttcttaactgtatatactatg

SEQ ID NO: 8293051 - DNA, 22 bp, Homo sapiens
cttcttaatcccttatatattt

SEQ ID NO: 8293052 - DNA, 22 bp, Homo sapiens
cttcttaaagttgtcacagctg

SEQ ID NO: 8293053 - DNA, 22 bp, Homo sapiens
cttaagaatattgaagttgtgg

SEQ ID NO: 8293054 - DNA, 22 bp, Homo sapiens
cttaaccagaaaatgcacttgt

SEQ ID NO: 8293055 - DNA, 22 bp, Homo sapiens
cttaacagatacatctgtggtt

SEQ ID NO: 8293056 - DNA, 22 bp, Homo sapiens
cttaacagagagaagtgttgct

SEQ ID NO: 8293057 - DNA, 22 bp, Homo sapiens
cttaacagcaagatctgtgtca

SEQ ID NO: 8293058 - DNA, 22 bp, Homo sapiens
cttatgtaaactacagataata

SEQ ID NO: 8293059 - DNA, 22 bp, Homo sapiens
cttatgtaaaacggaaagggaa

SEQ ID NO: 8293060 - DNA, 22 bp, Homo sapiens
cttatgtacacacatatattgt

SEQ ID NO: 8293061 - DNA, 22 bp, Homo sapiens
cttatgtatatttggaacgtac

SEQ ID NO: 8293062 - DNA, 22 bp, Homo sapiens
cttatgtataatgttccacata

SEQ ID NO: 8293063 - DNA, 22 bp, Homo sapiens
cttatgtatgctactttgtggt

SEQ ID NO: 8293064 - DNA, 22 bp, Homo sapiens
cttcaactttgtaagtagaatt

SEQ ID NO: 8293065 - DNA, 22 bp, Homo sapiens
cttcaagatatttctagaatca

SEQ ID NO: 8293066 - DNA, 22 bp, Homo sapiens
atcaagaacttattttggaaat

SEQ ID NO: 8293067 - DNA, 22 bp, Homo sapiens
atcataaaattgcaccatttct

SEQ ID NO: 8293068 - DNA, 22 bp, Homo sapiens
atcataaaccactttgtaatct

SEQ ID NO: 8293069 - DNA, 22 bp, Homo sapiens
atcataaaccactttgtaatct

SEQ ID NO: 8293070 - DNA, 22 bp, Homo sapiens
atcataaagtgctatctgattg

SEQ ID NO: 8293071 - DNA, 22 bp, Homo sapiens
atcataaagtgctatctgattg

SEQ ID NO: 8293072 - DNA, 22 bp, Homo sapiens
atcacaaaggctgcttcatgat

SEQ ID NO: 8293073 - DNA, 22 bp, Homo sapiens
atataaagaagtggaaaatgag

SEQ ID NO: 8293074 - DNA, 22 bp, Homo sapiens
atataaagtgtttagaaagctg

SEQ ID NO: 8293075 - DNA, 22 bp, Homo sapiens
atagtggttggatatgtcagag

SEQ ID NO: 8293076 - DNA, 22 bp, Homo sapiens
atagtggtgagctgcatttatg

SEQ ID NO: 8293077 - DNA, 20 bp, Homo sapiens
atacacatgcagacagatgc

SEQ ID NO: 8293078 - DNA, 22 bp, Homo sapiens
atacatgtcatcatatgtttgt

SEQ ID NO: 8293079 - DNA, 22 bp, Homo sapiens
atacacatgcacacatgtgtgt

SEQ ID NO: 8293080 - DNA, 20 bp, Homo sapiens
atacacatattcttgcaact

SEQ ID NO: 8293081 - DNA, 22 bp, Homo sapiens
atacacatatatacacgtttaa

SEQ ID NO: 8293082 - DNA, 22 bp, Homo sapiens
ataaaatcagagttggattgga

SEQ ID NO: 8293083 - DNA, 22 bp, Homo sapiens
ataaacatctgtttctcttctg

SEQ ID NO: 8293084 - DNA, 22 bp, Homo sapiens
ataaagcaaataggactattgc

SEQ ID NO: 8293085 - DNA, 22 bp, Homo sapiens
ataaagcaagcataccattaag

SEQ ID NO: 8293086 - DNA, 22 bp, Homo sapiens
ataaagcatactttgtatgact

SEQ ID NO: 8293087 - DNA, 22 bp, Homo sapiens
ataaagcatctagtctgtcact

SEQ ID NO: 8293088 - DNA, 22 bp, Homo sapiens
ataaagaggatgtatttacagc

SEQ ID NO: 8293089 - DNA, 22 bp, Homo sapiens
ataaaacttattagaattgtgt

SEQ ID NO: 8293090 - DNA, 22 bp, Homo sapiens
ataaaacttattagaattgtgt

SEQ ID NO: 8293091 - DNA, 22 bp, Homo sapiens
agttctcattgcatgagacaga

SEQ ID NO: 8293092 - DNA, 22 bp, Homo sapiens
agtgtgaccttatttggaaaca

SEQ ID NO: 8293093 - DNA, 22 bp, Homo sapiens
agtgtattgattggaacagcct

SEQ ID NO: 8293094 - DNA, 22 bp, Homo sapiens
agtggtaactaagtcctgctta

SEQ ID NO: 8293095 - DNA, 21 bp, Homo sapiens
agttcatactgagtaacaaaa

SEQ ID NO: 8293096 - DNA, 23 bp, Homo sapiens
agttccagaaaaatgctcaagca

SEQ ID NO: 8293097 - DNA, 22 bp, Homo sapiens
agttaaagtctgaaatagagaa

SEQ ID NO: 8293098 - DNA, 22 bp, Homo sapiens
agtgcattatatgtttcaatgg

SEQ ID NO: 8293099 - DNA, 22 bp, Homo sapiens
agtgcattgcatctctgcttca

SEQ ID NO: 8293100 - DNA, 17 bp, Homo sapiens
agtgacttggaaagagc

SEQ ID NO: 8293101 - DNA, 22 bp, Homo sapiens
agtaacaagtgccaacgttaga

SEQ ID NO: 8293102 - DNA, 22 bp, Homo sapiens
ctatcaaacagccattaatata

SEQ ID NO: 8293103 - DNA, 22 bp, Homo sapiens
ctatctttcgattctagcttaa

SEQ ID NO: 8293104 - DNA, 22 bp, Homo sapiens
aggtaaggctgtaagctaagcc

SEQ ID NO: 8293105 - DNA, 22 bp, Homo sapiens
aggtaagggtcacagttcatat

SEQ ID NO: 8293106 - DNA, 22 bp, Homo sapiens
aggtaacactacttagtatact

SEQ ID NO: 8293107 - DNA, 22 bp, Homo sapiens
aggtaaagacagtgaaagaggg

SEQ ID NO: 8293108 - DNA, 22 bp, Homo sapiens
aggtaaagactgcaaggagaat

SEQ ID NO: 8293109 - DNA, 22 bp, Homo sapiens
aggtcacacttggatcatagaa

SEQ ID NO: 8293110 - DNA, 22 bp, Homo sapiens
aggtcacacaactgtcagaggc

SEQ ID NO: 8293111 - DNA, 22 bp, Homo sapiens
aggtacagatgaaagtctagtt

SEQ ID NO: 8293112 - DNA, 22 bp, Homo sapiens
aggtcacatggataatgatcag

SEQ ID NO: 8293113 - DNA, 22 bp, Homo sapiens
atcaaaatgctccagtgatggt

SEQ ID NO: 8293114 - DNA, 22 bp, Homo sapiens
atcagtgctaaagcaaatgccc

SEQ ID NO: 8293115 - DNA, 22 bp, Homo sapiens
agaaatcattcccaaacccata

SEQ ID NO: 8293116 - DNA, 22 bp, Homo sapiens
agaaatcatgactaagagcagt

SEQ ID NO: 8293117 - DNA, 22 bp, Homo sapiens
atattttggggtgatgtgcatc

SEQ ID NO: 8293118 - DNA, 22 bp, Homo sapiens
agaaaaactaagagtgggtggt

SEQ ID NO: 8293119 - DNA, 22 bp, Homo sapiens
atattttgtaacttggaatagg

SEQ ID NO: 8293120 - DNA, 22 bp, Homo sapiens
atcaaaaccttgacttttaatg

SEQ ID NO: 8293121 - DNA, 22 bp, Homo sapiens
agaacctcaattatttttgcac

SEQ ID NO: 8293122 - DNA, 22 bp, Homo sapiens
agaacctctggatacagtttaa

SEQ ID NO: 8293123 - DNA, 22 bp, Homo sapiens
agaacatctaaatatctgagac

SEQ ID NO: 8293124 - DNA, 19 bp, Homo sapiens
agaaatctcgagatttgtt

SEQ ID NO: 8293125 - DNA, 22 bp, Homo sapiens
agaaatctgactgctgtgcaca

SEQ ID NO: 8293126 - DNA, 22 bp, Homo sapiens
actttggatctgatgtaatcag

SEQ ID NO: 8293127 - DNA, 22 bp, Homo sapiens
actttgcagagccagaagagaa

SEQ ID NO: 8293128 - DNA, 19 bp, Homo sapiens
actttgcatgtgtgtctaa

SEQ ID NO: 8293129 - DNA, 22 bp, Homo sapiens
atacatcatgctccatatattt

SEQ ID NO: 8293130 - DNA, 22 bp, Homo sapiens
actttgcactaagttactcatt

SEQ ID NO: 8293131 - DNA, 22 bp, Homo sapiens
actttgcaatgggcagaaccca

SEQ ID NO: 8293132 - DNA, 22 bp, Homo sapiens
actttgcaatacttaatacaaa

SEQ ID NO: 8293133 - DNA, 22 bp, Homo sapiens
agtttctaccggtacattcagg

SEQ ID NO: 8293134 - DNA, 19 bp, Homo sapiens
ataaataaaaagtgggaga

SEQ ID NO: 8293135 - DNA, 19 bp, Homo sapiens
ataaataaaaagtgggaga

SEQ ID NO: 8293136 - DNA, 22 bp, Homo sapiens
actactttgggccatttgttta

SEQ ID NO: 8293137 - DNA, 22 bp, Homo sapiens
aggtcaaaccacagctctaggc

SEQ ID NO: 8293138 - DNA, 22 bp, Homo sapiens
aggtcaagtttagatagagtta

SEQ ID NO: 8293139 - DNA, 22 bp, Homo sapiens
aggtcaaggccaaaagagtggt

SEQ ID NO: 8293140 - DNA, 18 bp, Homo sapiens
agtagtgggtttagcttc

SEQ ID NO: 8293141 - DNA, 22 bp, Homo sapiens
agtactttacttcttacagttt

SEQ ID NO: 8293142 - DNA, 22 bp, Homo sapiens
acattgaacatggcaggacatt

SEQ ID NO: 8293143 - DNA, 22 bp, Homo sapiens
acattgaagtgtctggcctcct

SEQ ID NO: 8293144 - DNA, 22 bp, Homo sapiens
acattaatgaggtgatgacaca

SEQ ID NO: 8293145 - DNA, 22 bp, Homo sapiens
acattcaaggccttctgacaca

SEQ ID NO: 8293146 - DNA, 22 bp, Homo sapiens
acattcaaggccttctgacaca

SEQ ID NO: 8293147 - DNA, 22 bp, Homo sapiens
acattcctgaggaaatacattc

SEQ ID NO: 8293148 - DNA, 22 bp, Homo sapiens
acattctaacattgtacagata

SEQ ID NO: 8293149 - DNA, 22 bp, Homo sapiens
acatgaaacctgagtctaactc

SEQ ID NO: 8293150 - DNA, 20 bp, Homo sapiens
acatgaaaggaaacaggaaa

SEQ ID NO: 8293151 - DNA, 22 bp, Homo sapiens
aggcagtgttcttctaagggca

SEQ ID NO: 8293152 - DNA, 22 bp, Homo sapiens
acatacatgggattaaaaaatt

SEQ ID NO: 8293153 - DNA, 20 bp, Homo sapiens
accataatgttaattacaaa

SEQ ID NO: 8293154 - DNA, 18 bp, Homo sapiens
aggcacagagcatacata

SEQ ID NO: 8293155 - DNA, 22 bp, Homo sapiens
acataacaatcataggacatag

SEQ ID NO: 8293156 - DNA, 22 bp, Homo sapiens
acataaatttcactgttccgtg

SEQ ID NO: 8293157 - DNA, 22 bp, Homo sapiens
acatacatcaagtatcacaaga

SEQ ID NO: 8293158 - DNA, 23 bp, Homo sapiens
acatacatggagataaagtgatg

SEQ ID NO: 8293159 - DNA, 22 bp, Homo sapiens
agcttcaaggttcaaggatgct

SEQ ID NO: 8293160 - DNA, 22 bp, Homo sapiens
agctggttcagaaattagatgg

SEQ ID NO: 8293161 - DNA, 22 bp, Homo sapiens
agctggttagcaatctaagtga

SEQ ID NO: 8293162 - DNA, 20 bp, Homo sapiens
agctggttatcttaattctt

SEQ ID NO: 8293163 - DNA, 22 bp, Homo sapiens
aggaaaaaagtctgtgattata

SEQ ID NO: 8293164 - DNA, 22 bp, Homo sapiens
agctgcaggattatggaatgga

SEQ ID NO: 8293165 - DNA, 22 bp, Homo sapiens
agaatatgaggaaactgtgaat

SEQ ID NO: 8293166 - DNA, 22 bp, Homo sapiens
atgcatcaaagtctgaaatttc

SEQ ID NO: 8293167 - DNA, 22 bp, Homo sapiens
agacagaacagaataattgttg

SEQ ID NO: 8293168 - DNA, 22 bp, Homo sapiens
agagaattggagcagtgacagg

SEQ ID NO: 8293169 - DNA, 21 bp, Homo sapiens
agagaattgccttagatgttc

SEQ ID NO: 8293170 - DNA, 22 bp, Homo sapiens
agagaattacagaagaatgtca

SEQ ID NO: 8293171 - DNA, 22 bp, Homo sapiens
attacagtaacagctacaatgc

SEQ ID NO: 8293172 - DNA, 22 bp, Homo sapiens
agatcacagcccccagatgcca

SEQ ID NO: 8293173 - DNA, 22 bp, Homo sapiens
agatgtgtttctagttcctgca

SEQ ID NO: 8293174 - DNA, 22 bp, Homo sapiens
attttagcaaatgcaagatgga

SEQ ID NO: 8293175 - DNA, 22 bp, Homo sapiens
agcatgctggtgttcatggcag

SEQ ID NO: 8293176 - DNA, 22 bp, Homo sapiens
cacatttaatcctttataagta

SEQ ID NO: 8293177 - DNA, 23 bp, Homo sapiens
caccactttctccttctccttgg

SEQ ID NO: 8293178 - DNA, 22 bp, Homo sapiens
caatacatcaggtcaaaatgtg

SEQ ID NO: 8293179 - DNA, 22 bp, Homo sapiens
caatacaattaccagttaatca

SEQ ID NO: 8293180 - DNA, 22 bp, Homo sapiens
caataatatcctgtgctgtttg

SEQ ID NO: 8293181 - DNA, 21 bp, Homo sapiens
cagcaaatcattgggcagact

SEQ ID NO: 8293182 - DNA, 22 bp, Homo sapiens
aagcacatctcctgtgcagaac

SEQ ID NO: 8293183 - DNA, 22 bp, Homo sapiens
aagacatttatgaaaagtgctg

SEQ ID NO: 8293184 - DNA, 22 bp, Homo sapiens
aagaggtagcagtcacaaaaga

SEQ ID NO: 8293185 - DNA, 22 bp, Homo sapiens
aagaggtcataccagataaggg

SEQ ID NO: 8293186 - DNA, 22 bp, Homo sapiens
aagagttaagcaacagatacca

SEQ ID NO: 8293187 - DNA, 22 bp, Homo sapiens
aattagagatcagttctttgac

SEQ ID NO: 8293188 - DNA, 22 bp, Homo sapiens
aattcaaattacaatagttgtt

SEQ ID NO: 8293189 - DNA, 22 bp, Homo sapiens
aattcaaagactagaattttgc

SEQ ID NO: 8293190 - DNA, 22 bp, Homo sapiens
aagaattattgcaatactagat

SEQ ID NO: 8293191 - DNA, 22 bp, Homo sapiens
aatgtctttaaagtgcaataga

SEQ ID NO: 8293192 - DNA, 22 bp, Homo sapiens
aatgtcttgagaagagaaatct

SEQ ID NO: 8293193 - DNA, 22 bp, Homo sapiens
aatgtacaataagacaaagagg

SEQ ID NO: 8293194 - DNA, 22 bp, Homo sapiens
aatgttatgtggttcaacttaa

SEQ ID NO: 8293195 - DNA, 22 bp, Homo sapiens
aatgttaaaaccttcagtgctt

SEQ ID NO: 8293196 - DNA, 22 bp, Homo sapiens
aagccatttgttgtccttcagg

SEQ ID NO: 8293197 - DNA, 22 bp, Homo sapiens
aaatttaagaagtgtgtgcgtg

SEQ ID NO: 8293198 - DNA, 22 bp, Homo sapiens
aaattgttgatctacagtaagg

SEQ ID NO: 8293199 - DNA, 22 bp, Homo sapiens
aacaaatgtgtggcagtgtggg

SEQ ID NO: 8293200 - DNA, 22 bp, Homo sapiens
aagttgaagcatgaaccaaggt

SEQ ID NO: 8293201 - DNA, 22 bp, Homo sapiens
aagttgaatgcgtacgtgacat

SEQ ID NO: 8293202 - DNA, 22 bp, Homo sapiens
aataaactgctcaattgcatca

SEQ ID NO: 8293203 - DNA, 20 bp, Homo sapiens
aataaactactgagagatgt

SEQ ID NO: 8293204 - DNA, 18 bp, Homo sapiens
aacagtttccagattctc

SEQ ID NO: 8293205 - DNA, 22 bp, Homo sapiens
aagtttgacagaagtttctaat

SEQ ID NO: 8293206 - DNA, 22 bp, Homo sapiens
aagtttgagaagcttatagata

SEQ ID NO: 8293207 - DNA, 22 bp, Homo sapiens
aagtttgagagcctttagtata

SEQ ID NO: 8293208 - DNA, 22 bp, Homo sapiens
aataaaatggtcagttttctca

SEQ ID NO: 8293209 - DNA, 22 bp, Homo sapiens
aatatttgcatcattagctatt

SEQ ID NO: 8293210 - DNA, 22 bp, Homo sapiens
aacatttcagcacctgattcct

SEQ ID NO: 8293211 - DNA, 21 bp, Homo sapiens
aacatttcaggatccaaattg

SEQ ID NO: 8293212 - DNA, 22 bp, Homo sapiens
aacatttcagcaaataagaaca

SEQ ID NO: 8293213 - DNA, 20 bp, Homo sapiens
aacattgaaagtctagaaga

SEQ ID NO: 8293214 - DNA, 22 bp, Homo sapiens
aacataaatttgaagtggcaaa

SEQ ID NO: 8293215 - DNA, 22 bp, Homo sapiens
aactcagttacatattagaata

SEQ ID NO: 8293216 - DNA, 22 bp, Homo sapiens
aactcagtgtgtttcttagtat

SEQ ID NO: 8293217 - DNA, 22 bp, Homo sapiens
aactcagttctttccacaatgc

SEQ ID NO: 8293218 - DNA, 22 bp, Homo sapiens
aatcagaaaattcagtggaatt

SEQ ID NO: 8293219 - DNA, 22 bp, Homo sapiens
aatcactttgcactcttatttg

SEQ ID NO: 8293220 - DNA, 22 bp, Homo sapiens
aaatattattgcttaaggggag

SEQ ID NO: 8293221 - DNA, 22 bp, Homo sapiens
aaatattagggagaacagggac

SEQ ID NO: 8293222 - DNA, 22 bp, Homo sapiens
aaatgcctctgctgtacacaat

SEQ ID NO: 8293223 - DNA, 22 bp, Homo sapiens
aaatgcctgtgtaaattctagc

SEQ ID NO: 8293224 - DNA, 18 bp, Homo sapiens
aaatgctaggctacatga

SEQ ID NO: 8293225 - DNA, 22 bp, Homo sapiens
aaatataatttctgcctcaata

SEQ ID NO: 8293226 - DNA, 22 bp, Homo sapiens
aaatatgtaaccaaggtgaagt

SEQ ID NO: 8293227 - DNA, 22 bp, Homo sapiens
aaatatgagggtgatgcccaga

SEQ ID NO: 8293228 - DNA, 22 bp, Homo sapiens
aaatatgtaaccaaggtgaagt

SEQ ID NO: 8293229 - DNA, 22 bp, Homo sapiens
aaatatgtgatcagtgaataaa

SEQ ID NO: 8293230 - DNA, 22 bp, Homo sapiens
aaatatgtgatcagtgaataaa

SEQ ID NO: 8293231 - DNA, 22 bp, Homo sapiens
aaatatgtatggagttcatgaa

SEQ ID NO: 8293232 - DNA, 22 bp, Homo sapiens
aaatatgtaagattagcactag

SEQ ID NO: 8293233 - DNA, 22 bp, Homo sapiens
aaatactgttgaatgaagtaag

SEQ ID NO: 8293234 - DNA, 22 bp, Homo sapiens
aaagcaatggatgagaatctgt

SEQ ID NO: 8293235 - DNA, 22 bp, Homo sapiens
aaaggcattttaattctaaaga

SEQ ID NO: 8293236 - DNA, 22 bp, Homo sapiens
aaagcaatgatggtagacacgt

SEQ ID NO: 8293237 - DNA, 22 bp, Homo sapiens
aaagcaatgcttgtggaatgta

SEQ ID NO: 8293238 - DNA, 22 bp, Homo sapiens
aaagtcatttgtatataccctt

SEQ ID NO: 8293239 - DNA, 22 bp, Homo sapiens
aaagtcattttccagaccagta

SEQ ID NO: 8293240 - DNA, 22 bp, Homo sapiens
aaaaatgtgaccacagggtgtt

SEQ ID NO: 8293241 - DNA, 22 bp, Homo sapiens
aaaaatgtcattatggaactga

SEQ ID NO: 8293242 - DNA, 22 bp, Homo sapiens
aaaaatgaattcttcagtggca

SEQ ID NO: 8293243 - DNA, 22 bp, Homo sapiens
aaaaatgctgtggtagctgtgt

SEQ ID NO: 8293244 - DNA, 22 bp, Homo sapiens
aaaaatgcttggacttaataaa

SEQ ID NO: 8293245 - DNA, 22 bp, Homo sapiens
aaaaatgaaacggctggttggc

SEQ ID NO: 8293246 - DNA, 22 bp, Homo sapiens
aaaaactgtaattacttttgca

SEQ ID NO: 8293247 - DNA, 22 bp, Homo sapiens
aaaagtgtccagattatgaaga

SEQ ID NO: 8293248 - DNA, 22 bp, Homo sapiens
aaaatagatgaaaggaagtctg

SEQ ID NO: 8293249 - DNA, 22 bp, Homo sapiens
aaacatgagcacttgcttcata

SEQ ID NO: 8293250 - DNA, 22 bp, Homo sapiens
aaacatgagttaaaagtaactg

SEQ ID NO: 8293251 - DNA, 22 bp, Homo sapiens
aacaactgaaaagctttttctg

SEQ ID NO: 8293252 - DNA, 22 bp, Homo sapiens
aacaaatgtgttttgtaattaa

SEQ ID NO: 8293253 - DNA, 22 bp, Homo sapiens
aaatggtatttactctgtatta

SEQ ID NO: 8293254 - DNA, 22 bp, Homo sapiens
aaatggtaagacaacacattat

SEQ ID NO: 8293255 - DNA, 22 bp, Homo sapiens
aacaattgacacttcattgtga

SEQ ID NO: 8293256 - DNA, 22 bp, Homo sapiens
aacacaaagaagctgcaggatc

SEQ ID NO: 8293257 - DNA, 22 bp, Homo sapiens
aacacataggcagagcatgaca

SEQ ID NO: 8293258 - DNA, 22 bp, Homo sapiens
aacacatatttatatatgcaca

SEQ ID NO: 8293259 - DNA, 22 bp, Homo sapiens
aacacatatttatatatgcaca

SEQ ID NO: 8293260 - DNA, 22 bp, Homo sapiens
aacattcacctctacctccttc

SEQ ID NO: 8293261 - DNA, 22 bp, Homo sapiens
aacattcaaaacccagttcagt

SEQ ID NO: 8293262 - DNA, 21 bp, Homo sapiens
aacatttctgggagaactcac

SEQ ID NO: 8293263 - DNA, 22 bp, Homo sapiens
aacatttctgagaatatcagtt

SEQ ID NO: 8293264 - DNA, 22 bp, Homo sapiens
aacatttcattggaagctatgt

SEQ ID NO: 8293265 - DNA, 20 bp, Homo sapiens
aacagtaccatttatctcag

SEQ ID NO: 8293266 - DNA, 22 bp, Homo sapiens
aacagtaatgtggtgttgggtt

SEQ ID NO: 8293267 - DNA, 22 bp, Homo sapiens
aacagtatcttttatcagaaat

SEQ ID NO: 8293268 - DNA, 22 bp, Homo sapiens
aactaatacattaatacatgtg

SEQ ID NO: 8293269 - DNA, 22 bp, Homo sapiens
aacatttcttctgaaactgagt

SEQ ID NO: 8293270 - DNA, 23 bp, Homo sapiens
aactgagataatgtatgtaaagc

SEQ ID NO: 8293271 - DNA, 22 bp, Homo sapiens
aactcagtcataaagcgaatgc

SEQ ID NO: 8293272 - DNA, 17 bp, Homo sapiens
aaatatgacctcaaagt

SEQ ID NO: 8293273 - DNA, 22 bp, Homo sapiens
aaatatgactagaatgccaggt

SEQ ID NO: 8293274 - DNA, 22 bp, Homo sapiens
aaatatgaatgataagagttat

SEQ ID NO: 8293275 - DNA, 23 bp, Homo sapiens
aagaatgcttctgaagagctgcc

SEQ ID NO: 8293276 - DNA, 22 bp, Homo sapiens
aagaatgtcgttggtattttaa

SEQ ID NO: 8293277 - DNA, 22 bp, Homo sapiens
aagaatgtgggtggatatgatg

SEQ ID NO: 8293278 - DNA, 22 bp, Homo sapiens
aagaatgttcttgtagtcatga

SEQ ID NO: 8293279 - DNA, 22 bp, Homo sapiens
aagaatgttagtttctgataca

SEQ ID NO: 8293280 - DNA, 22 bp, Homo sapiens
aagaatgttcattaaactgttg

SEQ ID NO: 8293281 - DNA, 22 bp, Homo sapiens
aagacagagactctgcaacagg

SEQ ID NO: 8293282 - DNA, 23 bp, Homo sapiens
agaattgtaaatagaatatacct

SEQ ID NO: 8293283 - DNA, 22 bp, Homo sapiens
agaattgttggggtaataaaag

SEQ ID NO: 8293284 - DNA, 22 bp, Homo sapiens
agaattgtaagcaatttgatta

SEQ ID NO: 8293285 - DNA, 22 bp, Homo sapiens
agaatttttgattatctactcg

SEQ ID NO: 8293286 - DNA, 19 bp, Homo sapiens
aatgtagtgttatgtcaac

SEQ ID NO: 8293287 - DNA, 22 bp, Homo sapiens
aatgctgtatatcttagctaat

SEQ ID NO: 8293288 - DNA, 22 bp, Homo sapiens
aatgctgtaaagatgctatctg

SEQ ID NO: 8293289 - DNA, 22 bp, Homo sapiens
agaataaatcaaatgtcctgag

SEQ ID NO: 8293290 - DNA, 22 bp, Homo sapiens
agaataaactgctttagggcag

SEQ ID NO: 8293291 - DNA, 22 bp, Homo sapiens
agaataaatcaaatgtcctgag

SEQ ID NO: 8293292 - DNA, 22 bp, Homo sapiens
agaataaatgttggacttagga

SEQ ID NO: 8293293 - DNA, 22 bp, Homo sapiens
agacactggtgaagaaatcagg

SEQ ID NO: 8293294 - DNA, 22 bp, Homo sapiens
aattttgtgtgggatcaaagga

SEQ ID NO: 8293295 - DNA, 22 bp, Homo sapiens
aatttcaagtggcatctttgat

SEQ ID NO: 8293296 - DNA, 22 bp, Homo sapiens
aatttcaaactaataggaacca

SEQ ID NO: 8293297 - DNA, 22 bp, Homo sapiens
aatttcaagtcttgaagaagta

SEQ ID NO: 8293298 - DNA, 22 bp, Homo sapiens
agcactttcctggcaaatgtgg

SEQ ID NO: 8293299 - DNA, 22 bp, Homo sapiens
agcatttaagcttctgcaaagc

SEQ ID NO: 8293300 - DNA, 22 bp, Homo sapiens
acagaactgggaaatgcacata

SEQ ID NO: 8293301 - DNA, 22 bp, Homo sapiens
acagtttacagggatttgagct

SEQ ID NO: 8293302 - DNA, 22 bp, Homo sapiens
acattatccctggcacaactgc

SEQ ID NO: 8293303 - DNA, 22 bp, Homo sapiens
acattagaacattaatattggg

SEQ ID NO: 8293304 - DNA, 22 bp, Homo sapiens
acatgcattctctaaaagcaaa

SEQ ID NO: 8293305 - DNA, 22 bp, Homo sapiens
acatagaaatttatttcttaca

SEQ ID NO: 8293306 - DNA, 23 bp, Homo sapiens
acatagaacagaatatatttgtg

SEQ ID NO: 8293307 - DNA, 22 bp, Homo sapiens
acataatgaaatgcagaaatca

SEQ ID NO: 8293308 - DNA, 22 bp, Homo sapiens
acataataggtgcctgaatatt

SEQ ID NO: 8293309 - DNA, 22 bp, Homo sapiens
acataataaaaataacagctca

SEQ ID NO: 8293310 - DNA, 22 bp, Homo sapiens
acataataggtacctgaataat

SEQ ID NO: 8293311 - DNA, 22 bp, Homo sapiens
acattcttaacagttaaaaact

SEQ ID NO: 8293312 - DNA, 22 bp, Homo sapiens
aatatcaggatgcaaagctgtg

SEQ ID NO: 8293313 - DNA, 22 bp, Homo sapiens
aatatgaattattgttacaagt

SEQ ID NO: 8293314 - DNA, 22 bp, Homo sapiens
acttagtatttttcagctttga

SEQ ID NO: 8293315 - DNA, 22 bp, Homo sapiens
aataacagattttcaagctgtg

SEQ ID NO: 8293316 - DNA, 22 bp, Homo sapiens
aataacaggctcatcagatgct

SEQ ID NO: 8293317 - DNA, 22 bp, Homo sapiens
aataaccttacttattacatgg

SEQ ID NO: 8293318 - DNA, 22 bp, Homo sapiens
aatattcatttgcagaagaagt

SEQ ID NO: 8293319 - DNA, 22 bp, Homo sapiens
aatatgttcaaaatagatcact

SEQ ID NO: 8293320 - DNA, 22 bp, Homo sapiens
aatattaatagaaggggttcta

SEQ ID NO: 8293321 - DNA, 22 bp, Homo sapiens
aatatgtgaggtatgttcagtg

SEQ ID NO: 8293322 - DNA, 22 bp, Homo sapiens
aatatgcatgtatacatgtgta

SEQ ID NO: 8293323 - DNA, 22 bp, Homo sapiens
aatctttaaggactcagtctct

SEQ ID NO: 8293324 - DNA, 22 bp, Homo sapiens
aataaatgttaagattgtctca

SEQ ID NO: 8293325 - DNA, 22 bp, Homo sapiens
aataacagagaagggtggcttc

SEQ ID NO: 8293326 - DNA, 22 bp, Homo sapiens
aataaaatggtcagttttctca

SEQ ID NO: 8293327 - DNA, 22 bp, Homo sapiens
aagttttaacaagtacttacta

SEQ ID NO: 8293328 - DNA, 21 bp, Homo sapiens
aagtaaatcagagaaataacc

SEQ ID NO: 8293329 - DNA, 18 bp, Homo sapiens
aagtaacagaagagcaca

SEQ ID NO: 8293330 - DNA, 22 bp, Homo sapiens
aagtaacaatgctgttgaattg

SEQ ID NO: 8293331 - DNA, 22 bp, Homo sapiens
aagtgatttgtacaaaatgtcg

SEQ ID NO: 8293332 - DNA, 22 bp, Homo sapiens
tcccttaaaactcatgtgttgt

SEQ ID NO: 8293333 - DNA, 22 bp, Homo sapiens
tccactttagcaatgattgaat

SEQ ID NO: 8293334 - DNA, 22 bp, Homo sapiens
tcataaaaatagactctaaagt

SEQ ID NO: 8293335 - DNA, 22 bp, Homo sapiens
tcagtttctccatcgctccagt

SEQ ID NO: 8293336 - DNA, 22 bp, Homo sapiens
tcagtttcttcatctccctaac

SEQ ID NO: 8293337 - DNA, 22 bp, Homo sapiens
tcagtttctaaatcttaccaat

SEQ ID NO: 8293338 - DNA, 22 bp, Homo sapiens
tcatcaaagcgcttggagtagg

SEQ ID NO: 8293339 - DNA, 23 bp, Homo sapiens
tcatcaaacagctgctcaagaaa

SEQ ID NO: 8293340 - DNA, 22 bp, Homo sapiens
tcataaaagtactcatgttcat

SEQ ID NO: 8293341 - DNA, 22 bp, Homo sapiens
tcataaaacacaccaggtagtt

SEQ ID NO: 8293342 - DNA, 22 bp, Homo sapiens
tcataaaatgctcctgatattg

SEQ ID NO: 8293343 - DNA, 20 bp, Homo sapiens
tcataaagaggaaataaata

SEQ ID NO: 8293344 - DNA, 22 bp, Homo sapiens
tcataaagctcttccaaatgta

SEQ ID NO: 8293345 - DNA, 22 bp, Homo sapiens
tcataaagcatttcagcttttg

SEQ ID NO: 8293346 - DNA, 22 bp, Homo sapiens
tcaggcaggctcagaggaaaac

SEQ ID NO: 8293347 - DNA, 22 bp, Homo sapiens
tcaggcaggatcccagggaagg

SEQ ID NO: 8293348 - DNA, 22 bp, Homo sapiens
tcagaggtggtaaaggacagca

SEQ ID NO: 8293349 - DNA, 22 bp, Homo sapiens
tcagaggtcacacagcaagttt

SEQ ID NO: 8293350 - DNA, 22 bp, Homo sapiens
tcagaggtaagggctgagagga

SEQ ID NO: 8293351 - DNA, 18 bp, Homo sapiens
tcagaggtacagaaaagt

SEQ ID NO: 8293352 - DNA, 22 bp, Homo sapiens
tcagaggtccctagcaggagtg

SEQ ID NO: 8293353 - DNA, 22 bp, Homo sapiens
tcagcctacactccaacagcat

SEQ ID NO: 8293354 - DNA, 22 bp, Homo sapiens
tcacatcttattagagtatctc

SEQ ID NO: 8293355 - DNA, 22 bp, Homo sapiens
tcacatgccctgtatttaccag

SEQ ID NO: 8293356 - DNA, 21 bp, Homo sapiens
tcacatgcccattactggagc

SEQ ID NO: 8293357 - DNA, 22 bp, Homo sapiens
tcactgtgcacatatgataggt

SEQ ID NO: 8293358 - DNA, 21 bp, Homo sapiens
tcactgtgcaaatgttgatgg

SEQ ID NO: 8293359 - DNA, 22 bp, Homo sapiens
tcagaacattgacattcttatt

SEQ ID NO: 8293360 - DNA, 22 bp, Homo sapiens
tcacatcattaagacttctcct

SEQ ID NO: 8293361 - DNA, 22 bp, Homo sapiens
tcacatcaacattatagcatga

SEQ ID NO: 8293362 - DNA, 22 bp, Homo sapiens
tcacagcaaatgctgcttctca

SEQ ID NO: 8293363 - DNA, 22 bp, Homo sapiens
tcacagaatagcactgtaagcg

SEQ ID NO: 8293364 - DNA, 22 bp, Homo sapiens
tcaaaagtttcacatagagata

SEQ ID NO: 8293365 - DNA, 22 bp, Homo sapiens
tcaaaagtctgcattcttcaca

SEQ ID NO: 8293366 - DNA, 22 bp, Homo sapiens
tcaaaagtggcctgtaaaatct

SEQ ID NO: 8293367 - DNA, 22 bp, Homo sapiens
tcaaacaggactacattctcat

SEQ ID NO: 8293368 - DNA, 22 bp, Homo sapiens
tcaaacagaggaacaattgttt

SEQ ID NO: 8293369 - DNA, 22 bp, Homo sapiens
tcaaacatgttagcagtctgtg

SEQ ID NO: 8293370 - DNA, 23 bp, Homo sapiens
tcaaacatattgtgagacacagg

SEQ ID NO: 8293371 - DNA, 22 bp, Homo sapiens
tcaatacatacaatgtatagtg

SEQ ID NO: 8293372 - DNA, 22 bp, Homo sapiens
tcaaactagcctgactggtatt

SEQ ID NO: 8293373 - DNA, 22 bp, Homo sapiens
tcaaaccaccttgttactgggg

SEQ ID NO: 8293374 - DNA, 22 bp, Homo sapiens
tcaatacttaagcttaattcta

SEQ ID NO: 8293375 - DNA, 19 bp, Homo sapiens
tcaatgcatgaaatcagcc

SEQ ID NO: 8293376 - DNA, 22 bp, Homo sapiens
gttttataggtgaaatattact

SEQ ID NO: 8293377 - DNA, 22 bp, Homo sapiens
taaacatggattctgatcacag

SEQ ID NO: 8293378 - DNA, 22 bp, Homo sapiens
taaacatgtgagtgtgcatata

SEQ ID NO: 8293379 - DNA, 21 bp, Homo sapiens
taaacataaccttgtatggct

SEQ ID NO: 8293380 - DNA, 17 bp, Homo sapiens
taaatacacaagggtat

SEQ ID NO: 8293381 - DNA, 22 bp, Homo sapiens
taaagttctggtgagaggtaag

SEQ ID NO: 8293382 - DNA, 22 bp, Homo sapiens
taaagttcagtgcatgaatgtg

SEQ ID NO: 8293383 - DNA, 22 bp, Homo sapiens
taaagacaataggaaagttgtt

SEQ ID NO: 8293384 - DNA, 22 bp, Homo sapiens
taaagacaaacccactagggtt

SEQ ID NO: 8293385 - DNA, 22 bp, Homo sapiens
taaacatgttgacatcttacct

SEQ ID NO: 8293386 - DNA, 22 bp, Homo sapiens
taaagaacacagggaatagcac

SEQ ID NO: 8293387 - DNA, 22 bp, Homo sapiens
taaagacaatttcgagctgtag

SEQ ID NO: 8293388 - DNA, 22 bp, Homo sapiens
taagataatccattataatgtt

SEQ ID NO: 8293389 - DNA, 22 bp, Homo sapiens
taacacaaaagaatatgtgtgt

SEQ ID NO: 8293390 - DNA, 22 bp, Homo sapiens
taacacactgaaggtgagatgg

SEQ ID NO: 8293391 - DNA, 22 bp, Homo sapiens
taaatacagtcatttgagccat

SEQ ID NO: 8293392 - DNA, 22 bp, Homo sapiens
taacacatggttagtacacaat

SEQ ID NO: 8293393 - DNA, 22 bp, Homo sapiens
taacacatatctacaacatgtg

SEQ ID NO: 8293394 - DNA, 22 bp, Homo sapiens
taacacatatttcaagagtagt

SEQ ID NO: 8293395 - DNA, 22 bp, Homo sapiens
taacacataagctgagaccatg

SEQ ID NO: 8293396 - DNA, 22 bp, Homo sapiens
gttcattttactgtaaatagca

SEQ ID NO: 8293397 - DNA, 22 bp, Homo sapiens
gttataaatacctaataggatt

SEQ ID NO: 8293398 - DNA, 22 bp, Homo sapiens
gttataaaggtgataatggtca

SEQ ID NO: 8293399 - DNA, 22 bp, Homo sapiens
gttataaaggtgataatggtca

SEQ ID NO: 8293400 - DNA, 22 bp, Homo sapiens
gttataaaatgcacagttgttt

SEQ ID NO: 8293401 - DNA, 22 bp, Homo sapiens
gttagaaacacattcttattga

SEQ ID NO: 8293402 - DNA, 22 bp, Homo sapiens
gttagaaagtgtctgcttgggt

SEQ ID NO: 8293403 - DNA, 22 bp, Homo sapiens
gttccaggcaagtgggatagga

SEQ ID NO: 8293404 - DNA, 22 bp, Homo sapiens
gtttataaggcccaatatttct

SEQ ID NO: 8293405 - DNA, 22 bp, Homo sapiens
gtttagaattctaactttaagg

SEQ ID NO: 8293406 - DNA, 22 bp, Homo sapiens
gtttacaaatattttaaatggt

SEQ ID NO: 8293407 - DNA, 18 bp, Homo sapiens
tacaggaaaagtgttaca

SEQ ID NO: 8293408 - DNA, 22 bp, Homo sapiens
tacaggaagtaagtaatgaaat

SEQ ID NO: 8293409 - DNA, 22 bp, Homo sapiens
tacaggaagcactcaagaaatg

SEQ ID NO: 8293410 - DNA, 22 bp, Homo sapiens
tacataatgagctagttaagtt

SEQ ID NO: 8293411 - DNA, 22 bp, Homo sapiens
tacataattaatctttaagttc

SEQ ID NO: 8293412 - DNA, 22 bp, Homo sapiens
tacatacaagatgtgtttaaaa

SEQ ID NO: 8293413 - DNA, 22 bp, Homo sapiens
tacatacaagatgtgtttaaaa

SEQ ID NO: 8293414 - DNA, 22 bp, Homo sapiens
tacagtttgttacattgttagt

SEQ ID NO: 8293415 - DNA, 22 bp, Homo sapiens
tacatacagtggatgctttagg

SEQ ID NO: 8293416 - DNA, 22 bp, Homo sapiens
tacattccatgtgtgtgtattc

SEQ ID NO: 8293417 - DNA, 22 bp, Homo sapiens
tacttcattcctttgtaaaatg

SEQ ID NO: 8293418 - DNA, 22 bp, Homo sapiens
tacttccagcaatctgcatatt

SEQ ID NO: 8293419 - DNA, 22 bp, Homo sapiens
tacacattctagggcacagtta

SEQ ID NO: 8293420 - DNA, 22 bp, Homo sapiens
tacacattacataatactatct

SEQ ID NO: 8293421 - DNA, 22 bp, Homo sapiens
tacacattttgcgggtacatgt

SEQ ID NO: 8293422 - DNA, 22 bp, Homo sapiens
tacacatatgtccattaatcag

SEQ ID NO: 8293423 - DNA, 22 bp, Homo sapiens
taatgcttaattttcacaagcc

SEQ ID NO: 8293424 - DNA, 22 bp, Homo sapiens
taatgcttttccttcaaataag

SEQ ID NO: 8293425 - DNA, 22 bp, Homo sapiens
taatttcaatagcttgcataat

SEQ ID NO: 8293426 - DNA, 22 bp, Homo sapiens
taatgcagtactgatataaaca

SEQ ID NO: 8293427 - DNA, 22 bp, Homo sapiens
taatgcacagaattgacatggg

SEQ ID NO: 8293428 - DNA, 22 bp, Homo sapiens
taatgcacatagaagtacttag

SEQ ID NO: 8293429 - DNA, 22 bp, Homo sapiens
taatgcacatgactgaactatt

SEQ ID NO: 8293430 - DNA, 22 bp, Homo sapiens
taagttcaatgaactcagttct

SEQ ID NO: 8293431 - DNA, 22 bp, Homo sapiens
taagttcataagcttattctta

SEQ ID NO: 8293432 - DNA, 22 bp, Homo sapiens
taagttcattagactacagata

SEQ ID NO: 8293433 - DNA, 22 bp, Homo sapiens
taagttcagttggtcgaagtag

SEQ ID NO: 8293434 - DNA, 22 bp, Homo sapiens
taagttcagagttctcatttgt

SEQ ID NO: 8293435 - DNA, 22 bp, Homo sapiens
taagtttaaatgtacatgaagc

SEQ ID NO: 8293436 - DNA, 22 bp, Homo sapiens
taataaatgaaagtgctggcat

SEQ ID NO: 8293437 - DNA, 22 bp, Homo sapiens
taataacaattgtaggacatga

SEQ ID NO: 8293438 - DNA, 22 bp, Homo sapiens
taataaatgaaagtgctggcat

SEQ ID NO: 8293439 - DNA, 22 bp, Homo sapiens
taataaatgaaagtgctggcat

SEQ ID NO: 8293440 - DNA, 22 bp, Homo sapiens
taggaagatgagtatcaacttg

SEQ ID NO: 8293441 - DNA, 22 bp, Homo sapiens
tagtaaaagtttagttgaaagt

SEQ ID NO: 8293442 - DNA, 19 bp, Homo sapiens
tagtagtagaaaacaatac

SEQ ID NO: 8293443 - DNA, 22 bp, Homo sapiens
tagtatctattagtaacaagag

SEQ ID NO: 8293444 - DNA, 22 bp, Homo sapiens
tagtcaaacctcagaatacccc

SEQ ID NO: 8293445 - DNA, 22 bp, Homo sapiens
tagtccagtaaaacagctaacg

SEQ ID NO: 8293446 - DNA, 22 bp, Homo sapiens
tagaagttaaaggaatacagaa

SEQ ID NO: 8293447 - DNA, 22 bp, Homo sapiens
tagaataagttgatgatatatg

SEQ ID NO: 8293448 - DNA, 22 bp, Homo sapiens
tagaataagttgatgatatatg

SEQ ID NO: 8293449 - DNA, 22 bp, Homo sapiens
tagcagtggaatcttttgtcca

SEQ ID NO: 8293450 - DNA, 22 bp, Homo sapiens
tagcatttatggtcatgtgtcc

SEQ ID NO: 8293451 - DNA, 22 bp, Homo sapiens
tagcagtgccaggattttgctg

SEQ ID NO: 8293452 - DNA, 21 bp, Homo sapiens
tagcacttcgctgtaattggg

SEQ ID NO: 8293453 - DNA, 22 bp, Homo sapiens
tagcacaggtcttgttgccatt

SEQ ID NO: 8293454 - DNA, 22 bp, Homo sapiens
tatcaaagttgtcctgtgaagt

SEQ ID NO: 8293455 - DNA, 22 bp, Homo sapiens
tatcaaaggctatgtgattttt

SEQ ID NO: 8293456 - DNA, 22 bp, Homo sapiens
tatctataatgttttacttcct

SEQ ID NO: 8293457 - DNA, 22 bp, Homo sapiens
tatctgttccaggcactcagct

SEQ ID NO: 8293458 - DNA, 22 bp, Homo sapiens
tatctttgcaaatatctctaag

SEQ ID NO: 8293459 - DNA, 22 bp, Homo sapiens
tatgcacatataacctgcactg

SEQ ID NO: 8293460 - DNA, 22 bp, Homo sapiens
tatgcacattatctaatccatt

SEQ ID NO: 8293461 - DNA, 22 bp, Homo sapiens
tatgcacattcacacaaaaatg

SEQ ID NO: 8293462 - DNA, 22 bp, Homo sapiens
tatgcacgtctatttatgaaga

SEQ ID NO: 8293463 - DNA, 22 bp, Homo sapiens
tatgcacattggtttcctcatt

SEQ ID NO: 8293464 - DNA, 22 bp, Homo sapiens
tatgcataggtatctatactca

SEQ ID NO: 8293465 - DNA, 22 bp, Homo sapiens
tatgcataattggataagtaga

SEQ ID NO: 8293466 - DNA, 22 bp, Homo sapiens
tatgcatatagatgcacacaca

SEQ ID NO: 8293467 - DNA, 22 bp, Homo sapiens
tatgcatatgaccccaagcttg

SEQ ID NO: 8293468 - DNA, 22 bp, Homo sapiens
tatctttaacttgcagtattta

SEQ ID NO: 8293469 - DNA, 22 bp, Homo sapiens
tatctttagaggaagagaatct

SEQ ID NO: 8293470 - DNA, 22 bp, Homo sapiens
tatatgtaagctatgtaagagt

SEQ ID NO: 8293471 - DNA, 22 bp, Homo sapiens
tatatgtaagctatgtaagagt

SEQ ID NO: 8293472 - DNA, 22 bp, Homo sapiens
tatattaaaccctctctgtagg

SEQ ID NO: 8293473 - DNA, 22 bp, Homo sapiens
tatattaaagtgctttgcagtg

SEQ ID NO: 8293474 - DNA, 22 bp, Homo sapiens
tatattaaatgaccagttttaa

SEQ ID NO: 8293475 - DNA, 22 bp, Homo sapiens
tatattaaatgaccagttttaa

SEQ ID NO: 8293476 - DNA, 22 bp, Homo sapiens
tatattaacacccacttgcctc

SEQ ID NO: 8293477 - DNA, 22 bp, Homo sapiens
tatattaaccatagggttctag

SEQ ID NO: 8293478 - DNA, 22 bp, Homo sapiens
tatattaacttgtgatcctgga

SEQ ID NO: 8293479 - DNA, 22 bp, Homo sapiens
tatactttcctgcaactttgat

SEQ ID NO: 8293480 - DNA, 22 bp, Homo sapiens
tatacagaaccgcctgaagtct

SEQ ID NO: 8293481 - DNA, 22 bp, Homo sapiens
tattggtgggggcagagagaga

SEQ ID NO: 8293482 - DNA, 22 bp, Homo sapiens
tatgttaaatgtttgatgttta

SEQ ID NO: 8293483 - DNA, 22 bp, Homo sapiens
tattcacatgtacatatgctca

SEQ ID NO: 8293484 - DNA, 22 bp, Homo sapiens
tattcacagttgatttacagtt

SEQ ID NO: 8293485 - DNA, 22 bp, Homo sapiens
tattgagttacagaaaatactt

SEQ ID NO: 8293486 - DNA, 22 bp, Homo sapiens
gctgaagagagatgcgtccagc

SEQ ID NO: 8293487 - DNA, 22 bp, Homo sapiens
gctgcaaacctgccacctggtg

SEQ ID NO: 8293488 - DNA, 21 bp, Homo sapiens
gctgcaaattctaacaattat

SEQ ID NO: 8293489 - DNA, 22 bp, Homo sapiens
gctgattattacatgtctgtgg

SEQ ID NO: 8293490 - DNA, 22 bp, Homo sapiens
gctgtgcactacctatacatcc

SEQ ID NO: 8293491 - DNA, 22 bp, Homo sapiens
gcatttgtgttcttcctagagc

SEQ ID NO: 8293492 - DNA, 22 bp, Homo sapiens
gcatctttctgtccattcagca

SEQ ID NO: 8293493 - DNA, 19 bp, Homo sapiens
gcatttctctttacagcca

SEQ ID NO: 8293494 - DNA, 22 bp, Homo sapiens
gcatttcttcctggtgtgagcc

SEQ ID NO: 8293495 - DNA, 22 bp, Homo sapiens
gcatttctgtgcatacacatga

SEQ ID NO: 8293496 - DNA, 22 bp, Homo sapiens
gcataatatacatgcttgatcc

SEQ ID NO: 8293497 - DNA, 22 bp, Homo sapiens
gcctaatatgcaaaattgatac

SEQ ID NO: 8293498 - DNA, 22 bp, Homo sapiens
gcctaataactagctgtgtaac

SEQ ID NO: 8293499 - DNA, 22 bp, Homo sapiens
gcaaatgctaaagtgtagagac

SEQ ID NO: 8293500 - DNA, 22 bp, Homo sapiens
ggctccagggagtggagagaag

SEQ ID NO: 8293501 - DNA, 22 bp, Homo sapiens
ggcagtgggttccccaaggcac

SEQ ID NO: 8293502 - DNA, 18 bp, Homo sapiens
gggcatcattcacaaagt

SEQ ID NO: 8293503 - DNA, 22 bp, Homo sapiens
ggtagcacattgcattaggaga

SEQ ID NO: 8293504 - DNA, 22 bp, Homo sapiens
ggtacaaggagtgaaggtttgg

SEQ ID NO: 8293505 - DNA, 22 bp, Homo sapiens
ggtaacagtatgtagagtaaga

SEQ ID NO: 8293506 - DNA, 19 bp, Homo sapiens
ggtaaaagtgagcttcagg

SEQ ID NO: 8293507 - DNA, 22 bp, Homo sapiens
gtgcaaaagcagttgtggtttt

SEQ ID NO: 8293508 - DNA, 22 bp, Homo sapiens
gtgcaaaaggcattgtggtttt

SEQ ID NO: 8293509 - DNA, 22 bp, Homo sapiens
gtgcaaaagtaaatgtggtttt

SEQ ID NO: 8293510 - DNA, 22 bp, Homo sapiens
gtgcaaaagtaactgtggtttt

SEQ ID NO: 8293511 - DNA, 22 bp, Homo sapiens
gtgcaaaaataattgtggtttt

SEQ ID NO: 8293512 - DNA, 22 bp, Homo sapiens
gtctctatcatagctgaaccct

SEQ ID NO: 8293513 - DNA, 22 bp, Homo sapiens
gtctctatcatagctgaaccct

SEQ ID NO: 8293514 - DNA, 22 bp, Homo sapiens
gtcatttctgtttcttcagtgc

SEQ ID NO: 8293515 - DNA, 22 bp, Homo sapiens
gtcaagtttatccgctcattca

SEQ ID NO: 8293516 - DNA, 22 bp, Homo sapiens
gtcaagttaagataaggtcatg

SEQ ID NO: 8293517 - DNA, 22 bp, Homo sapiens
gtaggaaagtaaatgaaataca

SEQ ID NO: 8293518 - DNA, 22 bp, Homo sapiens
gtaacacagaaatgaaattcca

SEQ ID NO: 8293519 - DNA, 22 bp, Homo sapiens
gtaacaaagtttctaggtgctg

SEQ ID NO: 8293520 - DNA, 22 bp, Homo sapiens
gtaacagaaagtcatgctcatt

SEQ ID NO: 8293521 - DNA, 22 bp, Homo sapiens
gtaacagagggtttgcagatat

SEQ ID NO: 8293522 - DNA, 22 bp, Homo sapiens
gtaaatcccatcctttctctgg

SEQ ID NO: 8293523 - DNA, 22 bp, Homo sapiens
gtaaatgtgcttcttttaactt

SEQ ID NO: 8293524 - DNA, 22 bp, Homo sapiens
gtaaatattccctcggttccta

SEQ ID NO: 8293525 - DNA, 22 bp, Homo sapiens
ttgaatcattacaatagataag

SEQ ID NO: 8293526 - DNA, 22 bp, Homo sapiens
ttgaataattaattacactcag

SEQ ID NO: 8293527 - DNA, 22 bp, Homo sapiens
ttcttaatacctattttctacc

SEQ ID NO: 8293528 - DNA, 22 bp, Homo sapiens
ttcttaatcccacaaatcttca

SEQ ID NO: 8293529 - DNA, 22 bp, Homo sapiens
ttcttaatctgtgtgggttcga

SEQ ID NO: 8293530 - DNA, 22 bp, Homo sapiens
ttcttaaagaggcaaaacacag

SEQ ID NO: 8293531 - DNA, 22 bp, Homo sapiens
ttctgaaaattgggtcatactt

SEQ ID NO: 8293532 - DNA, 22 bp, Homo sapiens
ctaaatgccctacaatgactgg

SEQ ID NO: 8293533 - DNA, 22 bp, Homo sapiens
ctaaatgcctttcctacctaac

SEQ ID NO: 8293534 - DNA, 22 bp, Homo sapiens
ttctcattctgactcagtgtag

SEQ ID NO: 8293535 - DNA, 22 bp, Homo sapiens
cgtcatcacggcaagcatctcc

SEQ ID NO: 8293536 - DNA, 22 bp, Homo sapiens
ttatcgtacgcttcagaaattt

SEQ ID NO: 8293537 - DNA, 22 bp, Homo sapiens
ttatgtacaatgttaatgtaaa

SEQ ID NO: 8293538 - DNA, 22 bp, Homo sapiens
ttatgtactctgcaatgtttga

SEQ ID NO: 8293539 - DNA, 22 bp, Homo sapiens
ttatgtatggatggctgaaagt

SEQ ID NO: 8293540 - DNA, 22 bp, Homo sapiens
ttcaaaacagctagatattgga

SEQ ID NO: 8293541 - DNA, 22 bp, Homo sapiens
ttcaaaacaatctgtttgcatt

SEQ ID NO: 8293542 - DNA, 22 bp, Homo sapiens
tgtttatacctgcaacctgtca

SEQ ID NO: 8293543 - DNA, 22 bp, Homo sapiens
tgtttataccttggtataacca

SEQ ID NO: 8293544 - DNA, 22 bp, Homo sapiens
ttacaaagcgttgagacaagta

SEQ ID NO: 8293545 - DNA, 22 bp, Homo sapiens
ttaatgcagaaatcaaactgac

SEQ ID NO: 8293546 - DNA, 22 bp, Homo sapiens
ttaaaatagccagtgcccctct

SEQ ID NO: 8293547 - DNA, 22 bp, Homo sapiens
ttaaaatgaatattgattagca

SEQ ID NO: 8293548 - DNA, 22 bp, Homo sapiens
ttaaaatctaaagcagttgtct

SEQ ID NO: 8293549 - DNA, 22 bp, Homo sapiens
ctgaggctgggcatggggtcca

SEQ ID NO: 8293550 - DNA, 22 bp, Homo sapiens
ctgaaggctaaaatggactgaa

SEQ ID NO: 8293551 - DNA, 22 bp, Homo sapiens
ctgaaagaataagatgtttaca

SEQ ID NO: 8293552 - DNA, 22 bp, Homo sapiens
tttcaaataccataaacctaat

SEQ ID NO: 8293553 - DNA, 22 bp, Homo sapiens
tttcaaataccataaacctaat

SEQ ID NO: 8293554 - DNA, 22 bp, Homo sapiens
tttcttaggctctaaaatgact

SEQ ID NO: 8293555 - DNA, 22 bp, Homo sapiens
gagcccagcttgcacatggagc

SEQ ID NO: 8293556 - DNA, 22 bp, Homo sapiens
gagccatacaacctataaagtg

SEQ ID NO: 8293557 - DNA, 22 bp, Homo sapiens
gacattcaagtttgcagttagg

SEQ ID NO: 8293558 - DNA, 22 bp, Homo sapiens
gacattgaaaataatgtgtaga

SEQ ID NO: 8293559 - DNA, 22 bp, Homo sapiens
gacattgaacaagtttcctgac

SEQ ID NO: 8293560 - DNA, 22 bp, Homo sapiens
gacattgaatttgaatgtatgt

SEQ ID NO: 8293561 - DNA, 22 bp, Homo sapiens
ctgtaaaactgcttaagtatgc

SEQ ID NO: 8293562 - DNA, 22 bp, Homo sapiens
ctgtagcaagttattcaataaa

SEQ ID NO: 8293563 - DNA, 22 bp, Homo sapiens
ctgtagcagtgtgctctttttc

SEQ ID NO: 8293564 - DNA, 22 bp, Homo sapiens
ctgtacatatacatttttttcc

SEQ ID NO: 8293565 - DNA, 22 bp, Homo sapiens
cttataaagtccatctgaacaa

SEQ ID NO: 8293566 - DNA, 22 bp, Homo sapiens
ctgttttcaaagagagagaatg

SEQ ID NO: 8293567 - DNA, 21 bp, Homo sapiens
ctgtttcttgtgaagtgacac

SEQ ID NO: 8293568 - DNA, 22 bp, Homo sapiens
ctgtttatacgacaggtggagg

SEQ ID NO: 8293569 - DNA, 22 bp, Homo sapiens
ctgtttataaatagaggggagt

SEQ ID NO: 8293570 - DNA, 22 bp, Homo sapiens
cttaatttttgtagtagatgga

SEQ ID NO: 8293571 - DNA, 22 bp, Homo sapiens
cttaatttaaaatagttcaggc

SEQ ID NO: 8293572 - DNA, 22 bp, Homo sapiens
cttacaagaccaaagaaaggat

SEQ ID NO: 8293573 - DNA, 22 bp, Homo sapiens
cttagaaataatggtttcagtt

SEQ ID NO: 8293574 - DNA, 22 bp, Homo sapiens
cttagaaatgcagattctcagg

SEQ ID NO: 8293575 - DNA, 22 bp, Homo sapiens
cttagaaatcgaactcaggtta

SEQ ID NO: 8293576 - DNA, 22 bp, Homo sapiens
cttgtgcaattgacattgaatc

SEQ ID NO: 8293577 - DNA, 22 bp, Homo sapiens
cttgtgcatttcattcctcagg

SEQ ID NO: 8293578 - DNA, 22 bp, Homo sapiens
ctttgaaagctcccaggactta

SEQ ID NO: 8293579 - DNA, 22 bp, Homo sapiens
ctttgaaaacttaaataacagc

SEQ ID NO: 8293580 - DNA, 22 bp, Homo sapiens
gaaaatgtttgtccggagctga

SEQ ID NO: 8293581 - DNA, 22 bp, Homo sapiens
gaaaatgttagcttcatagtca

SEQ ID NO: 8293582 - DNA, 22 bp, Homo sapiens
gaaaatgtttcctgttatttgc

SEQ ID NO: 8293583 - DNA, 22 bp, Homo sapiens
gaaacacatgcagctccataga

SEQ ID NO: 8293584 - DNA, 22 bp, Homo sapiens
ctttgcaatagaggcacacatg

SEQ ID NO: 8293585 - DNA, 22 bp, Homo sapiens
tgctagaaatctgaaactagca

SEQ ID NO: 8293586 - DNA, 22 bp, Homo sapiens
tggtacttggaggcagaaaaat

SEQ ID NO: 8293587 - DNA, 22 bp, Homo sapiens
tggcagtgggaagctggaagtc

SEQ ID NO: 8293588 - DNA, 22 bp, Homo sapiens
tgcaataactactttaatgttg

SEQ ID NO: 8293589 - DNA, 22 bp, Homo sapiens
tgcaataagttgtgttatcact

SEQ ID NO: 8293590 - DNA, 22 bp, Homo sapiens
tgcaataaggagtaatagtaaa

SEQ ID NO: 8293591 - DNA, 22 bp, Homo sapiens
tgcaataaagtgctataaatcc

SEQ ID NO: 8293592 - DNA, 22 bp, Homo sapiens
tgcagagaagaggacagttcta

SEQ ID NO: 8293593 - DNA, 22 bp, Homo sapiens
tgcagagaaagtgtagacaggc

SEQ ID NO: 8293594 - DNA, 22 bp, Homo sapiens
tgcagagacttgtgtgcatttg

SEQ ID NO: 8293595 - DNA, 22 bp, Homo sapiens
tgcagagagatatggcaagagg

SEQ ID NO: 8293596 - DNA, 20 bp, Homo sapiens
tgcaggaatttgcattcctt

SEQ ID NO: 8293597 - DNA, 22 bp, Homo sapiens
tgcaggaatgaggttctcagtt

SEQ ID NO: 8293598 - DNA, 22 bp, Homo sapiens
tgcaggaatagctacagagctg

SEQ ID NO: 8293599 - DNA, 22 bp, Homo sapiens
tcttacagaaaatagataacat

SEQ ID NO: 8293600 - DNA, 22 bp, Homo sapiens
tcttaattctgtgtcttcacta

SEQ ID NO: 8293601 - DNA, 22 bp, Homo sapiens
tcttaattgagaacagtgtagg

SEQ ID NO: 8293602 - DNA, 22 bp, Homo sapiens
tcttagaaatgaagttctttct

SEQ ID NO: 8293603 - DNA, 21 bp, Homo sapiens
tgaaacaatcagacagagtct

SEQ ID NO: 8293604 - DNA, 22 bp, Homo sapiens
tgaaacactttcaattacatat

SEQ ID NO: 8293605 - DNA, 22 bp, Homo sapiens
tgaaacactttcaattacatat

SEQ ID NO: 8293606 - DNA, 21 bp, Homo sapiens
tgaaacactctttccatgaga

SEQ ID NO: 8293607 - DNA, 22 bp, Homo sapiens
cattttctcaatgaaccctctt

SEQ ID NO: 8293608 - DNA, 20 bp, Homo sapiens
tccagttttggagacattct

SEQ ID NO: 8293609 - DNA, 21 bp, Homo sapiens
catttcatgattatagaaatg

SEQ ID NO: 8293610 - DNA, 22 bp, Homo sapiens
catttcatagttgtcacaataa

SEQ ID NO: 8293611 - DNA, 22 bp, Homo sapiens
tctagaaacatgacattgatct

SEQ ID NO: 8293612 - DNA, 22 bp, Homo sapiens
tctagaaattttgccttgtatt

SEQ ID NO: 8293613 - DNA, 22 bp, Homo sapiens
tctataaattatgcagtctcag

SEQ ID NO: 8293614 - DNA, 22 bp, Homo sapiens
tctataaatgcagatatgtgtg

SEQ ID NO: 8293615 - DNA, 22 bp, Homo sapiens
tcataatacaaagagttctgca

SEQ ID NO: 8293616 - DNA, 22 bp, Homo sapiens
tcatcaaagtcaaagaatgact

SEQ ID NO: 8293617 - DNA, 22 bp, Homo sapiens
tcagtttcctcatctacaaaag

SEQ ID NO: 8293618 - DNA, 22 bp, Homo sapiens
cagtgtacttggaatgtaacag

SEQ ID NO: 8293619 - DNA, 21 bp, Homo sapiens
catattaaatcggtgccttta

SEQ ID NO: 8293620 - DNA, 22 bp, Homo sapiens
catgtacagtttttctgtcctg

SEQ ID NO: 8293621 - DNA, 22 bp, Homo sapiens
catgtacactcatgtaactata

SEQ ID NO: 8293622 - DNA, 23 bp, Homo sapiens
catgtacagagtttgataaagtg

SEQ ID NO: 8293623 - DNA, 17 bp, Homo sapiens
catgtgtatgtgggagt

SEQ ID NO: 8293624 - DNA, 22 bp, Homo sapiens
cattacaaccccaaattacaaa

SEQ ID NO: 8293625 - DNA, 22 bp, Homo sapiens
cattacaaacatgttaagattt

SEQ ID NO: 8293626 - DNA, 22 bp, Homo sapiens
cattacaaagttataaacagtt

SEQ ID NO: 8293627 - DNA, 22 bp, Homo sapiens
catgctttgggtcagaaatgcc

SEQ ID NO: 8293628 - DNA, 22 bp, Homo sapiens
catgctttctgtccaaatgtta

SEQ ID NO: 8293629 - DNA, 22 bp, Homo sapiens
catgctttaccaaagcagtgat

SEQ ID NO: 8293630 - DNA, 22 bp, Homo sapiens
catgtacaaaaggcaaatgcct

SEQ ID NO: 8293631 - DNA, 22 bp, Homo sapiens
tccaagaagtcatctaaactgt

SEQ ID NO: 8293632 - DNA, 22 bp, Homo sapiens
tccagaggtatgtagagagtat

SEQ ID NO: 8293633 - DNA, 22 bp, Homo sapiens
tacacagaggctgatgtcttag

SEQ ID NO: 8293634 - DNA, 22 bp, Homo sapiens
tacagttcacagtatcataaat

SEQ ID NO: 8293635 - DNA, 22 bp, Homo sapiens
tagcataacaggtaagagtgag

SEQ ID NO: 8293636 - DNA, 22 bp, Homo sapiens
tagcagtgtctaggtaggccat

SEQ ID NO: 8293637 - DNA, 22 bp, Homo sapiens
tagaaatgtgataatagcttaa

SEQ ID NO: 8293638 - DNA, 22 bp, Homo sapiens
tagaaatgtcgtctccacattt

SEQ ID NO: 8293639 - DNA, 22 bp, Homo sapiens
tagaaatgttagatgtattgag

SEQ ID NO: 8293640 - DNA, 22 bp, Homo sapiens
tagaaatgttggtattaacatt

SEQ ID NO: 8293641 - DNA, 22 bp, Homo sapiens
tagaacagagttccagtgatca

SEQ ID NO: 8293642 - DNA, 22 bp, Homo sapiens
tcaaatgttccctgtactggcc

SEQ ID NO: 8293643 - DNA, 22 bp, Homo sapiens
tcaaatgctcagactcctgtgg

SEQ ID NO: 8293644 - DNA, 22 bp, Homo sapiens
tcaaatgcggtcatggctttta

SEQ ID NO: 8293645 - DNA, 22 bp, Homo sapiens
tcaaatgctctttgcagagagg

SEQ ID NO: 8293646 - DNA, 22 bp, Homo sapiens
tcaaatgctgcctttgtgtgcc

SEQ ID NO: 8293647 - DNA, 22 bp, Homo sapiens
tcaaatgcttctactcctaaga

SEQ ID NO: 8293648 - DNA, 22 bp, Homo sapiens
tcaaatgctgtattgtagtaat

SEQ ID NO: 8293649 - DNA, 19 bp, Homo sapiens
tcaaatgccaatgtcacag

SEQ ID NO: 8293650 - DNA, 21 bp, Homo sapiens
tcaaagcacatatttgcacat

SEQ ID NO: 8293651 - DNA, 19 bp, Homo sapiens
tcaaagcaagcatgttctg

SEQ ID NO: 8293652 - DNA, 22 bp, Homo sapiens
tcaaagcatcagtcaatttagg

SEQ ID NO: 8293653 - DNA, 22 bp, Homo sapiens
cagtgcataatctaaatggggg

SEQ ID NO: 8293654 - DNA, 22 bp, Homo sapiens
tcacacatttctcaagtgtagg

SEQ ID NO: 8293655 - DNA, 22 bp, Homo sapiens
tcacaccagtttcctttcaatt

SEQ ID NO: 8293656 - DNA, 22 bp, Homo sapiens
tcacatgcttgaggaaagaaaa

SEQ ID NO: 8293657 - DNA, 22 bp, Homo sapiens
tatgcacacaggcttaattcat

SEQ ID NO: 8293658 - DNA, 22 bp, Homo sapiens
tatgcacaatatgatctatttg

SEQ ID NO: 8293659 - DNA, 22 bp, Homo sapiens
tatgaagaaacctatcctctag

SEQ ID NO: 8293660 - DNA, 22 bp, Homo sapiens
tatgaacatgttcattgactta

SEQ ID NO: 8293661 - DNA, 22 bp, Homo sapiens
tatgtacatcgttgaattcaaa

SEQ ID NO: 8293662 - DNA, 22 bp, Homo sapiens
tatgcacacatcgcagcaggaa

SEQ ID NO: 8293663 - DNA, 22 bp, Homo sapiens
tagtaacagatttatacagtct

SEQ ID NO: 8293664 - DNA, 22 bp, Homo sapiens
tatataactactattttgctca

SEQ ID NO: 8293665 - DNA, 22 bp, Homo sapiens
tatataatttgtaaaagcacct

SEQ ID NO: 8293666 - DNA, 22 bp, Homo sapiens
tttaacatgttcaagaaacata

SEQ ID NO: 8293667 - DNA, 22 bp, Homo sapiens
tttacagatgaggaaactgaga

SEQ ID NO: 8293668 - DNA, 22 bp, Homo sapiens
tttacagatgaggatactgagg

SEQ ID NO: 8293669 - DNA, 22 bp, Homo sapiens
tttacagatgtggaaagtgagc

SEQ ID NO: 8293670 - DNA, 22 bp, Homo sapiens
tttacagagaatgtacataaag

SEQ ID NO: 8293671 - DNA, 22 bp, Homo sapiens
tttagcatgtgtgccatgtggc

SEQ ID NO: 8293672 - DNA, 22 bp, Homo sapiens
tttatgtaatttcataggtgtg

SEQ ID NO: 8293673 - DNA, 22 bp, Homo sapiens
tttatgtacatatccacaagga

SEQ ID NO: 8293674 - DNA, 22 bp, Homo sapiens
tttattgcatacacaaatgtca

SEQ ID NO: 8293675 - DNA, 21 bp, Homo sapiens
tttatgtacttcatagagtag

SEQ ID NO: 8293676 - DNA, 22 bp, Homo sapiens
tttatgtagttacggactatca

SEQ ID NO: 8293677 - DNA, 18 bp, Homo sapiens
tttcacaacctccagagg

SEQ ID NO: 8293678 - DNA, 22 bp, Homo sapiens
tttcataatgtcacagtcaaaa

SEQ ID NO: 8293679 - DNA, 22 bp, Homo sapiens
tttcatctctctaaaagacagt

SEQ ID NO: 8293680 - DNA, 22 bp, Homo sapiens
tttctaaatggtggctgcattg

SEQ ID NO: 8293681 - DNA, 22 bp, Homo sapiens
ttggcttcttcgcacagcagta

SEQ ID NO: 8293682 - DNA, 22 bp, Homo sapiens
ttgtattagctgtaaattttct

SEQ ID NO: 8293683 - DNA, 22 bp, Homo sapiens
ttcaagtcaaggaaagaggtct

SEQ ID NO: 8293684 - DNA, 22 bp, Homo sapiens
ttcaatcatttttacatagtcc

SEQ ID NO: 8293685 - DNA, 22 bp, Homo sapiens
ttcaatcatttttacatagtcc

SEQ ID NO: 8293686 - DNA, 22 bp, Homo sapiens
ttataagagtatatagtgtact

SEQ ID NO: 8293687 - DNA, 22 bp, Homo sapiens
ttatgctaaatgaatcaagtca

SEQ ID NO: 8293688 - DNA, 22 bp, Homo sapiens
ttatgctaagtgcaacaagcca

SEQ ID NO: 8293689 - DNA, 22 bp, Homo sapiens
ttatgctagtatagtccttaga

SEQ ID NO: 8293690 - DNA, 22 bp, Homo sapiens
ttcaagatcttccaaaggatac

SEQ ID NO: 8293691 - DNA, 22 bp, Homo sapiens
ttcaagactgcgactaatgccc

SEQ ID NO: 8293692 - DNA, 17 bp, Homo sapiens
ttcaagatattgaaatg

SEQ ID NO: 8293693 - DNA, 22 bp, Homo sapiens
ttcaagataataggaatgaaaa

SEQ ID NO: 8293694 - DNA, 23 bp, Homo sapiens
ttcaaaactggaaaatcagatgc

SEQ ID NO: 8293695 - DNA, 23 bp, Homo sapiens
ttcaaaactggaaaatcagatgc

SEQ ID NO: 8293696 - DNA, 22 bp, Homo sapiens
ttgagggtctggatctgctgct

SEQ ID NO: 8293697 - DNA, 22 bp, Homo sapiens
tttgggcagtagatgtatcact

SEQ ID NO: 8293698 - DNA, 23 bp, Homo sapiens
ttttaatttggacataagaagat

SEQ ID NO: 8293699 - DNA, 23 bp, Homo sapiens
ttttaatttggacataagaagat

SEQ ID NO: 8293700 - DNA, 22 bp, Homo sapiens
ttttagaaatactgatttagtg

SEQ ID NO: 8293701 - DNA, 22 bp, Homo sapiens
atttaatttggagagagaaacc

SEQ ID NO: 8293702 - DNA, 22 bp, Homo sapiens
atttagaagctaatttttcaga

SEQ ID NO: 8293703 - DNA, 22 bp, Homo sapiens
atttagaaattccaaaagtatt

SEQ ID NO: 8293704 - DNA, 19 bp, Homo sapiens
atttactgcctaaaatctc

SEQ ID NO: 8293705 - DNA, 22 bp, Homo sapiens
atttcatagattgtaaatccct

SEQ ID NO: 8293706 - DNA, 22 bp, Homo sapiens
caaaggtattctcattttggaa

SEQ ID NO: 8293707 - DNA, 22 bp, Homo sapiens
caaaggcaacatatacttgttt

SEQ ID NO: 8293708 - DNA, 22 bp, Homo sapiens
caaaactgtctagagagagaag

SEQ ID NO: 8293709 - DNA, 22 bp, Homo sapiens
caaaacattcagagagctcact

SEQ ID NO: 8293710 - DNA, 22 bp, Homo sapiens
atgttttatattttgcagcagt

SEQ ID NO: 8293711 - DNA, 22 bp, Homo sapiens
attaaatgttggcatattttgt

SEQ ID NO: 8293712 - DNA, 22 bp, Homo sapiens
attaaatgttggacgtatacat

SEQ ID NO: 8293713 - DNA, 22 bp, Homo sapiens
attaaatgttccttaaattata

SEQ ID NO: 8293714 - DNA, 22 bp, Homo sapiens
attaatatacactgttagcatg

SEQ ID NO: 8293715 - DNA, 22 bp, Homo sapiens
gatgatcatctgtaaagttaga

SEQ ID NO: 8293716 - DNA, 22 bp, Homo sapiens
attattaaagctacatcaagga

SEQ ID NO: 8293717 - DNA, 22 bp, Homo sapiens
attattcaatcatattaaaagt

SEQ ID NO: 8293718 - DNA, 22 bp, Homo sapiens
attagaatgaagtataggattt

SEQ ID NO: 8293719 - DNA, 22 bp, Homo sapiens
attcttaaatttaggtctgtga

SEQ ID NO: 8293720 - DNA, 22 bp, Homo sapiens
attcttaattgccatgctgtat

SEQ ID NO: 8293721 - DNA, 22 bp, Homo sapiens
attcttcacaaatatatagaag

SEQ ID NO: 8293722 - DNA, 22 bp, Homo sapiens
attctagatgctgtaagtagca

SEQ ID NO: 8293723 - DNA, 22 bp, Homo sapiens
attctcaaaacataacttcact

SEQ ID NO: 8293724 - DNA, 22 bp, Homo sapiens
attctcaatggctactttcata

SEQ ID NO: 8293725 - DNA, 22 bp, Homo sapiens
attgaacattgttctaggaggc

SEQ ID NO: 8293726 - DNA, 22 bp, Homo sapiens
attgaatgtcctttagtaaaaa

SEQ ID NO: 8293727 - DNA, 22 bp, Homo sapiens
attgaatctgcactagtatttt

SEQ ID NO: 8293728 - DNA, 21 bp, Homo sapiens
attcagagtaattcatcttta

SEQ ID NO: 8293729 - DNA, 22 bp, Homo sapiens
attattgtactttcaataaggt

SEQ ID NO: 8293730 - DNA, 22 bp, Homo sapiens
atgcaaataaagcaactataca

SEQ ID NO: 8293731 - DNA, 22 bp, Homo sapiens
atgcaaaattaccattctgttc

SEQ ID NO: 8293732 - DNA, 22 bp, Homo sapiens
atgcattatcaattgatgtagg

SEQ ID NO: 8293733 - DNA, 22 bp, Homo sapiens
atgcatcatggaaaactcagtt

SEQ ID NO: 8293734 - DNA, 22 bp, Homo sapiens
atgcagcagtttacaaagcaat

SEQ ID NO: 8293735 - DNA, 22 bp, Homo sapiens
atgagtaaaaccactatttaca

SEQ ID NO: 8293736 - DNA, 22 bp, Homo sapiens
atgagtaagaccataatttttg

SEQ ID NO: 8293737 - DNA, 22 bp, Homo sapiens
gaaagcacgatagtagcaaaag

SEQ ID NO: 8293738 - DNA, 22 bp, Homo sapiens
gaaagcacatactataaatcac

SEQ ID NO: 8293739 - DNA, 22 bp, Homo sapiens
atgaaaacggaccagagctatt

SEQ ID NO: 8293740 - DNA, 22 bp, Homo sapiens
atgaaatatcttgaagaaattc

SEQ ID NO: 8293741 - DNA, 22 bp, Homo sapiens
atgaaatatcttgaagaaattc

SEQ ID NO: 8293742 - DNA, 19 bp, Homo sapiens
cttggttatggtatgatgc

SEQ ID NO: 8293743 - DNA, 22 bp, Homo sapiens
atctagaagtggcatgaattac

SEQ ID NO: 8293744 - DNA, 22 bp, Homo sapiens
atctagaaagtgttgaagatca

SEQ ID NO: 8293745 - DNA, 22 bp, Homo sapiens
atctaggatttgaatgcacagt

SEQ ID NO: 8293746 - DNA, 22 bp, Homo sapiens
cttgcctttgtcttcaaaggct

SEQ ID NO: 8293747 - DNA, 22 bp, Homo sapiens
atgtgaaacctgtgagtagagt

SEQ ID NO: 8293748 - DNA, 22 bp, Homo sapiens
atgtctttctcacagccagttc

SEQ ID NO: 8293749 - DNA, 22 bp, Homo sapiens
atgtgaaaaatttcttattaca

SEQ ID NO: 8293750 - DNA, 22 bp, Homo sapiens
atgtctttggctttgacatggc

SEQ ID NO: 8293751 - DNA, 22 bp, Homo sapiens
atgtctttcgcatcagtagcta

SEQ ID NO: 8293752 - DNA, 22 bp, Homo sapiens
atgtctttataaatgtataatg

SEQ ID NO: 8293753 - DNA, 22 bp, Homo sapiens
atgtgtcaattttcaaatgctt

SEQ ID NO: 8293754 - DNA, 22 bp, Homo sapiens
atggtacaaaatgtataaagtc

SEQ ID NO: 8293755 - DNA, 22 bp, Homo sapiens
atgtacattttcctaatgtttt

SEQ ID NO: 8293756 - DNA, 22 bp, Homo sapiens
atgtacatttgtagtaatatca

SEQ ID NO: 8293757 - DNA, 22 bp, Homo sapiens
cagaggtagccgagtgcaatcg

SEQ ID NO: 8293758 - DNA, 18 bp, Homo sapiens
cagaagtccttcaaggcc

SEQ ID NO: 8293759 - DNA, 20 bp, Homo sapiens
cagaaggtctaagctttaga

SEQ ID NO: 8293760 - DNA, 22 bp, Homo sapiens
gtatttgcaaatctaaaagaga

SEQ ID NO: 8293761 - DNA, 22 bp, Homo sapiens
gtatctttccacatcttcagta

SEQ ID NO: 8293762 - DNA, 22 bp, Homo sapiens
gtatctttcccaccaatcacaa

SEQ ID NO: 8293763 - DNA, 22 bp, Homo sapiens
gtatcttttggtggaaaaataa

SEQ ID NO: 8293764 - DNA, 22 bp, Homo sapiens
gtatcttttacaccaggaaatt

SEQ ID NO: 8293765 - DNA, 22 bp, Homo sapiens
gtatgaaaattgtaaagttctt

SEQ ID NO: 8293766 - DNA, 22 bp, Homo sapiens
gtatcctttgcggaaatttcta

SEQ ID NO: 8293767 - DNA, 20 bp, Homo sapiens
gtaaaatatggtctttgggt

SEQ ID NO: 8293768 - DNA, 22 bp, Homo sapiens
cacaaagtctgcagctgctgta

SEQ ID NO: 8293769 - DNA, 22 bp, Homo sapiens
cacaatgcgtacatatatcaaa

SEQ ID NO: 8293770 - DNA, 22 bp, Homo sapiens
cacacattgaattcattcttgt

SEQ ID NO: 8293771 - DNA, 22 bp, Homo sapiens
cacaaaagtaggaggcaggcgg

SEQ ID NO: 8293772 - DNA, 22 bp, Homo sapiens
caacattatatagccacatgcc

SEQ ID NO: 8293773 - DNA, 22 bp, Homo sapiens
caagatggacataaggagagaa

SEQ ID NO: 8293774 - DNA, 22 bp, Homo sapiens
cacccagttgactacaaagggg

SEQ ID NO: 8293775 - DNA, 22 bp, Homo sapiens
cacccagtgaaggagcaagagg

SEQ ID NO: 8293776 - DNA, 22 bp, Homo sapiens
ggctagggatctagaccaggac

SEQ ID NO: 8293777 - DNA, 22 bp, Homo sapiens
atataacatacatacagaaaag

SEQ ID NO: 8293778 - DNA, 22 bp, Homo sapiens
atatataagctgatgagccaca

SEQ ID NO: 8293779 - DNA, 22 bp, Homo sapiens
atatataagctgatgagccaca

SEQ ID NO: 8293780 - DNA, 22 bp, Homo sapiens
atatgtgtgatgcatggactaa

SEQ ID NO: 8293781 - DNA, 22 bp, Homo sapiens
atatgtgtgccatttcagcagt

SEQ ID NO: 8293782 - DNA, 22 bp, Homo sapiens
atatgtgtacgtgcagtatata

SEQ ID NO: 8293783 - DNA, 20 bp, Homo sapiens
atatgtgtacgtgtatacat

SEQ ID NO: 8293784 - DNA, 22 bp, Homo sapiens
atatgtgtatttggttagccta

SEQ ID NO: 8293785 - DNA, 22 bp, Homo sapiens
atccaaacctggacatgagtgg

SEQ ID NO: 8293786 - DNA, 22 bp, Homo sapiens
atccaaaggtgacacagaatac

SEQ ID NO: 8293787 - DNA, 22 bp, Homo sapiens
atccaaagatggaaagaacttt

SEQ ID NO: 8293788 - DNA, 22 bp, Homo sapiens
atcatgttccagaaacagtgat

SEQ ID NO: 8293789 - DNA, 22 bp, Homo sapiens
ctgtgcaagcccaagataaaac

SEQ ID NO: 8293790 - DNA, 22 bp, Homo sapiens
ctgtgcaagacttactttaata

SEQ ID NO: 8293791 - DNA, 18 bp, Homo sapiens
atacaagatcaagtgttc

SEQ ID NO: 8293792 - DNA, 19 bp, Homo sapiens
atacaagactagcatttac

SEQ ID NO: 8293793 - DNA, 22 bp, Homo sapiens
ataatataatcctacttcccat

SEQ ID NO: 8293794 - DNA, 22 bp, Homo sapiens
ataatacatggttgatcttttc

SEQ ID NO: 8293795 - DNA, 22 bp, Homo sapiens
ctgaggcttggaggggtctggt

SEQ ID NO: 8293796 - DNA, 22 bp, Homo sapiens
ataaaagtaggaccaacttaca

SEQ ID NO: 8293797 - DNA, 22 bp, Homo sapiens
ataaaagtaggaccaacttaca

SEQ ID NO: 8293798 - DNA, 22 bp, Homo sapiens
agtttgtatcaatttgctttat

SEQ ID NO: 8293799 - DNA, 22 bp, Homo sapiens
ataaaagtttccaatcatgcct

SEQ ID NO: 8293800 - DNA, 20 bp, Homo sapiens
ataaaataactgccacaaga

SEQ ID NO: 8293801 - DNA, 20 bp, Homo sapiens
ataaaataactgccacaaga

SEQ ID NO: 8293802 - DNA, 22 bp, Homo sapiens
ataaatatcactgttgtccctc

SEQ ID NO: 8293803 - DNA, 22 bp, Homo sapiens
ataaatatcactgttgtccctc

SEQ ID NO: 8293804 - DNA, 22 bp, Homo sapiens
ataaatagtgtgtcataaagtc

SEQ ID NO: 8293805 - DNA, 23 bp, Homo sapiens
agtttgtaaagaaatatttgcac

SEQ ID NO: 8293806 - DNA, 18 bp, Homo sapiens
agtggtctgttatatcat

SEQ ID NO: 8293807 - DNA, 22 bp, Homo sapiens
ctcagaattacatcccatttta

SEQ ID NO: 8293808 - DNA, 22 bp, Homo sapiens
agtatgaacggaaggcctggga

SEQ ID NO: 8293809 - DNA, 22 bp, Homo sapiens
agtatcaaggatctccagcacc

SEQ ID NO: 8293810 - DNA, 22 bp, Homo sapiens
cctggctgggcctgatttctca

SEQ ID NO: 8293811 - DNA, 22 bp, Homo sapiens
aggcagtgagaaatagcaagat

SEQ ID NO: 8293812 - DNA, 22 bp, Homo sapiens
aggcagtggctgagaccagggg

SEQ ID NO: 8293813 - DNA, 22 bp, Homo sapiens
ccagtttaagacttatctcaat

SEQ ID NO: 8293814 - DNA, 22 bp, Homo sapiens
ccaggcagggctcaaggaacct

SEQ ID NO: 8293815 - DNA, 22 bp, Homo sapiens
agctggcagtatgactggtgac

SEQ ID NO: 8293816 - DNA, 22 bp, Homo sapiens
catttacagtgagagtttttac

SEQ ID NO: 8293817 - DNA, 22 bp, Homo sapiens
cattatctcttctatatgctag

SEQ ID NO: 8293818 - DNA, 22 bp, Homo sapiens
cattatctgccattgacaccat

SEQ ID NO: 8293819 - DNA, 18 bp, Homo sapiens
cattatgtggttatagaa

SEQ ID NO: 8293820 - DNA, 22 bp, Homo sapiens
cattatgtgggaaaatgttctt

SEQ ID NO: 8293821 - DNA, 22 bp, Homo sapiens
cattatgttcagtagcttaaaa

SEQ ID NO: 8293822 - DNA, 22 bp, Homo sapiens
aggagctgataaaagggggtca

SEQ ID NO: 8293823 - DNA, 20 bp, Homo sapiens
aggagctgaattagagggtt

SEQ ID NO: 8293824 - DNA, 22 bp, Homo sapiens
agatttcacatgctgctctatt

SEQ ID NO: 8293825 - DNA, 22 bp, Homo sapiens
agatgtagtagtgggtctttta

SEQ ID NO: 8293826 - DNA, 22 bp, Homo sapiens
atttagaagttggagggcaaga

SEQ ID NO: 8293827 - DNA, 22 bp, Homo sapiens
atttagtgtgtattgctattat

SEQ ID NO: 8293828 - DNA, 22 bp, Homo sapiens
attataaacctttgagggtggg

SEQ ID NO: 8293829 - DNA, 22 bp, Homo sapiens
attataaagaacatgtgtgtgg

SEQ ID NO: 8293830 - DNA, 22 bp, Homo sapiens
attataaatattttctaggggt

SEQ ID NO: 8293831 - DNA, 22 bp, Homo sapiens
attataaagaacatgtgtgtgg

SEQ ID NO: 8293832 - DNA, 22 bp, Homo sapiens
attatagagggttacagttaat

SEQ ID NO: 8293833 - DNA, 22 bp, Homo sapiens
atgtttatgttgggctatattt

SEQ ID NO: 8293834 - DNA, 20 bp, Homo sapiens
atgttaaatagcatttagag

SEQ ID NO: 8293835 - DNA, 22 bp, Homo sapiens
atgttaaatggtttattattaa

SEQ ID NO: 8293836 - DNA, 22 bp, Homo sapiens
atgttaaataatcccttaaagc

SEQ ID NO: 8293837 - DNA, 22 bp, Homo sapiens
atgttaaataatcccttaaagc

SEQ ID NO: 8293838 - DNA, 22 bp, Homo sapiens
atgtgtgccccttttactcttt

SEQ ID NO: 8293839 - DNA, 22 bp, Homo sapiens
agaatgcagtttgaaataaggt

SEQ ID NO: 8293840 - DNA, 22 bp, Homo sapiens
agaatgcaagataaactttatt

SEQ ID NO: 8293841 - DNA, 22 bp, Homo sapiens
agaatgcattttgtgtagctat

SEQ ID NO: 8293842 - DNA, 22 bp, Homo sapiens
agaattagtcacaattatagga

SEQ ID NO: 8293843 - DNA, 22 bp, Homo sapiens
agacacagcagtgcctgcctca

SEQ ID NO: 8293844 - DNA, 20 bp, Homo sapiens
atgtaaaattataaggctga

SEQ ID NO: 8293845 - DNA, 22 bp, Homo sapiens
atgtacagtttctagactcaaa

SEQ ID NO: 8293846 - DNA, 22 bp, Homo sapiens
atgtacagtggaaactaacaaa

SEQ ID NO: 8293847 - DNA, 22 bp, Homo sapiens
cagcagaggaaagcaaatctaa

SEQ ID NO: 8293848 - DNA, 22 bp, Homo sapiens
cagcagaggttggaacagttct

SEQ ID NO: 8293849 - DNA, 22 bp, Homo sapiens
agctcacagtgtccttcctcaa

SEQ ID NO: 8293850 - DNA, 22 bp, Homo sapiens
attttctggttgaggtttaaca

SEQ ID NO: 8293851 - DNA, 22 bp, Homo sapiens
caaatgcaaaatataaccctgt

SEQ ID NO: 8293852 - DNA, 22 bp, Homo sapiens
caaatgcagtccctttgttgct

SEQ ID NO: 8293853 - DNA, 22 bp, Homo sapiens
caaatattccaggtacatccct

SEQ ID NO: 8293854 - DNA, 22 bp, Homo sapiens
actggatgaggggaaagagaca

SEQ ID NO: 8293855 - DNA, 22 bp, Homo sapiens
aggtacagtagacagacagtta

SEQ ID NO: 8293856 - DNA, 22 bp, Homo sapiens
aggtagagctccagtagaaaat

SEQ ID NO: 8293857 - DNA, 22 bp, Homo sapiens
accttcaaactagatagaagtt

SEQ ID NO: 8293858 - DNA, 22 bp, Homo sapiens
accttcaatgaaaataatagtc

SEQ ID NO: 8293859 - DNA, 22 bp, Homo sapiens
accttcaatgaaaataatagtc

SEQ ID NO: 8293860 - DNA, 22 bp, Homo sapiens
actcaagatagggaaagtacaa

SEQ ID NO: 8293861 - DNA, 22 bp, Homo sapiens
actaaatagttttgacagaaca

SEQ ID NO: 8293862 - DNA, 22 bp, Homo sapiens
atatataacctggataaggctt

SEQ ID NO: 8293863 - DNA, 22 bp, Homo sapiens
atataattctcaggtttgacta

SEQ ID NO: 8293864 - DNA, 22 bp, Homo sapiens
atataatagtttcataaaggct

SEQ ID NO: 8293865 - DNA, 22 bp, Homo sapiens
atatatttgagaatattcatga

SEQ ID NO: 8293866 - DNA, 22 bp, Homo sapiens
atatcttttagagcaagcttgt

SEQ ID NO: 8293867 - DNA, 22 bp, Homo sapiens
atatctttgtttttgccaagat

SEQ ID NO: 8293868 - DNA, 22 bp, Homo sapiens
atatctttgtatggttcagcag

SEQ ID NO: 8293869 - DNA, 20 bp, Homo sapiens
atcatctttacaatgtcagt

SEQ ID NO: 8293870 - DNA, 22 bp, Homo sapiens
atcacattgttagcatagactg

SEQ ID NO: 8293871 - DNA, 22 bp, Homo sapiens
atcacatttatagtggcacgca

SEQ ID NO: 8293872 - DNA, 22 bp, Homo sapiens
agaaacatttagattatatgtc

SEQ ID NO: 8293873 - DNA, 21 bp, Homo sapiens
atcacattggctgttattatt

SEQ ID NO: 8293874 - DNA, 22 bp, Homo sapiens
agtttagagttcaaattagttc

SEQ ID NO: 8293875 - DNA, 22 bp, Homo sapiens
agtttatagcccagattcatgg

SEQ ID NO: 8293876 - DNA, 22 bp, Homo sapiens
agtttatgaaacacagatttga

SEQ ID NO: 8293877 - DNA, 18 bp, Homo sapiens
actgtggtttatgtgtag

SEQ ID NO: 8293878 - DNA, 22 bp, Homo sapiens
agctttatatttaatgaattct

SEQ ID NO: 8293879 - DNA, 22 bp, Homo sapiens
agctttatgggagcttagataa

SEQ ID NO: 8293880 - DNA, 22 bp, Homo sapiens
acataaagtactgagagactct

SEQ ID NO: 8293881 - DNA, 22 bp, Homo sapiens
acataaatagattattgggagg

SEQ ID NO: 8293882 - DNA, 22 bp, Homo sapiens
acagtaatgattctgagtctct

SEQ ID NO: 8293883 - DNA, 22 bp, Homo sapiens
acagtaatattgatgctcgtca

SEQ ID NO: 8293884 - DNA, 22 bp, Homo sapiens
acagtaataagtgttggtgagg

SEQ ID NO: 8293885 - DNA, 22 bp, Homo sapiens
acagtaattaaaatggatctgc

SEQ ID NO: 8293886 - DNA, 22 bp, Homo sapiens
accatttaataagtatttccat

SEQ ID NO: 8293887 - DNA, 21 bp, Homo sapiens
accaaaacctatactttctgt

SEQ ID NO: 8293888 - DNA, 22 bp, Homo sapiens
accaaacaaaattgtgcactgt

SEQ ID NO: 8293889 - DNA, 22 bp, Homo sapiens
agggacactgatgagaaattct

SEQ ID NO: 8293890 - DNA, 22 bp, Homo sapiens
agggacacactccagtgttatt

SEQ ID NO: 8293891 - DNA, 22 bp, Homo sapiens
agggacacatgtgattatttat

SEQ ID NO: 8293892 - DNA, 22 bp, Homo sapiens
acatgagattagctcacccact

SEQ ID NO: 8293893 - DNA, 22 bp, Homo sapiens
acatgagatcacaaagataaat

SEQ ID NO: 8293894 - DNA, 22 bp, Homo sapiens
acatgattggactccttcccct

SEQ ID NO: 8293895 - DNA, 22 bp, Homo sapiens
acatgagaagctgcaacatgac

SEQ ID NO: 8293896 - DNA, 20 bp, Homo sapiens
acatggaaggtcaaactatc

SEQ ID NO: 8293897 - DNA, 22 bp, Homo sapiens
acatggaaagtactccacaatt

SEQ ID NO: 8293898 - DNA, 22 bp, Homo sapiens
acatttaggatgttttgagaga

SEQ ID NO: 8293899 - DNA, 22 bp, Homo sapiens
acatttacagtgctagacaatc

SEQ ID NO: 8293900 - DNA, 20 bp, Homo sapiens
aagaaacttgaaagtacaag

SEQ ID NO: 8293901 - DNA, 22 bp, Homo sapiens
aagaaattaatgtgccattact

SEQ ID NO: 8293902 - DNA, 22 bp, Homo sapiens
aagaaattaaggaatgcaacga

SEQ ID NO: 8293903 - DNA, 22 bp, Homo sapiens
aagaaatgtagagcctagtaaa

SEQ ID NO: 8293904 - DNA, 22 bp, Homo sapiens
aagaacaactgctttaaaagca

SEQ ID NO: 8293905 - DNA, 22 bp, Homo sapiens
aagaacagattcagcctgaact

SEQ ID NO: 8293906 - DNA, 22 bp, Homo sapiens
aagatgcagcttccacttttgc

SEQ ID NO: 8293907 - DNA, 22 bp, Homo sapiens
acacatgcataagccttccctt

SEQ ID NO: 8293908 - DNA, 22 bp, Homo sapiens
acacatttaaaaaggaacatat

SEQ ID NO: 8293909 - DNA, 21 bp, Homo sapiens
acacattatgagcatagactc

SEQ ID NO: 8293910 - DNA, 21 bp, Homo sapiens
acacattatgagcatagactc

SEQ ID NO: 8293911 - DNA, 22 bp, Homo sapiens
acacattatgagcagttgtctt

SEQ ID NO: 8293912 - DNA, 22 bp, Homo sapiens
aagcacaatgaacatcttagat

SEQ ID NO: 8293913 - DNA, 22 bp, Homo sapiens
aactagaaaacaagatgctgat

SEQ ID NO: 8293914 - DNA, 19 bp, Homo sapiens
aactagaaaggttttgaga

SEQ ID NO: 8293915 - DNA, 22 bp, Homo sapiens
aactagaaccacttgtatttcc

SEQ ID NO: 8293916 - DNA, 22 bp, Homo sapiens
aatggctgggagtgtattttgg

SEQ ID NO: 8293917 - DNA, 22 bp, Homo sapiens
aactagaacgtctagttgctgg

SEQ ID NO: 8293918 - DNA, 22 bp, Homo sapiens
aacgacatctgtgtagggcatc

SEQ ID NO: 8293919 - DNA, 22 bp, Homo sapiens
aacatgaaaagcccagagaggt

SEQ ID NO: 8293920 - DNA, 22 bp, Homo sapiens
aatagaatttgtactgtgtttt

SEQ ID NO: 8293921 - DNA, 22 bp, Homo sapiens
aatagatactacttagatgtag

SEQ ID NO: 8293922 - DNA, 22 bp, Homo sapiens
aacatgtctgggtattcacaag

SEQ ID NO: 8293923 - DNA, 22 bp, Homo sapiens
aacatgtatcgctttttaatat

SEQ ID NO: 8293924 - DNA, 22 bp, Homo sapiens
aacatgtaaccagcattcatct

SEQ ID NO: 8293925 - DNA, 22 bp, Homo sapiens
aagtgtatatatgacttataaa

SEQ ID NO: 8293926 - DNA, 23 bp, Homo sapiens
aagtggttttgaacccggaccct

SEQ ID NO: 8293927 - DNA, 22 bp, Homo sapiens
aagtggttttaagaggttcctt

SEQ ID NO: 8293928 - DNA, 22 bp, Homo sapiens
aagtggtttgattcagtttatg

SEQ ID NO: 8293929 - DNA, 22 bp, Homo sapiens
aagtggttgcttgtgagtcccc

SEQ ID NO: 8293930 - DNA, 21 bp, Homo sapiens
aagtggtttacatccagctgt

SEQ ID NO: 8293931 - DNA, 21 bp, Homo sapiens
aagtggtttaggttaccgggg

SEQ ID NO: 8293932 - DNA, 22 bp, Homo sapiens
aagtggtttgagcacagtgctg

SEQ ID NO: 8293933 - DNA, 22 bp, Homo sapiens
aagtggttattttgatctagaa

SEQ ID NO: 8293934 - DNA, 22 bp, Homo sapiens
aagtggtagacaaagataattg

SEQ ID NO: 8293935 - DNA, 22 bp, Homo sapiens
aagtggtaggaagagagcactg

SEQ ID NO: 8293936 - DNA, 22 bp, Homo sapiens
aacatcagcacacaatagcaag

SEQ ID NO: 8293937 - DNA, 22 bp, Homo sapiens
aacatcagtattctcatctgta

SEQ ID NO: 8293938 - DNA, 22 bp, Homo sapiens
aacatcagaagtagaagactca

SEQ ID NO: 8293939 - DNA, 22 bp, Homo sapiens
aacatcatcatgaacaactaat

SEQ ID NO: 8293940 - DNA, 22 bp, Homo sapiens
aaatgcattggtttctacttgt

SEQ ID NO: 8293941 - DNA, 22 bp, Homo sapiens
aaatgtcagaagctttacttct

SEQ ID NO: 8293942 - DNA, 22 bp, Homo sapiens
aaattattttcagaatggagaa

SEQ ID NO: 8293943 - DNA, 20 bp, Homo sapiens
aacacactggtggcatcagg

SEQ ID NO: 8293944 - DNA, 20 bp, Homo sapiens
aacacactggtggcatcagg

SEQ ID NO: 8293945 - DNA, 22 bp, Homo sapiens
aacactttcttccttgctcagg

SEQ ID NO: 8293946 - DNA, 22 bp, Homo sapiens
aacagaacccgagtgtgaatct

SEQ ID NO: 8293947 - DNA, 22 bp, Homo sapiens
aacagaaaaggtaggtggcttt

SEQ ID NO: 8293948 - DNA, 22 bp, Homo sapiens
aacagaaatcatttagggctct

SEQ ID NO: 8293949 - DNA, 22 bp, Homo sapiens
aacagaatagttgatgtacagt

SEQ ID NO: 8293950 - DNA, 22 bp, Homo sapiens
aacagacatatttttaatatgc

SEQ ID NO: 8293951 - DNA, 22 bp, Homo sapiens
aacagacagaaaaatgtgatct

SEQ ID NO: 8293952 - DNA, 22 bp, Homo sapiens
aacagaattgctgctgccaatg

SEQ ID NO: 8293953 - DNA, 22 bp, Homo sapiens
aacagaatgcaggggatgctgc

SEQ ID NO: 8293954 - DNA, 22 bp, Homo sapiens
aacagacaactcctgtggctca

SEQ ID NO: 8293955 - DNA, 22 bp, Homo sapiens
aacagacaactcctgtggctca

SEQ ID NO: 8293956 - DNA, 22 bp, Homo sapiens
aaaacctgattgaattctattt

SEQ ID NO: 8293957 - DNA, 22 bp, Homo sapiens
aaaaccttcaggtttggagttt

SEQ ID NO: 8293958 - DNA, 22 bp, Homo sapiens
aaaaaggttgatccagattagg

SEQ ID NO: 8293959 - DNA, 22 bp, Homo sapiens
aaaaactgcaattacttttgtc

SEQ ID NO: 8293960 - DNA, 18 bp, Homo sapiens
aaaaagtgctcaggccta

SEQ ID NO: 8293961 - DNA, 18 bp, Homo sapiens
aaaaagtgctcaggccta

SEQ ID NO: 8293962 - DNA, 22 bp, Homo sapiens
aaaaagtttcaactgccaactc

SEQ ID NO: 8293963 - DNA, 22 bp, Homo sapiens
aaaaggtagttgccaaataagg

SEQ ID NO: 8293964 - DNA, 22 bp, Homo sapiens
aaaaggtagattctccttctat

SEQ ID NO: 8293965 - DNA, 22 bp, Homo sapiens
aaaagtaattgcaattttgtag

SEQ ID NO: 8293966 - DNA, 22 bp, Homo sapiens
aaaatgtgcagtttttaagctg

SEQ ID NO: 8293967 - DNA, 22 bp, Homo sapiens
aaaatgtgtttatgcatttcgt

SEQ ID NO: 8293968 - DNA, 22 bp, Homo sapiens
aaaactgtatcttcttgggact

SEQ ID NO: 8293969 - DNA, 21 bp, Homo sapiens
aaaatgtgagcgtgatgctta

SEQ ID NO: 8293970 - DNA, 22 bp, Homo sapiens
aaaatattttagggccaggaga

SEQ ID NO: 8293971 - DNA, 20 bp, Homo sapiens
aaaatatgtataactcttct

SEQ ID NO: 8293972 - DNA, 22 bp, Homo sapiens
aaaatactgtggagtgttgaaa

SEQ ID NO: 8293973 - DNA, 22 bp, Homo sapiens
aaaatatcagcaaagggtgaca

SEQ ID NO: 8293974 - DNA, 20 bp, Homo sapiens
aaaatatgtataactcttct

SEQ ID NO: 8293975 - DNA, 22 bp, Homo sapiens
aaacaggcatcactcagcaaag

SEQ ID NO: 8293976 - DNA, 22 bp, Homo sapiens
aaacaggcttccattagagcaa

SEQ ID NO: 8293977 - DNA, 22 bp, Homo sapiens
aaacacatcattcatgtcgtca

SEQ ID NO: 8293978 - DNA, 22 bp, Homo sapiens
aaacacattttaggaaaatcta

SEQ ID NO: 8293979 - DNA, 22 bp, Homo sapiens
aaacactagcaggaagcactga

SEQ ID NO: 8293980 - DNA, 22 bp, Homo sapiens
aaaatgtgatctacaaatgcaa

SEQ ID NO: 8293981 - DNA, 22 bp, Homo sapiens
aaaattgagagttatagatggt

SEQ ID NO: 8293982 - DNA, 22 bp, Homo sapiens
aaagaaatacctttctcagctt

SEQ ID NO: 8293983 - DNA, 22 bp, Homo sapiens
aaagaaatagatggcatttaaa

SEQ ID NO: 8293984 - DNA, 22 bp, Homo sapiens
aaagaacaaatgatatatggtt

SEQ ID NO: 8293985 - DNA, 22 bp, Homo sapiens
aaactgtgaagcaagtacaagg

SEQ ID NO: 8293986 - DNA, 22 bp, Homo sapiens
aaagaacagatgtgtggtgcat

SEQ ID NO: 8293987 - DNA, 22 bp, Homo sapiens
aaagaacaatgtggaatctcct

SEQ ID NO: 8293988 - DNA, 22 bp, Homo sapiens
aaagaacaaattagctgtttta

SEQ ID NO: 8293989 - DNA, 22 bp, Homo sapiens
aaagatcagtctgaagcaacat

SEQ ID NO: 8293990 - DNA, 22 bp, Homo sapiens
aaacatgtaattctgcttaaga

SEQ ID NO: 8293991 - DNA, 20 bp, Homo sapiens
aaacattcatgtacaagtga

SEQ ID NO: 8293992 - DNA, 22 bp, Homo sapiens
aaactgtaaacacagcagtaca

SEQ ID NO: 8293993 - DNA, 22 bp, Homo sapiens
aaacattgagcacttgctattt

SEQ ID NO: 8293994 - DNA, 22 bp, Homo sapiens
aaacattctcagccctgcttgc

SEQ ID NO: 8293995 - DNA, 22 bp, Homo sapiens
aaacattgtaattttagcatgg

SEQ ID NO: 8293996 - DNA, 22 bp, Homo sapiens
aaactgtaagagaataaactac

SEQ ID NO: 8293997 - DNA, 22 bp, Homo sapiens
aaactgtatatttatggcatgt

SEQ ID NO: 8293998 - DNA, 22 bp, Homo sapiens
aaacatgatgcctgtactaaga

SEQ ID NO: 8293999 - DNA, 22 bp, Homo sapiens
aaatgcatgtagaataatagag

SEQ ID NO: 8294000 - DNA, 22 bp, Homo sapiens
aagcccagatgggagcatttca

SEQ ID NO: 8294001 - DNA, 22 bp, Homo sapiens
aaatctgtaagcaattgctcag

SEQ ID NO: 8294002 - DNA, 22 bp, Homo sapiens
aagatattttagaacattcact

SEQ ID NO: 8294003 - DNA, 22 bp, Homo sapiens
aagaacatgctataattatctt

SEQ ID NO: 8294004 - DNA, 22 bp, Homo sapiens
aagaacatggtaggataacaaa

SEQ ID NO: 8294005 - DNA, 22 bp, Homo sapiens
aaagtttcaatagaggaagtgg

SEQ ID NO: 8294006 - DNA, 22 bp, Homo sapiens
aaagtttcctgctaagtgctat

SEQ ID NO: 8294007 - DNA, 22 bp, Homo sapiens
aaagtttgaatgatatattagt

SEQ ID NO: 8294008 - DNA, 22 bp, Homo sapiens
aaagtttgagtgatttgacaca

SEQ ID NO: 8294009 - DNA, 22 bp, Homo sapiens
aaagttttagaactaggaagca

SEQ ID NO: 8294010 - DNA, 22 bp, Homo sapiens
aaagtttgcaatttatgttaat

SEQ ID NO: 8294011 - DNA, 22 bp, Homo sapiens
aagaggtaaccatagcaaccac

SEQ ID NO: 8294012 - DNA, 22 bp, Homo sapiens
aagaaataagacttctctgtcc

SEQ ID NO: 8294013 - DNA, 22 bp, Homo sapiens
aagaacataaacagaaggacag

SEQ ID NO: 8294014 - DNA, 22 bp, Homo sapiens
aagaacagttgggaggtgagcc

SEQ ID NO: 8294015 - DNA, 22 bp, Homo sapiens
aagaacagtgtcctgggactcg

SEQ ID NO: 8294016 - DNA, 22 bp, Homo sapiens
aagaacataacagaagctgtgt

SEQ ID NO: 8294017 - DNA, 22 bp, Homo sapiens
aagaacatgaacacaatgttta

SEQ ID NO: 8294018 - DNA, 22 bp, Homo sapiens
aagaacatgaagtcacaaatgc

SEQ ID NO: 8294019 - DNA, 22 bp, Homo sapiens
aacagtgagttgatgactgaat

SEQ ID NO: 8294020 - DNA, 22 bp, Homo sapiens
aacatagacccagttcaacaaa

SEQ ID NO: 8294021 - DNA, 22 bp, Homo sapiens
aaagccattgaactgtacttta

SEQ ID NO: 8294022 - DNA, 22 bp, Homo sapiens
aacacttctgttgataataagc

SEQ ID NO: 8294023 - DNA, 22 bp, Homo sapiens
aattgagtgcagccagcccagt

SEQ ID NO: 8294024 - DNA, 22 bp, Homo sapiens
aattgatgggcactgaaatatt

SEQ ID NO: 8294025 - DNA, 18 bp, Homo sapiens
acaaaggtctgcaagacc

SEQ ID NO: 8294026 - DNA, 22 bp, Homo sapiens
acaaaggtgcgtcccttcagct

SEQ ID NO: 8294027 - DNA, 22 bp, Homo sapiens
acaaagtagtcaaagtagatga

SEQ ID NO: 8294028 - DNA, 22 bp, Homo sapiens
acaagataaggtgtcagtgtgt

SEQ ID NO: 8294029 - DNA, 22 bp, Homo sapiens
aattaacaaatgtagctgtgat

SEQ ID NO: 8294030 - DNA, 22 bp, Homo sapiens
aattaaattggtttagagagga

SEQ ID NO: 8294031 - DNA, 22 bp, Homo sapiens
aattaaattggtttagagagga

SEQ ID NO: 8294032 - DNA, 22 bp, Homo sapiens
aatgtggttaacccatttaaga

SEQ ID NO: 8294033 - DNA, 22 bp, Homo sapiens
aatgtgaactttgtcatgtaac

SEQ ID NO: 8294034 - DNA, 22 bp, Homo sapiens
aatgtgattagcctctactgga

SEQ ID NO: 8294035 - DNA, 22 bp, Homo sapiens
acactgagtgtagaaatagcca

SEQ ID NO: 8294036 - DNA, 22 bp, Homo sapiens
acacattataggcaatcaaaag

SEQ ID NO: 8294037 - DNA, 22 bp, Homo sapiens
acacattataggcaatcaaaag

SEQ ID NO: 8294038 - DNA, 22 bp, Homo sapiens
acacattaggcagtgcttaaat

SEQ ID NO: 8294039 - DNA, 22 bp, Homo sapiens
acacattatagagagtataata

SEQ ID NO: 8294040 - DNA, 22 bp, Homo sapiens
acacattatagagagtataata

SEQ ID NO: 8294041 - DNA, 22 bp, Homo sapiens
acaatgcaccagcatcttcacc

SEQ ID NO: 8294042 - DNA, 22 bp, Homo sapiens
acagaattaatgaaaattacaa

SEQ ID NO: 8294043 - DNA, 22 bp, Homo sapiens
acagaaagaaggtgtatttgag

SEQ ID NO: 8294044 - DNA, 22 bp, Homo sapiens
acactttgttgtggcatatacg

SEQ ID NO: 8294045 - DNA, 22 bp, Homo sapiens
acagacattcatatcctcggta

SEQ ID NO: 8294046 - DNA, 22 bp, Homo sapiens
aagcattttagataaagcatca

SEQ ID NO: 8294047 - DNA, 22 bp, Homo sapiens
aagcattttgccacttgaagtt

SEQ ID NO: 8294048 - DNA, 22 bp, Homo sapiens
aagcattttgttttaagaatga

SEQ ID NO: 8294049 - DNA, 22 bp, Homo sapiens
aagctcattaattagaagctaa

SEQ ID NO: 8294050 - DNA, 22 bp, Homo sapiens
acatatgatattgaggatctca

SEQ ID NO: 8294051 - DNA, 22 bp, Homo sapiens
acatagaacctggcacatagta

SEQ ID NO: 8294052 - DNA, 22 bp, Homo sapiens
acatagaacctggcacatagta

SEQ ID NO: 8294053 - DNA, 20 bp, Homo sapiens
acatatgaatgatagagcca

SEQ ID NO: 8294054 - DNA, 22 bp, Homo sapiens
aaggctgcttttaacatgcata

SEQ ID NO: 8294055 - DNA, 22 bp, Homo sapiens
acatttaaatatgccttatatt

SEQ ID NO: 8294056 - DNA, 22 bp, Homo sapiens
acatttcttccacatgctgctg

SEQ ID NO: 8294057 - DNA, 22 bp, Homo sapiens
acatttcttagcctagttccag

SEQ ID NO: 8294058 - DNA, 22 bp, Homo sapiens
acatttcttccctttagcagaa

SEQ ID NO: 8294059 - DNA, 22 bp, Homo sapiens
acatttctgctagaataggtga

SEQ ID NO: 8294060 - DNA, 22 bp, Homo sapiens
acatttctgtcttagggactgt

SEQ ID NO: 8294061 - DNA, 22 bp, Homo sapiens
acatttctggagtttctcaaca

SEQ ID NO: 8294062 - DNA, 22 bp, Homo sapiens
acatttctcttgatgtctctat

SEQ ID NO: 8294063 - DNA, 22 bp, Homo sapiens
acatttctgcatgtagggtaat

SEQ ID NO: 8294064 - DNA, 22 bp, Homo sapiens
acatttctgcatctcagagcta

SEQ ID NO: 8294065 - DNA, 22 bp, Homo sapiens
acatttctgagcagggagctgt

SEQ ID NO: 8294066 - DNA, 22 bp, Homo sapiens
actataacctgttagaatagat

SEQ ID NO: 8294067 - DNA, 22 bp, Homo sapiens
actggctgaagtttactttttg

SEQ ID NO: 8294068 - DNA, 22 bp, Homo sapiens
agaaattcctaaggtacacaag

SEQ ID NO: 8294069 - DNA, 22 bp, Homo sapiens
aatgatgtattagtacaacaca

SEQ ID NO: 8294070 - DNA, 22 bp, Homo sapiens
aatcagaatttattgaatcttt

SEQ ID NO: 8294071 - DNA, 22 bp, Homo sapiens
aatactagttattaaagctttt

SEQ ID NO: 8294072 - DNA, 22 bp, Homo sapiens
actttgaaactaaaattcatta

SEQ ID NO: 8294073 - DNA, 22 bp, Homo sapiens
actttgaaggggaacattttaa

SEQ ID NO: 8294074 - DNA, 20 bp, Homo sapiens
aatcagaaagtgtgagctct

SEQ ID NO: 8294075 - DNA, 22 bp, Homo sapiens
gtacatgtcaaaaaatgcataa

SEQ ID NO: 8294076 - DNA, 22 bp, Homo sapiens
gtacattggcaactctcttaga

SEQ ID NO: 8294077 - DNA, 22 bp, Homo sapiens
gtatacatgtggtaaaatgcac

SEQ ID NO: 8294078 - DNA, 22 bp, Homo sapiens
gtacagttttcagtgttcactg

SEQ ID NO: 8294079 - DNA, 22 bp, Homo sapiens
gtaaatataaatgctagctgcc

SEQ ID NO: 8294080 - DNA, 22 bp, Homo sapiens
gtaaataactggtaattggggt

SEQ ID NO: 8294081 - DNA, 22 bp, Homo sapiens
gtaaataactggtaattggggt

SEQ ID NO: 8294082 - DNA, 22 bp, Homo sapiens
gtaaatattaaaggctgctaga

SEQ ID NO: 8294083 - DNA, 22 bp, Homo sapiens
gtaaagttctatttgaatttag

SEQ ID NO: 8294084 - DNA, 22 bp, Homo sapiens
gtaaagttctactagaatcaac

SEQ ID NO: 8294085 - DNA, 22 bp, Homo sapiens
gtaaaatagaataacgtggcta

SEQ ID NO: 8294086 - DNA, 22 bp, Homo sapiens
gtgtaattatataaagatctac

SEQ ID NO: 8294087 - DNA, 22 bp, Homo sapiens
gtgtaattgaaattgagaacca

SEQ ID NO: 8294088 - DNA, 21 bp, Homo sapiens
gtggttattttcattagcatc

SEQ ID NO: 8294089 - DNA, 21 bp, Homo sapiens
gttcaaatgggtagattcaca

SEQ ID NO: 8294090 - DNA, 22 bp, Homo sapiens
gttcaaatctcaggacttcaga

SEQ ID NO: 8294091 - DNA, 21 bp, Homo sapiens
gttcaaatcctgacactacac

SEQ ID NO: 8294092 - DNA, 18 bp, Homo sapiens
gttcaaggtcaagagaga

SEQ ID NO: 8294093 - DNA, 22 bp, Homo sapiens
gttcaaagctcctggtacagta

SEQ ID NO: 8294094 - DNA, 22 bp, Homo sapiens
gttgtattcttcaatatcagag

SEQ ID NO: 8294095 - DNA, 22 bp, Homo sapiens
taacagaatttgctaaactccg

SEQ ID NO: 8294096 - DNA, 22 bp, Homo sapiens
taagaaatttagttatagaatg

SEQ ID NO: 8294097 - DNA, 22 bp, Homo sapiens
taacagaatcctgttattgcca

SEQ ID NO: 8294098 - DNA, 22 bp, Homo sapiens
taacagaatagcagaaacagaa

SEQ ID NO: 8294099 - DNA, 22 bp, Homo sapiens
taagaacaagatgttcctgttt

SEQ ID NO: 8294100 - DNA, 20 bp, Homo sapiens
taagaacaagactaggaagc

SEQ ID NO: 8294101 - DNA, 22 bp, Homo sapiens
taaatgacccatgctgacctca

SEQ ID NO: 8294102 - DNA, 22 bp, Homo sapiens
taaatgacattcttaagtcttg

SEQ ID NO: 8294103 - DNA, 22 bp, Homo sapiens
taaatgacaacacctgcttttg

SEQ ID NO: 8294104 - DNA, 22 bp, Homo sapiens
taaatagaatctaaactgctca

SEQ ID NO: 8294105 - DNA, 22 bp, Homo sapiens
taaatccctacatctgtgtttt

SEQ ID NO: 8294106 - DNA, 22 bp, Homo sapiens
taaatctcactgggtatattgg

SEQ ID NO: 8294107 - DNA, 22 bp, Homo sapiens
taaaactagtggttgggactaa

SEQ ID NO: 8294108 - DNA, 22 bp, Homo sapiens
gggccatgagaggttcatcaac

SEQ ID NO: 8294109 - DNA, 22 bp, Homo sapiens
ggctgcaaaggaaaagtggtga

SEQ ID NO: 8294110 - DNA, 22 bp, Homo sapiens
ggctgcaagacaaggttggttt

SEQ ID NO: 8294111 - DNA, 22 bp, Homo sapiens
ggcagaggaagctggaagtggg

SEQ ID NO: 8294112 - DNA, 22 bp, Homo sapiens
ggcaggcagatggctgcaccaa

SEQ ID NO: 8294113 - DNA, 22 bp, Homo sapiens
ggcaggcattgcaacatgtaca

SEQ ID NO: 8294114 - DNA, 22 bp, Homo sapiens
ggcaggcattagagattcccag

SEQ ID NO: 8294115 - DNA, 22 bp, Homo sapiens
ggcaggcagcctccatccacag

SEQ ID NO: 8294116 - DNA, 22 bp, Homo sapiens
gcttaattctggctcagtttcc

SEQ ID NO: 8294117 - DNA, 22 bp, Homo sapiens
gagatatgttagaaagctattg

SEQ ID NO: 8294118 - DNA, 22 bp, Homo sapiens
gaggtcaggcttgcagcagggt

SEQ ID NO: 8294119 - DNA, 22 bp, Homo sapiens
gataaaatatgtggcctttagt

SEQ ID NO: 8294120 - DNA, 22 bp, Homo sapiens
gataaaataactatggaatact

SEQ ID NO: 8294121 - DNA, 22 bp, Homo sapiens
gataaaataactatggaatact

SEQ ID NO: 8294122 - DNA, 22 bp, Homo sapiens
gataaaattcttattttacccg

SEQ ID NO: 8294123 - DNA, 22 bp, Homo sapiens
gagtgttcccacaccccagttg

SEQ ID NO: 8294124 - DNA, 22 bp, Homo sapiens
gagtggtaggcagtgttaggaa

SEQ ID NO: 8294125 - DNA, 22 bp, Homo sapiens
gatagtcacctcccttaacttt

SEQ ID NO: 8294126 - DNA, 22 bp, Homo sapiens
gatgcacatgtgagtatagaag

SEQ ID NO: 8294127 - DNA, 22 bp, Homo sapiens
gatgcacagtgaccctgccagt

SEQ ID NO: 8294128 - DNA, 19 bp, Homo sapiens
gatctttgccaatttaagc

SEQ ID NO: 8294129 - DNA, 22 bp, Homo sapiens
gagagctgggctttgggtgaag

SEQ ID NO: 8294130 - DNA, 22 bp, Homo sapiens
gaagttcaggtgggaattgagc

SEQ ID NO: 8294131 - DNA, 22 bp, Homo sapiens
gaattgtagagggaacagaagc

SEQ ID NO: 8294132 - DNA, 22 bp, Homo sapiens
gaattgtacgctttacataggt

SEQ ID NO: 8294133 - DNA, 22 bp, Homo sapiens
ctggctggttactatttctggt

SEQ ID NO: 8294134 - DNA, 22 bp, Homo sapiens
gaacagaattaccgaagatctg

SEQ ID NO: 8294135 - DNA, 22 bp, Homo sapiens
gaacagaagaggctggtgccac

SEQ ID NO: 8294136 - DNA, 22 bp, Homo sapiens
gaaataacctcatgcaccatga

SEQ ID NO: 8294137 - DNA, 22 bp, Homo sapiens
gaaagtttcttcattaagatgt

SEQ ID NO: 8294138 - DNA, 22 bp, Homo sapiens
gaacacatttctctgactgtag

SEQ ID NO: 8294139 - DNA, 22 bp, Homo sapiens
cttttaatgggagcagtatttg

SEQ ID NO: 8294140 - DNA, 23 bp, Homo sapiens
cttttaacttgatctgagaccag

SEQ ID NO: 8294141 - DNA, 22 bp, Homo sapiens
gaaagtttataggttatataat

SEQ ID NO: 8294142 - DNA, 21 bp, Homo sapiens
gattaaatttaagctacatgc

SEQ ID NO: 8294143 - DNA, 22 bp, Homo sapiens
gattcaatgttgcagatggaat

SEQ ID NO: 8294144 - DNA, 22 bp, Homo sapiens
gatttataaaggttgcactgga

SEQ ID NO: 8294145 - DNA, 22 bp, Homo sapiens
gatttagagaatgttttgtaag

SEQ ID NO: 8294146 - DNA, 21 bp, Homo sapiens
gatttataagccttaagccta

SEQ ID NO: 8294147 - DNA, 22 bp, Homo sapiens
gatttatagtatgtgctttcag

SEQ ID NO: 8294148 - DNA, 14 bp, Homo sapiens
gcaggcagaccacc

SEQ ID NO: 8294149 - DNA, 22 bp, Homo sapiens
gcaggcagagaaggaacattta

SEQ ID NO: 8294150 - DNA, 22 bp, Homo sapiens
gcaggcagagaggggtttccag

SEQ ID NO: 8294151 - DNA, 22 bp, Homo sapiens
gcagtggtggagcttacatatc

SEQ ID NO: 8294152 - DNA, 22 bp, Homo sapiens
gccataaattgctggtcaaaat

SEQ ID NO: 8294153 - DNA, 22 bp, Homo sapiens
gccatttagggaggcaaggtga

SEQ ID NO: 8294154 - DNA, 22 bp, Homo sapiens
gctccagatgaaaggccagagg

SEQ ID NO: 8294155 - DNA, 22 bp, Homo sapiens
gctcagagcactcagactcagc

SEQ ID NO: 8294156 - DNA, 22 bp, Homo sapiens
ctcatacatatgccattcctgc

SEQ ID NO: 8294157 - DNA, 22 bp, Homo sapiens
ctcatacatatgccattcctgc

SEQ ID NO: 8294158 - DNA, 22 bp, Homo sapiens
ttgttaaaatgcatattctggt

SEQ ID NO: 8294159 - DNA, 22 bp, Homo sapiens
tttcagttagctgagacccagg

SEQ ID NO: 8294160 - DNA, 22 bp, Homo sapiens
tttaaaaaactagtctgagtct

SEQ ID NO: 8294161 - DNA, 22 bp, Homo sapiens
tttaaatttagaagaaacactg

SEQ ID NO: 8294162 - DNA, 22 bp, Homo sapiens
ctaatactcatttctgtaactc

SEQ ID NO: 8294163 - DNA, 22 bp, Homo sapiens
ctaatttaatgaatgagtctta

SEQ ID NO: 8294164 - DNA, 22 bp, Homo sapiens
ttcacataaatagatcacatca

SEQ ID NO: 8294165 - DNA, 22 bp, Homo sapiens
ttcagaaaaagaccattgcaat

SEQ ID NO: 8294166 - DNA, 22 bp, Homo sapiens
ttcttgttctggttctgttagc

SEQ ID NO: 8294167 - DNA, 22 bp, Homo sapiens
ctatttctgcctaatgacctgt

SEQ ID NO: 8294168 - DNA, 22 bp, Homo sapiens
tttgtgaaatgaagtcacaact

SEQ ID NO: 8294169 - DNA, 22 bp, Homo sapiens
tttgtgaagggaacagaagtgt

SEQ ID NO: 8294170 - DNA, 22 bp, Homo sapiens
ctgaacatcatagagtgtactt

SEQ ID NO: 8294171 - DNA, 22 bp, Homo sapiens
ctgcagaggttggttctaagat

SEQ ID NO: 8294172 - DNA, 22 bp, Homo sapiens
ctgcagagctttctgaatgaag

SEQ ID NO: 8294173 - DNA, 22 bp, Homo sapiens
ctgcaaaagtaattgcaggttt

SEQ ID NO: 8294174 - DNA, 22 bp, Homo sapiens
ctgcaaaagtaattggggcttt

SEQ ID NO: 8294175 - DNA, 21 bp, Homo sapiens
ctgctttacttcagaggatct

SEQ ID NO: 8294176 - DNA, 22 bp, Homo sapiens
tgtatgtgtatgtacatatgca

SEQ ID NO: 8294177 - DNA, 22 bp, Homo sapiens
tgtattagatctgagaacttct

SEQ ID NO: 8294178 - DNA, 22 bp, Homo sapiens
tgtattagagcagtagaattat

SEQ ID NO: 8294179 - DNA, 22 bp, Homo sapiens
tgtattaacattaataaaatgg

SEQ ID NO: 8294180 - DNA, 22 bp, Homo sapiens
tgtgccatttctattctgcagc

SEQ ID NO: 8294181 - DNA, 22 bp, Homo sapiens
tgtgccatgaggctctgatatg

SEQ ID NO: 8294182 - DNA, 22 bp, Homo sapiens
tgtctgtacaaattttctgtgt

SEQ ID NO: 8294183 - DNA, 22 bp, Homo sapiens
tgtgtgtatatgcatttatcta

SEQ ID NO: 8294184 - DNA, 23 bp, Homo sapiens
tggcaaggaatgggatggagact

SEQ ID NO: 8294185 - DNA, 22 bp, Homo sapiens
tggcaaggccacaggtgcagtt

SEQ ID NO: 8294186 - DNA, 22 bp, Homo sapiens
tggcaaggctgtgggggcagag

SEQ ID NO: 8294187 - DNA, 22 bp, Homo sapiens
tggcaagggattgtggagaact

SEQ ID NO: 8294188 - DNA, 22 bp, Homo sapiens
tgcattatctttaatgttctca

SEQ ID NO: 8294189 - DNA, 23 bp, Homo sapiens
tgcattatcctctctgaagacca

SEQ ID NO: 8294190 - DNA, 22 bp, Homo sapiens
tgcattataactgaatgttgtt

SEQ ID NO: 8294191 - DNA, 22 bp, Homo sapiens
tgcattatacttttagaaattt

SEQ ID NO: 8294192 - DNA, 22 bp, Homo sapiens
tgcattatttgcatgtgcctgt

SEQ ID NO: 8294193 - DNA, 22 bp, Homo sapiens
tgcattatgcttgtgctgtata

SEQ ID NO: 8294194 - DNA, 22 bp, Homo sapiens
tgcattatgctacccagaagct

SEQ ID NO: 8294195 - DNA, 22 bp, Homo sapiens
tgctgcacaattggaaagtatc

SEQ ID NO: 8294196 - DNA, 22 bp, Homo sapiens
tgctgcactcaccaacagataa

SEQ ID NO: 8294197 - DNA, 22 bp, Homo sapiens
tgctgcacgataaataatttct

SEQ ID NO: 8294198 - DNA, 22 bp, Homo sapiens
taattgtacgatgttaaatcag

SEQ ID NO: 8294199 - DNA, 22 bp, Homo sapiens
taattgtaaagtagtagtacag

SEQ ID NO: 8294200 - DNA, 22 bp, Homo sapiens
tacagtaaagctgctatgaatt

SEQ ID NO: 8294201 - DNA, 22 bp, Homo sapiens
tacagtaacatgttgtacaagc

SEQ ID NO: 8294202 - DNA, 22 bp, Homo sapiens
tacagtaaccagtctacttaga

SEQ ID NO: 8294203 - DNA, 22 bp, Homo sapiens
tacaaatgaaccaactttgatg

SEQ ID NO: 8294204 - DNA, 22 bp, Homo sapiens
tacaaatgagttgtatgaacca

SEQ ID NO: 8294205 - DNA, 22 bp, Homo sapiens
tacaaatgaccatagccactta

SEQ ID NO: 8294206 - DNA, 20 bp, Homo sapiens
tacaaattttccatgtttcc

SEQ ID NO: 8294207 - DNA, 22 bp, Homo sapiens
tacaaattaatgggcatgttta

SEQ ID NO: 8294208 - DNA, 22 bp, Homo sapiens
taacagaaaagaactgagtttg

SEQ ID NO: 8294209 - DNA, 22 bp, Homo sapiens
taacagaaaggctcaggtgctc

SEQ ID NO: 8294210 - DNA, 22 bp, Homo sapiens
taacagaaacagataagtgtaa

SEQ ID NO: 8294211 - DNA, 22 bp, Homo sapiens
taacagaaaggggacagaaata

SEQ ID NO: 8294212 - DNA, 22 bp, Homo sapiens
taacagaaatagtaggtgaggg

SEQ ID NO: 8294213 - DNA, 22 bp, Homo sapiens
taacagaaatagaaatgagagt

SEQ ID NO: 8294214 - DNA, 22 bp, Homo sapiens
taacagaagatgaaacttcttt

SEQ ID NO: 8294215 - DNA, 22 bp, Homo sapiens
taacagaagaaaacatattgga

SEQ ID NO: 8294216 - DNA, 22 bp, Homo sapiens
taacagaagagcaggcagccct

SEQ ID NO: 8294217 - DNA, 22 bp, Homo sapiens
taacagaaattttagttagggg

SEQ ID NO: 8294218 - DNA, 22 bp, Homo sapiens
taacagaaatatttccaggtga

SEQ ID NO: 8294219 - DNA, 22 bp, Homo sapiens
taacagaaatagtaggtgaggg

SEQ ID NO: 8294220 - DNA, 22 bp, Homo sapiens
taacattcctcaaagttttcag

SEQ ID NO: 8294221 - DNA, 20 bp, Homo sapiens
taacagaagtagaagtgggt

SEQ ID NO: 8294222 - DNA, 22 bp, Homo sapiens
taacagaagttgttcattgtgg

SEQ ID NO: 8294223 - DNA, 22 bp, Homo sapiens
taaaatgacttcctccaacatc

SEQ ID NO: 8294224 - DNA, 22 bp, Homo sapiens
taaaatgacttcctccaacatc

SEQ ID NO: 8294225 - DNA, 22 bp, Homo sapiens
taaatgtaccttctgccttact

SEQ ID NO: 8294226 - DNA, 21 bp, Homo sapiens
taaatgtgagcagggctgggc

SEQ ID NO: 8294227 - DNA, 22 bp, Homo sapiens
taaatgtgaccttcattttata

SEQ ID NO: 8294228 - DNA, 22 bp, Homo sapiens
taaatgtgagtgatgcggtgaa

SEQ ID NO: 8294229 - DNA, 22 bp, Homo sapiens
taaagtcatctttacatctttg

SEQ ID NO: 8294230 - DNA, 22 bp, Homo sapiens
taaagtcatctttaaacatgcc

SEQ ID NO: 8294231 - DNA, 23 bp, Homo sapiens
taaagtcacatattagagtgagc

SEQ ID NO: 8294232 - DNA, 22 bp, Homo sapiens
taaagtcagatatctgggttga

SEQ ID NO: 8294233 - DNA, 22 bp, Homo sapiens
taaagtcataagagtggatccg

SEQ ID NO: 8294234 - DNA, 18 bp, Homo sapiens
taaatatatttccccctt

SEQ ID NO: 8294235 - DNA, 22 bp, Homo sapiens
taaatatcacctggaattgtta

SEQ ID NO: 8294236 - DNA, 22 bp, Homo sapiens
taaatatcacctggaattgtta

SEQ ID NO: 8294237 - DNA, 22 bp, Homo sapiens
taaatatgcatgtatccttatc

SEQ ID NO: 8294238 - DNA, 22 bp, Homo sapiens
taaatatgcatgtatccttatc

SEQ ID NO: 8294239 - DNA, 22 bp, Homo sapiens
cagctgcaggaacaaaaatgtg

SEQ ID NO: 8294240 - DNA, 22 bp, Homo sapiens
cagctgcaggaacaaaaatgtg

SEQ ID NO: 8294241 - DNA, 22 bp, Homo sapiens
gtgtataactatctatctagta

SEQ ID NO: 8294242 - DNA, 22 bp, Homo sapiens
gtgtatcaaagcacagacttca

SEQ ID NO: 8294243 - DNA, 22 bp, Homo sapiens
gtgtacatagaattgtgctttg

SEQ ID NO: 8294244 - DNA, 22 bp, Homo sapiens
gtgtacatattgagtctgctga

SEQ ID NO: 8294245 - DNA, 22 bp, Homo sapiens
gtgtacatgagaaatcaacttt

SEQ ID NO: 8294246 - DNA, 22 bp, Homo sapiens
gtgtgaaagttcctaagactat

SEQ ID NO: 8294247 - DNA, 22 bp, Homo sapiens
gtggcctttcctgaagaaatga

SEQ ID NO: 8294248 - DNA, 22 bp, Homo sapiens
caggaaacatatgtgcttgagg

SEQ ID NO: 8294249 - DNA, 22 bp, Homo sapiens
gttatgtattgggaaatccaag

SEQ ID NO: 8294250 - DNA, 22 bp, Homo sapiens
gttatgtatgggggccttatga

SEQ ID NO: 8294251 - DNA, 22 bp, Homo sapiens
ccagaggtgccacagaaagagc

SEQ ID NO: 8294252 - DNA, 22 bp, Homo sapiens
ccaaatgctccactgactttgg

SEQ ID NO: 8294253 - DNA, 22 bp, Homo sapiens
catttatataaaatgtccagaa

SEQ ID NO: 8294254 - DNA, 22 bp, Homo sapiens
catttagagtcttgcaatttta

SEQ ID NO: 8294255 - DNA, 22 bp, Homo sapiens
catttagacatttgatttgggg

SEQ ID NO: 8294256 - DNA, 22 bp, Homo sapiens
catttagaaactgtttttaaca

SEQ ID NO: 8294257 - DNA, 22 bp, Homo sapiens
ccagctgcttgggaaaatgtct

SEQ ID NO: 8294258 - DNA, 22 bp, Homo sapiens
tatttagaacagacaatagaaa

SEQ ID NO: 8294259 - DNA, 20 bp, Homo sapiens
tatttagattcaagtatgga

SEQ ID NO: 8294260 - DNA, 22 bp, Homo sapiens
tcagaaatagtctttaaaatga

SEQ ID NO: 8294261 - DNA, 22 bp, Homo sapiens
tcagaaatgtaagctgatgact

SEQ ID NO: 8294262 - DNA, 22 bp, Homo sapiens
tcagaaatgatcgttattcatt

SEQ ID NO: 8294263 - DNA, 22 bp, Homo sapiens
tcagaaatactatcagcttttg

SEQ ID NO: 8294264 - DNA, 22 bp, Homo sapiens
tcagaaattttctcagtagttc

SEQ ID NO: 8294265 - DNA, 22 bp, Homo sapiens
tatgtgtaggaggaggacaggg

SEQ ID NO: 8294266 - DNA, 22 bp, Homo sapiens
tatgtgtacatctggttgagca

SEQ ID NO: 8294267 - DNA, 22 bp, Homo sapiens
tattaaagagagaatcatcatc

SEQ ID NO: 8294268 - DNA, 22 bp, Homo sapiens
tatgtttttcaagtgcacacta

SEQ ID NO: 8294269 - DNA, 22 bp, Homo sapiens
tatgcacagttacaagaatatc

SEQ ID NO: 8294270 - DNA, 22 bp, Homo sapiens
tatgcacacattagcacagggt

SEQ ID NO: 8294271 - DNA, 22 bp, Homo sapiens
tatgcacacatgtatgcatgtg

SEQ ID NO: 8294272 - DNA, 22 bp, Homo sapiens
tatgcacagaagtttgctgaat

SEQ ID NO: 8294273 - DNA, 22 bp, Homo sapiens
tatgcacacctgggtccttgtc

SEQ ID NO: 8294274 - DNA, 22 bp, Homo sapiens
tatgtacatgttaaagggcaaa

SEQ ID NO: 8294275 - DNA, 22 bp, Homo sapiens
tataatccattcattgatttct

SEQ ID NO: 8294276 - DNA, 22 bp, Homo sapiens
tataagaaattgccaacctgtt

SEQ ID NO: 8294277 - DNA, 22 bp, Homo sapiens
tatctattccaaatatcagcgt

SEQ ID NO: 8294278 - DNA, 22 bp, Homo sapiens
catataatgtttgaagatgtgg

SEQ ID NO: 8294279 - DNA, 22 bp, Homo sapiens
catataaatacaacatgtgtta

SEQ ID NO: 8294280 - DNA, 22 bp, Homo sapiens
catactttgggataagagtgga

SEQ ID NO: 8294281 - DNA, 22 bp, Homo sapiens
catagaaaagagtaggtaatgt

SEQ ID NO: 8294282 - DNA, 22 bp, Homo sapiens
catagaaaagagtaggtaatgt

SEQ ID NO: 8294283 - DNA, 22 bp, Homo sapiens
cagtttctgggcgttcacaggt

SEQ ID NO: 8294284 - DNA, 22 bp, Homo sapiens
cagtttcttcatcagttaagca

SEQ ID NO: 8294285 - DNA, 22 bp, Homo sapiens
cagtttctgttttaaatagcag

SEQ ID NO: 8294286 - DNA, 22 bp, Homo sapiens
cagtttcttatcttcaaaattg

SEQ ID NO: 8294287 - DNA, 22 bp, Homo sapiens
tcagtttcacagtctgtgcaga

SEQ ID NO: 8294288 - DNA, 22 bp, Homo sapiens
catgcacaaaggtaagatgcgt

SEQ ID NO: 8294289 - DNA, 22 bp, Homo sapiens
catgcacaacatactcaagagg

SEQ ID NO: 8294290 - DNA, 18 bp, Homo sapiens
catgtctgcgccacaagg

SEQ ID NO: 8294291 - DNA, 22 bp, Homo sapiens
catgtctgtgtacacatgcaca

SEQ ID NO: 8294292 - DNA, 22 bp, Homo sapiens
catgtctgggtatatgcatatg

SEQ ID NO: 8294293 - DNA, 22 bp, Homo sapiens
tgttttatgagccatataacct

SEQ ID NO: 8294294 - DNA, 22 bp, Homo sapiens
tgttttatttctccaagaggga

SEQ ID NO: 8294295 - DNA, 22 bp, Homo sapiens
ttaaaatttccccaccatgtat

SEQ ID NO: 8294296 - DNA, 22 bp, Homo sapiens
ttaaacagacagtaaatgaaac

SEQ ID NO: 8294297 - DNA, 22 bp, Homo sapiens
ttaaacaggtttttgaatggcc

SEQ ID NO: 8294298 - DNA, 22 bp, Homo sapiens
ttaaacagagtctgaaatgtaa

SEQ ID NO: 8294299 - DNA, 22 bp, Homo sapiens
ttaaacagtgtttcatgtgggg

SEQ ID NO: 8294300 - DNA, 22 bp, Homo sapiens
ttaaacagtcccagaggctgac

SEQ ID NO: 8294301 - DNA, 22 bp, Homo sapiens
ttaaaatgcagattatgactca

SEQ ID NO: 8294302 - DNA, 22 bp, Homo sapiens
ttaaaatgcagattctgattca

SEQ ID NO: 8294303 - DNA, 22 bp, Homo sapiens
ttaaaatgcagattctgattca

SEQ ID NO: 8294304 - DNA, 22 bp, Homo sapiens
ttaaaacagcgtgaatctggca

SEQ ID NO: 8294305 - DNA, 18 bp, Homo sapiens
tgttaaatgaagatttgc

SEQ ID NO: 8294306 - DNA, 22 bp, Homo sapiens
tgttaaatgttcctttactgga

SEQ ID NO: 8294307 - DNA, 22 bp, Homo sapiens
tgttaacatcttggactcgtga

SEQ ID NO: 8294308 - DNA, 22 bp, Homo sapiens
tgtttataccttggtataacca

SEQ ID NO: 8294309 - DNA, 22 bp, Homo sapiens
tgtgtacaagagtgtttactgt

SEQ ID NO: 8294310 - DNA, 22 bp, Homo sapiens
tgtgtacatatctatcctagat

SEQ ID NO: 8294311 - DNA, 22 bp, Homo sapiens
tgtgtactcaattgagccattt

SEQ ID NO: 8294312 - DNA, 22 bp, Homo sapiens
tgtgtacaggccttgctagact

SEQ ID NO: 8294313 - DNA, 22 bp, Homo sapiens
tgtgtacagcaggatttctcaa

SEQ ID NO: 8294314 - DNA, 22 bp, Homo sapiens
tgtgtacacaatgattgcagag

SEQ ID NO: 8294315 - DNA, 22 bp, Homo sapiens
tgtgtgcattcacatgcatgcc

SEQ ID NO: 8294316 - DNA, 22 bp, Homo sapiens
tgtgtatttctggaacagacta

SEQ ID NO: 8294317 - DNA, 22 bp, Homo sapiens
tgtgtattcagcaagcgaaaca

SEQ ID NO: 8294318 - DNA, 22 bp, Homo sapiens
tgtgtattaccattttacagct

SEQ ID NO: 8294319 - DNA, 22 bp, Homo sapiens
tgtgtacttgaaagggcaggtc

SEQ ID NO: 8294320 - DNA, 22 bp, Homo sapiens
tgtgacatcgctgtgtctgttt

SEQ ID NO: 8294321 - DNA, 22 bp, Homo sapiens
tgtgacatgtgtcatcttttct

SEQ ID NO: 8294322 - DNA, 22 bp, Homo sapiens
tgtgaaagatactaggcagagg

SEQ ID NO: 8294323 - DNA, 22 bp, Homo sapiens
tgtgaaagagtcttatagtttc

SEQ ID NO: 8294324 - DNA, 22 bp, Homo sapiens
tgtgaaagcaagtctagttctc

SEQ ID NO: 8294325 - DNA, 22 bp, Homo sapiens
tgtgaaagatactaggcagagg

SEQ ID NO: 8294326 - DNA, 20 bp, Homo sapiens
tgtgaaagcagtagaatgac

SEQ ID NO: 8294327 - DNA, 22 bp, Homo sapiens
tgtgaaaggggtcacagggaaa

SEQ ID NO: 8294328 - DNA, 22 bp, Homo sapiens
tgtgaaaggagccatagacagt

SEQ ID NO: 8294329 - DNA, 22 bp, Homo sapiens
tgtgaaaggagccatagacagt

SEQ ID NO: 8294330 - DNA, 22 bp, Homo sapiens
tgtgaaaggaaggcatgaaaag

SEQ ID NO: 8294331 - DNA, 22 bp, Homo sapiens
tgtgaaagtcaaattaattgaa

SEQ ID NO: 8294332 - DNA, 22 bp, Homo sapiens
tgtggaaagtcaagttccagga

SEQ ID NO: 8294333 - DNA, 22 bp, Homo sapiens
tgtggaaaattggaacgttcct

SEQ ID NO: 8294334 - DNA, 22 bp, Homo sapiens
tgtcttttctactgtaagcata

SEQ ID NO: 8294335 - DNA, 22 bp, Homo sapiens
tgtgaaaagcgtgtgttctagg

SEQ ID NO: 8294336 - DNA, 22 bp, Homo sapiens
tgtcttcagtaaaatacactat

SEQ ID NO: 8294337 - DNA, 22 bp, Homo sapiens
tgtcttcatctccatgcacaga

SEQ ID NO: 8294338 - DNA, 23 bp, Homo sapiens
ttccagaggaagaagtcatgact

SEQ ID NO: 8294339 - DNA, 22 bp, Homo sapiens
ttcacatttgcccttatgtgtg

SEQ ID NO: 8294340 - DNA, 22 bp, Homo sapiens
ttcacattggttcttgatagct

SEQ ID NO: 8294341 - DNA, 22 bp, Homo sapiens
ttcacattgtgcagattatggt

SEQ ID NO: 8294342 - DNA, 19 bp, Homo sapiens
ttcacattggaagaagtag

SEQ ID NO: 8294343 - DNA, 22 bp, Homo sapiens
ttcacattggtgatatgtttct

SEQ ID NO: 8294344 - DNA, 22 bp, Homo sapiens
ttacaagattaattattggagt

SEQ ID NO: 8294345 - DNA, 22 bp, Homo sapiens
ttacaacaaaggcacgtgcatg

SEQ ID NO: 8294346 - DNA, 22 bp, Homo sapiens
ttaattaactagccaaccacta

SEQ ID NO: 8294347 - DNA, 22 bp, Homo sapiens
ttacaaagagaagttgtagaat

SEQ ID NO: 8294348 - DNA, 22 bp, Homo sapiens
ttacaaagttctgagttcaaac

SEQ ID NO: 8294349 - DNA, 22 bp, Homo sapiens
ttaataaagtatgaattggaaa

SEQ ID NO: 8294350 - DNA, 22 bp, Homo sapiens
ttaatacagtctccagaagtaa

SEQ ID NO: 8294351 - DNA, 22 bp, Homo sapiens
ttatgaaagacatttctgttgg

SEQ ID NO: 8294352 - DNA, 22 bp, Homo sapiens
ttatgaaggatcaggtacttgg

SEQ ID NO: 8294353 - DNA, 22 bp, Homo sapiens
ttagtcaatagtgaatatagag

SEQ ID NO: 8294354 - DNA, 22 bp, Homo sapiens
ttagaacatagcaacagaatta

SEQ ID NO: 8294355 - DNA, 22 bp, Homo sapiens
ttagataatgttattgtaattt

SEQ ID NO: 8294356 - DNA, 22 bp, Homo sapiens
ttagataatgtagagatatgag

SEQ ID NO: 8294357 - DNA, 22 bp, Homo sapiens
ttagataacagtagaatatcaa

SEQ ID NO: 8294358 - DNA, 22 bp, Homo sapiens
ttagataaattgcaacttgatt

SEQ ID NO: 8294359 - DNA, 22 bp, Homo sapiens
ttagatatgtttttgctaatgc

SEQ ID NO: 8294360 - DNA, 22 bp, Homo sapiens
ttagaaaggagcttatttcttt

SEQ ID NO: 8294361 - DNA, 22 bp, Homo sapiens
ttagaaaggaatcttcatttca

SEQ ID NO: 8294362 - DNA, 22 bp, Homo sapiens
ttagaaatacaagtgaggttga

SEQ ID NO: 8294363 - DNA, 22 bp, Homo sapiens
ttagaaatctgctgccatgcaa

SEQ ID NO: 8294364 - DNA, 22 bp, Homo sapiens
ttagaaatgatttcacctcttt

SEQ ID NO: 8294365 - DNA, 22 bp, Homo sapiens
ttagaaatcacctctgaagatc

SEQ ID NO: 8294366 - DNA, 22 bp, Homo sapiens
ttagtaatgtgttaatatgaat

SEQ ID NO: 8294367 - DNA, 22 bp, Homo sapiens
ttagtaaataaagtctactttc

SEQ ID NO: 8294368 - DNA, 22 bp, Homo sapiens
ttaggaaattccacctgtattc

SEQ ID NO: 8294369 - DNA, 22 bp, Homo sapiens
ttaggaaattatggtttcagat

SEQ ID NO: 8294370 - DNA, 17 bp, Homo sapiens
ttagcaaaatagcactt

SEQ ID NO: 8294371 - DNA, 22 bp, Homo sapiens
ttagcatagccattgaaatatg

SEQ ID NO: 8294372 - DNA, 22 bp, Homo sapiens
tggtatcagagccatctgtatt

SEQ ID NO: 8294373 - DNA, 22 bp, Homo sapiens
tggtaaagtgtactgaatatga

SEQ ID NO: 8294374 - DNA, 22 bp, Homo sapiens
tggtaaagaaggctagatctga

SEQ ID NO: 8294375 - DNA, 20 bp, Homo sapiens
tgtcctaatagacaagcaga

SEQ ID NO: 8294376 - DNA, 22 bp, Homo sapiens
tgtcatttagtcctctgtgtgt

SEQ ID NO: 8294377 - DNA, 22 bp, Homo sapiens
tgtcattttctaatctgttgtc

SEQ ID NO: 8294378 - DNA, 22 bp, Homo sapiens
tgtcatagtgtggtagcagtgg

SEQ ID NO: 8294379 - DNA, 22 bp, Homo sapiens
tgtcataaaacacaagctgttg

SEQ ID NO: 8294380 - DNA, 22 bp, Homo sapiens
tgtatgtaaagtttgtaataga

SEQ ID NO: 8294381 - DNA, 22 bp, Homo sapiens
tgtatgctttccaaaaatgctg

SEQ ID NO: 8294382 - DNA, 22 bp, Homo sapiens
tgtatgcaccattgtattacct

SEQ ID NO: 8294383 - DNA, 22 bp, Homo sapiens
tgtatgcagggcttgtatgcag

SEQ ID NO: 8294384 - DNA, 22 bp, Homo sapiens
tgtatgcagcaaaacaattagt

SEQ ID NO: 8294385 - DNA, 21 bp, Homo sapiens
tgtatgcacgcacatgcacac

SEQ ID NO: 8294386 - DNA, 22 bp, Homo sapiens
tgtatgcttgtgtataatataa

SEQ ID NO: 8294387 - DNA, 22 bp, Homo sapiens
tgtattttctgaagataatcaa

SEQ ID NO: 8294388 - DNA, 22 bp, Homo sapiens
tgtattttcttctggaagctta

SEQ ID NO: 8294389 - DNA, 22 bp, Homo sapiens
tgtattttgtgaggatcactct

SEQ ID NO: 8294390 - DNA, 22 bp, Homo sapiens
tgtatttttaggaatgcgctat

SEQ ID NO: 8294391 - DNA, 22 bp, Homo sapiens
tgtcacaaacatacattataga

SEQ ID NO: 8294392 - DNA, 22 bp, Homo sapiens
tgtataaatttaaattcctgct

SEQ ID NO: 8294393 - DNA, 22 bp, Homo sapiens
tgtatcactcagcaaagtgtct

SEQ ID NO: 8294394 - DNA, 22 bp, Homo sapiens
tgtatgcaaatttattagcaca

SEQ ID NO: 8294395 - DNA, 22 bp, Homo sapiens
tgtatattctgcctaaaagctt

SEQ ID NO: 8294396 - DNA, 20 bp, Homo sapiens
tgtatattttctggtgtaaa

SEQ ID NO: 8294397 - DNA, 23 bp, Homo sapiens
tgtagcatctcttatttctcagc

SEQ ID NO: 8294398 - DNA, 22 bp, Homo sapiens
tgtagcatgtaaattggttatt

SEQ ID NO: 8294399 - DNA, 22 bp, Homo sapiens
tgtagcacagagctttgacact

SEQ ID NO: 8294400 - DNA, 22 bp, Homo sapiens
tgtagaaagaatatgtttcata

SEQ ID NO: 8294401 - DNA, 22 bp, Homo sapiens
tgtagaaattagtaagatcaac

SEQ ID NO: 8294402 - DNA, 22 bp, Homo sapiens
tgtagaaattagtaagatcaac

SEQ ID NO: 8294403 - DNA, 22 bp, Homo sapiens
tgtagaaagaatatgtttcata

SEQ ID NO: 8294404 - DNA, 22 bp, Homo sapiens
tgtagaaactacacatgcaaca

SEQ ID NO: 8294405 - DNA, 22 bp, Homo sapiens
tggtttatttctctgaaaggtt

SEQ ID NO: 8294406 - DNA, 23 bp, Homo sapiens
tgtaaaatggggtagtgttacca

SEQ ID NO: 8294407 - DNA, 22 bp, Homo sapiens
tggttttgctccagtataaata

SEQ ID NO: 8294408 - DNA, 22 bp, Homo sapiens
tgtacaatagctattatctcca

SEQ ID NO: 8294409 - DNA, 20 bp, Homo sapiens
tgtacacagtactttacaat

SEQ ID NO: 8294410 - DNA, 22 bp, Homo sapiens
tgtacacaattcttaacataca

SEQ ID NO: 8294411 - DNA, 22 bp, Homo sapiens
tgtacagtatatttcaaagcca

SEQ ID NO: 8294412 - DNA, 22 bp, Homo sapiens
tgtacagtaggaacttgttatt

SEQ ID NO: 8294413 - DNA, 22 bp, Homo sapiens
tgtacctttttctgtgcatgct

SEQ ID NO: 8294414 - DNA, 22 bp, Homo sapiens
tgctgcatttatcttctcaaac

SEQ ID NO: 8294415 - DNA, 22 bp, Homo sapiens
tgcttaaacacatacatacata

SEQ ID NO: 8294416 - DNA, 22 bp, Homo sapiens
tgcttaatagtgcactggtttc

SEQ ID NO: 8294417 - DNA, 22 bp, Homo sapiens
tgcttaatgtacgtgagtgtac

SEQ ID NO: 8294418 - DNA, 22 bp, Homo sapiens
tgctttatgttatcagaagggt

SEQ ID NO: 8294419 - DNA, 21 bp, Homo sapiens
tgctttatgggaaaaatgtca

SEQ ID NO: 8294420 - DNA, 22 bp, Homo sapiens
tgcttttaagaacaatgctgct

SEQ ID NO: 8294421 - DNA, 22 bp, Homo sapiens
tggcttcaaaatctagtggtct

SEQ ID NO: 8294422 - DNA, 21 bp, Homo sapiens
tggcaggcagctggaagcttg

SEQ ID NO: 8294423 - DNA, 22 bp, Homo sapiens
tgagaaattcgacatatattta

SEQ ID NO: 8294424 - DNA, 22 bp, Homo sapiens
tgaatacaggaaaatatactga

SEQ ID NO: 8294425 - DNA, 22 bp, Homo sapiens
tgaatacactaaaaatcacttt

SEQ ID NO: 8294426 - DNA, 21 bp, Homo sapiens
tgaataaagctgctgtcgata

SEQ ID NO: 8294427 - DNA, 22 bp, Homo sapiens
tgaaatgtttaggaccactaga

SEQ ID NO: 8294428 - DNA, 22 bp, Homo sapiens
tgaaatgtttgggtccagaagt

SEQ ID NO: 8294429 - DNA, 22 bp, Homo sapiens
tgaaatgtgtaatgtggatgcc

SEQ ID NO: 8294430 - DNA, 22 bp, Homo sapiens
tgaaatgtctttgcaattgaaa

SEQ ID NO: 8294431 - DNA, 22 bp, Homo sapiens
tgaaatgtaaataggactagaa

SEQ ID NO: 8294432 - DNA, 20 bp, Homo sapiens
tgaaataaggagttgtcctt

SEQ ID NO: 8294433 - DNA, 21 bp, Homo sapiens
tgaaagttggagtcaaatgta

SEQ ID NO: 8294434 - DNA, 22 bp, Homo sapiens
tgaaagttgcacataagagaat

SEQ ID NO: 8294435 - DNA, 22 bp, Homo sapiens
tgaaagttacaggaaaacagat

SEQ ID NO: 8294436 - DNA, 22 bp, Homo sapiens
tgaaaggttaaaagtagtattg

SEQ ID NO: 8294437 - DNA, 22 bp, Homo sapiens
tgaaaggtgtccaatatttctc

SEQ ID NO: 8294438 - DNA, 22 bp, Homo sapiens
tgaaagcactgattctcaactc

SEQ ID NO: 8294439 - DNA, 22 bp, Homo sapiens
tgaaagcacaagttctaacagg

SEQ ID NO: 8294440 - DNA, 22 bp, Homo sapiens
tgaaagcacaagttctaacagg

SEQ ID NO: 8294441 - DNA, 22 bp, Homo sapiens
tgaacattagttgagtaaagtc

SEQ ID NO: 8294442 - DNA, 22 bp, Homo sapiens
tgaacattggcacaaggcagca

SEQ ID NO: 8294443 - DNA, 22 bp, Homo sapiens
tctttgcatgtgcttcttggcc

SEQ ID NO: 8294444 - DNA, 22 bp, Homo sapiens
tctttgcatgcattttccctta

SEQ ID NO: 8294445 - DNA, 22 bp, Homo sapiens
tctttgcatcccttccatagtt

SEQ ID NO: 8294446 - DNA, 21 bp, Homo sapiens
tctttgcatcagttgttttct

SEQ ID NO: 8294447 - DNA, 22 bp, Homo sapiens
tctttgcaactcccatttccat

SEQ ID NO: 8294448 - DNA, 22 bp, Homo sapiens
tctttgcaaatgttattatctt

SEQ ID NO: 8294449 - DNA, 22 bp, Homo sapiens
tctttgcaggagccctttgaac

SEQ ID NO: 8294450 - DNA, 22 bp, Homo sapiens
tctttgcagaatttaactttgc

SEQ ID NO: 8294451 - DNA, 22 bp, Homo sapiens
tctttggatatcgctagaccgt

SEQ ID NO: 8294452 - DNA, 22 bp, Homo sapiens
tgaaaaactttaatccataaag

SEQ ID NO: 8294453 - DNA, 23 bp, Homo sapiens
tgaaacatttagggtagaatttc

SEQ ID NO: 8294454 - DNA, 22 bp, Homo sapiens
tgaaacattatagaatatttat

SEQ ID NO: 8294455 - DNA, 22 bp, Homo sapiens
tgaaacattaggaaatcattat

SEQ ID NO: 8294456 - DNA, 22 bp, Homo sapiens
tgcagaggagctggaaggctgg

SEQ ID NO: 8294457 - DNA, 22 bp, Homo sapiens
tgcagagaaaccagtggaggac

SEQ ID NO: 8294458 - DNA, 22 bp, Homo sapiens
tgcaccccattttacatttaca

SEQ ID NO: 8294459 - DNA, 22 bp, Homo sapiens
tgcaccctcatcagtcaaatgg

SEQ ID NO: 8294460 - DNA, 22 bp, Homo sapiens
tgcacagcgggtgtctgtcagg

SEQ ID NO: 8294461 - DNA, 22 bp, Homo sapiens
tgcaggaagacttcccaagcca

SEQ ID NO: 8294462 - DNA, 22 bp, Homo sapiens
tgcaggaagcaaccaggtccaa

SEQ ID NO: 8294463 - DNA, 22 bp, Homo sapiens
tgcaggaacataggttccttgg

SEQ ID NO: 8294464 - DNA, 22 bp, Homo sapiens
tgcaggaacttggttttactca

SEQ ID NO: 8294465 - DNA, 22 bp, Homo sapiens
tgcaggaacagaactcactccc

SEQ ID NO: 8294466 - DNA, 22 bp, Homo sapiens
tgcaggaaaaccaacacgcctt

SEQ ID NO: 8294467 - DNA, 22 bp, Homo sapiens
tgcaggaaaacacctatcaccc

SEQ ID NO: 8294468 - DNA, 22 bp, Homo sapiens
tgcaaaaacagccttgaggcct

SEQ ID NO: 8294469 - DNA, 22 bp, Homo sapiens
tgcaaaaattgctggaatcttt

SEQ ID NO: 8294470 - DNA, 22 bp, Homo sapiens
tgcaaaaactgcaattgctttt

SEQ ID NO: 8294471 - DNA, 22 bp, Homo sapiens
tgcaaaaagagcgaggagccct

SEQ ID NO: 8294472 - DNA, 22 bp, Homo sapiens
tgcaaaaaggcagactggtgat

SEQ ID NO: 8294473 - DNA, 22 bp, Homo sapiens
tgatttatgcattatactgttg

SEQ ID NO: 8294474 - DNA, 22 bp, Homo sapiens
tgcaagaggaattctagaagca

SEQ ID NO: 8294475 - DNA, 22 bp, Homo sapiens
tgcaagaggtaaaatgaaagga

SEQ ID NO: 8294476 - DNA, 22 bp, Homo sapiens
tgcaagcactcaatgcaaacag

SEQ ID NO: 8294477 - DNA, 22 bp, Homo sapiens
tgatatttaagcaaaaatatgg

SEQ ID NO: 8294478 - DNA, 21 bp, Homo sapiens
tgatcatttgtgtaaaggaga

SEQ ID NO: 8294479 - DNA, 22 bp, Homo sapiens
tgatttaaaagaaacattgtct

SEQ ID NO: 8294480 - DNA, 21 bp, Homo sapiens
tgcataaagaaatacaaatac

SEQ ID NO: 8294481 - DNA, 22 bp, Homo sapiens
tgcataactagagtaattacag

SEQ ID NO: 8294482 - DNA, 22 bp, Homo sapiens
tgcatccttaaccagcatcact

SEQ ID NO: 8294483 - DNA, 22 bp, Homo sapiens
tgcatcttacgttttgaaaggg

SEQ ID NO: 8294484 - DNA, 22 bp, Homo sapiens
tgcatgcagctggtgataagaa

SEQ ID NO: 8294485 - DNA, 22 bp, Homo sapiens
tgcatgcataaatgtacacaca

SEQ ID NO: 8294486 - DNA, 21 bp, Homo sapiens
tgcatgctatgtttttatttc

SEQ ID NO: 8294487 - DNA, 22 bp, Homo sapiens
tgccagaagtgctttataagtg

SEQ ID NO: 8294488 - DNA, 22 bp, Homo sapiens
tgccagaagattctctatcaga

SEQ ID NO: 8294489 - DNA, 22 bp, Homo sapiens
tgcatttcagaagaaaattcgg

SEQ ID NO: 8294490 - DNA, 22 bp, Homo sapiens
tgcaggtaggcctgacttccag

SEQ ID NO: 8294491 - DNA, 19 bp, Homo sapiens
tctcacatcagctcctagc

SEQ ID NO: 8294492 - DNA, 22 bp, Homo sapiens
tctcttaattttggaatagtgt

SEQ ID NO: 8294493 - DNA, 22 bp, Homo sapiens
taagaacattttcggaaagata

SEQ ID NO: 8294494 - DNA, 21 bp, Homo sapiens
taagaacattatcttcttcct

SEQ ID NO: 8294495 - DNA, 22 bp, Homo sapiens
taagaacagtagaacagtaggt

SEQ ID NO: 8294496 - DNA, 22 bp, Homo sapiens
taagaacagataaagtttcccc

SEQ ID NO: 8294497 - DNA, 23 bp, Homo sapiens
taagaacagacaagcatttacat

SEQ ID NO: 8294498 - DNA, 23 bp, Homo sapiens
taagaacagacaagcatttacat

SEQ ID NO: 8294499 - DNA, 22 bp, Homo sapiens
taagaacaagctgggggttcca

SEQ ID NO: 8294500 - DNA, 22 bp, Homo sapiens
taagaacagtgacagccaacat

SEQ ID NO: 8294501 - DNA, 22 bp, Homo sapiens
taagaacagtgtctgtctcaca

SEQ ID NO: 8294502 - DNA, 22 bp, Homo sapiens
taagaacagtgtttcatctcta

SEQ ID NO: 8294503 - DNA, 22 bp, Homo sapiens
taagaacatctgtccccagatt

SEQ ID NO: 8294504 - DNA, 22 bp, Homo sapiens
taagaacataaattcatacggg

SEQ ID NO: 8294505 - DNA, 22 bp, Homo sapiens
tctagaaaaaaactgctgtgga

SEQ ID NO: 8294506 - DNA, 19 bp, Homo sapiens
tctaacagaagtgtcgtcc

SEQ ID NO: 8294507 - DNA, 22 bp, Homo sapiens
tctataaaactcaagagcaatt

SEQ ID NO: 8294508 - DNA, 22 bp, Homo sapiens
tctataaagggccagatagtag

SEQ ID NO: 8294509 - DNA, 22 bp, Homo sapiens
tccttaattctgtgcaatatgt

SEQ ID NO: 8294510 - DNA, 22 bp, Homo sapiens
tccttaatatggaagagttctc

SEQ ID NO: 8294511 - DNA, 22 bp, Homo sapiens
tctaaaaaagtctgttcacttg

SEQ ID NO: 8294512 - DNA, 22 bp, Homo sapiens
tctaaacacgtctctttgaata

SEQ ID NO: 8294513 - DNA, 22 bp, Homo sapiens
tctaaagccttccatataacgc

SEQ ID NO: 8294514 - DNA, 22 bp, Homo sapiens
tcttgaaacatatgagtaagtg

SEQ ID NO: 8294515 - DNA, 22 bp, Homo sapiens
tcttcaatttagaatggattta

SEQ ID NO: 8294516 - DNA, 22 bp, Homo sapiens
tcttcaaactgaaaatttagaa

SEQ ID NO: 8294517 - DNA, 22 bp, Homo sapiens
tcttaaaagtatgccaattgga

SEQ ID NO: 8294518 - DNA, 22 bp, Homo sapiens
tctgtttaggcaaaatagctac

SEQ ID NO: 8294519 - DNA, 22 bp, Homo sapiens
tctgtgaacatcacattgacag

SEQ ID NO: 8294520 - DNA, 22 bp, Homo sapiens
tctgtaaaacttctttgtaaat

SEQ ID NO: 8294521 - DNA, 21 bp, Homo sapiens
tctgtacatcattgagtcccc

SEQ ID NO: 8294522 - DNA, 22 bp, Homo sapiens
tctgtaaatcctgctcagcaac

SEQ ID NO: 8294523 - DNA, 20 bp, Homo sapiens
tctgtaaagactccagaagc

SEQ ID NO: 8294524 - DNA, 22 bp, Homo sapiens
tctgtagtaggttgtagttctt

SEQ ID NO: 8294525 - DNA, 22 bp, Homo sapiens
tctgtatctaattttacagtag

SEQ ID NO: 8294526 - DNA, 22 bp, Homo sapiens
tctgtatcacccgttcccagaa

SEQ ID NO: 8294527 - DNA, 22 bp, Homo sapiens
tctgctgtaaagaatttctgcc

SEQ ID NO: 8294528 - DNA, 22 bp, Homo sapiens
tctgagcattgaattttcttcc

SEQ ID NO: 8294529 - DNA, 22 bp, Homo sapiens
tctgacattagattaattggaa

SEQ ID NO: 8294530 - DNA, 22 bp, Homo sapiens
tctgacattttgagaatgacat

SEQ ID NO: 8294531 - DNA, 22 bp, Homo sapiens
tctgacattttgagaatgacat

SEQ ID NO: 8294532 - DNA, 22 bp, Homo sapiens
aatcagctaaataaactagtca

SEQ ID NO: 8294533 - DNA, 22 bp, Homo sapiens
agaaatgaagcaggagttatta

SEQ ID NO: 8294534 - DNA, 22 bp, Homo sapiens
agaaatgacaagactgatcagg

SEQ ID NO: 8294535 - DNA, 22 bp, Homo sapiens
aatgatgtgagtttttattctc

SEQ ID NO: 8294536 - DNA, 22 bp, Homo sapiens
agaaatgacacacatgagacat

SEQ ID NO: 8294537 - DNA, 22 bp, Homo sapiens
actgcgtggggagctgtgacta

SEQ ID NO: 8294538 - DNA, 22 bp, Homo sapiens
actacagaagtcttattagaga

SEQ ID NO: 8294539 - DNA, 22 bp, Homo sapiens
acctagaatttaaaacattgct

SEQ ID NO: 8294540 - DNA, 20 bp, Homo sapiens
acgtggccaccagtggctta

SEQ ID NO: 8294541 - DNA, 22 bp, Homo sapiens
acgtgcatctttccatatgtgg

SEQ ID NO: 8294542 - DNA, 22 bp, Homo sapiens
aaggcctgggaggcctctcttc

SEQ ID NO: 8294543 - DNA, 22 bp, Homo sapiens
aaggcctgctcagctgtctgtg

SEQ ID NO: 8294544 - DNA, 22 bp, Homo sapiens
acatatgtgttgtacatgcatg

SEQ ID NO: 8294545 - DNA, 22 bp, Homo sapiens
acagagaccagttacagcgtcc

SEQ ID NO: 8294546 - DNA, 22 bp, Homo sapiens
acagagacaggcagacagtctt

SEQ ID NO: 8294547 - DNA, 18 bp, Homo sapiens
acagacacttagtatgag

SEQ ID NO: 8294548 - DNA, 22 bp, Homo sapiens
acagacagacagagaactattc

SEQ ID NO: 8294549 - DNA, 22 bp, Homo sapiens
acagatgttagcaatgatgatg

SEQ ID NO: 8294550 - DNA, 22 bp, Homo sapiens
acagatgtggagtttgcatgat

SEQ ID NO: 8294551 - DNA, 21 bp, Homo sapiens
acagatgtgatatgcagtctt

SEQ ID NO: 8294552 - DNA, 22 bp, Homo sapiens
acagatgtaatctattcacatt

SEQ ID NO: 8294553 - DNA, 22 bp, Homo sapiens
acacagagttattatgtgaact

SEQ ID NO: 8294554 - DNA, 22 bp, Homo sapiens
acacagagtttgacacatggga

SEQ ID NO: 8294555 - DNA, 21 bp, Homo sapiens
acacagaggcatcatcacttt

SEQ ID NO: 8294556 - DNA, 22 bp, Homo sapiens
acactagtggaaattgatttgt

SEQ ID NO: 8294557 - DNA, 22 bp, Homo sapiens
acactagtctcttcttgacttg

SEQ ID NO: 8294558 - DNA, 22 bp, Homo sapiens
acactagtagaatagtgtttgc

SEQ ID NO: 8294559 - DNA, 22 bp, Homo sapiens
acacatgtgattctaagacagc

SEQ ID NO: 8294560 - DNA, 20 bp, Homo sapiens
acacatgtcaagctaaaggc

SEQ ID NO: 8294561 - DNA, 22 bp, Homo sapiens
acacatgtttgtgtagtcagtt

SEQ ID NO: 8294562 - DNA, 22 bp, Homo sapiens
acacatgtttccaaaagcaccc

SEQ ID NO: 8294563 - DNA, 22 bp, Homo sapiens
acacatgtttacagtcttcagt

SEQ ID NO: 8294564 - DNA, 22 bp, Homo sapiens
acacatgtgtctgcatgcagtg

SEQ ID NO: 8294565 - DNA, 20 bp, Homo sapiens
acacatgtgcgtgttcagta

SEQ ID NO: 8294566 - DNA, 22 bp, Homo sapiens
aatggcagaatgggccagaagc

SEQ ID NO: 8294567 - DNA, 20 bp, Homo sapiens
agaccctgtgtcctgtggcc

SEQ ID NO: 8294568 - DNA, 22 bp, Homo sapiens
aattaaaagataacccatgagt

SEQ ID NO: 8294569 - DNA, 22 bp, Homo sapiens
agagacagatctgagggacctc

SEQ ID NO: 8294570 - DNA, 22 bp, Homo sapiens
agagccagttgttaagcactta

SEQ ID NO: 8294571 - DNA, 22 bp, Homo sapiens
agagccaggtgctgctgtttga

SEQ ID NO: 8294572 - DNA, 22 bp, Homo sapiens
agagccaggctctacctgggtt

SEQ ID NO: 8294573 - DNA, 22 bp, Homo sapiens
agagccaggctcccatggggca

SEQ ID NO: 8294574 - DNA, 22 bp, Homo sapiens
agagccagttaagcacttacag

SEQ ID NO: 8294575 - DNA, 22 bp, Homo sapiens
agagccagttacaactgtggag

SEQ ID NO: 8294576 - DNA, 22 bp, Homo sapiens
agagccaggtgtagtctcggag

SEQ ID NO: 8294577 - DNA, 22 bp, Homo sapiens
agagccaggcggctgggcacct

SEQ ID NO: 8294578 - DNA, 22 bp, Homo sapiens
acaacacatgtgtatatgtgtg

SEQ ID NO: 8294579 - DNA, 22 bp, Homo sapiens
acaacagagctggactgagagg

SEQ ID NO: 8294580 - DNA, 22 bp, Homo sapiens
agagggggaaaatagaggtgtt

SEQ ID NO: 8294581 - DNA, 22 bp, Homo sapiens
aaagcagaggtgatatgactta

SEQ ID NO: 8294582 - DNA, 22 bp, Homo sapiens
aaagcagagatcatggcttgta

SEQ ID NO: 8294583 - DNA, 22 bp, Homo sapiens
aaatacatttacagtcgtggct

SEQ ID NO: 8294584 - DNA, 22 bp, Homo sapiens
aagcagcatatgacagcatcca

SEQ ID NO: 8294585 - DNA, 22 bp, Homo sapiens
aaacattgagcacttgctattt

SEQ ID NO: 8294586 - DNA, 20 bp, Homo sapiens
aaacattcatgtacaagtga

SEQ ID NO: 8294587 - DNA, 22 bp, Homo sapiens
aaacatgctggatttagaatat

SEQ ID NO: 8294588 - DNA, 22 bp, Homo sapiens
aaagacatgacacattggagag

SEQ ID NO: 8294589 - DNA, 22 bp, Homo sapiens
aaagacttggcttatgatttgc

SEQ ID NO: 8294590 - DNA, 22 bp, Homo sapiens
aaaacagtttttgctaactgct

SEQ ID NO: 8294591 - DNA, 22 bp, Homo sapiens
aacagacagaaaaatgtgatct

SEQ ID NO: 8294592 - DNA, 23 bp, Homo sapiens
aaattattgctcttcaattgcct

SEQ ID NO: 8294593 - DNA, 22 bp, Homo sapiens
aatagatactacttagatgtag

SEQ ID NO: 8294594 - DNA, 22 bp, Homo sapiens
aactagtcagtgattctcagaa

SEQ ID NO: 8294595 - DNA, 22 bp, Homo sapiens
aatgacatgctttttaattata

SEQ ID NO: 8294596 - DNA, 22 bp, Homo sapiens
aagaacaactgctttaaaagca

SEQ ID NO: 8294597 - DNA, 22 bp, Homo sapiens
aagaaactgttgcgtgacagcg

SEQ ID NO: 8294598 - DNA, 22 bp, Homo sapiens
accaaacaaaattgtgcactgt

SEQ ID NO: 8294599 - DNA, 20 bp, Homo sapiens
accattaatgtaagctttgt

SEQ ID NO: 8294600 - DNA, 22 bp, Homo sapiens
acaggtggtaaaatggactgtc

SEQ ID NO: 8294601 - DNA, 22 bp, Homo sapiens
acaggtggcttattggctgatt

SEQ ID NO: 8294602 - DNA, 22 bp, Homo sapiens
acagcacttattcagcacagtg

SEQ ID NO: 8294603 - DNA, 22 bp, Homo sapiens
acagcactggtcccgcaagcct

SEQ ID NO: 8294604 - DNA, 22 bp, Homo sapiens
acttggcaagtatctataaagt

SEQ ID NO: 8294605 - DNA, 20 bp, Homo sapiens
atcactggagaaggaaacct

SEQ ID NO: 8294606 - DNA, 22 bp, Homo sapiens
actattcaagtgctcattcaga

SEQ ID NO: 8294607 - DNA, 22 bp, Homo sapiens
accttagctgttaaaactaagt

SEQ ID NO: 8294608 - DNA, 22 bp, Homo sapiens
acctgtttacctgcacctgttt

SEQ ID NO: 8294609 - DNA, 23 bp, Homo sapiens
acctggctgctcaacctgcaggg

SEQ ID NO: 8294610 - DNA, 22 bp, Homo sapiens
acctggctggttgtgattccca

SEQ ID NO: 8294611 - DNA, 22 bp, Homo sapiens
agggctggtatgtccatgaaag

SEQ ID NO: 8294612 - DNA, 23 bp, Homo sapiens
actgcctgtgccgatctctctca

SEQ ID NO: 8294613 - DNA, 22 bp, Homo sapiens
agtctctgtcgtagatcagcgt

SEQ ID NO: 8294614 - DNA, 22 bp, Homo sapiens
caaatgatactgtttttagtct

SEQ ID NO: 8294615 - DNA, 22 bp, Homo sapiens
caaatgatccttgcaagctgtg

SEQ ID NO: 8294616 - DNA, 22 bp, Homo sapiens
caaatgatagagccgattatca

SEQ ID NO: 8294617 - DNA, 22 bp, Homo sapiens
caaatgatgcatggctagtgag

SEQ ID NO: 8294618 - DNA, 22 bp, Homo sapiens
agcacttaactgacagtactat

SEQ ID NO: 8294619 - DNA, 22 bp, Homo sapiens
caatgaaaatgaggactcctgt

SEQ ID NO: 8294620 - DNA, 22 bp, Homo sapiens
agcagcacacgggagaaagaca

SEQ ID NO: 8294621 - DNA, 22 bp, Homo sapiens
agcagcacctgtcctcgctgct

SEQ ID NO: 8294622 - DNA, 22 bp, Homo sapiens
agcagcacccagagccatgtct

SEQ ID NO: 8294623 - DNA, 22 bp, Homo sapiens
agcagcacgagtccacaaatcc

SEQ ID NO: 8294624 - DNA, 22 bp, Homo sapiens
caatgataatggctgtatttat

SEQ ID NO: 8294625 - DNA, 22 bp, Homo sapiens
agccttgaatgcgctgcattgg

SEQ ID NO: 8294626 - DNA, 22 bp, Homo sapiens
cagcagcagccccaggaaggtt

SEQ ID NO: 8294627 - DNA, 22 bp, Homo sapiens
cagcagcagcttagtggtcccc

SEQ ID NO: 8294628 - DNA, 22 bp, Homo sapiens
cagcagcagtggctgcagaaca

SEQ ID NO: 8294629 - DNA, 22 bp, Homo sapiens
cagcagcatcaggtctgtggtt

SEQ ID NO: 8294630 - DNA, 22 bp, Homo sapiens
cagcagcatgaattcgagccac

SEQ ID NO: 8294631 - DNA, 22 bp, Homo sapiens
cagaaatgacaaagtaagagga

SEQ ID NO: 8294632 - DNA, 22 bp, Homo sapiens
agccacagcatgtgtgtatgta

SEQ ID NO: 8294633 - DNA, 22 bp, Homo sapiens
agccacagcaacaagtgcaatt

SEQ ID NO: 8294634 - DNA, 22 bp, Homo sapiens
agccacagaggttgatgtggtt

SEQ ID NO: 8294635 - DNA, 17 bp, Homo sapiens
cagacagatatcctggg

SEQ ID NO: 8294636 - DNA, 22 bp, Homo sapiens
cagacagaggctgtatgagggc

SEQ ID NO: 8294637 - DNA, 22 bp, Homo sapiens
atgtacagccacttcacagtta

SEQ ID NO: 8294638 - DNA, 22 bp, Homo sapiens
atgtccagaggtgagtcagagc

SEQ ID NO: 8294639 - DNA, 22 bp, Homo sapiens
atgtccagagtgtcctggaaag

SEQ ID NO: 8294640 - DNA, 22 bp, Homo sapiens
atgtccaggaagtcttaactca

SEQ ID NO: 8294641 - DNA, 22 bp, Homo sapiens
atgcttggatgctgccatggga

SEQ ID NO: 8294642 - DNA, 22 bp, Homo sapiens
agactacatatgccacatgaag

SEQ ID NO: 8294643 - DNA, 22 bp, Homo sapiens
agacacagtataagcacaacaa

SEQ ID NO: 8294644 - DNA, 22 bp, Homo sapiens
agacacagtgttgaaggctagt

SEQ ID NO: 8294645 - DNA, 22 bp, Homo sapiens
agaattacataaatacatgaat

SEQ ID NO: 8294646 - DNA, 22 bp, Homo sapiens
agacacagaacacaaaagcata

SEQ ID NO: 8294647 - DNA, 19 bp, Homo sapiens
agacacacttgatatgtgt

SEQ ID NO: 8294648 - DNA, 22 bp, Homo sapiens
agacacagattttggaaaagat

SEQ ID NO: 8294649 - DNA, 22 bp, Homo sapiens
agaatgatagctagtatttact

SEQ ID NO: 8294650 - DNA, 22 bp, Homo sapiens
atcttgtgtgatgatgagaaag

SEQ ID NO: 8294651 - DNA, 22 bp, Homo sapiens
atcttgtgctgacaaaacacat

SEQ ID NO: 8294652 - DNA, 22 bp, Homo sapiens
agaatacaattgttcagtaata

SEQ ID NO: 8294653 - DNA, 22 bp, Homo sapiens
atgtgtgcctgagtgatggact

SEQ ID NO: 8294654 - DNA, 22 bp, Homo sapiens
atgtgtgcatcaatgatagatc

SEQ ID NO: 8294655 - DNA, 22 bp, Homo sapiens
atgtgtgctacaggtgtgggaa

SEQ ID NO: 8294656 - DNA, 22 bp, Homo sapiens
attagcataagtgttcggtgca

SEQ ID NO: 8294657 - DNA, 22 bp, Homo sapiens
attagcatgccaagcttttaga

SEQ ID NO: 8294658 - DNA, 19 bp, Homo sapiens
attagcatgcttgaggatg

SEQ ID NO: 8294659 - DNA, 22 bp, Homo sapiens
attagcattgctactctcaaga

SEQ ID NO: 8294660 - DNA, 22 bp, Homo sapiens
attcagcacatctttgtacagc

SEQ ID NO: 8294661 - DNA, 22 bp, Homo sapiens
attcagcataatcagtagcttg

SEQ ID NO: 8294662 - DNA, 22 bp, Homo sapiens
atttattatgggatttggctca

SEQ ID NO: 8294663 - DNA, 22 bp, Homo sapiens
atttagtgacctgaactgaaac

SEQ ID NO: 8294664 - DNA, 22 bp, Homo sapiens
atttagtgaaacccataaagca

SEQ ID NO: 8294665 - DNA, 22 bp, Homo sapiens
atttattattgtggttacttct

SEQ ID NO: 8294666 - DNA, 22 bp, Homo sapiens
atttagaagttggagggcaaga

SEQ ID NO: 8294667 - DNA, 22 bp, Homo sapiens
agagtgggcctctgagtcccag

SEQ ID NO: 8294668 - DNA, 22 bp, Homo sapiens
atttaaattttctgatggagag

SEQ ID NO: 8294669 - DNA, 22 bp, Homo sapiens
aggaagctggggtgttcttcat

SEQ ID NO: 8294670 - DNA, 22 bp, Homo sapiens
aggaagcttggggcagggctac

SEQ ID NO: 8294671 - DNA, 22 bp, Homo sapiens
aggcagcatttctgcttatcca

SEQ ID NO: 8294672 - DNA, 19 bp, Homo sapiens
aggcagcattctggggctt

SEQ ID NO: 8294673 - DNA, 22 bp, Homo sapiens
catgaaatgttagaattagaca

SEQ ID NO: 8294674 - DNA, 22 bp, Homo sapiens
catgcctgtatttctgatctat

SEQ ID NO: 8294675 - DNA, 22 bp, Homo sapiens
cagcttcttagtctttccttgt

SEQ ID NO: 8294676 - DNA, 22 bp, Homo sapiens
caggcctcatggtgtgtccttc

SEQ ID NO: 8294677 - DNA, 22 bp, Homo sapiens
ccagtctgtactttgctctgtt

SEQ ID NO: 8294678 - DNA, 22 bp, Homo sapiens
cctcagtctgtctgatctgcca

SEQ ID NO: 8294679 - DNA, 18 bp, Homo sapiens
cccttagcctttcctctc

SEQ ID NO: 8294680 - DNA, 22 bp, Homo sapiens
cccttagccaggaaatcgacct

SEQ ID NO: 8294681 - DNA, 23 bp, Homo sapiens
cccttcagcgagggcattaaggt

SEQ ID NO: 8294682 - DNA, 22 bp, Homo sapiens
cccttagctccaaggggtttgg

SEQ ID NO: 8294683 - DNA, 22 bp, Homo sapiens
cccttagctggtgagcccagcg

SEQ ID NO: 8294684 - DNA, 22 bp, Homo sapiens
cccttagctcaatttcttgccc

SEQ ID NO: 8294685 - DNA, 22 bp, Homo sapiens
cccttagctcacaagctaaagc

SEQ ID NO: 8294686 - DNA, 22 bp, Homo sapiens
agggcagctctcacctctggcc

SEQ ID NO: 8294687 - DNA, 22 bp, Homo sapiens
cccagcctgatctcggccagct

SEQ ID NO: 8294688 - DNA, 18 bp, Homo sapiens
cccagcctctcctttcta

SEQ ID NO: 8294689 - DNA, 22 bp, Homo sapiens
cccagcctctgggctcacccaa

SEQ ID NO: 8294690 - DNA, 22 bp, Homo sapiens
cccagcctctggattctgccct

SEQ ID NO: 8294691 - DNA, 22 bp, Homo sapiens
cccagcctctgtttgctcctct

SEQ ID NO: 8294692 - DNA, 22 bp, Homo sapiens
cccagcctctgggttctgccgg

SEQ ID NO: 8294693 - DNA, 22 bp, Homo sapiens
cccagcctcagctttacttcca

SEQ ID NO: 8294694 - DNA, 22 bp, Homo sapiens
cctggcagcgtgccgagctgcg

SEQ ID NO: 8294695 - DNA, 22 bp, Homo sapiens
agggtgaatctcacaactctta

SEQ ID NO: 8294696 - DNA, 22 bp, Homo sapiens
agtatatgccagagagatagct

SEQ ID NO: 8294697 - DNA, 22 bp, Homo sapiens
cggccaagccggggccccgaag

SEQ ID NO: 8294698 - DNA, 22 bp, Homo sapiens
ccttggctgaggagggagctga

SEQ ID NO: 8294699 - DNA, 22 bp, Homo sapiens
agtatcatgttggaattaatca

SEQ ID NO: 8294700 - DNA, 22 bp, Homo sapiens
ctcagcacatctttacatttcc

SEQ ID NO: 8294701 - DNA, 22 bp, Homo sapiens
ctcagcacactcccatctaatt

SEQ ID NO: 8294702 - DNA, 22 bp, Homo sapiens
agttgtgagaaacagaatgagc

SEQ ID NO: 8294703 - DNA, 22 bp, Homo sapiens
ctgaggtcagagtttagtctgg

SEQ ID NO: 8294704 - DNA, 22 bp, Homo sapiens
ctgcttggggttagggtgtcct

SEQ ID NO: 8294705 - DNA, 22 bp, Homo sapiens
atacttgaggtagcaacttaag

SEQ ID NO: 8294706 - DNA, 22 bp, Homo sapiens
atacttatgataaataattgct

SEQ ID NO: 8294707 - DNA, 18 bp, Homo sapiens
ctgtcttttttctctcca

SEQ ID NO: 8294708 - DNA, 22 bp, Homo sapiens
ctgtcttttcttctcattgatg

SEQ ID NO: 8294709 - DNA, 22 bp, Homo sapiens
ctgtcttttcatactttccctc

SEQ ID NO: 8294710 - DNA, 22 bp, Homo sapiens
ctgtcttttactatcatttact

SEQ ID NO: 8294711 - DNA, 22 bp, Homo sapiens
atatttgtcaattcactgttca

SEQ ID NO: 8294712 - DNA, 22 bp, Homo sapiens
atatttgtatttcgtgtgtgta

SEQ ID NO: 8294713 - DNA, 22 bp, Homo sapiens
atatttgtggtttttggctcct

SEQ ID NO: 8294714 - DNA, 22 bp, Homo sapiens
atatttgtcatctgccttagtt

SEQ ID NO: 8294715 - DNA, 22 bp, Homo sapiens
atatttgtggtaaaggtaagaa

SEQ ID NO: 8294716 - DNA, 21 bp, Homo sapiens
ctgtcctcagatgtggacgag

SEQ ID NO: 8294717 - DNA, 22 bp, Homo sapiens
ctgtggagatgcagaccaggcc

SEQ ID NO: 8294718 - DNA, 22 bp, Homo sapiens
ctgtggagcttgtggcagtggg

SEQ ID NO: 8294719 - DNA, 22 bp, Homo sapiens
ctgtggagtgcttggctcagtg

SEQ ID NO: 8294720 - DNA, 22 bp, Homo sapiens
atatgtgtgatgcatggactaa

SEQ ID NO: 8294721 - DNA, 22 bp, Homo sapiens
atatttgtagtgggtaagaagt

SEQ ID NO: 8294722 - DNA, 22 bp, Homo sapiens
atatttgtaaaattctgtgtct

SEQ ID NO: 8294723 - DNA, 22 bp, Homo sapiens
ctggcttctgggccagggcaga

SEQ ID NO: 8294724 - DNA, 22 bp, Homo sapiens
cactggatttccaggaatactc

SEQ ID NO: 8294725 - DNA, 22 bp, Homo sapiens
ggcacatggagacttggcatca

SEQ ID NO: 8294726 - DNA, 22 bp, Homo sapiens
ggcacagggggctgaggactag

SEQ ID NO: 8294727 - DNA, 22 bp, Homo sapiens
ggcacaaggtttaaataacatc

SEQ ID NO: 8294728 - DNA, 22 bp, Homo sapiens
cacagtgtagttaatgtgacat

SEQ ID NO: 8294729 - DNA, 22 bp, Homo sapiens
gctgctggcatctagggggtgg

SEQ ID NO: 8294730 - DNA, 19 bp, Homo sapiens
caacagtactggtttgtcc

SEQ ID NO: 8294731 - DNA, 22 bp, Homo sapiens
gctcctgcaggacccaggagac

SEQ ID NO: 8294732 - DNA, 22 bp, Homo sapiens
cacacccttgctaacacttgtt

SEQ ID NO: 8294733 - DNA, 22 bp, Homo sapiens
cacacctcagccatgtggaggc

SEQ ID NO: 8294734 - DNA, 22 bp, Homo sapiens
cacaccctcgtgctccctcccg

SEQ ID NO: 8294735 - DNA, 19 bp, Homo sapiens
cacaacttcgcttgattcc

SEQ ID NO: 8294736 - DNA, 22 bp, Homo sapiens
cagcaagggttatatcaaagat

SEQ ID NO: 8294737 - DNA, 22 bp, Homo sapiens
cagcagcactctgcgggtcccc

SEQ ID NO: 8294738 - DNA, 22 bp, Homo sapiens
cagcagcagagatactggtttc

SEQ ID NO: 8294739 - DNA, 22 bp, Homo sapiens
cagcagcagattcagcgtctgg

SEQ ID NO: 8294740 - DNA, 22 bp, Homo sapiens
cagcagcaaatctagaagagga

SEQ ID NO: 8294741 - DNA, 22 bp, Homo sapiens
cagcagcaacaacggaagcctt

SEQ ID NO: 8294742 - DNA, 22 bp, Homo sapiens
cagcagcaacaatagcggtcac

SEQ ID NO: 8294743 - DNA, 22 bp, Homo sapiens
cagcagcaaggtgagggtggag

SEQ ID NO: 8294744 - DNA, 22 bp, Homo sapiens
gtatttgtcttgttggtctcca

SEQ ID NO: 8294745 - DNA, 22 bp, Homo sapiens
gtatttgtagtagcatagaatt

SEQ ID NO: 8294746 - DNA, 18 bp, Homo sapiens
cagcattagcagcttcca

SEQ ID NO: 8294747 - DNA, 22 bp, Homo sapiens
cagccacagctgggtgcctgac

SEQ ID NO: 8294748 - DNA, 22 bp, Homo sapiens
gggaaactagaagcagggttat

SEQ ID NO: 8294749 - DNA, 22 bp, Homo sapiens
gggaaactcacaggtgcagggg

SEQ ID NO: 8294750 - DNA, 22 bp, Homo sapiens
gggaaactttcacaatgtccag

SEQ ID NO: 8294751 - DNA, 22 bp, Homo sapiens
gggaaacttctgctaaaaccag

SEQ ID NO: 8294752 - DNA, 22 bp, Homo sapiens
gggaaactgtccagttctcccc

SEQ ID NO: 8294753 - DNA, 22 bp, Homo sapiens
gggaaactcaggcatttccact

SEQ ID NO: 8294754 - DNA, 21 bp, Homo sapiens
gggaaactctgcttaacagag

SEQ ID NO: 8294755 - DNA, 22 bp, Homo sapiens
gggaaactgaattcaggactct

SEQ ID NO: 8294756 - DNA, 22 bp, Homo sapiens
gggaaactgcaactcagagagg

SEQ ID NO: 8294757 - DNA, 22 bp, Homo sapiens
gggaaactggggactgaatctg

SEQ ID NO: 8294758 - DNA, 22 bp, Homo sapiens
cactggctgagcttctctaggg

SEQ ID NO: 8294759 - DNA, 22 bp, Homo sapiens
ggggaaactgaggcacagacag

SEQ ID NO: 8294760 - DNA, 22 bp, Homo sapiens
ggggaaacatgttgttcagacc

SEQ ID NO: 8294761 - DNA, 22 bp, Homo sapiens
atggtacagataatacatgctg

SEQ ID NO: 8294762 - DNA, 22 bp, Homo sapiens
atgtgtcattatccagaataac

SEQ ID NO: 8294763 - DNA, 22 bp, Homo sapiens
gaggcctgggagcctgtcctcc

SEQ ID NO: 8294764 - DNA, 22 bp, Homo sapiens
gaggcctgggagaactgttttt

SEQ ID NO: 8294765 - DNA, 22 bp, Homo sapiens
cttgctgagataaatgctgtct

SEQ ID NO: 8294766 - DNA, 22 bp, Homo sapiens
cttggcctgacatgtggcaggg

SEQ ID NO: 8294767 - DNA, 22 bp, Homo sapiens
atgaaatatcttgaagaaattc

SEQ ID NO: 8294768 - DNA, 22 bp, Homo sapiens
atcttgatcaaggctatcatga

SEQ ID NO: 8294769 - DNA, 22 bp, Homo sapiens
atgcagcttcaggattatgatg

SEQ ID NO: 8294770 - DNA, 22 bp, Homo sapiens
atgcagctgtgggcaagaaatg

SEQ ID NO: 8294771 - DNA, 22 bp, Homo sapiens
attctcaattttgccaaagggt

SEQ ID NO: 8294772 - DNA, 22 bp, Homo sapiens
attctgtgttaggatagatggt

SEQ ID NO: 8294773 - DNA, 22 bp, Homo sapiens
gatgatattttgactggagaat

SEQ ID NO: 8294774 - DNA, 22 bp, Homo sapiens
attaaattaagtggctaattta

SEQ ID NO: 8294775 - DNA, 22 bp, Homo sapiens
attaaattagcaaactgtgaaa

SEQ ID NO: 8294776 - DNA, 22 bp, Homo sapiens
atgttttatattttgcagcagt

SEQ ID NO: 8294777 - DNA, 22 bp, Homo sapiens
atgttttatgttccactcaagg

SEQ ID NO: 8294778 - DNA, 23 bp, Homo sapiens
atgttttatgtctctagctgcca

SEQ ID NO: 8294779 - DNA, 20 bp, Homo sapiens
atgttttataaaagaacggg

SEQ ID NO: 8294780 - DNA, 22 bp, Homo sapiens
atgttttaccctttgcacaaac

SEQ ID NO: 8294781 - DNA, 22 bp, Homo sapiens
atgttttattaccaacttgtac

SEQ ID NO: 8294782 - DNA, 22 bp, Homo sapiens
atgtgtgtgtgcgcgcgcagga

SEQ ID NO: 8294783 - DNA, 22 bp, Homo sapiens
gcctggctgaggcctctgctaa

SEQ ID NO: 8294784 - DNA, 22 bp, Homo sapiens
atttattgagagggaggggaat

SEQ ID NO: 8294785 - DNA, 22 bp, Homo sapiens
atttattatgggatttggcaca

SEQ ID NO: 8294786 - DNA, 22 bp, Homo sapiens
atttagaaccccttccaacctg

SEQ ID NO: 8294787 - DNA, 22 bp, Homo sapiens
atttagaaattccaaaagtatt

SEQ ID NO: 8294788 - DNA, 22 bp, Homo sapiens
atttagaagctaatttttcaga

SEQ ID NO: 8294789 - DNA, 22 bp, Homo sapiens
atttagaactttgtttgccaat

SEQ ID NO: 8294790 - DNA, 22 bp, Homo sapiens
atttaatttatagatgtggata

SEQ ID NO: 8294791 - DNA, 22 bp, Homo sapiens
atttaatttgtgtctttagctg

SEQ ID NO: 8294792 - DNA, 22 bp, Homo sapiens
atttaattttctcaacagtgct

SEQ ID NO: 8294793 - DNA, 22 bp, Homo sapiens
atttaatttacatttgacagag

SEQ ID NO: 8294794 - DNA, 22 bp, Homo sapiens
atttaatttacatttgacagag

SEQ ID NO: 8294795 - DNA, 22 bp, Homo sapiens
catgatataaagtagtagataa

SEQ ID NO: 8294796 - DNA, 22 bp, Homo sapiens
tcatttgttgaactttagtgcg

SEQ ID NO: 8294797 - DNA, 22 bp, Homo sapiens
tcatttgttgctgttacctgag

SEQ ID NO: 8294798 - DNA, 18 bp, Homo sapiens
tcatttgttttgcatgaa

SEQ ID NO: 8294799 - DNA, 22 bp, Homo sapiens
tcatgtacatgtaagtcagaaa

SEQ ID NO: 8294800 - DNA, 22 bp, Homo sapiens
catcacaggtcctgatgacatt

SEQ ID NO: 8294801 - DNA, 22 bp, Homo sapiens
tacatgtggtagggagggcagt

SEQ ID NO: 8294802 - DNA, 22 bp, Homo sapiens
tatgtacatgttaaagggcaaa

SEQ ID NO: 8294803 - DNA, 22 bp, Homo sapiens
tatggctggaatactgaaaggc

SEQ ID NO: 8294804 - DNA, 22 bp, Homo sapiens
tatgtgtaatcaaacacatgct

SEQ ID NO: 8294805 - DNA, 22 bp, Homo sapiens
tatgtgtattgagcattgttac

SEQ ID NO: 8294806 - DNA, 22 bp, Homo sapiens
tatttagtgatagaagcaagga

SEQ ID NO: 8294807 - DNA, 22 bp, Homo sapiens
tatttagaacagacaatagaaa

SEQ ID NO: 8294808 - DNA, 22 bp, Homo sapiens
tctggcttcccactctgccggg

SEQ ID NO: 8294809 - DNA, 21 bp, Homo sapiens
tctgtcttcctcagcctaagg

SEQ ID NO: 8294810 - DNA, 22 bp, Homo sapiens
tctgtcttggccagccatctgg

SEQ ID NO: 8294811 - DNA, 22 bp, Homo sapiens
tctgtcttagccatctcaggct

SEQ ID NO: 8294812 - DNA, 22 bp, Homo sapiens
ccagcctttgcatcccccatct

SEQ ID NO: 8294813 - DNA, 22 bp, Homo sapiens
ccagctctaaacggctctgtgg

SEQ ID NO: 8294814 - DNA, 22 bp, Homo sapiens
tctcttgtaatttaaaaaatct

SEQ ID NO: 8294815 - DNA, 22 bp, Homo sapiens
catttagagaagattacaagga

SEQ ID NO: 8294816 - DNA, 22 bp, Homo sapiens
catttgcagagggtgacactct

SEQ ID NO: 8294817 - DNA, 22 bp, Homo sapiens
ccaaagtgatatgtgctgtaag

SEQ ID NO: 8294818 - DNA, 23 bp, Homo sapiens
tcctgccagatgactcctttctt

SEQ ID NO: 8294819 - DNA, 22 bp, Homo sapiens
cagcttcattgcctgatgtctt

SEQ ID NO: 8294820 - DNA, 22 bp, Homo sapiens
cagcttcagcgtgacaccagtg

SEQ ID NO: 8294821 - DNA, 22 bp, Homo sapiens
cagcttcaactgcacagtcaac

SEQ ID NO: 8294822 - DNA, 22 bp, Homo sapiens
gtgttttattggtgcagtcaga

SEQ ID NO: 8294823 - DNA, 22 bp, Homo sapiens
gttcctgatgctttgaaattca

SEQ ID NO: 8294824 - DNA, 22 bp, Homo sapiens
gttgctgaaagccctgactggc

SEQ ID NO: 8294825 - DNA, 22 bp, Homo sapiens
gttgctgaaattaatattggag

SEQ ID NO: 8294826 - DNA, 22 bp, Homo sapiens
gttgctgattaacactttgagt

SEQ ID NO: 8294827 - DNA, 22 bp, Homo sapiens
gttgctgatggcaagattccag

SEQ ID NO: 8294828 - DNA, 22 bp, Homo sapiens
gttgctgaaggcatgccagaga

SEQ ID NO: 8294829 - DNA, 22 bp, Homo sapiens
gtttattattcaacttcatgtt

SEQ ID NO: 8294830 - DNA, 22 bp, Homo sapiens
gtgtacatattgagtctgctga

SEQ ID NO: 8294831 - DNA, 22 bp, Homo sapiens
gtgtacatagaattgtgctttg

SEQ ID NO: 8294832 - DNA, 22 bp, Homo sapiens
gtgtacaggatgactgtactta

SEQ ID NO: 8294833 - DNA, 22 bp, Homo sapiens
gtgtacagtaagtgaatctagg

SEQ ID NO: 8294834 - DNA, 22 bp, Homo sapiens
taaaatgacttcctccaacatc

SEQ ID NO: 8294835 - DNA, 22 bp, Homo sapiens
caggacactacagatgggaggg

SEQ ID NO: 8294836 - DNA, 22 bp, Homo sapiens
caggacacagaataaggcagtt

SEQ ID NO: 8294837 - DNA, 22 bp, Homo sapiens
caggcacaaatttctagataag

SEQ ID NO: 8294838 - DNA, 22 bp, Homo sapiens
caggcacaagaagcaaatgtta

SEQ ID NO: 8294839 - DNA, 22 bp, Homo sapiens
caggcacactgtctacactgag

SEQ ID NO: 8294840 - DNA, 22 bp, Homo sapiens
tacaaatgagttgtatgaacca

SEQ ID NO: 8294841 - DNA, 22 bp, Homo sapiens
tacagggtataggtacagatga

SEQ ID NO: 8294842 - DNA, 22 bp, Homo sapiens
tgctgaataagacgtggcttgt

SEQ ID NO: 8294843 - DNA, 22 bp, Homo sapiens
tgctgaataaataaagtctatt

SEQ ID NO: 8294844 - DNA, 22 bp, Homo sapiens
tgctgaataaagatatattttc

SEQ ID NO: 8294845 - DNA, 22 bp, Homo sapiens
tgctgaatgaatggatggttgc

SEQ ID NO: 8294846 - DNA, 21 bp, Homo sapiens
tgctgaatctgccatattttc

SEQ ID NO: 8294847 - DNA, 22 bp, Homo sapiens
tgctgaatcccaccctccagtg

SEQ ID NO: 8294848 - DNA, 22 bp, Homo sapiens
tgctgaatatagagcaagaagt

SEQ ID NO: 8294849 - DNA, 22 bp, Homo sapiens
tgctgaataataagattactca

SEQ ID NO: 8294850 - DNA, 22 bp, Homo sapiens
tgctgaatcaaaacaaaggttt

SEQ ID NO: 8294851 - DNA, 22 bp, Homo sapiens
tgctgaatcatatggtaattct

SEQ ID NO: 8294852 - DNA, 22 bp, Homo sapiens
tgctgaatttacatttttgtag

SEQ ID NO: 8294853 - DNA, 22 bp, Homo sapiens
tgctgaattctcattccctgga

SEQ ID NO: 8294854 - DNA, 22 bp, Homo sapiens
tgctgaattggtagtactgttg

SEQ ID NO: 8294855 - DNA, 22 bp, Homo sapiens
tgctgaatgggatatgttgagc

SEQ ID NO: 8294856 - DNA, 22 bp, Homo sapiens
tgctgaatgctgcatgccgtat

SEQ ID NO: 8294857 - DNA, 22 bp, Homo sapiens
tgctgaatgggtgattttggag

SEQ ID NO: 8294858 - DNA, 22 bp, Homo sapiens
tgctgaatggtaaagaagtata

SEQ ID NO: 8294859 - DNA, 22 bp, Homo sapiens
tgctgaattaaactctatgtgg

SEQ ID NO: 8294860 - DNA, 22 bp, Homo sapiens
tgctgaatgtgctcccttttaa

SEQ ID NO: 8294861 - DNA, 22 bp, Homo sapiens
tgctgaattctaccatccattt

SEQ ID NO: 8294862 - DNA, 22 bp, Homo sapiens
tgctgaattccagggccccact

SEQ ID NO: 8294863 - DNA, 22 bp, Homo sapiens
tgcctgggatctgtgccctttg

SEQ ID NO: 8294864 - DNA, 20 bp, Homo sapiens
tgcattaagtggcattgagc

SEQ ID NO: 8294865 - DNA, 22 bp, Homo sapiens
tgcattaaaatgtgcctctctt

SEQ ID NO: 8294866 - DNA, 22 bp, Homo sapiens
tgcattaaaaccatcgaccatc

SEQ ID NO: 8294867 - DNA, 22 bp, Homo sapiens
cccagcctactctgccatagca

SEQ ID NO: 8294868 - DNA, 22 bp, Homo sapiens
cccagcctttgcttcctggttc

SEQ ID NO: 8294869 - DNA, 22 bp, Homo sapiens
cccagccttccaccctggacta

SEQ ID NO: 8294870 - DNA, 22 bp, Homo sapiens
cccagcctgtctttcccaatga

SEQ ID NO: 8294871 - DNA, 22 bp, Homo sapiens
cccagcctgtgacagccgtcct

SEQ ID NO: 8294872 - DNA, 17 bp, Homo sapiens
ccctggctctaggtgga

SEQ ID NO: 8294873 - DNA, 22 bp, Homo sapiens
ccctggctctgcctcagagccc

SEQ ID NO: 8294874 - DNA, 22 bp, Homo sapiens
ccctggctctgcctcagagccc

SEQ ID NO: 8294875 - DNA, 22 bp, Homo sapiens
ccctggctcttcaccacctgcc

SEQ ID NO: 8294876 - DNA, 22 bp, Homo sapiens
ccctggctcttcaccacctgcc

SEQ ID NO: 8294877 - DNA, 18 bp, Homo sapiens
cctcggagcctccgtgtc

SEQ ID NO: 8294878 - DNA, 22 bp, Homo sapiens
cctcggagaaaggcagctccac

SEQ ID NO: 8294879 - DNA, 22 bp, Homo sapiens
tggccctgctgggtcagagctg

SEQ ID NO: 8294880 - DNA, 22 bp, Homo sapiens
tggctgcctagtgtctgagcag

SEQ ID NO: 8294881 - DNA, 21 bp, Homo sapiens
tggctgcctggctctgtggtt

SEQ ID NO: 8294882 - DNA, 22 bp, Homo sapiens
cctctgggtgggaggccgggcg

SEQ ID NO: 8294883 - DNA, 22 bp, Homo sapiens
cctctggggtgagtgggccact

SEQ ID NO: 8294884 - DNA, 22 bp, Homo sapiens
cctctgggggtcctcagagtct

SEQ ID NO: 8294885 - DNA, 22 bp, Homo sapiens
cctgggcctggcgggtcggctc

SEQ ID NO: 8294886 - DNA, 22 bp, Homo sapiens
cctgggccttgacctcgtgggc

SEQ ID NO: 8294887 - DNA, 22 bp, Homo sapiens
cctgggtcttcagtctgctggt

SEQ ID NO: 8294888 - DNA, 22 bp, Homo sapiens
cctgggcctcacccagctcttg

SEQ ID NO: 8294889 - DNA, 22 bp, Homo sapiens
cctgggccaggcttgggaatgc

SEQ ID NO: 8294890 - DNA, 22 bp, Homo sapiens
tgtctttagaaagaagcagaca

SEQ ID NO: 8294891 - DNA, 22 bp, Homo sapiens
tgtctttacttagaagttcagg

SEQ ID NO: 8294892 - DNA, 22 bp, Homo sapiens
cctggctgagggacctcgggta

SEQ ID NO: 8294893 - DNA, 21 bp, Homo sapiens
cctgggagatcagctgccttc

SEQ ID NO: 8294894 - DNA, 22 bp, Homo sapiens
cctggcttccatatggcacata

SEQ ID NO: 8294895 - DNA, 22 bp, Homo sapiens
tgtattagagcatataatttga

SEQ ID NO: 8294896 - DNA, 22 bp, Homo sapiens
tgtaccactctactaagggttc

SEQ ID NO: 8294897 - DNA, 23 bp, Homo sapiens
tgtaccaggagtttcagcagact

SEQ ID NO: 8294898 - DNA, 22 bp, Homo sapiens
tgtaaagaaatagcatttgtag

SEQ ID NO: 8294899 - DNA, 22 bp, Homo sapiens
cctggactcaggctgtgggcac

SEQ ID NO: 8294900 - DNA, 22 bp, Homo sapiens
tgtcctggacaacagcccctag

SEQ ID NO: 8294901 - DNA, 22 bp, Homo sapiens
tgtcctggaaaaatggagagtt

SEQ ID NO: 8294902 - DNA, 22 bp, Homo sapiens
tgtcctggagttataatgcctg

SEQ ID NO: 8294903 - DNA, 22 bp, Homo sapiens
tgtcctggatcatgcctctgaa

SEQ ID NO: 8294904 - DNA, 22 bp, Homo sapiens
tgtcctggagtgcttgggggaa

SEQ ID NO: 8294905 - DNA, 22 bp, Homo sapiens
tgtcctggagacacaaggtggt

SEQ ID NO: 8294906 - DNA, 22 bp, Homo sapiens
cctggctccaaagctgtgactc

SEQ ID NO: 8294907 - DNA, 22 bp, Homo sapiens
cctggctccctgcacagggctc

SEQ ID NO: 8294908 - DNA, 22 bp, Homo sapiens
cctggctcgctgacctcagggg

SEQ ID NO: 8294909 - DNA, 22 bp, Homo sapiens
tgtcctccagcagcatggtatg

SEQ ID NO: 8294910 - DNA, 22 bp, Homo sapiens
ctggcctggagcctctgggtgg

SEQ ID NO: 8294911 - DNA, 22 bp, Homo sapiens
ctggctcctgaggcttggcccc

SEQ ID NO: 8294912 - DNA, 22 bp, Homo sapiens
ctggctccactccctgcctgac

SEQ ID NO: 8294913 - DNA, 22 bp, Homo sapiens
ctggctccctctccctgagtca

SEQ ID NO: 8294914 - DNA, 22 bp, Homo sapiens
ctggctcctcaggactgcggga

SEQ ID NO: 8294915 - DNA, 22 bp, Homo sapiens
ctggctccctggacatggggcc

SEQ ID NO: 8294916 - DNA, 22 bp, Homo sapiens
ctggcctggcgcagtggctcac

SEQ ID NO: 8294917 - DNA, 22 bp, Homo sapiens
ctgatgatagtgatttattgag

SEQ ID NO: 8294918 - DNA, 22 bp, Homo sapiens
ctgccctgggttttatgggagt

SEQ ID NO: 8294919 - DNA, 22 bp, Homo sapiens
ctgccctggggggcctccttgc

SEQ ID NO: 8294920 - DNA, 22 bp, Homo sapiens
ctgccctgggtgctggggatcc

SEQ ID NO: 8294921 - DNA, 22 bp, Homo sapiens
tttgtgaataagagaatgacag

SEQ ID NO: 8294922 - DNA, 19 bp, Homo sapiens
tttgtgaagaaaatgatgc

SEQ ID NO: 8294923 - DNA, 22 bp, Homo sapiens
tttgtgaagggaacagaagtgt

SEQ ID NO: 8294924 - DNA, 22 bp, Homo sapiens
tttgtgaacactgcgcagaact

SEQ ID NO: 8294925 - DNA, 22 bp, Homo sapiens
tttgtgaacaaacatgaagatg

SEQ ID NO: 8294926 - DNA, 22 bp, Homo sapiens
tttgtgaaatgaagtcacaact

SEQ ID NO: 8294927 - DNA, 23 bp, Homo sapiens
tttgtgaaagtgttgagaggaga

SEQ ID NO: 8294928 - DNA, 22 bp, Homo sapiens
ctctggctgtttgcagctcaag

SEQ ID NO: 8294929 - DNA, 22 bp, Homo sapiens
ctctggctggcacctgatctga

SEQ ID NO: 8294930 - DNA, 22 bp, Homo sapiens
ctctggctgcctctcaggcctg

SEQ ID NO: 8294931 - DNA, 22 bp, Homo sapiens
tttgtgaatggaatccacagac

SEQ ID NO: 8294932 - DNA, 22 bp, Homo sapiens
tttgtgaattcttggaagattg

SEQ ID NO: 8294933 - DNA, 22 bp, Homo sapiens
tttgtgacttgcttctcagaat

SEQ ID NO: 8294934 - DNA, 22 bp, Homo sapiens
tttgtgaataggttggcttcca

SEQ ID NO: 8294935 - DNA, 22 bp, Homo sapiens
ttttattatctttgaatgggac

SEQ ID NO: 8294936 - DNA, 22 bp, Homo sapiens
ctctgggctccttcagcccttt

SEQ ID NO: 8294937 - DNA, 22 bp, Homo sapiens
ctctgggcaggacgccaggcct

SEQ ID NO: 8294938 - DNA, 22 bp, Homo sapiens
ctatttgtacagcattagtaat

SEQ ID NO: 8294939 - DNA, 22 bp, Homo sapiens
ctatttgtaaagtgcctggtgt

SEQ ID NO: 8294940 - DNA, 22 bp, Homo sapiens
ctatttgtaagagccccacacc

SEQ ID NO: 8294941 - DNA, 22 bp, Homo sapiens
ctatttgtacagcattcgagtt

SEQ ID NO: 8294942 - DNA, 22 bp, Homo sapiens
ctatttgtcacaactggtgttt

SEQ ID NO: 8294943 - DNA, 22 bp, Homo sapiens
ctatttgtcagtttggctttaa

SEQ ID NO: 8294944 - DNA, 22 bp, Homo sapiens
ctaggctgtaaagagctaggag

SEQ ID NO: 8294945 - DNA, 22 bp, Homo sapiens
ctcagcaccccgacaggacatt

SEQ ID NO: 8294946 - DNA, 19 bp, Homo sapiens
ctcagcacttttacacagg

SEQ ID NO: 8294947 - DNA, 22 bp, Homo sapiens
ctcagcactttggaaggctgat

SEQ ID NO: 8294948 - DNA, 22 bp, Homo sapiens
ctcagcactgacccaggagatg

SEQ ID NO: 8294949 - DNA, 21 bp, Homo sapiens
cggaaactcggctctggttcc

SEQ ID NO: 8294950 - DNA, 22 bp, Homo sapiens
ctaattgtaagctccttgaggg

SEQ ID NO: 8294951 - DNA, 21 bp, Homo sapiens
ttcccttctggttttgagaga

SEQ ID NO: 8294952 - DNA, 22 bp, Homo sapiens
ttcccttctagttttgagagac

SEQ ID NO: 8294953 - DNA, 22 bp, Homo sapiens
tttaaatttagaagaaacactg

SEQ ID NO: 8294954 - DNA, 22 bp, Homo sapiens
tttaaattctgtctgccgctta

SEQ ID NO: 8294955 - DNA, 22 bp, Homo sapiens
tttaaatttgtgtttagagggt

SEQ ID NO: 8294956 - DNA, 22 bp, Homo sapiens
tttaaaaaactagtctgagtct

SEQ ID NO: 8294957 - DNA, 17 bp, Homo sapiens
tttagaatacaatgttt

SEQ ID NO: 8294958 - DNA, 22 bp, Homo sapiens
ctcctctggaaattcctctgcc

SEQ ID NO: 8294959 - DNA, 22 bp, Homo sapiens
ttgtatttgggtagtatagaga

SEQ ID NO: 8294960 - DNA, 22 bp, Homo sapiens
ttgatattctgagaagctgaag

SEQ ID NO: 8294961 - DNA, 22 bp, Homo sapiens
ttgatattagagtatttgtttg

SEQ ID NO: 8294962 - DNA, 22 bp, Homo sapiens
gccttagcatcttaaagctgtg

SEQ ID NO: 8294963 - DNA, 22 bp, Homo sapiens
gccttaattgcagagcaatata

SEQ ID NO: 8294964 - DNA, 22 bp, Homo sapiens
gctcctggcaggcagtgtgtgt

SEQ ID NO: 8294965 - DNA, 22 bp, Homo sapiens
gctcctggctctggccaaggga

SEQ ID NO: 8294966 - DNA, 21 bp, Homo sapiens
gctgaagaactctttattttc

SEQ ID NO: 8294967 - DNA, 22 bp, Homo sapiens
gctgcctgctcacccggcctgg

SEQ ID NO: 8294968 - DNA, 22 bp, Homo sapiens
gctgcctggagctcagcctgcc

SEQ ID NO: 8294969 - DNA, 22 bp, Homo sapiens
gctgcctggtttctcagctgca

SEQ ID NO: 8294970 - DNA, 22 bp, Homo sapiens
gctgctctgggtctgcccagct

SEQ ID NO: 8294971 - DNA, 22 bp, Homo sapiens
gccgttagataataacaagcat

SEQ ID NO: 8294972 - DNA, 19 bp, Homo sapiens
gccctcaggcagctccatc

SEQ ID NO: 8294973 - DNA, 22 bp, Homo sapiens
gcccttataaacaaggcttcag

SEQ ID NO: 8294974 - DNA, 22 bp, Homo sapiens
gcccttaggtactacttattct

SEQ ID NO: 8294975 - DNA, 22 bp, Homo sapiens
gcccttagtcagcactttcact

SEQ ID NO: 8294976 - DNA, 22 bp, Homo sapiens
gcccttagccttatagcctcta

SEQ ID NO: 8294977 - DNA, 22 bp, Homo sapiens
gcccttagggccactgtcactg

SEQ ID NO: 8294978 - DNA, 22 bp, Homo sapiens
gcccttaggcaagcagaagccc

SEQ ID NO: 8294979 - DNA, 22 bp, Homo sapiens
gcctgtggccactgcgtctgca

SEQ ID NO: 8294980 - DNA, 22 bp, Homo sapiens
gcctgtggccgactgagagcct

SEQ ID NO: 8294981 - DNA, 22 bp, Homo sapiens
gcctggcttttgcctcatgttc

SEQ ID NO: 8294982 - DNA, 22 bp, Homo sapiens
gcctgcctttgtatgaccctga

SEQ ID NO: 8294983 - DNA, 23 bp, Homo sapiens
gcctctggagccccagtgctcag

SEQ ID NO: 8294984 - DNA, 22 bp, Homo sapiens
gcatgtgtctccccagtggagg

SEQ ID NO: 8294985 - DNA, 22 bp, Homo sapiens
gattcaagacctagctcagcca

SEQ ID NO: 8294986 - DNA, 22 bp, Homo sapiens
gattagctctagatctgggcta

SEQ ID NO: 8294987 - DNA, 22 bp, Homo sapiens
gcacaaggagcagtgtatgaaa

SEQ ID NO: 8294988 - DNA, 22 bp, Homo sapiens
gcaaacatgttgtgagatacca

SEQ ID NO: 8294989 - DNA, 22 bp, Homo sapiens
gatttgtgctcattttccatta

SEQ ID NO: 8294990 - DNA, 22 bp, Homo sapiens
gatttgtggtgtgaggaagagc

SEQ ID NO: 8294991 - DNA, 22 bp, Homo sapiens
ctttgtgatagtgttaagacca

SEQ ID NO: 8294992 - DNA, 22 bp, Homo sapiens
ctttgtgatgaggcctaagaca

SEQ ID NO: 8294993 - DNA, 22 bp, Homo sapiens
gaaataacctcatgcaccatga

SEQ ID NO: 8294994 - DNA, 22 bp, Homo sapiens
gaaataacagctctggaagagt

SEQ ID NO: 8294995 - DNA, 22 bp, Homo sapiens
gaactccagatgactcaggaac

SEQ ID NO: 8294996 - DNA, 22 bp, Homo sapiens
ctggctggttccctgctccagg

SEQ ID NO: 8294997 - DNA, 22 bp, Homo sapiens
ctttagaatttgatataatcaa

SEQ ID NO: 8294998 - DNA, 22 bp, Homo sapiens
ctttagaatttcatgtttggtc

SEQ ID NO: 8294999 - DNA, 22 bp, Homo sapiens
ctttagaagggtaacggaatta

SEQ ID NO: 8295000 - DNA, 20 bp, Homo sapiens
ctttagaagaacccaagcat

SEQ ID NO: 8295001 - DNA, 22 bp, Homo sapiens
gaattacatgaccctgagtaga

SEQ ID NO: 8295002 - DNA, 22 bp, Homo sapiens
gacacagagataggcctgtgtt

SEQ ID NO: 8295003 - DNA, 22 bp, Homo sapiens
gacacagatgatcaggtgtgga

SEQ ID NO: 8295004 - DNA, 22 bp, Homo sapiens
gaactgtagttaatactacaca

SEQ ID NO: 8295005 - DNA, 22 bp, Homo sapiens
gagacacacccaaggttatgag

SEQ ID NO: 8295006 - DNA, 22 bp, Homo sapiens
gagacacacacaggaggtggca

SEQ ID NO: 8295007 - DNA, 22 bp, Homo sapiens
gagacacaatctcatttacatt

SEQ ID NO: 8295008 - DNA, 22 bp, Homo sapiens
gagacacagcagatattcaatc

SEQ ID NO: 8295009 - DNA, 22 bp, Homo sapiens
gagacacagttatcaggcatac

SEQ ID NO: 8295010 - DNA, 22 bp, Homo sapiens
gactgtggggaagcagatgcca

SEQ ID NO: 8295011 - DNA, 22 bp, Homo sapiens
gatcttgagcaagttgtgtaac

SEQ ID NO: 8295012 - DNA, 22 bp, Homo sapiens
gatcttgagcaagttgcatccc

SEQ ID NO: 8295013 - DNA, 22 bp, Homo sapiens
gatcttgaaatatcttttccta

SEQ ID NO: 8295014 - DNA, 22 bp, Homo sapiens
gataagctaacccaagcccttt

SEQ ID NO: 8295015 - DNA, 22 bp, Homo sapiens
gatattttcagtctcctttcaa

SEQ ID NO: 8295016 - DNA, 22 bp, Homo sapiens
gatattttcgcagggagaattc

SEQ ID NO: 8295017 - DNA, 22 bp, Homo sapiens
gatattttcattcggatgctca

SEQ ID NO: 8295018 - DNA, 22 bp, Homo sapiens
gatatttttaggtgatgcaggc

SEQ ID NO: 8295019 - DNA, 22 bp, Homo sapiens
gatattttgagaaatcctatga

SEQ ID NO: 8295020 - DNA, 22 bp, Homo sapiens
gatatttttagtatttctgcct

SEQ ID NO: 8295021 - DNA, 22 bp, Homo sapiens
gatatttttgcagacacctggg

SEQ ID NO: 8295022 - DNA, 22 bp, Homo sapiens
gatcacatgaatggaatagaag

SEQ ID NO: 8295023 - DNA, 22 bp, Homo sapiens
gagtgggtaaaggtgcttggct

SEQ ID NO: 8295024 - DNA, 22 bp, Homo sapiens
gagtcacattaatttaatttta

SEQ ID NO: 8295025 - DNA, 22 bp, Homo sapiens
gagtcacaaagcctttcttatt

SEQ ID NO: 8295026 - DNA, 22 bp, Homo sapiens
gaggcctgctttggcactctgg

SEQ ID NO: 8295027 - DNA, 22 bp, Homo sapiens
gagggcagtagcctcgtaccct

SEQ ID NO: 8295028 - DNA, 22 bp, Homo sapiens
gcttagcatcttacaatgctga

SEQ ID NO: 8295029 - DNA, 20 bp, Homo sapiens
gcttagcaggcatagtagct

SEQ ID NO: 8295030 - DNA, 22 bp, Homo sapiens
gcttagcaatgtgacaagatgc

SEQ ID NO: 8295031 - DNA, 22 bp, Homo sapiens
gctgggctccaggccagggtga

SEQ ID NO: 8295032 - DNA, 22 bp, Homo sapiens
gcttcagagatttcactagttt

SEQ ID NO: 8295033 - DNA, 21 bp, Homo sapiens
gcttcagcaaggcttgctggt

SEQ ID NO: 8295034 - DNA, 22 bp, Homo sapiens
gcttcagcccatcccagtacat

SEQ ID NO: 8295035 - DNA, 22 bp, Homo sapiens
gcttcagccgggcacttaatga

SEQ ID NO: 8295036 - DNA, 22 bp, Homo sapiens
gcttcagctttgtctccttggg

SEQ ID NO: 8295037 - DNA, 22 bp, Homo sapiens
gcttcagcctcacactgatatc

SEQ ID NO: 8295038 - DNA, 22 bp, Homo sapiens
gcttcatgaaaatcactggtca

SEQ ID NO: 8295039 - DNA, 23 bp, Homo sapiens
gcttctagtcaatttcaccagga

SEQ ID NO: 8295040 - DNA, 22 bp, Homo sapiens
ggaactcctgctccaagcagct

SEQ ID NO: 8295041 - DNA, 22 bp, Homo sapiens
ggaaactaaagaggtgtttttg

SEQ ID NO: 8295042 - DNA, 22 bp, Homo sapiens
ggaaacttggcataattttaag

SEQ ID NO: 8295043 - DNA, 22 bp, Homo sapiens
ggaaacttgttattgtattttc

SEQ ID NO: 8295044 - DNA, 22 bp, Homo sapiens
ggaaacttggatgccagcactc

SEQ ID NO: 8295045 - DNA, 22 bp, Homo sapiens
ggagctgcacgctctgaagcct

SEQ ID NO: 8295046 - DNA, 22 bp, Homo sapiens
ggcacacagatggagcactagc

SEQ ID NO: 8295047 - DNA, 22 bp, Homo sapiens
ggctcctggggaggtgagcttg

SEQ ID NO: 8295048 - DNA, 23 bp, Homo sapiens
ggctcctggattcaaatcctgcc

SEQ ID NO: 8295049 - DNA, 22 bp, Homo sapiens
ggctcctggaggcaccactggt

SEQ ID NO: 8295050 - DNA, 22 bp, Homo sapiens
ggctgctctccatcccaggcct

SEQ ID NO: 8295051 - DNA, 22 bp, Homo sapiens
ggctgccttcatagaccatggg

SEQ ID NO: 8295052 - DNA, 19 bp, Homo sapiens
gggaaattcacttgcttcc

SEQ ID NO: 8295053 - DNA, 22 bp, Homo sapiens
ggcttcagtgagctgagctcac

SEQ ID NO: 8295054 - DNA, 22 bp, Homo sapiens
ggcttcaggggcccagtcagca

SEQ ID NO: 8295055 - DNA, 22 bp, Homo sapiens
ggctgtgtggccgtgggctcta

SEQ ID NO: 8295056 - DNA, 22 bp, Homo sapiens
ggccctgagctgaagtactgtg

SEQ ID NO: 8295057 - DNA, 22 bp, Homo sapiens
ggctcctgccgtcttttctgag

SEQ ID NO: 8295058 - DNA, 22 bp, Homo sapiens
gggcctggtgcttctgactcct

SEQ ID NO: 8295059 - DNA, 22 bp, Homo sapiens
gggcctgtatgggtctcagata

SEQ ID NO: 8295060 - DNA, 22 bp, Homo sapiens
gggtctgcctgctgtgaagtca

SEQ ID NO: 8295061 - DNA, 22 bp, Homo sapiens
taaagcaggccacatatgtgat

SEQ ID NO: 8295062 - DNA, 22 bp, Homo sapiens
taaatgacattcttaagtcttg

SEQ ID NO: 8295063 - DNA, 22 bp, Homo sapiens
gttgttgatcacatgcatatct

SEQ ID NO: 8295064 - DNA, 22 bp, Homo sapiens
gttgtgaatagtgccgcaataa

SEQ ID NO: 8295065 - DNA, 22 bp, Homo sapiens
gtgtgcagggggccagcgcagc

SEQ ID NO: 8295066 - DNA, 22 bp, Homo sapiens
gtgtgcaggcttgaggattagg

SEQ ID NO: 8295067 - DNA, 22 bp, Homo sapiens
gtgtgcaggccacaggccaggg

SEQ ID NO: 8295068 - DNA, 22 bp, Homo sapiens
gtgtgcagaagacacaagacat

SEQ ID NO: 8295069 - DNA, 22 bp, Homo sapiens
gtgtgcagcagagacaggactc

SEQ ID NO: 8295070 - DNA, 22 bp, Homo sapiens
gtgtgtcagagctcagagaagt

SEQ ID NO: 8295071 - DNA, 22 bp, Homo sapiens
gtgtcctgtttccctgtctata

SEQ ID NO: 8295072 - DNA, 22 bp, Homo sapiens
gtgtcctggttccttgtggctg

SEQ ID NO: 8295073 - DNA, 22 bp, Homo sapiens
gtgtcctgggggacttcaggtt

SEQ ID NO: 8295074 - DNA, 22 bp, Homo sapiens
gtgtcctgggtctctgattctt

SEQ ID NO: 8295075 - DNA, 18 bp, Homo sapiens
gtgtcctggctgcggcgc

SEQ ID NO: 8295076 - DNA, 22 bp, Homo sapiens
gtgtcctgggcattaggcttag

SEQ ID NO: 8295077 - DNA, 22 bp, Homo sapiens
gtgtcctgccaccctgggcttt

SEQ ID NO: 8295078 - DNA, 22 bp, Homo sapiens
gtgtcctgccaccctgggcttt

SEQ ID NO: 8295079 - DNA, 22 bp, Homo sapiens
gtgtcctgcattggctctgccc

SEQ ID NO: 8295080 - DNA, 22 bp, Homo sapiens
gtgtcctgatcaattgagctgg

SEQ ID NO: 8295081 - DNA, 22 bp, Homo sapiens
gtgtacaaaatgtctccatgga

SEQ ID NO: 8295082 - DNA, 19 bp, Homo sapiens
gtgtacagctcagtgaatt

SEQ ID NO: 8295083 - DNA, 22 bp, Homo sapiens
gtgtcaataaatagcggtgtgg

SEQ ID NO: 8295084 - DNA, 22 bp, Homo sapiens
gtggggagcagccttagcccct

SEQ ID NO: 8295085 - DNA, 22 bp, Homo sapiens
gtgggctggaccctcctgctcc

SEQ ID NO: 8295086 - DNA, 22 bp, Homo sapiens
gtgggctgcccttgaggtcagc

SEQ ID NO: 8295087 - DNA, 22 bp, Homo sapiens
gtaaataactggtaattggggt

SEQ ID NO: 8295088 - DNA, 22 bp, Homo sapiens
gtacagagaaggttacatatga

SEQ ID NO: 8295089 - DNA, 22 bp, Homo sapiens
gtcctggtagggctctgtgtct

SEQ ID NO: 8295090 - DNA, 22 bp, Homo sapiens
gtcctgtgtgagtgcaccacct

SEQ ID NO: 8295091 - DNA, 22 bp, Homo sapiens
gtccatctgtaggagggacaca

SEQ ID NO: 8295092 - DNA, 22 bp, Homo sapiens
gtctgggctcccagggtcggcg

SEQ ID NO: 8295093 - DNA, 22 bp, Homo sapiens
gtctgggcaagggagatggcgc

SEQ ID NO: 8295094 - DNA, 22 bp, Homo sapiens
gtctggcttttgccctgtgttt

SEQ ID NO: 8295095 - DNA, 22 bp, Homo sapiens
gtctggctttgctcagatgctg

SEQ ID NO: 8295096 - DNA, 22 bp, Homo sapiens
gtctggctttatatttgctatt

SEQ ID NO: 8295097 - DNA, 22 bp, Homo sapiens
gtctgggcacctggcctgggaa

SEQ ID NO: 8295098 - DNA, 22 bp, Homo sapiens
gtctggctagagacaccctccc

SEQ ID NO: 8295099 - DNA, 22 bp, Homo sapiens
gtctggctgtccagcttatcta

SEQ ID NO: 8295100 - DNA, 22 bp, Homo sapiens
gtccttggctgggcttgcctcg

SEQ ID NO: 8295101 - DNA, 22 bp, Homo sapiens
gtggctctcgccagcctgcggg

SEQ ID NO: 8295102 - DNA, 22 bp, Homo sapiens
gtggctctgtaaaatgcctgca

SEQ ID NO: 8295103 - DNA, 21 bp, Homo sapiens
gtggctctgccaggactgaaa

SEQ ID NO: 8295104 - DNA, 22 bp, Homo sapiens
gtgctacagactgagtacactt

SEQ ID NO: 8295105 - DNA, 22 bp, Homo sapiens
gtgcctggaatgcgcctcggcg

SEQ ID NO: 8295106 - DNA, 22 bp, Homo sapiens
gtgacagatttgctgcgcatgg

SEQ ID NO: 8295107 - DNA, 22 bp, Homo sapiens
gtggcacagagatggggcatga

SEQ ID NO: 8295108 - DNA, 22 bp, Homo sapiens
gtggcacagggttgttggtcat

SEQ ID NO: 8295109 - DNA, 22 bp, Homo sapiens
tctgacccgtggctctgcctcc

SEQ ID NO: 8295110 - DNA, 22 bp, Homo sapiens
tctgattagagcattcttgagt

SEQ ID NO: 8295111 - DNA, 21 bp, Homo sapiens
tctgatggtagatgagatgtg

SEQ ID NO: 8295112 - DNA, 22 bp, Homo sapiens
tctgcccactgctctgctgccc

SEQ ID NO: 8295113 - DNA, 22 bp, Homo sapiens
tctgctgacatttatgaataga

SEQ ID NO: 8295114 - DNA, 22 bp, Homo sapiens
tctgggccaacccttccatggg

SEQ ID NO: 8295115 - DNA, 22 bp, Homo sapiens
tctgggccagtgatttttccag

SEQ ID NO: 8295116 - DNA, 22 bp, Homo sapiens
tctgggccagatctagggatct

SEQ ID NO: 8295117 - DNA, 23 bp, Homo sapiens
tctgggccacttgtctgcacttc

SEQ ID NO: 8295118 - DNA, 22 bp, Homo sapiens
tctgggccctaaaccagctcta

SEQ ID NO: 8295119 - DNA, 22 bp, Homo sapiens
tctgggcccactcaacttcact

SEQ ID NO: 8295120 - DNA, 21 bp, Homo sapiens
tctgggcccatgctgcctcac

SEQ ID NO: 8295121 - DNA, 22 bp, Homo sapiens
tctgggctcttagtgtaccctc

SEQ ID NO: 8295122 - DNA, 22 bp, Homo sapiens
tctggctgtcattggaggcccc

SEQ ID NO: 8295123 - DNA, 22 bp, Homo sapiens
tctggctgggaagggggcccga

SEQ ID NO: 8295124 - DNA, 22 bp, Homo sapiens
tctggctgctgcgtgagtgctt

SEQ ID NO: 8295125 - DNA, 22 bp, Homo sapiens
tctggctgattccctgggactg

SEQ ID NO: 8295126 - DNA, 22 bp, Homo sapiens
tctggctgcgtggcctttagca

SEQ ID NO: 8295127 - DNA, 19 bp, Homo sapiens
tctggctgccaaggattga

SEQ ID NO: 8295128 - DNA, 22 bp, Homo sapiens
tctgtacagtaccagatagtaa

SEQ ID NO: 8295129 - DNA, 22 bp, Homo sapiens
tctgggtgccctttgctctgtt

SEQ ID NO: 8295130 - DNA, 22 bp, Homo sapiens
tctgggcttggttagggctgtt

SEQ ID NO: 8295131 - DNA, 22 bp, Homo sapiens
tctgggctttacactgtgctta

SEQ ID NO: 8295132 - DNA, 20 bp, Homo sapiens
tctgggcttcccccagctcc

SEQ ID NO: 8295133 - DNA, 22 bp, Homo sapiens
tctgggcttggattggctctgc

SEQ ID NO: 8295134 - DNA, 22 bp, Homo sapiens
tctgggcttggattggctctgc

SEQ ID NO: 8295135 - DNA, 22 bp, Homo sapiens
tctgggctgggagcgtgtggac

SEQ ID NO: 8295136 - DNA, 22 bp, Homo sapiens
tctgtgctttccctgccttctt

SEQ ID NO: 8295137 - DNA, 22 bp, Homo sapiens
tcttagcaaatactacttagaa

SEQ ID NO: 8295138 - DNA, 22 bp, Homo sapiens
tcttagcacagctatataagtt

SEQ ID NO: 8295139 - DNA, 22 bp, Homo sapiens
tcttagcatttcataacaactg

SEQ ID NO: 8295140 - DNA, 22 bp, Homo sapiens
tcttagcatttgttaataccca

SEQ ID NO: 8295141 - DNA, 22 bp, Homo sapiens
tcttattttttaatgacagaga

SEQ ID NO: 8295142 - DNA, 22 bp, Homo sapiens
tctttaattgtggaagagcagc

SEQ ID NO: 8295143 - DNA, 22 bp, Homo sapiens
tctttacatcacaattgtatgg

SEQ ID NO: 8295144 - DNA, 22 bp, Homo sapiens
tcttggctgcagagccggcaag

SEQ ID NO: 8295145 - DNA, 22 bp, Homo sapiens
tcttggctcctcacagcatcag

SEQ ID NO: 8295146 - DNA, 22 bp, Homo sapiens
tcttggctacttaggaggattc

SEQ ID NO: 8295147 - DNA, 22 bp, Homo sapiens
tctttcaatgtgaaaccatgta

SEQ ID NO: 8295148 - DNA, 22 bp, Homo sapiens
tccttagacaaagagtgggctt

SEQ ID NO: 8295149 - DNA, 22 bp, Homo sapiens
tccttagcaacactgttataat

SEQ ID NO: 8295150 - DNA, 22 bp, Homo sapiens
tccttagcttacaagtcttctg

SEQ ID NO: 8295151 - DNA, 22 bp, Homo sapiens
tccttagctgtgaaatgagaat

SEQ ID NO: 8295152 - DNA, 18 bp, Homo sapiens
tccttagctgagcttgtc

SEQ ID NO: 8295153 - DNA, 22 bp, Homo sapiens
tccttagcaggcattcaggacc

SEQ ID NO: 8295154 - DNA, 22 bp, Homo sapiens
tccttagccagggcagctcaaa

SEQ ID NO: 8295155 - DNA, 22 bp, Homo sapiens
tccttagcccactaatacttat

SEQ ID NO: 8295156 - DNA, 22 bp, Homo sapiens
tccttagccggagcagctcatc

SEQ ID NO: 8295157 - DNA, 22 bp, Homo sapiens
tccttggcaagctgcaatggga

SEQ ID NO: 8295158 - DNA, 19 bp, Homo sapiens
tctagtcagtcagtcattc

SEQ ID NO: 8295159 - DNA, 22 bp, Homo sapiens
tctagtcatattttttcagtat

SEQ ID NO: 8295160 - DNA, 22 bp, Homo sapiens
tctatttgttctcaggatcatc

SEQ ID NO: 8295161 - DNA, 22 bp, Homo sapiens
tctagctgagggtaggagacct

SEQ ID NO: 8295162 - DNA, 22 bp, Homo sapiens
tcctgctgttttctggcccaca

SEQ ID NO: 8295163 - DNA, 22 bp, Homo sapiens
tcctggctcctggagacctgct

SEQ ID NO: 8295164 - DNA, 22 bp, Homo sapiens
tcctggctcggcttggggactt

SEQ ID NO: 8295165 - DNA, 22 bp, Homo sapiens
tcctggctcgattgctaccaat

SEQ ID NO: 8295166 - DNA, 22 bp, Homo sapiens
tcctggctctaagtcctgagtg

SEQ ID NO: 8295167 - DNA, 17 bp, Homo sapiens
tcctggctctgccactg

SEQ ID NO: 8295168 - DNA, 22 bp, Homo sapiens
tcctggctctgctgcctcctag

SEQ ID NO: 8295169 - DNA, 22 bp, Homo sapiens
tcctggctctctacaaaccaga

SEQ ID NO: 8295170 - DNA, 23 bp, Homo sapiens
tcctggctctgcacttgctaatg

SEQ ID NO: 8295171 - DNA, 22 bp, Homo sapiens
tcctgtggaagacagtgttggg

SEQ ID NO: 8295172 - DNA, 22 bp, Homo sapiens
tcctgtggagaggactggaggt

SEQ ID NO: 8295173 - DNA, 22 bp, Homo sapiens
tcctgtcttaatgatctcgtgc

SEQ ID NO: 8295174 - DNA, 22 bp, Homo sapiens
tcctgggcaaagaggggcagtg

SEQ ID NO: 8295175 - DNA, 22 bp, Homo sapiens
tcctgggcagaatgggatggct

SEQ ID NO: 8295176 - DNA, 19 bp, Homo sapiens
tcctgggctgggccaggtc

SEQ ID NO: 8295177 - DNA, 21 bp, Homo sapiens
tcctggctttatgctacctct

SEQ ID NO: 8295178 - DNA, 22 bp, Homo sapiens
tcctggcttctgtctccttatt

SEQ ID NO: 8295179 - DNA, 22 bp, Homo sapiens
tcctggcttgtcacatctacgt

SEQ ID NO: 8295180 - DNA, 21 bp, Homo sapiens
tcctggctttatgctacctct

SEQ ID NO: 8295181 - DNA, 22 bp, Homo sapiens
tcctggcttttcttggctcatc

SEQ ID NO: 8295182 - DNA, 22 bp, Homo sapiens
tcctggcttccactcctctgtt

SEQ ID NO: 8295183 - DNA, 22 bp, Homo sapiens
tcctggcttcctgctcttgtca

SEQ ID NO: 8295184 - DNA, 22 bp, Homo sapiens
tcctggcttaggtttccagaac

SEQ ID NO: 8295185 - DNA, 22 bp, Homo sapiens
tcctggcttccacacctgtcat

SEQ ID NO: 8295186 - DNA, 22 bp, Homo sapiens
tcctggctgttagagaggcaag

SEQ ID NO: 8295187 - DNA, 22 bp, Homo sapiens
tcctggctgtcactcgggttga

SEQ ID NO: 8295188 - DNA, 22 bp, Homo sapiens
tcctggctggaatttctcactc

SEQ ID NO: 8295189 - DNA, 22 bp, Homo sapiens
tcctggctgccgtcgtcctgcg

SEQ ID NO: 8295190 - DNA, 22 bp, Homo sapiens
tcctggctgcaccagtgaccct

SEQ ID NO: 8295191 - DNA, 22 bp, Homo sapiens
tcctggctcttctgagttttct

SEQ ID NO: 8295192 - DNA, 22 bp, Homo sapiens
tcctggctgagttcccaagtcg

SEQ ID NO: 8295193 - DNA, 22 bp, Homo sapiens
tctctgggtttttgtcctgtac

SEQ ID NO: 8295194 - DNA, 22 bp, Homo sapiens
tctctttaaagactcagagatt

SEQ ID NO: 8295195 - DNA, 22 bp, Homo sapiens
tctctttaagtataatcttata

SEQ ID NO: 8295196 - DNA, 22 bp, Homo sapiens
tctctgggatcaggtggcccag

SEQ ID NO: 8295197 - DNA, 22 bp, Homo sapiens
tctctggggtagggcccaggac

SEQ ID NO: 8295198 - DNA, 22 bp, Homo sapiens
tctcatctgccatttgcaggag

SEQ ID NO: 8295199 - DNA, 22 bp, Homo sapiens
tgccacctggacaaccttatgc

SEQ ID NO: 8295200 - DNA, 22 bp, Homo sapiens
tgccacctagtggtctttagtc

SEQ ID NO: 8295201 - DNA, 22 bp, Homo sapiens
tgccagccagggaagctcaccc

SEQ ID NO: 8295202 - DNA, 22 bp, Homo sapiens
tgcctgaacatgaatagtttat

SEQ ID NO: 8295203 - DNA, 22 bp, Homo sapiens
tgcctccttcaggagggcccgg

SEQ ID NO: 8295204 - DNA, 22 bp, Homo sapiens
tgcctggcacagagcaggtggc

SEQ ID NO: 8295205 - DNA, 22 bp, Homo sapiens
tgccctgtgggtatctgatggc

SEQ ID NO: 8295206 - DNA, 22 bp, Homo sapiens
tgcccttacacatggaaaggga

SEQ ID NO: 8295207 - DNA, 22 bp, Homo sapiens
tgcccttatgaaagaggcccaa

SEQ ID NO: 8295208 - DNA, 22 bp, Homo sapiens
tgcccttaggaaggctcaccaa

SEQ ID NO: 8295209 - DNA, 22 bp, Homo sapiens
tgcccttataaaggaggcctga

SEQ ID NO: 8295210 - DNA, 22 bp, Homo sapiens
tgccctggctggagtgcagtgg

SEQ ID NO: 8295211 - DNA, 22 bp, Homo sapiens
tgccgtggggctgaggctggag

SEQ ID NO: 8295212 - DNA, 22 bp, Homo sapiens
tgccaggctccggaacgacagt

SEQ ID NO: 8295213 - DNA, 17 bp, Homo sapiens
tgccagcctgtcccagg

SEQ ID NO: 8295214 - DNA, 22 bp, Homo sapiens
tgccagcctcctgatatcatcc

SEQ ID NO: 8295215 - DNA, 22 bp, Homo sapiens
tgccaggccctcccacagatta

SEQ ID NO: 8295216 - DNA, 22 bp, Homo sapiens
tgccaggcatttgacagacact

SEQ ID NO: 8295217 - DNA, 22 bp, Homo sapiens
tgccaggccaatgaaggcaggg

SEQ ID NO: 8295218 - DNA, 22 bp, Homo sapiens
tgcccagggtggagtgcagcgg

SEQ ID NO: 8295219 - DNA, 22 bp, Homo sapiens
tgattctgttctccttgagaat

SEQ ID NO: 8295220 - DNA, 23 bp, Homo sapiens
tgattacaagggccaaagaaagg

SEQ ID NO: 8295221 - DNA, 22 bp, Homo sapiens
tgattacaaaagattgtttgaa

SEQ ID NO: 8295222 - DNA, 22 bp, Homo sapiens
tgatgtttaatactatgctttt

SEQ ID NO: 8295223 - DNA, 22 bp, Homo sapiens
tgatgatttcatttctagctgt

SEQ ID NO: 8295224 - DNA, 22 bp, Homo sapiens
tgatcacaagtctgaagaatga

SEQ ID NO: 8295225 - DNA, 22 bp, Homo sapiens
tgatattttatgagctttcata

SEQ ID NO: 8295226 - DNA, 22 bp, Homo sapiens
tgatatttttcactggcctctg

SEQ ID NO: 8295227 - DNA, 22 bp, Homo sapiens
tgatatgtgaagctattagttc

SEQ ID NO: 8295228 - DNA, 22 bp, Homo sapiens
tgatatttaagcaaaaatatgg

SEQ ID NO: 8295229 - DNA, 20 bp, Homo sapiens
tgatatttctggaagtggag

SEQ ID NO: 8295230 - DNA, 22 bp, Homo sapiens
tgatatttgctgactgcattgt

SEQ ID NO: 8295231 - DNA, 22 bp, Homo sapiens
tgatatggctaaagaaagtttc

SEQ ID NO: 8295232 - DNA, 22 bp, Homo sapiens
tgatatggaaggaagatgtaca

SEQ ID NO: 8295233 - DNA, 22 bp, Homo sapiens
tgatacttttcttttagactaa

SEQ ID NO: 8295234 - DNA, 22 bp, Homo sapiens
tgcaaggcttgcaatggtgatc

SEQ ID NO: 8295235 - DNA, 22 bp, Homo sapiens
tgcaaggcccagacaagagctc

SEQ ID NO: 8295236 - DNA, 22 bp, Homo sapiens
tgcaaggctattcacatgtatt

SEQ ID NO: 8295237 - DNA, 17 bp, Homo sapiens
tgcacaagagacaatag

SEQ ID NO: 8295238 - DNA, 22 bp, Homo sapiens
tgcaatgagaatatattaacca

SEQ ID NO: 8295239 - DNA, 22 bp, Homo sapiens
tgatttaggaaacagctacagg

SEQ ID NO: 8295240 - DNA, 22 bp, Homo sapiens
tgcaaagaagcctttgccttct

SEQ ID NO: 8295241 - DNA, 20 bp, Homo sapiens
tgcacagggtgggaagcaac

SEQ ID NO: 8295242 - DNA, 22 bp, Homo sapiens
tgcacaggtgagactcaggaag

SEQ ID NO: 8295243 - DNA, 22 bp, Homo sapiens
tgcacaggccttgaagggagag

SEQ ID NO: 8295244 - DNA, 22 bp, Homo sapiens
tgcacagggagggggccagctc

SEQ ID NO: 8295245 - DNA, 21 bp, Homo sapiens
tgcacagggcccaggagagcc

SEQ ID NO: 8295246 - DNA, 22 bp, Homo sapiens
tgcacaggtggtccatctgcac

SEQ ID NO: 8295247 - DNA, 22 bp, Homo sapiens
tgcagattcaaatgaaatgcaa

SEQ ID NO: 8295248 - DNA, 22 bp, Homo sapiens
tgcagcaccacacctggctaat

SEQ ID NO: 8295249 - DNA, 23 bp, Homo sapiens
tgaaacatttagggtagaatttc

SEQ ID NO: 8295250 - DNA, 22 bp, Homo sapiens
tgaaacttttgaggttcttcca

SEQ ID NO: 8295251 - DNA, 22 bp, Homo sapiens
tgaaacttattcagtttctacc

SEQ ID NO: 8295252 - DNA, 21 bp, Homo sapiens
tgaaagaggatgtggtcattc

SEQ ID NO: 8295253 - DNA, 22 bp, Homo sapiens
tcttttagtaataaatatttgt

SEQ ID NO: 8295254 - DNA, 22 bp, Homo sapiens
tcttttagagcatttctgattc

SEQ ID NO: 8295255 - DNA, 22 bp, Homo sapiens
tcttttagaaaagttgaatgta

SEQ ID NO: 8295256 - DNA, 22 bp, Homo sapiens
tgaactcctgacctcatgatcc

SEQ ID NO: 8295257 - DNA, 22 bp, Homo sapiens
tgaataatcttgggtattaata

SEQ ID NO: 8295258 - DNA, 22 bp, Homo sapiens
tgaagctggaagttaggtagac

SEQ ID NO: 8295259 - DNA, 22 bp, Homo sapiens
tgaagctgtgggcagtggagcc

SEQ ID NO: 8295260 - DNA, 22 bp, Homo sapiens
tgaatcatggataaatagctta

SEQ ID NO: 8295261 - DNA, 22 bp, Homo sapiens
tgactgaaattgcattttaaaa

SEQ ID NO: 8295262 - DNA, 22 bp, Homo sapiens
tgacacacagggggatggagtt

SEQ ID NO: 8295263 - DNA, 22 bp, Homo sapiens
tgagaggtaggaaatgaacaag

SEQ ID NO: 8295264 - DNA, 22 bp, Homo sapiens
tgagcacagctcgcaccagctt

SEQ ID NO: 8295265 - DNA, 22 bp, Homo sapiens
tgagccaggctcaagtgatcct

SEQ ID NO: 8295266 - DNA, 22 bp, Homo sapiens
tgagccaggcccagtggggtca

SEQ ID NO: 8295267 - DNA, 22 bp, Homo sapiens
tgagccaggagtttgaggctgt

SEQ ID NO: 8295268 - DNA, 22 bp, Homo sapiens
tgagccaggcactgctcctgga

SEQ ID NO: 8295269 - DNA, 22 bp, Homo sapiens
tgagccagagtggagtgtgcct

SEQ ID NO: 8295270 - DNA, 22 bp, Homo sapiens
tgagccagagaggttgaggcta

SEQ ID NO: 8295271 - DNA, 22 bp, Homo sapiens
tgagccagtctgtctgggtgaa

SEQ ID NO: 8295272 - DNA, 22 bp, Homo sapiens
tgagcttccctcctgcactaca

SEQ ID NO: 8295273 - DNA, 22 bp, Homo sapiens
tgaggatggcagtgtgctcagc

SEQ ID NO: 8295274 - DNA, 22 bp, Homo sapiens
tgaggatggaatgctgtgcaag

SEQ ID NO: 8295275 - DNA, 22 bp, Homo sapiens
tgaggatgacgatggcaatggc

SEQ ID NO: 8295276 - DNA, 22 bp, Homo sapiens
tgaggatgagatgagataacac

SEQ ID NO: 8295277 - DNA, 21 bp, Homo sapiens
tggcaggcagctggaagcttg

SEQ ID NO: 8295278 - DNA, 22 bp, Homo sapiens
tggcaggaaataccctgcctag

SEQ ID NO: 8295279 - DNA, 22 bp, Homo sapiens
tggcagcctggaatctctcagc

SEQ ID NO: 8295280 - DNA, 22 bp, Homo sapiens
tggcacagaaaaatgctccatt

SEQ ID NO: 8295281 - DNA, 20 bp, Homo sapiens
tggatgtcaaattaggctgg

SEQ ID NO: 8295282 - DNA, 22 bp, Homo sapiens
tggcaaaggaaatgatttaaga

SEQ ID NO: 8295283 - DNA, 22 bp, Homo sapiens
tggccctgaggacccagtgtgg

SEQ ID NO: 8295284 - DNA, 22 bp, Homo sapiens
tggcttcaagtctaggttctac

SEQ ID NO: 8295285 - DNA, 18 bp, Homo sapiens
tggcttcttgagctaaca

SEQ ID NO: 8295286 - DNA, 22 bp, Homo sapiens
tggcttctggccaggcacagga

SEQ ID NO: 8295287 - DNA, 22 bp, Homo sapiens
tggcttctgctttcagtggagg

SEQ ID NO: 8295288 - DNA, 22 bp, Homo sapiens
tggcttctggctggtgagaaat

SEQ ID NO: 8295289 - DNA, 22 bp, Homo sapiens
tggctcctttccgggtctccag

SEQ ID NO: 8295290 - DNA, 22 bp, Homo sapiens
tggctccttcattctcctgcca

SEQ ID NO: 8295291 - DNA, 22 bp, Homo sapiens
tggcctggttgttgctgccgtt

SEQ ID NO: 8295292 - DNA, 22 bp, Homo sapiens
tggcctggccctgaggccctgt

SEQ ID NO: 8295293 - DNA, 22 bp, Homo sapiens
tggctcctaggatggtgcctgg

SEQ ID NO: 8295294 - DNA, 22 bp, Homo sapiens
tggctccgttgtacaggctgga

SEQ ID NO: 8295295 - DNA, 22 bp, Homo sapiens
tggctcctgcagaccatctgga

SEQ ID NO: 8295296 - DNA, 22 bp, Homo sapiens
tggctcctcttctgggtgtccc

SEQ ID NO: 8295297 - DNA, 22 bp, Homo sapiens
tggctcctccctgtgtgtgcgt

SEQ ID NO: 8295298 - DNA, 22 bp, Homo sapiens
tggctcctggcaggtgtttcaa

SEQ ID NO: 8295299 - DNA, 18 bp, Homo sapiens
tggctcctgcctcctgca

SEQ ID NO: 8295300 - DNA, 22 bp, Homo sapiens
tggaaattaaaattcctcttaa

SEQ ID NO: 8295301 - DNA, 22 bp, Homo sapiens
tggactcagtgctgccattccc

SEQ ID NO: 8295302 - DNA, 22 bp, Homo sapiens
tggactccagtgtctgtgttct

SEQ ID NO: 8295303 - DNA, 22 bp, Homo sapiens
tggactcaagtccaagttcacg

SEQ ID NO: 8295304 - DNA, 22 bp, Homo sapiens
tggacctcactgtctgctggta

SEQ ID NO: 8295305 - DNA, 22 bp, Homo sapiens
tggagagcctggagtccctgat

SEQ ID NO: 8295306 - DNA, 22 bp, Homo sapiens
tggagctgaactttgaggccag

SEQ ID NO: 8295307 - DNA, 22 bp, Homo sapiens
tggagtctgtgatgctctgggt

SEQ ID NO: 8295308 - DNA, 22 bp, Homo sapiens
tgcttattaaacatgcatattc

SEQ ID NO: 8295309 - DNA, 22 bp, Homo sapiens
tgcttcagaggaaaggcaaaag

SEQ ID NO: 8295310 - DNA, 22 bp, Homo sapiens
tgcttcagtgtgtcattattta

SEQ ID NO: 8295311 - DNA, 22 bp, Homo sapiens
tgcttcaggagatgtcaccatg

SEQ ID NO: 8295312 - DNA, 23 bp, Homo sapiens
tgctgggcagagctggtgctgag

SEQ ID NO: 8295313 - DNA, 21 bp, Homo sapiens
tgctggctgaaaggcacagag

SEQ ID NO: 8295314 - DNA, 22 bp, Homo sapiens
tgctggatgcttgattttgagg

SEQ ID NO: 8295315 - DNA, 22 bp, Homo sapiens
tgctcctgctgcatgcatctcc

SEQ ID NO: 8295316 - DNA, 17 bp, Homo sapiens
tgctcctgtggcagcct

SEQ ID NO: 8295317 - DNA, 22 bp, Homo sapiens
tgctgatatattctagttttct

SEQ ID NO: 8295318 - DNA, 22 bp, Homo sapiens
tgctgagtcgtattatttttta

SEQ ID NO: 8295319 - DNA, 22 bp, Homo sapiens
tgctgaaagaccgtatttatct

SEQ ID NO: 8295320 - DNA, 20 bp, Homo sapiens
tgccttgggacagtgcctgt

SEQ ID NO: 8295321 - DNA, 21 bp, Homo sapiens
tgccttggcaaatgaccatga

SEQ ID NO: 8295322 - DNA, 20 bp, Homo sapiens
tgccttggagcagccaaggt

SEQ ID NO: 8295323 - DNA, 22 bp, Homo sapiens
tgctagtgtgtgagatgttcaa

SEQ ID NO: 8295324 - DNA, 22 bp, Homo sapiens
tgcgcccagccaagtctggcac

SEQ ID NO: 8295325 - DNA, 22 bp, Homo sapiens
tgtacagataaagactgtaaat

SEQ ID NO: 8295326 - DNA, 22 bp, Homo sapiens
tgtacagactttgcagtgtgca

SEQ ID NO: 8295327 - DNA, 22 bp, Homo sapiens
tgtacagagactaccattaata

SEQ ID NO: 8295328 - DNA, 22 bp, Homo sapiens
tgtacacaacctacagtctgct

SEQ ID NO: 8295329 - DNA, 22 bp, Homo sapiens
tgtacaaggccatctacatgct

SEQ ID NO: 8295330 - DNA, 22 bp, Homo sapiens
tgtacaagcaaatagaccttca

SEQ ID NO: 8295331 - DNA, 22 bp, Homo sapiens
tggtcctggccttgaccccagg

SEQ ID NO: 8295332 - DNA, 23 bp, Homo sapiens
tggtcctgccaacggtgcccctc

SEQ ID NO: 8295333 - DNA, 20 bp, Homo sapiens
tggtcctgtcccacccactc

SEQ ID NO: 8295334 - DNA, 22 bp, Homo sapiens
tggtcctgtctcaaggagcctt

SEQ ID NO: 8295335 - DNA, 22 bp, Homo sapiens
tgtagcattttatgtaataagt

SEQ ID NO: 8295336 - DNA, 22 bp, Homo sapiens
tgtaggaaaaacaatgatctgc

SEQ ID NO: 8295337 - DNA, 22 bp, Homo sapiens
tgtatttgagttatgaaagaga

SEQ ID NO: 8295338 - DNA, 22 bp, Homo sapiens
tgtcagtgagttgggtcctgag

SEQ ID NO: 8295339 - DNA, 22 bp, Homo sapiens
tgtcagggctggacacagctgc

SEQ ID NO: 8295340 - DNA, 21 bp, Homo sapiens
tgtccaaggtatgcactgggg

SEQ ID NO: 8295341 - DNA, 22 bp, Homo sapiens
tgtcctagatccagctgtgctg

SEQ ID NO: 8295342 - DNA, 22 bp, Homo sapiens
tgtcctggccaaggccttgctt

SEQ ID NO: 8295343 - DNA, 22 bp, Homo sapiens
tgtcctggcctccagaaagtcg

SEQ ID NO: 8295344 - DNA, 22 bp, Homo sapiens
tgtcctgggaatgggatgcagt

SEQ ID NO: 8295345 - DNA, 22 bp, Homo sapiens
tgtcctgggaactcacagtcca

SEQ ID NO: 8295346 - DNA, 22 bp, Homo sapiens
tgtcctgggaaatcccttaggc

SEQ ID NO: 8295347 - DNA, 22 bp, Homo sapiens
tgtcctgggccggcgactggtc

SEQ ID NO: 8295348 - DNA, 22 bp, Homo sapiens
tgtcctgggaggcggggtccag

SEQ ID NO: 8295349 - DNA, 22 bp, Homo sapiens
tgtcctgggtcaaatcctggtc

SEQ ID NO: 8295350 - DNA, 22 bp, Homo sapiens
tgtcctggggcgacttggggcc

SEQ ID NO: 8295351 - DNA, 22 bp, Homo sapiens
tgtcctggggacaagaggccct

SEQ ID NO: 8295352 - DNA, 19 bp, Homo sapiens
tgtcctgtcctgctctgac

SEQ ID NO: 8295353 - DNA, 22 bp, Homo sapiens
tgtcctgtgacctggcaccaca

SEQ ID NO: 8295354 - DNA, 22 bp, Homo sapiens
tgtcctgtgccaccttcctgag

SEQ ID NO: 8295355 - DNA, 22 bp, Homo sapiens
tgtcctggtgctccaggtggct

SEQ ID NO: 8295356 - DNA, 22 bp, Homo sapiens
tgtcctggtgcttcttgggatt

SEQ ID NO: 8295357 - DNA, 22 bp, Homo sapiens
tgtcctgggtggatgcttcatt

SEQ ID NO: 8295358 - DNA, 22 bp, Homo sapiens
tgtcctgggtccctgctagaag

SEQ ID NO: 8295359 - DNA, 22 bp, Homo sapiens
tgtcctgggtcaaccaggtcga

SEQ ID NO: 8295360 - DNA, 21 bp, Homo sapiens
tgtcctggtcactgctctccc

SEQ ID NO: 8295361 - DNA, 22 bp, Homo sapiens
tgtcctgttcttgctgtgtcct

SEQ ID NO: 8295362 - DNA, 22 bp, Homo sapiens
tgtccctgatccactggacccc

SEQ ID NO: 8295363 - DNA, 22 bp, Homo sapiens
tgtccctggtggaggctggcag

SEQ ID NO: 8295364 - DNA, 19 bp, Homo sapiens
tgtccgtggccttctggat

SEQ ID NO: 8295365 - DNA, 22 bp, Homo sapiens
tgtccagggggcttacctggag

SEQ ID NO: 8295366 - DNA, 22 bp, Homo sapiens
tgtccagggatggggtcaggga

SEQ ID NO: 8295367 - DNA, 22 bp, Homo sapiens
tgggggctccaggctccaggga

SEQ ID NO: 8295368 - DNA, 22 bp, Homo sapiens
tgggggctagaacccagggatt

SEQ ID NO: 8295369 - DNA, 22 bp, Homo sapiens
tgggctggctgaacttcaacct

SEQ ID NO: 8295370 - DNA, 22 bp, Homo sapiens
tgggctggctgaggcattcact

SEQ ID NO: 8295371 - DNA, 22 bp, Homo sapiens
tggggaaactatttccttgtcc

SEQ ID NO: 8295372 - DNA, 22 bp, Homo sapiens
tgggcacagagtcccatctgcc

SEQ ID NO: 8295373 - DNA, 22 bp, Homo sapiens
tgggcaaatgtcactttctttt

SEQ ID NO: 8295374 - DNA, 19 bp, Homo sapiens
tgggcaggttcagtaatgg

SEQ ID NO: 8295375 - DNA, 22 bp, Homo sapiens
tgggcaggggccctgcttccgt

SEQ ID NO: 8295376 - DNA, 22 bp, Homo sapiens
tgggccaacaggaggtctagga

SEQ ID NO: 8295377 - DNA, 22 bp, Homo sapiens
tgggcagggagctggaaccaca

SEQ ID NO: 8295378 - DNA, 22 bp, Homo sapiens
tgggctgcccaaggtggccatg

SEQ ID NO: 8295379 - DNA, 22 bp, Homo sapiens
tgggctgccggcaggctctgcc

SEQ ID NO: 8295380 - DNA, 22 bp, Homo sapiens
ttagcattctcatttgcataaa

SEQ ID NO: 8295381 - DNA, 22 bp, Homo sapiens
ttagcatctgctgtaagcttat

SEQ ID NO: 8295382 - DNA, 22 bp, Homo sapiens
ttagcattctgcctcctatatc

SEQ ID NO: 8295383 - DNA, 22 bp, Homo sapiens
ttagcattcttctggggggcac

SEQ ID NO: 8295384 - DNA, 22 bp, Homo sapiens
ttagcattctctgtgtgcataa

SEQ ID NO: 8295385 - DNA, 22 bp, Homo sapiens
ttagcactttgattcatgcaga

SEQ ID NO: 8295386 - DNA, 22 bp, Homo sapiens
ttagcatttctggaatcacaag

SEQ ID NO: 8295387 - DNA, 22 bp, Homo sapiens
ttagcattttctgggctgaaat

SEQ ID NO: 8295388 - DNA, 22 bp, Homo sapiens
ttagcatttcagtacacatgtt

SEQ ID NO: 8295389 - DNA, 22 bp, Homo sapiens
ttagcattgtacatttgtgctt

SEQ ID NO: 8295390 - DNA, 22 bp, Homo sapiens
ttagcatttcagtacacatgtt

SEQ ID NO: 8295391 - DNA, 22 bp, Homo sapiens
ttagcatttcatttcaagagga

SEQ ID NO: 8295392 - DNA, 22 bp, Homo sapiens
ttagtcacttcttccttcatca

SEQ ID NO: 8295393 - DNA, 22 bp, Homo sapiens
ttagtcacatgcccatctctga

SEQ ID NO: 8295394 - DNA, 22 bp, Homo sapiens
ttatctgtctatcaagactagc

SEQ ID NO: 8295395 - DNA, 22 bp, Homo sapiens
ttatgagctaagttgtggcccc

SEQ ID NO: 8295396 - DNA, 22 bp, Homo sapiens
ttattctgactaatgtataact

SEQ ID NO: 8295397 - DNA, 22 bp, Homo sapiens
ttattcttcttctcttgccagg

SEQ ID NO: 8295398 - DNA, 18 bp, Homo sapiens
ttaatgtggcttactatg

SEQ ID NO: 8295399 - DNA, 22 bp, Homo sapiens
ttaataagtagtagttattgtt

SEQ ID NO: 8295400 - DNA, 22 bp, Homo sapiens
ttaataataatgagcccatttt

SEQ ID NO: 8295401 - DNA, 22 bp, Homo sapiens
ttacaaagttctgagttcaaac

SEQ ID NO: 8295402 - DNA, 22 bp, Homo sapiens
ttacaaagtgttatgataaaca

SEQ ID NO: 8295403 - DNA, 20 bp, Homo sapiens
ttacaaagaggcatcgcttt

SEQ ID NO: 8295404 - DNA, 22 bp, Homo sapiens
ttaattaactagccaaccacta

SEQ ID NO: 8295405 - DNA, 22 bp, Homo sapiens
ttaattaaattcatgagcattg

SEQ ID NO: 8295406 - DNA, 17 bp, Homo sapiens
ttacaacaattcatgag

SEQ ID NO: 8295407 - DNA, 17 bp, Homo sapiens
ttacaacgtcatctctg

SEQ ID NO: 8295408 - DNA, 22 bp, Homo sapiens
ttacaagataacctgatgctgt

SEQ ID NO: 8295409 - DNA, 22 bp, Homo sapiens
ttacaaggaggatagcatttcc

SEQ ID NO: 8295410 - DNA, 22 bp, Homo sapiens
ttacaatgggtatacttccatt

SEQ ID NO: 8295411 - DNA, 21 bp, Homo sapiens
ttacatggtttatcatatgga

SEQ ID NO: 8295412 - DNA, 22 bp, Homo sapiens
ttacatgggcttgtgagtcctt

SEQ ID NO: 8295413 - DNA, 22 bp, Homo sapiens
ttacatgggccatttagacatg

SEQ ID NO: 8295414 - DNA, 22 bp, Homo sapiens
ttatttgtaaaggtccatagta

SEQ ID NO: 8295415 - DNA, 22 bp, Homo sapiens
ttatttgtaaggcagggccagt

SEQ ID NO: 8295416 - DNA, 22 bp, Homo sapiens
ttatttgtatcaaggacggttg

SEQ ID NO: 8295417 - DNA, 22 bp, Homo sapiens
ttatttgtgaatcatttatcta

SEQ ID NO: 8295418 - DNA, 22 bp, Homo sapiens
ttatttgcccatgtttagcaga

SEQ ID NO: 8295419 - DNA, 22 bp, Homo sapiens
ttcagcatagcagcttcaggac

SEQ ID NO: 8295420 - DNA, 22 bp, Homo sapiens
ttcactgaattaatttccttct

SEQ ID NO: 8295421 - DNA, 22 bp, Homo sapiens
ttcacctgtgttttgtggctga

SEQ ID NO: 8295422 - DNA, 22 bp, Homo sapiens
ttcattcacccaggaaacatct

SEQ ID NO: 8295423 - DNA, 22 bp, Homo sapiens
ttccagcccgcgacttgttcag

SEQ ID NO: 8295424 - DNA, 22 bp, Homo sapiens
tgtctgctacttggttctacca

SEQ ID NO: 8295425 - DNA, 22 bp, Homo sapiens
tgtctgaaacttatgatatact

SEQ ID NO: 8295426 - DNA, 22 bp, Homo sapiens
tgtctctgctgcaccttctggg

SEQ ID NO: 8295427 - DNA, 22 bp, Homo sapiens
tgtctctgaaatatgtggctcc

SEQ ID NO: 8295428 - DNA, 22 bp, Homo sapiens
tgtgctgacaagatcagaaggt

SEQ ID NO: 8295429 - DNA, 22 bp, Homo sapiens
tgtgcatagactttcaccacct

SEQ ID NO: 8295430 - DNA, 22 bp, Homo sapiens
tgtgcctactgatagagccaag

SEQ ID NO: 8295431 - DNA, 20 bp, Homo sapiens
tgtgccctgcagacttcttt

SEQ ID NO: 8295432 - DNA, 22 bp, Homo sapiens
tgtgcagagcccacaggcagct

SEQ ID NO: 8295433 - DNA, 22 bp, Homo sapiens
tgtgcacataaaacagtactag

SEQ ID NO: 8295434 - DNA, 22 bp, Homo sapiens
tgtgcacattctaggactagta

SEQ ID NO: 8295435 - DNA, 22 bp, Homo sapiens
tgtgaatgtctaggttttatgt

SEQ ID NO: 8295436 - DNA, 22 bp, Homo sapiens
tgtgaatgtatagtttgtatat

SEQ ID NO: 8295437 - DNA, 19 bp, Homo sapiens
tgtgataagcagaattcca

SEQ ID NO: 8295438 - DNA, 22 bp, Homo sapiens
tgtgtgccagatacaagcactg

SEQ ID NO: 8295439 - DNA, 22 bp, Homo sapiens
tgtgtgcattcacatgcatgcc

SEQ ID NO: 8295440 - DNA, 19 bp, Homo sapiens
tgtgtgccctcaccacata

SEQ ID NO: 8295441 - DNA, 22 bp, Homo sapiens
tgtgtgtctggaagctcaggga

SEQ ID NO: 8295442 - DNA, 22 bp, Homo sapiens
tgtgtgtgcaggagagcaggtg

SEQ ID NO: 8295443 - DNA, 22 bp, Homo sapiens
tgtgtgtggggaggcagcagat

SEQ ID NO: 8295444 - DNA, 22 bp, Homo sapiens
tgtgtgtgtgcgcgcacgcata

SEQ ID NO: 8295445 - DNA, 22 bp, Homo sapiens
tgtgtacacacagatatataca

SEQ ID NO: 8295446 - DNA, 22 bp, Homo sapiens
tgtgtacacatgacaggcaccc

SEQ ID NO: 8295447 - DNA, 22 bp, Homo sapiens
tgtgtacagcatggtccagcag

SEQ ID NO: 8295448 - DNA, 22 bp, Homo sapiens
tgtgtacatatacacaaataca

SEQ ID NO: 8295449 - DNA, 22 bp, Homo sapiens
tgtgtacatctcttctcacatt

SEQ ID NO: 8295450 - DNA, 22 bp, Homo sapiens
tgtgtacacaagtatatataca

SEQ ID NO: 8295451 - DNA, 23 bp, Homo sapiens
tgtgtacacaatagatgaggttt

SEQ ID NO: 8295452 - DNA, 22 bp, Homo sapiens
tgtgggaggaacacagccagaa

SEQ ID NO: 8295453 - DNA, 22 bp, Homo sapiens
tgttgagtatatacctacaagt

SEQ ID NO: 8295454 - DNA, 22 bp, Homo sapiens
tgttgattagtgtttagactta

SEQ ID NO: 8295455 - DNA, 22 bp, Homo sapiens
tgttgtgacccagaccaagaag

SEQ ID NO: 8295456 - DNA, 22 bp, Homo sapiens
tgttttaaagccattgcctttc

SEQ ID NO: 8295457 - DNA, 22 bp, Homo sapiens
tgttttaagctctagaagggga

SEQ ID NO: 8295458 - DNA, 22 bp, Homo sapiens
tgttttaagagcgcactttata

SEQ ID NO: 8295459 - DNA, 22 bp, Homo sapiens
tgttttaatctcccattgctct

SEQ ID NO: 8295460 - DNA, 22 bp, Homo sapiens
tgttttaagggtcaactgtcac

SEQ ID NO: 8295461 - DNA, 22 bp, Homo sapiens
tgtttgtggttataataagtat

SEQ ID NO: 8295462 - DNA, 18 bp, Homo sapiens
acctggctgtgtgagctg

SEQ ID NO: 8295463 - DNA, 22 bp, Homo sapiens
acctggcttccaatctaggagc

SEQ ID NO: 8295464 - DNA, 22 bp, Homo sapiens
acctggcttctaatcatggctc

SEQ ID NO: 8295465 - DNA, 20 bp, Homo sapiens
acctggcttcctcttggcat

SEQ ID NO: 8295466 - DNA, 22 bp, Homo sapiens
acctggcttcagagtctggcca

SEQ ID NO: 8295467 - DNA, 22 bp, Homo sapiens
accttctggtctgcctgacagc

SEQ ID NO: 8295468 - DNA, 22 bp, Homo sapiens
accttctgaccagttatcttga

SEQ ID NO: 8295469 - DNA, 22 bp, Homo sapiens
acctggcttgtttctacctcct

SEQ ID NO: 8295470 - DNA, 22 bp, Homo sapiens
aatcttgagggactcatgaggt

SEQ ID NO: 8295471 - DNA, 22 bp, Homo sapiens
aatcttgagtgttactctcatt

SEQ ID NO: 8295472 - DNA, 22 bp, Homo sapiens
aatcttcattttgacaagattc

SEQ ID NO: 8295473 - DNA, 22 bp, Homo sapiens
aatcttcataaaaatctagtag

SEQ ID NO: 8295474 - DNA, 22 bp, Homo sapiens
agaaaatattcattgagaggct

SEQ ID NO: 8295475 - DNA, 22 bp, Homo sapiens
acttagcaggtactttcatatt

SEQ ID NO: 8295476 - DNA, 22 bp, Homo sapiens
acttagcagtttagaatatgtc

SEQ ID NO: 8295477 - DNA, 22 bp, Homo sapiens
acttagcattatgtaattacta

SEQ ID NO: 8295478 - DNA, 22 bp, Homo sapiens
acttagcaatttgattaaaaga

SEQ ID NO: 8295479 - DNA, 22 bp, Homo sapiens
acagtggtgagtgactgatagg

SEQ ID NO: 8295480 - DNA, 22 bp, Homo sapiens
acagtgctcatgtgacatggtg

SEQ ID NO: 8295481 - DNA, 22 bp, Homo sapiens
acaggtgtagcaggagcatcaa

SEQ ID NO: 8295482 - DNA, 22 bp, Homo sapiens
acaggtgtctaaggcagacagc

SEQ ID NO: 8295483 - DNA, 22 bp, Homo sapiens
acaggcttactgtttcataggg

SEQ ID NO: 8295484 - DNA, 22 bp, Homo sapiens
acaggcactgtcaagtcatgaa

SEQ ID NO: 8295485 - DNA, 22 bp, Homo sapiens
acaggcactttgacatgccatc

SEQ ID NO: 8295486 - DNA, 22 bp, Homo sapiens
agccctgcaggatgagggaggt

SEQ ID NO: 8295487 - DNA, 22 bp, Homo sapiens
agcctgtggatccctgcactgg

SEQ ID NO: 8295488 - DNA, 22 bp, Homo sapiens
agcctgtgttttttctattgca

SEQ ID NO: 8295489 - DNA, 22 bp, Homo sapiens
agccttaaatgctagattcata

SEQ ID NO: 8295490 - DNA, 22 bp, Homo sapiens
agcagttatattactctcaggt

SEQ ID NO: 8295491 - DNA, 22 bp, Homo sapiens
agcaggcatagagtagcactca

SEQ ID NO: 8295492 - DNA, 19 bp, Homo sapiens
agcaggcaggtggcccagg

SEQ ID NO: 8295493 - DNA, 23 bp, Homo sapiens
agcaggcatctgtggcacaaggc

SEQ ID NO: 8295494 - DNA, 21 bp, Homo sapiens
aattttgaaggaagattaagg

SEQ ID NO: 8295495 - DNA, 22 bp, Homo sapiens
agattacagcatgggaatggga

SEQ ID NO: 8295496 - DNA, 22 bp, Homo sapiens
aagaatgtgggtggatatgatg

SEQ ID NO: 8295497 - DNA, 22 bp, Homo sapiens
aagaatgagctcaaagatctta

SEQ ID NO: 8295498 - DNA, 22 bp, Homo sapiens
aagcaaatgtgggtgcagaatt

SEQ ID NO: 8295499 - DNA, 22 bp, Homo sapiens
aagcactaggtcacacaagtta

SEQ ID NO: 8295500 - DNA, 22 bp, Homo sapiens
aagcagattggggatttccatg

SEQ ID NO: 8295501 - DNA, 22 bp, Homo sapiens
aagcagatctgatagggccctg

SEQ ID NO: 8295502 - DNA, 22 bp, Homo sapiens
aagcagatgccaagatttacca

SEQ ID NO: 8295503 - DNA, 22 bp, Homo sapiens
aacatttcataacttgactttt

SEQ ID NO: 8295504 - DNA, 22 bp, Homo sapiens
aacattcaaaacccagttcagt

SEQ ID NO: 8295505 - DNA, 22 bp, Homo sapiens
aacattcaagttctggtttatg

SEQ ID NO: 8295506 - DNA, 23 bp, Homo sapiens
aaacttgctatggctgaaatcat

SEQ ID NO: 8295507 - DNA, 22 bp, Homo sapiens
aaaaatgaaacggctggttggc

SEQ ID NO: 8295508 - DNA, 21 bp, Homo sapiens
aaaaatgaagttgttcaggaa

SEQ ID NO: 8295509 - DNA, 22 bp, Homo sapiens
aaaaatgaattcttcagtggca

SEQ ID NO: 8295510 - DNA, 22 bp, Homo sapiens
aaacactggtatgatgtatagt

SEQ ID NO: 8295511 - DNA, 22 bp, Homo sapiens
aaacagttttctcatttagtgt

SEQ ID NO: 8295512 - DNA, 22 bp, Homo sapiens
aaatgctctccaaaatgaaagt

SEQ ID NO: 8295513 - DNA, 20 bp, Homo sapiens
aacattgaaagtctagaaga

SEQ ID NO: 8295514 - DNA, 22 bp, Homo sapiens
aagttgagatgtcataggagac

SEQ ID NO: 8295515 - DNA, 22 bp, Homo sapiens
aagttgaatcagtaacacagtt

SEQ ID NO: 8295516 - DNA, 22 bp, Homo sapiens
aaattagtcggtttaggaattt

SEQ ID NO: 8295517 - DNA, 22 bp, Homo sapiens
aaattagtacattgcaaagtcc

SEQ ID NO: 8295518 - DNA, 22 bp, Homo sapiens
aaattattatgcccctctataa

SEQ ID NO: 8295519 - DNA, 22 bp, Homo sapiens
aaattattacaagctagttggc

SEQ ID NO: 8295520 - DNA, 22 bp, Homo sapiens
aagctgtcaatgtatctagtct

SEQ ID NO: 8295521 - DNA, 22 bp, Homo sapiens
aatgtatttgatgtattagcct

SEQ ID NO: 8295522 - DNA, 22 bp, Homo sapiens
aattagctaattaattgtagcc

SEQ ID NO: 8295523 - DNA, 22 bp, Homo sapiens
aagacattgtcattttataatt

SEQ ID NO: 8295524 - DNA, 22 bp, Homo sapiens
aagacacacacatatgctgagt

SEQ ID NO: 8295525 - DNA, 22 bp, Homo sapiens
acacccttgtccatagcagatg

SEQ ID NO: 8295526 - DNA, 22 bp, Homo sapiens
acacacagcgcctaccatgtgc

SEQ ID NO: 8295527 - DNA, 22 bp, Homo sapiens
acagagtcattcactgatgaag

SEQ ID NO: 8295528 - DNA, 22 bp, Homo sapiens
acagagtcatggtagtcaaagg

SEQ ID NO: 8295529 - DNA, 19 bp, Homo sapiens
acagaaatgtaagtgagac

SEQ ID NO: 8295530 - DNA, 22 bp, Homo sapiens
aagattttcagctaatggtgca

SEQ ID NO: 8295531 - DNA, 22 bp, Homo sapiens
cagatgtggaatgcagcaggct

SEQ ID NO: 8295532 - DNA, 23 bp, Homo sapiens
cagatgtgcaactctaggcaatg

SEQ ID NO: 8295533 - DNA, 22 bp, Homo sapiens
cagatgtgcctccagggctttg

SEQ ID NO: 8295534 - DNA, 22 bp, Homo sapiens
agcctggtttaagcattttata

SEQ ID NO: 8295535 - DNA, 22 bp, Homo sapiens
agctccagaagcctgcaaggta

SEQ ID NO: 8295536 - DNA, 23 bp, Homo sapiens
agctccagctgacgtgggcagcc

SEQ ID NO: 8295537 - DNA, 22 bp, Homo sapiens
cagagcctggcgatgtcatgga

SEQ ID NO: 8295538 - DNA, 22 bp, Homo sapiens
cagagacccttctcagtggcca

SEQ ID NO: 8295539 - DNA, 20 bp, Homo sapiens
cagagacccaggcttcagct

SEQ ID NO: 8295540 - DNA, 22 bp, Homo sapiens
cagagacatgtggcctgcacgt

SEQ ID NO: 8295541 - DNA, 22 bp, Homo sapiens
cagagacattaagtgccatgat

SEQ ID NO: 8295542 - DNA, 22 bp, Homo sapiens
caataatatcctgtgctgtttg

SEQ ID NO: 8295543 - DNA, 20 bp, Homo sapiens
agcagagtgcccatcccgga

SEQ ID NO: 8295544 - DNA, 22 bp, Homo sapiens
agcactagcctgttttgctgtg

SEQ ID NO: 8295545 - DNA, 22 bp, Homo sapiens
agcactagctttaagcattctg

SEQ ID NO: 8295546 - DNA, 20 bp, Homo sapiens
agcactaggtgtggcaggtg

SEQ ID NO: 8295547 - DNA, 22 bp, Homo sapiens
agcactagacatgtaagtgagc

SEQ ID NO: 8295548 - DNA, 17 bp, Homo sapiens
agcactaaaatgcttcc

SEQ ID NO: 8295549 - DNA, 22 bp, Homo sapiens
agcactagagccaaaatttggg

SEQ ID NO: 8295550 - DNA, 22 bp, Homo sapiens
cacagcagaaagtgtaggagga

SEQ ID NO: 8295551 - DNA, 22 bp, Homo sapiens
agcattaagagagactgaactg

SEQ ID NO: 8295552 - DNA, 22 bp, Homo sapiens
agcattaagcctggctcagagg

SEQ ID NO: 8295553 - DNA, 22 bp, Homo sapiens
agcatgtaaagctcttagcacc

SEQ ID NO: 8295554 - DNA, 22 bp, Homo sapiens
agcattaataagaaatggctcc

SEQ ID NO: 8295555 - DNA, 23 bp, Homo sapiens
agcattagagatgccagccctgt

SEQ ID NO: 8295556 - DNA, 22 bp, Homo sapiens
cactgttgaagatacttcctct

SEQ ID NO: 8295557 - DNA, 22 bp, Homo sapiens
agcagtaagcaactgagcttgc

SEQ ID NO: 8295558 - DNA, 22 bp, Homo sapiens
agcatataggaaatgttgaatc

SEQ ID NO: 8295559 - DNA, 22 bp, Homo sapiens
agatcacagtggcaactccctt

SEQ ID NO: 8295560 - DNA, 22 bp, Homo sapiens
agatatttgtatcttgctattg

SEQ ID NO: 8295561 - DNA, 22 bp, Homo sapiens
attacagtaacagctacaatgc

SEQ ID NO: 8295562 - DNA, 22 bp, Homo sapiens
agagtcaccttttcctcaggat

SEQ ID NO: 8295563 - DNA, 21 bp, Homo sapiens
agacttctagaagtgagatag

SEQ ID NO: 8295564 - DNA, 21 bp, Homo sapiens
agagcctgagatcttccagca

SEQ ID NO: 8295565 - DNA, 22 bp, Homo sapiens
agagcacaggctctggagtcta

SEQ ID NO: 8295566 - DNA, 22 bp, Homo sapiens
agagcacagtatctgcacatca

SEQ ID NO: 8295567 - DNA, 22 bp, Homo sapiens
agagcacagtgcaggatccccg

SEQ ID NO: 8295568 - DNA, 22 bp, Homo sapiens
agagccaggccaggccggggca

SEQ ID NO: 8295569 - DNA, 22 bp, Homo sapiens
agagccaggcaggcaatgttga

SEQ ID NO: 8295570 - DNA, 22 bp, Homo sapiens
agacagaacagaataattgttg

SEQ ID NO: 8295571 - DNA, 22 bp, Homo sapiens
atgaacaatgactacatattga

SEQ ID NO: 8295572 - DNA, 22 bp, Homo sapiens
agctgcagcttcctagtccagc

SEQ ID NO: 8295573 - DNA, 20 bp, Homo sapiens
agctccatgaagtagtcact

SEQ ID NO: 8295574 - DNA, 18 bp, Homo sapiens
agctccatctgtcagcat

SEQ ID NO: 8295575 - DNA, 22 bp, Homo sapiens
agcttcatggaacctgaggcta

SEQ ID NO: 8295576 - DNA, 17 bp, Homo sapiens
agcttcagttgcaaaac

SEQ ID NO: 8295577 - DNA, 22 bp, Homo sapiens
agcttcagttttctattgttaa

SEQ ID NO: 8295578 - DNA, 22 bp, Homo sapiens
agcttcaggtggtcttgtttct

SEQ ID NO: 8295579 - DNA, 22 bp, Homo sapiens
agcttcagtgtcaggcccgtgg

SEQ ID NO: 8295580 - DNA, 22 bp, Homo sapiens
aggaaactaacttatctttata

SEQ ID NO: 8295581 - DNA, 22 bp, Homo sapiens
aggaaactttcttttgcttcat

SEQ ID NO: 8295582 - DNA, 22 bp, Homo sapiens
aggaaacttcagagttttggtc

SEQ ID NO: 8295583 - DNA, 22 bp, Homo sapiens
aggaaactgggtatggttatac

SEQ ID NO: 8295584 - DNA, 22 bp, Homo sapiens
aggaaactgggcctcaggttag

SEQ ID NO: 8295585 - DNA, 22 bp, Homo sapiens
aggaaactgatgttttttacaa

SEQ ID NO: 8295586 - DNA, 22 bp, Homo sapiens
agcttcagatttatctttctgt

SEQ ID NO: 8295587 - DNA, 20 bp, Homo sapiens
agcttcaggctcaagagaac

SEQ ID NO: 8295588 - DNA, 22 bp, Homo sapiens
agcttcagggacttgtggcaga

SEQ ID NO: 8295589 - DNA, 22 bp, Homo sapiens
agcttcaggaacaggcagcctg

SEQ ID NO: 8295590 - DNA, 22 bp, Homo sapiens
agcttcagcttgcagctgtgat

SEQ ID NO: 8295591 - DNA, 20 bp, Homo sapiens
agcttcagccctaggattgc

SEQ ID NO: 8295592 - DNA, 18 bp, Homo sapiens
aggcacagagcatacata

SEQ ID NO: 8295593 - DNA, 22 bp, Homo sapiens
aggcacagatttggggaaagca

SEQ ID NO: 8295594 - DNA, 22 bp, Homo sapiens
aggcaacaggaaaccacatgat

SEQ ID NO: 8295595 - DNA, 22 bp, Homo sapiens
aggaagctaaccagggagtgag

SEQ ID NO: 8295596 - DNA, 23 bp, Homo sapiens
aggaagctaagtgtggctgcgga

SEQ ID NO: 8295597 - DNA, 22 bp, Homo sapiens
accagggcagccgaggtgtgtc

SEQ ID NO: 8295598 - DNA, 22 bp, Homo sapiens
accagggcggcttgaggaggca

SEQ ID NO: 8295599 - DNA, 22 bp, Homo sapiens
accagggcttacagcagtagct

SEQ ID NO: 8295600 - DNA, 22 bp, Homo sapiens
accagggttgagtcagctgcgt

SEQ ID NO: 8295601 - DNA, 22 bp, Homo sapiens
accaggaggcctggagcacaaa

SEQ ID NO: 8295602 - DNA, 22 bp, Homo sapiens
acattcattccaggtcagtcag

SEQ ID NO: 8295603 - DNA, 22 bp, Homo sapiens
agtataattagatatcaaaagt

SEQ ID NO: 8295604 - DNA, 21 bp, Homo sapiens
accttctgaattacctaccaa

SEQ ID NO: 8295605 - DNA, 22 bp, Homo sapiens
aggtgactggtttatctggcag

SEQ ID NO: 8295606 - DNA, 22 bp, Homo sapiens
actagaaagtttccagagttat

SEQ ID NO: 8295607 - DNA, 22 bp, Homo sapiens
actgggccacatagacctgctg

SEQ ID NO: 8295608 - DNA, 22 bp, Homo sapiens
actgggccaggtgtgggtgagt

SEQ ID NO: 8295609 - DNA, 22 bp, Homo sapiens
actgggccggtgcagagtagtt

SEQ ID NO: 8295610 - DNA, 22 bp, Homo sapiens
actgggcctacccagattggca

SEQ ID NO: 8295611 - DNA, 22 bp, Homo sapiens
actgggcccagtggtgtggctg

SEQ ID NO: 8295612 - DNA, 22 bp, Homo sapiens
actgggcctgattgggtcggag

SEQ ID NO: 8295613 - DNA, 22 bp, Homo sapiens
actgggcctggattggcgtgtc

SEQ ID NO: 8295614 - DNA, 22 bp, Homo sapiens
actgcctgctcctggctccaca

SEQ ID NO: 8295615 - DNA, 22 bp, Homo sapiens
actgcctggcctggcctcactg

SEQ ID NO: 8295616 - DNA, 19 bp, Homo sapiens
actgcctgaggctcacagg

SEQ ID NO: 8295617 - DNA, 23 bp, Homo sapiens
actgcctgctactatgcccacgg

SEQ ID NO: 8295618 - DNA, 22 bp, Homo sapiens
actgcctgccttccaggtactg

SEQ ID NO: 8295619 - DNA, 19 bp, Homo sapiens
ataaataaaaagtgggaga

SEQ ID NO: 8295620 - DNA, 22 bp, Homo sapiens
acttaaaaagaatcttttcacg

SEQ ID NO: 8295621 - DNA, 22 bp, Homo sapiens
actttgcagggcttgatatcca

SEQ ID NO: 8295622 - DNA, 22 bp, Homo sapiens
actttgtgcccaacagaaagaa

SEQ ID NO: 8295623 - DNA, 22 bp, Homo sapiens
atcccagatagtgaccctcagg

SEQ ID NO: 8295624 - DNA, 22 bp, Homo sapiens
aggtgcagctggtggagtctgg

SEQ ID NO: 8295625 - DNA, 23 bp, Homo sapiens
aggtcctggacatatgtgcatca

SEQ ID NO: 8295626 - DNA, 22 bp, Homo sapiens
agtcacagtttccctgagagag

SEQ ID NO: 8295627 - DNA, 19 bp, Homo sapiens
agtcacagggaagaggaac

SEQ ID NO: 8295628 - DNA, 20 bp, Homo sapiens
agtcacaggcctggaacatg

SEQ ID NO: 8295629 - DNA, 22 bp, Homo sapiens
agtcacagggtacacaaggatt

SEQ ID NO: 8295630 - DNA, 22 bp, Homo sapiens
agtcacatgggattagaaccca

SEQ ID NO: 8295631 - DNA, 22 bp, Homo sapiens
agtcacatgcattttcttcaat

SEQ ID NO: 8295632 - DNA, 22 bp, Homo sapiens
agtacatacttcaaatgtactt

SEQ ID NO: 8295633 - DNA, 22 bp, Homo sapiens
agtgcatttggggtagtggaag

SEQ ID NO: 8295634 - DNA, 22 bp, Homo sapiens
ctgagctgctcccgctgcagcg

SEQ ID NO: 8295635 - DNA, 22 bp, Homo sapiens
agtgtacaaaatgatagataaa

SEQ ID NO: 8295636 - DNA, 22 bp, Homo sapiens
ctgcctgtgccaccgcctcatt

SEQ ID NO: 8295637 - DNA, 22 bp, Homo sapiens
ctgcctgtgccaatgctccttt

SEQ ID NO: 8295638 - DNA, 22 bp, Homo sapiens
ctgcctgtgatttttctctagt

SEQ ID NO: 8295639 - DNA, 22 bp, Homo sapiens
ctgcctgggttcaagtcctgtt

SEQ ID NO: 8295640 - DNA, 22 bp, Homo sapiens
ctggcaggttatagagctgccc

SEQ ID NO: 8295641 - DNA, 22 bp, Homo sapiens
ctggcctcagagggtcatggtg

SEQ ID NO: 8295642 - DNA, 22 bp, Homo sapiens
ctggcctgtgggctgtctccgg

SEQ ID NO: 8295643 - DNA, 19 bp, Homo sapiens
ctggcctgtgtcctgtgct

SEQ ID NO: 8295644 - DNA, 22 bp, Homo sapiens
ctgtaaatatgaagaatatatg

SEQ ID NO: 8295645 - DNA, 22 bp, Homo sapiens
atcagcacaacgtacagagaaa

SEQ ID NO: 8295646 - DNA, 19 bp, Homo sapiens
cttattagagtgagagctt

SEQ ID NO: 8295647 - DNA, 19 bp, Homo sapiens
cttatgcagctgagcttgg

SEQ ID NO: 8295648 - DNA, 22 bp, Homo sapiens
atctgtaacatcagtagcagaa

SEQ ID NO: 8295649 - DNA, 22 bp, Homo sapiens
atctgtgatcaagacagacagt

SEQ ID NO: 8295650 - DNA, 22 bp, Homo sapiens
cttctccttatatgtcccgttc

SEQ ID NO: 8295651 - DNA, 20 bp, Homo sapiens
caggtccagcacgtgcacgg

SEQ ID NO: 8295652 - DNA, 22 bp, Homo sapiens
catgtgtggtctgtggctatct

SEQ ID NO: 8295653 - DNA, 22 bp, Homo sapiens
catgtgtgggacccttaggttg

SEQ ID NO: 8295654 - DNA, 22 bp, Homo sapiens
catgtgtggagggcatgcatgg

SEQ ID NO: 8295655 - DNA, 22 bp, Homo sapiens
catgtgtgagtatatcttatcc

SEQ ID NO: 8295656 - DNA, 23 bp, Homo sapiens
catgtgtgacagtatcactgttt

SEQ ID NO: 8295657 - DNA, 22 bp, Homo sapiens
catgtgtgaatcttgtgatcat

SEQ ID NO: 8295658 - DNA, 22 bp, Homo sapiens
catgtgtgaagactgcgggcca

SEQ ID NO: 8295659 - DNA, 22 bp, Homo sapiens
catgtgtctttatggagccaca

SEQ ID NO: 8295660 - DNA, 22 bp, Homo sapiens
catcactgtcaccatctttcct

SEQ ID NO: 8295661 - DNA, 22 bp, Homo sapiens
catcactgaaccccaactttct

SEQ ID NO: 8295662 - DNA, 22 bp, Homo sapiens
aggccagtgcagctggaacaga

SEQ ID NO: 8295663 - DNA, 22 bp, Homo sapiens
ccagctctggcttcttgctggg

SEQ ID NO: 8295664 - DNA, 22 bp, Homo sapiens
ccagctctgcttgcccagtcag

SEQ ID NO: 8295665 - DNA, 22 bp, Homo sapiens
ccaggacaagccagagggacag

SEQ ID NO: 8295666 - DNA, 22 bp, Homo sapiens
agggctggagggtactagttta

SEQ ID NO: 8295667 - DNA, 22 bp, Homo sapiens
gcctggctccctctgcagctcc

SEQ ID NO: 8295668 - DNA, 22 bp, Homo sapiens
gcctggctctgagtttctctcc

SEQ ID NO: 8295669 - DNA, 22 bp, Homo sapiens
gcctggctctgagggagctcct

SEQ ID NO: 8295670 - DNA, 21 bp, Homo sapiens
gcctggctctcactggcctgg

SEQ ID NO: 8295671 - DNA, 22 bp, Homo sapiens
gctattgtgacagcttttcgcc

SEQ ID NO: 8295672 - DNA, 22 bp, Homo sapiens
gctacagactgagcatggctct

SEQ ID NO: 8295673 - DNA, 22 bp, Homo sapiens
gctaatgactgagtttttagca

SEQ ID NO: 8295674 - DNA, 22 bp, Homo sapiens
atttaaattttctgatggagag

SEQ ID NO: 8295675 - DNA, 22 bp, Homo sapiens
atttaaatgcttaagagggttt

SEQ ID NO: 8295676 - DNA, 16 bp, Homo sapiens
attgttttcaattaga

SEQ ID NO: 8295677 - DNA, 22 bp, Homo sapiens
atttaaatgcttaagagggttt

SEQ ID NO: 8295678 - DNA, 22 bp, Homo sapiens
attgttatgaaaataagatgtt

SEQ ID NO: 8295679 - DNA, 22 bp, Homo sapiens
gcaggggtggaggctgtcctgt

SEQ ID NO: 8295680 - DNA, 20 bp, Homo sapiens
gcacagagatgagcaaagta

SEQ ID NO: 8295681 - DNA, 18 bp, Homo sapiens
gcacagagcccaggctct

SEQ ID NO: 8295682 - DNA, 22 bp, Homo sapiens
gcacagagctggccctccaggc

SEQ ID NO: 8295683 - DNA, 22 bp, Homo sapiens
gcacagagcctggtaccgagaa

SEQ ID NO: 8295684 - DNA, 22 bp, Homo sapiens
gcacagaggaagcacagactct

SEQ ID NO: 8295685 - DNA, 19 bp, Homo sapiens
gcagccaggtgctctacct

SEQ ID NO: 8295686 - DNA, 22 bp, Homo sapiens
gcagccaggggctgtgacctgt

SEQ ID NO: 8295687 - DNA, 22 bp, Homo sapiens
gagggggctccctgaagccagt

SEQ ID NO: 8295688 - DNA, 21 bp, Homo sapiens
gagccttccctctgccctttc

SEQ ID NO: 8295689 - DNA, 22 bp, Homo sapiens
gagcctggcctcctgcctcagc

SEQ ID NO: 8295690 - DNA, 22 bp, Homo sapiens
atgtcacagcaggagtattctt

SEQ ID NO: 8295691 - DNA, 22 bp, Homo sapiens
atgccctgagcaggccttcaag

SEQ ID NO: 8295692 - DNA, 22 bp, Homo sapiens
atgccctgaaagattcaaaggc

SEQ ID NO: 8295693 - DNA, 22 bp, Homo sapiens
atgccctgaggaatgtcacgct

SEQ ID NO: 8295694 - DNA, 22 bp, Homo sapiens
atgccctgcatcaagtgacact

SEQ ID NO: 8295695 - DNA, 22 bp, Homo sapiens
atgccctgctctcgggaaggga

SEQ ID NO: 8295696 - DNA, 22 bp, Homo sapiens
atgccctgccaagcaggctaaa

SEQ ID NO: 8295697 - DNA, 22 bp, Homo sapiens
atgccctgctgccatctggccg

SEQ ID NO: 8295698 - DNA, 22 bp, Homo sapiens
atgccctgctgctggggcagtg

SEQ ID NO: 8295699 - DNA, 22 bp, Homo sapiens
atgccctggactagctatactt

SEQ ID NO: 8295700 - DNA, 18 bp, Homo sapiens
atgccctgttgacttcag

SEQ ID NO: 8295701 - DNA, 22 bp, Homo sapiens
atgccctgtggttcatgtgaga

SEQ ID NO: 8295702 - DNA, 22 bp, Homo sapiens
atgccctgggagtgctgtacca

SEQ ID NO: 8295703 - DNA, 22 bp, Homo sapiens
atgccctggacttctagtattc

SEQ ID NO: 8295704 - DNA, 23 bp, Homo sapiens
atgccctgtagaggctgctgacc

SEQ ID NO: 8295705 - DNA, 22 bp, Homo sapiens
atgccctggggctacctctgag

SEQ ID NO: 8295706 - DNA, 22 bp, Homo sapiens
atgccctgtgactctcctggac

SEQ ID NO: 8295707 - DNA, 20 bp, Homo sapiens
atgccctgtcctcttctgtt

SEQ ID NO: 8295708 - DNA, 23 bp, Homo sapiens
atgccctgtgcagaaatgtggaa

SEQ ID NO: 8295709 - DNA, 22 bp, Homo sapiens
atgccctgtggcagtacatatt

SEQ ID NO: 8295710 - DNA, 22 bp, Homo sapiens
gaatcatagaacattaatagaa

SEQ ID NO: 8295711 - DNA, 22 bp, Homo sapiens
atgcttgggactccctgtagca

SEQ ID NO: 8295712 - DNA, 22 bp, Homo sapiens
atgcttggcgtttcacttcctg

SEQ ID NO: 8295713 - DNA, 22 bp, Homo sapiens
atgcttttatgtcacatggtca

SEQ ID NO: 8295714 - DNA, 22 bp, Homo sapiens
atgcttttccaggagaaatata

SEQ ID NO: 8295715 - DNA, 22 bp, Homo sapiens
gaaaatgagcctcagctacatt

SEQ ID NO: 8295716 - DNA, 22 bp, Homo sapiens
gaaatcttttccaattgtttag

SEQ ID NO: 8295717 - DNA, 22 bp, Homo sapiens
gaaatgattttagtttatcatg

SEQ ID NO: 8295718 - DNA, 22 bp, Homo sapiens
gaaatgatgtctgtgctgccac

SEQ ID NO: 8295719 - DNA, 22 bp, Homo sapiens
cttgagcacagcggcttcagga

SEQ ID NO: 8295720 - DNA, 22 bp, Homo sapiens
atgaatgaagaacatctgtgcc

SEQ ID NO: 8295721 - DNA, 22 bp, Homo sapiens
atgaatgaatgagagtaggtca

SEQ ID NO: 8295722 - DNA, 22 bp, Homo sapiens
atgaattgaggaaaacagtcgt

SEQ ID NO: 8295723 - DNA, 22 bp, Homo sapiens
atgaatgagtgctaggtttgtc

SEQ ID NO: 8295724 - DNA, 22 bp, Homo sapiens
atgaatgactgtctactttggg

SEQ ID NO: 8295725 - DNA, 21 bp, Homo sapiens
atgaatgatttctactcttaa

SEQ ID NO: 8295726 - DNA, 19 bp, Homo sapiens
ggcttcagggagttagcat

SEQ ID NO: 8295727 - DNA, 22 bp, Homo sapiens
cagaaatggagcccaggaatct

SEQ ID NO: 8295728 - DNA, 22 bp, Homo sapiens
ggctgctgtgacctcaggtgat

SEQ ID NO: 8295729 - DNA, 22 bp, Homo sapiens
cactgagttccctgacatttca

SEQ ID NO: 8295730 - DNA, 22 bp, Homo sapiens
cactgattaagtctgctagagg

SEQ ID NO: 8295731 - DNA, 19 bp, Homo sapiens
ggctcctgtggctgcagcc

SEQ ID NO: 8295732 - DNA, 22 bp, Homo sapiens
ggctcctgtcccctcagctgct

SEQ ID NO: 8295733 - DNA, 22 bp, Homo sapiens
ggctcctgtcccctcagctgct

SEQ ID NO: 8295734 - DNA, 22 bp, Homo sapiens
ggctcctgggggtgctcctgcc

SEQ ID NO: 8295735 - DNA, 22 bp, Homo sapiens
ggctgcggccgcgggtctgtgc

SEQ ID NO: 8295736 - DNA, 22 bp, Homo sapiens
ggctgcggatctaaggctggga

SEQ ID NO: 8295737 - DNA, 22 bp, Homo sapiens
gcttccagggctcagtcactgc

SEQ ID NO: 8295738 - DNA, 21 bp, Homo sapiens
gctgggcctgtacttgccctg

SEQ ID NO: 8295739 - DNA, 22 bp, Homo sapiens
gctgggccgacctgggctgcag

SEQ ID NO: 8295740 - DNA, 22 bp, Homo sapiens
gctgggccctgggtgccctagc

SEQ ID NO: 8295741 - DNA, 22 bp, Homo sapiens
gctggcagcattagaccctggg

SEQ ID NO: 8295742 - DNA, 22 bp, Homo sapiens
ggaacactgccttttattttcc

SEQ ID NO: 8295743 - DNA, 22 bp, Homo sapiens
ggacacacaagttatctaatga

SEQ ID NO: 8295744 - DNA, 22 bp, Homo sapiens
cacagcagtctttcactaaata

SEQ ID NO: 8295745 - DNA, 22 bp, Homo sapiens
gtaacatttacagttcctagag

SEQ ID NO: 8295746 - DNA, 22 bp, Homo sapiens
gtaacattattcatgagataca

SEQ ID NO: 8295747 - DNA, 22 bp, Homo sapiens
cagcactatgacatttaattct

SEQ ID NO: 8295748 - DNA, 22 bp, Homo sapiens
ggggtctgggcttagctggaat

SEQ ID NO: 8295749 - DNA, 22 bp, Homo sapiens
cagagacagtttcacagggtct

SEQ ID NO: 8295750 - DNA, 22 bp, Homo sapiens
gtgaatgaaaggatgattcttt

SEQ ID NO: 8295751 - DNA, 22 bp, Homo sapiens
gtgaatgacatattttgtactg

SEQ ID NO: 8295752 - DNA, 22 bp, Homo sapiens
gtgaatgactgttttcagcatt

SEQ ID NO: 8295753 - DNA, 22 bp, Homo sapiens
gtgaatgatagcttctctttgg

SEQ ID NO: 8295754 - DNA, 22 bp, Homo sapiens
gtcctagtgcctggaagctggg

SEQ ID NO: 8295755 - DNA, 23 bp, Homo sapiens
gtcctagtgcttggtgcccaggc

SEQ ID NO: 8295756 - DNA, 22 bp, Homo sapiens
gtgccctgaaagagttaattca

SEQ ID NO: 8295757 - DNA, 22 bp, Homo sapiens
gtgccctgacacacctggtgtg

SEQ ID NO: 8295758 - DNA, 22 bp, Homo sapiens
gtgcctgggacttgctccggat

SEQ ID NO: 8295759 - DNA, 22 bp, Homo sapiens
cagcccttgtttctaaagctgc

SEQ ID NO: 8295760 - DNA, 22 bp, Homo sapiens
tagtttgtaatgaggagaagta

SEQ ID NO: 8295761 - DNA, 22 bp, Homo sapiens
tagtttgtagaaatctagaaat

SEQ ID NO: 8295762 - DNA, 22 bp, Homo sapiens
tatgtacatcttgagcaatgaa

SEQ ID NO: 8295763 - DNA, 22 bp, Homo sapiens
cagtacatttcatatgattcta

SEQ ID NO: 8295764 - DNA, 22 bp, Homo sapiens
tatgatattctaaattgacacc

SEQ ID NO: 8295765 - DNA, 22 bp, Homo sapiens
tatgatatgcactttatcagaa

SEQ ID NO: 8295766 - DNA, 22 bp, Homo sapiens
tcacatgtatatgcagcacagc

SEQ ID NO: 8295767 - DNA, 22 bp, Homo sapiens
tcacatgtgtggcagtgcaagt

SEQ ID NO: 8295768 - DNA, 22 bp, Homo sapiens
tcacatgttaggtcgggcaagg

SEQ ID NO: 8295769 - DNA, 22 bp, Homo sapiens
tcacatgtgttttctcaccaac

SEQ ID NO: 8295770 - DNA, 22 bp, Homo sapiens
cagtgggtgatgagtcctgggg

SEQ ID NO: 8295771 - DNA, 22 bp, Homo sapiens
tagcattagagatagaaatagt

SEQ ID NO: 8295772 - DNA, 22 bp, Homo sapiens
tagcattaaaggtaagacatta

SEQ ID NO: 8295773 - DNA, 22 bp, Homo sapiens
tacagagactttatggcacaaa

SEQ ID NO: 8295774 - DNA, 22 bp, Homo sapiens
tacagagacccacaagagactg

SEQ ID NO: 8295775 - DNA, 22 bp, Homo sapiens
tacagagagaggggttaccagg

SEQ ID NO: 8295776 - DNA, 22 bp, Homo sapiens
tacagagagataagtgtaaaag

SEQ ID NO: 8295777 - DNA, 22 bp, Homo sapiens
tacacagaagccagaaggcctg

SEQ ID NO: 8295778 - DNA, 22 bp, Homo sapiens
caggccacagctaaagaggatt

SEQ ID NO: 8295779 - DNA, 22 bp, Homo sapiens
catgtaatcctggggagatgaa

SEQ ID NO: 8295780 - DNA, 20 bp, Homo sapiens
tccagcaccctcacagagaa

SEQ ID NO: 8295781 - DNA, 22 bp, Homo sapiens
cattacaaagttataaacagtt

SEQ ID NO: 8295782 - DNA, 22 bp, Homo sapiens
cattaataaacatttcagaaga

SEQ ID NO: 8295783 - DNA, 22 bp, Homo sapiens
cattaatattgttcttctttag

SEQ ID NO: 8295784 - DNA, 22 bp, Homo sapiens
cattacaaccccaaattacaaa

SEQ ID NO: 8295785 - DNA, 22 bp, Homo sapiens
catgtgtaaggctcacaggcag

SEQ ID NO: 8295786 - DNA, 22 bp, Homo sapiens
catgtacaaggatgctcagagt

SEQ ID NO: 8295787 - DNA, 22 bp, Homo sapiens
tcatcactcattggacaacaga

SEQ ID NO: 8295788 - DNA, 22 bp, Homo sapiens
catcagtcccacggagcagccc

SEQ ID NO: 8295789 - DNA, 22 bp, Homo sapiens
tctagaatgacatgcaagagta

SEQ ID NO: 8295790 - DNA, 22 bp, Homo sapiens
tctcaggatctaatacatggta

SEQ ID NO: 8295791 - DNA, 22 bp, Homo sapiens
tcctgtgttactgcctggagcg

SEQ ID NO: 8295792 - DNA, 22 bp, Homo sapiens
tcctgtgtgggcaggatgagaa

SEQ ID NO: 8295793 - DNA, 22 bp, Homo sapiens
tcctgtgtaaatagatctggtt

SEQ ID NO: 8295794 - DNA, 22 bp, Homo sapiens
tcctgtgtctcagcgtgaagca

SEQ ID NO: 8295795 - DNA, 22 bp, Homo sapiens
tcctgtggtctggaaggaatgg

SEQ ID NO: 8295796 - DNA, 22 bp, Homo sapiens
tctctgggataaactgggccag

SEQ ID NO: 8295797 - DNA, 22 bp, Homo sapiens
cattttcagcacccatctgaaa

SEQ ID NO: 8295798 - DNA, 22 bp, Homo sapiens
catttgtgtgggaacccatcag

SEQ ID NO: 8295799 - DNA, 22 bp, Homo sapiens
catttgtgcttttataaaatag

SEQ ID NO: 8295800 - DNA, 22 bp, Homo sapiens
catttgtgtccgtcccagttct

SEQ ID NO: 8295801 - DNA, 22 bp, Homo sapiens
tcctggctaacacggtgacacc

SEQ ID NO: 8295802 - DNA, 22 bp, Homo sapiens
tcctggctccactgagcaggcc

SEQ ID NO: 8295803 - DNA, 22 bp, Homo sapiens
tcctggctagttttgctgaaat

SEQ ID NO: 8295804 - DNA, 22 bp, Homo sapiens
tcctggctcaggcccctggtgc

SEQ ID NO: 8295805 - DNA, 22 bp, Homo sapiens
tcctggctaatgctgctgatgg

SEQ ID NO: 8295806 - DNA, 23 bp, Homo sapiens
ccaagactgttaggagtggggag

SEQ ID NO: 8295807 - DNA, 22 bp, Homo sapiens
tgaaatgacagtcttaagctct

SEQ ID NO: 8295808 - DNA, 22 bp, Homo sapiens
tgaaatgagcatttattcttta

SEQ ID NO: 8295809 - DNA, 22 bp, Homo sapiens
ccagggcaacgctgtctcagag

SEQ ID NO: 8295810 - DNA, 22 bp, Homo sapiens
ccagggcatcacatccagtgtt

SEQ ID NO: 8295811 - DNA, 22 bp, Homo sapiens
ccagcactcctgtctcaagtct

SEQ ID NO: 8295812 - DNA, 22 bp, Homo sapiens
ccagcactctgtcccagcttcc

SEQ ID NO: 8295813 - DNA, 22 bp, Homo sapiens
ccagcactctattgaatattct

SEQ ID NO: 8295814 - DNA, 22 bp, Homo sapiens
tctgggcctatagaagtctacc

SEQ ID NO: 8295815 - DNA, 22 bp, Homo sapiens
tctgggccggagccgacggcag

SEQ ID NO: 8295816 - DNA, 22 bp, Homo sapiens
tctgggccctgagatgttcttc

SEQ ID NO: 8295817 - DNA, 22 bp, Homo sapiens
tctgggccgctgcgttccatga

SEQ ID NO: 8295818 - DNA, 22 bp, Homo sapiens
tctgggcctcacctgctgctca

SEQ ID NO: 8295819 - DNA, 22 bp, Homo sapiens
tctgggcctcagtttcttcatc

SEQ ID NO: 8295820 - DNA, 22 bp, Homo sapiens
tctgggcctgatggctaaagcc

SEQ ID NO: 8295821 - DNA, 22 bp, Homo sapiens
tctgggcctgtctcagagctgg

SEQ ID NO: 8295822 - DNA, 22 bp, Homo sapiens
tctgggccttggagtggggaga

SEQ ID NO: 8295823 - DNA, 22 bp, Homo sapiens
tctgggctatatggtctctgct

SEQ ID NO: 8295824 - DNA, 22 bp, Homo sapiens
tctgggctatatggtctctgct

SEQ ID NO: 8295825 - DNA, 22 bp, Homo sapiens
tctgggcttttgcactggccat

SEQ ID NO: 8295826 - DNA, 22 bp, Homo sapiens
tgcactagccacatttcaaatg

SEQ ID NO: 8295827 - DNA, 22 bp, Homo sapiens
tgagccatgggactccaaggga

SEQ ID NO: 8295828 - DNA, 22 bp, Homo sapiens
cctcctctgtgcagctgtgggt

SEQ ID NO: 8295829 - DNA, 22 bp, Homo sapiens
cctgccctgtcactggctaggg

SEQ ID NO: 8295830 - DNA, 23 bp, Homo sapiens
tggtaatagggagcagaaggtag

SEQ ID NO: 8295831 - DNA, 22 bp, Homo sapiens
tgggcaggagagaagctaaaga

SEQ ID NO: 8295832 - DNA, 22 bp, Homo sapiens
tgggctccgttgcctggggcag

SEQ ID NO: 8295833 - DNA, 22 bp, Homo sapiens
tgggctccagcacctgtgctct

SEQ ID NO: 8295834 - DNA, 22 bp, Homo sapiens
tgggctccagcacctgtgctct

SEQ ID NO: 8295835 - DNA, 22 bp, Homo sapiens
tgctaatgtttcatttttagat

SEQ ID NO: 8295836 - DNA, 22 bp, Homo sapiens
cccagtggggagctgaggttca

SEQ ID NO: 8295837 - DNA, 22 bp, Homo sapiens
cccagtgtctgggcctgcaggg

SEQ ID NO: 8295838 - DNA, 22 bp, Homo sapiens
tggaaactagagagtttgtatt

SEQ ID NO: 8295839 - DNA, 19 bp, Homo sapiens
tggaaactcctgatattag

SEQ ID NO: 8295840 - DNA, 22 bp, Homo sapiens
tggaaactctacctctctaaga

SEQ ID NO: 8295841 - DNA, 22 bp, Homo sapiens
tggaaactgggagttaaatgta

SEQ ID NO: 8295842 - DNA, 22 bp, Homo sapiens
tggaaactgtggtatttcttta

SEQ ID NO: 8295843 - DNA, 22 bp, Homo sapiens
ccctggcttaaaaacctcatat

SEQ ID NO: 8295844 - DNA, 22 bp, Homo sapiens
ccctggctgcttgtagtctggc

SEQ ID NO: 8295845 - DNA, 22 bp, Homo sapiens
ccctggctgctaccaggtagct

SEQ ID NO: 8295846 - DNA, 22 bp, Homo sapiens
ctttaattaggaagtataatga

SEQ ID NO: 8295847 - DNA, 22 bp, Homo sapiens
ctttacaaagcaattttgtctc

SEQ ID NO: 8295848 - DNA, 22 bp, Homo sapiens
cttgttttggaacagagtgaat

SEQ ID NO: 8295849 - DNA, 22 bp, Homo sapiens
cttgtttttaagagatgtttac

SEQ ID NO: 8295850 - DNA, 22 bp, Homo sapiens
cttgttttggctagtatgatgt

SEQ ID NO: 8295851 - DNA, 21 bp, Homo sapiens
cttgttttgaaaggactggcc

SEQ ID NO: 8295852 - DNA, 22 bp, Homo sapiens
cttgttttgaaagcagtggcca

SEQ ID NO: 8295853 - DNA, 22 bp, Homo sapiens
cttgttttctaaaacatcattt

SEQ ID NO: 8295854 - DNA, 22 bp, Homo sapiens
cttgttttcttctgcagtctat

SEQ ID NO: 8295855 - DNA, 22 bp, Homo sapiens
cttctggggatggagcccagaa

SEQ ID NO: 8295856 - DNA, 22 bp, Homo sapiens
cttagcagaagcttcagcttca

SEQ ID NO: 8295857 - DNA, 22 bp, Homo sapiens
cttagcagaattccaagcttga

SEQ ID NO: 8295858 - DNA, 22 bp, Homo sapiens
cttaaattcttaatgccctcat

SEQ ID NO: 8295859 - DNA, 22 bp, Homo sapiens
cttaaattttcatctacaagaa

SEQ ID NO: 8295860 - DNA, 22 bp, Homo sapiens
cttaaattggatgagttaagtt

SEQ ID NO: 8295861 - DNA, 22 bp, Homo sapiens
ctgttttatctcaagagttcaa

SEQ ID NO: 8295862 - DNA, 22 bp, Homo sapiens
cttaggatttaatttcagactc

SEQ ID NO: 8295863 - DNA, 22 bp, Homo sapiens
cttagctttgtcctaggtctct

SEQ ID NO: 8295864 - DNA, 22 bp, Homo sapiens
cttagctttgtttaacacaggg

SEQ ID NO: 8295865 - DNA, 22 bp, Homo sapiens
cttagcttttccagcttctaga

SEQ ID NO: 8295866 - DNA, 22 bp, Homo sapiens
cttagcttctctgcatctgtgt

SEQ ID NO: 8295867 - DNA, 20 bp, Homo sapiens
cttagcttctaaggttctgg

SEQ ID NO: 8295868 - DNA, 22 bp, Homo sapiens
cttagcttcattattggtggcc

SEQ ID NO: 8295869 - DNA, 22 bp, Homo sapiens
cttagcttcactgggtctcagt

SEQ ID NO: 8295870 - DNA, 22 bp, Homo sapiens
cttagcatgcagtgttctgccc

SEQ ID NO: 8295871 - DNA, 22 bp, Homo sapiens
cttagcagataaaaaccttcag

SEQ ID NO: 8295872 - DNA, 22 bp, Homo sapiens
cttagcatgtggtgtccttgta

SEQ ID NO: 8295873 - DNA, 22 bp, Homo sapiens
cttagccagctaacttaagcac

SEQ ID NO: 8295874 - DNA, 20 bp, Homo sapiens
cttagctagtaagaagctgt

SEQ ID NO: 8295875 - DNA, 22 bp, Homo sapiens
cttcatttcaggctgaagaata

SEQ ID NO: 8295876 - DNA, 22 bp, Homo sapiens
ctgtacatcccgagagccagta

SEQ ID NO: 8295877 - DNA, 22 bp, Homo sapiens
ctgtagcaagttattcaataaa

SEQ ID NO: 8295878 - DNA, 22 bp, Homo sapiens
ctgggcctttgcttattaattt

SEQ ID NO: 8295879 - DNA, 22 bp, Homo sapiens
gacagacatgggacttcatact

SEQ ID NO: 8295880 - DNA, 22 bp, Homo sapiens
gaccacagctacaagggcaagg

SEQ ID NO: 8295881 - DNA, 22 bp, Homo sapiens
gaatgatagagctgccttcgga

SEQ ID NO: 8295882 - DNA, 22 bp, Homo sapiens
gaatgataaatggaagcagcat

SEQ ID NO: 8295883 - DNA, 22 bp, Homo sapiens
gaatgagttaatatttgcttgg

SEQ ID NO: 8295884 - DNA, 22 bp, Homo sapiens
gaatgatatattagcagatttt

SEQ ID NO: 8295885 - DNA, 22 bp, Homo sapiens
gaatgatattatttcgtgctgg

SEQ ID NO: 8295886 - DNA, 22 bp, Homo sapiens
gacagacaggaggcattcaggg

SEQ ID NO: 8295887 - DNA, 22 bp, Homo sapiens
gacagacacaattgatccatga

SEQ ID NO: 8295888 - DNA, 22 bp, Homo sapiens
gacagacacagggccatgattg

SEQ ID NO: 8295889 - DNA, 22 bp, Homo sapiens
tttcttagcgatgcttgataaa

SEQ ID NO: 8295890 - DNA, 22 bp, Homo sapiens
tttcttatactatattgtcatc

SEQ ID NO: 8295891 - DNA, 19 bp, Homo sapiens
tttctgcagcccagcagca

SEQ ID NO: 8295892 - DNA, 22 bp, Homo sapiens
tttctgcaggtattgcataagt

SEQ ID NO: 8295893 - DNA, 22 bp, Homo sapiens
tttctgcaaacttccacgtctc

SEQ ID NO: 8295894 - DNA, 22 bp, Homo sapiens
ctctgaggtccttcccagctct

SEQ ID NO: 8295895 - DNA, 22 bp, Homo sapiens
tttcaaatagaatctttccaaa

SEQ ID NO: 8295896 - DNA, 22 bp, Homo sapiens
ctcctgtcaataggctcctggc

SEQ ID NO: 8295897 - DNA, 22 bp, Homo sapiens
ctcctgtcagaagcatcctgag

SEQ ID NO: 8295898 - DNA, 22 bp, Homo sapiens
ctcctgtggtactcccagggcc

SEQ ID NO: 8295899 - DNA, 18 bp, Homo sapiens
tttatatggatagagacc

SEQ ID NO: 8295900 - DNA, 22 bp, Homo sapiens
ctcctggaggatagtgactggg

SEQ ID NO: 8295901 - DNA, 22 bp, Homo sapiens
ctgaaagaataagatgtttaca

SEQ ID NO: 8295902 - DNA, 22 bp, Homo sapiens
ctgaaaatgttacacaggaaga

SEQ ID NO: 8295903 - DNA, 22 bp, Homo sapiens
ttttttgttgggtagaacggaa

SEQ ID NO: 8295904 - DNA, 22 bp, Homo sapiens
ctgaataatacagactagcttc

SEQ ID NO: 8295905 - DNA, 22 bp, Homo sapiens
ctgagatggtctctttgttact

SEQ ID NO: 8295906 - DNA, 22 bp, Homo sapiens
ctgccctgctggagatcacagt

SEQ ID NO: 8295907 - DNA, 22 bp, Homo sapiens
ctgccctgcttctgagggaagc

SEQ ID NO: 8295908 - DNA, 22 bp, Homo sapiens
ctgccctgctaatgagttccaa

SEQ ID NO: 8295909 - DNA, 22 bp, Homo sapiens
ctgccctgctctccgggatctt

SEQ ID NO: 8295910 - DNA, 20 bp, Homo sapiens
ctgccctgccctgggtcctg

SEQ ID NO: 8295911 - DNA, 22 bp, Homo sapiens
ctgccctgcctggccagtgtgg

SEQ ID NO: 8295912 - DNA, 22 bp, Homo sapiens
ctgccctgcccaggccttgggc

SEQ ID NO: 8295913 - DNA, 22 bp, Homo sapiens
ctgccctgagggcctgtgtgtt

SEQ ID NO: 8295914 - DNA, 22 bp, Homo sapiens
ctgccctgagtcatgccagatg

SEQ ID NO: 8295915 - DNA, 22 bp, Homo sapiens
ctgccctgatatgatttagaac

SEQ ID NO: 8295916 - DNA, 23 bp, Homo sapiens
ctgccctgatcttgatctattgt

SEQ ID NO: 8295917 - DNA, 22 bp, Homo sapiens
ctgccctgcagctccacggact

SEQ ID NO: 8295918 - DNA, 22 bp, Homo sapiens
ctgccctgcttgatgacagcga

SEQ ID NO: 8295919 - DNA, 22 bp, Homo sapiens
ctgccctggcagcctaccatgg

SEQ ID NO: 8295920 - DNA, 22 bp, Homo sapiens
ctgccctggaaaacgtatctta

SEQ ID NO: 8295921 - DNA, 22 bp, Homo sapiens
ctgccctgcttgtttccagtgg

SEQ ID NO: 8295922 - DNA, 22 bp, Homo sapiens
ctgccctggccactgtgcccag

SEQ ID NO: 8295923 - DNA, 22 bp, Homo sapiens
ctgccctgggagtacctgtcct

SEQ ID NO: 8295924 - DNA, 22 bp, Homo sapiens
ctgccctgggatggtctgtgcg

SEQ ID NO: 8295925 - DNA, 22 bp, Homo sapiens
ctgccctgggccaggaagcggc

SEQ ID NO: 8295926 - DNA, 22 bp, Homo sapiens
ctgcctgcactgcctggctcca

SEQ ID NO: 8295927 - DNA, 21 bp, Homo sapiens
ttacaaagctacagatgttgc

SEQ ID NO: 8295928 - DNA, 22 bp, Homo sapiens
ttacaatctgattgtctcatct

SEQ ID NO: 8295929 - DNA, 20 bp, Homo sapiens
tgtttctgacggtaggagag

SEQ ID NO: 8295930 - DNA, 22 bp, Homo sapiens
cctgcgtcgtgtgggcagtgac

SEQ ID NO: 8295931 - DNA, 22 bp, Homo sapiens
cctttggggtcctgcctgggct

SEQ ID NO: 8295932 - DNA, 22 bp, Homo sapiens
ttaccaagctctgcatgttaag

SEQ ID NO: 8295933 - DNA, 19 bp, Homo sapiens
ttcttacaacaccctggga

SEQ ID NO: 8295934 - DNA, 22 bp, Homo sapiens
ttgatattttgcacgcttggta

SEQ ID NO: 8295935 - DNA, 23 bp, Homo sapiens
ttgcacagtgtatacacatattt

SEQ ID NO: 8295936 - DNA, 22 bp, Homo sapiens
ttgctgagcagtgtttaattgt

SEQ ID NO: 8295937 - DNA, 17 bp, Homo sapiens
gtaaggcttgcagatgc

SEQ ID NO: 8295938 - DNA, 22 bp, Homo sapiens
gtaataagaaacagcaattatt

SEQ ID NO: 8295939 - DNA, 17 bp, Homo sapiens
gtcaacaggatttcttt

SEQ ID NO: 8295940 - DNA, 23 bp, Homo sapiens
gtaatgatgggaatttacttaga

SEQ ID NO: 8295941 - DNA, 22 bp, Homo sapiens
gtagcattctgagttcgcagag

SEQ ID NO: 8295942 - DNA, 22 bp, Homo sapiens
gtcctctgcttcatgccctgat

SEQ ID NO: 8295943 - DNA, 22 bp, Homo sapiens
gtcagggctccactcaccctcc

SEQ ID NO: 8295944 - DNA, 22 bp, Homo sapiens
gtcagggcacagtgacagctcc

SEQ ID NO: 8295945 - DNA, 22 bp, Homo sapiens
gtgataagacagtaggcacaag

SEQ ID NO: 8295946 - DNA, 22 bp, Homo sapiens
gtgatatttttaaagattaagg

SEQ ID NO: 8295947 - DNA, 22 bp, Homo sapiens
gtgccctgagcttatgcattct

SEQ ID NO: 8295948 - DNA, 22 bp, Homo sapiens
gtgccctgaggtcttcactttg

SEQ ID NO: 8295949 - DNA, 22 bp, Homo sapiens
gtgccctgatcgctaggctccc

SEQ ID NO: 8295950 - DNA, 22 bp, Homo sapiens
gtgccctgagtgggtaggagag

SEQ ID NO: 8295951 - DNA, 22 bp, Homo sapiens
gtgccctgcatgccccgggtat

SEQ ID NO: 8295952 - DNA, 22 bp, Homo sapiens
gtgccctggaggggttgaaggg

SEQ ID NO: 8295953 - DNA, 22 bp, Homo sapiens
gtgccctggatgactttggtct

SEQ ID NO: 8295954 - DNA, 22 bp, Homo sapiens
gtgccctgatgcaattgtctca

SEQ ID NO: 8295955 - DNA, 22 bp, Homo sapiens
gtgccctggtccccagcatata

SEQ ID NO: 8295956 - DNA, 22 bp, Homo sapiens
gtgccctggggtgaacccctgg

SEQ ID NO: 8295957 - DNA, 22 bp, Homo sapiens
gtgccctggctcacagtgtctc

SEQ ID NO: 8295958 - DNA, 22 bp, Homo sapiens
gtgccctgggccttcagggcca

SEQ ID NO: 8295959 - DNA, 22 bp, Homo sapiens
gtgccctgtctcttgtctccag

SEQ ID NO: 8295960 - DNA, 22 bp, Homo sapiens
gtgccctgtgaactgtaaggaa

SEQ ID NO: 8295961 - DNA, 22 bp, Homo sapiens
gtgccctgttcatttctctccc

SEQ ID NO: 8295962 - DNA, 20 bp, Homo sapiens
gtgccctgtgggctattttc

SEQ ID NO: 8295963 - DNA, 22 bp, Homo sapiens
gtgccctgttgcacacttgagg

SEQ ID NO: 8295964 - DNA, 21 bp, Homo sapiens
gtgccctgttcccacatgccc

SEQ ID NO: 8295965 - DNA, 22 bp, Homo sapiens
ggtaaactaaccattttaattt

SEQ ID NO: 8295966 - DNA, 22 bp, Homo sapiens
ggtaacttgagtgtgttgttca

SEQ ID NO: 8295967 - DNA, 23 bp, Homo sapiens
ggtgggagattatccagaattat

SEQ ID NO: 8295968 - DNA, 22 bp, Homo sapiens
ggcctcacccatcggtgccttt

SEQ ID NO: 8295969 - DNA, 22 bp, Homo sapiens
ggctgggtcccagctgggagga

SEQ ID NO: 8295970 - DNA, 22 bp, Homo sapiens
gcacaggaggccgatgctcatg

SEQ ID NO: 8295971 - DNA, 22 bp, Homo sapiens
gcacaggaaatgactcatgtta

SEQ ID NO: 8295972 - DNA, 22 bp, Homo sapiens
gcagcagctcagttctgggagg

SEQ ID NO: 8295973 - DNA, 22 bp, Homo sapiens
gcagcagctgacagtgggtgcc

SEQ ID NO: 8295974 - DNA, 22 bp, Homo sapiens
gcagcagctctgaatgggcccc

SEQ ID NO: 8295975 - DNA, 22 bp, Homo sapiens
gcatctaatccagtccagcatc

SEQ ID NO: 8295976 - DNA, 22 bp, Homo sapiens
gcagtccattgacagaggtctt

SEQ ID NO: 8295977 - DNA, 22 bp, Homo sapiens
gctgggtttccagcaggcagga

SEQ ID NO: 8295978 - DNA, 22 bp, Homo sapiens
gctgggttttcttccgggccta

SEQ ID NO: 8295979 - DNA, 22 bp, Homo sapiens
gctggctctgatgggctccagg

SEQ ID NO: 8295980 - DNA, 18 bp, Homo sapiens
gctggctgcacttctgct

SEQ ID NO: 8295981 - DNA, 22 bp, Homo sapiens
gctggctgccttactttgtgga

SEQ ID NO: 8295982 - DNA, 22 bp, Homo sapiens
gctggattggagcaatagagtc

SEQ ID NO: 8295983 - DNA, 22 bp, Homo sapiens
ggaaagctcagatcttgttgga

SEQ ID NO: 8295984 - DNA, 22 bp, Homo sapiens
ggaaccttagtgttcttttacc

SEQ ID NO: 8295985 - DNA, 22 bp, Homo sapiens
gctgaagttgcctattttaata

SEQ ID NO: 8295986 - DNA, 22 bp, Homo sapiens
gctgaaggtatgagttttatct

SEQ ID NO: 8295987 - DNA, 22 bp, Homo sapiens
gctctggctactgtggctaccg

SEQ ID NO: 8295988 - DNA, 22 bp, Homo sapiens
gctctggccagaccctcagtgg

SEQ ID NO: 8295989 - DNA, 22 bp, Homo sapiens
gctctggctactccaccctgtt

SEQ ID NO: 8295990 - DNA, 23 bp, Homo sapiens
gctctggcagcttgtgtcagcac

SEQ ID NO: 8295991 - DNA, 21 bp, Homo sapiens
gctcaggctcttgacagagca

SEQ ID NO: 8295992 - DNA, 22 bp, Homo sapiens
gctcaggcctcggacacacaat

SEQ ID NO: 8295993 - DNA, 22 bp, Homo sapiens
gctctcagaagtaacttgtcca

SEQ ID NO: 8295994 - DNA, 21 bp, Homo sapiens
gctcctggtgctgcgtggcgc

SEQ ID NO: 8295995 - DNA, 22 bp, Homo sapiens
gcggcccgagcaggacgggtgg

SEQ ID NO: 8295996 - DNA, 22 bp, Homo sapiens
gccttctgtgctcctggccttt

SEQ ID NO: 8295997 - DNA, 22 bp, Homo sapiens
gccttctgcgctcgtgtctccg

SEQ ID NO: 8295998 - DNA, 22 bp, Homo sapiens
gccttctgtccaaccccacgat

SEQ ID NO: 8295999 - DNA, 22 bp, Homo sapiens
gccttctgattgctggactgac

SEQ ID NO: 8296000 - DNA, 22 bp, Homo sapiens
gccttctgatcgctggactgac

SEQ ID NO: 8296001 - DNA, 22 bp, Homo sapiens
gccttctgatatctcttggcat

SEQ ID NO: 8296002 - DNA, 17 bp, Homo sapiens
gccttctctgccctcac

SEQ ID NO: 8296003 - DNA, 22 bp, Homo sapiens
gcctggctgccggccttggcaa

SEQ ID NO: 8296004 - DNA, 22 bp, Homo sapiens
gcctggctatggcctcccccat

SEQ ID NO: 8296005 - DNA, 21 bp, Homo sapiens
gcctggctagaagctcctagc

SEQ ID NO: 8296006 - DNA, 22 bp, Homo sapiens
gcctggctgctcagccactcac

SEQ ID NO: 8296007 - DNA, 22 bp, Homo sapiens
gcctggctgctggttctgagga

SEQ ID NO: 8296008 - DNA, 22 bp, Homo sapiens
gcctggctgcttagcctacttc

SEQ ID NO: 8296009 - DNA, 22 bp, Homo sapiens
gcctggcttgccagccctggcg

SEQ ID NO: 8296010 - DNA, 22 bp, Homo sapiens
gcctggcttggggctcagtggt

SEQ ID NO: 8296011 - DNA, 22 bp, Homo sapiens
gcctggctggtcactgcctggc

SEQ ID NO: 8296012 - DNA, 22 bp, Homo sapiens
gcctgggtgtcgatcactagtg

SEQ ID NO: 8296013 - DNA, 22 bp, Homo sapiens
gcctggtggtgtgctcaagtgg

SEQ ID NO: 8296014 - DNA, 22 bp, Homo sapiens
gccttagcctgcacttcctgtt

SEQ ID NO: 8296015 - DNA, 22 bp, Homo sapiens
tatgtgtgtttcagtggaaatg

SEQ ID NO: 8296016 - DNA, 16 bp, Homo sapiens
tatgtgtgtgggagtg

SEQ ID NO: 8296017 - DNA, 22 bp, Homo sapiens
tatgtgtgtatgacagacagag

SEQ ID NO: 8296018 - DNA, 22 bp, Homo sapiens
tatgttgtggggtgcatcaaaa

SEQ ID NO: 8296019 - DNA, 22 bp, Homo sapiens
tattggtgggggcagagagaga

SEQ ID NO: 8296020 - DNA, 22 bp, Homo sapiens
tattggtgtacttatagcagag

SEQ ID NO: 8296021 - DNA, 22 bp, Homo sapiens
tatttgtccttattaagatctg

SEQ ID NO: 8296022 - DNA, 22 bp, Homo sapiens
tatttgtctttcttataagaat

SEQ ID NO: 8296023 - DNA, 22 bp, Homo sapiens
tatttgtcactgcacttgaaat

SEQ ID NO: 8296024 - DNA, 20 bp, Homo sapiens
tatttgtatttgggaaagtt

SEQ ID NO: 8296025 - DNA, 22 bp, Homo sapiens
tatttgtgtgggtatctatata

SEQ ID NO: 8296026 - DNA, 22 bp, Homo sapiens
tatttgtgagactgactgaagt

SEQ ID NO: 8296027 - DNA, 22 bp, Homo sapiens
tatttgtatgtgtgtacatata

SEQ ID NO: 8296028 - DNA, 22 bp, Homo sapiens
tatacttatgctaaaaaatgtt

SEQ ID NO: 8296029 - DNA, 20 bp, Homo sapiens
tatgataattacaaaatagt

SEQ ID NO: 8296030 - DNA, 22 bp, Homo sapiens
tagcactacttaggtacagcca

SEQ ID NO: 8296031 - DNA, 22 bp, Homo sapiens
tagcactatttttcactatcct

SEQ ID NO: 8296032 - DNA, 22 bp, Homo sapiens
tagcactatatgttagctatta

SEQ ID NO: 8296033 - DNA, 22 bp, Homo sapiens
tagcatttcactgatcttcact

SEQ ID NO: 8296034 - DNA, 22 bp, Homo sapiens
tagccacatgcagactttcatg

SEQ ID NO: 8296035 - DNA, 22 bp, Homo sapiens
tagaataagttgatgatatatg

SEQ ID NO: 8296036 - DNA, 22 bp, Homo sapiens
tacttgtgttctactagagaaa

SEQ ID NO: 8296037 - DNA, 22 bp, Homo sapiens
tagtcacaggaagtttcaatgt

SEQ ID NO: 8296038 - DNA, 22 bp, Homo sapiens
tagtcacacaattgtgtacatt

SEQ ID NO: 8296039 - DNA, 22 bp, Homo sapiens
tagtcacaaccttcaagttgtc

SEQ ID NO: 8296040 - DNA, 22 bp, Homo sapiens
tagtcacatgatcacaggatcg

SEQ ID NO: 8296041 - DNA, 22 bp, Homo sapiens
tagtcacagtacaggataaaga

SEQ ID NO: 8296042 - DNA, 22 bp, Homo sapiens
tagtacagttttggcacatgga

SEQ ID NO: 8296043 - DNA, 22 bp, Homo sapiens
tagccattgacttaaagcttat

SEQ ID NO: 8296044 - DNA, 22 bp, Homo sapiens
tagccatttttattaatgctgg

SEQ ID NO: 8296045 - DNA, 22 bp, Homo sapiens
taataacaattgtaggacatga

SEQ ID NO: 8296046 - DNA, 22 bp, Homo sapiens
taagtttctccaaagcacagaa

SEQ ID NO: 8296047 - DNA, 18 bp, Homo sapiens
taatgataagccttgaag

SEQ ID NO: 8296048 - DNA, 22 bp, Homo sapiens
taatgcttaattttcacaagcc

SEQ ID NO: 8296049 - DNA, 22 bp, Homo sapiens
tacacatgacagtggactgaga

SEQ ID NO: 8296050 - DNA, 22 bp, Homo sapiens
tacacccttctcctgagtgtgt

SEQ ID NO: 8296051 - DNA, 22 bp, Homo sapiens
tacacatgtccaaggtgtcacc

SEQ ID NO: 8296052 - DNA, 22 bp, Homo sapiens
tacacatgtatttatgtgtaca

SEQ ID NO: 8296053 - DNA, 22 bp, Homo sapiens
taattttgtattgccattgtag

SEQ ID NO: 8296054 - DNA, 22 bp, Homo sapiens
taattttgtcacagtgacatgc

SEQ ID NO: 8296055 - DNA, 22 bp, Homo sapiens
tacaatgagctgtacatctcca

SEQ ID NO: 8296056 - DNA, 22 bp, Homo sapiens
tacattatcttgttatctttca

SEQ ID NO: 8296057 - DNA, 20 bp, Homo sapiens
tacaggaatcaagactgcat

SEQ ID NO: 8296058 - DNA, 22 bp, Homo sapiens
tacaggaagtctcagtacagta

SEQ ID NO: 8296059 - DNA, 22 bp, Homo sapiens
tacaggaactgggcaggacatt

SEQ ID NO: 8296060 - DNA, 22 bp, Homo sapiens
gtttagaaaatagtgaagcaag

SEQ ID NO: 8296061 - DNA, 22 bp, Homo sapiens
gtttagaacacggaaatactga

SEQ ID NO: 8296062 - DNA, 22 bp, Homo sapiens
gtttagaagccaagatttgggt

SEQ ID NO: 8296063 - DNA, 21 bp, Homo sapiens
gtttagaagtagtctggctca

SEQ ID NO: 8296064 - DNA, 22 bp, Homo sapiens
gtttagaattctaactttaagg

SEQ ID NO: 8296065 - DNA, 22 bp, Homo sapiens
gtttagaatggcaaaattaagt

SEQ ID NO: 8296066 - DNA, 22 bp, Homo sapiens
gtttagaatgaaacttttgagc

SEQ ID NO: 8296067 - DNA, 22 bp, Homo sapiens
gtttctgagcacttttattgca

SEQ ID NO: 8296068 - DNA, 22 bp, Homo sapiens
gttagcatgacttagaatcagg

SEQ ID NO: 8296069 - DNA, 22 bp, Homo sapiens
gttagcatgattcctgctcatt

SEQ ID NO: 8296070 - DNA, 22 bp, Homo sapiens
gttagcatttgtttaatatcag

SEQ ID NO: 8296071 - DNA, 22 bp, Homo sapiens
taacacaaaagaatatgtgtgt

SEQ ID NO: 8296072 - DNA, 23 bp, Homo sapiens
gttttcaacacaataaatgtaac

SEQ ID NO: 8296073 - DNA, 22 bp, Homo sapiens
tcacacagattggtagagctga

SEQ ID NO: 8296074 - DNA, 22 bp, Homo sapiens
tcacacagcttggagttatggt

SEQ ID NO: 8296075 - DNA, 22 bp, Homo sapiens
tcacacagggttctggtctcat

SEQ ID NO: 8296076 - DNA, 22 bp, Homo sapiens
tcacacaggtttgcaatgattt

SEQ ID NO: 8296077 - DNA, 22 bp, Homo sapiens
tcagaggactaccttctccagt

SEQ ID NO: 8296078 - DNA, 22 bp, Homo sapiens
tcagcccttcctggagctttta

SEQ ID NO: 8296079 - DNA, 22 bp, Homo sapiens
tccacgtgagcttcgtgtgcag

SEQ ID NO: 8296080 - DNA, 22 bp, Homo sapiens
tcatgtgtgtttcatgtatgga

SEQ ID NO: 8296081 - DNA, 22 bp, Homo sapiens
tcattaatttgcttagacttat

SEQ ID NO: 8296082 - DNA, 22 bp, Homo sapiens
tcattaatcccggggtccaggg

SEQ ID NO: 8296083 - DNA, 23 bp, Homo sapiens
tccagcctcttgctctcacatgc

SEQ ID NO: 8296084 - DNA, 19 bp, Homo sapiens
tccagcctgctgtttctct

SEQ ID NO: 8296085 - DNA, 22 bp, Homo sapiens
tccagccttgccacttttctgt

SEQ ID NO: 8296086 - DNA, 22 bp, Homo sapiens
ttttagaaatactgatttagtg

SEQ ID NO: 8296087 - DNA, 22 bp, Homo sapiens
ttttagaaggaatgctatggtg

SEQ ID NO: 8296088 - DNA, 22 bp, Homo sapiens
ttttagaaagatccctggcagg

SEQ ID NO: 8296089 - DNA, 22 bp, Homo sapiens
ttttagaagtgcctatcctatg

SEQ ID NO: 8296090 - DNA, 22 bp, Homo sapiens
ttttaattttgcaaatctggtg

SEQ ID NO: 8296091 - DNA, 22 bp, Homo sapiens
tttgtgcagtggttaagaccat

SEQ ID NO: 8296092 - DNA, 22 bp, Homo sapiens
ttttgtgagcccataaatgcca

SEQ ID NO: 8296093 - DNA, 22 bp, Homo sapiens
ttttgtgagctgagaaatgtat

SEQ ID NO: 8296094 - DNA, 22 bp, Homo sapiens
ttttgtgagctccttggaggta

SEQ ID NO: 8296095 - DNA, 22 bp, Homo sapiens
ttttgtgatggcattacattta

SEQ ID NO: 8296096 - DNA, 22 bp, Homo sapiens
ttttgtgacacttcttgagaca

SEQ ID NO: 8296097 - DNA, 22 bp, Homo sapiens
ttttgtgaatagtttatctaag

SEQ ID NO: 8296098 - DNA, 22 bp, Homo sapiens
ttttgtgacagaaagattaagt

SEQ ID NO: 8296099 - DNA, 22 bp, Homo sapiens
ttttgtgagatgcgtatgaatg

SEQ ID NO: 8296100 - DNA, 22 bp, Homo sapiens
tttttgtggtgcagactaaagc

SEQ ID NO: 8296101 - DNA, 22 bp, Homo sapiens
tttgctgatattttgctgatac

SEQ ID NO: 8296102 - DNA, 22 bp, Homo sapiens
tttgctgagttgaagtttgagg

SEQ ID NO: 8296103 - DNA, 22 bp, Homo sapiens
tttgctgaccccattctgagtc

SEQ ID NO: 8296104 - DNA, 22 bp, Homo sapiens
tttgaaatatgaggcattatga

SEQ ID NO: 8296105 - DNA, 22 bp, Homo sapiens
ttctttctcactctttaggaag

SEQ ID NO: 8296106 - DNA, 22 bp, Homo sapiens
ttctgggcacacaggccctggt

SEQ ID NO: 8296107 - DNA, 22 bp, Homo sapiens
ttcctttagtgtcatatacttt

SEQ ID NO: 8296108 - DNA, 22 bp, Homo sapiens
ttctcacaggatttcttttagt

SEQ ID NO: 8296109 - DNA, 22 bp, Homo sapiens
ttatttaaaagtggtaagattc

SEQ ID NO: 8296110 - DNA, 22 bp, Homo sapiens
ttattgtttgggtataatttga

SEQ ID NO: 8296111 - DNA, 22 bp, Homo sapiens
ttatgttgggaaaagtcagatt

SEQ ID NO: 8296112 - DNA, 22 bp, Homo sapiens
ttatttacaactcttctcttcc

SEQ ID NO: 8296113 - DNA, 18 bp, Homo sapiens
ttatttgttacagcacat

SEQ ID NO: 8296114 - DNA, 22 bp, Homo sapiens
ttatttgttttctgagaagtat

SEQ ID NO: 8296115 - DNA, 20 bp, Homo sapiens
ttatttgtttactttggtcc

SEQ ID NO: 8296116 - DNA, 22 bp, Homo sapiens
ttatttgtggcatatgagacga

SEQ ID NO: 8296117 - DNA, 22 bp, Homo sapiens
ttatttgtggcatccatgttgg

SEQ ID NO: 8296118 - DNA, 22 bp, Homo sapiens
ttatgtgtataattacaggaag

SEQ ID NO: 8296119 - DNA, 22 bp, Homo sapiens
ttataattctggcataggctgt

SEQ ID NO: 8296120 - DNA, 22 bp, Homo sapiens
ttcagacaataagagtcatctc

SEQ ID NO: 8296121 - DNA, 22 bp, Homo sapiens
ttgtattaattgaaatgaatgc

SEQ ID NO: 8296122 - DNA, 22 bp, Homo sapiens
ttgtgataaaacattagacatt

SEQ ID NO: 8296123 - DNA, 22 bp, Homo sapiens
ttggctcaggacccctgtgact

SEQ ID NO: 8296124 - DNA, 22 bp, Homo sapiens
ttgctaataaagtttttatgtg

SEQ ID NO: 8296125 - DNA, 22 bp, Homo sapiens
ttgctaaaggattttgtattta

SEQ ID NO: 8296126 - DNA, 22 bp, Homo sapiens
tttccagtctcagccctgtaac

SEQ ID NO: 8296127 - DNA, 22 bp, Homo sapiens
tttcacatatggttgttgattg

SEQ ID NO: 8296128 - DNA, 22 bp, Homo sapiens
tttcacatcagaggtagattag

SEQ ID NO: 8296129 - DNA, 22 bp, Homo sapiens
tttcacatttaggcgtgaattg

SEQ ID NO: 8296130 - DNA, 22 bp, Homo sapiens
tttatgtttgacaatgatctgg

SEQ ID NO: 8296131 - DNA, 22 bp, Homo sapiens
tttatctttggatcttcagaaa

SEQ ID NO: 8296132 - DNA, 20 bp, Homo sapiens
tttattggcctttcaggaac

SEQ ID NO: 8296133 - DNA, 22 bp, Homo sapiens
tttattgtgttgaaactgaatt

SEQ ID NO: 8296134 - DNA, 22 bp, Homo sapiens
tttattggatatttacaagata

SEQ ID NO: 8296135 - DNA, 22 bp, Homo sapiens
tttagcatcgaagtaaatttag

SEQ ID NO: 8296136 - DNA, 23 bp, Homo sapiens
tttagcatgaagcagctggagaa

SEQ ID NO: 8296137 - DNA, 22 bp, Homo sapiens
tttagcattactaaaatgaaaa

SEQ ID NO: 8296138 - DNA, 22 bp, Homo sapiens
tttagcttcatttggcgtgatt

SEQ ID NO: 8296139 - DNA, 23 bp, Homo sapiens
tttagcttccctttagttagggg

SEQ ID NO: 8296140 - DNA, 22 bp, Homo sapiens
tttagcttgaaagttttggagg

SEQ ID NO: 8296141 - DNA, 22 bp, Homo sapiens
tttagctttacctcatagattt

SEQ ID NO: 8296142 - DNA, 22 bp, Homo sapiens
tttagctttgaaggatatggtt

SEQ ID NO: 8296143 - DNA, 22 bp, Homo sapiens
tttagcttgttggaacaattga

SEQ ID NO: 8296144 - DNA, 22 bp, Homo sapiens
tttatctttaggactttgcaga

SEQ ID NO: 8296145 - DNA, 22 bp, Homo sapiens
tttatctggactgtgatataaa

SEQ ID NO: 8296146 - DNA, 22 bp, Homo sapiens
tttaaattatagttaatgtctg

SEQ ID NO: 8296147 - DNA, 22 bp, Homo sapiens
aataagacacacaactgtcaag

SEQ ID NO: 8296148 - DNA, 19 bp, Homo sapiens
aataatgttcatgagattg

SEQ ID NO: 8296149 - DNA, 22 bp, Homo sapiens
aataattagtgggacagagaac

SEQ ID NO: 8296150 - DNA, 22 bp, Homo sapiens
aataattacccatctttttgta

SEQ ID NO: 8296151 - DNA, 22 bp, Homo sapiens
aataattatttgagagcagacc

SEQ ID NO: 8296152 - DNA, 22 bp, Homo sapiens
actgcctgtttggcatggcccc

SEQ ID NO: 8296153 - DNA, 22 bp, Homo sapiens
aagtcacagaacccattgtaac

SEQ ID NO: 8296154 - DNA, 22 bp, Homo sapiens
aatgactaataagttttactgt

SEQ ID NO: 8296155 - DNA, 19 bp, Homo sapiens
aatgactgagtacattgtc

SEQ ID NO: 8296156 - DNA, 22 bp, Homo sapiens
acttgttttatctgtcaataga

SEQ ID NO: 8296157 - DNA, 22 bp, Homo sapiens
acttgtttacaagcagttctga

SEQ ID NO: 8296158 - DNA, 22 bp, Homo sapiens
aagtcacaagcatatatgcatt

SEQ ID NO: 8296159 - DNA, 22 bp, Homo sapiens
aagtcacaaagtgctgtacatg

SEQ ID NO: 8296160 - DNA, 22 bp, Homo sapiens
acatgtgtacatatatatgtgc

SEQ ID NO: 8296161 - DNA, 22 bp, Homo sapiens
acatgtgtacttttaaggatgt

SEQ ID NO: 8296162 - DNA, 22 bp, Homo sapiens
acatgtgtgacaacagaggtga

SEQ ID NO: 8296163 - DNA, 22 bp, Homo sapiens
acagtataccattgtgactttg

SEQ ID NO: 8296164 - DNA, 22 bp, Homo sapiens
aatgcaatgcagcacctccttg

SEQ ID NO: 8296165 - DNA, 22 bp, Homo sapiens
aattagctgtcaatgaggatct

SEQ ID NO: 8296166 - DNA, 20 bp, Homo sapiens
aattagcttaagtcaatcag

SEQ ID NO: 8296167 - DNA, 22 bp, Homo sapiens
aattagcttatgtgtacttttc

SEQ ID NO: 8296168 - DNA, 22 bp, Homo sapiens
aattagcttcagcttgtggggc

SEQ ID NO: 8296169 - DNA, 22 bp, Homo sapiens
aattagctttccgccatcacac

SEQ ID NO: 8296170 - DNA, 22 bp, Homo sapiens
aattagctttacctaggattgt

SEQ ID NO: 8296171 - DNA, 20 bp, Homo sapiens
acaaaataggtactgggtag

SEQ ID NO: 8296172 - DNA, 22 bp, Homo sapiens
aatttgtgaatctgtctcttga

SEQ ID NO: 8296173 - DNA, 22 bp, Homo sapiens
aatttgtggccacattgtggaa

SEQ ID NO: 8296174 - DNA, 22 bp, Homo sapiens
aatttgtgttagtccacgttca

SEQ ID NO: 8296175 - DNA, 22 bp, Homo sapiens
aatttgtgttatacctgctcct

SEQ ID NO: 8296176 - DNA, 22 bp, Homo sapiens
acaaatgagaatgtagacagag

SEQ ID NO: 8296177 - DNA, 22 bp, Homo sapiens
acagaaattctgggacagaaaa

SEQ ID NO: 8296178 - DNA, 22 bp, Homo sapiens
acagaaattgggcaaatggaag

SEQ ID NO: 8296179 - DNA, 22 bp, Homo sapiens
acagaacaagacctgcttattg

SEQ ID NO: 8296180 - DNA, 22 bp, Homo sapiens
agccacagggggtgagggacaa

SEQ ID NO: 8296181 - DNA, 22 bp, Homo sapiens
acagagtctcaaacctacaaag

SEQ ID NO: 8296182 - DNA, 22 bp, Homo sapiens
acagagtctgacaggtaggcgc

SEQ ID NO: 8296183 - DNA, 22 bp, Homo sapiens
acagagtctcagggatgaaagc

SEQ ID NO: 8296184 - DNA, 22 bp, Homo sapiens
acagagtcttacgtggtgataa

SEQ ID NO: 8296185 - DNA, 22 bp, Homo sapiens
agcctgcgatcccacctggcct

SEQ ID NO: 8296186 - DNA, 22 bp, Homo sapiens
acacaggtacacatatgtacct

SEQ ID NO: 8296187 - DNA, 22 bp, Homo sapiens
acacagtaggatagtttgagga

SEQ ID NO: 8296188 - DNA, 22 bp, Homo sapiens
acacagtaaatatgtattgaat

SEQ ID NO: 8296189 - DNA, 22 bp, Homo sapiens
acacagtaccccaaggctgggc

SEQ ID NO: 8296190 - DNA, 20 bp, Homo sapiens
acacagtagatgagtgactg

SEQ ID NO: 8296191 - DNA, 19 bp, Homo sapiens
aagcattagccaaagcatt

SEQ ID NO: 8296192 - DNA, 22 bp, Homo sapiens
aagacatgactgcacagccaaa

SEQ ID NO: 8296193 - DNA, 22 bp, Homo sapiens
acaaggaccatgaggcagaccc

SEQ ID NO: 8296194 - DNA, 22 bp, Homo sapiens
aacagtaaaaatcatttagttg

SEQ ID NO: 8296195 - DNA, 22 bp, Homo sapiens
aataacttcatgtaacatttaa

SEQ ID NO: 8296196 - DNA, 22 bp, Homo sapiens
aacggctgtggctggcggcagc

SEQ ID NO: 8296197 - DNA, 22 bp, Homo sapiens
aatgatatagcagacatagcct

SEQ ID NO: 8296198 - DNA, 22 bp, Homo sapiens
aatgatatttattgaatagatg

SEQ ID NO: 8296199 - DNA, 22 bp, Homo sapiens
aatgatatgcaaattatcatca

SEQ ID NO: 8296200 - DNA, 22 bp, Homo sapiens
aaataacagtcagggacaacat

SEQ ID NO: 8296201 - DNA, 22 bp, Homo sapiens
aaatagacaggcttaaatagga

SEQ ID NO: 8296202 - DNA, 22 bp, Homo sapiens
aaagtatcaagggaagcatttt

SEQ ID NO: 8296203 - DNA, 22 bp, Homo sapiens
aaagcttctaggcctattgctt

SEQ ID NO: 8296204 - DNA, 22 bp, Homo sapiens
aaagcttctattcacttacttg

SEQ ID NO: 8296205 - DNA, 22 bp, Homo sapiens
aaacattgtaattttagcatgg

SEQ ID NO: 8296206 - DNA, 22 bp, Homo sapiens
aaacattgtacattctgtagct

SEQ ID NO: 8296207 - DNA, 22 bp, Homo sapiens
aaacagtttcattttcatgacc

SEQ ID NO: 8296208 - DNA, 22 bp, Homo sapiens
aaacagtttataacatgatact

SEQ ID NO: 8296209 - DNA, 22 bp, Homo sapiens
aaacagtgactggtacataata

SEQ ID NO: 8296210 - DNA, 22 bp, Homo sapiens
aaagaatactccttttgccttg

SEQ ID NO: 8296211 - DNA, 21 bp, Homo sapiens
aaactgaccttgcctgagaca

SEQ ID NO: 8296212 - DNA, 22 bp, Homo sapiens
aaacactgtgggacatcttact

SEQ ID NO: 8296213 - DNA, 22 bp, Homo sapiens
aaaatgaataagttaacccagg

SEQ ID NO: 8296214 - DNA, 22 bp, Homo sapiens
aaagacatggaactagagatgg

SEQ ID NO: 8296215 - DNA, 22 bp, Homo sapiens
aaagacattagcttagatgtca

SEQ ID NO: 8296216 - DNA, 22 bp, Homo sapiens
aaagacatggcaagagatgggg

SEQ ID NO: 8296217 - DNA, 22 bp, Homo sapiens
aaacaaacaattagttgtgtgg

SEQ ID NO: 8296218 - DNA, 22 bp, Homo sapiens
agacagaccatggctattcaga

SEQ ID NO: 8296219 - DNA, 22 bp, Homo sapiens
agaagtcaatgatgagagtgct

SEQ ID NO: 8296220 - DNA, 21 bp, Homo sapiens
agaagtcaattgaactgaaat

SEQ ID NO: 8296221 - DNA, 22 bp, Homo sapiens
atgtgtacaaccaagcactaaa

SEQ ID NO: 8296222 - DNA, 22 bp, Homo sapiens
atgtgggccgtgcgggtgtcct

SEQ ID NO: 8296223 - DNA, 22 bp, Homo sapiens
agagcctgtaacatctttctta

SEQ ID NO: 8296224 - DNA, 22 bp, Homo sapiens
agagcctgtgattgtcatcacc

SEQ ID NO: 8296225 - DNA, 22 bp, Homo sapiens
agagccagcaagtgaatagtga

SEQ ID NO: 8296226 - DNA, 22 bp, Homo sapiens
agagccagatggagccgtgtgt

SEQ ID NO: 8296227 - DNA, 22 bp, Homo sapiens
agagccagcaactctagccctg

SEQ ID NO: 8296228 - DNA, 22 bp, Homo sapiens
agagcctgggcagctcctctgg

SEQ ID NO: 8296229 - DNA, 22 bp, Homo sapiens
agagccagagacctgggttcac

SEQ ID NO: 8296230 - DNA, 22 bp, Homo sapiens
agagccagaccattgccgtgca

SEQ ID NO: 8296231 - DNA, 19 bp, Homo sapiens
agagccagacagcatagga

SEQ ID NO: 8296232 - DNA, 22 bp, Homo sapiens
agagccacagtggataggagcc

SEQ ID NO: 8296233 - DNA, 22 bp, Homo sapiens
agaccatgacctgccactaagc

SEQ ID NO: 8296234 - DNA, 22 bp, Homo sapiens
agagacatggagaggcaaagtt

SEQ ID NO: 8296235 - DNA, 20 bp, Homo sapiens
atttggcatgaagtattgat

SEQ ID NO: 8296236 - DNA, 22 bp, Homo sapiens
atttggcaacattaattgaatc

SEQ ID NO: 8296237 - DNA, 22 bp, Homo sapiens
atttgtgaattaagcatgtcaa

SEQ ID NO: 8296238 - DNA, 17 bp, Homo sapiens
atttgtgatgtaacgtc

SEQ ID NO: 8296239 - DNA, 22 bp, Homo sapiens
atttgtgataatttgttacagc

SEQ ID NO: 8296240 - DNA, 22 bp, Homo sapiens
atttgtgatcgtgcgtgatgaa

SEQ ID NO: 8296241 - DNA, 22 bp, Homo sapiens
atttgtgggactataatgcagg

SEQ ID NO: 8296242 - DNA, 22 bp, Homo sapiens
atttgttgaataaattagtatt

SEQ ID NO: 8296243 - DNA, 22 bp, Homo sapiens
atttgtgttgtattaagctgct

SEQ ID NO: 8296244 - DNA, 22 bp, Homo sapiens
attgctgactttaatattatat

SEQ ID NO: 8296245 - DNA, 22 bp, Homo sapiens
attgctgactcaataattgaag

SEQ ID NO: 8296246 - DNA, 22 bp, Homo sapiens
attgctgaaagtattttatgac

SEQ ID NO: 8296247 - DNA, 22 bp, Homo sapiens
attgctgaaatgaaaggatatg

SEQ ID NO: 8296248 - DNA, 22 bp, Homo sapiens
atgtgtaggtgaatcgaggctg

SEQ ID NO: 8296249 - DNA, 22 bp, Homo sapiens
attattattgttgatgttaggg

SEQ ID NO: 8296250 - DNA, 22 bp, Homo sapiens
attattagacttatatggtagt

SEQ ID NO: 8296251 - DNA, 22 bp, Homo sapiens
attattaggtgctctctgacaa

SEQ ID NO: 8296252 - DNA, 22 bp, Homo sapiens
attattagtgatgttgttactg

SEQ ID NO: 8296253 - DNA, 22 bp, Homo sapiens
attattagattcttaattgtaa

SEQ ID NO: 8296254 - DNA, 22 bp, Homo sapiens
attgataaattgcaatggggct

SEQ ID NO: 8296255 - DNA, 22 bp, Homo sapiens
attcatgttagcccacatgtag

SEQ ID NO: 8296256 - DNA, 22 bp, Homo sapiens
attcatttaggtattcacttac

SEQ ID NO: 8296257 - DNA, 22 bp, Homo sapiens
caagcagagactagatagctgt

SEQ ID NO: 8296258 - DNA, 22 bp, Homo sapiens
caccaggtggaaatgtcacagc

SEQ ID NO: 8296259 - DNA, 22 bp, Homo sapiens
agcaggcaggaaggcagcactg

SEQ ID NO: 8296260 - DNA, 22 bp, Homo sapiens
cacagtgttccagagcagtggt

SEQ ID NO: 8296261 - DNA, 22 bp, Homo sapiens
agcaggcaccagggctcgtcct

SEQ ID NO: 8296262 - DNA, 17 bp, Homo sapiens
agcaggcacgtcagcac

SEQ ID NO: 8296263 - DNA, 22 bp, Homo sapiens
agcaggcacgctccctgcgcga

SEQ ID NO: 8296264 - DNA, 22 bp, Homo sapiens
agcctctgtcaagcttttcaaa

SEQ ID NO: 8296265 - DNA, 22 bp, Homo sapiens
cagcagcattgctctggattcc

SEQ ID NO: 8296266 - DNA, 22 bp, Homo sapiens
cagccctgcacgctgcctccgc

SEQ ID NO: 8296267 - DNA, 22 bp, Homo sapiens
agccacaggaaacagagacagc

SEQ ID NO: 8296268 - DNA, 22 bp, Homo sapiens
cagacatgatgtaagcagaggc

SEQ ID NO: 8296269 - DNA, 22 bp, Homo sapiens
atacattagctcatatgattaa

SEQ ID NO: 8296270 - DNA, 22 bp, Homo sapiens
actgtcacctaaattttcattg

SEQ ID NO: 8296271 - DNA, 22 bp, Homo sapiens
agaaagttaaacagtgataaga

SEQ ID NO: 8296272 - DNA, 22 bp, Homo sapiens
actttcaacttggtgggagagc

SEQ ID NO: 8296273 - DNA, 20 bp, Homo sapiens
agtgtacagacactagaaat

SEQ ID NO: 8296274 - DNA, 22 bp, Homo sapiens
agtggcagagccagggttggga

SEQ ID NO: 8296275 - DNA, 22 bp, Homo sapiens
actcctgtgggcatggcacccc

SEQ ID NO: 8296276 - DNA, 22 bp, Homo sapiens
agtcttggtccaggctcatttc

SEQ ID NO: 8296277 - DNA, 22 bp, Homo sapiens
actagtcatttaggtgatatta

SEQ ID NO: 8296278 - DNA, 22 bp, Homo sapiens
agtcaaagatgaccgagttcct

SEQ ID NO: 8296279 - DNA, 20 bp, Homo sapiens
aggtcctgttccttgtctcc

SEQ ID NO: 8296280 - DNA, 22 bp, Homo sapiens
acatgctatgagagattacttc

SEQ ID NO: 8296281 - DNA, 22 bp, Homo sapiens
aggccagggcactgctctttag

SEQ ID NO: 8296282 - DNA, 22 bp, Homo sapiens
aggccaggcctttctccattcc

SEQ ID NO: 8296283 - DNA, 22 bp, Homo sapiens
agctgaagctcagcccagtagt

SEQ ID NO: 8296284 - DNA, 22 bp, Homo sapiens
acaggtgttgactcacaggccc

SEQ ID NO: 8296285 - DNA, 22 bp, Homo sapiens
acaggtgtacaatgcatgacag

SEQ ID NO: 8296286 - DNA, 22 bp, Homo sapiens
acatagaacttcccagtgagca

SEQ ID NO: 8296287 - DNA, 22 bp, Homo sapiens
ataattatctcagacacttgtt

SEQ ID NO: 8296288 - DNA, 20 bp, Homo sapiens
ataattatttacttttgtgc

SEQ ID NO: 8296289 - DNA, 22 bp, Homo sapiens
atacatatatggtacttcctgg

SEQ ID NO: 8296290 - DNA, 22 bp, Homo sapiens
atagaatagcatagaaaattga

SEQ ID NO: 8296291 - DNA, 22 bp, Homo sapiens
ctgccctgtggttgtgggttct

SEQ ID NO: 8296292 - DNA, 22 bp, Homo sapiens
ctgccctgtttggacagcccgg

SEQ ID NO: 8296293 - DNA, 22 bp, Homo sapiens
ataagcctgattcacttgtcat

SEQ ID NO: 8296294 - DNA, 22 bp, Homo sapiens
ctgccctgtatcttctcccaat

SEQ ID NO: 8296295 - DNA, 22 bp, Homo sapiens
ctgccctgtccttcccgccggc

SEQ ID NO: 8296296 - DNA, 22 bp, Homo sapiens
ctgccctgtctgcagcctggct

SEQ ID NO: 8296297 - DNA, 22 bp, Homo sapiens
ctgccctgtgcacaggaaactg

SEQ ID NO: 8296298 - DNA, 22 bp, Homo sapiens
ctgccctgtggctctgagtcat

SEQ ID NO: 8296299 - DNA, 22 bp, Homo sapiens
ctgccctgtgagggtccttggg

SEQ ID NO: 8296300 - DNA, 22 bp, Homo sapiens
ctgccctgtgagggtccttggg

SEQ ID NO: 8296301 - DNA, 22 bp, Homo sapiens
ctgccctgtctttttctgatga

SEQ ID NO: 8296302 - DNA, 22 bp, Homo sapiens
ctgccctgacctgcctcagagt

SEQ ID NO: 8296303 - DNA, 22 bp, Homo sapiens
ctgccctgactgaccttttgaa

SEQ ID NO: 8296304 - DNA, 22 bp, Homo sapiens
ctgccctgtagctgttctagca

SEQ ID NO: 8296305 - DNA, 22 bp, Homo sapiens
ctgccctggtcccatggctgat

SEQ ID NO: 8296306 - DNA, 18 bp, Homo sapiens
ctgccccttctctgagat

SEQ ID NO: 8296307 - DNA, 22 bp, Homo sapiens
ctgccctcccagttggtccgtg

SEQ ID NO: 8296308 - DNA, 22 bp, Homo sapiens
agtttcttgaagactgatgttt

SEQ ID NO: 8296309 - DNA, 22 bp, Homo sapiens
ctgagtgggtttctgcttgtca

SEQ ID NO: 8296310 - DNA, 22 bp, Homo sapiens
ctgatatgatgggtgattttca

SEQ ID NO: 8296311 - DNA, 22 bp, Homo sapiens
ctgatattctttgagctgctaa

SEQ ID NO: 8296312 - DNA, 22 bp, Homo sapiens
ctgatattctattttgcttgct

SEQ ID NO: 8296313 - DNA, 22 bp, Homo sapiens
ctgatattattgaagctggagt

SEQ ID NO: 8296314 - DNA, 22 bp, Homo sapiens
ctgatattcattatggagctcc

SEQ ID NO: 8296315 - DNA, 22 bp, Homo sapiens
cttcagcagatgtgctagagat

SEQ ID NO: 8296316 - DNA, 23 bp, Homo sapiens
cttcagcagaaacataaattctc

SEQ ID NO: 8296317 - DNA, 22 bp, Homo sapiens
cttcagcagatgcaaaacccct

SEQ ID NO: 8296318 - DNA, 22 bp, Homo sapiens
cttcagcacctcagctggagag

SEQ ID NO: 8296319 - DNA, 22 bp, Homo sapiens
cttcagcaactttggaatgttt

SEQ ID NO: 8296320 - DNA, 21 bp, Homo sapiens
cttcagcaaatacttggcagg

SEQ ID NO: 8296321 - DNA, 22 bp, Homo sapiens
cttcagcaccatagctccttct

SEQ ID NO: 8296322 - DNA, 19 bp, Homo sapiens
cttcagcatctccggagct

SEQ ID NO: 8296323 - DNA, 22 bp, Homo sapiens
cttcagcagcctcttgcataaa

SEQ ID NO: 8296324 - DNA, 22 bp, Homo sapiens
atcattaaatataagcttcaca

SEQ ID NO: 8296325 - DNA, 22 bp, Homo sapiens
atagtcactgccttccatttgt

SEQ ID NO: 8296326 - DNA, 22 bp, Homo sapiens
ctgggccagggaggtgtctgta

SEQ ID NO: 8296327 - DNA, 22 bp, Homo sapiens
ctgggccatcagaggggctgga

SEQ ID NO: 8296328 - DNA, 22 bp, Homo sapiens
ctgtatgaaattgtcattttta

SEQ ID NO: 8296329 - DNA, 22 bp, Homo sapiens
ctgtatgattccatttctataa

SEQ ID NO: 8296330 - DNA, 22 bp, Homo sapiens
atatttgttagagtctatgtgt

SEQ ID NO: 8296331 - DNA, 22 bp, Homo sapiens
atatttgttgagttcttatgat

SEQ ID NO: 8296332 - DNA, 22 bp, Homo sapiens
atatttgtttggcagagttcag

SEQ ID NO: 8296333 - DNA, 23 bp, Homo sapiens
ctgggctgtcctgaggtcacctc

SEQ ID NO: 8296334 - DNA, 22 bp, Homo sapiens
ctgggctgtcaatggccctctg

SEQ ID NO: 8296335 - DNA, 22 bp, Homo sapiens
ctgggctgtcccagggcggcag

SEQ ID NO: 8296336 - DNA, 22 bp, Homo sapiens
agtcacatttgggggtgtcaaa

SEQ ID NO: 8296337 - DNA, 19 bp, Homo sapiens
cgcctggcaggccctgcgc

SEQ ID NO: 8296338 - DNA, 22 bp, Homo sapiens
agtcagggcctggcctgctgaa

SEQ ID NO: 8296339 - DNA, 22 bp, Homo sapiens
aggtcctgtctatcaccctcgc

SEQ ID NO: 8296340 - DNA, 22 bp, Homo sapiens
aggtcctgtccttggtctctga

SEQ ID NO: 8296341 - DNA, 19 bp, Homo sapiens
aggtctgcagctgcagttt

SEQ ID NO: 8296342 - DNA, 23 bp, Homo sapiens
cctgggtttcagagctgcttttc

SEQ ID NO: 8296343 - DNA, 22 bp, Homo sapiens
cctgggttattttggtctagtg

SEQ ID NO: 8296344 - DNA, 22 bp, Homo sapiens
cctgggttagtatctgtttcca

SEQ ID NO: 8296345 - DNA, 22 bp, Homo sapiens
cctggctcaggcacgcatggct

SEQ ID NO: 8296346 - DNA, 22 bp, Homo sapiens
cctggctcagaccccagttctg

SEQ ID NO: 8296347 - DNA, 22 bp, Homo sapiens
ctctgtttggcgctgctccttc

SEQ ID NO: 8296348 - DNA, 22 bp, Homo sapiens
agtgcaggccccaggccaggcc

SEQ ID NO: 8296349 - DNA, 18 bp, Homo sapiens
ctctctgggtgaggacaa

SEQ ID NO: 8296350 - DNA, 22 bp, Homo sapiens
agtccaaggccatacagttgtg

SEQ ID NO: 8296351 - DNA, 22 bp, Homo sapiens
catggcactgagcaggtatgca

SEQ ID NO: 8296352 - DNA, 22 bp, Homo sapiens
catggacagtgggacagtgtgt

SEQ ID NO: 8296353 - DNA, 22 bp, Homo sapiens
ccaaggactggacacacaggtt

SEQ ID NO: 8296354 - DNA, 22 bp, Homo sapiens
catttgaaattcttagaacaaa

SEQ ID NO: 8296355 - DNA, 22 bp, Homo sapiens
aggacatgtaaatggagaggga

SEQ ID NO: 8296356 - DNA, 22 bp, Homo sapiens
cagtgggtggctaagtggctga

SEQ ID NO: 8296357 - DNA, 22 bp, Homo sapiens
cagtgggtggcctcttgagtca

SEQ ID NO: 8296358 - DNA, 22 bp, Homo sapiens
catagtgtctggtaacatagta

SEQ ID NO: 8296359 - DNA, 22 bp, Homo sapiens
catagtaaataatgcagatgat

SEQ ID NO: 8296360 - DNA, 22 bp, Homo sapiens
caggcactggccagtcagcaca

SEQ ID NO: 8296361 - DNA, 22 bp, Homo sapiens
agctgccacagagcctggccag

SEQ ID NO: 8296362 - DNA, 22 bp, Homo sapiens
cagggatgggatggagtcagtt

SEQ ID NO: 8296363 - DNA, 22 bp, Homo sapiens
ccacaggaagttatgagtacta

SEQ ID NO: 8296364 - DNA, 17 bp, Homo sapiens
aggcaggtaagagttat

SEQ ID NO: 8296365 - DNA, 22 bp, Homo sapiens
ccagcactgctctcagactgag

SEQ ID NO: 8296366 - DNA, 22 bp, Homo sapiens
ccagcctgaaatgcctcatcct

SEQ ID NO: 8296367 - DNA, 19 bp, Homo sapiens
ccagcctctcttccacccc

SEQ ID NO: 8296368 - DNA, 22 bp, Homo sapiens
ccatgtgcttgctctggcacct

SEQ ID NO: 8296369 - DNA, 22 bp, Homo sapiens
cctgagctttaaaagccatgta

SEQ ID NO: 8296370 - DNA, 22 bp, Homo sapiens
cctctggcttactgttgggttt

SEQ ID NO: 8296371 - DNA, 22 bp, Homo sapiens
cctctgggaagccagtcctgct

SEQ ID NO: 8296372 - DNA, 22 bp, Homo sapiens
cctctgggcaggtagcagcagc

SEQ ID NO: 8296373 - DNA, 22 bp, Homo sapiens
ccctctggctcttctcaggccg

SEQ ID NO: 8296374 - DNA, 17 bp, Homo sapiens
ccctctggggagggagg

SEQ ID NO: 8296375 - DNA, 22 bp, Homo sapiens
atttgtagtgaagtgaaaataa

SEQ ID NO: 8296376 - DNA, 22 bp, Homo sapiens
atttgtcaaaacacagagaaca

SEQ ID NO: 8296377 - DNA, 22 bp, Homo sapiens
atttgtcaataagatgaacata

SEQ ID NO: 8296378 - DNA, 22 bp, Homo sapiens
attttgataatcatgttagaga

SEQ ID NO: 8296379 - DNA, 22 bp, Homo sapiens
caaagactgcataacacatgaa

SEQ ID NO: 8296380 - DNA, 20 bp, Homo sapiens
caaagacatgctaggggtgg

SEQ ID NO: 8296381 - DNA, 22 bp, Homo sapiens
gcccaggttggagagcagtggc

SEQ ID NO: 8296382 - DNA, 22 bp, Homo sapiens
atttatgacaaccaaagagtga

SEQ ID NO: 8296383 - DNA, 21 bp, Homo sapiens
atttagaaggaaattttgcaa

SEQ ID NO: 8296384 - DNA, 22 bp, Homo sapiens
atttatgactggtgaatagaac

SEQ ID NO: 8296385 - DNA, 22 bp, Homo sapiens
gccatcatatcccctgtgacct

SEQ ID NO: 8296386 - DNA, 22 bp, Homo sapiens
gcacacagattaggaaacagaa

SEQ ID NO: 8296387 - DNA, 22 bp, Homo sapiens
gcacacagactaaccatatttc

SEQ ID NO: 8296388 - DNA, 22 bp, Homo sapiens
gcacacagctagattaccattc

SEQ ID NO: 8296389 - DNA, 22 bp, Homo sapiens
gcacacaggcagtttccagcca

SEQ ID NO: 8296390 - DNA, 22 bp, Homo sapiens
attaaattggacgctgggggaa

SEQ ID NO: 8296391 - DNA, 22 bp, Homo sapiens
attaaattggatctgcatagtt

SEQ ID NO: 8296392 - DNA, 22 bp, Homo sapiens
attaaattttcactaggctccc

SEQ ID NO: 8296393 - DNA, 23 bp, Homo sapiens
atgttattattagcagtcttgcc

SEQ ID NO: 8296394 - DNA, 22 bp, Homo sapiens
atgttattaaagtacagattct

SEQ ID NO: 8296395 - DNA, 22 bp, Homo sapiens
gcaggcaggagcccaactgcct

SEQ ID NO: 8296396 - DNA, 22 bp, Homo sapiens
attcttttcccaactgctttaa

SEQ ID NO: 8296397 - DNA, 22 bp, Homo sapiens
atctttctatggtactttctcc

SEQ ID NO: 8296398 - DNA, 22 bp, Homo sapiens
cttctcctctgagtcctgggag

SEQ ID NO: 8296399 - DNA, 22 bp, Homo sapiens
ctttagaaatctggatgtattt

SEQ ID NO: 8296400 - DNA, 22 bp, Homo sapiens
ctttattagatgtagactttct

SEQ ID NO: 8296401 - DNA, 22 bp, Homo sapiens
cttgttttaaactgttgtggct

SEQ ID NO: 8296402 - DNA, 17 bp, Homo sapiens
cttgttttccactggga

SEQ ID NO: 8296403 - DNA, 22 bp, Homo sapiens
atgagaggtttcgtcagaggaa

SEQ ID NO: 8296404 - DNA, 22 bp, Homo sapiens
gaaggatttgagattatcctag

SEQ ID NO: 8296405 - DNA, 22 bp, Homo sapiens
atgatgttaccagtacttagag

SEQ ID NO: 8296406 - DNA, 22 bp, Homo sapiens
atgatgtgtgctgatcaagctt

SEQ ID NO: 8296407 - DNA, 22 bp, Homo sapiens
atgatgttgataaattacttta

SEQ ID NO: 8296408 - DNA, 22 bp, Homo sapiens
gagcccgagcgcgtacccggcg

SEQ ID NO: 8296409 - DNA, 22 bp, Homo sapiens
atgtagctgcagatgataatgc

SEQ ID NO: 8296410 - DNA, 22 bp, Homo sapiens
atgtatcacagcaatgtagtca

SEQ ID NO: 8296411 - DNA, 22 bp, Homo sapiens
cagacacagatatgcatatggc

SEQ ID NO: 8296412 - DNA, 18 bp, Homo sapiens
cagacactctgctctgca

SEQ ID NO: 8296413 - DNA, 22 bp, Homo sapiens
cagagccaaatgctgtggttat

SEQ ID NO: 8296414 - DNA, 20 bp, Homo sapiens
cagagccaagagcagcatct

SEQ ID NO: 8296415 - DNA, 22 bp, Homo sapiens
cagagacaacctggtagagaaa

SEQ ID NO: 8296416 - DNA, 22 bp, Homo sapiens
cagagacacttaacaggaatgg

SEQ ID NO: 8296417 - DNA, 22 bp, Homo sapiens
cagagcactgcttggaggattt

SEQ ID NO: 8296418 - DNA, 22 bp, Homo sapiens
ggtcctggcagctctgtgtcca

SEQ ID NO: 8296419 - DNA, 22 bp, Homo sapiens
ggtcctggcagtctttggttgt

SEQ ID NO: 8296420 - DNA, 22 bp, Homo sapiens
cagagccagcagtggggacagg

SEQ ID NO: 8296421 - DNA, 22 bp, Homo sapiens
cagagccacttggagatgagaa

SEQ ID NO: 8296422 - DNA, 22 bp, Homo sapiens
gtagggagcccagagcccagtg

SEQ ID NO: 8296423 - DNA, 22 bp, Homo sapiens
gtcctggtcctgcctccccatg

SEQ ID NO: 8296424 - DNA, 22 bp, Homo sapiens
gtcctggtggagtctctgggga

SEQ ID NO: 8296425 - DNA, 17 bp, Homo sapiens
gtcctggtgtgtgagga

SEQ ID NO: 8296426 - DNA, 22 bp, Homo sapiens
gtcctggtgccacctgcgggat

SEQ ID NO: 8296427 - DNA, 22 bp, Homo sapiens
gtcctggttttcacagaccttt

SEQ ID NO: 8296428 - DNA, 22 bp, Homo sapiens
cagccctgaaacaacctcctct

SEQ ID NO: 8296429 - DNA, 22 bp, Homo sapiens
cacacaggtatatatatgtaca

SEQ ID NO: 8296430 - DNA, 22 bp, Homo sapiens
gctgcctgcacagagctgcttt

SEQ ID NO: 8296431 - DNA, 22 bp, Homo sapiens
gctggctgaggtctagctcttt

SEQ ID NO: 8296432 - DNA, 22 bp, Homo sapiens
gctggctgagttctgtcgtctg

SEQ ID NO: 8296433 - DNA, 22 bp, Homo sapiens
cacattattctaaagaggtact

SEQ ID NO: 8296434 - DNA, 22 bp, Homo sapiens
cacatgtgcaaatactgaggct

SEQ ID NO: 8296435 - DNA, 21 bp, Homo sapiens
cacatgtgaattactgaactg

SEQ ID NO: 8296436 - DNA, 22 bp, Homo sapiens
cacatgtgcagttacatgaatt

SEQ ID NO: 8296437 - DNA, 22 bp, Homo sapiens
cacatgtgtatatgtgaggggg

SEQ ID NO: 8296438 - DNA, 22 bp, Homo sapiens
cacatgtgtgctgaggactgtg

SEQ ID NO: 8296439 - DNA, 22 bp, Homo sapiens
ggcagagtcagaggtggttctg

SEQ ID NO: 8296440 - DNA, 22 bp, Homo sapiens
ggcagagtgctctgggcagggg

SEQ ID NO: 8296441 - DNA, 22 bp, Homo sapiens
cacagtaagaaatgaagaggta

SEQ ID NO: 8296442 - DNA, 22 bp, Homo sapiens
cacagtaaccccaggactggga

SEQ ID NO: 8296443 - DNA, 22 bp, Homo sapiens
cacaggtatatgtgtatatact

SEQ ID NO: 8296444 - DNA, 19 bp, Homo sapiens
cactagtctagatgggatg

SEQ ID NO: 8296445 - DNA, 22 bp, Homo sapiens
cactagtcctggtttcatgcta

SEQ ID NO: 8296446 - DNA, 22 bp, Homo sapiens
ggccaggctggtctcagacttc

SEQ ID NO: 8296447 - DNA, 22 bp, Homo sapiens
cagtgggtaggaaaggctcttc

SEQ ID NO: 8296448 - DNA, 22 bp, Homo sapiens
tcacagactgtgttgctactca

SEQ ID NO: 8296449 - DNA, 22 bp, Homo sapiens
cagtagtctttttcctcctaga

SEQ ID NO: 8296450 - DNA, 22 bp, Homo sapiens
tagctattgttggtagttaccc

SEQ ID NO: 8296451 - DNA, 22 bp, Homo sapiens
tagctatttggaaaattccaat

SEQ ID NO: 8296452 - DNA, 22 bp, Homo sapiens
tatcataagttaattaaacagt

SEQ ID NO: 8296453 - DNA, 22 bp, Homo sapiens
tagataatttggcatcatattg

SEQ ID NO: 8296454 - DNA, 22 bp, Homo sapiens
tagcattatttcctctttttgt

SEQ ID NO: 8296455 - DNA, 22 bp, Homo sapiens
tagcattccatcactcagcacc

SEQ ID NO: 8296456 - DNA, 22 bp, Homo sapiens
tagcattatctgtcttatcatt

SEQ ID NO: 8296457 - DNA, 22 bp, Homo sapiens
tagcattagtcagatatgtttt

SEQ ID NO: 8296458 - DNA, 21 bp, Homo sapiens
tcatttattgagaaatgactg

SEQ ID NO: 8296459 - DNA, 22 bp, Homo sapiens
tcatttatgcaggaatggcata

SEQ ID NO: 8296460 - DNA, 20 bp, Homo sapiens
tccaagccctccttccattc

SEQ ID NO: 8296461 - DNA, 22 bp, Homo sapiens
catgtgtggttacctacttgac

SEQ ID NO: 8296462 - DNA, 22 bp, Homo sapiens
catgtgtgtccatgtgactaag

SEQ ID NO: 8296463 - DNA, 22 bp, Homo sapiens
catgtgtgtggacgagcgtggc

SEQ ID NO: 8296464 - DNA, 22 bp, Homo sapiens
catgtgtgtgagggaaacatgt

SEQ ID NO: 8296465 - DNA, 22 bp, Homo sapiens
catttgtagtatctgtttatat

SEQ ID NO: 8296466 - DNA, 22 bp, Homo sapiens
catttgtagttaaaaatgtctc

SEQ ID NO: 8296467 - DNA, 22 bp, Homo sapiens
catttgtatagtgcttagacca

SEQ ID NO: 8296468 - DNA, 22 bp, Homo sapiens
catttgtatgttcctccttagg

SEQ ID NO: 8296469 - DNA, 22 bp, Homo sapiens
catttgtatctgggctgctgtg

SEQ ID NO: 8296470 - DNA, 22 bp, Homo sapiens
catttgtatcatatgtatctta

SEQ ID NO: 8296471 - DNA, 22 bp, Homo sapiens
catttgtaggatgcttcttgtt

SEQ ID NO: 8296472 - DNA, 22 bp, Homo sapiens
catttgtagctatttactgtat

SEQ ID NO: 8296473 - DNA, 22 bp, Homo sapiens
catttgtacagaacagctttat

SEQ ID NO: 8296474 - DNA, 22 bp, Homo sapiens
catttgtaatactgacttgcag

SEQ ID NO: 8296475 - DNA, 22 bp, Homo sapiens
tcctagaagatggatcagagaa

SEQ ID NO: 8296476 - DNA, 22 bp, Homo sapiens
cattgaatccttccttcagaag

SEQ ID NO: 8296477 - DNA, 22 bp, Homo sapiens
cattgcaacttcaaactcctgg

SEQ ID NO: 8296478 - DNA, 22 bp, Homo sapiens
tctgaatgcacttagttaccaa

SEQ ID NO: 8296479 - DNA, 22 bp, Homo sapiens
tctgaatgttaggaaactttct

SEQ ID NO: 8296480 - DNA, 22 bp, Homo sapiens
tctgaatgtatcgaattgaggc

SEQ ID NO: 8296481 - DNA, 19 bp, Homo sapiens
tctgaatgggatgagttgg

SEQ ID NO: 8296482 - DNA, 19 bp, Homo sapiens
ccagccctgtcacttcttg

SEQ ID NO: 8296483 - DNA, 22 bp, Homo sapiens
ccagcagctttattggctctcc

SEQ ID NO: 8296484 - DNA, 22 bp, Homo sapiens
tctctgggaatgggcctgggta

SEQ ID NO: 8296485 - DNA, 19 bp, Homo sapiens
ccactttgcttctctgggt

SEQ ID NO: 8296486 - DNA, 22 bp, Homo sapiens
tcggggtctttgacacgctctg

SEQ ID NO: 8296487 - DNA, 22 bp, Homo sapiens
tgattacattggtaatgtttat

SEQ ID NO: 8296488 - DNA, 22 bp, Homo sapiens
tgattacagtatttgagatcca

SEQ ID NO: 8296489 - DNA, 23 bp, Homo sapiens
tgattacaggaagttcaagtgtt

SEQ ID NO: 8296490 - DNA, 22 bp, Homo sapiens
tgattacacagcagtaatttca

SEQ ID NO: 8296491 - DNA, 22 bp, Homo sapiens
tgattacactatttgggaatag

SEQ ID NO: 8296492 - DNA, 22 bp, Homo sapiens
tgatgacaaactttcctgatgc

SEQ ID NO: 8296493 - DNA, 22 bp, Homo sapiens
tgaacagatcaatagaactgac

SEQ ID NO: 8296494 - DNA, 22 bp, Homo sapiens
tgaacagatggcccagcagagg

SEQ ID NO: 8296495 - DNA, 23 bp, Homo sapiens
tcttgtttcctttgcgctatcca

SEQ ID NO: 8296496 - DNA, 22 bp, Homo sapiens
tcttgtttctgtatataatgac

SEQ ID NO: 8296497 - DNA, 22 bp, Homo sapiens
tcttgtttcttctaagcagcag

SEQ ID NO: 8296498 - DNA, 22 bp, Homo sapiens
tcttgtttggattttgggcagt

SEQ ID NO: 8296499 - DNA, 22 bp, Homo sapiens
tcttgttttgaactcatcagga

SEQ ID NO: 8296500 - DNA, 22 bp, Homo sapiens
ccagcccttgaggtctgtccat

SEQ ID NO: 8296501 - DNA, 22 bp, Homo sapiens
ccagcctcactggcatcaccta

SEQ ID NO: 8296502 - DNA, 22 bp, Homo sapiens
tctttaatataaaggaatgaat

SEQ ID NO: 8296503 - DNA, 22 bp, Homo sapiens
tctttaagccaagatatattta

SEQ ID NO: 8296504 - DNA, 19 bp, Homo sapiens
ccaggcctggcgtctccgc

SEQ ID NO: 8296505 - DNA, 22 bp, Homo sapiens
tgacagagcatgtagtgacagc

SEQ ID NO: 8296506 - DNA, 22 bp, Homo sapiens
tgagaggtgaggcatgaggcat

SEQ ID NO: 8296507 - DNA, 22 bp, Homo sapiens
ccctagaacacgcagacactga

SEQ ID NO: 8296508 - DNA, 22 bp, Homo sapiens
ccctgctcttagtgcctgtgtg

SEQ ID NO: 8296509 - DNA, 22 bp, Homo sapiens
tggctacatcacagagaattcc

SEQ ID NO: 8296510 - DNA, 22 bp, Homo sapiens
tgtaatgatgtacttagaagga

SEQ ID NO: 8296511 - DNA, 22 bp, Homo sapiens
tgtaatgagtcacttaccttaa

SEQ ID NO: 8296512 - DNA, 22 bp, Homo sapiens
tgtaatgagaaagagagtgaat

SEQ ID NO: 8296513 - DNA, 22 bp, Homo sapiens
tgtacatagatcttgaaaatta

SEQ ID NO: 8296514 - DNA, 22 bp, Homo sapiens
tgtacatacatagatatacaca

SEQ ID NO: 8296515 - DNA, 22 bp, Homo sapiens
tgggccactcttccctgggtct

SEQ ID NO: 8296516 - DNA, 22 bp, Homo sapiens
cctctggcctaggccgggagag

SEQ ID NO: 8296517 - DNA, 22 bp, Homo sapiens
cctgaatgcctgacatttcact

SEQ ID NO: 8296518 - DNA, 22 bp, Homo sapiens
cctgaggtcacaacttgcttat

SEQ ID NO: 8296519 - DNA, 22 bp, Homo sapiens
cctgagctggcagtgacctgga

SEQ ID NO: 8296520 - DNA, 22 bp, Homo sapiens
ctctggctcccgcagcccccat

SEQ ID NO: 8296521 - DNA, 22 bp, Homo sapiens
ctctggctccatttccctatgt

SEQ ID NO: 8296522 - DNA, 22 bp, Homo sapiens
tttcattaaagtcaaatctggt

SEQ ID NO: 8296523 - DNA, 22 bp, Homo sapiens
tttctacagctggtgcaacttt

SEQ ID NO: 8296524 - DNA, 22 bp, Homo sapiens
ctgaggtctattttgaaactgc

SEQ ID NO: 8296525 - DNA, 22 bp, Homo sapiens
ctgagcatttgtgcagcttctc

SEQ ID NO: 8296526 - DNA, 23 bp, Homo sapiens
ctgaggtctgcaattctagtagt

SEQ ID NO: 8296527 - DNA, 22 bp, Homo sapiens
ctgcccctgccaggcagctgtc

SEQ ID NO: 8296528 - DNA, 22 bp, Homo sapiens
ctgctgtctagtatcttaaaaa

SEQ ID NO: 8296529 - DNA, 22 bp, Homo sapiens
ctgctgaagttgttggtctttt

SEQ ID NO: 8296530 - DNA, 22 bp, Homo sapiens
ctgctgaaaacaataatgatga

SEQ ID NO: 8296531 - DNA, 22 bp, Homo sapiens
ctgcctgtttcctcttgctccc

SEQ ID NO: 8296532 - DNA, 22 bp, Homo sapiens
ctgcctgtggtctgtgatctaa

SEQ ID NO: 8296533 - DNA, 22 bp, Homo sapiens
cgtgtacacgcacacgtgtcct

SEQ ID NO: 8296534 - DNA, 22 bp, Homo sapiens
ttctggcttgacccctacttcc

SEQ ID NO: 8296535 - DNA, 22 bp, Homo sapiens
ttctggcttatcctaactctaa

SEQ ID NO: 8296536 - DNA, 22 bp, Homo sapiens
ttctggctccagatgcttctgt

SEQ ID NO: 8296537 - DNA, 22 bp, Homo sapiens
ttctggctgcagtccctgtaat

SEQ ID NO: 8296538 - DNA, 22 bp, Homo sapiens
ttctggctctcccctgctgggt

SEQ ID NO: 8296539 - DNA, 18 bp, Homo sapiens
ttctggctcactcatgct

SEQ ID NO: 8296540 - DNA, 22 bp, Homo sapiens
ctcagtctcttgggctgtgaag

SEQ ID NO: 8296541 - DNA, 22 bp, Homo sapiens
ctcagtccttatttgcctctac

SEQ ID NO: 8296542 - DNA, 22 bp, Homo sapiens
ctcagtccgtcccgctaggtgc

SEQ ID NO: 8296543 - DNA, 22 bp, Homo sapiens
ttgcagaaaacagttttcttgt

SEQ ID NO: 8296544 - DNA, 17 bp, Homo sapiens
ttgccctgatttttaac

SEQ ID NO: 8296545 - DNA, 16 bp, Homo sapiens
ttgccctgaggggagg

SEQ ID NO: 8296546 - DNA, 22 bp, Homo sapiens
ttgccctgaagaacgtcccaga

SEQ ID NO: 8296547 - DNA, 22 bp, Homo sapiens
ttgccctgcagcggtgagtggt

SEQ ID NO: 8296548 - DNA, 22 bp, Homo sapiens
ttgccctgcctccctgaggtga

SEQ ID NO: 8296549 - DNA, 22 bp, Homo sapiens
ttgccctgtctcactatgttaa

SEQ ID NO: 8296550 - DNA, 22 bp, Homo sapiens
ttgccctgtcagtagaagtgca

SEQ ID NO: 8296551 - DNA, 22 bp, Homo sapiens
ttgccctgtcttaagctggcaa

SEQ ID NO: 8296552 - DNA, 22 bp, Homo sapiens
ttgccctgcgttaccatctctt

SEQ ID NO: 8296553 - DNA, 22 bp, Homo sapiens
ttgccctgcgggtcctgcgcaa

SEQ ID NO: 8296554 - DNA, 22 bp, Homo sapiens
ttgccctggggctggcctggca

SEQ ID NO: 8296555 - DNA, 22 bp, Homo sapiens
ttgccctgtggggcctccagcc

SEQ ID NO: 8296556 - DNA, 22 bp, Homo sapiens
ctcagggcagtatggctgagag

SEQ ID NO: 8296557 - DNA, 21 bp, Homo sapiens
ttagcaaagcaaacacatgct

SEQ ID NO: 8296558 - DNA, 22 bp, Homo sapiens
ccttcagcctagaacttgagag

SEQ ID NO: 8296559 - DNA, 22 bp, Homo sapiens
ttacatagttaaatagtacagc

SEQ ID NO: 8296560 - DNA, 22 bp, Homo sapiens
ttacataaaagttcacgtaggc

SEQ ID NO: 8296561 - DNA, 22 bp, Homo sapiens
ttatcacttatgagctttttgc

SEQ ID NO: 8296562 - DNA, 22 bp, Homo sapiens
ttagttttcccatctttatggt

SEQ ID NO: 8296563 - DNA, 22 bp, Homo sapiens
ccttacaatgcagtttacttag

SEQ ID NO: 8296564 - DNA, 18 bp, Homo sapiens
cctgtgtgtgttgcaggc

SEQ ID NO: 8296565 - DNA, 22 bp, Homo sapiens
ccttagcattagaagctgtggg

SEQ ID NO: 8296566 - DNA, 22 bp, Homo sapiens
ccttagcatggctgtgctgtgt

SEQ ID NO: 8296567 - DNA, 22 bp, Homo sapiens
ccttagcaaattggcatcttct

SEQ ID NO: 8296568 - DNA, 22 bp, Homo sapiens
ccttagcaacacttagcaactg

SEQ ID NO: 8296569 - DNA, 22 bp, Homo sapiens
ccttagcaactgtcatagagca

SEQ ID NO: 8296570 - DNA, 22 bp, Homo sapiens
ccttagcagggagtctgtccag

SEQ ID NO: 8296571 - DNA, 22 bp, Homo sapiens
ccttagcagggccgggcctggg

SEQ ID NO: 8296572 - DNA, 22 bp, Homo sapiens
ttacaaagattatattcagtta

SEQ ID NO: 8296573 - DNA, 22 bp, Homo sapiens
ttacaaagcaggtcagctgaaa

SEQ ID NO: 8296574 - DNA, 22 bp, Homo sapiens
ttacaaagcgctttacctctga

SEQ ID NO: 8296575 - DNA, 22 bp, Homo sapiens
ttacaaagcgttgagacaagta

SEQ ID NO: 8296576 - DNA, 22 bp, Homo sapiens
ttacagtttagtccaagccaga

SEQ ID NO: 8296577 - DNA, 22 bp, Homo sapiens
ttaaattccagcctcataatag

SEQ ID NO: 8296578 - DNA, 22 bp, Homo sapiens
ttaaattttagaaacagactct

SEQ ID NO: 8296579 - DNA, 22 bp, Homo sapiens
ttaaattgtcatttgagcaatg

SEQ ID NO: 8296580 - DNA, 22 bp, Homo sapiens
tgtcaatagttttgagttctct

SEQ ID NO: 8296581 - DNA, 22 bp, Homo sapiens
cgtggctggtggacctgagggc

SEQ ID NO: 8296582 - DNA, 20 bp, Homo sapiens
ctgggctcggtggccctggc

SEQ ID NO: 8296583 - DNA, 22 bp, Homo sapiens
ctgggctctagaaaggaaagaa

SEQ ID NO: 8296584 - DNA, 22 bp, Homo sapiens
ctgggcccacgagggctctggg

SEQ ID NO: 8296585 - DNA, 22 bp, Homo sapiens
ctgggcccaggcggctctcgga

SEQ ID NO: 8296586 - DNA, 22 bp, Homo sapiens
ctgggctcagcaggccaaggcc

SEQ ID NO: 8296587 - DNA, 22 bp, Homo sapiens
ctgggccctatggaagaaaggg

SEQ ID NO: 8296588 - DNA, 22 bp, Homo sapiens
ctgtgggctcctgcagctcagg

SEQ ID NO: 8296589 - DNA, 22 bp, Homo sapiens
ctgtgttttgattaaaaagcaa

SEQ ID NO: 8296590 - DNA, 22 bp, Homo sapiens
ctgtggtgagcaactgactgaa

SEQ ID NO: 8296591 - DNA, 22 bp, Homo sapiens
gaattacagccagaagaatgaa

SEQ ID NO: 8296592 - DNA, 22 bp, Homo sapiens
gaattacaaagtgagacaagct

SEQ ID NO: 8296593 - DNA, 22 bp, Homo sapiens
gactagtcatttgcattccgtc

SEQ ID NO: 8296594 - DNA, 22 bp, Homo sapiens
gagagcatgtggtctagtttta

SEQ ID NO: 8296595 - DNA, 22 bp, Homo sapiens
gagaactttctgtgtttttatc

SEQ ID NO: 8296596 - DNA, 22 bp, Homo sapiens
gagcagcttgcgctgtcttcac

SEQ ID NO: 8296597 - DNA, 22 bp, Homo sapiens
gagggtggcctttagagcccat

SEQ ID NO: 8296598 - DNA, 22 bp, Homo sapiens
gagctccacttagcaaggccac

SEQ ID NO: 8296599 - DNA, 22 bp, Homo sapiens
gagctccaccaccttcaggcag

SEQ ID NO: 8296600 - DNA, 22 bp, Homo sapiens
gagctccagcatctctgccaaa

SEQ ID NO: 8296601 - DNA, 22 bp, Homo sapiens
gagctccaccaccttcaggcag

SEQ ID NO: 8296602 - DNA, 22 bp, Homo sapiens
gaggcctggaccagccacagag

SEQ ID NO: 8296603 - DNA, 22 bp, Homo sapiens
gaggcctggaattccagcctgg

SEQ ID NO: 8296604 - DNA, 22 bp, Homo sapiens
taacagtattgaagataaacta

SEQ ID NO: 8296605 - DNA, 20 bp, Homo sapiens
taacagtaagtgatgttaca

SEQ ID NO: 8296606 - DNA, 22 bp, Homo sapiens
taacagtaaagtaagttagctt

SEQ ID NO: 8296607 - DNA, 22 bp, Homo sapiens
taacagtatagcctaacatttc

SEQ ID NO: 8296608 - DNA, 22 bp, Homo sapiens
taaatgataataatgctagtgt

SEQ ID NO: 8296609 - DNA, 22 bp, Homo sapiens
taaatgatttatgtatgtgaaa

SEQ ID NO: 8296610 - DNA, 22 bp, Homo sapiens
gttaaattcgatgatggataaa

SEQ ID NO: 8296611 - DNA, 22 bp, Homo sapiens
gttctttaagtggagaaggaaa

SEQ ID NO: 8296612 - DNA, 22 bp, Homo sapiens
tacacagaacctggtgtacagt

SEQ ID NO: 8296613 - DNA, 22 bp, Homo sapiens
tacacagaaattgtgtagggat

SEQ ID NO: 8296614 - DNA, 22 bp, Homo sapiens
taattattatgacaacaattgc

SEQ ID NO: 8296615 - DNA, 22 bp, Homo sapiens
taagcttcaaagaacatattgg

SEQ ID NO: 8296616 - DNA, 22 bp, Homo sapiens
taagcattcaatgcttagcact

SEQ ID NO: 8296617 - DNA, 22 bp, Homo sapiens
tactcctgctgatcctgccagc

SEQ ID NO: 8296618 - DNA, 22 bp, Homo sapiens
tactagtcttctgctattccct

SEQ ID NO: 8296619 - DNA, 22 bp, Homo sapiens
tactaggaagcagctgcattgg

SEQ ID NO: 8296620 - DNA, 22 bp, Homo sapiens
tacagagatttattgctaaggc

SEQ ID NO: 8296621 - DNA, 22 bp, Homo sapiens
tacagagagtacagcatccaca

SEQ ID NO: 8296622 - DNA, 22 bp, Homo sapiens
tacagagatgccgaagagtgaa

SEQ ID NO: 8296623 - DNA, 22 bp, Homo sapiens
tatcattttactgtgacatttt

SEQ ID NO: 8296624 - DNA, 22 bp, Homo sapiens
tatcagcatctcctcaaagata

SEQ ID NO: 8296625 - DNA, 22 bp, Homo sapiens
tatcactacacctggctaatta

SEQ ID NO: 8296626 - DNA, 22 bp, Homo sapiens
tattaataagtgactactagct

SEQ ID NO: 8296627 - DNA, 22 bp, Homo sapiens
tatgtacatacatgtgcatacg

SEQ ID NO: 8296628 - DNA, 22 bp, Homo sapiens
tatttttgcctctcagataaaa

SEQ ID NO: 8296629 - DNA, 22 bp, Homo sapiens
tattttgtatttatgcaagaaa

SEQ ID NO: 8296630 - DNA, 22 bp, Homo sapiens
tattgtgagttcagactaaaaa

SEQ ID NO: 8296631 - DNA, 23 bp, Homo sapiens
tatttgctactggtaattctgga

SEQ ID NO: 8296632 - DNA, 22 bp, Homo sapiens
tatttgatggttctaaaacagc

SEQ ID NO: 8296633 - DNA, 23 bp, Homo sapiens
tatttggaaagagggaagaagac

SEQ ID NO: 8296634 - DNA, 22 bp, Homo sapiens
tatttggaaaggacatgtaagt

SEQ ID NO: 8296635 - DNA, 22 bp, Homo sapiens
tatttgctgaatctgattcaga

SEQ ID NO: 8296636 - DNA, 22 bp, Homo sapiens
tatttggacaccaagtagaagt

SEQ ID NO: 8296637 - DNA, 22 bp, Homo sapiens
tagatataaggtccttagaaca

SEQ ID NO: 8296638 - DNA, 22 bp, Homo sapiens
tcactgctatattggatactga

SEQ ID NO: 8296639 - DNA, 22 bp, Homo sapiens
tcaggacagccagggtgcagac

SEQ ID NO: 8296640 - DNA, 17 bp, Homo sapiens
tcagcatacacagagaa

SEQ ID NO: 8296641 - DNA, 22 bp, Homo sapiens
tcatttgttctcattctctact

SEQ ID NO: 8296642 - DNA, 22 bp, Homo sapiens
tcatttgttcatctgctcttct

SEQ ID NO: 8296643 - DNA, 22 bp, Homo sapiens
tcatttgtgtgagtgatttgac

SEQ ID NO: 8296644 - DNA, 19 bp, Homo sapiens
tcatttgttagtagaagtt

SEQ ID NO: 8296645 - DNA, 22 bp, Homo sapiens
tcatttgtggaagtgattgtgg

SEQ ID NO: 8296646 - DNA, 21 bp, Homo sapiens
tcatttgtgatctgatttcca

SEQ ID NO: 8296647 - DNA, 22 bp, Homo sapiens
tcatttgtaccattttttaaga

SEQ ID NO: 8296648 - DNA, 22 bp, Homo sapiens
tcatttataaggatgcaattaa

SEQ ID NO: 8296649 - DNA, 22 bp, Homo sapiens
tcattgtttctgcttttcatga

SEQ ID NO: 8296650 - DNA, 22 bp, Homo sapiens
tcagtcctcacttggttctaag

SEQ ID NO: 8296651 - DNA, 18 bp, Homo sapiens
tcagtctattgtataaga

SEQ ID NO: 8296652 - DNA, 22 bp, Homo sapiens
tcagtcctctctgggtttctta

SEQ ID NO: 8296653 - DNA, 23 bp, Homo sapiens
tcataaatattagcacagtagga

SEQ ID NO: 8296654 - DNA, 22 bp, Homo sapiens
tcataaatgcagtgtcataaat

SEQ ID NO: 8296655 - DNA, 22 bp, Homo sapiens
tcagggctgactgctactctcc

SEQ ID NO: 8296656 - DNA, 22 bp, Homo sapiens
tccatgtgcttcctcaggggaa

SEQ ID NO: 8296657 - DNA, 22 bp, Homo sapiens
tccatgtggcaataggagacag

SEQ ID NO: 8296658 - DNA, 22 bp, Homo sapiens
tccatgtgttttcctgtccaca

SEQ ID NO: 8296659 - DNA, 23 bp, Homo sapiens
tcccagcctcttctcttgcatac

SEQ ID NO: 8296660 - DNA, 22 bp, Homo sapiens
tcccagcctggaccctgccagt

SEQ ID NO: 8296661 - DNA, 22 bp, Homo sapiens
tccctggcagctaagggtggtc

SEQ ID NO: 8296662 - DNA, 22 bp, Homo sapiens
tccctggccattcctctaggcc

SEQ ID NO: 8296663 - DNA, 22 bp, Homo sapiens
tcctagaatctttgtaagattg

SEQ ID NO: 8296664 - DNA, 22 bp, Homo sapiens
tcctagaatgcacctctgctgt

SEQ ID NO: 8296665 - DNA, 22 bp, Homo sapiens
tcctagaataatctttgactgc

SEQ ID NO: 8296666 - DNA, 22 bp, Homo sapiens
tcctagaatagtgtgtctggag

SEQ ID NO: 8296667 - DNA, 20 bp, Homo sapiens
tcctgagtgcagttggcttg

SEQ ID NO: 8296668 - DNA, 22 bp, Homo sapiens
tcctctggggcgtggtcctgga

SEQ ID NO: 8296669 - DNA, 22 bp, Homo sapiens
gcacagagtcactagctaagca

SEQ ID NO: 8296670 - DNA, 22 bp, Homo sapiens
gcacagaggtggaggacaaata

SEQ ID NO: 8296671 - DNA, 22 bp, Homo sapiens
gcacagagtgggtgagatgtgg

SEQ ID NO: 8296672 - DNA, 18 bp, Homo sapiens
gcacatgtaagagtaaag

SEQ ID NO: 8296673 - DNA, 22 bp, Homo sapiens
gcacatgtgagagtagaggcct

SEQ ID NO: 8296674 - DNA, 22 bp, Homo sapiens
gcacatgtcttattcactgtta

SEQ ID NO: 8296675 - DNA, 17 bp, Homo sapiens
gcacatgtgttctttta

SEQ ID NO: 8296676 - DNA, 22 bp, Homo sapiens
gcacatgttgctagttacttgc

SEQ ID NO: 8296677 - DNA, 22 bp, Homo sapiens
gcacagagagggaaggtaactt

SEQ ID NO: 8296678 - DNA, 22 bp, Homo sapiens
gcagggcagcttagtccctgtc

SEQ ID NO: 8296679 - DNA, 17 bp, Homo sapiens
gcagccagtgcagcagg

SEQ ID NO: 8296680 - DNA, 22 bp, Homo sapiens
gcagccagcccctctgacctct

SEQ ID NO: 8296681 - DNA, 22 bp, Homo sapiens
gcagcagcccagggctctcaga

SEQ ID NO: 8296682 - DNA, 22 bp, Homo sapiens
gcagcactgatcctaaacttag

SEQ ID NO: 8296683 - DNA, 22 bp, Homo sapiens
gcagcagcaggcgctcggccgt

SEQ ID NO: 8296684 - DNA, 22 bp, Homo sapiens
gcattaatgtaagacccactcc

SEQ ID NO: 8296685 - DNA, 22 bp, Homo sapiens
gcattgaatcctatcaggcaaa

SEQ ID NO: 8296686 - DNA, 22 bp, Homo sapiens
gcagttaaaaataaaccttcat

SEQ ID NO: 8296687 - DNA, 22 bp, Homo sapiens
gcatttaaatttgaacttcaga

SEQ ID NO: 8296688 - DNA, 22 bp, Homo sapiens
gccctgctctggtctctgcccg

SEQ ID NO: 8296689 - DNA, 22 bp, Homo sapiens
gctgttggcgaggagctcagct

SEQ ID NO: 8296690 - DNA, 22 bp, Homo sapiens
ggagccagtgccctctggtgga

SEQ ID NO: 8296691 - DNA, 22 bp, Homo sapiens
ggagccaggcatatcggggcac

SEQ ID NO: 8296692 - DNA, 22 bp, Homo sapiens
ggagccagtatttagtggtctt

SEQ ID NO: 8296693 - DNA, 22 bp, Homo sapiens
gctgagtgattgatattttagt

SEQ ID NO: 8296694 - DNA, 22 bp, Homo sapiens
gctgctgggatcctgggtctca

SEQ ID NO: 8296695 - DNA, 22 bp, Homo sapiens
gctggcaggtaaagccccgggg

SEQ ID NO: 8296696 - DNA, 22 bp, Homo sapiens
gctctgtggcaggaggtcttgt

SEQ ID NO: 8296697 - DNA, 22 bp, Homo sapiens
gtacaacaggattgatgtacca

SEQ ID NO: 8296698 - DNA, 22 bp, Homo sapiens
gtagtcacaaaccattcatatg

SEQ ID NO: 8296699 - DNA, 22 bp, Homo sapiens
gtcctctgggctttgagcagtc

SEQ ID NO: 8296700 - DNA, 22 bp, Homo sapiens
gtcctctgtccctggggcacgg

SEQ ID NO: 8296701 - DNA, 22 bp, Homo sapiens
gtcctggcttagttcgctgtaa

SEQ ID NO: 8296702 - DNA, 22 bp, Homo sapiens
gtcctggcccactggcaggctg

SEQ ID NO: 8296703 - DNA, 22 bp, Homo sapiens
gtcctggctagtcgtccgcgac

SEQ ID NO: 8296704 - DNA, 22 bp, Homo sapiens
gtcctggctggttctgtggggc

SEQ ID NO: 8296705 - DNA, 22 bp, Homo sapiens
gtcctggcctctgggggtatgg

SEQ ID NO: 8296706 - DNA, 22 bp, Homo sapiens
gtccagcccctgactcccaggc

SEQ ID NO: 8296707 - DNA, 22 bp, Homo sapiens
gtccagcccgggctccgccagc

SEQ ID NO: 8296708 - DNA, 22 bp, Homo sapiens
gtcactgtatccaggttccagc

SEQ ID NO: 8296709 - DNA, 22 bp, Homo sapiens
gtgctgattgggagctgggatt

SEQ ID NO: 8296710 - DNA, 22 bp, Homo sapiens
gtgctgaagtgaaattcatcaa

SEQ ID NO: 8296711 - DNA, 22 bp, Homo sapiens
gtgctgaatccactcttaggaa

SEQ ID NO: 8296712 - DNA, 22 bp, Homo sapiens
gtgctgaattgtgctctttaca

SEQ ID NO: 8296713 - DNA, 20 bp, Homo sapiens
gtctttatgttttatgacct

SEQ ID NO: 8296714 - DNA, 22 bp, Homo sapiens
ggctctctgaggaaacccttcc

SEQ ID NO: 8296715 - DNA, 22 bp, Homo sapiens
ggctctctccttggctttcaga

SEQ ID NO: 8296716 - DNA, 22 bp, Homo sapiens
ggctgcctgctcaggtgcggcg

SEQ ID NO: 8296717 - DNA, 22 bp, Homo sapiens
ggctgtggtctgggtgctcccc

SEQ ID NO: 8296718 - DNA, 22 bp, Homo sapiens
tttgacaaaggaaaaatgcaca

SEQ ID NO: 8296719 - DNA, 22 bp, Homo sapiens
tttggtgatagtgcagagaaat

SEQ ID NO: 8296720 - DNA, 22 bp, Homo sapiens
tttgaggttagctagcagatca

SEQ ID NO: 8296721 - DNA, 22 bp, Homo sapiens
tttgatgagtttaataacagcc

SEQ ID NO: 8296722 - DNA, 22 bp, Homo sapiens
tttgatgatgatgataaagttt

SEQ ID NO: 8296723 - DNA, 22 bp, Homo sapiens
ttttcatttacattagggaaga

SEQ ID NO: 8296724 - DNA, 22 bp, Homo sapiens
ttttcattgttcctcgagcatt

SEQ ID NO: 8296725 - DNA, 22 bp, Homo sapiens
ttttattagtggctagatgggg

SEQ ID NO: 8296726 - DNA, 22 bp, Homo sapiens
tttgtaaatagcagtactcatg

SEQ ID NO: 8296727 - DNA, 22 bp, Homo sapiens
tttgtaaaggcctgaatttcag

SEQ ID NO: 8296728 - DNA, 18 bp, Homo sapiens
ttcagcagcagacacact

SEQ ID NO: 8296729 - DNA, 22 bp, Homo sapiens
ttcagcaccacttccagagaag

SEQ ID NO: 8296730 - DNA, 22 bp, Homo sapiens
ttcagcacagttcaagatggta

SEQ ID NO: 8296731 - DNA, 22 bp, Homo sapiens
ttcagcaccctctgaggcatcc

SEQ ID NO: 8296732 - DNA, 22 bp, Homo sapiens
ttcagcacaagactagacaggt

SEQ ID NO: 8296733 - DNA, 22 bp, Homo sapiens
ttcagcactttgttttgctcat

SEQ ID NO: 8296734 - DNA, 22 bp, Homo sapiens
ttcagcactgttatggatttgc

SEQ ID NO: 8296735 - DNA, 22 bp, Homo sapiens
ttcagcactggacagcgagtct

SEQ ID NO: 8296736 - DNA, 22 bp, Homo sapiens
ttcagcacctggaatagcacct

SEQ ID NO: 8296737 - DNA, 22 bp, Homo sapiens
ttcagcactgactgagtggtta

SEQ ID NO: 8296738 - DNA, 22 bp, Homo sapiens
ttcatttgttgacagagacatg

SEQ ID NO: 8296739 - DNA, 21 bp, Homo sapiens
ttcatttgttatagacaaagt

SEQ ID NO: 8296740 - DNA, 22 bp, Homo sapiens
ttcatttgggatgagtcagaag

SEQ ID NO: 8296741 - DNA, 23 bp, Homo sapiens
ttcatttaggagttcataagagc

SEQ ID NO: 8296742 - DNA, 21 bp, Homo sapiens
ttagctttctagaatctttgt

SEQ ID NO: 8296743 - DNA, 20 bp, Homo sapiens
ttagctttggcaatagtgac

SEQ ID NO: 8296744 - DNA, 22 bp, Homo sapiens
tcctgctgctacctggcccacg

SEQ ID NO: 8296745 - DNA, 22 bp, Homo sapiens
ttagccattttattcagcaggt

SEQ ID NO: 8296746 - DNA, 22 bp, Homo sapiens
ttagccttagaagcttagcaaa

SEQ ID NO: 8296747 - DNA, 22 bp, Homo sapiens
ttagccatttgaggtcttcatt

SEQ ID NO: 8296748 - DNA, 22 bp, Homo sapiens
ttagctgactgtgtgatttggc

SEQ ID NO: 8296749 - DNA, 22 bp, Homo sapiens
ttagcttaattaaataatcagt

SEQ ID NO: 8296750 - DNA, 22 bp, Homo sapiens
ttattacactgaaagaattgcg

SEQ ID NO: 8296751 - DNA, 22 bp, Homo sapiens
ttattagctgggcttcagggtg

SEQ ID NO: 8296752 - DNA, 22 bp, Homo sapiens
ttgaaatggcagcagctgacct

SEQ ID NO: 8296753 - DNA, 19 bp, Homo sapiens
ttgaaattgtttgatatgg

SEQ ID NO: 8296754 - DNA, 22 bp, Homo sapiens
ttcttattcttgaaatgtggga

SEQ ID NO: 8296755 - DNA, 22 bp, Homo sapiens
ttcttcaaccatctacataaac

SEQ ID NO: 8296756 - DNA, 22 bp, Homo sapiens
ttcttttaatagagatcctgtg

SEQ ID NO: 8296757 - DNA, 22 bp, Homo sapiens
ttcttttaatgtctggctttca

SEQ ID NO: 8296758 - DNA, 22 bp, Homo sapiens
ttctttgtgctgaagaagccct

SEQ ID NO: 8296759 - DNA, 22 bp, Homo sapiens
ttcttacattactttacatgtg

SEQ ID NO: 8296760 - DNA, 22 bp, Homo sapiens
ttctgtgactcctcagagattt

SEQ ID NO: 8296761 - DNA, 22 bp, Homo sapiens
ttctgtgaaactaaagagagga

SEQ ID NO: 8296762 - DNA, 22 bp, Homo sapiens
tttatctgagctgatagatagt

SEQ ID NO: 8296763 - DNA, 22 bp, Homo sapiens
tttagcatatcctataaaacta

SEQ ID NO: 8296764 - DNA, 22 bp, Homo sapiens
ttgtgtgactcctagagtagag

SEQ ID NO: 8296765 - DNA, 22 bp, Homo sapiens
tttaaatgtgttcttagtagct

SEQ ID NO: 8296766 - DNA, 22 bp, Homo sapiens
tttcattatacagcttcataaa

SEQ ID NO: 8296767 - DNA, 22 bp, Homo sapiens
tttattcttgagagtgagaaga

SEQ ID NO: 8296768 - DNA, 22 bp, Homo sapiens
tttattctgtgctacatgaaga

SEQ ID NO: 8296769 - DNA, 22 bp, Homo sapiens
tttattctagctcagaatagtt

SEQ ID NO: 8296770 - DNA, 22 bp, Homo sapiens
ttgtaaatagtagtaagatgcc

SEQ ID NO: 8296771 - DNA, 22 bp, Homo sapiens
ttgtaaatgaccttttctaatt

SEQ ID NO: 8296772 - DNA, 22 bp, Homo sapiens
ttgtcctgagataaggaacaga

SEQ ID NO: 8296773 - DNA, 16 bp, Homo sapiens
ttgtcctgtctcactg

SEQ ID NO: 8296774 - DNA, 22 bp, Homo sapiens
ttgtcctgtcaggctgggggct

SEQ ID NO: 8296775 - DNA, 22 bp, Homo sapiens
ttgtcctggaggttaatagagt

SEQ ID NO: 8296776 - DNA, 22 bp, Homo sapiens
ttgtcctggcccaaatgtcaac

SEQ ID NO: 8296777 - DNA, 23 bp, Homo sapiens
ttgtcctgccgatctctgagaat

SEQ ID NO: 8296778 - DNA, 22 bp, Homo sapiens
ttgtcctgattttgcaacttct

SEQ ID NO: 8296779 - DNA, 22 bp, Homo sapiens
ttgtcctgatttataaaatgaa

SEQ ID NO: 8296780 - DNA, 22 bp, Homo sapiens
ttgtcctgaggactgttatcag

SEQ ID NO: 8296781 - DNA, 22 bp, Homo sapiens
ttgtcctgcaggtggctgggag

SEQ ID NO: 8296782 - DNA, 22 bp, Homo sapiens
ttgtcctgcaacctcacatggc

SEQ ID NO: 8296783 - DNA, 22 bp, Homo sapiens
ttgtcacatgtagttcattctc

SEQ ID NO: 8296784 - DNA, 22 bp, Homo sapiens
ttgtcctgttacttgtttggat

SEQ ID NO: 8296785 - DNA, 22 bp, Homo sapiens
ttgtcctgtttagggataagga

SEQ ID NO: 8296786 - DNA, 22 bp, Homo sapiens
ttgtcctgtgtctgtttggatt

SEQ ID NO: 8296787 - DNA, 22 bp, Homo sapiens
ttgtcctgtgatttcagggcct

SEQ ID NO: 8296788 - DNA, 22 bp, Homo sapiens
ttgcagctgcagtaaatgttca

SEQ ID NO: 8296789 - DNA, 22 bp, Homo sapiens
ttgcagcttcgagtctatctgt

SEQ ID NO: 8296790 - DNA, 22 bp, Homo sapiens
ttgcagcttagtgatgttatct

SEQ ID NO: 8296791 - DNA, 22 bp, Homo sapiens
ttgcagcttctaccactgtttc

SEQ ID NO: 8296792 - DNA, 22 bp, Homo sapiens
ttgcattagtgtcataaggtgg

SEQ ID NO: 8296793 - DNA, 22 bp, Homo sapiens
ttgctgaaaacaggtcatcagg

SEQ ID NO: 8296794 - DNA, 22 bp, Homo sapiens
ttgctgaaaagctggcctttgt

SEQ ID NO: 8296795 - DNA, 22 bp, Homo sapiens
ttgctgaaaacagtgggtattg

SEQ ID NO: 8296796 - DNA, 22 bp, Homo sapiens
ttgctgaaatctatgacatcct

SEQ ID NO: 8296797 - DNA, 22 bp, Homo sapiens
ttgctgaaccctgccctctaat

SEQ ID NO: 8296798 - DNA, 22 bp, Homo sapiens
ttgctgaaagtggcaagaagta

SEQ ID NO: 8296799 - DNA, 22 bp, Homo sapiens
ttgctgaaaggtagctgtgtgg

SEQ ID NO: 8296800 - DNA, 22 bp, Homo sapiens
ttgctgaagaaaaaatatgtta

SEQ ID NO: 8296801 - DNA, 22 bp, Homo sapiens
ttgctgaagctgccaaaccagt

SEQ ID NO: 8296802 - DNA, 19 bp, Homo sapiens
ttgctgaaggaagcctctg

SEQ ID NO: 8296803 - DNA, 22 bp, Homo sapiens
ttgctgaaggcctcttggggtt

SEQ ID NO: 8296804 - DNA, 22 bp, Homo sapiens
ttgctgaagtatgaaaaagaca

SEQ ID NO: 8296805 - DNA, 22 bp, Homo sapiens
ttgctgaagtattgtgaatcct

SEQ ID NO: 8296806 - DNA, 22 bp, Homo sapiens
ttgctgaagttaatgcttgcaa

SEQ ID NO: 8296807 - DNA, 22 bp, Homo sapiens
ttgctgaagtgaaggtatgttt

SEQ ID NO: 8296808 - DNA, 22 bp, Homo sapiens
ttgctgaatgcaagttggatag

SEQ ID NO: 8296809 - DNA, 22 bp, Homo sapiens
ttgctgaagttgctcagctcca

SEQ ID NO: 8296810 - DNA, 22 bp, Homo sapiens
ttgcttatttgattaaatgtct

SEQ ID NO: 8296811 - DNA, 22 bp, Homo sapiens
ttgctgaattgaatcctttggt

SEQ ID NO: 8296812 - DNA, 22 bp, Homo sapiens
aagtccattcttccagccagct

SEQ ID NO: 8296813 - DNA, 23 bp, Homo sapiens
aagtagataacactgttctgaga

SEQ ID NO: 8296814 - DNA, 22 bp, Homo sapiens
acatttcagattcatgaagtga

SEQ ID NO: 8296815 - DNA, 20 bp, Homo sapiens
acatgaacagggctacagca

SEQ ID NO: 8296816 - DNA, 22 bp, Homo sapiens
acatctcagaactgagtaaccg

SEQ ID NO: 8296817 - DNA, 22 bp, Homo sapiens
aagcttcatctgatgccgaact

SEQ ID NO: 8296818 - DNA, 22 bp, Homo sapiens
aagcttcatttcaactcagggg

SEQ ID NO: 8296819 - DNA, 22 bp, Homo sapiens
aagcttacagttccacgtagca

SEQ ID NO: 8296820 - DNA, 22 bp, Homo sapiens
aagcttcacattgaacttgggt

SEQ ID NO: 8296821 - DNA, 22 bp, Homo sapiens
aagcttcaatgagataattgtt

SEQ ID NO: 8296822 - DNA, 20 bp, Homo sapiens
aagcttcacttcatttgatc

SEQ ID NO: 8296823 - DNA, 22 bp, Homo sapiens
aagcttcagtggactgtagtgt

SEQ ID NO: 8296824 - DNA, 22 bp, Homo sapiens
aagcttcaggcccacccatgtc

SEQ ID NO: 8296825 - DNA, 22 bp, Homo sapiens
aagcttcagtgtgagcatgtaa

SEQ ID NO: 8296826 - DNA, 22 bp, Homo sapiens
aagcttcatatatgtgtgagtc

SEQ ID NO: 8296827 - DNA, 22 bp, Homo sapiens
aagcttcagttctggggcaatg

SEQ ID NO: 8296828 - DNA, 22 bp, Homo sapiens
aatgaagaaatggacatcttta

SEQ ID NO: 8296829 - DNA, 22 bp, Homo sapiens
aatagcatcctaaaacatactt

SEQ ID NO: 8296830 - DNA, 22 bp, Homo sapiens
aataagctgctaggaacttagt

SEQ ID NO: 8296831 - DNA, 22 bp, Homo sapiens
aataagctggagctatattgag

SEQ ID NO: 8296832 - DNA, 19 bp, Homo sapiens
aataagcttgggtaaaact

SEQ ID NO: 8296833 - DNA, 22 bp, Homo sapiens
acagaggtaggacatgagatat

SEQ ID NO: 8296834 - DNA, 22 bp, Homo sapiens
agctgatacatttcttgtagcc

SEQ ID NO: 8296835 - DNA, 22 bp, Homo sapiens
acaccatactcatgttggttcc

SEQ ID NO: 8296836 - DNA, 19 bp, Homo sapiens
agccagagtggcccagggg

SEQ ID NO: 8296837 - DNA, 22 bp, Homo sapiens
acacagtggtgtttacaaaatt

SEQ ID NO: 8296838 - DNA, 22 bp, Homo sapiens
acacagtattacaataggtgct

SEQ ID NO: 8296839 - DNA, 22 bp, Homo sapiens
acacagtatgacattggcagag

SEQ ID NO: 8296840 - DNA, 22 bp, Homo sapiens
acacaagattgtgtattgaatt

SEQ ID NO: 8296841 - DNA, 22 bp, Homo sapiens
agacatcaatgatcagaggtag

SEQ ID NO: 8296842 - DNA, 22 bp, Homo sapiens
agacatcagcttgtgtgcaggg

SEQ ID NO: 8296843 - DNA, 19 bp, Homo sapiens
agacatgagacacaggatg

SEQ ID NO: 8296844 - DNA, 22 bp, Homo sapiens
agagcacaaattttaaggaggc

SEQ ID NO: 8296845 - DNA, 22 bp, Homo sapiens
agagcacaaattagttggtctt

SEQ ID NO: 8296846 - DNA, 22 bp, Homo sapiens
agagcacagaagaataggtgct

SEQ ID NO: 8296847 - DNA, 22 bp, Homo sapiens
agagcacactgacgtcagtctg

SEQ ID NO: 8296848 - DNA, 22 bp, Homo sapiens
aatttctccaagaatgcttaga

SEQ ID NO: 8296849 - DNA, 22 bp, Homo sapiens
acacaagaagttaatgggcaaa

SEQ ID NO: 8296850 - DNA, 22 bp, Homo sapiens
acagacattttaagacacttta

SEQ ID NO: 8296851 - DNA, 23 bp, Homo sapiens
acagacattccataatgtacacc

SEQ ID NO: 8296852 - DNA, 22 bp, Homo sapiens
acagagatgtcagattggcagc

SEQ ID NO: 8296853 - DNA, 22 bp, Homo sapiens
acacagagccaaaccatatcac

SEQ ID NO: 8296854 - DNA, 22 bp, Homo sapiens
aagaacttcctaatatattttc

SEQ ID NO: 8296855 - DNA, 22 bp, Homo sapiens
acaaaatagagttctcccctgg

SEQ ID NO: 8296856 - DNA, 22 bp, Homo sapiens
aataatattcctctgtgtgcgt

SEQ ID NO: 8296857 - DNA, 22 bp, Homo sapiens
aaggaggttatcccagtggact

SEQ ID NO: 8296858 - DNA, 22 bp, Homo sapiens
aaatggaagaagtgcaatactg

SEQ ID NO: 8296859 - DNA, 22 bp, Homo sapiens
aagtaacatctgaacatgatgt

SEQ ID NO: 8296860 - DNA, 22 bp, Homo sapiens
aaatgtctgtctcatgaggaaa

SEQ ID NO: 8296861 - DNA, 18 bp, Homo sapiens
aaaataacaaagttggct

SEQ ID NO: 8296862 - DNA, 22 bp, Homo sapiens
aaaataacttctactatttgca

SEQ ID NO: 8296863 - DNA, 22 bp, Homo sapiens
aaaatgatatcctgacttttat

SEQ ID NO: 8296864 - DNA, 22 bp, Homo sapiens
aaaatgatgctgtaatttggca

SEQ ID NO: 8296865 - DNA, 20 bp, Homo sapiens
aaaatgatgggcagggcagg

SEQ ID NO: 8296866 - DNA, 22 bp, Homo sapiens
aaaacattttactgccatctca

SEQ ID NO: 8296867 - DNA, 22 bp, Homo sapiens
aaaacattgaattgcacactat

SEQ ID NO: 8296868 - DNA, 22 bp, Homo sapiens
aaatgatggaaatgaggctgaa

SEQ ID NO: 8296869 - DNA, 20 bp, Homo sapiens
aaatgatgggaataatctat

SEQ ID NO: 8296870 - DNA, 22 bp, Homo sapiens
aaatatagtgacacttatagtc

SEQ ID NO: 8296871 - DNA, 22 bp, Homo sapiens
aaatacatacactgtacgtggc

SEQ ID NO: 8296872 - DNA, 22 bp, Homo sapiens
attatttgagttcctctctacc

SEQ ID NO: 8296873 - DNA, 22 bp, Homo sapiens
attatttgacttgagaacaggt

SEQ ID NO: 8296874 - DNA, 22 bp, Homo sapiens
attatttgcttggctcatctaa

SEQ ID NO: 8296875 - DNA, 22 bp, Homo sapiens
attatttgtgtccacagaatac

SEQ ID NO: 8296876 - DNA, 15 bp, Homo sapiens
attatttgtgctcag

SEQ ID NO: 8296877 - DNA, 22 bp, Homo sapiens
attatttggaataggcattgca

SEQ ID NO: 8296878 - DNA, 22 bp, Homo sapiens
attaataaaataccactttgtt

SEQ ID NO: 8296879 - DNA, 22 bp, Homo sapiens
attctacaaaagaactggatct

SEQ ID NO: 8296880 - DNA, 22 bp, Homo sapiens
caaacattgctaccagaggttt

SEQ ID NO: 8296881 - DNA, 22 bp, Homo sapiens
attttgtgaaccctcaagcaat

SEQ ID NO: 8296882 - DNA, 22 bp, Homo sapiens
attttgtggcagatgcagaacc

SEQ ID NO: 8296883 - DNA, 22 bp, Homo sapiens
agagccagcatttgacactggc

SEQ ID NO: 8296884 - DNA, 22 bp, Homo sapiens
agagccagcatttgggccctgc

SEQ ID NO: 8296885 - DNA, 22 bp, Homo sapiens
agagccagccttctcagcttac

SEQ ID NO: 8296886 - DNA, 22 bp, Homo sapiens
agagccaggatctgttttgggg

SEQ ID NO: 8296887 - DNA, 22 bp, Homo sapiens
agagccaggaagtggcgtgggg

SEQ ID NO: 8296888 - DNA, 22 bp, Homo sapiens
agagccaggactgtgtctcact

SEQ ID NO: 8296889 - DNA, 22 bp, Homo sapiens
agagccaggatgtcttctgggg

SEQ ID NO: 8296890 - DNA, 22 bp, Homo sapiens
atgtgcacacagtgtcatgcaa

SEQ ID NO: 8296891 - DNA, 22 bp, Homo sapiens
atgtgcaggatccaggctccta

SEQ ID NO: 8296892 - DNA, 22 bp, Homo sapiens
atgtgcagttggtggccaggag

SEQ ID NO: 8296893 - DNA, 22 bp, Homo sapiens
atgtgcagcttttctagagaag

SEQ ID NO: 8296894 - DNA, 21 bp, Homo sapiens
atgtgcagcaagcagcatgct

SEQ ID NO: 8296895 - DNA, 23 bp, Homo sapiens
atgtgcacatctccttgtccacc

SEQ ID NO: 8296896 - DNA, 22 bp, Homo sapiens
attaagtgactaaagtaatgct

SEQ ID NO: 8296897 - DNA, 22 bp, Homo sapiens
agacataagtgctatgacattg

SEQ ID NO: 8296898 - DNA, 22 bp, Homo sapiens
atgccaggaacaaacagtggtg

SEQ ID NO: 8296899 - DNA, 22 bp, Homo sapiens
atgctgaaaattggatttgaat

SEQ ID NO: 8296900 - DNA, 22 bp, Homo sapiens
atgctgaactgagatgtaactt

SEQ ID NO: 8296901 - DNA, 22 bp, Homo sapiens
atgctgaagagttcatgattat

SEQ ID NO: 8296902 - DNA, 22 bp, Homo sapiens
atgctgaatgaaagaaattagt

SEQ ID NO: 8296903 - DNA, 22 bp, Homo sapiens
atgatatatgtgttgagcttgc

SEQ ID NO: 8296904 - DNA, 22 bp, Homo sapiens
cagcctctaagcacagcctctc

SEQ ID NO: 8296905 - DNA, 21 bp, Homo sapiens
agcccttaggacataagagag

SEQ ID NO: 8296906 - DNA, 22 bp, Homo sapiens
agcctattccaggatgagctca

SEQ ID NO: 8296907 - DNA, 22 bp, Homo sapiens
cagcactgctgctgtacacaca

SEQ ID NO: 8296908 - DNA, 22 bp, Homo sapiens
cagagcacccaaggagcatttg

SEQ ID NO: 8296909 - DNA, 22 bp, Homo sapiens
cagagcaccagtgggagacaag

SEQ ID NO: 8296910 - DNA, 22 bp, Homo sapiens
cagagccatcatgatatggagt

SEQ ID NO: 8296911 - DNA, 22 bp, Homo sapiens
caagcagagaggttagaacaca

SEQ ID NO: 8296912 - DNA, 22 bp, Homo sapiens
agcagacaggtaggaggataaa

SEQ ID NO: 8296913 - DNA, 21 bp, Homo sapiens
caattacagatggctcagggg

SEQ ID NO: 8296914 - DNA, 22 bp, Homo sapiens
cacacatgtgtgcagcttagaa

SEQ ID NO: 8296915 - DNA, 22 bp, Homo sapiens
cacacatggtagcaggtacaag

SEQ ID NO: 8296916 - DNA, 22 bp, Homo sapiens
cacacagaaccgctcgccactt

SEQ ID NO: 8296917 - DNA, 22 bp, Homo sapiens
agcaggcaggcccagcggctgg

SEQ ID NO: 8296918 - DNA, 22 bp, Homo sapiens
cacagaaattattaggatgctt

SEQ ID NO: 8296919 - DNA, 22 bp, Homo sapiens
cacatttaaaggttgaagctga

SEQ ID NO: 8296920 - DNA, 20 bp, Homo sapiens
agcatttgaaatatgactat

SEQ ID NO: 8296921 - DNA, 22 bp, Homo sapiens
agcattaggtgtgtttcagagg

SEQ ID NO: 8296922 - DNA, 19 bp, Homo sapiens
agcatttggaattctacac

SEQ ID NO: 8296923 - DNA, 22 bp, Homo sapiens
agaaatggaaatccaagcaact

SEQ ID NO: 8296924 - DNA, 22 bp, Homo sapiens
atattaatgggatttagtcagg

SEQ ID NO: 8296925 - DNA, 22 bp, Homo sapiens
agaaacttcagctattcttttg

SEQ ID NO: 8296926 - DNA, 22 bp, Homo sapiens
agttcagcttcccaggtcactg

SEQ ID NO: 8296927 - DNA, 22 bp, Homo sapiens
ataagctctggacagccacatt

SEQ ID NO: 8296928 - DNA, 22 bp, Homo sapiens
ataagcttcctgttagaaaccg

SEQ ID NO: 8296929 - DNA, 22 bp, Homo sapiens
ataagcttgatgtaactaacca

SEQ ID NO: 8296930 - DNA, 22 bp, Homo sapiens
ataagcttttaaagctactttg

SEQ ID NO: 8296931 - DNA, 22 bp, Homo sapiens
ataagcttttgattcacttcag

SEQ ID NO: 8296932 - DNA, 22 bp, Homo sapiens
ataagctttgctggagagacct

SEQ ID NO: 8296933 - DNA, 22 bp, Homo sapiens
atagcatttacttttcagaaat

SEQ ID NO: 8296934 - DNA, 22 bp, Homo sapiens
atagcattatttacaattagta

SEQ ID NO: 8296935 - DNA, 22 bp, Homo sapiens
atagcatataagttataaaact

SEQ ID NO: 8296936 - DNA, 22 bp, Homo sapiens
atagtgtgttagtgacataggc

SEQ ID NO: 8296937 - DNA, 23 bp, Homo sapiens
agtaacatgcaaataacagtctg

SEQ ID NO: 8296938 - DNA, 22 bp, Homo sapiens
agtcaggggttggacggggcca

SEQ ID NO: 8296939 - DNA, 22 bp, Homo sapiens
agtcctggttctgattctgaca

SEQ ID NO: 8296940 - DNA, 22 bp, Homo sapiens
agtcctggtgacactcctcttc

SEQ ID NO: 8296941 - DNA, 22 bp, Homo sapiens
agtggcagagcaggtgctggaa

SEQ ID NO: 8296942 - DNA, 22 bp, Homo sapiens
agtggcagaagtcactgggtag

SEQ ID NO: 8296943 - DNA, 22 bp, Homo sapiens
acatatattactagtaaagaca

SEQ ID NO: 8296944 - DNA, 22 bp, Homo sapiens
aggcaggttacaaaaactttat

SEQ ID NO: 8296945 - DNA, 22 bp, Homo sapiens
aggacttagaacattatgtact

SEQ ID NO: 8296946 - DNA, 22 bp, Homo sapiens
acaggacaactcagcagccagc

SEQ ID NO: 8296947 - DNA, 22 bp, Homo sapiens
acaggacaggctgggctagact

SEQ ID NO: 8296948 - DNA, 22 bp, Homo sapiens
acaggacaggtaggattcgcag

SEQ ID NO: 8296949 - DNA, 22 bp, Homo sapiens
acaggacagtctagtaacagta

SEQ ID NO: 8296950 - DNA, 22 bp, Homo sapiens
aggacatgaagaaagggcaagg

SEQ ID NO: 8296951 - DNA, 22 bp, Homo sapiens
agggccagcactcctggcagga

SEQ ID NO: 8296952 - DNA, 22 bp, Homo sapiens
cagtaagtcaacaaacatgggg

SEQ ID NO: 8296953 - DNA, 22 bp, Homo sapiens
cagtatgtttgggagacatgac

SEQ ID NO: 8296954 - DNA, 22 bp, Homo sapiens
aggacacatgcacaccctgcgt

SEQ ID NO: 8296955 - DNA, 22 bp, Homo sapiens
caggcacacatccgtgagagat

SEQ ID NO: 8296956 - DNA, 22 bp, Homo sapiens
caggcacacccactggtgcaga

SEQ ID NO: 8296957 - DNA, 22 bp, Homo sapiens
ccactagtttaataccttcctt

SEQ ID NO: 8296958 - DNA, 22 bp, Homo sapiens
catttattggttaggccagcag

SEQ ID NO: 8296959 - DNA, 22 bp, Homo sapiens
aggagccagtggagttcctgcc

SEQ ID NO: 8296960 - DNA, 22 bp, Homo sapiens
cataacatgtacatataaatgc

SEQ ID NO: 8296961 - DNA, 22 bp, Homo sapiens
catacatatgtggatgtcatat

SEQ ID NO: 8296962 - DNA, 22 bp, Homo sapiens
catctctggttcagtctctgtg

SEQ ID NO: 8296963 - DNA, 22 bp, Homo sapiens
catcttgatgctttgacaggtt

SEQ ID NO: 8296964 - DNA, 22 bp, Homo sapiens
catcttgactgggataagggat

SEQ ID NO: 8296965 - DNA, 22 bp, Homo sapiens
catcttgagacatgaaaggtgt

SEQ ID NO: 8296966 - DNA, 22 bp, Homo sapiens
catcttgaaggtttctttagct

SEQ ID NO: 8296967 - DNA, 20 bp, Homo sapiens
catcttgaaggtcttccaca

SEQ ID NO: 8296968 - DNA, 22 bp, Homo sapiens
ccaggtgtttggcctgcatgat

SEQ ID NO: 8296969 - DNA, 22 bp, Homo sapiens
ccagggcagcagaattggggca

SEQ ID NO: 8296970 - DNA, 22 bp, Homo sapiens
ccaggcctcccttttccagcca

SEQ ID NO: 8296971 - DNA, 22 bp, Homo sapiens
ccaggcctcacctgcccaccta

SEQ ID NO: 8296972 - DNA, 19 bp, Homo sapiens
ccccttaggggttaagcct

SEQ ID NO: 8296973 - DNA, 22 bp, Homo sapiens
agggaaactagactgcctttct

SEQ ID NO: 8296974 - DNA, 22 bp, Homo sapiens
agggcctgtgaattctccctgc

SEQ ID NO: 8296975 - DNA, 22 bp, Homo sapiens
cctcctggtgggcgcttctggc

SEQ ID NO: 8296976 - DNA, 22 bp, Homo sapiens
cctctgtgggccgggcctgctg

SEQ ID NO: 8296977 - DNA, 22 bp, Homo sapiens
atagattagccctatagtttta

SEQ ID NO: 8296978 - DNA, 22 bp, Homo sapiens
atagattatttgctcattactt

SEQ ID NO: 8296979 - DNA, 22 bp, Homo sapiens
ctggctccatccttgagctctg

SEQ ID NO: 8296980 - DNA, 22 bp, Homo sapiens
ctggctccatccttgagctctg

SEQ ID NO: 8296981 - DNA, 22 bp, Homo sapiens
ctggctccattactcagcatct

SEQ ID NO: 8296982 - DNA, 22 bp, Homo sapiens
ctggctcccgtctggtggccat

SEQ ID NO: 8296983 - DNA, 22 bp, Homo sapiens
ctggctcccatgagctctcacg

SEQ ID NO: 8296984 - DNA, 22 bp, Homo sapiens
ctgcatgaagtcttttttatag

SEQ ID NO: 8296985 - DNA, 22 bp, Homo sapiens
atattagcagtgatcaaaatgg

SEQ ID NO: 8296986 - DNA, 22 bp, Homo sapiens
ctgggctgagcctgggctgtgt

SEQ ID NO: 8296987 - DNA, 22 bp, Homo sapiens
atattgtgtgtacaagtagtta

SEQ ID NO: 8296988 - DNA, 22 bp, Homo sapiens
atcaaaatggaagaatttggct

SEQ ID NO: 8296989 - DNA, 22 bp, Homo sapiens
atcaacagtgaagagatcaaga

SEQ ID NO: 8296990 - DNA, 22 bp, Homo sapiens
ctgtggctcaaaatcccatgat

SEQ ID NO: 8296991 - DNA, 19 bp, Homo sapiens
ctgtggcctccaggaggga

SEQ ID NO: 8296992 - DNA, 22 bp, Homo sapiens
ctgaatggcgagttagttagtt

SEQ ID NO: 8296993 - DNA, 22 bp, Homo sapiens
ctgaatgataatcttttgctgg

SEQ ID NO: 8296994 - DNA, 22 bp, Homo sapiens
ctgaatgatataagatctttct

SEQ ID NO: 8296995 - DNA, 22 bp, Homo sapiens
ctgaatgaaatcaaggactgag

SEQ ID NO: 8296996 - DNA, 22 bp, Homo sapiens
ctgaatgaatggtttgtcttat

SEQ ID NO: 8296997 - DNA, 22 bp, Homo sapiens
ctgaatgactgaagtcacaatt

SEQ ID NO: 8296998 - DNA, 22 bp, Homo sapiens
ctgaatgagtggatttttcatt

SEQ ID NO: 8296999 - DNA, 22 bp, Homo sapiens
ctgaatgagggattctgagggc

SEQ ID NO: 8297000 - DNA, 22 bp, Homo sapiens
ctgaatgaggaaaagagtgagg

SEQ ID NO: 8297001 - DNA, 22 bp, Homo sapiens
ctctgggcttgttgacctgcac

SEQ ID NO: 8297002 - DNA, 22 bp, Homo sapiens
ctctggcttgttaatgcatatt

SEQ ID NO: 8297003 - DNA, 22 bp, Homo sapiens
ctctggctttgctcatgcatcc

SEQ ID NO: 8297004 - DNA, 22 bp, Homo sapiens
agtggcagagtcagggtttgga

SEQ ID NO: 8297005 - DNA, 22 bp, Homo sapiens
agtcttcactcttcactactat

SEQ ID NO: 8297006 - DNA, 20 bp, Homo sapiens
ctcatgtggcaccaggcact

SEQ ID NO: 8297007 - DNA, 18 bp, Homo sapiens
ctcatgtgtggtcccagc

SEQ ID NO: 8297008 - DNA, 22 bp, Homo sapiens
agtcctggctctacgggcttca

SEQ ID NO: 8297009 - DNA, 22 bp, Homo sapiens
agtcctgggtccagcaggtcct

SEQ ID NO: 8297010 - DNA, 22 bp, Homo sapiens
agtcctggcatataggtcctca

SEQ ID NO: 8297011 - DNA, 22 bp, Homo sapiens
agtccgtggccagactcaagag

SEQ ID NO: 8297012 - DNA, 22 bp, Homo sapiens
aggtcctgaagattttactaga

SEQ ID NO: 8297013 - DNA, 22 bp, Homo sapiens
aggtcctgagggttcgtctgca

SEQ ID NO: 8297014 - DNA, 22 bp, Homo sapiens
cctgggcttctgtctagatgtt

SEQ ID NO: 8297015 - DNA, 22 bp, Homo sapiens
cctgggcttgcatctgtgctgg

SEQ ID NO: 8297016 - DNA, 22 bp, Homo sapiens
cctgggctcaagtgatggtccc

SEQ ID NO: 8297017 - DNA, 22 bp, Homo sapiens
cctgggctcaccatgccttgga

SEQ ID NO: 8297018 - DNA, 22 bp, Homo sapiens
cctgggctccactccaagagca

SEQ ID NO: 8297019 - DNA, 20 bp, Homo sapiens
cctgtctcctcttacctggc

SEQ ID NO: 8297020 - DNA, 22 bp, Homo sapiens
ctagtcacacagtaaggacggg

SEQ ID NO: 8297021 - DNA, 22 bp, Homo sapiens
ctagtcacgtctttcagttacc

SEQ ID NO: 8297022 - DNA, 22 bp, Homo sapiens
ctagtcactcagcactgacaaa

SEQ ID NO: 8297023 - DNA, 22 bp, Homo sapiens
ctagtcactgtaataatctgct

SEQ ID NO: 8297024 - DNA, 22 bp, Homo sapiens
agtacaagtagaatgctacaag

SEQ ID NO: 8297025 - DNA, 22 bp, Homo sapiens
ctaagacatgccctgcatgata

SEQ ID NO: 8297026 - DNA, 22 bp, Homo sapiens
cctgttgtctcttcctgttgac

SEQ ID NO: 8297027 - DNA, 22 bp, Homo sapiens
gctggctgggtccctgagaggc

SEQ ID NO: 8297028 - DNA, 22 bp, Homo sapiens
gctggctgtatcacctggccag

SEQ ID NO: 8297029 - DNA, 20 bp, Homo sapiens
caaggcctggatctagttgc

SEQ ID NO: 8297030 - DNA, 22 bp, Homo sapiens
caaggcctgactgcttgtctaa

SEQ ID NO: 8297031 - DNA, 22 bp, Homo sapiens
cacacagacagctctctgaaga

SEQ ID NO: 8297032 - DNA, 22 bp, Homo sapiens
cacaggaatgaacagggaaaga

SEQ ID NO: 8297033 - DNA, 22 bp, Homo sapiens
cacaggaccaattcacattcca

SEQ ID NO: 8297034 - DNA, 18 bp, Homo sapiens
cacaggaaggggaatatc

SEQ ID NO: 8297035 - DNA, 22 bp, Homo sapiens
cacagatacctagtgaaacata

SEQ ID NO: 8297036 - DNA, 22 bp, Homo sapiens
cacagatagaccttatgagatt

SEQ ID NO: 8297037 - DNA, 22 bp, Homo sapiens
ggccggcctttgcgagcattct

SEQ ID NO: 8297038 - DNA, 22 bp, Homo sapiens
ggccaaggatggtggctctggt

SEQ ID NO: 8297039 - DNA, 22 bp, Homo sapiens
ggctgcctactttcccagagtt

SEQ ID NO: 8297040 - DNA, 22 bp, Homo sapiens
ggcctgtccagcctgcctggct

SEQ ID NO: 8297041 - DNA, 22 bp, Homo sapiens
ggtcctgggaagatgctcatga

SEQ ID NO: 8297042 - DNA, 22 bp, Homo sapiens
cagagtcatgggccgtcaggca

SEQ ID NO: 8297043 - DNA, 22 bp, Homo sapiens
cagagtcatatcagagaatatg

SEQ ID NO: 8297044 - DNA, 22 bp, Homo sapiens
cagcacatctccaagaatttct

SEQ ID NO: 8297045 - DNA, 22 bp, Homo sapiens
cagcacatcttctgatcttttg

SEQ ID NO: 8297046 - DNA, 22 bp, Homo sapiens
ggtctgccctgggtggaggcgc

SEQ ID NO: 8297047 - DNA, 22 bp, Homo sapiens
cagagcctctcagaggtcagac

SEQ ID NO: 8297048 - DNA, 22 bp, Homo sapiens
cagagacaggaatcagctgcag

SEQ ID NO: 8297049 - DNA, 22 bp, Homo sapiens
ggcttcagaggggaggtagtgc

SEQ ID NO: 8297050 - DNA, 22 bp, Homo sapiens
gtccagccagctggtccttgcc

SEQ ID NO: 8297051 - DNA, 22 bp, Homo sapiens
gtcatgcctggcttcttagaca

SEQ ID NO: 8297052 - DNA, 22 bp, Homo sapiens
gtcatgccagcggagctcggga

SEQ ID NO: 8297053 - DNA, 22 bp, Homo sapiens
cagcactaggatatacatttcc

SEQ ID NO: 8297054 - DNA, 22 bp, Homo sapiens
cagcactaatcctgcaatttct

SEQ ID NO: 8297055 - DNA, 19 bp, Homo sapiens
gtccctgggcagaggcacc

SEQ ID NO: 8297056 - DNA, 22 bp, Homo sapiens
gtccctggtctaccgtggcttc

SEQ ID NO: 8297057 - DNA, 22 bp, Homo sapiens
gtccctgggtctaaggcagtaa

SEQ ID NO: 8297058 - DNA, 22 bp, Homo sapiens
gtccctgggtagctcagtggct

SEQ ID NO: 8297059 - DNA, 22 bp, Homo sapiens
atgatattttagtaaagtgata

SEQ ID NO: 8297060 - DNA, 22 bp, Homo sapiens
atgatattattctagcccagag

SEQ ID NO: 8297061 - DNA, 22 bp, Homo sapiens
atgatatttgcaatgtgcttgc

SEQ ID NO: 8297062 - DNA, 22 bp, Homo sapiens
gaaacattgtgttctacagatt

SEQ ID NO: 8297063 - DNA, 22 bp, Homo sapiens
gaaacattcagtcaacagtgtt

SEQ ID NO: 8297064 - DNA, 22 bp, Homo sapiens
ctttcttgcataatttgaaacc

SEQ ID NO: 8297065 - DNA, 22 bp, Homo sapiens
gaaacatttgttgagtacttgc

SEQ ID NO: 8297066 - DNA, 22 bp, Homo sapiens
gaataatattgactttgcaggc

SEQ ID NO: 8297067 - DNA, 22 bp, Homo sapiens
gaataatagcagaaattagcag

SEQ ID NO: 8297068 - DNA, 22 bp, Homo sapiens
gaataacattttttcctttaca

SEQ ID NO: 8297069 - DNA, 22 bp, Homo sapiens
gaataatagcagaaattagcag

SEQ ID NO: 8297070 - DNA, 22 bp, Homo sapiens
gaccacagcagtgcaagaggag

SEQ ID NO: 8297071 - DNA, 22 bp, Homo sapiens
gaccacagattcctaagtggca

SEQ ID NO: 8297072 - DNA, 22 bp, Homo sapiens
gaccacagactggaaagagggc

SEQ ID NO: 8297073 - DNA, 22 bp, Homo sapiens
gaccacagaagccttgataggg

SEQ ID NO: 8297074 - DNA, 22 bp, Homo sapiens
gataattataggctaagccact

SEQ ID NO: 8297075 - DNA, 23 bp, Homo sapiens
atgtcctgcatagttgcttctgt

SEQ ID NO: 8297076 - DNA, 20 bp, Homo sapiens
atgtcctgcttctcctcacc

SEQ ID NO: 8297077 - DNA, 22 bp, Homo sapiens
atgtcctgttttggcttgctct

SEQ ID NO: 8297078 - DNA, 20 bp, Homo sapiens
atgtcctgttgctgccccag

SEQ ID NO: 8297079 - DNA, 22 bp, Homo sapiens
atgtcctgggctgggttatgtt

SEQ ID NO: 8297080 - DNA, 22 bp, Homo sapiens
atgtcctggggtcttctcttca

SEQ ID NO: 8297081 - DNA, 22 bp, Homo sapiens
atgtcctggtctagcttccggg

SEQ ID NO: 8297082 - DNA, 22 bp, Homo sapiens
atgtgacagtgtttgacagatg

SEQ ID NO: 8297083 - DNA, 22 bp, Homo sapiens
atttctgataaacgtaagctgc

SEQ ID NO: 8297084 - DNA, 22 bp, Homo sapiens
gccaggtgcacctgccctggcc

SEQ ID NO: 8297085 - DNA, 22 bp, Homo sapiens
gccaggtgcatggctgagtctc

SEQ ID NO: 8297086 - DNA, 22 bp, Homo sapiens
atttgctgagctcaaagaaaag

SEQ ID NO: 8297087 - DNA, 22 bp, Homo sapiens
atttgctgaatcaatgaatttt

SEQ ID NO: 8297088 - DNA, 22 bp, Homo sapiens
caaatgatacctattactaggc

SEQ ID NO: 8297089 - DNA, 22 bp, Homo sapiens
gctcttgtcaaaaattagttga

SEQ ID NO: 8297090 - DNA, 22 bp, Homo sapiens
caaaatgatgtgattttattgt

SEQ ID NO: 8297091 - DNA, 22 bp, Homo sapiens
caaacattcaagtacaagtctt

SEQ ID NO: 8297092 - DNA, 22 bp, Homo sapiens
caaagagttttttcatataatg

SEQ ID NO: 8297093 - DNA, 22 bp, Homo sapiens
attgtgaatagtgccgcagtaa

SEQ ID NO: 8297094 - DNA, 22 bp, Homo sapiens
attagtgatatgtgactagacc

SEQ ID NO: 8297095 - DNA, 22 bp, Homo sapiens
attagcttatcccatttctgaa

SEQ ID NO: 8297096 - DNA, 22 bp, Homo sapiens
attagcttattgtaaggtgaaa

SEQ ID NO: 8297097 - DNA, 21 bp, Homo sapiens
attagcttcaaaagcttgtct

SEQ ID NO: 8297098 - DNA, 22 bp, Homo sapiens
attagcttcaaagccatcaacc

SEQ ID NO: 8297099 - DNA, 22 bp, Homo sapiens
attagcttcctatagtaagggg

SEQ ID NO: 8297100 - DNA, 22 bp, Homo sapiens
attagcttctgaagcccttgaa

SEQ ID NO: 8297101 - DNA, 22 bp, Homo sapiens
attagcttctgtgcatggactt

SEQ ID NO: 8297102 - DNA, 20 bp, Homo sapiens
attagcttggagacagtggc

SEQ ID NO: 8297103 - DNA, 22 bp, Homo sapiens
attagcttggtatgccataaag

SEQ ID NO: 8297104 - DNA, 22 bp, Homo sapiens
attagcttatcacacaagctgc

SEQ ID NO: 8297105 - DNA, 22 bp, Homo sapiens
attagcttaggcatgaagagaa

SEQ ID NO: 8297106 - DNA, 22 bp, Homo sapiens
attagcttagtgtttccgtaat

SEQ ID NO: 8297107 - DNA, 22 bp, Homo sapiens
attagctttaaagactttgatt

SEQ ID NO: 8297108 - DNA, 22 bp, Homo sapiens
attagctttaaaccacagcagt

SEQ ID NO: 8297109 - DNA, 22 bp, Homo sapiens
attagctttatttgaaatagga

SEQ ID NO: 8297110 - DNA, 22 bp, Homo sapiens
attagctttggattcagaagat

SEQ ID NO: 8297111 - DNA, 22 bp, Homo sapiens
attagctttggtggaaaggagt

SEQ ID NO: 8297112 - DNA, 22 bp, Homo sapiens
gcactagtcaagtgaacaattt

SEQ ID NO: 8297113 - DNA, 22 bp, Homo sapiens
gcactagtctaggtgctaagat

SEQ ID NO: 8297114 - DNA, 22 bp, Homo sapiens
gcactagttctactgccagcaa

SEQ ID NO: 8297115 - DNA, 22 bp, Homo sapiens
gcactagtgttcttcagtaata

SEQ ID NO: 8297116 - DNA, 22 bp, Homo sapiens
ccagtcctgctccctgaccacc

SEQ ID NO: 8297117 - DNA, 22 bp, Homo sapiens
ccagtcctgccaccctgtctat

SEQ ID NO: 8297118 - DNA, 22 bp, Homo sapiens
ccatgcctttcactgaaccagt

SEQ ID NO: 8297119 - DNA, 22 bp, Homo sapiens
tgaatgatggtgtgttcttgcc

SEQ ID NO: 8297120 - DNA, 23 bp, Homo sapiens
tgaatgatggtgctcctcatctt

SEQ ID NO: 8297121 - DNA, 22 bp, Homo sapiens
tgaatgatgtataatattgaga

SEQ ID NO: 8297122 - DNA, 22 bp, Homo sapiens
tgaatgattaaaacccggacta

SEQ ID NO: 8297123 - DNA, 23 bp, Homo sapiens
tgaatgattgtactgagctttta

SEQ ID NO: 8297124 - DNA, 22 bp, Homo sapiens
tgaatgatttcttaggcaattg

SEQ ID NO: 8297125 - DNA, 21 bp, Homo sapiens
tgaatgatgccccagagttgt

SEQ ID NO: 8297126 - DNA, 22 bp, Homo sapiens
tgaatgatgcagtataatgata

SEQ ID NO: 8297127 - DNA, 22 bp, Homo sapiens
tgaatgatgcatttgtttccca

SEQ ID NO: 8297128 - DNA, 21 bp, Homo sapiens
tgaatgatctggttgcctttt

SEQ ID NO: 8297129 - DNA, 22 bp, Homo sapiens
tgaatgatgaggggagaataat

SEQ ID NO: 8297130 - DNA, 22 bp, Homo sapiens
tgaatgatatattgggaataat

SEQ ID NO: 8297131 - DNA, 22 bp, Homo sapiens
tgaatgatacagaattatgtag

SEQ ID NO: 8297132 - DNA, 22 bp, Homo sapiens
tgaatgatctccgattagtcct

SEQ ID NO: 8297133 - DNA, 22 bp, Homo sapiens
tgaatgatctagttttgtagac

SEQ ID NO: 8297134 - DNA, 22 bp, Homo sapiens
tgaatgatatgtgaaaaggaac

SEQ ID NO: 8297135 - DNA, 22 bp, Homo sapiens
tgaatgatttgggtgcattcag

SEQ ID NO: 8297136 - DNA, 22 bp, Homo sapiens
tctggcctcttgggatgctccc

SEQ ID NO: 8297137 - DNA, 22 bp, Homo sapiens
tctggcctgaaagtccatgctt

SEQ ID NO: 8297138 - DNA, 22 bp, Homo sapiens
ccaggacagggagacgggagcc

SEQ ID NO: 8297139 - DNA, 22 bp, Homo sapiens
ccaggatggggagcagatagaa

SEQ ID NO: 8297140 - DNA, 22 bp, Homo sapiens
cccattcttcatggtttcctgt

SEQ ID NO: 8297141 - DNA, 22 bp, Homo sapiens
cccaggtccccacctgtctgct

SEQ ID NO: 8297142 - DNA, 21 bp, Homo sapiens
cccgcacagcggtaggccgcc

SEQ ID NO: 8297143 - DNA, 22 bp, Homo sapiens
cccgagtgtctactcactccca

SEQ ID NO: 8297144 - DNA, 22 bp, Homo sapiens
tgccctggtgaagtgctctcct

SEQ ID NO: 8297145 - DNA, 22 bp, Homo sapiens
tgccctggttacactggagtcc

SEQ ID NO: 8297146 - DNA, 22 bp, Homo sapiens
tgcctgttgcccacctgataaa

SEQ ID NO: 8297147 - DNA, 22 bp, Homo sapiens
tggcctggctgccctgtctgga

SEQ ID NO: 8297148 - DNA, 22 bp, Homo sapiens
tgggccagtttctcattgaaat

SEQ ID NO: 8297149 - DNA, 22 bp, Homo sapiens
tgggctgctgttacaggggctg

SEQ ID NO: 8297150 - DNA, 22 bp, Homo sapiens
tgggctgcggataggcctcgga

SEQ ID NO: 8297151 - DNA, 18 bp, Homo sapiens
tgggctgcctggcctctg

SEQ ID NO: 8297152 - DNA, 22 bp, Homo sapiens
tgggctgcttctattggtggtc

SEQ ID NO: 8297153 - DNA, 22 bp, Homo sapiens
cctgagctcaaagggtgcctgg

SEQ ID NO: 8297154 - DNA, 22 bp, Homo sapiens
tggcttcatgtagtttgagttg

SEQ ID NO: 8297155 - DNA, 22 bp, Homo sapiens
catctgctgttccttggactca

SEQ ID NO: 8297156 - DNA, 22 bp, Homo sapiens
tcagaggagcaaaagaggggat

SEQ ID NO: 8297157 - DNA, 22 bp, Homo sapiens
tcaatcacgtgttccatgttct

SEQ ID NO: 8297158 - DNA, 22 bp, Homo sapiens
cataatatctccgattacttgc

SEQ ID NO: 8297159 - DNA, 22 bp, Homo sapiens
cataattaaattctgggcaaga

SEQ ID NO: 8297160 - DNA, 22 bp, Homo sapiens
cataattactgatatgctgatt

SEQ ID NO: 8297161 - DNA, 22 bp, Homo sapiens
cataattagagaattcatgtta

SEQ ID NO: 8297162 - DNA, 22 bp, Homo sapiens
cataattaggcagttgatcatt

SEQ ID NO: 8297163 - DNA, 22 bp, Homo sapiens
cataattagtcatgttatgcat

SEQ ID NO: 8297164 - DNA, 22 bp, Homo sapiens
cataattataaacgcaagttca

SEQ ID NO: 8297165 - DNA, 22 bp, Homo sapiens
cattagcaggcactaagaaggt

SEQ ID NO: 8297166 - DNA, 22 bp, Homo sapiens
cattgttaccatcttttaccta

SEQ ID NO: 8297167 - DNA, 22 bp, Homo sapiens
cattgttatagcattacacacc

SEQ ID NO: 8297168 - DNA, 22 bp, Homo sapiens
catttaatctggctcatgagca

SEQ ID NO: 8297169 - DNA, 22 bp, Homo sapiens
catttaatgcctttgccatcca

SEQ ID NO: 8297170 - DNA, 20 bp, Homo sapiens
tcctaataacctgaagaaat

SEQ ID NO: 8297171 - DNA, 22 bp, Homo sapiens
tcctagaacagcccacctggaa

SEQ ID NO: 8297172 - DNA, 22 bp, Homo sapiens
tcctagaactccaggacagtcc

SEQ ID NO: 8297173 - DNA, 22 bp, Homo sapiens
tcctggctccagcagctcttcc

SEQ ID NO: 8297174 - DNA, 22 bp, Homo sapiens
tcctggctcctgatctgtcact

SEQ ID NO: 8297175 - DNA, 22 bp, Homo sapiens
tcctgggcttagtggctaggtc

SEQ ID NO: 8297176 - DNA, 22 bp, Homo sapiens
cagtcacattgccctgcattta

SEQ ID NO: 8297177 - DNA, 22 bp, Homo sapiens
cagtcacataggtatacacata

SEQ ID NO: 8297178 - DNA, 22 bp, Homo sapiens
cagtcacacaagtggacttggg

SEQ ID NO: 8297179 - DNA, 17 bp, Homo sapiens
cagtcacaggtcttttc

SEQ ID NO: 8297180 - DNA, 22 bp, Homo sapiens
caggtacattcgtagacccatt

SEQ ID NO: 8297181 - DNA, 22 bp, Homo sapiens
caggtcagaggcgcagccccca

SEQ ID NO: 8297182 - DNA, 19 bp, Homo sapiens
tagcttcacgtggtctaga

SEQ ID NO: 8297183 - DNA, 22 bp, Homo sapiens
tagcttcatgcttcaccacgct

SEQ ID NO: 8297184 - DNA, 22 bp, Homo sapiens
tagcttcagtggccctagacac

SEQ ID NO: 8297185 - DNA, 22 bp, Homo sapiens
caggcctctatggtcagctgag

SEQ ID NO: 8297186 - DNA, 19 bp, Homo sapiens
caggcctctggtctgctgt

SEQ ID NO: 8297187 - DNA, 22 bp, Homo sapiens
caggccagagcgcgtggttggg

SEQ ID NO: 8297188 - DNA, 22 bp, Homo sapiens
tttaatatccagtggatacaaa

SEQ ID NO: 8297189 - DNA, 23 bp, Homo sapiens
ttgtatttttagtagagacaggg

SEQ ID NO: 8297190 - DNA, 22 bp, Homo sapiens
ttcttttacattaagatttcag

SEQ ID NO: 8297191 - DNA, 22 bp, Homo sapiens
ttcttttacattaagatttcag

SEQ ID NO: 8297192 - DNA, 22 bp, Homo sapiens
tttagtagaaatatttgggcct

SEQ ID NO: 8297193 - DNA, 22 bp, Homo sapiens
tttagtgattcatttagaaaaa

SEQ ID NO: 8297194 - DNA, 22 bp, Homo sapiens
ctctctgagtgagggacaagct

SEQ ID NO: 8297195 - DNA, 22 bp, Homo sapiens
ctgcactgacttccccggctgc

SEQ ID NO: 8297196 - DNA, 22 bp, Homo sapiens
ctgaggccgtctgggtctgcag

SEQ ID NO: 8297197 - DNA, 22 bp, Homo sapiens
ctgaccctagcatctctgtgca

SEQ ID NO: 8297198 - DNA, 22 bp, Homo sapiens
ctgaatcatggtcattagttta

SEQ ID NO: 8297199 - DNA, 22 bp, Homo sapiens
ttttagaatcaggttgtctggg

SEQ ID NO: 8297200 - DNA, 22 bp, Homo sapiens
ctctgcccgcggatgccacgtc

SEQ ID NO: 8297201 - DNA, 22 bp, Homo sapiens
ctctgccctcgcacatctgcca

SEQ ID NO: 8297202 - DNA, 22 bp, Homo sapiens
ctctgcccacgtcttgcccaga

SEQ ID NO: 8297203 - DNA, 22 bp, Homo sapiens
ctaaataatccctctggtctta

SEQ ID NO: 8297204 - DNA, 22 bp, Homo sapiens
ttaggcatgcaagattaagctc

SEQ ID NO: 8297205 - DNA, 22 bp, Homo sapiens
cgcatccagggcgcaggatctg

SEQ ID NO: 8297206 - DNA, 22 bp, Homo sapiens
ctattatttcctcatctataaa

SEQ ID NO: 8297207 - DNA, 19 bp, Homo sapiens
ctattagcttgggcatcat

SEQ ID NO: 8297208 - DNA, 22 bp, Homo sapiens
ctattacatttctggacattca

SEQ ID NO: 8297209 - DNA, 22 bp, Homo sapiens
ctagcacagcccattcagtcta

SEQ ID NO: 8297210 - DNA, 22 bp, Homo sapiens
ctacagaggacacaaagatctt

SEQ ID NO: 8297211 - DNA, 22 bp, Homo sapiens
cctgtgtcatcagctgtggcta

SEQ ID NO: 8297212 - DNA, 22 bp, Homo sapiens
cctgtctgtattggtttgctat

SEQ ID NO: 8297213 - DNA, 22 bp, Homo sapiens
cctgtctgaggaggtgctcttt

SEQ ID NO: 8297214 - DNA, 22 bp, Homo sapiens
cctgggcttacgacctctgact

SEQ ID NO: 8297215 - DNA, 22 bp, Homo sapiens
cctggtgttgccaatctgtgcc

SEQ ID NO: 8297216 - DNA, 22 bp, Homo sapiens
gaagacatcatggagaggatag

SEQ ID NO: 8297217 - DNA, 22 bp, Homo sapiens
gaaatgattttagtttatcatg

SEQ ID NO: 8297218 - DNA, 22 bp, Homo sapiens
gaatatatttctcttaccttta

SEQ ID NO: 8297219 - DNA, 22 bp, Homo sapiens
gaatatattggtgaaaatagtt

SEQ ID NO: 8297220 - DNA, 22 bp, Homo sapiens
gaatagatcctcatttattgat

SEQ ID NO: 8297221 - DNA, 22 bp, Homo sapiens
gaatacattggaaatcagaata

SEQ ID NO: 8297222 - DNA, 22 bp, Homo sapiens
gaagttgatagagtacatgatt

SEQ ID NO: 8297223 - DNA, 22 bp, Homo sapiens
gaagcttcgtggctcttcaaat

SEQ ID NO: 8297224 - DNA, 22 bp, Homo sapiens
gaataacagcaagtttgcaggc

SEQ ID NO: 8297225 - DNA, 22 bp, Homo sapiens
gaataacattggaaccctgaag

SEQ ID NO: 8297226 - DNA, 22 bp, Homo sapiens
gacacagaatgggtgctcagta

SEQ ID NO: 8297227 - DNA, 22 bp, Homo sapiens
gacacagaaggtcacatgttca

SEQ ID NO: 8297228 - DNA, 22 bp, Homo sapiens
gacacagagacttgcagttgta

SEQ ID NO: 8297229 - DNA, 22 bp, Homo sapiens
gagacacaaacacatttagagg

SEQ ID NO: 8297230 - DNA, 22 bp, Homo sapiens
gagcttcagaatttaacagact

SEQ ID NO: 8297231 - DNA, 22 bp, Homo sapiens
gagcttcagagaccacttaact

SEQ ID NO: 8297232 - DNA, 22 bp, Homo sapiens
gagcttcacgggggacagcatt

SEQ ID NO: 8297233 - DNA, 20 bp, Homo sapiens
gagcttcaactcagcaaaca

SEQ ID NO: 8297234 - DNA, 22 bp, Homo sapiens
gagcctggatagccttgttcca

SEQ ID NO: 8297235 - DNA, 22 bp, Homo sapiens
ctgtcctgtgctttttactgtc

SEQ ID NO: 8297236 - DNA, 22 bp, Homo sapiens
ctgtcctgcccaccctgcaggg

SEQ ID NO: 8297237 - DNA, 22 bp, Homo sapiens
ctgtcctgccagtcctggactc

SEQ ID NO: 8297238 - DNA, 22 bp, Homo sapiens
ctgtcctgatggtgccactggt

SEQ ID NO: 8297239 - DNA, 22 bp, Homo sapiens
ctgtcctgtactttgaggccct

SEQ ID NO: 8297240 - DNA, 19 bp, Homo sapiens
ctgtcctggtttggtccct

SEQ ID NO: 8297241 - DNA, 22 bp, Homo sapiens
ctgtcctggccgcccttgtgag

SEQ ID NO: 8297242 - DNA, 22 bp, Homo sapiens
ctgtcctgggggtggtccttgc

SEQ ID NO: 8297243 - DNA, 22 bp, Homo sapiens
ctgtcctgaagttttcatgaga

SEQ ID NO: 8297244 - DNA, 22 bp, Homo sapiens
ctgtgtcttctgcttacagtct

SEQ ID NO: 8297245 - DNA, 22 bp, Homo sapiens
ctgtggctctcagaggctgctg

SEQ ID NO: 8297246 - DNA, 22 bp, Homo sapiens
ctgtggctggcctgtctgacat

SEQ ID NO: 8297247 - DNA, 22 bp, Homo sapiens
cttcagcatctttttcttgggg

SEQ ID NO: 8297248 - DNA, 22 bp, Homo sapiens
cttatttgaatgtatgagtttt

SEQ ID NO: 8297249 - DNA, 22 bp, Homo sapiens
cttatttgtactaataaatctg

SEQ ID NO: 8297250 - DNA, 22 bp, Homo sapiens
cttatttgagagaaaagaaact

SEQ ID NO: 8297251 - DNA, 22 bp, Homo sapiens
cttatttgcccatgtttcttta

SEQ ID NO: 8297252 - DNA, 22 bp, Homo sapiens
ctgggtctggctactgcttcct

SEQ ID NO: 8297253 - DNA, 22 bp, Homo sapiens
ctgggtctgggcctcctggagt

SEQ ID NO: 8297254 - DNA, 22 bp, Homo sapiens
ctggggccctgggtctgccctc

SEQ ID NO: 8297255 - DNA, 22 bp, Homo sapiens
ctgggctggacacacttaacct

SEQ ID NO: 8297256 - DNA, 22 bp, Homo sapiens
ctgggctgcaggagtggggcaa

SEQ ID NO: 8297257 - DNA, 22 bp, Homo sapiens
ctgggctgcagttcctggtcct

SEQ ID NO: 8297258 - DNA, 22 bp, Homo sapiens
ctggctgtgctgactgagaggg

SEQ ID NO: 8297259 - DNA, 22 bp, Homo sapiens
ctggccctggagggctgtgcga

SEQ ID NO: 8297260 - DNA, 22 bp, Homo sapiens
ctggcctggtctggcctctcca

SEQ ID NO: 8297261 - DNA, 22 bp, Homo sapiens
ctggctcatagagcagctccaa

SEQ ID NO: 8297262 - DNA, 22 bp, Homo sapiens
ctggctccaaattctgatgttc

SEQ ID NO: 8297263 - DNA, 22 bp, Homo sapiens
ctgcatccatgttgctgcaaag

SEQ ID NO: 8297264 - DNA, 22 bp, Homo sapiens
ctgccagctcgccacaatgaca

SEQ ID NO: 8297265 - DNA, 22 bp, Homo sapiens
ctgccagcaatgtgaccatgct

SEQ ID NO: 8297266 - DNA, 22 bp, Homo sapiens
gtgaacagataatagaaatgaa

SEQ ID NO: 8297267 - DNA, 22 bp, Homo sapiens
gtcctgggcggagggctgctgt

SEQ ID NO: 8297268 - DNA, 22 bp, Homo sapiens
gtctgcctgctagtggctgcct

SEQ ID NO: 8297269 - DNA, 22 bp, Homo sapiens
gtgcatttgtgcatgcacatgt

SEQ ID NO: 8297270 - DNA, 21 bp, Homo sapiens
gtgcacagtcctgcacacagg

SEQ ID NO: 8297271 - DNA, 22 bp, Homo sapiens
gtattagcaagagttgtgattt

SEQ ID NO: 8297272 - DNA, 22 bp, Homo sapiens
gtattagctgttagctacatca

SEQ ID NO: 8297273 - DNA, 22 bp, Homo sapiens
gtattagctgccttggagctaa

SEQ ID NO: 8297274 - DNA, 22 bp, Homo sapiens
ggttttaactacagaattgcaa

SEQ ID NO: 8297275 - DNA, 22 bp, Homo sapiens
gtccctgcatcaccacgggact

SEQ ID NO: 8297276 - DNA, 22 bp, Homo sapiens
gtccctgcatctgcaggccatg

SEQ ID NO: 8297277 - DNA, 18 bp, Homo sapiens
gtccacagccctcacagc

SEQ ID NO: 8297278 - DNA, 22 bp, Homo sapiens
gtccacagggatggccacacat

SEQ ID NO: 8297279 - DNA, 18 bp, Homo sapiens
ggtcctgggcctggctca

SEQ ID NO: 8297280 - DNA, 22 bp, Homo sapiens
ggtccctggggaactaggctgt

SEQ ID NO: 8297281 - DNA, 22 bp, Homo sapiens
ggggttaacagtattgctcatg

SEQ ID NO: 8297282 - DNA, 22 bp, Homo sapiens
gggctgccaagcctgcctgcct

SEQ ID NO: 8297283 - DNA, 22 bp, Homo sapiens
gggccaaggggagctggaaggg

SEQ ID NO: 8297284 - DNA, 22 bp, Homo sapiens
ggcaaactacatttttgaaata

SEQ ID NO: 8297285 - DNA, 22 bp, Homo sapiens
ggagccagctccctccttgtga

SEQ ID NO: 8297286 - DNA, 22 bp, Homo sapiens
ggagccagagggatgcagttga

SEQ ID NO: 8297287 - DNA, 22 bp, Homo sapiens
gggagactagtgctatgttttc

SEQ ID NO: 8297288 - DNA, 22 bp, Homo sapiens
ggctttagtgtaggtttctgtt

SEQ ID NO: 8297289 - DNA, 22 bp, Homo sapiens
gggcaggagagaacagtcatgg

SEQ ID NO: 8297290 - DNA, 22 bp, Homo sapiens
gcacaggctccggaggagagct

SEQ ID NO: 8297291 - DNA, 22 bp, Homo sapiens
gcacagaaatgtctacacatgt

SEQ ID NO: 8297292 - DNA, 22 bp, Homo sapiens
gcacacagtagggattcaatga

SEQ ID NO: 8297293 - DNA, 18 bp, Homo sapiens
gcagagcagaagctcaag

SEQ ID NO: 8297294 - DNA, 22 bp, Homo sapiens
gcagaggtgaccagcagcaggg

SEQ ID NO: 8297295 - DNA, 22 bp, Homo sapiens
gcagtggctaagctcgcatgca

SEQ ID NO: 8297296 - DNA, 22 bp, Homo sapiens
gcagtggctaggagtctggcgt

SEQ ID NO: 8297297 - DNA, 23 bp, Homo sapiens
gccagccttgctctcctgcagcc

SEQ ID NO: 8297298 - DNA, 21 bp, Homo sapiens
gccagcctgtttacctgtggt

SEQ ID NO: 8297299 - DNA, 22 bp, Homo sapiens
gccagccttctgtggcctgcaa

SEQ ID NO: 8297300 - DNA, 22 bp, Homo sapiens
gccagcctgtgcttggccaggc

SEQ ID NO: 8297301 - DNA, 22 bp, Homo sapiens
gccagcctgtgggggctctgtg

SEQ ID NO: 8297302 - DNA, 22 bp, Homo sapiens
gcctctggagttgcttgtaaat

SEQ ID NO: 8297303 - DNA, 22 bp, Homo sapiens
gccagggttcgaatccgtatgg

SEQ ID NO: 8297304 - DNA, 22 bp, Homo sapiens
ggagccagaaatgctgtggttg

SEQ ID NO: 8297305 - DNA, 22 bp, Homo sapiens
ggaatgatggtgcctagattat

SEQ ID NO: 8297306 - DNA, 22 bp, Homo sapiens
ggaatctttgaaggattttaag

SEQ ID NO: 8297307 - DNA, 22 bp, Homo sapiens
gctggctgttggaggtacctgc

SEQ ID NO: 8297308 - DNA, 22 bp, Homo sapiens
gctggctgtgtttcatctctga

SEQ ID NO: 8297309 - DNA, 22 bp, Homo sapiens
gctggctgtgttccttctgcca

SEQ ID NO: 8297310 - DNA, 22 bp, Homo sapiens
gctggctttgcactgggtgcat

SEQ ID NO: 8297311 - DNA, 22 bp, Homo sapiens
gctgggcttcacctccagagtt

SEQ ID NO: 8297312 - DNA, 22 bp, Homo sapiens
gctggctggcgggtgcgtcctc

SEQ ID NO: 8297313 - DNA, 18 bp, Homo sapiens
gctctggctcacctccag

SEQ ID NO: 8297314 - DNA, 22 bp, Homo sapiens
gctgaatgaatgtattttaaaa

SEQ ID NO: 8297315 - DNA, 23 bp, Homo sapiens
gctgaatgtaatgttctttgggt

SEQ ID NO: 8297316 - DNA, 18 bp, Homo sapiens
gctgaatgtctgctttgc

SEQ ID NO: 8297317 - DNA, 22 bp, Homo sapiens
gctgcctgtcctgaggagtccg

SEQ ID NO: 8297318 - DNA, 22 bp, Homo sapiens
gctgcctccaatctgtgccccg

SEQ ID NO: 8297319 - DNA, 22 bp, Homo sapiens
gcgtggcttagagtggggtacc

SEQ ID NO: 8297320 - DNA, 22 bp, Homo sapiens
gctacaggagctgtcacatgct

SEQ ID NO: 8297321 - DNA, 22 bp, Homo sapiens
gctacaggtatatagatgaaac

SEQ ID NO: 8297322 - DNA, 22 bp, Homo sapiens
gctacagagctctgtgaagaga

SEQ ID NO: 8297323 - DNA, 22 bp, Homo sapiens
gcctctgtcatagctcatgtga

SEQ ID NO: 8297324 - DNA, 22 bp, Homo sapiens
gcctctggggcagctgagtcat

SEQ ID NO: 8297325 - DNA, 22 bp, Homo sapiens
gcctctggtccctcatgctgtg

SEQ ID NO: 8297326 - DNA, 22 bp, Homo sapiens
tatagcatatacagataagctg

SEQ ID NO: 8297327 - DNA, 20 bp, Homo sapiens
tatctaaatgcttacattac

SEQ ID NO: 8297328 - DNA, 22 bp, Homo sapiens
tatctaaaggatttaatttagt

SEQ ID NO: 8297329 - DNA, 22 bp, Homo sapiens
tataattagtaaatggcagatt

SEQ ID NO: 8297330 - DNA, 22 bp, Homo sapiens
taggtgggtgacttccatgggg

SEQ ID NO: 8297331 - DNA, 22 bp, Homo sapiens
tatacaagtaatgctgaatgat

SEQ ID NO: 8297332 - DNA, 22 bp, Homo sapiens
tatgtgcatatgcatacacaca

SEQ ID NO: 8297333 - DNA, 22 bp, Homo sapiens
tatgtgtggcagctgggagtgt

SEQ ID NO: 8297334 - DNA, 23 bp, Homo sapiens
tatgtgtgggtctactagaagtc

SEQ ID NO: 8297335 - DNA, 21 bp, Homo sapiens
tattagcttctggtgctgttt

SEQ ID NO: 8297336 - DNA, 22 bp, Homo sapiens
tattagctccagtactgttgcc

SEQ ID NO: 8297337 - DNA, 22 bp, Homo sapiens
tattagctgtgtaactctggtt

SEQ ID NO: 8297338 - DNA, 22 bp, Homo sapiens
tattagctcatgatttcggtgg

SEQ ID NO: 8297339 - DNA, 17 bp, Homo sapiens
tattagctagcttccag

SEQ ID NO: 8297340 - DNA, 22 bp, Homo sapiens
tatgtacacacacatgcatgta

SEQ ID NO: 8297341 - DNA, 22 bp, Homo sapiens
tatgtacagggatagaacttga

SEQ ID NO: 8297342 - DNA, 18 bp, Homo sapiens
tattctgtcctatgaagc

SEQ ID NO: 8297343 - DNA, 22 bp, Homo sapiens
tattagcttgtttggcaggatg

SEQ ID NO: 8297344 - DNA, 22 bp, Homo sapiens
tattagctttagcctttggatg

SEQ ID NO: 8297345 - DNA, 22 bp, Homo sapiens
tattagcttctggttttgttct

SEQ ID NO: 8297346 - DNA, 22 bp, Homo sapiens
tatttctgaatccaaaaggtca

SEQ ID NO: 8297347 - DNA, 22 bp, Homo sapiens
tatttatgtggaccataagcct

SEQ ID NO: 8297348 - DNA, 20 bp, Homo sapiens
tatttacaacttagagcctc

SEQ ID NO: 8297349 - DNA, 22 bp, Homo sapiens
tagaatgacctcctcttagctt

SEQ ID NO: 8297350 - DNA, 22 bp, Homo sapiens
tagaatgagaaagtgtagcagg

SEQ ID NO: 8297351 - DNA, 22 bp, Homo sapiens
tacttttagcctatttgattct

SEQ ID NO: 8297352 - DNA, 23 bp, Homo sapiens
tagcagcatttttagcctctgtc

SEQ ID NO: 8297353 - DNA, 22 bp, Homo sapiens
tagctgaagggcatttaataaa

SEQ ID NO: 8297354 - DNA, 23 bp, Homo sapiens
tacagaaggagtagtcactaaga

SEQ ID NO: 8297355 - DNA, 22 bp, Homo sapiens
tacagaagctgagacactgaga

SEQ ID NO: 8297356 - DNA, 22 bp, Homo sapiens
tacagaagcttttgaaaagatg

SEQ ID NO: 8297357 - DNA, 22 bp, Homo sapiens
tacagagttttcctgccaagaa

SEQ ID NO: 8297358 - DNA, 21 bp, Homo sapiens
tacagatgaggagaccaaggc

SEQ ID NO: 8297359 - DNA, 22 bp, Homo sapiens
tacatagagggtaatagcatca

SEQ ID NO: 8297360 - DNA, 22 bp, Homo sapiens
taattacagaggtttgccagtt

SEQ ID NO: 8297361 - DNA, 22 bp, Homo sapiens
taattacaggtccaaaacaatc

SEQ ID NO: 8297362 - DNA, 22 bp, Homo sapiens
taataatagcagtagctgccac

SEQ ID NO: 8297363 - DNA, 22 bp, Homo sapiens
taataagcgtagaaggtatatc

SEQ ID NO: 8297364 - DNA, 19 bp, Homo sapiens
taataagcaatatggaagt

SEQ ID NO: 8297365 - DNA, 22 bp, Homo sapiens
taatacatcattcatctaagga

SEQ ID NO: 8297366 - DNA, 22 bp, Homo sapiens
taaaatgatctctcatgttctt

SEQ ID NO: 8297367 - DNA, 22 bp, Homo sapiens
taaattgttttctagaagttgt

SEQ ID NO: 8297368 - DNA, 22 bp, Homo sapiens
gttcagcacaggtgctcagaca

SEQ ID NO: 8297369 - DNA, 22 bp, Homo sapiens
gttcagcaagtactcagtccac

SEQ ID NO: 8297370 - DNA, 18 bp, Homo sapiens
gtttcatgcatgtgaaac

SEQ ID NO: 8297371 - DNA, 22 bp, Homo sapiens
gttaataaaggtatagaatcag

SEQ ID NO: 8297372 - DNA, 22 bp, Homo sapiens
gtgctcctcacagtgtggccct

SEQ ID NO: 8297373 - DNA, 22 bp, Homo sapiens
gtgtgcatgcatagacaccaca

SEQ ID NO: 8297374 - DNA, 22 bp, Homo sapiens
gtgtgcatgtgcttgcacagat

SEQ ID NO: 8297375 - DNA, 23 bp, Homo sapiens
gtgtgccaagcactgtgccagga

SEQ ID NO: 8297376 - DNA, 22 bp, Homo sapiens
gtgtgccaacaaaagacagtgc

SEQ ID NO: 8297377 - DNA, 22 bp, Homo sapiens
gtgtgccaccactgacaggatt

SEQ ID NO: 8297378 - DNA, 22 bp, Homo sapiens
tcagcactttttaaagcagcat

SEQ ID NO: 8297379 - DNA, 22 bp, Homo sapiens
tcagcactttgaagcagaagga

SEQ ID NO: 8297380 - DNA, 22 bp, Homo sapiens
tcagcactttgaagcagaagga

SEQ ID NO: 8297381 - DNA, 22 bp, Homo sapiens
tcagcacttttactctctttgc

SEQ ID NO: 8297382 - DNA, 22 bp, Homo sapiens
tcagcacttggatttcagagat

SEQ ID NO: 8297383 - DNA, 22 bp, Homo sapiens
tcagcctttgaagggctgcagg

SEQ ID NO: 8297384 - DNA, 20 bp, Homo sapiens
tcagccttctcatcctgggg

SEQ ID NO: 8297385 - DNA, 20 bp, Homo sapiens
tcagccttgaatgcttgaaa

SEQ ID NO: 8297386 - DNA, 22 bp, Homo sapiens
tcagccttgcttctggactggt

SEQ ID NO: 8297387 - DNA, 22 bp, Homo sapiens
tcatgccaatttctgcatggct

SEQ ID NO: 8297388 - DNA, 22 bp, Homo sapiens
tcatgccaaactgaacacagtt

SEQ ID NO: 8297389 - DNA, 22 bp, Homo sapiens
tcatgccaaaatccagtggctt

SEQ ID NO: 8297390 - DNA, 22 bp, Homo sapiens
tcattattttggactggagtgt

SEQ ID NO: 8297391 - DNA, 21 bp, Homo sapiens
tcactagtgccttctgtcatt

SEQ ID NO: 8297392 - DNA, 22 bp, Homo sapiens
tcactagtcgcggggggaggta

SEQ ID NO: 8297393 - DNA, 23 bp, Homo sapiens
tcactagtcaagtgcctttgagt

SEQ ID NO: 8297394 - DNA, 22 bp, Homo sapiens
tcactagtcatcaacttccatt

SEQ ID NO: 8297395 - DNA, 22 bp, Homo sapiens
tcagcacaggtcttgcaaaaca

SEQ ID NO: 8297396 - DNA, 22 bp, Homo sapiens
tcagcactatacattttgaata

SEQ ID NO: 8297397 - DNA, 22 bp, Homo sapiens
tcagcactgaaattcttcacat

SEQ ID NO: 8297398 - DNA, 22 bp, Homo sapiens
tcagcactcgctacctagtaaa

SEQ ID NO: 8297399 - DNA, 22 bp, Homo sapiens
tcagcactgtgtccagtctccc

SEQ ID NO: 8297400 - DNA, 22 bp, Homo sapiens
tcagcacttactagtggccttt

SEQ ID NO: 8297401 - DNA, 22 bp, Homo sapiens
tcagcactgtcttttatttgaa

SEQ ID NO: 8297402 - DNA, 22 bp, Homo sapiens
tcagcactgtctattagtgaga

SEQ ID NO: 8297403 - DNA, 22 bp, Homo sapiens
tcagcactgaatctggatttgc

SEQ ID NO: 8297404 - DNA, 22 bp, Homo sapiens
tcagcactgatagaagtcaata

SEQ ID NO: 8297405 - DNA, 22 bp, Homo sapiens
tcagcactgatgtttcagaaga

SEQ ID NO: 8297406 - DNA, 22 bp, Homo sapiens
tcagcactggcgctgggcaggt

SEQ ID NO: 8297407 - DNA, 22 bp, Homo sapiens
tcaataatggcaggataaattt

SEQ ID NO: 8297408 - DNA, 22 bp, Homo sapiens
tcaagacatattaaatgtgcga

SEQ ID NO: 8297409 - DNA, 22 bp, Homo sapiens
tatttctgggagttcagaaatt

SEQ ID NO: 8297410 - DNA, 22 bp, Homo sapiens
tatttctgaggcccaggaagtg

SEQ ID NO: 8297411 - DNA, 22 bp, Homo sapiens
tatttctgtatgcataaaagga

SEQ ID NO: 8297412 - DNA, 22 bp, Homo sapiens
tatttctgtcagccagatatgg

SEQ ID NO: 8297413 - DNA, 22 bp, Homo sapiens
tcaagaatttggataagaaatg

SEQ ID NO: 8297414 - DNA, 20 bp, Homo sapiens
tcaagacagacatggagttt

SEQ ID NO: 8297415 - DNA, 22 bp, Homo sapiens
tcccagggattaggacatggat

SEQ ID NO: 8297416 - DNA, 22 bp, Homo sapiens
ttttttgtcttgaagaaatggt

SEQ ID NO: 8297417 - DNA, 22 bp, Homo sapiens
ttttagaagttcatgtgggatt

SEQ ID NO: 8297418 - DNA, 22 bp, Homo sapiens
tttgttttcaatgtgtcattca

SEQ ID NO: 8297419 - DNA, 22 bp, Homo sapiens
ttttagaagttcacttgggttt

SEQ ID NO: 8297420 - DNA, 22 bp, Homo sapiens
tttgtttgccacacaaaacagt

SEQ ID NO: 8297421 - DNA, 22 bp, Homo sapiens
tttgtagaactgtagaacaatg

SEQ ID NO: 8297422 - DNA, 22 bp, Homo sapiens
tttgtagacgtcagaagttact

SEQ ID NO: 8297423 - DNA, 22 bp, Homo sapiens
tttgtagaactatacttacatt

SEQ ID NO: 8297424 - DNA, 22 bp, Homo sapiens
tttgtagactaccagtaattgt

SEQ ID NO: 8297425 - DNA, 22 bp, Homo sapiens
tttgtagagggtaattgacaga

SEQ ID NO: 8297426 - DNA, 22 bp, Homo sapiens
tttgttgagttacagagatgaa

SEQ ID NO: 8297427 - DNA, 22 bp, Homo sapiens
tttcagcactttaggcagcagg

SEQ ID NO: 8297428 - DNA, 22 bp, Homo sapiens
tttattagattatcaaagaggt

SEQ ID NO: 8297429 - DNA, 22 bp, Homo sapiens
tttattagattatcaaagaggt

SEQ ID NO: 8297430 - DNA, 22 bp, Homo sapiens
tttattagtgcttgtatcactg

SEQ ID NO: 8297431 - DNA, 22 bp, Homo sapiens
tttatttggcatctctgccaag

SEQ ID NO: 8297432 - DNA, 22 bp, Homo sapiens
tttatttgtcttgccatttagt

SEQ ID NO: 8297433 - DNA, 22 bp, Homo sapiens
tttatttggcatccagggagaa

SEQ ID NO: 8297434 - DNA, 19 bp, Homo sapiens
tttatttgagacatgcctt

SEQ ID NO: 8297435 - DNA, 22 bp, Homo sapiens
tttatttgaatcaggggagaat

SEQ ID NO: 8297436 - DNA, 22 bp, Homo sapiens
tttaattgttgtgggtacatag

SEQ ID NO: 8297437 - DNA, 22 bp, Homo sapiens
tttaatttgtatttctagaggg

SEQ ID NO: 8297438 - DNA, 22 bp, Homo sapiens
ttgttttattctgcaatttccc

SEQ ID NO: 8297439 - DNA, 22 bp, Homo sapiens
ttgttttatctttctacagact

SEQ ID NO: 8297440 - DNA, 22 bp, Homo sapiens
ttgttttaacgactcagcttgt

SEQ ID NO: 8297441 - DNA, 22 bp, Homo sapiens
ttgttttaacctagtgtttatg

SEQ ID NO: 8297442 - DNA, 20 bp, Homo sapiens
ttgttttaaatcctggatga

SEQ ID NO: 8297443 - DNA, 22 bp, Homo sapiens
ttgttttagtaggtacactgag

SEQ ID NO: 8297444 - DNA, 22 bp, Homo sapiens
ttgttttaagccagtctgccta

SEQ ID NO: 8297445 - DNA, 22 bp, Homo sapiens
ttgttttaatgagggaggttga

SEQ ID NO: 8297446 - DNA, 18 bp, Homo sapiens
ttgttttaagactctgtc

SEQ ID NO: 8297447 - DNA, 22 bp, Homo sapiens
ttgtttgtatgctgagaagaat

SEQ ID NO: 8297448 - DNA, 22 bp, Homo sapiens
ttgtttgtaaggctcttagaat

SEQ ID NO: 8297449 - DNA, 22 bp, Homo sapiens
ttgtgaatgcttaatatgtttc

SEQ ID NO: 8297450 - DNA, 22 bp, Homo sapiens
ttgtctgacttctttagttact

SEQ ID NO: 8297451 - DNA, 22 bp, Homo sapiens
ttgatgtaaagtgattcatggg

SEQ ID NO: 8297452 - DNA, 22 bp, Homo sapiens
ttgattactatgtgttgaaagc

SEQ ID NO: 8297453 - DNA, 22 bp, Homo sapiens
ttgatgtacagaattgttcaca

SEQ ID NO: 8297454 - DNA, 23 bp, Homo sapiens
ttgatttagctgggattgcatgc

SEQ ID NO: 8297455 - DNA, 22 bp, Homo sapiens
ttgatttatagaatgttcaagc

SEQ ID NO: 8297456 - DNA, 22 bp, Homo sapiens
ttgatttgtaggaatggagacc

SEQ ID NO: 8297457 - DNA, 22 bp, Homo sapiens
ttgatttgattgatgaactaag

SEQ ID NO: 8297458 - DNA, 22 bp, Homo sapiens
ttgaatgatcctatctagcaca

SEQ ID NO: 8297459 - DNA, 22 bp, Homo sapiens
ttgaatgaggaagagcactggc

SEQ ID NO: 8297460 - DNA, 22 bp, Homo sapiens
ttgaatgagtgttttactcatg

SEQ ID NO: 8297461 - DNA, 22 bp, Homo sapiens
ttgaatgagaagttattgccat

SEQ ID NO: 8297462 - DNA, 20 bp, Homo sapiens
ttgaatgaatgtctggctca

SEQ ID NO: 8297463 - DNA, 22 bp, Homo sapiens
ttgaatgaagtccctttttact

SEQ ID NO: 8297464 - DNA, 22 bp, Homo sapiens
ttctttctcaacatgaatgttt

SEQ ID NO: 8297465 - DNA, 21 bp, Homo sapiens
ttctgccttcgaggtctcagg

SEQ ID NO: 8297466 - DNA, 22 bp, Homo sapiens
ttctgggcccactgtagcatcc

SEQ ID NO: 8297467 - DNA, 22 bp, Homo sapiens
ttcttacaagtattccaggtcc

SEQ ID NO: 8297468 - DNA, 22 bp, Homo sapiens
ttcttacatattttcatatggt

SEQ ID NO: 8297469 - DNA, 22 bp, Homo sapiens
ttcttacagagtttacagagcc

SEQ ID NO: 8297470 - DNA, 22 bp, Homo sapiens
ttcttacagatttggtgaatga

SEQ ID NO: 8297471 - DNA, 22 bp, Homo sapiens
ttcttgattagtctcatgccaa

SEQ ID NO: 8297472 - DNA, 22 bp, Homo sapiens
ttcatgtaggctgcaatgcaca

SEQ ID NO: 8297473 - DNA, 22 bp, Homo sapiens
ttcatgtaccgtgtaccaggca

SEQ ID NO: 8297474 - DNA, 22 bp, Homo sapiens
ttcagtgtcaatttttaaatat

SEQ ID NO: 8297475 - DNA, 22 bp, Homo sapiens
ttcacagtggctgtgccatttg

SEQ ID NO: 8297476 - DNA, 22 bp, Homo sapiens
ttcacagtggccctctctgagt

SEQ ID NO: 8297477 - DNA, 22 bp, Homo sapiens
ttcacagtgagctatgtcttgt

SEQ ID NO: 8297478 - DNA, 22 bp, Homo sapiens
ttactttggatggtcaagaaag

SEQ ID NO: 8297479 - DNA, 22 bp, Homo sapiens
ttacaaagaaaattaggcattt

SEQ ID NO: 8297480 - DNA, 22 bp, Homo sapiens
ttacaggtgggaaaactaagct

SEQ ID NO: 8297481 - DNA, 22 bp, Homo sapiens
ttaacattgtccttagcagatt

SEQ ID NO: 8297482 - DNA, 22 bp, Homo sapiens
ttaagaaggtactcaaagatct

SEQ ID NO: 8297483 - DNA, 22 bp, Homo sapiens
ttaattaattagttaagcatgt

SEQ ID NO: 8297484 - DNA, 22 bp, Homo sapiens
ttaattatgagaaagggaaaag

SEQ ID NO: 8297485 - DNA, 22 bp, Homo sapiens
ttaaatgatgcatatcatttag

SEQ ID NO: 8297486 - DNA, 22 bp, Homo sapiens
ttaaatgaggctgatgtagatt

SEQ ID NO: 8297487 - DNA, 22 bp, Homo sapiens
ttaaatgagatgttcagatatt

SEQ ID NO: 8297488 - DNA, 22 bp, Homo sapiens
ttaaattagtcaagcttctctg

SEQ ID NO: 8297489 - DNA, 21 bp, Homo sapiens
tgtgtgcatatgcatgtacat

SEQ ID NO: 8297490 - DNA, 22 bp, Homo sapiens
tgttcctgaatgcctggctggc

SEQ ID NO: 8297491 - DNA, 22 bp, Homo sapiens
tgtgtccatctgacaggagagg

SEQ ID NO: 8297492 - DNA, 22 bp, Homo sapiens
tgtgtccattcaggcactgacc

SEQ ID NO: 8297493 - DNA, 22 bp, Homo sapiens
tgtgtcctgtccccttgctgct

SEQ ID NO: 8297494 - DNA, 22 bp, Homo sapiens
tgtgtacaaactaacaacatat

SEQ ID NO: 8297495 - DNA, 19 bp, Homo sapiens
tgtggtctctgttctcagg

SEQ ID NO: 8297496 - DNA, 22 bp, Homo sapiens
tgtggaggattctgatgccagc

SEQ ID NO: 8297497 - DNA, 22 bp, Homo sapiens
tgtggagctcagaagtagcagt

SEQ ID NO: 8297498 - DNA, 22 bp, Homo sapiens
tcccctgcagatgagggcagtg

SEQ ID NO: 8297499 - DNA, 22 bp, Homo sapiens
attcatcagctaatggacattt

SEQ ID NO: 8297500 - DNA, 22 bp, Homo sapiens
gcagatggaaagtgcttgaggg

SEQ ID NO: 8297501 - DNA, 22 bp, Homo sapiens
gcagatgctgtggtgatagaag

SEQ ID NO: 8297502 - DNA, 22 bp, Homo sapiens
gcagctgccttcagctggatgg

SEQ ID NO: 8297503 - DNA, 22 bp, Homo sapiens
gcagctgctggagggaggcagg

SEQ ID NO: 8297504 - DNA, 22 bp, Homo sapiens
gcagctggacccacacggctta

SEQ ID NO: 8297505 - DNA, 22 bp, Homo sapiens
caaagccatagagtagataaga

SEQ ID NO: 8297506 - DNA, 22 bp, Homo sapiens
caaagccaggctttctaatgta

SEQ ID NO: 8297507 - DNA, 21 bp, Homo sapiens
caaagccaggcaactctctcc

SEQ ID NO: 8297508 - DNA, 22 bp, Homo sapiens
caaaataccacgacttgtttta

SEQ ID NO: 8297509 - DNA, 22 bp, Homo sapiens
gatacaaaatataaatggagag

SEQ ID NO: 8297510 - DNA, 22 bp, Homo sapiens
gatacaaattcatgtctgaatt

SEQ ID NO: 8297511 - DNA, 22 bp, Homo sapiens
gaatacaaagcagaactcatac

SEQ ID NO: 8297512 - DNA, 22 bp, Homo sapiens
atgacagctctagcacacagta

SEQ ID NO: 8297513 - DNA, 22 bp, Homo sapiens
cagccctcaaaccacttccagg

SEQ ID NO: 8297514 - DNA, 22 bp, Homo sapiens
cagccctcaggtcctcagcagc

SEQ ID NO: 8297515 - DNA, 22 bp, Homo sapiens
gtcccagaggctttggccacag

SEQ ID NO: 8297516 - DNA, 22 bp, Homo sapiens
gggctctgtttagatcagagat

SEQ ID NO: 8297517 - DNA, 22 bp, Homo sapiens
gggctctgtttagaccagagat

SEQ ID NO: 8297518 - DNA, 22 bp, Homo sapiens
gggctctgcgggcccggactcc

SEQ ID NO: 8297519 - DNA, 22 bp, Homo sapiens
ggtcctgggaagatgctcatga

SEQ ID NO: 8297520 - DNA, 22 bp, Homo sapiens
ggggagcaggctgggctgtctg

SEQ ID NO: 8297521 - DNA, 22 bp, Homo sapiens
ggcaggtgcccagagagcacga

SEQ ID NO: 8297522 - DNA, 22 bp, Homo sapiens
ggcaggtgcacctgagccatct

SEQ ID NO: 8297523 - DNA, 22 bp, Homo sapiens
ggcaggtgatctagagtcaata

SEQ ID NO: 8297524 - DNA, 22 bp, Homo sapiens
ggcaggcatcatgtggtcatta

SEQ ID NO: 8297525 - DNA, 22 bp, Homo sapiens
ggagcaggcagggccgtgtctg

SEQ ID NO: 8297526 - DNA, 22 bp, Homo sapiens
caagtaatggttttataatagt

SEQ ID NO: 8297527 - DNA, 22 bp, Homo sapiens
ctaagaacagtctaccctcctt

SEQ ID NO: 8297528 - DNA, 17 bp, Homo sapiens
cgggcatggagggcagg

SEQ ID NO: 8297529 - DNA, 22 bp, Homo sapiens
agtccaggtggaccttggccag

SEQ ID NO: 8297530 - DNA, 22 bp, Homo sapiens
agtatggggctgtgtgtgcaca

SEQ ID NO: 8297531 - DNA, 22 bp, Homo sapiens
aggtccagttttctgacaaggg

SEQ ID NO: 8297532 - DNA, 22 bp, Homo sapiens
ctcctgggtcattgccagcaaa

SEQ ID NO: 8297533 - DNA, 22 bp, Homo sapiens
ctcctgggggacagcggcaggg

SEQ ID NO: 8297534 - DNA, 22 bp, Homo sapiens
ctcctggggccatggaaggaac

SEQ ID NO: 8297535 - DNA, 22 bp, Homo sapiens
ctcctgggaatttagttgtgag

SEQ ID NO: 8297536 - DNA, 20 bp, Homo sapiens
ctcctgggactgctggttat

SEQ ID NO: 8297537 - DNA, 22 bp, Homo sapiens
ctcctgggaaatgaaggggcag

SEQ ID NO: 8297538 - DNA, 22 bp, Homo sapiens
ctcctgggaaaggctggacaca

SEQ ID NO: 8297539 - DNA, 22 bp, Homo sapiens
ctctgggaagtggagacttcag

SEQ ID NO: 8297540 - DNA, 22 bp, Homo sapiens
ctgaaatattttaatctcagga

SEQ ID NO: 8297541 - DNA, 22 bp, Homo sapiens
atcctgggcagttttgagtgct

SEQ ID NO: 8297542 - DNA, 22 bp, Homo sapiens
atcctgggggcagctggaaaca

SEQ ID NO: 8297543 - DNA, 22 bp, Homo sapiens
cttcccacagaattcaatcagt

SEQ ID NO: 8297544 - DNA, 22 bp, Homo sapiens
cttcttggctgcaagtctctgt

SEQ ID NO: 8297545 - DNA, 22 bp, Homo sapiens
cttcttgggtcagagaatcatt

SEQ ID NO: 8297546 - DNA, 22 bp, Homo sapiens
cttcttgggttctgagattaca

SEQ ID NO: 8297547 - DNA, 22 bp, Homo sapiens
atcaaatcattgcattaatgtt

SEQ ID NO: 8297548 - DNA, 22 bp, Homo sapiens
ctggctggccatgcagcgccag

SEQ ID NO: 8297549 - DNA, 22 bp, Homo sapiens
atagcactggtttttcttggtt

SEQ ID NO: 8297550 - DNA, 22 bp, Homo sapiens
ataccaaagcacatactgtttg

SEQ ID NO: 8297551 - DNA, 22 bp, Homo sapiens
cctcctggtgacaaggcaaagc

SEQ ID NO: 8297552 - DNA, 22 bp, Homo sapiens
agggggtgcatttgtgaatgaa

SEQ ID NO: 8297553 - DNA, 22 bp, Homo sapiens
cccagatgcaggttcaagagta

SEQ ID NO: 8297554 - DNA, 21 bp, Homo sapiens
ccaggcgagtttggactctcc

SEQ ID NO: 8297555 - DNA, 22 bp, Homo sapiens
aggctctgggaagcagtgagtt

SEQ ID NO: 8297556 - DNA, 22 bp, Homo sapiens
aggctctgggaacagacgggtg

SEQ ID NO: 8297557 - DNA, 20 bp, Homo sapiens
aggctctgcctgcaggccca

SEQ ID NO: 8297558 - DNA, 22 bp, Homo sapiens
ccaggtgcctccagtcacagtg

SEQ ID NO: 8297559 - DNA, 22 bp, Homo sapiens
ccaggtgcactcaagacctgct

SEQ ID NO: 8297560 - DNA, 19 bp, Homo sapiens
aggctctgtaggagagggc

SEQ ID NO: 8297561 - DNA, 22 bp, Homo sapiens
aggcaggtcccctggaaggcac

SEQ ID NO: 8297562 - DNA, 22 bp, Homo sapiens
ccagccagaagtccgggcttct

SEQ ID NO: 8297563 - DNA, 22 bp, Homo sapiens
catacaaatgtgtccaggctct

SEQ ID NO: 8297564 - DNA, 22 bp, Homo sapiens
cagtgtttaatcattgtgaatt

SEQ ID NO: 8297565 - DNA, 22 bp, Homo sapiens
caggcagagtgaggtggtctaa

SEQ ID NO: 8297566 - DNA, 23 bp, Homo sapiens
cagctggttgtgggagtggctgc

SEQ ID NO: 8297567 - DNA, 20 bp, Homo sapiens
cagtattgatccattgtctg

SEQ ID NO: 8297568 - DNA, 22 bp, Homo sapiens
aggggttggatttggcctagag

SEQ ID NO: 8297569 - DNA, 22 bp, Homo sapiens
aggggttggacataagacagaa

SEQ ID NO: 8297570 - DNA, 22 bp, Homo sapiens
aggggagccgaggggcatctgt

SEQ ID NO: 8297571 - DNA, 22 bp, Homo sapiens
aggctctgacgtcacacgtggc

SEQ ID NO: 8297572 - DNA, 22 bp, Homo sapiens
aggctctggagaagaatccgct

SEQ ID NO: 8297573 - DNA, 22 bp, Homo sapiens
aggctctgaaggagaacctgtt

SEQ ID NO: 8297574 - DNA, 22 bp, Homo sapiens
aggctctggagttagccaggca

SEQ ID NO: 8297575 - DNA, 17 bp, Homo sapiens
accactttgccaagttg

SEQ ID NO: 8297576 - DNA, 20 bp, Homo sapiens
agtgggagagggcagactgc

SEQ ID NO: 8297577 - DNA, 22 bp, Homo sapiens
agtgggaggcggctgacgggcg

SEQ ID NO: 8297578 - DNA, 22 bp, Homo sapiens
agtgggagccagcagcttgggg

SEQ ID NO: 8297579 - DNA, 22 bp, Homo sapiens
agtgggggccaacgagggcagc

SEQ ID NO: 8297580 - DNA, 22 bp, Homo sapiens
agtccaggcattccagccattc

SEQ ID NO: 8297581 - DNA, 22 bp, Homo sapiens
agtccaggaagcatcatggtct

SEQ ID NO: 8297582 - DNA, 22 bp, Homo sapiens
aggtggtgatgacagaagacag

SEQ ID NO: 8297583 - DNA, 22 bp, Homo sapiens
aggtggagacccagagaaggcg

SEQ ID NO: 8297584 - DNA, 22 bp, Homo sapiens
aggtgcaggagctgtgcaggga

SEQ ID NO: 8297585 - DNA, 22 bp, Homo sapiens
atacacgtgccatgttggtgtg

SEQ ID NO: 8297586 - DNA, 22 bp, Homo sapiens
atacaatagtgtttgttttgag

SEQ ID NO: 8297587 - DNA, 22 bp, Homo sapiens
agaaagaacgttggttatctta

SEQ ID NO: 8297588 - DNA, 22 bp, Homo sapiens
atcaagtctgcctgtctggagg

SEQ ID NO: 8297589 - DNA, 23 bp, Homo sapiens
atcaagtcatcagcaaaatacat

SEQ ID NO: 8297590 - DNA, 22 bp, Homo sapiens
atcctgggaatgggagggtcat

SEQ ID NO: 8297591 - DNA, 22 bp, Homo sapiens
cacgggagacgtgatcttggac

SEQ ID NO: 8297592 - DNA, 18 bp, Homo sapiens
agcaggtggcgtctgcag

SEQ ID NO: 8297593 - DNA, 22 bp, Homo sapiens
agcaggtggcctcctgtctgtc

SEQ ID NO: 8297594 - DNA, 22 bp, Homo sapiens
agcaggtgggatcaagctggca

SEQ ID NO: 8297595 - DNA, 22 bp, Homo sapiens
caagtcctctggtttcaaatag

SEQ ID NO: 8297596 - DNA, 22 bp, Homo sapiens
agccagggaagaggcctacctc

SEQ ID NO: 8297597 - DNA, 22 bp, Homo sapiens
agccagggacgctgcaggctac

SEQ ID NO: 8297598 - DNA, 22 bp, Homo sapiens
agcgaggtgagtcctccagctc

SEQ ID NO: 8297599 - DNA, 22 bp, Homo sapiens
cagctggcaagtggagcagggt

SEQ ID NO: 8297600 - DNA, 22 bp, Homo sapiens
agctctggagccggaggatttc

SEQ ID NO: 8297601 - DNA, 21 bp, Homo sapiens
agctctggagcagcaatcaag

SEQ ID NO: 8297602 - DNA, 22 bp, Homo sapiens
cagcctctgacaccacagtcgt

SEQ ID NO: 8297603 - DNA, 22 bp, Homo sapiens
attaagtgtcaggcagggagtg

SEQ ID NO: 8297604 - DNA, 22 bp, Homo sapiens
atggaatttggagattaggcat

SEQ ID NO: 8297605 - DNA, 22 bp, Homo sapiens
atggaattaataggggaatact

SEQ ID NO: 8297606 - DNA, 22 bp, Homo sapiens
atggaattgagcatcagttgtt

SEQ ID NO: 8297607 - DNA, 22 bp, Homo sapiens
atggaattaaaagtcaagtaat

SEQ ID NO: 8297608 - DNA, 21 bp, Homo sapiens
attctctgtgatgggattagg

SEQ ID NO: 8297609 - DNA, 22 bp, Homo sapiens
aagaagtggtccttttctttct

SEQ ID NO: 8297610 - DNA, 22 bp, Homo sapiens
aaaggcatgcatggtctgctcc

SEQ ID NO: 8297611 - DNA, 22 bp, Homo sapiens
aaaaccacttccttgctattgg

SEQ ID NO: 8297612 - DNA, 22 bp, Homo sapiens
aaaaccacaattacttttgcac

SEQ ID NO: 8297613 - DNA, 22 bp, Homo sapiens
aaaaccacagttacttttgcac

SEQ ID NO: 8297614 - DNA, 22 bp, Homo sapiens
aaaaccacaaaagtggcttggt

SEQ ID NO: 8297615 - DNA, 22 bp, Homo sapiens
aaaaccacaatgacttttgcac

SEQ ID NO: 8297616 - DNA, 22 bp, Homo sapiens
aaaaccacaatgacttttgcag

SEQ ID NO: 8297617 - DNA, 22 bp, Homo sapiens
aaaacactgcctgcttgactga

SEQ ID NO: 8297618 - DNA, 22 bp, Homo sapiens
aaaatacacatactaggggaaa

SEQ ID NO: 8297619 - DNA, 22 bp, Homo sapiens
aaatacacgtacatgtgtaaaa

SEQ ID NO: 8297620 - DNA, 22 bp, Homo sapiens
aaagtcatacatggtgcttact

SEQ ID NO: 8297621 - DNA, 22 bp, Homo sapiens
aaagtacatgcaattcttctga

SEQ ID NO: 8297622 - DNA, 22 bp, Homo sapiens
aaaattgtcagaagttgatctt

SEQ ID NO: 8297623 - DNA, 22 bp, Homo sapiens
aagtcttgtctaaggtctctaa

SEQ ID NO: 8297624 - DNA, 22 bp, Homo sapiens
aatgtaaacagcaagagaaggg

SEQ ID NO: 8297625 - DNA, 22 bp, Homo sapiens
aagaacaggttctagaaccatt

SEQ ID NO: 8297626 - DNA, 22 bp, Homo sapiens
acacttgtggcctttctagtaa

SEQ ID NO: 8297627 - DNA, 22 bp, Homo sapiens
acaataacttctgtttccttgc

SEQ ID NO: 8297628 - DNA, 22 bp, Homo sapiens
agatgcagagtttgctgtggac

SEQ ID NO: 8297629 - DNA, 22 bp, Homo sapiens
agcaggtgtcactttcactcca

SEQ ID NO: 8297630 - DNA, 22 bp, Homo sapiens
agcaggtgtatataaggctgag

SEQ ID NO: 8297631 - DNA, 22 bp, Homo sapiens
agcaggtgtagggctctttgta

SEQ ID NO: 8297632 - DNA, 22 bp, Homo sapiens
agcaggtggtaggcagtcagca

SEQ ID NO: 8297633 - DNA, 22 bp, Homo sapiens
agcaggtggtctgttgctgctg

SEQ ID NO: 8297634 - DNA, 20 bp, Homo sapiens
aatgaagttattaatgatgt

SEQ ID NO: 8297635 - DNA, 22 bp, Homo sapiens
aatgaagtgttatttagtttca

SEQ ID NO: 8297636 - DNA, 22 bp, Homo sapiens
aatgaagtgtttagaagtttta

SEQ ID NO: 8297637 - DNA, 22 bp, Homo sapiens
aagggcacagggaaagagtgca

SEQ ID NO: 8297638 - DNA, 22 bp, Homo sapiens
accagatgctctggcgccttcc

SEQ ID NO: 8297639 - DNA, 22 bp, Homo sapiens
tccaggcatgtctgagtccttc

SEQ ID NO: 8297640 - DNA, 22 bp, Homo sapiens
tccaggattgcaggtgcacaac

SEQ ID NO: 8297641 - DNA, 21 bp, Homo sapiens
tccagaggaggacagactcag

SEQ ID NO: 8297642 - DNA, 22 bp, Homo sapiens
tcaagtcttgatgagacaaacc

SEQ ID NO: 8297643 - DNA, 22 bp, Homo sapiens
tcaagtctggagatctggaact

SEQ ID NO: 8297644 - DNA, 22 bp, Homo sapiens
tcagcactgtgtccagtctccc

SEQ ID NO: 8297645 - DNA, 22 bp, Homo sapiens
tcacttttgatccctatgcagt

SEQ ID NO: 8297646 - DNA, 22 bp, Homo sapiens
tcacttttgggtttccagtaga

SEQ ID NO: 8297647 - DNA, 22 bp, Homo sapiens
tcactttttgatatcattctgc

SEQ ID NO: 8297648 - DNA, 22 bp, Homo sapiens
gttgggatgtcaggcctaggtg

SEQ ID NO: 8297649 - DNA, 22 bp, Homo sapiens
gttgggatgatttagtcaagca

SEQ ID NO: 8297650 - DNA, 20 bp, Homo sapiens
tacagaaacaggacttttgg

SEQ ID NO: 8297651 - DNA, 23 bp, Homo sapiens
tagaattcaatctgttccacatc

SEQ ID NO: 8297652 - DNA, 22 bp, Homo sapiens
tatttatcgagtgtctactatg

SEQ ID NO: 8297653 - DNA, 22 bp, Homo sapiens
tatttataatctgccaaagaga

SEQ ID NO: 8297654 - DNA, 22 bp, Homo sapiens
taggggtgtttcgagagaggtt

SEQ ID NO: 8297655 - DNA, 22 bp, Homo sapiens
tataacaggaagtattcaaaca

SEQ ID NO: 8297656 - DNA, 22 bp, Homo sapiens
tatgagaaaggagaatgacttt

SEQ ID NO: 8297657 - DNA, 22 bp, Homo sapiens
gccttgtttcattacacgtggt

SEQ ID NO: 8297658 - DNA, 22 bp, Homo sapiens
gcttgagaacttcaactcagtg

SEQ ID NO: 8297659 - DNA, 22 bp, Homo sapiens
ggacaggtgtgaggctggcaca

SEQ ID NO: 8297660 - DNA, 22 bp, Homo sapiens
gcctccggagtcacagtgtctt

SEQ ID NO: 8297661 - DNA, 22 bp, Homo sapiens
gcctccggagttgcagtgtctt

SEQ ID NO: 8297662 - DNA, 22 bp, Homo sapiens
gcagtgggagcttaggcagtgc

SEQ ID NO: 8297663 - DNA, 22 bp, Homo sapiens
gcagatggactgtatgacctga

SEQ ID NO: 8297664 - DNA, 20 bp, Homo sapiens
gcagagtgtgagagggtgaa

SEQ ID NO: 8297665 - DNA, 22 bp, Homo sapiens
gcagatggtgggggaggagtac

SEQ ID NO: 8297666 - DNA, 22 bp, Homo sapiens
gcagatggcgcagtggaagttc

SEQ ID NO: 8297667 - DNA, 22 bp, Homo sapiens
gcagggaaggggcatgctggag

SEQ ID NO: 8297668 - DNA, 22 bp, Homo sapiens
gcaggcagatcacctgtcagga

SEQ ID NO: 8297669 - DNA, 22 bp, Homo sapiens
gggaggaaggcttgggtgagta

SEQ ID NO: 8297670 - DNA, 22 bp, Homo sapiens
gggagagcgcgctagggccgag

SEQ ID NO: 8297671 - DNA, 22 bp, Homo sapiens
gggagagcgggaggtgccacag

SEQ ID NO: 8297672 - DNA, 22 bp, Homo sapiens
ggcaggcaagtctgctctgtga

SEQ ID NO: 8297673 - DNA, 22 bp, Homo sapiens
ggcaggcaatgaggatgggaag

SEQ ID NO: 8297674 - DNA, 22 bp, Homo sapiens
ggcaggcaaggcagcctggtga

SEQ ID NO: 8297675 - DNA, 22 bp, Homo sapiens
ggcaggcactgtgctaggcgct

SEQ ID NO: 8297676 - DNA, 22 bp, Homo sapiens
ggcaggcacatttgggggccgt

SEQ ID NO: 8297677 - DNA, 20 bp, Homo sapiens
ggcatgggtggggctcccag

SEQ ID NO: 8297678 - DNA, 22 bp, Homo sapiens
ggccatgagaatgtgcaggtcc

SEQ ID NO: 8297679 - DNA, 22 bp, Homo sapiens
ggcgagcagttcccagggaggt

SEQ ID NO: 8297680 - DNA, 21 bp, Homo sapiens
ggggttggcaagagcagagac

SEQ ID NO: 8297681 - DNA, 22 bp, Homo sapiens
ggggttgatcacagaggggtct

SEQ ID NO: 8297682 - DNA, 20 bp, Homo sapiens
ggggttgaccctcttggact

SEQ ID NO: 8297683 - DNA, 22 bp, Homo sapiens
ggggttgatcacagaggggtct

SEQ ID NO: 8297684 - DNA, 22 bp, Homo sapiens
gggtaggctgctcctggggccc

SEQ ID NO: 8297685 - DNA, 22 bp, Homo sapiens
gggtaggctctgcaggctgggt

SEQ ID NO: 8297686 - DNA, 22 bp, Homo sapiens
ggggctctgtgacagtaaccct

SEQ ID NO: 8297687 - DNA, 22 bp, Homo sapiens
ggggctctaggtaaagcaacat

SEQ ID NO: 8297688 - DNA, 22 bp, Homo sapiens
ggggctctcaggtctccccaaa

SEQ ID NO: 8297689 - DNA, 18 bp, Homo sapiens
ggtcctgggcctggctca

SEQ ID NO: 8297690 - DNA, 22 bp, Homo sapiens
ggtttattgttaataagtttga

SEQ ID NO: 8297691 - DNA, 22 bp, Homo sapiens
ggtttattgaaggccaccccac

SEQ ID NO: 8297692 - DNA, 22 bp, Homo sapiens
ggtttattaatgtgaactgtat

SEQ ID NO: 8297693 - DNA, 22 bp, Homo sapiens
ggtggcctcagcaaggctggca

SEQ ID NO: 8297694 - DNA, 22 bp, Homo sapiens
ggtggccttttatgagcagggt

SEQ ID NO: 8297695 - DNA, 21 bp, Homo sapiens
ggtggccttggtgagagacct

SEQ ID NO: 8297696 - DNA, 22 bp, Homo sapiens
ggtggcctggaatcttaacaag

SEQ ID NO: 8297697 - DNA, 22 bp, Homo sapiens
ggtggcctccagggcataggtg

SEQ ID NO: 8297698 - DNA, 22 bp, Homo sapiens
gtcctgggaggggctggtcctg

SEQ ID NO: 8297699 - DNA, 22 bp, Homo sapiens
gtcctgggcatgcagggctttc

SEQ ID NO: 8297700 - DNA, 22 bp, Homo sapiens
gtcctgggcctgctgaggctga

SEQ ID NO: 8297701 - DNA, 22 bp, Homo sapiens
gtcctgggggcagctgtgtcca

SEQ ID NO: 8297702 - DNA, 22 bp, Homo sapiens
ctgccagccaggccaggtaggc

SEQ ID NO: 8297703 - DNA, 22 bp, Homo sapiens
ctgccagctagctcctagttga

SEQ ID NO: 8297704 - DNA, 22 bp, Homo sapiens
ctgccagcagaggccagcgctg

SEQ ID NO: 8297705 - DNA, 22 bp, Homo sapiens
ctgccagctctctggaggctct

SEQ ID NO: 8297706 - DNA, 22 bp, Homo sapiens
ctgccagcaagctaccctggca

SEQ ID NO: 8297707 - DNA, 22 bp, Homo sapiens
ctggcaggcggaggttgcagtg

SEQ ID NO: 8297708 - DNA, 22 bp, Homo sapiens
ctgggtctcttaccatgtgact

SEQ ID NO: 8297709 - DNA, 19 bp, Homo sapiens
cttcctggaggagagcctc

SEQ ID NO: 8297710 - DNA, 22 bp, Homo sapiens
gaggcaagcccagtgggtctaa

SEQ ID NO: 8297711 - DNA, 22 bp, Homo sapiens
gagccaggtcgggccgcggcga

SEQ ID NO: 8297712 - DNA, 22 bp, Homo sapiens
gagccaggttggaggctgcagt

SEQ ID NO: 8297713 - DNA, 22 bp, Homo sapiens
gagccagggctgtgagctgagc

SEQ ID NO: 8297714 - DNA, 22 bp, Homo sapiens
gaatacaagcctgccacctgga

SEQ ID NO: 8297715 - DNA, 22 bp, Homo sapiens
gaagcctcaacatctctgcgtc

SEQ ID NO: 8297716 - DNA, 22 bp, Homo sapiens
gaacagggagtacggcacattt

SEQ ID NO: 8297717 - DNA, 22 bp, Homo sapiens
gaagccatctttgttccccacc

SEQ ID NO: 8297718 - DNA, 21 bp, Homo sapiens
tgggggagaattggttgcttt

SEQ ID NO: 8297719 - DNA, 22 bp, Homo sapiens
tgggggaaattcagccagatat

SEQ ID NO: 8297720 - DNA, 22 bp, Homo sapiens
cctgggagtgtgccatctctgt

SEQ ID NO: 8297721 - DNA, 22 bp, Homo sapiens
cctgggatgctgtcctcatcta

SEQ ID NO: 8297722 - DNA, 22 bp, Homo sapiens
cctgtctgcatgagtgagcata

SEQ ID NO: 8297723 - DNA, 22 bp, Homo sapiens
cctgtctggaacatggcctgtt

SEQ ID NO: 8297724 - DNA, 23 bp, Homo sapiens
cctgtctgtgctgggtggacaca

SEQ ID NO: 8297725 - DNA, 22 bp, Homo sapiens
ttctctggagagtatcttctta

SEQ ID NO: 8297726 - DNA, 22 bp, Homo sapiens
ttctctggatgtttctcagtca

SEQ ID NO: 8297727 - DNA, 22 bp, Homo sapiens
ttctctggccatagctggctag

SEQ ID NO: 8297728 - DNA, 22 bp, Homo sapiens
ctcacactgtgccaaatccttt

SEQ ID NO: 8297729 - DNA, 20 bp, Homo sapiens
ctcacactggaaaagtctga

SEQ ID NO: 8297730 - DNA, 22 bp, Homo sapiens
cggtccagggaacgcccccgcc

SEQ ID NO: 8297731 - DNA, 22 bp, Homo sapiens
ctctggaatgtttacatgccct

SEQ ID NO: 8297732 - DNA, 22 bp, Homo sapiens
ctctggaaaaccactagcagga

SEQ ID NO: 8297733 - DNA, 22 bp, Homo sapiens
tttatttaaagtcgtgtgttaa

SEQ ID NO: 8297734 - DNA, 22 bp, Homo sapiens
ctcctggcagttccccttgtca

SEQ ID NO: 8297735 - DNA, 22 bp, Homo sapiens
ttgtaattagtttttgatctgg

SEQ ID NO: 8297736 - DNA, 22 bp, Homo sapiens
caggccagagcgcgtggttggg

SEQ ID NO: 8297737 - DNA, 22 bp, Homo sapiens
tacaaaaaattgatactgacga

SEQ ID NO: 8297738 - DNA, 22 bp, Homo sapiens
taagtcgtggatgattcttcgg

SEQ ID NO: 8297739 - DNA, 22 bp, Homo sapiens
caggcagagccaatcgtggggt

SEQ ID NO: 8297740 - DNA, 22 bp, Homo sapiens
caggcgagggccctgaggagcc

SEQ ID NO: 8297741 - DNA, 22 bp, Homo sapiens
cagggctcttcatcacacagta

SEQ ID NO: 8297742 - DNA, 22 bp, Homo sapiens
cagggctccatgcagggactcc

SEQ ID NO: 8297743 - DNA, 22 bp, Homo sapiens
caggtcagcacttggaggtgca

SEQ ID NO: 8297744 - DNA, 22 bp, Homo sapiens
caggtggcaaatgagtagcatt

SEQ ID NO: 8297745 - DNA, 22 bp, Homo sapiens
caggtggctaacggcctcatag

SEQ ID NO: 8297746 - DNA, 23 bp, Homo sapiens
caggtggctccacgaggggtggg

SEQ ID NO: 8297747 - DNA, 22 bp, Homo sapiens
caggtgggtgtatgaatgcaaa

SEQ ID NO: 8297748 - DNA, 21 bp, Homo sapiens
tctaagaacatgattctccct

SEQ ID NO: 8297749 - DNA, 22 bp, Homo sapiens
tctaagaattgaagtggctctt

SEQ ID NO: 8297750 - DNA, 22 bp, Homo sapiens
catgaaaataacattgttgtga

SEQ ID NO: 8297751 - DNA, 22 bp, Homo sapiens
tggcagggttggccaccttacc

SEQ ID NO: 8297752 - DNA, 19 bp, Homo sapiens
tggagcagggcccttgttt

SEQ ID NO: 8297753 - DNA, 22 bp, Homo sapiens
tgccttcctggagctgaaggct

SEQ ID NO: 8297754 - DNA, 22 bp, Homo sapiens
tgccttcctaatggtggggttt

SEQ ID NO: 8297755 - DNA, 22 bp, Homo sapiens
tggagcagaaatggcctcttgt

SEQ ID NO: 8297756 - DNA, 22 bp, Homo sapiens
tggagcaggactgctgccctca

SEQ ID NO: 8297757 - DNA, 21 bp, Homo sapiens
tcttcccattatgttccaatt

SEQ ID NO: 8297758 - DNA, 22 bp, Homo sapiens
ccaggccagcgctggctggagg

SEQ ID NO: 8297759 - DNA, 22 bp, Homo sapiens
tcttcccagaggaggtgccagc

SEQ ID NO: 8297760 - DNA, 22 bp, Homo sapiens
tcttcccactgcccatgggcag

SEQ ID NO: 8297761 - DNA, 22 bp, Homo sapiens
ccaggccattcccagagttgct

SEQ ID NO: 8297762 - DNA, 22 bp, Homo sapiens
ccaggccaggagagcgaggttt

SEQ ID NO: 8297763 - DNA, 22 bp, Homo sapiens
tctgggttttgtaccgtgctcg

SEQ ID NO: 8297764 - DNA, 18 bp, Homo sapiens
tctggaacaacttcatgt

SEQ ID NO: 8297765 - DNA, 22 bp, Homo sapiens
tgacagtgtgcccggaggttag

SEQ ID NO: 8297766 - DNA, 22 bp, Homo sapiens
tgacagtggtgacaggatgggg

SEQ ID NO: 8297767 - DNA, 22 bp, Homo sapiens
ccaggtgctagcaatcactgtc

SEQ ID NO: 8297768 - DNA, 22 bp, Homo sapiens
tgaggcagcaattgtattgtat

SEQ ID NO: 8297769 - DNA, 22 bp, Homo sapiens
tgaggcagatatttattgggtt

SEQ ID NO: 8297770 - DNA, 20 bp, Homo sapiens
ccagtccctgagcaccaggg

SEQ ID NO: 8297771 - DNA, 22 bp, Homo sapiens
ccagtcccgcatggtccagaat

SEQ ID NO: 8297772 - DNA, 22 bp, Homo sapiens
tgtggacgtcattaaagcagtg

SEQ ID NO: 8297773 - DNA, 22 bp, Homo sapiens
tgtggcacagaaagatgaaggg

SEQ ID NO: 8297774 - DNA, 22 bp, Homo sapiens
tgtggcacttacatcctagttt

SEQ ID NO: 8297775 - DNA, 22 bp, Homo sapiens
tgtggcacagaagaaagagagg

SEQ ID NO: 8297776 - DNA, 22 bp, Homo sapiens
tgtggcacatacacaggagggc

SEQ ID NO: 8297777 - DNA, 22 bp, Homo sapiens
tgtggcacttctctccttgtaa

SEQ ID NO: 8297778 - DNA, 22 bp, Homo sapiens
tgtggcacttgcaaatattttg

SEQ ID NO: 8297779 - DNA, 22 bp, Homo sapiens
tgtggggaggctgcagtgctgc

SEQ ID NO: 8297780 - DNA, 19 bp, Homo sapiens
tgtggggagtcagggggct

SEQ ID NO: 8297781 - DNA, 22 bp, Homo sapiens
ttcacaaagctggagcatttcc

SEQ ID NO: 8297782 - DNA, 22 bp, Homo sapiens
ttctggtggccagaagtctgaa

SEQ ID NO: 8297783 - DNA, 22 bp, Homo sapiens
ttctggtgtgttctctctaggc

SEQ ID NO: 8297784 - DNA, 22 bp, Homo sapiens
ttgatcaagtgggaaatagtaa

SEQ ID NO: 8297785 - DNA, 22 bp, Homo sapiens
ttgtcgggcttacgcagggcca

SEQ ID NO: 8297786 - DNA, 23 bp, Homo sapiens
tttatagcagcatgatttataat

SEQ ID NO: 8297787 - DNA, 23 bp, Homo sapiens
tttatagcagcatgatttatagt

SEQ ID NO: 8297788 - DNA, 22 bp, Homo sapiens
tttctcagggaggagtcaagcc

SEQ ID NO: 8297789 - DNA, 22 bp, Homo sapiens
tttttcatgagactagaagtca

SEQ ID NO: 8297790 - DNA, 22 bp, Homo sapiens
caagccattctcctgcctcagc

SEQ ID NO: 8297791 - DNA, 23 bp, Homo sapiens
gctctggagctgggcctggcagg

SEQ ID NO: 8297792 - DNA, 22 bp, Homo sapiens
gctctggaacctgccaggatgc

SEQ ID NO: 8297793 - DNA, 22 bp, Homo sapiens
gctctggaccctgccagcctta

SEQ ID NO: 8297794 - DNA, 22 bp, Homo sapiens
gctctggagagccataggccct

SEQ ID NO: 8297795 - DNA, 22 bp, Homo sapiens
cagccctcctttcactcccagg

SEQ ID NO: 8297796 - DNA, 22 bp, Homo sapiens
cagccctcctaccctgccaggc

SEQ ID NO: 8297797 - DNA, 22 bp, Homo sapiens
cagccctcatctcagcttcttt

SEQ ID NO: 8297798 - DNA, 22 bp, Homo sapiens
gtgagcagaacaggtggcttct

SEQ ID NO: 8297799 - DNA, 20 bp, Homo sapiens
gggtacagttctgcagttac

SEQ ID NO: 8297800 - DNA, 22 bp, Homo sapiens
gggtacagaaactgaggcttag

SEQ ID NO: 8297801 - DNA, 20 bp, Homo sapiens
ggggttggctggcacaggga

SEQ ID NO: 8297802 - DNA, 22 bp, Homo sapiens
ggggttggtttaaatgcttgag

SEQ ID NO: 8297803 - DNA, 18 bp, Homo sapiens
ggtcctgaatgcctgcta

SEQ ID NO: 8297804 - DNA, 22 bp, Homo sapiens
gggttcagtgatgccttcagga

SEQ ID NO: 8297805 - DNA, 22 bp, Homo sapiens
gggtacagttcttccagtgtca

SEQ ID NO: 8297806 - DNA, 20 bp, Homo sapiens
gggaggcattggtccctcac

SEQ ID NO: 8297807 - DNA, 22 bp, Homo sapiens
gggaggcagtgctggaggctgg

SEQ ID NO: 8297808 - DNA, 22 bp, Homo sapiens
gggaggcacgaggcgcgcagtg

SEQ ID NO: 8297809 - DNA, 22 bp, Homo sapiens
gggaggcatgtgttatccactt

SEQ ID NO: 8297810 - DNA, 23 bp, Homo sapiens
gagaacagccacagagagctgtg

SEQ ID NO: 8297811 - DNA, 22 bp, Homo sapiens
atggattggatttttatggacc

SEQ ID NO: 8297812 - DNA, 22 bp, Homo sapiens
gaagctggctgaagttcagcta

SEQ ID NO: 8297813 - DNA, 19 bp, Homo sapiens
gcaggcagctggggtatcc

SEQ ID NO: 8297814 - DNA, 22 bp, Homo sapiens
gcagaatttaggaattaggaaa

SEQ ID NO: 8297815 - DNA, 22 bp, Homo sapiens
gcagaatttgggggtaaccttt

SEQ ID NO: 8297816 - DNA, 22 bp, Homo sapiens
atttatcatcagaccttttaaa

SEQ ID NO: 8297817 - DNA, 22 bp, Homo sapiens
gccttccctctcatcctgctgg

SEQ ID NO: 8297818 - DNA, 22 bp, Homo sapiens
gccttcccaccctgcgaggctg

SEQ ID NO: 8297819 - DNA, 22 bp, Homo sapiens
cctcctggaaaaattccctggc

SEQ ID NO: 8297820 - DNA, 22 bp, Homo sapiens
cctcctggaggctctagggaaa

SEQ ID NO: 8297821 - DNA, 22 bp, Homo sapiens
cctcctggccctgggcctggaa

SEQ ID NO: 8297822 - DNA, 22 bp, Homo sapiens
agggctcctgaggcccttctgg

SEQ ID NO: 8297823 - DNA, 22 bp, Homo sapiens
aggctctgtgatgtgccaggca

SEQ ID NO: 8297824 - DNA, 22 bp, Homo sapiens
aggctctgtgactaaagaggat

SEQ ID NO: 8297825 - DNA, 22 bp, Homo sapiens
cagggctcccttgcaaggaggg

SEQ ID NO: 8297826 - DNA, 22 bp, Homo sapiens
cagggctccctgcagcctctgt

SEQ ID NO: 8297827 - DNA, 22 bp, Homo sapiens
cagggctccccagagagcctct

SEQ ID NO: 8297828 - DNA, 22 bp, Homo sapiens
cagggctcgctgccagcttcag

SEQ ID NO: 8297829 - DNA, 22 bp, Homo sapiens
cagggctcgctcttgcccttcg

SEQ ID NO: 8297830 - DNA, 22 bp, Homo sapiens
caggtgcaatgagacagctctg

SEQ ID NO: 8297831 - DNA, 17 bp, Homo sapiens
agctgcagatgaagttg

SEQ ID NO: 8297832 - DNA, 22 bp, Homo sapiens
caggtgcagctggatggaagcc

SEQ ID NO: 8297833 - DNA, 22 bp, Homo sapiens
caggtggcttctctgcagcctt

SEQ ID NO: 8297834 - DNA, 22 bp, Homo sapiens
agtgggagggccatatggtgaa

SEQ ID NO: 8297835 - DNA, 22 bp, Homo sapiens
ctctgagatgcttgaagaggat

SEQ ID NO: 8297836 - DNA, 22 bp, Homo sapiens
ctctgagaggtgagaagcagca

SEQ ID NO: 8297837 - DNA, 20 bp, Homo sapiens
agtggggagtcaggagtgcc

SEQ ID NO: 8297838 - DNA, 22 bp, Homo sapiens
agtggggacaatgagagcaggt

SEQ ID NO: 8297839 - DNA, 22 bp, Homo sapiens
cctgggttagtatctgtttcca

SEQ ID NO: 8297840 - DNA, 22 bp, Homo sapiens
cctgggttattttggtctagtg

SEQ ID NO: 8297841 - DNA, 22 bp, Homo sapiens
cctgggttccagcaccctctag

SEQ ID NO: 8297842 - DNA, 22 bp, Homo sapiens
cctgggtttggagcctgcagaa

SEQ ID NO: 8297843 - DNA, 22 bp, Homo sapiens
aggtggagtgaaggaaaggcag

SEQ ID NO: 8297844 - DNA, 22 bp, Homo sapiens
cgtggcctttgagtgagctccc

SEQ ID NO: 8297845 - DNA, 19 bp, Homo sapiens
cgtggcctgcactcgcagc

SEQ ID NO: 8297846 - DNA, 22 bp, Homo sapiens
aggtttattatgtagcattatt

SEQ ID NO: 8297847 - DNA, 17 bp, Homo sapiens
aggtttatggtatttga

SEQ ID NO: 8297848 - DNA, 22 bp, Homo sapiens
aggtttatgattctgcacgtgg

SEQ ID NO: 8297849 - DNA, 22 bp, Homo sapiens
ctgtccagcacatgtctgcccc

SEQ ID NO: 8297850 - DNA, 22 bp, Homo sapiens
atatcaaaataaacagcatgca

SEQ ID NO: 8297851 - DNA, 19 bp, Homo sapiens
agtttattataggtgattc

SEQ ID NO: 8297852 - DNA, 22 bp, Homo sapiens
agtttatttttgataagtcttg

SEQ ID NO: 8297853 - DNA, 17 bp, Homo sapiens
agtttatttagccttct

SEQ ID NO: 8297854 - DNA, 22 bp, Homo sapiens
agtttatttctccatttaccta

SEQ ID NO: 8297855 - DNA, 22 bp, Homo sapiens
agtttattctgcttggccctcc

SEQ ID NO: 8297856 - DNA, 22 bp, Homo sapiens
agtttattgtatatggtagttt

SEQ ID NO: 8297857 - DNA, 20 bp, Homo sapiens
agtttattccaggagaactg

SEQ ID NO: 8297858 - DNA, 22 bp, Homo sapiens
agtttattctctggtcttagta

SEQ ID NO: 8297859 - DNA, 22 bp, Homo sapiens
atagaattatggaaagcatctt

SEQ ID NO: 8297860 - DNA, 22 bp, Homo sapiens
atacagaagcctgtatttctgg

SEQ ID NO: 8297861 - DNA, 22 bp, Homo sapiens
aggagcagaccgtagtcctgca

SEQ ID NO: 8297862 - DNA, 22 bp, Homo sapiens
agctctggttattgaagcaggg

SEQ ID NO: 8297863 - DNA, 22 bp, Homo sapiens
agctctgggtcacggctgccga

SEQ ID NO: 8297864 - DNA, 22 bp, Homo sapiens
agctctggggtggagcccagga

SEQ ID NO: 8297865 - DNA, 22 bp, Homo sapiens
agctggtggagaagcagacctc

SEQ ID NO: 8297866 - DNA, 22 bp, Homo sapiens
acagggcttgtgacaactttaa

SEQ ID NO: 8297867 - DNA, 22 bp, Homo sapiens
acagggcttgttgaaagcggag

SEQ ID NO: 8297868 - DNA, 22 bp, Homo sapiens
acatgtttaagtttaatgaaaa

SEQ ID NO: 8297869 - DNA, 22 bp, Homo sapiens
aggctctggctactacagagct

SEQ ID NO: 8297870 - DNA, 22 bp, Homo sapiens
acatttgaaatgccatgtgagg

SEQ ID NO: 8297871 - DNA, 22 bp, Homo sapiens
agtcaaccatttagaagagtgt

SEQ ID NO: 8297872 - DNA, 22 bp, Homo sapiens
actctgtgttttggtggcagca

SEQ ID NO: 8297873 - DNA, 22 bp, Homo sapiens
actggaattaggtttgtataca

SEQ ID NO: 8297874 - DNA, 18 bp, Homo sapiens
atcctgggagcagacagc

SEQ ID NO: 8297875 - DNA, 22 bp, Homo sapiens
agaacaggcagttggttggatt

SEQ ID NO: 8297876 - DNA, 22 bp, Homo sapiens
agaacaggaggaagccagctcc

SEQ ID NO: 8297877 - DNA, 22 bp, Homo sapiens
acttcttcttcagctgggggat

SEQ ID NO: 8297878 - DNA, 22 bp, Homo sapiens
agcctcttccagctcctttcta

SEQ ID NO: 8297879 - DNA, 22 bp, Homo sapiens
agcaggcaaggtccgtgcctcg

SEQ ID NO: 8297880 - DNA, 22 bp, Homo sapiens
agaggtgacataggagaggctc

SEQ ID NO: 8297881 - DNA, 22 bp, Homo sapiens
atgtggggacaaaatgatggcc

SEQ ID NO: 8297882 - DNA, 22 bp, Homo sapiens
aaacacttgcaaaatggttcct

SEQ ID NO: 8297883 - DNA, 22 bp, Homo sapiens
aaacactttaagtgaggaggat

SEQ ID NO: 8297884 - DNA, 22 bp, Homo sapiens
aaacacttcttaggtcttaagt

SEQ ID NO: 8297885 - DNA, 22 bp, Homo sapiens
aaacacttcaaggacttctgtc

SEQ ID NO: 8297886 - DNA, 22 bp, Homo sapiens
aaaaacacaactgtctttctct

SEQ ID NO: 8297887 - DNA, 22 bp, Homo sapiens
aaaaaccattgtcttcagtctc

SEQ ID NO: 8297888 - DNA, 20 bp, Homo sapiens
aaaaacagtaatgctgaaga

SEQ ID NO: 8297889 - DNA, 21 bp, Homo sapiens
aaagaacaggcagatgttctt

SEQ ID NO: 8297890 - DNA, 22 bp, Homo sapiens
aaatgcactctgcttctgtgac

SEQ ID NO: 8297891 - DNA, 22 bp, Homo sapiens
aaaccctgagacttggggccag

SEQ ID NO: 8297892 - DNA, 22 bp, Homo sapiens
aaagccatctgtattaagtgaa

SEQ ID NO: 8297893 - DNA, 22 bp, Homo sapiens
aaagccatctgctggttcgcat

SEQ ID NO: 8297894 - DNA, 22 bp, Homo sapiens
aaagccatgaatgttatagagg

SEQ ID NO: 8297895 - DNA, 22 bp, Homo sapiens
aaagccatgggtctttggcata

SEQ ID NO: 8297896 - DNA, 22 bp, Homo sapiens
aaagcgcttccctttggagcgt

SEQ ID NO: 8297897 - DNA, 22 bp, Homo sapiens
aaagccataagcctaatactaa

SEQ ID NO: 8297898 - DNA, 22 bp, Homo sapiens
aaagccatatctattctattct

SEQ ID NO: 8297899 - DNA, 22 bp, Homo sapiens
aaagccatcagtaaaatgattt

SEQ ID NO: 8297900 - DNA, 22 bp, Homo sapiens
aaaggtttatttgttgctcaca

SEQ ID NO: 8297901 - DNA, 22 bp, Homo sapiens
aactgtttggaactcttccaca

SEQ ID NO: 8297902 - DNA, 22 bp, Homo sapiens
aactgtttaccatacacagtga

SEQ ID NO: 8297903 - DNA, 22 bp, Homo sapiens
aaccacttatttaagctctgat

SEQ ID NO: 8297904 - DNA, 22 bp, Homo sapiens
aacagggctttggaagtctccg

SEQ ID NO: 8297905 - DNA, 20 bp, Homo sapiens
aacagggcagaagcggagac

SEQ ID NO: 8297906 - DNA, 22 bp, Homo sapiens
aacaggctggccttgaagcagt

SEQ ID NO: 8297907 - DNA, 22 bp, Homo sapiens
aaatgtgtcatattcaaagtca

SEQ ID NO: 8297908 - DNA, 22 bp, Homo sapiens
acagaattgatggaaatctcag

SEQ ID NO: 8297909 - DNA, 22 bp, Homo sapiens
aagatttactttctttgtaata

SEQ ID NO: 8297910 - DNA, 22 bp, Homo sapiens
agcctgcgatcccacctggcct

SEQ ID NO: 8297911 - DNA, 22 bp, Homo sapiens
agctaggggaccaaggtggccc

SEQ ID NO: 8297912 - DNA, 22 bp, Homo sapiens
agctctgggctgacatgctccc

SEQ ID NO: 8297913 - DNA, 22 bp, Homo sapiens
agccatgggagactgtgggaga

SEQ ID NO: 8297914 - DNA, 22 bp, Homo sapiens
agccatggcgccactagaggga

SEQ ID NO: 8297915 - DNA, 22 bp, Homo sapiens
agccatgtcacatatggtcatc

SEQ ID NO: 8297916 - DNA, 22 bp, Homo sapiens
agccatgtatgagggtttccag

SEQ ID NO: 8297917 - DNA, 22 bp, Homo sapiens
agccatgttaaatggacttgat

SEQ ID NO: 8297918 - DNA, 22 bp, Homo sapiens
agccatgtgtctttattctgtt

SEQ ID NO: 8297919 - DNA, 22 bp, Homo sapiens
agccatgttggggaaggtgggc

SEQ ID NO: 8297920 - DNA, 22 bp, Homo sapiens
aattatatgttaatcttcaatt

SEQ ID NO: 8297921 - DNA, 22 bp, Homo sapiens
aagctgcagcacagagaggtgg

SEQ ID NO: 8297922 - DNA, 22 bp, Homo sapiens
acagggcttagaaatctgttgc

SEQ ID NO: 8297923 - DNA, 22 bp, Homo sapiens
acagggcttagtggaaattttt

SEQ ID NO: 8297924 - DNA, 23 bp, Homo sapiens
acagggctggcagctgcaagacc

SEQ ID NO: 8297925 - DNA, 22 bp, Homo sapiens
acagggctggggaaagaggcta

SEQ ID NO: 8297926 - DNA, 22 bp, Homo sapiens
acagggctctgacaccaaggta

SEQ ID NO: 8297927 - DNA, 22 bp, Homo sapiens
aaggtgcctgtctgcaaacctg

SEQ ID NO: 8297928 - DNA, 22 bp, Homo sapiens
aaggtgccccctcctgaacctt

SEQ ID NO: 8297929 - DNA, 22 bp, Homo sapiens
aaggtgccacttccctcagact

SEQ ID NO: 8297930 - DNA, 21 bp, Homo sapiens
aagtggagaagaaaagctgga

SEQ ID NO: 8297931 - DNA, 22 bp, Homo sapiens
aagtggagagccctggaggtct

SEQ ID NO: 8297932 - DNA, 22 bp, Homo sapiens
aagtttatgttggtaagatatc

SEQ ID NO: 8297933 - DNA, 22 bp, Homo sapiens
gggaagcagacggcggggaaat

SEQ ID NO: 8297934 - DNA, 22 bp, Homo sapiens
gggaagcagcattgtgctggct

SEQ ID NO: 8297935 - DNA, 22 bp, Homo sapiens
gggaagcaggtgcagctcgcct

SEQ ID NO: 8297936 - DNA, 22 bp, Homo sapiens
gggaagcatctgagggtccact

SEQ ID NO: 8297937 - DNA, 22 bp, Homo sapiens
gggctctggaaatgggagctcc

SEQ ID NO: 8297938 - DNA, 22 bp, Homo sapiens
gggctctgaatcccaggtctgc

SEQ ID NO: 8297939 - DNA, 22 bp, Homo sapiens
ggcagtggcatgtgggtagtgg

SEQ ID NO: 8297940 - DNA, 22 bp, Homo sapiens
ggcagtggaggaccctgtgtct

SEQ ID NO: 8297941 - DNA, 22 bp, Homo sapiens
ggcactgactgtgcagcgcacc

SEQ ID NO: 8297942 - DNA, 22 bp, Homo sapiens
ggcactgacactagcatggcac

SEQ ID NO: 8297943 - DNA, 22 bp, Homo sapiens
gtgccagcagttatggtgattt

SEQ ID NO: 8297944 - DNA, 22 bp, Homo sapiens
gtcctgggaactggacagctaa

SEQ ID NO: 8297945 - DNA, 22 bp, Homo sapiens
gtaggcagaccagtggatgggt

SEQ ID NO: 8297946 - DNA, 22 bp, Homo sapiens
gtacaaaagttattgcggtttt

SEQ ID NO: 8297947 - DNA, 22 bp, Homo sapiens
gtaattgaacattaagttgaag

SEQ ID NO: 8297948 - DNA, 22 bp, Homo sapiens
ggtggcacactggggagctcgg

SEQ ID NO: 8297949 - DNA, 22 bp, Homo sapiens
gggctctgggattcagagcaag

SEQ ID NO: 8297950 - DNA, 22 bp, Homo sapiens
gggctctgggatgctcttagag

SEQ ID NO: 8297951 - DNA, 22 bp, Homo sapiens
gggctctggggtcagacagcct

SEQ ID NO: 8297952 - DNA, 22 bp, Homo sapiens
gctccccattgatctgcaggct

SEQ ID NO: 8297953 - DNA, 22 bp, Homo sapiens
gctggcagtaaagggtttggca

SEQ ID NO: 8297954 - DNA, 22 bp, Homo sapiens
gctggcatcactggcttcggtg

SEQ ID NO: 8297955 - DNA, 22 bp, Homo sapiens
gctgagtcttgagcactgagca

SEQ ID NO: 8297956 - DNA, 19 bp, Homo sapiens
ggaaggcagaggggctgtg

SEQ ID NO: 8297957 - DNA, 22 bp, Homo sapiens
ggaaggcagtgaaggggctgat

SEQ ID NO: 8297958 - DNA, 22 bp, Homo sapiens
gcaggtgattcaccctgggcct

SEQ ID NO: 8297959 - DNA, 22 bp, Homo sapiens
gcagctgggacactgaggccag

SEQ ID NO: 8297960 - DNA, 22 bp, Homo sapiens
gcagctggtgcaaatgtcactc

SEQ ID NO: 8297961 - DNA, 21 bp, Homo sapiens
gcagctggtctcagagcttgc

SEQ ID NO: 8297962 - DNA, 22 bp, Homo sapiens
gcagctggtctggcctagagta

SEQ ID NO: 8297963 - DNA, 23 bp, Homo sapiens
gcagctggttagaagggaaggag

SEQ ID NO: 8297964 - DNA, 19 bp, Homo sapiens
gcaggtgagccgtggctcc

SEQ ID NO: 8297965 - DNA, 19 bp, Homo sapiens
gcagagtggggtggagggt

SEQ ID NO: 8297966 - DNA, 18 bp, Homo sapiens
gcagagtgcgtctctgtg

SEQ ID NO: 8297967 - DNA, 22 bp, Homo sapiens
tcctcagtaaggatcgtcagct

SEQ ID NO: 8297968 - DNA, 22 bp, Homo sapiens
tcctgagatgagacagtgctgc

SEQ ID NO: 8297969 - DNA, 21 bp, Homo sapiens
tcctgcagaatgccttcctac

SEQ ID NO: 8297970 - DNA, 22 bp, Homo sapiens
tcagcagttgccccctcccagc

SEQ ID NO: 8297971 - DNA, 22 bp, Homo sapiens
tcagcatctcaaccttctctac

SEQ ID NO: 8297972 - DNA, 22 bp, Homo sapiens
tcactgcaacctccacctcctg

SEQ ID NO: 8297973 - DNA, 22 bp, Homo sapiens
tcactgcaacctccacctcccg

SEQ ID NO: 8297974 - DNA, 22 bp, Homo sapiens
tcaaccaggaaactattttgct

SEQ ID NO: 8297975 - DNA, 22 bp, Homo sapiens
tagtttatgattttttggaagg

SEQ ID NO: 8297976 - DNA, 22 bp, Homo sapiens
tatttaaaaagaggccagctgg

SEQ ID NO: 8297977 - DNA, 22 bp, Homo sapiens
tattgtctgcaaaggtttataa

SEQ ID NO: 8297978 - DNA, 22 bp, Homo sapiens
tcaaatctcattgcctaaaact

SEQ ID NO: 8297979 - DNA, 22 bp, Homo sapiens
taagccatcatcatggctttgg

SEQ ID NO: 8297980 - DNA, 23 bp, Homo sapiens
gttgaagtggtcggggaggcaga

SEQ ID NO: 8297981 - DNA, 22 bp, Homo sapiens
gtttatcagagagcagaggtgg

SEQ ID NO: 8297982 - DNA, 22 bp, Homo sapiens
gtgttgatgacattttagaaac

SEQ ID NO: 8297983 - DNA, 22 bp, Homo sapiens
gaggcatgcagagctggagcag

SEQ ID NO: 8297984 - DNA, 22 bp, Homo sapiens
gaggaggttgacggcactgtga

SEQ ID NO: 8297985 - DNA, 22 bp, Homo sapiens
gagctcaggtggtcaaaacaat

SEQ ID NO: 8297986 - DNA, 22 bp, Homo sapiens
gagaacagtgtcatcctataat

SEQ ID NO: 8297987 - DNA, 22 bp, Homo sapiens
gagaacagtgttgtattttttc

SEQ ID NO: 8297988 - DNA, 19 bp, Homo sapiens
gactccaactttaagcatg

SEQ ID NO: 8297989 - DNA, 22 bp, Homo sapiens
gagaacaggctctggagtcaga

SEQ ID NO: 8297990 - DNA, 22 bp, Homo sapiens
gaattaaaatagttttggtcga

SEQ ID NO: 8297991 - DNA, 22 bp, Homo sapiens
gaattaaaatagttttggtcga

SEQ ID NO: 8297992 - DNA, 22 bp, Homo sapiens
ctgtggcatttagaggttgcgt

SEQ ID NO: 8297993 - DNA, 20 bp, Homo sapiens
ctgtggcatcttgaaggagg

SEQ ID NO: 8297994 - DNA, 22 bp, Homo sapiens
ctgtggcattgccgaggctggc

SEQ ID NO: 8297995 - DNA, 22 bp, Homo sapiens
ctgtggcattaataaaagtgca

SEQ ID NO: 8297996 - DNA, 22 bp, Homo sapiens
ctgtggcattgtgaggactgca

SEQ ID NO: 8297997 - DNA, 20 bp, Homo sapiens
ctgtggcatctgtcatggtg

SEQ ID NO: 8297998 - DNA, 22 bp, Homo sapiens
ctgtggcagggaagaggccatg

SEQ ID NO: 8297999 - DNA, 22 bp, Homo sapiens
ctgtggcaggtgtctggggcag

SEQ ID NO: 8298000 - DNA, 22 bp, Homo sapiens
ctgtggcaccaatacatttttc

SEQ ID NO: 8298001 - DNA, 22 bp, Homo sapiens
ctgtggcacatgtggcaaggcc

SEQ ID NO: 8298002 - DNA, 22 bp, Homo sapiens
ctgtggcagaggtgacacctct

SEQ ID NO: 8298003 - DNA, 22 bp, Homo sapiens
ctgtggcactcaagaagcctcc

SEQ ID NO: 8298004 - DNA, 22 bp, Homo sapiens
ctgtggcaggaagggactagca

SEQ ID NO: 8298005 - DNA, 22 bp, Homo sapiens
ctgtggcaaatgatacctccca

SEQ ID NO: 8298006 - DNA, 22 bp, Homo sapiens
ctgtggcaagtctgcctgtcac

SEQ ID NO: 8298007 - DNA, 23 bp, Homo sapiens
ctgtggcaagtcctgcacctgcc

SEQ ID NO: 8298008 - DNA, 22 bp, Homo sapiens
ctgtggaatcgggaaaagacag

SEQ ID NO: 8298009 - DNA, 22 bp, Homo sapiens
ctgggggtcttgaaagggagag

SEQ ID NO: 8298010 - DNA, 22 bp, Homo sapiens
ctgggggtgagcagcagcgacg

SEQ ID NO: 8298011 - DNA, 22 bp, Homo sapiens
cttcccagcacctcagtctggc

SEQ ID NO: 8298012 - DNA, 22 bp, Homo sapiens
gaaaaatgagctgatgtcaggg

SEQ ID NO: 8298013 - DNA, 22 bp, Homo sapiens
gaagaacacctgctgcccagtg

SEQ ID NO: 8298014 - DNA, 22 bp, Homo sapiens
ttataaacttgccaagaaggag

SEQ ID NO: 8298015 - DNA, 22 bp, Homo sapiens
ccttcagccttcatccttcctt

SEQ ID NO: 8298016 - DNA, 22 bp, Homo sapiens
ttgcatcacagtatctctgtaa

SEQ ID NO: 8298017 - DNA, 22 bp, Homo sapiens
cgtttattttgaagattccact

SEQ ID NO: 8298018 - DNA, 22 bp, Homo sapiens
ctgcctggggcatcagtcaagg

SEQ ID NO: 8298019 - DNA, 22 bp, Homo sapiens
ctggaaggagcccgggcggatc

SEQ ID NO: 8298020 - DNA, 21 bp, Homo sapiens
tttatgcatgcctctctgtca

SEQ ID NO: 8298021 - DNA, 22 bp, Homo sapiens
ctctgtggaagaagaaagaagg

SEQ ID NO: 8298022 - DNA, 22 bp, Homo sapiens
ctctgtgggtatttatatgtat

SEQ ID NO: 8298023 - DNA, 22 bp, Homo sapiens
ctctgtggtaaaatagcagtat

SEQ ID NO: 8298024 - DNA, 22 bp, Homo sapiens
ctctgtggtggagtgggtcacc

SEQ ID NO: 8298025 - DNA, 22 bp, Homo sapiens
ctctgtgggcctgtgctttagt

SEQ ID NO: 8298026 - DNA, 22 bp, Homo sapiens
ctctgtgggggagaggcagctg

SEQ ID NO: 8298027 - DNA, 22 bp, Homo sapiens
ctctgtggcttgcctttctgtc

SEQ ID NO: 8298028 - DNA, 17 bp, Homo sapiens
ctctgtggaggtgttta

SEQ ID NO: 8298029 - DNA, 22 bp, Homo sapiens
ctctgtggctacacaaacctcc

SEQ ID NO: 8298030 - DNA, 22 bp, Homo sapiens
ctctgtgggaggaggagtaggc

SEQ ID NO: 8298031 - DNA, 22 bp, Homo sapiens
ctctgtgggaagctgggtgtga

SEQ ID NO: 8298032 - DNA, 22 bp, Homo sapiens
ctctgtgggccagagaggcccc

SEQ ID NO: 8298033 - DNA, 22 bp, Homo sapiens
ctctgtggttagactatggctg

SEQ ID NO: 8298034 - DNA, 22 bp, Homo sapiens
cctgagaatgtttaacagagaa

SEQ ID NO: 8298035 - DNA, 22 bp, Homo sapiens
cctgaatggtctccaaatagat

SEQ ID NO: 8298036 - DNA, 22 bp, Homo sapiens
cctgaatgctggttcctctcct

SEQ ID NO: 8298037 - DNA, 22 bp, Homo sapiens
tgggggtgtcctggtgcacaca

SEQ ID NO: 8298038 - DNA, 22 bp, Homo sapiens
tgggggtggttcttgcctccag

SEQ ID NO: 8298039 - DNA, 22 bp, Homo sapiens
tgggggtgtgccagggacctcc

SEQ ID NO: 8298040 - DNA, 22 bp, Homo sapiens
tggggtacttgtatcaaagcac

SEQ ID NO: 8298041 - DNA, 22 bp, Homo sapiens
cctgaatgcctgacatttcact

SEQ ID NO: 8298042 - DNA, 22 bp, Homo sapiens
tgtaattaaactgaagacagaa

SEQ ID NO: 8298043 - DNA, 22 bp, Homo sapiens
tgtaattaacgttcttgttaga

SEQ ID NO: 8298044 - DNA, 22 bp, Homo sapiens
ccctgctgaatcccatggagtc

SEQ ID NO: 8298045 - DNA, 22 bp, Homo sapiens
tggaggtcttacccagggctat

SEQ ID NO: 8298046 - DNA, 22 bp, Homo sapiens
tggaagggaaagtttggggtcc

SEQ ID NO: 8298047 - DNA, 22 bp, Homo sapiens
tggaagggaacaggtgggtgtt

SEQ ID NO: 8298048 - DNA, 22 bp, Homo sapiens
tgctttattggaacctcatcct

SEQ ID NO: 8298049 - DNA, 19 bp, Homo sapiens
tgagagtgaggaaggcttc

SEQ ID NO: 8298050 - DNA, 22 bp, Homo sapiens
tgagctggcacttttcctggga

SEQ ID NO: 8298051 - DNA, 22 bp, Homo sapiens
ccagggcatgggaagaactgaa

SEQ ID NO: 8298052 - DNA, 22 bp, Homo sapiens
tgaacaggagaaaggtttcttt

SEQ ID NO: 8298053 - DNA, 22 bp, Homo sapiens
tgaacaggtgccttcagggagt

SEQ ID NO: 8298054 - DNA, 22 bp, Homo sapiens
tgaacaggcattatcagggatc

SEQ ID NO: 8298055 - DNA, 22 bp, Homo sapiens
tgaacaggctgtactcatgagg

SEQ ID NO: 8298056 - DNA, 22 bp, Homo sapiens
tgaacaggtatttattgaacat

SEQ ID NO: 8298057 - DNA, 22 bp, Homo sapiens
tgaacaggtcttagtaggttct

SEQ ID NO: 8298058 - DNA, 22 bp, Homo sapiens
tgccctccctgtactgtcagga

SEQ ID NO: 8298059 - DNA, 22 bp, Homo sapiens
tcggagctgtagatgaaaccct

SEQ ID NO: 8298060 - DNA, 22 bp, Homo sapiens
tcggagctgtagatgaaaccct

SEQ ID NO: 8298061 - DNA, 22 bp, Homo sapiens
tcctgaataaattagctgtcac

SEQ ID NO: 8298062 - DNA, 22 bp, Homo sapiens
tcctgaatccaggagagtaggg

SEQ ID NO: 8298063 - DNA, 22 bp, Homo sapiens
tcctgaatgagttgatcacaat

SEQ ID NO: 8298064 - DNA, 20 bp, Homo sapiens
tcctgaatttcctttctgct

SEQ ID NO: 8298065 - DNA, 22 bp, Homo sapiens
tcctgaatttcccagcatgaac

SEQ ID NO: 8298066 - DNA, 22 bp, Homo sapiens
tcctgaattgttgagaagcagc

SEQ ID NO: 8298067 - DNA, 22 bp, Homo sapiens
tcctgaattgaactcagttaat

SEQ ID NO: 8298068 - DNA, 22 bp, Homo sapiens
tcctgaattgccttagtttctg

SEQ ID NO: 8298069 - DNA, 22 bp, Homo sapiens
tcctgaattcctctttgcatcc

SEQ ID NO: 8298070 - DNA, 22 bp, Homo sapiens
ccacttttcactaagatgaatt

SEQ ID NO: 8298071 - DNA, 22 bp, Homo sapiens
ccacttttgggaacagtgagta

SEQ ID NO: 8298072 - DNA, 22 bp, Homo sapiens
ccacttttctacccactgtgac

SEQ ID NO: 8298073 - DNA, 22 bp, Homo sapiens
ccactttttagagaacaaaact

SEQ ID NO: 8298074 - DNA, 22 bp, Homo sapiens
ccactttttcagtgtgcatgca

SEQ ID NO: 8298075 - DNA, 22 bp, Homo sapiens
ccacttttttctccatctctga

SEQ ID NO: 8298076 - DNA, 22 bp, Homo sapiens
tctctgagttgtaaaaaatagt

SEQ ID NO: 8298077 - DNA, 17 bp, Homo sapiens
tctcctggctctatcag

SEQ ID NO: 8298078 - DNA, 22 bp, Homo sapiens
tctcctggccgggctgtcccct

SEQ ID NO: 8298079 - DNA, 22 bp, Homo sapiens
tctctgtgttgcaggaaaatct

SEQ ID NO: 8298080 - DNA, 22 bp, Homo sapiens
tctctgtgtgttggctgtatat

SEQ ID NO: 8298081 - DNA, 22 bp, Homo sapiens
tctctgtgtgggagatcttttt

SEQ ID NO: 8298082 - DNA, 22 bp, Homo sapiens
tctctgtgtgtgtgacagcatt

SEQ ID NO: 8298083 - DNA, 22 bp, Homo sapiens
tctctgtgttccctgttttctc

SEQ ID NO: 8298084 - DNA, 21 bp, Homo sapiens
tctctgtgttcaaggtgccag

SEQ ID NO: 8298085 - DNA, 22 bp, Homo sapiens
tctctgtgtgccttcatctgcc

SEQ ID NO: 8298086 - DNA, 22 bp, Homo sapiens
tccagctggcctaacttcaggg

SEQ ID NO: 8298087 - DNA, 22 bp, Homo sapiens
catgaaaaatttactgttaaca

SEQ ID NO: 8298088 - DNA, 22 bp, Homo sapiens
caggggagtgagtccctctctg

SEQ ID NO: 8298089 - DNA, 22 bp, Homo sapiens
cagggctcagggactgcagaaa

SEQ ID NO: 8298090 - DNA, 22 bp, Homo sapiens
caggttctggagatgcagagat

SEQ ID NO: 8298091 - DNA, 22 bp, Homo sapiens
cagtgggacatgggcactgggc

SEQ ID NO: 8298092 - DNA, 22 bp, Homo sapiens
cagtgggaagaatgcagcctcc

SEQ ID NO: 8298093 - DNA, 22 bp, Homo sapiens
cagtgttttgttacttgggcac

SEQ ID NO: 8298094 - DNA, 22 bp, Homo sapiens
ttggaattttccaggtacagtg

SEQ ID NO: 8298095 - DNA, 22 bp, Homo sapiens
tttaagcacagggataaagtta

SEQ ID NO: 8298096 - DNA, 22 bp, Homo sapiens
tttatcatcttgtttttaaagc

SEQ ID NO: 8298097 - DNA, 21 bp, Homo sapiens
tttatcatcacgagcttgagc

SEQ ID NO: 8298098 - DNA, 22 bp, Homo sapiens
ttctctggacagtgaagagagg

SEQ ID NO: 8298099 - DNA, 22 bp, Homo sapiens
ttctctgggacaggaacagttt

SEQ ID NO: 8298100 - DNA, 22 bp, Homo sapiens
ttctctggggttcagtatctct

SEQ ID NO: 8298101 - DNA, 22 bp, Homo sapiens
ttctctggtaaacacatgcgta

SEQ ID NO: 8298102 - DNA, 22 bp, Homo sapiens
ttctctgggttaggggaactat

SEQ ID NO: 8298103 - DNA, 22 bp, Homo sapiens
ttctctggggactgtctctatt

SEQ ID NO: 8298104 - DNA, 21 bp, Homo sapiens
ttctctggtcaagcacacata

SEQ ID NO: 8298105 - DNA, 22 bp, Homo sapiens
ttctctggaactgaaacaagat

SEQ ID NO: 8298106 - DNA, 22 bp, Homo sapiens
ttattaatcttatctttggaaa

SEQ ID NO: 8298107 - DNA, 22 bp, Homo sapiens
ttatagcagcatgatttatagt

SEQ ID NO: 8298108 - DNA, 22 bp, Homo sapiens
ttatagcagcatgatttacaat

SEQ ID NO: 8298109 - DNA, 22 bp, Homo sapiens
ttatagcagcatgatttataat

SEQ ID NO: 8298110 - DNA, 22 bp, Homo sapiens
cagctccccatggttcctgaag

SEQ ID NO: 8298111 - DNA, 22 bp, Homo sapiens
gtgaagtggttagggagttggc

SEQ ID NO: 8298112 - DNA, 22 bp, Homo sapiens
gtgaagtggagtggtatggttt

SEQ ID NO: 8298113 - DNA, 22 bp, Homo sapiens
gtgaagtgcaaagcagccagtt

SEQ ID NO: 8298114 - DNA, 22 bp, Homo sapiens
gtgaagtgattgaagggtaggg

SEQ ID NO: 8298115 - DNA, 22 bp, Homo sapiens
gggctctgcagagaactggctc

SEQ ID NO: 8298116 - DNA, 22 bp, Homo sapiens
gggctctgcgctcagctccagc

SEQ ID NO: 8298117 - DNA, 22 bp, Homo sapiens
gggctctgcagtgacttgaggg

SEQ ID NO: 8298118 - DNA, 22 bp, Homo sapiens
ggaacaggaaaggagggatgct

SEQ ID NO: 8298119 - DNA, 22 bp, Homo sapiens
gctggcagagagctggtgagga

SEQ ID NO: 8298120 - DNA, 22 bp, Homo sapiens
gctgggccgacctgggctgcag

SEQ ID NO: 8298121 - DNA, 22 bp, Homo sapiens
gctggtgcattagctgcagttc

SEQ ID NO: 8298122 - DNA, 22 bp, Homo sapiens
cactgtctgtgtgtccttgggg

SEQ ID NO: 8298123 - DNA, 22 bp, Homo sapiens
cagaacagaaacgttgttccat

SEQ ID NO: 8298124 - DNA, 22 bp, Homo sapiens
cagaacagaagtaaaatttacc

SEQ ID NO: 8298125 - DNA, 22 bp, Homo sapiens
cagaacagaatcgtgtggtgag

SEQ ID NO: 8298126 - DNA, 22 bp, Homo sapiens
cagaacagacttaacagggctg

SEQ ID NO: 8298127 - DNA, 22 bp, Homo sapiens
cagaacagtcgcctgcatggat

SEQ ID NO: 8298128 - DNA, 20 bp, Homo sapiens
cagaacagtctgagaggcca

SEQ ID NO: 8298129 - DNA, 19 bp, Homo sapiens
cagaacaggaccaggggcc

SEQ ID NO: 8298130 - DNA, 22 bp, Homo sapiens
cagaacagggcccaaggggtcg

SEQ ID NO: 8298131 - DNA, 22 bp, Homo sapiens
cagaacaggtcatgcttgctgt

SEQ ID NO: 8298132 - DNA, 22 bp, Homo sapiens
cagaacagtacctagcacatag

SEQ ID NO: 8298133 - DNA, 23 bp, Homo sapiens
cagaacagtaaaagatgccatgg

SEQ ID NO: 8298134 - DNA, 19 bp, Homo sapiens
cagaacagctgggaagaga

SEQ ID NO: 8298135 - DNA, 22 bp, Homo sapiens
cagaacagagtcaaaagtatgt

SEQ ID NO: 8298136 - DNA, 19 bp, Homo sapiens
cagaacagaggtcatggcc

SEQ ID NO: 8298137 - DNA, 22 bp, Homo sapiens
cagaacagagcctgaatctctc

SEQ ID NO: 8298138 - DNA, 22 bp, Homo sapiens
ggcaggtgtttttatattaaag

SEQ ID NO: 8298139 - DNA, 22 bp, Homo sapiens
ggcaggtgtgagatcgaggcca

SEQ ID NO: 8298140 - DNA, 22 bp, Homo sapiens
cttgagaaggaggaagggcttt

SEQ ID NO: 8298141 - DNA, 22 bp, Homo sapiens
cttgagaacatctccagctcac

SEQ ID NO: 8298142 - DNA, 22 bp, Homo sapiens
cttgagaaaggaacaggaagct

SEQ ID NO: 8298143 - DNA, 22 bp, Homo sapiens
atcttcccaggctggggagagg

SEQ ID NO: 8298144 - DNA, 22 bp, Homo sapiens
gagctctgcttgggttcttagg

SEQ ID NO: 8298145 - DNA, 22 bp, Homo sapiens
gagcagggcttgtcctcctcat

SEQ ID NO: 8298146 - DNA, 22 bp, Homo sapiens
gagcaggtttcaatgctgatgc

SEQ ID NO: 8298147 - DNA, 22 bp, Homo sapiens
gaggggggcgccctgcagtgca

SEQ ID NO: 8298148 - DNA, 21 bp, Homo sapiens
gagtgcagcaaggtagagtct

SEQ ID NO: 8298149 - DNA, 21 bp, Homo sapiens
gatctctggaatgactctggc

SEQ ID NO: 8298150 - DNA, 22 bp, Homo sapiens
gatctctgctggaagggacacc

SEQ ID NO: 8298151 - DNA, 21 bp, Homo sapiens
gatctctggaaggagaaagct

SEQ ID NO: 8298152 - DNA, 18 bp, Homo sapiens
gatctctgcagtgcctac

SEQ ID NO: 8298153 - DNA, 22 bp, Homo sapiens
gcagatgcctgaaggagctggg

SEQ ID NO: 8298154 - DNA, 22 bp, Homo sapiens
gcagatgccagatcatgcaggg

SEQ ID NO: 8298155 - DNA, 22 bp, Homo sapiens
gcagaattctacagatgataaa

SEQ ID NO: 8298156 - DNA, 22 bp, Homo sapiens
gcagaattgaaatgtgtcactt

SEQ ID NO: 8298157 - DNA, 22 bp, Homo sapiens
gcaaaaaccacaattactttta

SEQ ID NO: 8298158 - DNA, 22 bp, Homo sapiens
gcaaaaaccacaattacttttg

SEQ ID NO: 8298159 - DNA, 22 bp, Homo sapiens
gcaaaaactgcaattacttttg

SEQ ID NO: 8298160 - DNA, 22 bp, Homo sapiens
gcaggtggatcacctgaggtca

SEQ ID NO: 8298161 - DNA, 14 bp, Homo sapiens
gcaggcggatcact

SEQ ID NO: 8298162 - DNA, 21 bp, Homo sapiens
gcagtgcagcttggagggtag

SEQ ID NO: 8298163 - DNA, 18 bp, Homo sapiens
gcagtgcaggaagaagag

SEQ ID NO: 8298164 - DNA, 20 bp, Homo sapiens
caaatccctgctctgtgctg

SEQ ID NO: 8298165 - DNA, 22 bp, Homo sapiens
gctctgagaaccaggaacacag

SEQ ID NO: 8298166 - DNA, 22 bp, Homo sapiens
cctcttccactgggccccatcc

SEQ ID NO: 8298167 - DNA, 22 bp, Homo sapiens
cctgaaatgagttctgctcact

SEQ ID NO: 8298168 - DNA, 22 bp, Homo sapiens
ccagctggagctcgcagatagg

SEQ ID NO: 8298169 - DNA, 22 bp, Homo sapiens
ccagctggaacggcagcccagc

SEQ ID NO: 8298170 - DNA, 22 bp, Homo sapiens
ccagctggcactgtggctgccc

SEQ ID NO: 8298171 - DNA, 22 bp, Homo sapiens
ccagaccagactgacttgagcc

SEQ ID NO: 8298172 - DNA, 19 bp, Homo sapiens
aggctaaagagtcttgcgt

SEQ ID NO: 8298173 - DNA, 17 bp, Homo sapiens
cagtgcagataagtgag

SEQ ID NO: 8298174 - DNA, 23 bp, Homo sapiens
cagtgcagggcaactcagactcc

SEQ ID NO: 8298175 - DNA, 22 bp, Homo sapiens
cagtgcaggaagtgagatgcct

SEQ ID NO: 8298176 - DNA, 23 bp, Homo sapiens
aggcaggcagttcagctgttgtt

SEQ ID NO: 8298177 - DNA, 22 bp, Homo sapiens
aggcaggcctacacaatgggag

SEQ ID NO: 8298178 - DNA, 22 bp, Homo sapiens
agctgggcctgagctggaagct

SEQ ID NO: 8298179 - DNA, 22 bp, Homo sapiens
agctgggcctgatttgcagggg

SEQ ID NO: 8298180 - DNA, 21 bp, Homo sapiens
agctgggcctcagcctgcagt

SEQ ID NO: 8298181 - DNA, 22 bp, Homo sapiens
agctgggcagactgcagtggtt

SEQ ID NO: 8298182 - DNA, 18 bp, Homo sapiens
agctggtgaaatccagta

SEQ ID NO: 8298183 - DNA, 22 bp, Homo sapiens
caggaacctacatctgtttggg

SEQ ID NO: 8298184 - DNA, 22 bp, Homo sapiens
caggaacgcctggtgttggcct

SEQ ID NO: 8298185 - DNA, 22 bp, Homo sapiens
caggaaccttgtctgtgttgtt

SEQ ID NO: 8298186 - DNA, 22 bp, Homo sapiens
atctgtggtcaaaatagaaact

SEQ ID NO: 8298187 - DNA, 22 bp, Homo sapiens
atcacaaagggttttctctgag

SEQ ID NO: 8298188 - DNA, 19 bp, Homo sapiens
ctggcctgtgtcctgtgct

SEQ ID NO: 8298189 - DNA, 22 bp, Homo sapiens
ctggcaggtggaggttgcagtg

SEQ ID NO: 8298190 - DNA, 22 bp, Homo sapiens
agtggggagtttccagatgtgt

SEQ ID NO: 8298191 - DNA, 18 bp, Homo sapiens
aggtgcagcctctgaggc

SEQ ID NO: 8298192 - DNA, 22 bp, Homo sapiens
aggtaacatgtggtgctataag

SEQ ID NO: 8298193 - DNA, 22 bp, Homo sapiens
aggtaacactacttagtatact

SEQ ID NO: 8298194 - DNA, 22 bp, Homo sapiens
agaacagggactggaggcttca

SEQ ID NO: 8298195 - DNA, 22 bp, Homo sapiens
agaacaggttcagggtataaaa

SEQ ID NO: 8298196 - DNA, 22 bp, Homo sapiens
actttttctcagaaggattggt

SEQ ID NO: 8298197 - DNA, 22 bp, Homo sapiens
atacaaaaattagccgggagta

SEQ ID NO: 8298198 - DNA, 22 bp, Homo sapiens
acttctcttcataggtggcaat

SEQ ID NO: 8298199 - DNA, 22 bp, Homo sapiens
atacaaaatatatactggagac

SEQ ID NO: 8298200 - DNA, 22 bp, Homo sapiens
agtgaagtaaaagatgtgcatc

SEQ ID NO: 8298201 - DNA, 22 bp, Homo sapiens
aggtgaagttgaggaggcagaa

SEQ ID NO: 8298202 - DNA, 22 bp, Homo sapiens
aggtccaggcatttgggttggg

SEQ ID NO: 8298203 - DNA, 22 bp, Homo sapiens
agctgcagctgttttctgagtg

SEQ ID NO: 8298204 - DNA, 22 bp, Homo sapiens
agctgcagccgcagctgtggcc

SEQ ID NO: 8298205 - DNA, 22 bp, Homo sapiens
agagaggttggctaggatgttt

SEQ ID NO: 8298206 - DNA, 22 bp, Homo sapiens
agatcaaatctgggatttctaa

SEQ ID NO: 8298207 - DNA, 22 bp, Homo sapiens
cactgttctttttgtagtccaa

SEQ ID NO: 8298208 - DNA, 22 bp, Homo sapiens
cactgtttgaggccctagttga

SEQ ID NO: 8298209 - DNA, 22 bp, Homo sapiens
cactgttttcagtcagttctat

SEQ ID NO: 8298210 - DNA, 22 bp, Homo sapiens
agcatggtctgatcaggtggct

SEQ ID NO: 8298211 - DNA, 22 bp, Homo sapiens
agcatggggcaatgcatgtgct

SEQ ID NO: 8298212 - DNA, 20 bp, Homo sapiens
agcagagtgcccatcccgga

SEQ ID NO: 8298213 - DNA, 22 bp, Homo sapiens
agctcttacatttaggtctatg

SEQ ID NO: 8298214 - DNA, 22 bp, Homo sapiens
agctctgggattctcaggccac

SEQ ID NO: 8298215 - DNA, 22 bp, Homo sapiens
agctctggtttagaaggggaaa

SEQ ID NO: 8298216 - DNA, 22 bp, Homo sapiens
cagatgtgattcttccctcagc

SEQ ID NO: 8298217 - DNA, 20 bp, Homo sapiens
aagctgggtaggagaggagc

SEQ ID NO: 8298218 - DNA, 18 bp, Homo sapiens
aagctgggaaggagacag

SEQ ID NO: 8298219 - DNA, 22 bp, Homo sapiens
aagccatggtagaaaactcagt

SEQ ID NO: 8298220 - DNA, 22 bp, Homo sapiens
aagccatgcaagccacaaggtg

SEQ ID NO: 8298221 - DNA, 22 bp, Homo sapiens
aagccatggcatgccaggatca

SEQ ID NO: 8298222 - DNA, 22 bp, Homo sapiens
aagccatggctgcatcagcctg

SEQ ID NO: 8298223 - DNA, 22 bp, Homo sapiens
aacatttacaaatccttctgca

SEQ ID NO: 8298224 - DNA, 22 bp, Homo sapiens
aacatttaggaaggacctcctc

SEQ ID NO: 8298225 - DNA, 22 bp, Homo sapiens
aaacactggcaatttcatgcac

SEQ ID NO: 8298226 - DNA, 22 bp, Homo sapiens
aaacatttgcaactcggtttgg

SEQ ID NO: 8298227 - DNA, 22 bp, Homo sapiens
aaacatttttcttcatcatcct

SEQ ID NO: 8298228 - DNA, 22 bp, Homo sapiens
aaaccactcctgattcacttca

SEQ ID NO: 8298229 - DNA, 22 bp, Homo sapiens
aacattaattacagtcaaacat

SEQ ID NO: 8298230 - DNA, 22 bp, Homo sapiens
aacatttgcagaggaaagctat

SEQ ID NO: 8298231 - DNA, 22 bp, Homo sapiens
aagcactttatgtcaatgtcct

SEQ ID NO: 8298232 - DNA, 22 bp, Homo sapiens
aagcacttagaagagtgcctgc

SEQ ID NO: 8298233 - DNA, 22 bp, Homo sapiens
aagccaatggattggttgcttt

SEQ ID NO: 8298234 - DNA, 23 bp, Homo sapiens
aacttttagagtttaacagtgtt

SEQ ID NO: 8298235 - DNA, 22 bp, Homo sapiens
aagacactgatactctgtgatt

SEQ ID NO: 8298236 - DNA, 23 bp, Homo sapiens
agatctgatgttaccaagaattg

SEQ ID NO: 8298237 - DNA, 22 bp, Homo sapiens
acaaaaaccgtggattcagcat

SEQ ID NO: 8298238 - DNA, 22 bp, Homo sapiens
agagcaggcataaagctttgaa

SEQ ID NO: 8298239 - DNA, 22 bp, Homo sapiens
agagcaggggcaatgtgttgca

SEQ ID NO: 8298240 - DNA, 20 bp, Homo sapiens
agcaggtgacggggcctgct

SEQ ID NO: 8298241 - DNA, 22 bp, Homo sapiens
agcaggtgacagggctgtggtg

SEQ ID NO: 8298242 - DNA, 22 bp, Homo sapiens
agcaggtgaattcctggatgtg

SEQ ID NO: 8298243 - DNA, 22 bp, Homo sapiens
agcactttgagcagatgaagga

SEQ ID NO: 8298244 - DNA, 22 bp, Homo sapiens
agcccagggagttgattagcat

SEQ ID NO: 8298245 - DNA, 18 bp, Homo sapiens
acttattcactaggtgga

SEQ ID NO: 8298246 - DNA, 22 bp, Homo sapiens
actgtggccttgtgggttcagg

SEQ ID NO: 8298247 - DNA, 22 bp, Homo sapiens
aatattatcaaaagctttttca

SEQ ID NO: 8298248 - DNA, 18 bp, Homo sapiens
aagtggcacaggagtgca

SEQ ID NO: 8298249 - DNA, 22 bp, Homo sapiens
tcccagcttagatttgctcatt

SEQ ID NO: 8298250 - DNA, 22 bp, Homo sapiens
tccgggcaactgaagggaggtt

SEQ ID NO: 8298251 - DNA, 22 bp, Homo sapiens
tcagcctcctaatttcctgtga

SEQ ID NO: 8298252 - DNA, 22 bp, Homo sapiens
tcagcctctctgagtccagacc

SEQ ID NO: 8298253 - DNA, 23 bp, Homo sapiens
tcagcctcttaggacttctcacc

SEQ ID NO: 8298254 - DNA, 22 bp, Homo sapiens
tcaatgattagagtttagtgtg

SEQ ID NO: 8298255 - DNA, 22 bp, Homo sapiens
taacaatttgcttcatttgttt

SEQ ID NO: 8298256 - DNA, 22 bp, Homo sapiens
gtgctttagttcttgcaactgg

SEQ ID NO: 8298257 - DNA, 22 bp, Homo sapiens
gtgctttaaaaataggagatga

SEQ ID NO: 8298258 - DNA, 22 bp, Homo sapiens
tagccatgtgtggaacacagcc

SEQ ID NO: 8298259 - DNA, 22 bp, Homo sapiens
tagccatgagcagatcactata

SEQ ID NO: 8298260 - DNA, 22 bp, Homo sapiens
tattgcatctcttcatatctgt

SEQ ID NO: 8298261 - DNA, 22 bp, Homo sapiens
tattgatctggatatttagaca

SEQ ID NO: 8298262 - DNA, 22 bp, Homo sapiens
gcctgggtccaccgctcgcgct

SEQ ID NO: 8298263 - DNA, 22 bp, Homo sapiens
ggaacagggatttggcctggtt

SEQ ID NO: 8298264 - DNA, 21 bp, Homo sapiens
ggaagcagtggcggcaactcc

SEQ ID NO: 8298265 - DNA, 22 bp, Homo sapiens
ggaagctgttgtgagtgcagca

SEQ ID NO: 8298266 - DNA, 22 bp, Homo sapiens
gcttcccaatgtgctagtttct

SEQ ID NO: 8298267 - DNA, 20 bp, Homo sapiens
gcttcccaattcttgatctg

SEQ ID NO: 8298268 - DNA, 23 bp, Homo sapiens
gcttcccagacaatactgcttcc

SEQ ID NO: 8298269 - DNA, 22 bp, Homo sapiens
gctgggttttcttccgggccta

SEQ ID NO: 8298270 - DNA, 20 bp, Homo sapiens
gctgggggtgtgctgagtga

SEQ ID NO: 8298271 - DNA, 22 bp, Homo sapiens
gcagctgcagagaccgggtggg

SEQ ID NO: 8298272 - DNA, 22 bp, Homo sapiens
gcaggctgaaactcggggtcta

SEQ ID NO: 8298273 - DNA, 22 bp, Homo sapiens
gcaggctgatgactggagttgg

SEQ ID NO: 8298274 - DNA, 22 bp, Homo sapiens
gcactgttctcagagcattaga

SEQ ID NO: 8298275 - DNA, 22 bp, Homo sapiens
gcactgtttatctaagtcttga

SEQ ID NO: 8298276 - DNA, 21 bp, Homo sapiens
gcacttctgcagggctgctgg

SEQ ID NO: 8298277 - DNA, 22 bp, Homo sapiens
gcacttctcgggggcgctgtct

SEQ ID NO: 8298278 - DNA, 22 bp, Homo sapiens
gcacttctggcctggcctgtgt

SEQ ID NO: 8298279 - DNA, 22 bp, Homo sapiens
gcactgggctccaggaaggagg

SEQ ID NO: 8298280 - DNA, 22 bp, Homo sapiens
ggctgggtacagggcagtgtgc

SEQ ID NO: 8298281 - DNA, 22 bp, Homo sapiens
ggctgggttatttatggccaag

SEQ ID NO: 8298282 - DNA, 22 bp, Homo sapiens
gggaggttgaggctgcagtgag

SEQ ID NO: 8298283 - DNA, 22 bp, Homo sapiens
gggcacatgcttagggaggaaa

SEQ ID NO: 8298284 - DNA, 22 bp, Homo sapiens
gggaatgagagtcagcccagga

SEQ ID NO: 8298285 - DNA, 22 bp, Homo sapiens
ggcaggtgacggggatgagtat

SEQ ID NO: 8298286 - DNA, 17 bp, Homo sapiens
ggcaggtgacagacacc

SEQ ID NO: 8298287 - DNA, 22 bp, Homo sapiens
ggcaggtgacctggcctcccag

SEQ ID NO: 8298288 - DNA, 17 bp, Homo sapiens
ggcagggtgctgggtat

SEQ ID NO: 8298289 - DNA, 22 bp, Homo sapiens
ggcagggtgcctggctcctgtt

SEQ ID NO: 8298290 - DNA, 22 bp, Homo sapiens
ggcagtggtgggaggctcgctc

SEQ ID NO: 8298291 - DNA, 22 bp, Homo sapiens
ggcagctgttggctctctagga

SEQ ID NO: 8298292 - DNA, 22 bp, Homo sapiens
ggcagctgtggacgtcgtcatt

SEQ ID NO: 8298293 - DNA, 22 bp, Homo sapiens
ggatggcagacagtgagtggct

SEQ ID NO: 8298294 - DNA, 22 bp, Homo sapiens
ggtgaagtaataccaggtgtac

SEQ ID NO: 8298295 - DNA, 22 bp, Homo sapiens
ggtaggcactggtgggaagaga

SEQ ID NO: 8298296 - DNA, 18 bp, Homo sapiens
ggtcaggggcggagagaa

SEQ ID NO: 8298297 - DNA, 22 bp, Homo sapiens
ggtcagggggatctgtgaggta

SEQ ID NO: 8298298 - DNA, 22 bp, Homo sapiens
ggtccagagtccttgctagaga

SEQ ID NO: 8298299 - DNA, 22 bp, Homo sapiens
gggcatgagcacatagtgtcta

SEQ ID NO: 8298300 - DNA, 22 bp, Homo sapiens
gggcatgagatggtagtagctt

SEQ ID NO: 8298301 - DNA, 22 bp, Homo sapiens
gggcatgacttttggagtggga

SEQ ID NO: 8298302 - DNA, 22 bp, Homo sapiens
gggcatgagaggcaggcaagtg

SEQ ID NO: 8298303 - DNA, 22 bp, Homo sapiens
ggggcagctcccgagggcagga

SEQ ID NO: 8298304 - DNA, 22 bp, Homo sapiens
gtgcctcccgggaccatgcact

SEQ ID NO: 8298305 - DNA, 22 bp, Homo sapiens
gtcttattaaaaatctaatccc

SEQ ID NO: 8298306 - DNA, 22 bp, Homo sapiens
gtcctcagagtgggcaggtcct

SEQ ID NO: 8298307 - DNA, 22 bp, Homo sapiens
gtagcttacatcagagttggtt

SEQ ID NO: 8298308 - DNA, 22 bp, Homo sapiens
ttgaagtgagaggggctggggt

SEQ ID NO: 8298309 - DNA, 22 bp, Homo sapiens
cggctgggttcggctgcaggcc

SEQ ID NO: 8298310 - DNA, 20 bp, Homo sapiens
tgttgattggtgtcatctca

SEQ ID NO: 8298311 - DNA, 22 bp, Homo sapiens
ctcctgagctctgaggaagctt

SEQ ID NO: 8298312 - DNA, 23 bp, Homo sapiens
ctccctggcccttgggagacctg

SEQ ID NO: 8298313 - DNA, 22 bp, Homo sapiens
ctctgctggtgaccactgggcc

SEQ ID NO: 8298314 - DNA, 19 bp, Homo sapiens
ctctggagcagacactgga

SEQ ID NO: 8298315 - DNA, 22 bp, Homo sapiens
gaaggtgcaggcaaggttggtt

SEQ ID NO: 8298316 - DNA, 22 bp, Homo sapiens
gaaggcagggaatgtggtgcta

SEQ ID NO: 8298317 - DNA, 22 bp, Homo sapiens
gagccatgagatagttggttcg

SEQ ID NO: 8298318 - DNA, 22 bp, Homo sapiens
gagcatggctgcctccctgtgc

SEQ ID NO: 8298319 - DNA, 22 bp, Homo sapiens
cttctggttccagcttctgttg

SEQ ID NO: 8298320 - DNA, 22 bp, Homo sapiens
gaaagagtatgggagctttact

SEQ ID NO: 8298321 - DNA, 22 bp, Homo sapiens
gaaaatttagaactgaacttct

SEQ ID NO: 8298322 - DNA, 22 bp, Homo sapiens
tggaggcatcagagtgcttggc

SEQ ID NO: 8298323 - DNA, 22 bp, Homo sapiens
tggaggcatgacagtgtctgga

SEQ ID NO: 8298324 - DNA, 22 bp, Homo sapiens
tggaggcatttctttttggtcg

SEQ ID NO: 8298325 - DNA, 22 bp, Homo sapiens
tggaggcattgtgactgctgaa

SEQ ID NO: 8298326 - DNA, 22 bp, Homo sapiens
tggaggcatttgatgttcataa

SEQ ID NO: 8298327 - DNA, 22 bp, Homo sapiens
tggaggcattttaggttgtcac

SEQ ID NO: 8298328 - DNA, 22 bp, Homo sapiens
cctcctggcctgtgcagagccc

SEQ ID NO: 8298329 - DNA, 22 bp, Homo sapiens
cctcctgggacaggctggcaca

SEQ ID NO: 8298330 - DNA, 22 bp, Homo sapiens
cctcctggcttttcccattgaa

SEQ ID NO: 8298331 - DNA, 23 bp, Homo sapiens
cctcctgggcacaggcctgatgg

SEQ ID NO: 8298332 - DNA, 22 bp, Homo sapiens
cctcctgggactcattagcacc

SEQ ID NO: 8298333 - DNA, 22 bp, Homo sapiens
cctcctgggccttgctctgtga

SEQ ID NO: 8298334 - DNA, 22 bp, Homo sapiens
cctcctggtccagcatctcttt

SEQ ID NO: 8298335 - DNA, 22 bp, Homo sapiens
ccagtccatatttatactgccg

SEQ ID NO: 8298336 - DNA, 22 bp, Homo sapiens
tgagcaggtgagtctagggcag

SEQ ID NO: 8298337 - DNA, 22 bp, Homo sapiens
ccatccattttcttgcttgcct

SEQ ID NO: 8298338 - DNA, 22 bp, Homo sapiens
tctgtggctatcatactgaagg

SEQ ID NO: 8298339 - DNA, 23 bp, Homo sapiens
tctgtggctccttcaggctgctg

SEQ ID NO: 8298340 - DNA, 22 bp, Homo sapiens
tcttctctgtggcctggtggtg

SEQ ID NO: 8298341 - DNA, 22 bp, Homo sapiens
tcttctctcctgcttggcagaa

SEQ ID NO: 8298342 - DNA, 17 bp, Homo sapiens
tcttctcttccagtctt

SEQ ID NO: 8298343 - DNA, 21 bp, Homo sapiens
ccaggcagagctgtgagttct

SEQ ID NO: 8298344 - DNA, 22 bp, Homo sapiens
tgaagtctattctatgccaggt

SEQ ID NO: 8298345 - DNA, 22 bp, Homo sapiens
tgaagtgggggaacgagagttc

SEQ ID NO: 8298346 - DNA, 22 bp, Homo sapiens
ccagggcacgttgggacagtac

SEQ ID NO: 8298347 - DNA, 22 bp, Homo sapiens
ccagggcaggggctggagttca

SEQ ID NO: 8298348 - DNA, 22 bp, Homo sapiens
ccagggcagggaccacgtgtct

SEQ ID NO: 8298349 - DNA, 22 bp, Homo sapiens
ccaaccagctatggaatcttgt

SEQ ID NO: 8298350 - DNA, 22 bp, Homo sapiens
catcaaattatgtgtcaaagca

SEQ ID NO: 8298351 - DNA, 22 bp, Homo sapiens
catcaaatggcaagtgaaagct

SEQ ID NO: 8298352 - DNA, 22 bp, Homo sapiens
tagaacagcatttggctattaa

SEQ ID NO: 8298353 - DNA, 22 bp, Homo sapiens
tagaacaggctgtcagagcggg

SEQ ID NO: 8298354 - DNA, 22 bp, Homo sapiens
tagaacaggaataagggaaata

SEQ ID NO: 8298355 - DNA, 22 bp, Homo sapiens
tagaacagagggttgcccagat

SEQ ID NO: 8298356 - DNA, 22 bp, Homo sapiens
tagaacagagttccagtgatca

SEQ ID NO: 8298357 - DNA, 22 bp, Homo sapiens
tagaacagaaggcaccttctct

SEQ ID NO: 8298358 - DNA, 22 bp, Homo sapiens
tagaacagtataggctaaacat

SEQ ID NO: 8298359 - DNA, 22 bp, Homo sapiens
cagtggagtgggactggtctga

SEQ ID NO: 8298360 - DNA, 22 bp, Homo sapiens
cagtggagaggcatgcttggca

SEQ ID NO: 8298361 - DNA, 22 bp, Homo sapiens
cagtgcagtttcccagatgctg

SEQ ID NO: 8298362 - DNA, 22 bp, Homo sapiens
cagtgcaggtttagggctgggg

SEQ ID NO: 8298363 - DNA, 22 bp, Homo sapiens
cagtgcagaggtgcaagcatgt

SEQ ID NO: 8298364 - DNA, 22 bp, Homo sapiens
cagtgcaggtggcagaggacag

SEQ ID NO: 8298365 - DNA, 22 bp, Homo sapiens
tcaaagcctgtggatagtttgg

SEQ ID NO: 8298366 - DNA, 22 bp, Homo sapiens
caggtggcttattagggtcagt

SEQ ID NO: 8298367 - DNA, 22 bp, Homo sapiens
tttaacagatgtgaaattttca

SEQ ID NO: 8298368 - DNA, 22 bp, Homo sapiens
tttaacaggtaaagtaaatgtg

SEQ ID NO: 8298369 - DNA, 22 bp, Homo sapiens
tttattgcatacacaaatgtca

SEQ ID NO: 8298370 - DNA, 23 bp, Homo sapiens
tttcatcagttgatctggacagc

SEQ ID NO: 8298371 - DNA, 22 bp, Homo sapiens
tttcatcaccccaaatctatgg

SEQ ID NO: 8298372 - DNA, 21 bp, Homo sapiens
ttcaagtctctaggacttctc

SEQ ID NO: 8298373 - DNA, 19 bp, Homo sapiens
ttctctgtgctagactctg

SEQ ID NO: 8298374 - DNA, 22 bp, Homo sapiens
ttctctgtggattgggtgagag

SEQ ID NO: 8298375 - DNA, 16 bp, Homo sapiens
ttctctgttccttgtg

SEQ ID NO: 8298376 - DNA, 22 bp, Homo sapiens
ttctctgttttcccctcgatgt

SEQ ID NO: 8298377 - DNA, 22 bp, Homo sapiens
ttctctgtgagggtgctggatt

SEQ ID NO: 8298378 - DNA, 22 bp, Homo sapiens
ttctctgtagttgcctggtgga

SEQ ID NO: 8298379 - DNA, 22 bp, Homo sapiens
ttctgagggaggttctctggga

SEQ ID NO: 8298380 - DNA, 23 bp, Homo sapiens
ttgaaagattgctaagtaaaaat

SEQ ID NO: 8298381 - DNA, 22 bp, Homo sapiens
tttgagaagtaattcaagacat

SEQ ID NO: 8298382 - DNA, 18 bp, Homo sapiens
tttgagaatgcatgactg

SEQ ID NO: 8298383 - DNA, 22 bp, Homo sapiens
caaaaactgcaattacttttac

SEQ ID NO: 8298384 - DNA, 22 bp, Homo sapiens
cttgcggagaactgtgccctta

SEQ ID NO: 8298385 - DNA, 22 bp, Homo sapiens
atgggttcaagtgattctcctg

SEQ ID NO: 8298386 - DNA, 21 bp, Homo sapiens
gagctgggcgaggctccgggg

SEQ ID NO: 8298387 - DNA, 22 bp, Homo sapiens
gagccaggaagaaggccttact

SEQ ID NO: 8298388 - DNA, 22 bp, Homo sapiens
gagccaggagatacctaagggg

SEQ ID NO: 8298389 - DNA, 22 bp, Homo sapiens
gagaacagaagcattcctaatt

SEQ ID NO: 8298390 - DNA, 22 bp, Homo sapiens
gagaacagagataattttactt

SEQ ID NO: 8298391 - DNA, 22 bp, Homo sapiens
gagaacagatttttctgctgtc

SEQ ID NO: 8298392 - DNA, 22 bp, Homo sapiens
gggtgcagtggttcacgcctgt

SEQ ID NO: 8298393 - DNA, 22 bp, Homo sapiens
gggaattatagctgtcacaggc

SEQ ID NO: 8298394 - DNA, 19 bp, Homo sapiens
gggagcaggaaagctgtgg

SEQ ID NO: 8298395 - DNA, 22 bp, Homo sapiens
caaagtacagtgcttcctggga

SEQ ID NO: 8298396 - DNA, 22 bp, Homo sapiens
caagatcttggctgaagtacag

SEQ ID NO: 8298397 - DNA, 22 bp, Homo sapiens
cactgcagcctcaaattcctgg

SEQ ID NO: 8298398 - DNA, 22 bp, Homo sapiens
ggcctcgagcaatactcccatc

SEQ ID NO: 8298399 - DNA, 22 bp, Homo sapiens
ggcagctgagatcatgctgttg

SEQ ID NO: 8298400 - DNA, 22 bp, Homo sapiens
ggcagctgagcatggctacctt

SEQ ID NO: 8298401 - DNA, 22 bp, Homo sapiens
atccccctcttggatggcggca

SEQ ID NO: 8298402 - DNA, 22 bp, Homo sapiens
agttggcattcctgcatcctat

SEQ ID NO: 8298403 - DNA, 22 bp, Homo sapiens
ctcagctcaaaattcacctttg

SEQ ID NO: 8298404 - DNA, 22 bp, Homo sapiens
ctcagctccctccacccagacc

SEQ ID NO: 8298405 - DNA, 22 bp, Homo sapiens
ctcagactggggctccctgagt

SEQ ID NO: 8298406 - DNA, 22 bp, Homo sapiens
agtgggagagaagcaagtagta

SEQ ID NO: 8298407 - DNA, 22 bp, Homo sapiens
ctcctgaggggacaggactcat

SEQ ID NO: 8298408 - DNA, 22 bp, Homo sapiens
ctcgggcttgaggctgtttacc

SEQ ID NO: 8298409 - DNA, 22 bp, Homo sapiens
cgagcatgatgacggctgtggc

SEQ ID NO: 8298410 - DNA, 22 bp, Homo sapiens
aggctctgcagtccatcccgtg

SEQ ID NO: 8298411 - DNA, 22 bp, Homo sapiens
aggctctgatgcaagcccaggg

SEQ ID NO: 8298412 - DNA, 19 bp, Homo sapiens
aggctctgagctcctggag

SEQ ID NO: 8298413 - DNA, 22 bp, Homo sapiens
aggctctgagtagagctgccag

SEQ ID NO: 8298414 - DNA, 22 bp, Homo sapiens
ccaggccaaattcagtcagcag

SEQ ID NO: 8298415 - DNA, 22 bp, Homo sapiens
aggccaggatagcatggatcag

SEQ ID NO: 8298416 - DNA, 22 bp, Homo sapiens
cagcttcttagtctttccttgt

SEQ ID NO: 8298417 - DNA, 22 bp, Homo sapiens
cagctctctaaggtcttgcttt

SEQ ID NO: 8298418 - DNA, 22 bp, Homo sapiens
cagctctcacacttagcttcta

SEQ ID NO: 8298419 - DNA, 22 bp, Homo sapiens
cagcttttaggactgtgagaaa

SEQ ID NO: 8298420 - DNA, 22 bp, Homo sapiens
agctgcaggcctctcctgggga

SEQ ID NO: 8298421 - DNA, 21 bp, Homo sapiens
agctgcagccatgtacatggc

SEQ ID NO: 8298422 - DNA, 22 bp, Homo sapiens
agatggtgtttccccaggtgga

SEQ ID NO: 8298423 - DNA, 22 bp, Homo sapiens
atggagttctgccagcgctgct

SEQ ID NO: 8298424 - DNA, 18 bp, Homo sapiens
agccaggtggaatggaac

SEQ ID NO: 8298425 - DNA, 22 bp, Homo sapiens
agccctccatctgtgctcaggc

SEQ ID NO: 8298426 - DNA, 22 bp, Homo sapiens
caatgataatggctgtatttat

SEQ ID NO: 8298427 - DNA, 22 bp, Homo sapiens
agcaggtgatgtgagtctggaa

SEQ ID NO: 8298428 - DNA, 22 bp, Homo sapiens
agcaggtgatcgcgtgtgctcc

SEQ ID NO: 8298429 - DNA, 21 bp, Homo sapiens
agcaggtgctgttggaggaaa

SEQ ID NO: 8298430 - DNA, 22 bp, Homo sapiens
agcaggtgcgttacttcactct

SEQ ID NO: 8298431 - DNA, 18 bp, Homo sapiens
agcaggtgctgtttcttt

SEQ ID NO: 8298432 - DNA, 22 bp, Homo sapiens
agcataagttggtacagccact

SEQ ID NO: 8298433 - DNA, 22 bp, Homo sapiens
caaatgcagtccctttgttgct

SEQ ID NO: 8298434 - DNA, 22 bp, Homo sapiens
agtctctgttccagggcttcag

SEQ ID NO: 8298435 - DNA, 22 bp, Homo sapiens
agtctgggagggatgccagtgt

SEQ ID NO: 8298436 - DNA, 21 bp, Homo sapiens
actgaatgtgtccaagctgag

SEQ ID NO: 8298437 - DNA, 22 bp, Homo sapiens
actgtcttgctatgagctccca

SEQ ID NO: 8298438 - DNA, 22 bp, Homo sapiens
actgtcttcatatctgtgtctc

SEQ ID NO: 8298439 - DNA, 22 bp, Homo sapiens
agctgccagggactgggcatgg

SEQ ID NO: 8298440 - DNA, 22 bp, Homo sapiens
aggcaggcaaccacctgggaag

SEQ ID NO: 8298441 - DNA, 22 bp, Homo sapiens
accatttaaggaaaatgtatca

SEQ ID NO: 8298442 - DNA, 21 bp, Homo sapiens
accaaaacctatactttctgt

SEQ ID NO: 8298443 - DNA, 22 bp, Homo sapiens
aggcgaagggaccagacggtag

SEQ ID NO: 8298444 - DNA, 22 bp, Homo sapiens
aagaacagattcagcctgaact

SEQ ID NO: 8298445 - DNA, 22 bp, Homo sapiens
aacatattcagatgccaagtcc

SEQ ID NO: 8298446 - DNA, 22 bp, Homo sapiens
aacagcgacgtcctccccaaca

SEQ ID NO: 8298447 - DNA, 22 bp, Homo sapiens
aaaaatacttcacttctgggtg

SEQ ID NO: 8298448 - DNA, 22 bp, Homo sapiens
aaaaagggatttgtgatccagg

SEQ ID NO: 8298449 - DNA, 22 bp, Homo sapiens
aaaaggttttgagtacaaatat

SEQ ID NO: 8298450 - DNA, 22 bp, Homo sapiens
aaaatgtgatctacaaatgcaa

SEQ ID NO: 8298451 - DNA, 22 bp, Homo sapiens
aaagaacagatgtgtggtgcat

SEQ ID NO: 8298452 - DNA, 22 bp, Homo sapiens
aaagaacaaattagctgtttta

SEQ ID NO: 8298453 - DNA, 22 bp, Homo sapiens
aaagaacaaatgatatatggtt

SEQ ID NO: 8298454 - DNA, 22 bp, Homo sapiens
aagcctggactatcgcgtgtgc

SEQ ID NO: 8298455 - DNA, 22 bp, Homo sapiens
aaagcacttcaggagcagtttg

SEQ ID NO: 8298456 - DNA, 22 bp, Homo sapiens
aaagcactcgttagtatttctg

SEQ ID NO: 8298457 - DNA, 22 bp, Homo sapiens
aaagccattgaactgtacttta

SEQ ID NO: 8298458 - DNA, 22 bp, Homo sapiens
aaagccattgcagagcaggatt

SEQ ID NO: 8298459 - DNA, 22 bp, Homo sapiens
aaagccattacaaaatttcata

SEQ ID NO: 8298460 - DNA, 22 bp, Homo sapiens
aacactgtggtcttttcagtaa

SEQ ID NO: 8298461 - DNA, 20 bp, Homo sapiens
aacactgtgcgtggtaggtg

SEQ ID NO: 8298462 - DNA, 22 bp, Homo sapiens
aacactgtcagcctttgatgga

SEQ ID NO: 8298463 - DNA, 22 bp, Homo sapiens
aagaacagttgggaggtgagcc

SEQ ID NO: 8298464 - DNA, 22 bp, Homo sapiens
aagaacagtgtcctgggactcg

SEQ ID NO: 8298465 - DNA, 22 bp, Homo sapiens
aacatttgtgtttgctaaaaat

SEQ ID NO: 8298466 - DNA, 22 bp, Homo sapiens
aaagcctgtctggtcatagcta

SEQ ID NO: 8298467 - DNA, 22 bp, Homo sapiens
agagcaggtggcaactctggga

SEQ ID NO: 8298468 - DNA, 22 bp, Homo sapiens
agagcaggtggcaactctggga

SEQ ID NO: 8298469 - DNA, 22 bp, Homo sapiens
aattaaaaaaggagagcttgct

SEQ ID NO: 8298470 - DNA, 22 bp, Homo sapiens
aattaaattggtttagagagga

SEQ ID NO: 8298471 - DNA, 22 bp, Homo sapiens
aattaaatgacaggggaagatg

SEQ ID NO: 8298472 - DNA, 23 bp, Homo sapiens
aattaaattgctagatccagggc

SEQ ID NO: 8298473 - DNA, 22 bp, Homo sapiens
aatgtaaaatatcttgtacttg

SEQ ID NO: 8298474 - DNA, 22 bp, Homo sapiens
agcctctctgttagtcactggg

SEQ ID NO: 8298475 - DNA, 22 bp, Homo sapiens
acagaattaatgaaaattacaa

SEQ ID NO: 8298476 - DNA, 22 bp, Homo sapiens
acacttttaagactttaatgaa

SEQ ID NO: 8298477 - DNA, 22 bp, Homo sapiens
acacttttagctatgagttaat

SEQ ID NO: 8298478 - DNA, 22 bp, Homo sapiens
acagaaaagtttacttttgctc

SEQ ID NO: 8298479 - DNA, 22 bp, Homo sapiens
acacttttgtttgaagtctcca

SEQ ID NO: 8298480 - DNA, 22 bp, Homo sapiens
acacttttatctctggaggctt

SEQ ID NO: 8298481 - DNA, 22 bp, Homo sapiens
acacttttgtgtatatccagtt

SEQ ID NO: 8298482 - DNA, 22 bp, Homo sapiens
aagtctctgactcacacaatgt

SEQ ID NO: 8298483 - DNA, 22 bp, Homo sapiens
accgtgtctgacactttgggcg

SEQ ID NO: 8298484 - DNA, 22 bp, Homo sapiens
aatcagtcattagctctgacct

SEQ ID NO: 8298485 - DNA, 22 bp, Homo sapiens
gtggagggtgattgccggctgt

SEQ ID NO: 8298486 - DNA, 22 bp, Homo sapiens
gtgcgcaccctcccggcatccc

SEQ ID NO: 8298487 - DNA, 22 bp, Homo sapiens
gtgggagccctcagggaggtgc

SEQ ID NO: 8298488 - DNA, 22 bp, Homo sapiens
gtgggagctgcggaggcctggg

SEQ ID NO: 8298489 - DNA, 22 bp, Homo sapiens
gtggcaggatcacggctcactg

SEQ ID NO: 8298490 - DNA, 22 bp, Homo sapiens
gtcctgggtccccgcaggtcag

SEQ ID NO: 8298491 - DNA, 22 bp, Homo sapiens
gtatacatagatgatgaacaag

SEQ ID NO: 8298492 - DNA, 22 bp, Homo sapiens
ggtgcaggaatctgcaattgaa

SEQ ID NO: 8298493 - DNA, 22 bp, Homo sapiens
ggtgcaggacgaagtgggggtt

SEQ ID NO: 8298494 - DNA, 22 bp, Homo sapiens
gtggggaaaggagtggggctca

SEQ ID NO: 8298495 - DNA, 22 bp, Homo sapiens
gtggggctggaagatgggtact

SEQ ID NO: 8298496 - DNA, 22 bp, Homo sapiens
gtggtttaggggaaagaactgt

SEQ ID NO: 8298497 - DNA, 22 bp, Homo sapiens
gtggtcagcagcagtgggagtg

SEQ ID NO: 8298498 - DNA, 22 bp, Homo sapiens
gtggtcaggcagtgggagagaa

SEQ ID NO: 8298499 - DNA, 22 bp, Homo sapiens
gtgggggtggaaaggcaagttg

SEQ ID NO: 8298500 - DNA, 18 bp, Homo sapiens
gtggggtgttgtgaggat

SEQ ID NO: 8298501 - DNA, 22 bp, Homo sapiens
gtgtccagggccgtgttgtctt

SEQ ID NO: 8298502 - DNA, 22 bp, Homo sapiens
gtgtccagcctgcacagggtgc

SEQ ID NO: 8298503 - DNA, 22 bp, Homo sapiens
gtgtgggaggaaggtgaacaga

SEQ ID NO: 8298504 - DNA, 20 bp, Homo sapiens
taagaacaagactaggaagc

SEQ ID NO: 8298505 - DNA, 22 bp, Homo sapiens
gggctctgggtcgtgtctccat

SEQ ID NO: 8298506 - DNA, 22 bp, Homo sapiens
gggctctggtcctgaactgaag

SEQ ID NO: 8298507 - DNA, 22 bp, Homo sapiens
gggctctggtgccttcacagaa

SEQ ID NO: 8298508 - DNA, 22 bp, Homo sapiens
gggatgcagactacagggctta

SEQ ID NO: 8298509 - DNA, 22 bp, Homo sapiens
ggccagaagttggaaaagagcc

SEQ ID NO: 8298510 - DNA, 22 bp, Homo sapiens
ggcaggtgcttgtcgaaggcct

SEQ ID NO: 8298511 - DNA, 22 bp, Homo sapiens
ggcaggtgctctgtgggcctgg

SEQ ID NO: 8298512 - DNA, 22 bp, Homo sapiens
ggcaggcaggagcgtgcttggg

SEQ ID NO: 8298513 - DNA, 22 bp, Homo sapiens
ggcaggtgctaagagaggtaaa

SEQ ID NO: 8298514 - DNA, 17 bp, Homo sapiens
ggcaggtgcggggccgc

SEQ ID NO: 8298515 - DNA, 22 bp, Homo sapiens
ggcaggtgaggcatgtgcctgg

SEQ ID NO: 8298516 - DNA, 22 bp, Homo sapiens
ggcagctgtaagatgagtgaat

SEQ ID NO: 8298517 - DNA, 22 bp, Homo sapiens
ggcagctgcacgttgtcccgtc

SEQ ID NO: 8298518 - DNA, 22 bp, Homo sapiens
ggaggctgagaggtcgcagtgg

SEQ ID NO: 8298519 - DNA, 22 bp, Homo sapiens
ggaggtgggctaaggactctct

SEQ ID NO: 8298520 - DNA, 22 bp, Homo sapiens
ggaggcagaatagagtgtgggt

SEQ ID NO: 8298521 - DNA, 22 bp, Homo sapiens
ggagaggtgaatggctgctcta

SEQ ID NO: 8298522 - DNA, 22 bp, Homo sapiens
ggagaggtgcaggtcagtggca

SEQ ID NO: 8298523 - DNA, 22 bp, Homo sapiens
ggaactcctgctccaagcagct

SEQ ID NO: 8298524 - DNA, 22 bp, Homo sapiens
gagctgggacatgggtcctctc

SEQ ID NO: 8298525 - DNA, 22 bp, Homo sapiens
gaggcctcaggaatgtcgtgtg

SEQ ID NO: 8298526 - DNA, 22 bp, Homo sapiens
gagtgcagtggcgtgatctctg

SEQ ID NO: 8298527 - DNA, 22 bp, Homo sapiens
gagtgcagtatgagaggctgct

SEQ ID NO: 8298528 - DNA, 22 bp, Homo sapiens
gagtgcagaaattcccttcctg

SEQ ID NO: 8298529 - DNA, 22 bp, Homo sapiens
gagtgcagttggggtgagggga

SEQ ID NO: 8298530 - DNA, 22 bp, Homo sapiens
gagagtctaggaacctcatata

SEQ ID NO: 8298531 - DNA, 22 bp, Homo sapiens
gaagtggggaagcaacaggaga

SEQ ID NO: 8298532 - DNA, 22 bp, Homo sapiens
gacagctgtgcaggagaagggg

SEQ ID NO: 8298533 - DNA, 22 bp, Homo sapiens
gaattacattgttagccttcct

SEQ ID NO: 8298534 - DNA, 20 bp, Homo sapiens
ctttatcaaagggctactag

SEQ ID NO: 8298535 - DNA, 22 bp, Homo sapiens
ctggctggtcatgtcatgagcc

SEQ ID NO: 8298536 - DNA, 22 bp, Homo sapiens
cttctctgacagtctgtttcac

SEQ ID NO: 8298537 - DNA, 22 bp, Homo sapiens
cttctctgcaccccacttttgc

SEQ ID NO: 8298538 - DNA, 23 bp, Homo sapiens
cttctctgagctaggaatgctct

SEQ ID NO: 8298539 - DNA, 22 bp, Homo sapiens
cttctctggctcctcagcgccc

SEQ ID NO: 8298540 - DNA, 22 bp, Homo sapiens
cttctctggcatagcaagcagg

SEQ ID NO: 8298541 - DNA, 22 bp, Homo sapiens
cttctctgcccataggaaatgc

SEQ ID NO: 8298542 - DNA, 17 bp, Homo sapiens
cttctctggcagaagat

SEQ ID NO: 8298543 - DNA, 22 bp, Homo sapiens
cttctctggcagatgtgtgtcc

SEQ ID NO: 8298544 - DNA, 22 bp, Homo sapiens
cttctctgtgtagagattcaga

SEQ ID NO: 8298545 - DNA, 22 bp, Homo sapiens
cttctctgtcacagggttacgt

SEQ ID NO: 8298546 - DNA, 22 bp, Homo sapiens
gcacttttcaaagcttcctgtg

SEQ ID NO: 8298547 - DNA, 23 bp, Homo sapiens
gcacttttataggtggggaaaca

SEQ ID NO: 8298548 - DNA, 22 bp, Homo sapiens
gattgtggaagtcagtggttct

SEQ ID NO: 8298549 - DNA, 22 bp, Homo sapiens
gcagtggggaatgctggggaga

SEQ ID NO: 8298550 - DNA, 16 bp, Homo sapiens
gctcctgggccctcga

SEQ ID NO: 8298551 - DNA, 22 bp, Homo sapiens
gctctgagcagggagaaacagg

SEQ ID NO: 8298552 - DNA, 19 bp, Homo sapiens
gctcctgggcctcactcat

SEQ ID NO: 8298553 - DNA, 22 bp, Homo sapiens
gctctgagtaaatgaaagcatt

SEQ ID NO: 8298554 - DNA, 22 bp, Homo sapiens
gctcatgactgtaatcccagca

SEQ ID NO: 8298555 - DNA, 22 bp, Homo sapiens
ctcagttttaagactactcttt

SEQ ID NO: 8298556 - DNA, 22 bp, Homo sapiens
ttgggttgctttgtttcccgga

SEQ ID NO: 8298557 - DNA, 22 bp, Homo sapiens
ttgggttgaagggcgcttcctt

SEQ ID NO: 8298558 - DNA, 22 bp, Homo sapiens
ctcctgggctcaagtgatcctc

SEQ ID NO: 8298559 - DNA, 22 bp, Homo sapiens
ctcctgggagtcttcctggatg

SEQ ID NO: 8298560 - DNA, 22 bp, Homo sapiens
ctcctgggaggatgcggacccg

SEQ ID NO: 8298561 - DNA, 22 bp, Homo sapiens
ctcctgggagcagggatggatg

SEQ ID NO: 8298562 - DNA, 22 bp, Homo sapiens
ctcctgggagctgtggcagagc

SEQ ID NO: 8298563 - DNA, 22 bp, Homo sapiens
ctacaaaagtaattgtggtttt

SEQ ID NO: 8298564 - DNA, 22 bp, Homo sapiens
ttcttgggaatttttccaacac

SEQ ID NO: 8298565 - DNA, 23 bp, Homo sapiens
ctctcctgaaggacaagctgccg

SEQ ID NO: 8298566 - DNA, 22 bp, Homo sapiens
ctctcctgggctgaccgtccga

SEQ ID NO: 8298567 - DNA, 22 bp, Homo sapiens
ctgagaagcactgtctgcaaga

SEQ ID NO: 8298568 - DNA, 22 bp, Homo sapiens
ctgagaagcaaagaactgcact

SEQ ID NO: 8298569 - DNA, 22 bp, Homo sapiens
ctgagaaggaagcctccactct

SEQ ID NO: 8298570 - DNA, 19 bp, Homo sapiens
ctgaaaaacattctcagga

SEQ ID NO: 8298571 - DNA, 22 bp, Homo sapiens
ctgccagctggagaccaaggaa

SEQ ID NO: 8298572 - DNA, 22 bp, Homo sapiens
ctggcctgaggtcggctgtagg

SEQ ID NO: 8298573 - DNA, 22 bp, Homo sapiens
ctggcatgccttgggtgcctct

SEQ ID NO: 8298574 - DNA, 22 bp, Homo sapiens
ctggcatgtgtttggctcctgt

SEQ ID NO: 8298575 - DNA, 22 bp, Homo sapiens
tgtaaacagtaggactaaagag

SEQ ID NO: 8298576 - DNA, 22 bp, Homo sapiens
cctgggagccaagcctctgtgt

SEQ ID NO: 8298577 - DNA, 22 bp, Homo sapiens
cctgggagagctgcccgggtga

SEQ ID NO: 8298578 - DNA, 22 bp, Homo sapiens
cctggggaatagagtcaagggg

SEQ ID NO: 8298579 - DNA, 22 bp, Homo sapiens
cctcggagaaaggcagctccac

SEQ ID NO: 8298580 - DNA, 22 bp, Homo sapiens
tctgtggcgcatagttgtctct

SEQ ID NO: 8298581 - DNA, 21 bp, Homo sapiens
tctgtggcggactctaggccc

SEQ ID NO: 8298582 - DNA, 19 bp, Homo sapiens
tctgtggccttccctgatg

SEQ ID NO: 8298583 - DNA, 22 bp, Homo sapiens
tctgtggcctgtgtccaagtgc

SEQ ID NO: 8298584 - DNA, 22 bp, Homo sapiens
tctgtggcagttctggttcatc

SEQ ID NO: 8298585 - DNA, 22 bp, Homo sapiens
tctgtggcatgaggaaataggc

SEQ ID NO: 8298586 - DNA, 22 bp, Homo sapiens
tctgtggcatagtgcttgggaa

SEQ ID NO: 8298587 - DNA, 22 bp, Homo sapiens
tctgtggcatgttgcacttgta

SEQ ID NO: 8298588 - DNA, 22 bp, Homo sapiens
tctgtggcatggtatctggagg

SEQ ID NO: 8298589 - DNA, 23 bp, Homo sapiens
tctgtggccccttcgccccactc

SEQ ID NO: 8298590 - DNA, 22 bp, Homo sapiens
tctgtggcccaagtgatggctg

SEQ ID NO: 8298591 - DNA, 22 bp, Homo sapiens
tctgtggcctccttccacttac

SEQ ID NO: 8298592 - DNA, 22 bp, Homo sapiens
tctgtggcctgcctcctcattt

SEQ ID NO: 8298593 - DNA, 22 bp, Homo sapiens
caggcaggagccagggattcca

SEQ ID NO: 8298594 - DNA, 22 bp, Homo sapiens
caggcaagcaaggggtcttgaa

SEQ ID NO: 8298595 - DNA, 16 bp, Homo sapiens
taacatttttaaaagg

SEQ ID NO: 8298596 - DNA, 22 bp, Homo sapiens
taacatttaaatttttcacata

SEQ ID NO: 8298597 - DNA, 22 bp, Homo sapiens
taacatttcggtgacagtggga

SEQ ID NO: 8298598 - DNA, 22 bp, Homo sapiens
taaagccaacactttactgctc

SEQ ID NO: 8298599 - DNA, 22 bp, Homo sapiens
taaagccaatatacctagcata

SEQ ID NO: 8298600 - DNA, 22 bp, Homo sapiens
cagctgcactgaagcaggtttg

SEQ ID NO: 8298601 - DNA, 22 bp, Homo sapiens
gtggggcatgcacgctgctcct

SEQ ID NO: 8298602 - DNA, 18 bp, Homo sapiens
cagctgcaggctcaggac

SEQ ID NO: 8298603 - DNA, 22 bp, Homo sapiens
gtgggaagaacttcaagtggct

SEQ ID NO: 8298604 - DNA, 22 bp, Homo sapiens
gtggcaggtggagcctcctgca

SEQ ID NO: 8298605 - DNA, 22 bp, Homo sapiens
gtggcaggttataagcatctca

SEQ ID NO: 8298606 - DNA, 22 bp, Homo sapiens
gtttattccagcaatctgctta

SEQ ID NO: 8298607 - DNA, 22 bp, Homo sapiens
gtttattcttcagcaacatctg

SEQ ID NO: 8298608 - DNA, 22 bp, Homo sapiens
cagcttccacagacttggctcg

SEQ ID NO: 8298609 - DNA, 22 bp, Homo sapiens
tcctgcagtgtgtctcctgcac

SEQ ID NO: 8298610 - DNA, 22 bp, Homo sapiens
ccagatgggttacttcaagcaa

SEQ ID NO: 8298611 - DNA, 22 bp, Homo sapiens
ccagccagtccagcattggtgt

SEQ ID NO: 8298612 - DNA, 22 bp, Homo sapiens
tctgtggcacgattgcactgca

SEQ ID NO: 8298613 - DNA, 22 bp, Homo sapiens
tctgtggcaaacacagtgacca

SEQ ID NO: 8298614 - DNA, 19 bp, Homo sapiens
tctgtggcacctgggaggg

SEQ ID NO: 8298615 - DNA, 21 bp, Homo sapiens
tctgtggcagcatgatgaggt

SEQ ID NO: 8298616 - DNA, 20 bp, Homo sapiens
tctgtggcaggtggcgcttg

SEQ ID NO: 8298617 - DNA, 18 bp, Homo sapiens
tctgtggcagcagtgcac

SEQ ID NO: 8298618 - DNA, 22 bp, Homo sapiens
ccagctggtttatattccccac

SEQ ID NO: 8298619 - DNA, 22 bp, Homo sapiens
ccagctggggaagtggggcata

SEQ ID NO: 8298620 - DNA, 22 bp, Homo sapiens
ccagctggtgacatccccaacc

SEQ ID NO: 8298621 - DNA, 22 bp, Homo sapiens
ccagctggtctgtgctcatgtt

SEQ ID NO: 8298622 - DNA, 22 bp, Homo sapiens
cagtgcagacgtggagggggca

SEQ ID NO: 8298623 - DNA, 17 bp, Homo sapiens
cagtgcagagccctttc

SEQ ID NO: 8298624 - DNA, 22 bp, Homo sapiens
cagtgcagaggccagggaggat

SEQ ID NO: 8298625 - DNA, 22 bp, Homo sapiens
tattgcttggggtacaaggtat

SEQ ID NO: 8298626 - DNA, 22 bp, Homo sapiens
tcagccctgggcttcctcatgg

SEQ ID NO: 8298627 - DNA, 18 bp, Homo sapiens
tgtttatttttctcttac

SEQ ID NO: 8298628 - DNA, 22 bp, Homo sapiens
tgtttattcatggctaatgaaa

SEQ ID NO: 8298629 - DNA, 22 bp, Homo sapiens
tgtttattacagttcttggaat

SEQ ID NO: 8298630 - DNA, 22 bp, Homo sapiens
tgtttattgagtgcctactata

SEQ ID NO: 8298631 - DNA, 18 bp, Homo sapiens
tgtttattctcctgacag

SEQ ID NO: 8298632 - DNA, 22 bp, Homo sapiens
tgtttattgctgcaattgtgcc

SEQ ID NO: 8298633 - DNA, 22 bp, Homo sapiens
tgtttattttcaggatggattg

SEQ ID NO: 8298634 - DNA, 22 bp, Homo sapiens
tgtttattgcagtgctgggctg

SEQ ID NO: 8298635 - DNA, 22 bp, Homo sapiens
tgtggggacccatgccatgggc

SEQ ID NO: 8298636 - DNA, 22 bp, Homo sapiens
tgtgtggattcatctcaaagag

SEQ ID NO: 8298637 - DNA, 23 bp, Homo sapiens
tgtcttcgactcctgcgtgcttc

SEQ ID NO: 8298638 - DNA, 22 bp, Homo sapiens
tgtcttcgctacaatgaaaagg

SEQ ID NO: 8298639 - DNA, 20 bp, Homo sapiens
tgtcttattccagtgtttac

SEQ ID NO: 8298640 - DNA, 19 bp, Homo sapiens
ttagaacatcctctaggga

SEQ ID NO: 8298641 - DNA, 22 bp, Homo sapiens
tgggctctggggaaactgtgat

SEQ ID NO: 8298642 - DNA, 22 bp, Homo sapiens
tgggctctgctgcgtaccagtt

SEQ ID NO: 8298643 - DNA, 22 bp, Homo sapiens
tgggctctcctggaggacaaca

SEQ ID NO: 8298644 - DNA, 22 bp, Homo sapiens
tgggctctctggcaggaaggct

SEQ ID NO: 8298645 - DNA, 22 bp, Homo sapiens
tgggctctcagtcagactggca

SEQ ID NO: 8298646 - DNA, 19 bp, Homo sapiens
tgggctctcaagagcggaa

SEQ ID NO: 8298647 - DNA, 22 bp, Homo sapiens
tgggcagggagctggaaccaca

SEQ ID NO: 8298648 - DNA, 22 bp, Homo sapiens
tgggcagggatctcttttgcaa

SEQ ID NO: 8298649 - DNA, 22 bp, Homo sapiens
tgggcaggggccctgcttccgt

SEQ ID NO: 8298650 - DNA, 22 bp, Homo sapiens
tgggaggcttccagaccttgct

SEQ ID NO: 8298651 - DNA, 22 bp, Homo sapiens
tgggagtccattgtcccaggca

SEQ ID NO: 8298652 - DNA, 22 bp, Homo sapiens
tgggaggccaaggcaggcggat

SEQ ID NO: 8298653 - DNA, 22 bp, Homo sapiens
tgggaggccgaggcaggtggat

SEQ ID NO: 8298654 - DNA, 22 bp, Homo sapiens
tggggagtgatgcctcggataa

SEQ ID NO: 8298655 - DNA, 22 bp, Homo sapiens
tgggggtgactatctcgggaat

SEQ ID NO: 8298656 - DNA, 21 bp, Homo sapiens
tgggggtgaggcctaggaatc

SEQ ID NO: 8298657 - DNA, 22 bp, Homo sapiens
tgggggtgaaagtctggacagt

SEQ ID NO: 8298658 - DNA, 22 bp, Homo sapiens
tggggttgaagaaaggatctag

SEQ ID NO: 8298659 - DNA, 23 bp, Homo sapiens
tggggttgaattgtagctgtgcc

SEQ ID NO: 8298660 - DNA, 22 bp, Homo sapiens
tgtccactttgtcagtgtcata

SEQ ID NO: 8298661 - DNA, 22 bp, Homo sapiens
tggtgggagtgagggcatgcca

SEQ ID NO: 8298662 - DNA, 23 bp, Homo sapiens
tggtgcctcagaagcagtgggct

SEQ ID NO: 8298663 - DNA, 21 bp, Homo sapiens
tggtttatttcactcagcata

SEQ ID NO: 8298664 - DNA, 22 bp, Homo sapiens
tggtttataacatgtctcatga

SEQ ID NO: 8298665 - DNA, 22 bp, Homo sapiens
tgcggctggtgctgaagctgag

SEQ ID NO: 8298666 - DNA, 22 bp, Homo sapiens
tgcctgggctcggtagccatcg

SEQ ID NO: 8298667 - DNA, 22 bp, Homo sapiens
tgcctgggaaccaatcctggct

SEQ ID NO: 8298668 - DNA, 22 bp, Homo sapiens
tggaggcaactgaagatgtagt

SEQ ID NO: 8298669 - DNA, 20 bp, Homo sapiens
tggaggcacctgtggagatc

SEQ ID NO: 8298670 - DNA, 19 bp, Homo sapiens
tggaggcaagacatggagg

SEQ ID NO: 8298671 - DNA, 22 bp, Homo sapiens
tggaggcagatacactgtaaaa

SEQ ID NO: 8298672 - DNA, 22 bp, Homo sapiens
tggaggcagccgtgaaccacct

SEQ ID NO: 8298673 - DNA, 22 bp, Homo sapiens
tggaggcaggggatacaggtca

SEQ ID NO: 8298674 - DNA, 22 bp, Homo sapiens
tggaggcagtaactgagcaaca

SEQ ID NO: 8298675 - DNA, 22 bp, Homo sapiens
tggaggcagtcacctgaagtca

SEQ ID NO: 8298676 - DNA, 18 bp, Homo sapiens
tggagcaggaagcctggc

SEQ ID NO: 8298677 - DNA, 22 bp, Homo sapiens
tggagcagctctagcgggcgcc

SEQ ID NO: 8298678 - DNA, 22 bp, Homo sapiens
tggagcagctaagcctctgaga

SEQ ID NO: 8298679 - DNA, 22 bp, Homo sapiens
tggagcagaaatttgaagccat

SEQ ID NO: 8298680 - DNA, 22 bp, Homo sapiens
tggagcagagatgggagcccaa

SEQ ID NO: 8298681 - DNA, 22 bp, Homo sapiens
tggagcagaggaagaaggcttt

SEQ ID NO: 8298682 - DNA, 22 bp, Homo sapiens
tggagcagagatggtggccttc

SEQ ID NO: 8298683 - DNA, 22 bp, Homo sapiens
tggagcagaggctgaggttggg

SEQ ID NO: 8298684 - DNA, 22 bp, Homo sapiens
tggaattaataggggatataca

SEQ ID NO: 8298685 - DNA, 22 bp, Homo sapiens
tggaattatctgaagtgatttg

SEQ ID NO: 8298686 - DNA, 22 bp, Homo sapiens
tggaagtggcagaggaagtggt

SEQ ID NO: 8298687 - DNA, 22 bp, Homo sapiens
tggaagtgatgctgaggtgacg

SEQ ID NO: 8298688 - DNA, 21 bp, Homo sapiens
tggaaacagcgccatctgccg

SEQ ID NO: 8298689 - DNA, 18 bp, Homo sapiens
tgctttatgcttatataa

SEQ ID NO: 8298690 - DNA, 20 bp, Homo sapiens
tgctttatgctatactttgt

SEQ ID NO: 8298691 - DNA, 22 bp, Homo sapiens
tgctttatatctctcttcttag

SEQ ID NO: 8298692 - DNA, 22 bp, Homo sapiens
tgctttatcaaagctatagtga

SEQ ID NO: 8298693 - DNA, 22 bp, Homo sapiens
tgctttataacttagtttatgg

SEQ ID NO: 8298694 - DNA, 22 bp, Homo sapiens
tgctttatagacaaggaagtag

SEQ ID NO: 8298695 - DNA, 22 bp, Homo sapiens
tgctttattcgacatctggtag

SEQ ID NO: 8298696 - DNA, 22 bp, Homo sapiens
tggcctggccacatccagcagg

SEQ ID NO: 8298697 - DNA, 22 bp, Homo sapiens
tggcatgagtataggcttctca

SEQ ID NO: 8298698 - DNA, 22 bp, Homo sapiens
tggcatgagaatactgagggat

SEQ ID NO: 8298699 - DNA, 22 bp, Homo sapiens
tggcatgagggaagtttgtggc

SEQ ID NO: 8298700 - DNA, 22 bp, Homo sapiens
tggcatgaatttagctttccat

SEQ ID NO: 8298701 - DNA, 17 bp, Homo sapiens
tggcatgagggtgtggg

SEQ ID NO: 8298702 - DNA, 22 bp, Homo sapiens
tggcactgtagccactactgcc

SEQ ID NO: 8298703 - DNA, 22 bp, Homo sapiens
tggcactgaccccaggcctgtg

SEQ ID NO: 8298704 - DNA, 22 bp, Homo sapiens
tggcagggcctgaatcttatac

SEQ ID NO: 8298705 - DNA, 22 bp, Homo sapiens
tgaggcagctttttctgtgtgt

SEQ ID NO: 8298706 - DNA, 21 bp, Homo sapiens
tgaggcaggggtgcttttgtc

SEQ ID NO: 8298707 - DNA, 22 bp, Homo sapiens
tgaggcaggaggattgcaggat

SEQ ID NO: 8298708 - DNA, 22 bp, Homo sapiens
tgaggtctgcagggctgtgcat

SEQ ID NO: 8298709 - DNA, 22 bp, Homo sapiens
tgagcaggattcgcctcttgca

SEQ ID NO: 8298710 - DNA, 22 bp, Homo sapiens
tgagcaggctcccacttcagtg

SEQ ID NO: 8298711 - DNA, 22 bp, Homo sapiens
tgagcaggcgcagcaggaggtc

SEQ ID NO: 8298712 - DNA, 22 bp, Homo sapiens
tgagcaggactgaccggcctta

SEQ ID NO: 8298713 - DNA, 22 bp, Homo sapiens
tgagcaggactcactgcagcct

SEQ ID NO: 8298714 - DNA, 22 bp, Homo sapiens
tgacagtgagcttggggtactt

SEQ ID NO: 8298715 - DNA, 22 bp, Homo sapiens
tgaatgtgatgctaaacatatg

SEQ ID NO: 8298716 - DNA, 22 bp, Homo sapiens
tgaattcaaattgtgcctatta

SEQ ID NO: 8298717 - DNA, 22 bp, Homo sapiens
tgaatgacctttgaggatggaa

SEQ ID NO: 8298718 - DNA, 22 bp, Homo sapiens
tgaattcatccatttatgcaag

SEQ ID NO: 8298719 - DNA, 22 bp, Homo sapiens
tgaattcatacagtggatacca

SEQ ID NO: 8298720 - DNA, 22 bp, Homo sapiens
tgaattcaggggctattatatt

SEQ ID NO: 8298721 - DNA, 22 bp, Homo sapiens
tgaattcaagttgttgagccat

SEQ ID NO: 8298722 - DNA, 21 bp, Homo sapiens
tgaaacatttgatcaaagcac

SEQ ID NO: 8298723 - DNA, 22 bp, Homo sapiens
tgcagatgcctgggctgcacca

SEQ ID NO: 8298724 - DNA, 22 bp, Homo sapiens
tgcagaattctcagtcagactc

SEQ ID NO: 8298725 - DNA, 22 bp, Homo sapiens
tgccaggcatatggcctctttg

SEQ ID NO: 8298726 - DNA, 22 bp, Homo sapiens
tgccaggctgaacagggtctta

SEQ ID NO: 8298727 - DNA, 22 bp, Homo sapiens
tgcctgaaataccatcatgagt

SEQ ID NO: 8298728 - DNA, 22 bp, Homo sapiens
tgcctgaatgatcagtcagatt

SEQ ID NO: 8298729 - DNA, 20 bp, Homo sapiens
tctcccaggctcagggaaga

SEQ ID NO: 8298730 - DNA, 22 bp, Homo sapiens
tctcctggatggaccttctctt

SEQ ID NO: 8298731 - DNA, 22 bp, Homo sapiens
tctcctggatagatactatcca

SEQ ID NO: 8298732 - DNA, 22 bp, Homo sapiens
tctcctggaagaataccacact

SEQ ID NO: 8298733 - DNA, 22 bp, Homo sapiens
tctcctggaagtgattcccctg

SEQ ID NO: 8298734 - DNA, 20 bp, Homo sapiens
tctcctggtctggtccgtgc

SEQ ID NO: 8298735 - DNA, 22 bp, Homo sapiens
tctcctggccctgtcgccatct

SEQ ID NO: 8298736 - DNA, 22 bp, Homo sapiens
tctcctgggtaaaagggttgat

SEQ ID NO: 8298737 - DNA, 22 bp, Homo sapiens
tctcctggtacccttcctagca

SEQ ID NO: 8298738 - DNA, 22 bp, Homo sapiens
tctcctggtatgtatgcacctg

SEQ ID NO: 8298739 - DNA, 21 bp, Homo sapiens
tctcctgggtccaacccatgc

SEQ ID NO: 8298740 - DNA, 20 bp, Homo sapiens
tctcctggtgacagtaccca

SEQ ID NO: 8298741 - DNA, 22 bp, Homo sapiens
tctctgggcccagaccttcctt

SEQ ID NO: 8298742 - DNA, 19 bp, Homo sapiens
tctctggggacactttcac

SEQ ID NO: 8298743 - DNA, 22 bp, Homo sapiens
tctctggactcgagcttactca

SEQ ID NO: 8298744 - DNA, 22 bp, Homo sapiens
tctctggaattggctgaggcaa

SEQ ID NO: 8298745 - DNA, 22 bp, Homo sapiens
tctctggagctgcagatccagg

SEQ ID NO: 8298746 - DNA, 22 bp, Homo sapiens
tctctggagtataaccagggat

SEQ ID NO: 8298747 - DNA, 23 bp, Homo sapiens
tctctggaactggagagtacggt

SEQ ID NO: 8298748 - DNA, 21 bp, Homo sapiens
tctctggaattagaccatgtt

SEQ ID NO: 8298749 - DNA, 22 bp, Homo sapiens
tctctggaagcgcagatctgtt

SEQ ID NO: 8298750 - DNA, 19 bp, Homo sapiens
tctctggatgacagacact

SEQ ID NO: 8298751 - DNA, 21 bp, Homo sapiens
tctctggagttagcagagaga

SEQ ID NO: 8298752 - DNA, 20 bp, Homo sapiens
tctctgagcttctcttgggg

SEQ ID NO: 8298753 - DNA, 22 bp, Homo sapiens
tctctgagcacctaagatatat

SEQ ID NO: 8298754 - DNA, 21 bp, Homo sapiens
tctctgagacactctggagcc

SEQ ID NO: 8298755 - DNA, 22 bp, Homo sapiens
tctctgggtttttgtcctgtac

SEQ ID NO: 8298756 - DNA, 22 bp, Homo sapiens
tctctgtgagatttgtattaag

SEQ ID NO: 8298757 - DNA, 22 bp, Homo sapiens
tctctgtgagccaggtcctagt

SEQ ID NO: 8298758 - DNA, 22 bp, Homo sapiens
tctctgtgcaggatgctgagtt

SEQ ID NO: 8298759 - DNA, 22 bp, Homo sapiens
tctctgtgagtggaaggcaccc

SEQ ID NO: 8298760 - DNA, 22 bp, Homo sapiens
tctctgtgacagctgggtatgt

SEQ ID NO: 8298761 - DNA, 22 bp, Homo sapiens
tctctgtgaagctcccgttagg

SEQ ID NO: 8298762 - DNA, 22 bp, Homo sapiens
tctctgtgaatggcgtcacctg

SEQ ID NO: 8298763 - DNA, 22 bp, Homo sapiens
tctctgtgactgcagctttgca

SEQ ID NO: 8298764 - DNA, 22 bp, Homo sapiens
tctctgtgacatttctgagcct

SEQ ID NO: 8298765 - DNA, 22 bp, Homo sapiens
tctctgtgagatgccttcctga

SEQ ID NO: 8298766 - DNA, 22 bp, Homo sapiens
tctctgtggtactgagagtcta

SEQ ID NO: 8298767 - DNA, 22 bp, Homo sapiens
tctctgtgggtttcaccagcgc

SEQ ID NO: 8298768 - DNA, 22 bp, Homo sapiens
tctctgtggtatgtcatagcaa

SEQ ID NO: 8298769 - DNA, 22 bp, Homo sapiens
tctctgtggtgggaggctgagt

SEQ ID NO: 8298770 - DNA, 21 bp, Homo sapiens
tctctgtggtccaatcccagc

SEQ ID NO: 8298771 - DNA, 22 bp, Homo sapiens
tctctgtgtcctgaaatgaagg

SEQ ID NO: 8298772 - DNA, 21 bp, Homo sapiens
tctctgtgtacagtctcaccc

SEQ ID NO: 8298773 - DNA, 22 bp, Homo sapiens
tctctgtggtttgagagccggg

SEQ ID NO: 8298774 - DNA, 19 bp, Homo sapiens
tctctgtgtctctgtttat

SEQ ID NO: 8298775 - DNA, 22 bp, Homo sapiens
tctctgtgtcttagtgaaggga

SEQ ID NO: 8298776 - DNA, 22 bp, Homo sapiens
tctctgtgtctcatgttcctat

SEQ ID NO: 8298777 - DNA, 22 bp, Homo sapiens
tctctgtggcatccactcaact

SEQ ID NO: 8298778 - DNA, 21 bp, Homo sapiens
tctctgtggcctaccctctac

SEQ ID NO: 8298779 - DNA, 22 bp, Homo sapiens
tctctgtgggctttggacttga

SEQ ID NO: 8298780 - DNA, 22 bp, Homo sapiens
tctctgtggcaagcatgctgct

SEQ ID NO: 8298781 - DNA, 22 bp, Homo sapiens
tctctgtggcaactacttagct

SEQ ID NO: 8298782 - DNA, 22 bp, Homo sapiens
tctctgtggcaacaattcacta

SEQ ID NO: 8298783 - DNA, 22 bp, Homo sapiens
tctctgtggagcagtgtgttca

SEQ ID NO: 8298784 - DNA, 22 bp, Homo sapiens
tctctgtgcccagtagttctct

SEQ ID NO: 8298785 - DNA, 22 bp, Homo sapiens
tctctgtgcttgactttcccat

SEQ ID NO: 8298786 - DNA, 21 bp, Homo sapiens
tctctgtgtctttaagctgga

SEQ ID NO: 8298787 - DNA, 23 bp, Homo sapiens
tctctgtgtgcctcagtttcttc

SEQ ID NO: 8298788 - DNA, 22 bp, Homo sapiens
tcctgggaggcaggaccccttt

SEQ ID NO: 8298789 - DNA, 22 bp, Homo sapiens
tcctgggaggctgtgcctggct

SEQ ID NO: 8298790 - DNA, 22 bp, Homo sapiens
tcctgggttcatgtcctggtgc

SEQ ID NO: 8298791 - DNA, 22 bp, Homo sapiens
tcctgggtggctctgcccggct

SEQ ID NO: 8298792 - DNA, 22 bp, Homo sapiens
tcctgggtagcctgtccaagat

SEQ ID NO: 8298793 - DNA, 22 bp, Homo sapiens
tcctggagttgtgcagtgcaca

SEQ ID NO: 8298794 - DNA, 22 bp, Homo sapiens
taagaacatctgtccccagatt

SEQ ID NO: 8298795 - DNA, 22 bp, Homo sapiens
taagaacagtgacagccaacat

SEQ ID NO: 8298796 - DNA, 22 bp, Homo sapiens
taagaacattttcggaaagata

SEQ ID NO: 8298797 - DNA, 20 bp, Homo sapiens
tcctggaggcttcatccata

SEQ ID NO: 8298798 - DNA, 22 bp, Homo sapiens
tcgtctgtgaaattgggataag

SEQ ID NO: 8298799 - DNA, 22 bp, Homo sapiens
tcgagctctggagccaaggatg

SEQ ID NO: 8298800 - DNA, 22 bp, Homo sapiens
tcttggaggagagtaagtacct

SEQ ID NO: 8298801 - DNA, 22 bp, Homo sapiens
tcttgagatcaagacacaggga

SEQ ID NO: 8298802 - DNA, 22 bp, Homo sapiens
tcttgagagatatactactgaa

SEQ ID NO: 8298803 - DNA, 22 bp, Homo sapiens
tcttctctacaccagcagcccc

SEQ ID NO: 8298804 - DNA, 22 bp, Homo sapiens
tcttctctcatgtaggagggaa

SEQ ID NO: 8298805 - DNA, 23 bp, Homo sapiens
tcttcctgaactatcaggcacat

SEQ ID NO: 8298806 - DNA, 21 bp, Homo sapiens
tcttcctgctccacactcccc

SEQ ID NO: 8298807 - DNA, 22 bp, Homo sapiens
tctgtggctgtctttccagagg

SEQ ID NO: 8298808 - DNA, 22 bp, Homo sapiens
tctgtggctggagaacttgtct

SEQ ID NO: 8298809 - DNA, 22 bp, Homo sapiens
tctgtggctggtaattgcatgt

SEQ ID NO: 8298810 - DNA, 22 bp, Homo sapiens
tctgtggctgtgctgggccaga

SEQ ID NO: 8298811 - DNA, 22 bp, Homo sapiens
tctgtggctgttatctttatat

SEQ ID NO: 8298812 - DNA, 19 bp, Homo sapiens
tctgtggctgtggggagga

SEQ ID NO: 8298813 - DNA, 22 bp, Homo sapiens
tctgtggcttctatttaacttt

SEQ ID NO: 8298814 - DNA, 22 bp, Homo sapiens
tctgtggcttcctatttcttgg

SEQ ID NO: 8298815 - DNA, 22 bp, Homo sapiens
tctgtggcttgggcctgcctgt

SEQ ID NO: 8298816 - DNA, 22 bp, Homo sapiens
tctgtggctttcttatgttgta

SEQ ID NO: 8298817 - DNA, 22 bp, Homo sapiens
tctgtggctttcgtgtaagatg

SEQ ID NO: 8298818 - DNA, 20 bp, Homo sapiens
tctggggatgaggtctagga

SEQ ID NO: 8298819 - DNA, 22 bp, Homo sapiens
tctgggttgggttcctggaatt

SEQ ID NO: 8298820 - DNA, 17 bp, Homo sapiens
tctgggtttaaatccca

SEQ ID NO: 8298821 - DNA, 22 bp, Homo sapiens
tctgggttattatgatggctac

SEQ ID NO: 8298822 - DNA, 22 bp, Homo sapiens
tctgggttcaaggggagtctgc

SEQ ID NO: 8298823 - DNA, 22 bp, Homo sapiens
tctgggttgaattggataaaca

SEQ ID NO: 8298824 - DNA, 22 bp, Homo sapiens
tctgtaaagactccaaaagcca

SEQ ID NO: 8298825 - DNA, 22 bp, Homo sapiens
tctgggaatggttgatccacac

SEQ ID NO: 8298826 - DNA, 22 bp, Homo sapiens
tctgctctgtactgcactggcc

SEQ ID NO: 8298827 - DNA, 22 bp, Homo sapiens
tctggagagatcttccacaaca

SEQ ID NO: 8298828 - DNA, 22 bp, Homo sapiens
tctgcctgttcccgattccatg

SEQ ID NO: 8298829 - DNA, 21 bp, Homo sapiens
tctgatggtagatgagatgtg

SEQ ID NO: 8298830 - DNA, 22 bp, Homo sapiens
tctgagaagctagaggacaaag

SEQ ID NO: 8298831 - DNA, 22 bp, Homo sapiens
tctgagaatggagctaaaaatc

SEQ ID NO: 8298832 - DNA, 22 bp, Homo sapiens
tctgagaatagtgccactgtgg

SEQ ID NO: 8298833 - DNA, 22 bp, Homo sapiens
aatcagttaaatattgagtaca

SEQ ID NO: 8298834 - DNA, 22 bp, Homo sapiens
aatcagtcattagctctgacct

SEQ ID NO: 8298835 - DNA, 22 bp, Homo sapiens
aatcagttgtccaaagttcaca

SEQ ID NO: 8298836 - DNA, 22 bp, Homo sapiens
aatcagttctacatcttatcca

SEQ ID NO: 8298837 - DNA, 22 bp, Homo sapiens
aatcagttagggtgttaatgag

SEQ ID NO: 8298838 - DNA, 22 bp, Homo sapiens
aatcagttagaaggaagagaat

SEQ ID NO: 8298839 - DNA, 22 bp, Homo sapiens
aatcagtttcttggcaagttta

SEQ ID NO: 8298840 - DNA, 22 bp, Homo sapiens
aatcagttgttcactctgaaaa

SEQ ID NO: 8298841 - DNA, 22 bp, Homo sapiens
aatcagaatttattgaatcttt

SEQ ID NO: 8298842 - DNA, 22 bp, Homo sapiens
agaaatgacacacatgagacat

SEQ ID NO: 8298843 - DNA, 22 bp, Homo sapiens
agaaattcctaaggtacacaag

SEQ ID NO: 8298844 - DNA, 22 bp, Homo sapiens
aatgatgtattagtacaacaca

SEQ ID NO: 8298845 - DNA, 22 bp, Homo sapiens
aatgatggttaaacactggagg

SEQ ID NO: 8298846 - DNA, 22 bp, Homo sapiens
aatgatggtttcatcacttgaa

SEQ ID NO: 8298847 - DNA, 22 bp, Homo sapiens
aatgatggatttagacaagctg

SEQ ID NO: 8298848 - DNA, 22 bp, Homo sapiens
aatgatgggaaggagaaaagca

SEQ ID NO: 8298849 - DNA, 22 bp, Homo sapiens
aatgatggtattgatgagctaa

SEQ ID NO: 8298850 - DNA, 22 bp, Homo sapiens
aatgatggtcatggcaactttt

SEQ ID NO: 8298851 - DNA, 20 bp, Homo sapiens
aatcagaaagtgtgagctct

SEQ ID NO: 8298852 - DNA, 22 bp, Homo sapiens
actttgaaactaaaattcatta

SEQ ID NO: 8298853 - DNA, 22 bp, Homo sapiens
actttatttcctattgcatcca

SEQ ID NO: 8298854 - DNA, 22 bp, Homo sapiens
actcactttccattcaagcacc

SEQ ID NO: 8298855 - DNA, 22 bp, Homo sapiens
actatacattgaatgttaaggt

SEQ ID NO: 8298856 - DNA, 22 bp, Homo sapiens
actctcagagggtggcagcaat

SEQ ID NO: 8298857 - DNA, 22 bp, Homo sapiens
actggagcccgtggaggcgcag

SEQ ID NO: 8298858 - DNA, 20 bp, Homo sapiens
actggagccatctcagccta

SEQ ID NO: 8298859 - DNA, 22 bp, Homo sapiens
actggctgaagtttactttttg

SEQ ID NO: 8298860 - DNA, 22 bp, Homo sapiens
actggctcagagttcctagaga

SEQ ID NO: 8298861 - DNA, 22 bp, Homo sapiens
actctgcttattgctgcaggca

SEQ ID NO: 8298862 - DNA, 22 bp, Homo sapiens
actgagtgtaggactttgagtt

SEQ ID NO: 8298863 - DNA, 22 bp, Homo sapiens
aaggcagagggctggatcagag

SEQ ID NO: 8298864 - DNA, 22 bp, Homo sapiens
aaggaggaatttcagggtgaat

SEQ ID NO: 8298865 - DNA, 22 bp, Homo sapiens
aaggagctcccggcagaccagg

SEQ ID NO: 8298866 - DNA, 21 bp, Homo sapiens
aaggagcctaggaggctcagg

SEQ ID NO: 8298867 - DNA, 22 bp, Homo sapiens
aaggagcttgttcgccttcctc

SEQ ID NO: 8298868 - DNA, 22 bp, Homo sapiens
aaggagagtacaggagttggta

SEQ ID NO: 8298869 - DNA, 22 bp, Homo sapiens
aaggagaggttgtccgtgttgt

SEQ ID NO: 8298870 - DNA, 22 bp, Homo sapiens
aagctggagagttaggtgaata

SEQ ID NO: 8298871 - DNA, 22 bp, Homo sapiens
aaggagagagctttgctggaac

SEQ ID NO: 8298872 - DNA, 22 bp, Homo sapiens
aaggagagagctttgctggaac

SEQ ID NO: 8298873 - DNA, 22 bp, Homo sapiens
aagctccccgaaacccacctct

SEQ ID NO: 8298874 - DNA, 17 bp, Homo sapiens
acagggcagaaacagct

SEQ ID NO: 8298875 - DNA, 22 bp, Homo sapiens
aagctctgctcagcagactagg

SEQ ID NO: 8298876 - DNA, 22 bp, Homo sapiens
acagggcagaaatgttgcatct

SEQ ID NO: 8298877 - DNA, 22 bp, Homo sapiens
acagggcagagaggcaggcttg

SEQ ID NO: 8298878 - DNA, 22 bp, Homo sapiens
acagggcagagtgaaatgctat

SEQ ID NO: 8298879 - DNA, 22 bp, Homo sapiens
acagggcagagggcagttggta

SEQ ID NO: 8298880 - DNA, 22 bp, Homo sapiens
aagctgccctgtgttagagttc

SEQ ID NO: 8298881 - DNA, 22 bp, Homo sapiens
aagctgccctcattcccagtgc

SEQ ID NO: 8298882 - DNA, 18 bp, Homo sapiens
aagctgccctcaggcagg

SEQ ID NO: 8298883 - DNA, 19 bp, Homo sapiens
acagggcagcaataggata

SEQ ID NO: 8298884 - DNA, 22 bp, Homo sapiens
aagctgcctagagttgaatgtc

SEQ ID NO: 8298885 - DNA, 22 bp, Homo sapiens
aagctgcctgggaggaagggct

SEQ ID NO: 8298886 - DNA, 22 bp, Homo sapiens
aagctgcctgccacgctagata

SEQ ID NO: 8298887 - DNA, 22 bp, Homo sapiens
aagctgccttgctgaggagaaa

SEQ ID NO: 8298888 - DNA, 23 bp, Homo sapiens
aagctgccttcgcagttggtctg

SEQ ID NO: 8298889 - DNA, 22 bp, Homo sapiens
aagctgccttccatgtgaggaa

SEQ ID NO: 8298890 - DNA, 21 bp, Homo sapiens
acagcctgtcatctcatggtc

SEQ ID NO: 8298891 - DNA, 22 bp, Homo sapiens
acagcctgtttgatctggtgct

SEQ ID NO: 8298892 - DNA, 19 bp, Homo sapiens
acagcctgttggtggggct

SEQ ID NO: 8298893 - DNA, 22 bp, Homo sapiens
acagcctgtgtaccagctggga

SEQ ID NO: 8298894 - DNA, 22 bp, Homo sapiens
aagccttcctgagtgcaaggcc

SEQ ID NO: 8298895 - DNA, 22 bp, Homo sapiens
aagcgccacgagaagctggacc

SEQ ID NO: 8298896 - DNA, 22 bp, Homo sapiens
aagcgccatggttcctgcgcag

SEQ ID NO: 8298897 - DNA, 22 bp, Homo sapiens
aaggcctgctcagctgtctgtg

SEQ ID NO: 8298898 - DNA, 21 bp, Homo sapiens
aaggcctgcttactgctagtt

SEQ ID NO: 8298899 - DNA, 22 bp, Homo sapiens
aaggcctgaacatgaggagatg

SEQ ID NO: 8298900 - DNA, 22 bp, Homo sapiens
aaggcctgggaggcctctcttc

SEQ ID NO: 8298901 - DNA, 22 bp, Homo sapiens
aaggcctggatttaggttgtga

SEQ ID NO: 8298902 - DNA, 22 bp, Homo sapiens
aaggcctgctcagctgtctgtg

SEQ ID NO: 8298903 - DNA, 21 bp, Homo sapiens
aaggcctgcttactgctagtt

SEQ ID NO: 8298904 - DNA, 22 bp, Homo sapiens
aaggcctgggagtactgggaca

SEQ ID NO: 8298905 - DNA, 22 bp, Homo sapiens
aaggcgacacaggcagcaggcc

SEQ ID NO: 8298906 - DNA, 22 bp, Homo sapiens
aaggctctctgatggcagcagt

SEQ ID NO: 8298907 - DNA, 22 bp, Homo sapiens
acatttctgagcagggagctgt

SEQ ID NO: 8298908 - DNA, 22 bp, Homo sapiens
acatttctgcatctcagagcta

SEQ ID NO: 8298909 - DNA, 22 bp, Homo sapiens
acatttctgcatgtagggtaat

SEQ ID NO: 8298910 - DNA, 22 bp, Homo sapiens
acatttctcttgatgtctctat

SEQ ID NO: 8298911 - DNA, 22 bp, Homo sapiens
acatttctggagtttctcaaca

SEQ ID NO: 8298912 - DNA, 22 bp, Homo sapiens
acatttctgtcttagggactgt

SEQ ID NO: 8298913 - DNA, 22 bp, Homo sapiens
acatttctgctagaataggtga

SEQ ID NO: 8298914 - DNA, 22 bp, Homo sapiens
acatttcttccctttagcagaa

SEQ ID NO: 8298915 - DNA, 22 bp, Homo sapiens
acatttcttagcctagttccag

SEQ ID NO: 8298916 - DNA, 22 bp, Homo sapiens
acatttcttccacatgctgctg

SEQ ID NO: 8298917 - DNA, 22 bp, Homo sapiens
acatttaaatatgccttatatt

SEQ ID NO: 8298918 - DNA, 22 bp, Homo sapiens
acatttaaatacctatgtttct

SEQ ID NO: 8298919 - DNA, 22 bp, Homo sapiens
aaggctgcttttaacatgcata

SEQ ID NO: 8298920 - DNA, 22 bp, Homo sapiens
acccttttgcctttaattcatg

SEQ ID NO: 8298921 - DNA, 22 bp, Homo sapiens
accctgccgtgggctgcttgtg

SEQ ID NO: 8298922 - DNA, 22 bp, Homo sapiens
accctgaggggtatagcagaag

SEQ ID NO: 8298923 - DNA, 22 bp, Homo sapiens
accctgagtcagacagcctgac

SEQ ID NO: 8298924 - DNA, 22 bp, Homo sapiens
acccctccattctgaaggctgc

SEQ ID NO: 8298925 - DNA, 22 bp, Homo sapiens
acccaggaggtggaggctgcag

SEQ ID NO: 8298926 - DNA, 22 bp, Homo sapiens
acccagaggtgtctagcaagct

SEQ ID NO: 8298927 - DNA, 22 bp, Homo sapiens
acccagaggcggaggttgcagt

SEQ ID NO: 8298928 - DNA, 22 bp, Homo sapiens
acccagagctgggcttggcaaa

SEQ ID NO: 8298929 - DNA, 21 bp, Homo sapiens
accaggcttgtgggagggagc

SEQ ID NO: 8298930 - DNA, 19 bp, Homo sapiens
acccagagccctttgcagg

SEQ ID NO: 8298931 - DNA, 19 bp, Homo sapiens
accaggcttatggtcagtg

SEQ ID NO: 8298932 - DNA, 22 bp, Homo sapiens
acagaaagaaggtgtatttgag

SEQ ID NO: 8298933 - DNA, 22 bp, Homo sapiens
acactttgttgtggcatatacg

SEQ ID NO: 8298934 - DNA, 22 bp, Homo sapiens
acagaattaatgaaaattacaa

SEQ ID NO: 8298935 - DNA, 20 bp, Homo sapiens
acagaaagagagaatgtcag

SEQ ID NO: 8298936 - DNA, 22 bp, Homo sapiens
acagacagattttgtctgatgt

SEQ ID NO: 8298937 - DNA, 22 bp, Homo sapiens
agccaggggattcatcagggac

SEQ ID NO: 8298938 - DNA, 22 bp, Homo sapiens
acagacagggcacctgcctcct

SEQ ID NO: 8298939 - DNA, 22 bp, Homo sapiens
acagagaaagtgggctgaagat

SEQ ID NO: 8298940 - DNA, 19 bp, Homo sapiens
agccagggtgagaaggagc

SEQ ID NO: 8298941 - DNA, 19 bp, Homo sapiens
agccagggtgagaaggagc

SEQ ID NO: 8298942 - DNA, 22 bp, Homo sapiens
agcctctctgttagtcactggg

SEQ ID NO: 8298943 - DNA, 22 bp, Homo sapiens
agcctctctgatgtgacagcta

SEQ ID NO: 8298944 - DNA, 22 bp, Homo sapiens
agcctctctccagcttggcaga

SEQ ID NO: 8298945 - DNA, 20 bp, Homo sapiens
agccctgtttcctggagaga

SEQ ID NO: 8298946 - DNA, 22 bp, Homo sapiens
agcctctctttattcccagcta

SEQ ID NO: 8298947 - DNA, 22 bp, Homo sapiens
agcctctctttctggtggctaa

SEQ ID NO: 8298948 - DNA, 22 bp, Homo sapiens
agcctctgactgtcagcaaggt

SEQ ID NO: 8298949 - DNA, 22 bp, Homo sapiens
acagagccactttggtgcctac

SEQ ID NO: 8298950 - DNA, 21 bp, Homo sapiens
acagagccgggcacaaagctg

SEQ ID NO: 8298951 - DNA, 22 bp, Homo sapiens
acagagcctccaggagtgctgg

SEQ ID NO: 8298952 - DNA, 22 bp, Homo sapiens
acagagccaaaaggacatagta

SEQ ID NO: 8298953 - DNA, 22 bp, Homo sapiens
acagagctgggatctgaaccca

SEQ ID NO: 8298954 - DNA, 22 bp, Homo sapiens
acagagctgggtgccccctgga

SEQ ID NO: 8298955 - DNA, 22 bp, Homo sapiens
acagagctcccagccatctcct

SEQ ID NO: 8298956 - DNA, 19 bp, Homo sapiens
acagagctctctgcttctg

SEQ ID NO: 8298957 - DNA, 21 bp, Homo sapiens
acagatgggatgagcacactg

SEQ ID NO: 8298958 - DNA, 22 bp, Homo sapiens
agctcccagaaggccctgcgcc

SEQ ID NO: 8298959 - DNA, 22 bp, Homo sapiens
agctcccagagctcgagagtaa

SEQ ID NO: 8298960 - DNA, 22 bp, Homo sapiens
acagcacaatctgagtcccaga

SEQ ID NO: 8298961 - DNA, 17 bp, Homo sapiens
agctcctgcccatggct

SEQ ID NO: 8298962 - DNA, 22 bp, Homo sapiens
agctcctgcacccagccttgag

SEQ ID NO: 8298963 - DNA, 22 bp, Homo sapiens
acacagggatatttcaggtggt

SEQ ID NO: 8298964 - DNA, 22 bp, Homo sapiens
acacagggaggaggtgctgtgc

SEQ ID NO: 8298965 - DNA, 17 bp, Homo sapiens
acacagggagagggagc

SEQ ID NO: 8298966 - DNA, 22 bp, Homo sapiens
acacagggcagagagctggctc

SEQ ID NO: 8298967 - DNA, 19 bp, Homo sapiens
acacagggatcagagggtt

SEQ ID NO: 8298968 - DNA, 22 bp, Homo sapiens
acacagggcaatgctttgacct

SEQ ID NO: 8298969 - DNA, 22 bp, Homo sapiens
acacatgctgataagaatataa

SEQ ID NO: 8298970 - DNA, 22 bp, Homo sapiens
acacagggcggaaagcatgaga

SEQ ID NO: 8298971 - DNA, 22 bp, Homo sapiens
acactgaagagcactttcaaag

SEQ ID NO: 8298972 - DNA, 22 bp, Homo sapiens
acactgaatatacaatgaatat

SEQ ID NO: 8298973 - DNA, 22 bp, Homo sapiens
acactgaataattgagagttga

SEQ ID NO: 8298974 - DNA, 22 bp, Homo sapiens
acactgcagatgaaagcataag

SEQ ID NO: 8298975 - DNA, 22 bp, Homo sapiens
acactttacagcttcctttgca

SEQ ID NO: 8298976 - DNA, 22 bp, Homo sapiens
acactgaatgctgtttagaaat

SEQ ID NO: 8298977 - DNA, 22 bp, Homo sapiens
acactgaatgtttaagaacttg

SEQ ID NO: 8298978 - DNA, 19 bp, Homo sapiens
acactgaatgtagaattgg

SEQ ID NO: 8298979 - DNA, 22 bp, Homo sapiens
agcagctggtgagcaagctcag

SEQ ID NO: 8298980 - DNA, 22 bp, Homo sapiens
agcagctggtaggagtggccac

SEQ ID NO: 8298981 - DNA, 17 bp, Homo sapiens
agcagctgggttgatct

SEQ ID NO: 8298982 - DNA, 22 bp, Homo sapiens
agcagctgggctcagagctggg

SEQ ID NO: 8298983 - DNA, 22 bp, Homo sapiens
agcagctggggcctgtgacgat

SEQ ID NO: 8298984 - DNA, 22 bp, Homo sapiens
agcagctgagccccagctgtga

SEQ ID NO: 8298985 - DNA, 22 bp, Homo sapiens
acaatgcaccagcatcttcacc

SEQ ID NO: 8298986 - DNA, 22 bp, Homo sapiens
agcagaactgatgagacttgag

SEQ ID NO: 8298987 - DNA, 22 bp, Homo sapiens
agcagaacctgcagacctgtct

SEQ ID NO: 8298988 - DNA, 19 bp, Homo sapiens
agcagagcagggccgtggg

SEQ ID NO: 8298989 - DNA, 22 bp, Homo sapiens
agcagagccagaattggaccag

SEQ ID NO: 8298990 - DNA, 22 bp, Homo sapiens
agcagagccaggtctctctgta

SEQ ID NO: 8298991 - DNA, 22 bp, Homo sapiens
agcagatgagcctcatgactgg

SEQ ID NO: 8298992 - DNA, 22 bp, Homo sapiens
agcagagcccttccatggcctt

SEQ ID NO: 8298993 - DNA, 18 bp, Homo sapiens
agcagagcccatgcattc

SEQ ID NO: 8298994 - DNA, 19 bp, Homo sapiens
agcagagccctgaagatcc

SEQ ID NO: 8298995 - DNA, 23 bp, Homo sapiens
aatggtcttcctccacccctctg

SEQ ID NO: 8298996 - DNA, 22 bp, Homo sapiens
aatgggaggattttctctcttg

SEQ ID NO: 8298997 - DNA, 22 bp, Homo sapiens
aatgggagagaacacaaagtcc

SEQ ID NO: 8298998 - DNA, 22 bp, Homo sapiens
aatgggaggtagtatgggaggt

SEQ ID NO: 8298999 - DNA, 22 bp, Homo sapiens
agaagcagactctgaggcaagg

SEQ ID NO: 8299000 - DNA, 23 bp, Homo sapiens
agaagcagcttctggagtatcgg

SEQ ID NO: 8299001 - DNA, 22 bp, Homo sapiens
aattaacaaatgtagctgtgat

SEQ ID NO: 8299002 - DNA, 22 bp, Homo sapiens
aattaacagagggcttattact

SEQ ID NO: 8299003 - DNA, 22 bp, Homo sapiens
agagacaggatatctgctcatg

SEQ ID NO: 8299004 - DNA, 20 bp, Homo sapiens
agaccctgtgtcctgtggcc

SEQ ID NO: 8299005 - DNA, 22 bp, Homo sapiens
agaccctgtcagtgttaggaaa

SEQ ID NO: 8299006 - DNA, 22 bp, Homo sapiens
aatgtggttaacccatttaaga

SEQ ID NO: 8299007 - DNA, 22 bp, Homo sapiens
aatgtgtacatgacagatagaa

SEQ ID NO: 8299008 - DNA, 22 bp, Homo sapiens
agaccctgcacctctcgtgggc

SEQ ID NO: 8299009 - DNA, 22 bp, Homo sapiens
agagccaggcggctgggcacct

SEQ ID NO: 8299010 - DNA, 22 bp, Homo sapiens
agagacagggttttgccatgtt

SEQ ID NO: 8299011 - DNA, 22 bp, Homo sapiens
agagcaggtggcaactctggga

SEQ ID NO: 8299012 - DNA, 22 bp, Homo sapiens
agagccaggtgtagtctcggag

SEQ ID NO: 8299013 - DNA, 22 bp, Homo sapiens
agagccaggtgctgctgtttga

SEQ ID NO: 8299014 - DNA, 22 bp, Homo sapiens
agagcctgcatcaggcttgggg

SEQ ID NO: 8299015 - DNA, 22 bp, Homo sapiens
agagcctgcatcaggcttgggg

SEQ ID NO: 8299016 - DNA, 22 bp, Homo sapiens
agagcctggacctgagctacaa

SEQ ID NO: 8299017 - DNA, 22 bp, Homo sapiens
agagcctgctgtgtaagtcaca

SEQ ID NO: 8299018 - DNA, 20 bp, Homo sapiens
agagcctggaaaaagacatc

SEQ ID NO: 8299019 - DNA, 22 bp, Homo sapiens
agagcctggacttttctgagcc

SEQ ID NO: 8299020 - DNA, 22 bp, Homo sapiens
acaaaggtgcgtcccttcagct

SEQ ID NO: 8299021 - DNA, 22 bp, Homo sapiens
acaaaggtggaccatgtggctt

SEQ ID NO: 8299022 - DNA, 18 bp, Homo sapiens
acaaaggtctgcaagacc

SEQ ID NO: 8299023 - DNA, 22 bp, Homo sapiens
agaggctgttacactcccagat

SEQ ID NO: 8299024 - DNA, 22 bp, Homo sapiens
agaggctgttacactcccagat

SEQ ID NO: 8299025 - DNA, 22 bp, Homo sapiens
agaggctgagaaaccctcttct

SEQ ID NO: 8299026 - DNA, 20 bp, Homo sapiens
agaggcttccttgggaggag

SEQ ID NO: 8299027 - DNA, 19 bp, Homo sapiens
acaaagctgtgagcagctt

SEQ ID NO: 8299028 - DNA, 22 bp, Homo sapiens
agaggctgaatgatgtcatcat

SEQ ID NO: 8299029 - DNA, 22 bp, Homo sapiens
agaggctgaatgatgtcatcat

SEQ ID NO: 8299030 - DNA, 22 bp, Homo sapiens
agaggctgaatgatgtcatcat

SEQ ID NO: 8299031 - DNA, 22 bp, Homo sapiens
agaggccctctctctcctgatg

SEQ ID NO: 8299032 - DNA, 22 bp, Homo sapiens
acaagagacaagaggttcttct

SEQ ID NO: 8299033 - DNA, 22 bp, Homo sapiens
acaagagattatctacagatga

SEQ ID NO: 8299034 - DNA, 22 bp, Homo sapiens
agataacttttgggtattcatg

SEQ ID NO: 8299035 - DNA, 17 bp, Homo sapiens
acaagcagtggccatgg

SEQ ID NO: 8299036 - DNA, 22 bp, Homo sapiens
aaagccttcaagtagatgtaag

SEQ ID NO: 8299037 - DNA, 22 bp, Homo sapiens
aaagccttgcccgtcactggga

SEQ ID NO: 8299038 - DNA, 22 bp, Homo sapiens
aaagccttgagatcctatagtt

SEQ ID NO: 8299039 - DNA, 22 bp, Homo sapiens
aaagccttgggatttgtgatca

SEQ ID NO: 8299040 - DNA, 22 bp, Homo sapiens
aaagccttggtcatctggttcc

SEQ ID NO: 8299041 - DNA, 22 bp, Homo sapiens
aacccagccgtgtagctgccgc

SEQ ID NO: 8299042 - DNA, 22 bp, Homo sapiens
aagaacagttgggaggtgagcc

SEQ ID NO: 8299043 - DNA, 22 bp, Homo sapiens
aagaacagtgtcctgggactcg

SEQ ID NO: 8299044 - DNA, 23 bp, Homo sapiens
aacaccaaggctcagagagataa

SEQ ID NO: 8299045 - DNA, 22 bp, Homo sapiens
aaagatttgagttctgcttata

SEQ ID NO: 8299046 - DNA, 22 bp, Homo sapiens
aaagatttcagaagcctgtgcc

SEQ ID NO: 8299047 - DNA, 22 bp, Homo sapiens
aaagatttcacatcccaagcct

SEQ ID NO: 8299048 - DNA, 22 bp, Homo sapiens
aaagatttgaaattaggcatca

SEQ ID NO: 8299049 - DNA, 22 bp, Homo sapiens
aaagatttatgaagttcaatta

SEQ ID NO: 8299050 - DNA, 22 bp, Homo sapiens
aaagatttaagaataatttgtg

SEQ ID NO: 8299051 - DNA, 22 bp, Homo sapiens
aaagcctcccaggttatgagta

SEQ ID NO: 8299052 - DNA, 22 bp, Homo sapiens
aaagcccatgtggaagtacagg

SEQ ID NO: 8299053 - DNA, 22 bp, Homo sapiens
aacatacagtgagcagtggact

SEQ ID NO: 8299054 - DNA, 22 bp, Homo sapiens
aagcctggcacattggagtctg

SEQ ID NO: 8299055 - DNA, 22 bp, Homo sapiens
aagcctctggggcctcatctgt

SEQ ID NO: 8299056 - DNA, 22 bp, Homo sapiens
aagcctcaccttttagaagcta

SEQ ID NO: 8299057 - DNA, 22 bp, Homo sapiens
aaatgcatgtagaataatagag

SEQ ID NO: 8299058 - DNA, 21 bp, Homo sapiens
aagcctcaagcagaagacaga

SEQ ID NO: 8299059 - DNA, 22 bp, Homo sapiens
aagccgggcctgagaaatgaca

SEQ ID NO: 8299060 - DNA, 22 bp, Homo sapiens
aaatctgtaagcaattgctcag

SEQ ID NO: 8299061 - DNA, 22 bp, Homo sapiens
aaatctggttcagtaagtcctc

SEQ ID NO: 8299062 - DNA, 22 bp, Homo sapiens
aaatctgggtcaaggtggagtg

SEQ ID NO: 8299063 - DNA, 22 bp, Homo sapiens
aaatctgggagcagctcggcca

SEQ ID NO: 8299064 - DNA, 22 bp, Homo sapiens
aaatctggccccttgcctattt

SEQ ID NO: 8299065 - DNA, 22 bp, Homo sapiens
aagcccagatgggagcatttca

SEQ ID NO: 8299066 - DNA, 22 bp, Homo sapiens
aagcaggcattccagagacaat

SEQ ID NO: 8299067 - DNA, 22 bp, Homo sapiens
aagattctacagtaggtacatt

SEQ ID NO: 8299068 - DNA, 22 bp, Homo sapiens
aagaggtaaccatagcaaccac

SEQ ID NO: 8299069 - DNA, 22 bp, Homo sapiens
aaagtttgcaatttatgttaat

SEQ ID NO: 8299070 - DNA, 22 bp, Homo sapiens
aaagttttagaactaggaagca

SEQ ID NO: 8299071 - DNA, 22 bp, Homo sapiens
aaagtttgagtgatttgacaca

SEQ ID NO: 8299072 - DNA, 22 bp, Homo sapiens
aaagtttgaatgatatattagt

SEQ ID NO: 8299073 - DNA, 22 bp, Homo sapiens
aaagtttcctgctaagtgctat

SEQ ID NO: 8299074 - DNA, 22 bp, Homo sapiens
aaagtttcaatagaggaagtgg

SEQ ID NO: 8299075 - DNA, 22 bp, Homo sapiens
aagagggctgcaatcttattgc

SEQ ID NO: 8299076 - DNA, 22 bp, Homo sapiens
aagagggaggtgcgggtgcaga

SEQ ID NO: 8299077 - DNA, 22 bp, Homo sapiens
aaagaacaaatgatatatggtt

SEQ ID NO: 8299078 - DNA, 22 bp, Homo sapiens
aaagaaatagatggcatttaaa

SEQ ID NO: 8299079 - DNA, 22 bp, Homo sapiens
aaagaacaaattagctgtttta

SEQ ID NO: 8299080 - DNA, 22 bp, Homo sapiens
aaagaacaatgtggaatctcct

SEQ ID NO: 8299081 - DNA, 22 bp, Homo sapiens
aaagaacagatgtgtggtgcat

SEQ ID NO: 8299082 - DNA, 22 bp, Homo sapiens
aaagactagcatttatatgtac

SEQ ID NO: 8299083 - DNA, 23 bp, Homo sapiens
aaagactgctgagaattttagga

SEQ ID NO: 8299084 - DNA, 22 bp, Homo sapiens
aaagactggtgtgttacatata

SEQ ID NO: 8299085 - DNA, 22 bp, Homo sapiens
aaagatcagtctgaagcaacat

SEQ ID NO: 8299086 - DNA, 22 bp, Homo sapiens
aaacattgctaaataatgctgc

SEQ ID NO: 8299087 - DNA, 22 bp, Homo sapiens
aaactgtaaacacagcagtaca

SEQ ID NO: 8299088 - DNA, 22 bp, Homo sapiens
aaactgtatatttatggcatgt

SEQ ID NO: 8299089 - DNA, 22 bp, Homo sapiens
aaactgtaagagaataaactac

SEQ ID NO: 8299090 - DNA, 22 bp, Homo sapiens
aaacagctgtcattgttttaaa

SEQ ID NO: 8299091 - DNA, 22 bp, Homo sapiens
aaaatgtgatctacaaatgcaa

SEQ ID NO: 8299092 - DNA, 17 bp, Homo sapiens
aaaattctgtaaagagg

SEQ ID NO: 8299093 - DNA, 22 bp, Homo sapiens
aaagagctaacattgccgagat

SEQ ID NO: 8299094 - DNA, 22 bp, Homo sapiens
aaagagcttcatttccatttat

SEQ ID NO: 8299095 - DNA, 22 bp, Homo sapiens
aaaatatcagcaaagggtgaca

SEQ ID NO: 8299096 - DNA, 20 bp, Homo sapiens
aaaatatgtataactcttct

SEQ ID NO: 8299097 - DNA, 21 bp, Homo sapiens
aaaatgtgagcgtgatgctta

SEQ ID NO: 8299098 - DNA, 22 bp, Homo sapiens
aaaaggtagttgccaaataagg

SEQ ID NO: 8299099 - DNA, 22 bp, Homo sapiens
aaaaggttttgagtacaaatat

SEQ ID NO: 8299100 - DNA, 22 bp, Homo sapiens
aaaagtaattgatgcaatcgta

SEQ ID NO: 8299101 - DNA, 22 bp, Homo sapiens
aaaagtaattgcaattttgtag

SEQ ID NO: 8299102 - DNA, 22 bp, Homo sapiens
aaaaggtagattctccttctat

SEQ ID NO: 8299103 - DNA, 22 bp, Homo sapiens
aaaagggactactctcagctcc

SEQ ID NO: 8299104 - DNA, 22 bp, Homo sapiens
aaaagtaattgcaattttgtag

SEQ ID NO: 8299105 - DNA, 22 bp, Homo sapiens
aaaatgtgtttatgcatttcgt

SEQ ID NO: 8299106 - DNA, 22 bp, Homo sapiens
aaaatgtgcagtttttaagctg

SEQ ID NO: 8299107 - DNA, 22 bp, Homo sapiens
aaaaaggttgatccagattagg

SEQ ID NO: 8299108 - DNA, 22 bp, Homo sapiens
aaaaactgcaattacttttgtc

SEQ ID NO: 8299109 - DNA, 22 bp, Homo sapiens
aaaaagtttcaactgccaactc

SEQ ID NO: 8299110 - DNA, 22 bp, Homo sapiens
aaaactctgcagttagtttcta

SEQ ID NO: 8299111 - DNA, 22 bp, Homo sapiens
aagtgtatatatgacttataaa

SEQ ID NO: 8299112 - DNA, 22 bp, Homo sapiens
aagtggtaggaagagagcactg

SEQ ID NO: 8299113 - DNA, 22 bp, Homo sapiens
aagtggtagacaaagataattg

SEQ ID NO: 8299114 - DNA, 22 bp, Homo sapiens
aacatcagaatatccatgttgg

SEQ ID NO: 8299115 - DNA, 22 bp, Homo sapiens
aacatctttttgtttgctgaaa

SEQ ID NO: 8299116 - DNA, 22 bp, Homo sapiens
aactagaaccacttgtatttcc

SEQ ID NO: 8299117 - DNA, 19 bp, Homo sapiens
aactagaaaggttttgaga

SEQ ID NO: 8299118 - DNA, 22 bp, Homo sapiens
aactagaaaacaagatgctgat

SEQ ID NO: 8299119 - DNA, 22 bp, Homo sapiens
aactagaacgtctagttgctgg

SEQ ID NO: 8299120 - DNA, 22 bp, Homo sapiens
aatggctgggagtgtattttgg

SEQ ID NO: 8299121 - DNA, 22 bp, Homo sapiens
aaccctggggcagctgctaggg

SEQ ID NO: 8299122 - DNA, 22 bp, Homo sapiens
aaggcagatataaagactagag

SEQ ID NO: 8299123 - DNA, 22 bp, Homo sapiens
aaggcacttaacgtgggaggat

SEQ ID NO: 8299124 - DNA, 22 bp, Homo sapiens
aaggcagcaccgcctcctgaaa

SEQ ID NO: 8299125 - DNA, 22 bp, Homo sapiens
aaggcagccctggctcagcctg

SEQ ID NO: 8299126 - DNA, 22 bp, Homo sapiens
aaggcagcagtgcacgactgat

SEQ ID NO: 8299127 - DNA, 22 bp, Homo sapiens
aaatgcattggtttctacttgt

SEQ ID NO: 8299128 - DNA, 22 bp, Homo sapiens
aaggaagacacagatgaagtga

SEQ ID NO: 8299129 - DNA, 22 bp, Homo sapiens
aacagacagaaaaatgtgatct

SEQ ID NO: 8299130 - DNA, 22 bp, Homo sapiens
aacagacaactcctgtggctca

SEQ ID NO: 8299131 - DNA, 22 bp, Homo sapiens
aacagaatgcaggggatgctgc

SEQ ID NO: 8299132 - DNA, 22 bp, Homo sapiens
aacagaattgctgctgccaatg

SEQ ID NO: 8299133 - DNA, 22 bp, Homo sapiens
aacagaatagttgatgtacagt

SEQ ID NO: 8299134 - DNA, 22 bp, Homo sapiens
aacagaaatcatttagggctct

SEQ ID NO: 8299135 - DNA, 22 bp, Homo sapiens
aacagaaaaggtaggtggcttt

SEQ ID NO: 8299136 - DNA, 22 bp, Homo sapiens
aacagaaaaggtaggtggcttt

SEQ ID NO: 8299137 - DNA, 22 bp, Homo sapiens
aacagaacccgagtgtgaatct

SEQ ID NO: 8299138 - DNA, 22 bp, Homo sapiens
aagaacagattcagcctgaact

SEQ ID NO: 8299139 - DNA, 22 bp, Homo sapiens
aagaacaactgctttaaaagca

SEQ ID NO: 8299140 - DNA, 22 bp, Homo sapiens
aagaaattaatgtgccattact

SEQ ID NO: 8299141 - DNA, 22 bp, Homo sapiens
aagaaattaaggaatgcaacga

SEQ ID NO: 8299142 - DNA, 22 bp, Homo sapiens
aagaaatgtagagcctagtaaa

SEQ ID NO: 8299143 - DNA, 20 bp, Homo sapiens
aagaaacttgaaagtacaag

SEQ ID NO: 8299144 - DNA, 22 bp, Homo sapiens
aattccctcaggggactccttt

SEQ ID NO: 8299145 - DNA, 19 bp, Homo sapiens
aattcgcctcccaggccgc

SEQ ID NO: 8299146 - DNA, 22 bp, Homo sapiens
aattcctgtcttaacagttctg

SEQ ID NO: 8299147 - DNA, 22 bp, Homo sapiens
aattctagcattgtgaaaatat

SEQ ID NO: 8299148 - DNA, 22 bp, Homo sapiens
aagaaaagaaacctgaggcttt

SEQ ID NO: 8299149 - DNA, 22 bp, Homo sapiens
aagactttctcccaaatcctca

SEQ ID NO: 8299150 - DNA, 20 bp, Homo sapiens
aagagaagaagtctttgaaa

SEQ ID NO: 8299151 - DNA, 22 bp, Homo sapiens
aagacccacaaggctgaatgtt

SEQ ID NO: 8299152 - DNA, 22 bp, Homo sapiens
aagcacaatgaacatcttagat

SEQ ID NO: 8299153 - DNA, 22 bp, Homo sapiens
aagcaatatactgatatgatta

SEQ ID NO: 8299154 - DNA, 20 bp, Homo sapiens
aagcaatatagtgcaaatgt

SEQ ID NO: 8299155 - DNA, 22 bp, Homo sapiens
aagcagaatttcccactagttg

SEQ ID NO: 8299156 - DNA, 20 bp, Homo sapiens
aagcagaagctgctctcagc

SEQ ID NO: 8299157 - DNA, 22 bp, Homo sapiens
aagcagaagttgatctaccata

SEQ ID NO: 8299158 - DNA, 22 bp, Homo sapiens
acagcagagacactcaggaggc

SEQ ID NO: 8299159 - DNA, 22 bp, Homo sapiens
aagcagcttaaattagagcctg

SEQ ID NO: 8299160 - DNA, 22 bp, Homo sapiens
aagcagcttaaattagagcctg

SEQ ID NO: 8299161 - DNA, 22 bp, Homo sapiens
aagcagcttaaattagagcctg

SEQ ID NO: 8299162 - DNA, 22 bp, Homo sapiens
acagccagggcattgtcgccga

SEQ ID NO: 8299163 - DNA, 22 bp, Homo sapiens
acagcctggactggctctctgc

SEQ ID NO: 8299164 - DNA, 22 bp, Homo sapiens
acacatgcataagccttccctt

SEQ ID NO: 8299165 - DNA, 22 bp, Homo sapiens
acacatgagaaacatcagttgt

SEQ ID NO: 8299166 - DNA, 22 bp, Homo sapiens
aagatgcagcttccacttttgc

SEQ ID NO: 8299167 - DNA, 22 bp, Homo sapiens
aagatgatagatctgtcaatgt

SEQ ID NO: 8299168 - DNA, 22 bp, Homo sapiens
aagatgataggacttgcttaag

SEQ ID NO: 8299169 - DNA, 22 bp, Homo sapiens
aagatgatgttgtgttttcact

SEQ ID NO: 8299170 - DNA, 22 bp, Homo sapiens
aagatgcttattgctcctgcag

SEQ ID NO: 8299171 - DNA, 22 bp, Homo sapiens
aagatgtatcagttaagtcttc

SEQ ID NO: 8299172 - DNA, 22 bp, Homo sapiens
aagcaataagccagatttggat

SEQ ID NO: 8299173 - DNA, 22 bp, Homo sapiens
aggccttcctcggagacaggga

SEQ ID NO: 8299174 - DNA, 22 bp, Homo sapiens
aggcctgtctggggctcagcca

SEQ ID NO: 8299175 - DNA, 22 bp, Homo sapiens
aggcctgttccaggcccctttt

SEQ ID NO: 8299176 - DNA, 22 bp, Homo sapiens
aggcctgttccttcctgggcac

SEQ ID NO: 8299177 - DNA, 22 bp, Homo sapiens
aggcctgttggcgtgggctcta

SEQ ID NO: 8299178 - DNA, 22 bp, Homo sapiens
acatttaatgatcctactgtga

SEQ ID NO: 8299179 - DNA, 22 bp, Homo sapiens
aggctatttccactcttctcat

SEQ ID NO: 8299180 - DNA, 22 bp, Homo sapiens
acatttacagtgctagacaatc

SEQ ID NO: 8299181 - DNA, 22 bp, Homo sapiens
acatttaggatgttttgagaga

SEQ ID NO: 8299182 - DNA, 19 bp, Homo sapiens
acatttagaatgtacttgc

SEQ ID NO: 8299183 - DNA, 19 bp, Homo sapiens
aggctgcaaggtggtgggc

SEQ ID NO: 8299184 - DNA, 22 bp, Homo sapiens
aggccctgttatgagccactgt

SEQ ID NO: 8299185 - DNA, 22 bp, Homo sapiens
aggccctgtccatggtgctgaa

SEQ ID NO: 8299186 - DNA, 22 bp, Homo sapiens
acatgattggactccttcccct

SEQ ID NO: 8299187 - DNA, 22 bp, Homo sapiens
acatttgtcttctttcagatta

SEQ ID NO: 8299188 - DNA, 22 bp, Homo sapiens
agggaagagcttgcaagaaacc

SEQ ID NO: 8299189 - DNA, 22 bp, Homo sapiens
agggacacatgtgattatttat

SEQ ID NO: 8299190 - DNA, 22 bp, Homo sapiens
agggacacactccagtgttatt

SEQ ID NO: 8299191 - DNA, 22 bp, Homo sapiens
agggacactgatgagaaattct

SEQ ID NO: 8299192 - DNA, 22 bp, Homo sapiens
agggacagatgaatgactgagt

SEQ ID NO: 8299193 - DNA, 22 bp, Homo sapiens
agggacagatgaatgactgagt

SEQ ID NO: 8299194 - DNA, 22 bp, Homo sapiens
agggaatgtagcaagatgccaa

SEQ ID NO: 8299195 - DNA, 21 bp, Homo sapiens
agggagctatttatagtaagc

SEQ ID NO: 8299196 - DNA, 22 bp, Homo sapiens
agggagctcagttggaagcggt

SEQ ID NO: 8299197 - DNA, 22 bp, Homo sapiens
accatcagtactggatgctgac

SEQ ID NO: 8299198 - DNA, 22 bp, Homo sapiens
accatcagtcacatgtagagaa

SEQ ID NO: 8299199 - DNA, 22 bp, Homo sapiens
accatcagagcacagtccgtgc

SEQ ID NO: 8299200 - DNA, 22 bp, Homo sapiens
accatttaataagtatttccat

SEQ ID NO: 8299201 - DNA, 20 bp, Homo sapiens
agggcagcttgaggagccgg

SEQ ID NO: 8299202 - DNA, 22 bp, Homo sapiens
acccaggagcaggctgggcagt

SEQ ID NO: 8299203 - DNA, 22 bp, Homo sapiens
agggcctgggatgtcctcctag

SEQ ID NO: 8299204 - DNA, 22 bp, Homo sapiens
acccaggcctgagagacaggag

SEQ ID NO: 8299205 - DNA, 22 bp, Homo sapiens
agggcctggtgacctgggtcct

SEQ ID NO: 8299206 - DNA, 22 bp, Homo sapiens
agggcctggggtagcttactgc

SEQ ID NO: 8299207 - DNA, 22 bp, Homo sapiens
agggcctggggtagcttactgc

SEQ ID NO: 8299208 - DNA, 22 bp, Homo sapiens
aggcagcatgctctgcttctac

SEQ ID NO: 8299209 - DNA, 23 bp, Homo sapiens
acagttatagctgtgaataacat

SEQ ID NO: 8299210 - DNA, 22 bp, Homo sapiens
acaggtggcttattggctgatt

SEQ ID NO: 8299211 - DNA, 22 bp, Homo sapiens
acaggtggccccgagggagtgg

SEQ ID NO: 8299212 - DNA, 22 bp, Homo sapiens
acaggtggtaaaatggactgtc

SEQ ID NO: 8299213 - DNA, 22 bp, Homo sapiens
acaggtggggaggctgaggttc

SEQ ID NO: 8299214 - DNA, 22 bp, Homo sapiens
acaggtgggcttaagagtcggc

SEQ ID NO: 8299215 - DNA, 21 bp, Homo sapiens
aggagctgtgttagctggtcg

SEQ ID NO: 8299216 - DNA, 22 bp, Homo sapiens
aggagctgttttgttcagcaaa

SEQ ID NO: 8299217 - DNA, 22 bp, Homo sapiens
aggagctggagtccaggcaagt

SEQ ID NO: 8299218 - DNA, 22 bp, Homo sapiens
acagggcaacctctgggagact

SEQ ID NO: 8299219 - DNA, 22 bp, Homo sapiens
acagggcacctgaggtaggaag

SEQ ID NO: 8299220 - DNA, 22 bp, Homo sapiens
acaggtggcataggcagtttga

SEQ ID NO: 8299221 - DNA, 22 bp, Homo sapiens
acaggtggagtggttagcaggc

SEQ ID NO: 8299222 - DNA, 22 bp, Homo sapiens
acaggtggaggctttaggaggt

SEQ ID NO: 8299223 - DNA, 22 bp, Homo sapiens
acagtaattaaaatggatctgc

SEQ ID NO: 8299224 - DNA, 22 bp, Homo sapiens
acagtaataagtgttggtgagg

SEQ ID NO: 8299225 - DNA, 22 bp, Homo sapiens
acagtaatattgatgctcgtca

SEQ ID NO: 8299226 - DNA, 22 bp, Homo sapiens
acagtaatgattctgagtctct

SEQ ID NO: 8299227 - DNA, 23 bp, Homo sapiens
aggaggaaaagttatctgctgag

SEQ ID NO: 8299228 - DNA, 22 bp, Homo sapiens
aggagtgcaaatagtccagaga

SEQ ID NO: 8299229 - DNA, 22 bp, Homo sapiens
aggagtggaattactgggttct

SEQ ID NO: 8299230 - DNA, 22 bp, Homo sapiens
aggagtcattgagaggggtcct

SEQ ID NO: 8299231 - DNA, 17 bp, Homo sapiens
aggagtctcagatgagc

SEQ ID NO: 8299232 - DNA, 22 bp, Homo sapiens
aggagggtgatccgggctggtc

SEQ ID NO: 8299233 - DNA, 22 bp, Homo sapiens
aggagtcagatatgggaaagtt

SEQ ID NO: 8299234 - DNA, 22 bp, Homo sapiens
aggagtcactcagggcttcatc

SEQ ID NO: 8299235 - DNA, 22 bp, Homo sapiens
aggagtcaggaccaaatggaaa

SEQ ID NO: 8299236 - DNA, 22 bp, Homo sapiens
aggagtcataaatgtgaacaaa

SEQ ID NO: 8299237 - DNA, 17 bp, Homo sapiens
agctgccagggagtgtg

SEQ ID NO: 8299238 - DNA, 17 bp, Homo sapiens
agctgccagggagtgtg

SEQ ID NO: 8299239 - DNA, 22 bp, Homo sapiens
agctgccagggactgggcatgg

SEQ ID NO: 8299240 - DNA, 22 bp, Homo sapiens
agctgccaggcccctgagaacc

SEQ ID NO: 8299241 - DNA, 22 bp, Homo sapiens
agctgccatccgaggtgtcaga

SEQ ID NO: 8299242 - DNA, 22 bp, Homo sapiens
agctgccatcctgttcagcacc

SEQ ID NO: 8299243 - DNA, 22 bp, Homo sapiens
agctgccatcagcctttggatg

SEQ ID NO: 8299244 - DNA, 22 bp, Homo sapiens
agctgccatctgaagaactgca

SEQ ID NO: 8299245 - DNA, 22 bp, Homo sapiens
agctgcaggcccatgctcagtc

SEQ ID NO: 8299246 - DNA, 22 bp, Homo sapiens
agctgccagcatcccggaaggg

SEQ ID NO: 8299247 - DNA, 21 bp, Homo sapiens
acagcagacaggcttaggacc

SEQ ID NO: 8299248 - DNA, 22 bp, Homo sapiens
acagcctgctgcctgcttcttg

SEQ ID NO: 8299249 - DNA, 22 bp, Homo sapiens
acagcctgctgcctgcttcttg

SEQ ID NO: 8299250 - DNA, 22 bp, Homo sapiens
agctgctatgacaacaccagcc

SEQ ID NO: 8299251 - DNA, 22 bp, Homo sapiens
agctgcctgggcttgtacacct

SEQ ID NO: 8299252 - DNA, 22 bp, Homo sapiens
agctgcctgtcctaggccatca

SEQ ID NO: 8299253 - DNA, 22 bp, Homo sapiens
agctggggctgcagagaacagg

SEQ ID NO: 8299254 - DNA, 23 bp, Homo sapiens
acagctgcacctggccgcctggc

SEQ ID NO: 8299255 - DNA, 22 bp, Homo sapiens
agctttatgggagcttagataa

SEQ ID NO: 8299256 - DNA, 22 bp, Homo sapiens
acaggctctggggcaggatggc

SEQ ID NO: 8299257 - DNA, 22 bp, Homo sapiens
acaggctgcctaccaagtatca

SEQ ID NO: 8299258 - DNA, 22 bp, Homo sapiens
acaggctgcccgctccccacct

SEQ ID NO: 8299259 - DNA, 22 bp, Homo sapiens
acaggctgctgagccatttgct

SEQ ID NO: 8299260 - DNA, 22 bp, Homo sapiens
acaggctgctgggctccgtgct

SEQ ID NO: 8299261 - DNA, 22 bp, Homo sapiens
agctttatatttaatgaattct

SEQ ID NO: 8299262 - DNA, 22 bp, Homo sapiens
acaggcctgacacacagagggc

SEQ ID NO: 8299263 - DNA, 18 bp, Homo sapiens
acaggcctcagtcctgca

SEQ ID NO: 8299264 - DNA, 22 bp, Homo sapiens
acagctgtggggactcttgccc

SEQ ID NO: 8299265 - DNA, 22 bp, Homo sapiens
agctgggtcttgggccaggaga

SEQ ID NO: 8299266 - DNA, 22 bp, Homo sapiens
acagctgtgaaaatccacagga

SEQ ID NO: 8299267 - DNA, 22 bp, Homo sapiens
acagctgtggccacttgcatcc

SEQ ID NO: 8299268 - DNA, 22 bp, Homo sapiens
actgtcttccaggtctggaggt

SEQ ID NO: 8299269 - DNA, 22 bp, Homo sapiens
actgtctgtcctgctctccgtg

SEQ ID NO: 8299270 - DNA, 22 bp, Homo sapiens
actgtctgctggcccctggtta

SEQ ID NO: 8299271 - DNA, 18 bp, Homo sapiens
actgtggtttatgtgtag

SEQ ID NO: 8299272 - DNA, 22 bp, Homo sapiens
agtttatgaaacacagatttga

SEQ ID NO: 8299273 - DNA, 22 bp, Homo sapiens
agtttatagcccagattcatgg

SEQ ID NO: 8299274 - DNA, 22 bp, Homo sapiens
agtttagagttcaaattagttc

SEQ ID NO: 8299275 - DNA, 22 bp, Homo sapiens
actggcagtttgagaatgcatt

SEQ ID NO: 8299276 - DNA, 22 bp, Homo sapiens
actggcagtggcagcagaaaga

SEQ ID NO: 8299277 - DNA, 22 bp, Homo sapiens
actggcagctgtaggatgcatg

SEQ ID NO: 8299278 - DNA, 22 bp, Homo sapiens
acttggagagcattgctgggga

SEQ ID NO: 8299279 - DNA, 22 bp, Homo sapiens
acttcattgtaatattatagca

SEQ ID NO: 8299280 - DNA, 22 bp, Homo sapiens
acttgattttgaacctttctac

SEQ ID NO: 8299281 - DNA, 22 bp, Homo sapiens
actgtgtggaaatttgtgaggg

SEQ ID NO: 8299282 - DNA, 22 bp, Homo sapiens
actgtgtgccctgacgccaggg

SEQ ID NO: 8299283 - DNA, 22 bp, Homo sapiens
actgtgtgaaacatcaatgtgt

SEQ ID NO: 8299284 - DNA, 22 bp, Homo sapiens
actgtgtcctatttccttgaca

SEQ ID NO: 8299285 - DNA, 22 bp, Homo sapiens
actgtgtcctcatgtggcagaa

SEQ ID NO: 8299286 - DNA, 22 bp, Homo sapiens
actgtgtgtttgtctagcacag

SEQ ID NO: 8299287 - DNA, 22 bp, Homo sapiens
actgtgtgggccgctcactggg

SEQ ID NO: 8299288 - DNA, 22 bp, Homo sapiens
actgtgtggaccactctgaggc

SEQ ID NO: 8299289 - DNA, 22 bp, Homo sapiens
atcacgtcatggtttgatctgg

SEQ ID NO: 8299290 - DNA, 22 bp, Homo sapiens
agaaacatttagattatatgtc

SEQ ID NO: 8299291 - DNA, 22 bp, Homo sapiens
atcagcaagtcctgttaattct

SEQ ID NO: 8299292 - DNA, 19 bp, Homo sapiens
atcagcaaggtaggatgtg

SEQ ID NO: 8299293 - DNA, 22 bp, Homo sapiens
atcagcaaggcaatcactgcag

SEQ ID NO: 8299294 - DNA, 22 bp, Homo sapiens
atcagcaagcatttattgagtg

SEQ ID NO: 8299295 - DNA, 22 bp, Homo sapiens
atcagcaagattgtgtcttgta

SEQ ID NO: 8299296 - DNA, 22 bp, Homo sapiens
atcagcaagcatggttaggtgt

SEQ ID NO: 8299297 - DNA, 22 bp, Homo sapiens
atcagcaagatgtaatttctat

SEQ ID NO: 8299298 - DNA, 22 bp, Homo sapiens
atcagcaagactaggggaatac

SEQ ID NO: 8299299 - DNA, 20 bp, Homo sapiens
atcagcaactgccactcagt

SEQ ID NO: 8299300 - DNA, 21 bp, Homo sapiens
atcagcaaatgcctgtctccc

SEQ ID NO: 8299301 - DNA, 22 bp, Homo sapiens
atcagcaaaaatgccttcagaa

SEQ ID NO: 8299302 - DNA, 22 bp, Homo sapiens
atatctttgtatggttcagcag

SEQ ID NO: 8299303 - DNA, 22 bp, Homo sapiens
atatctttgtttttgccaagat

SEQ ID NO: 8299304 - DNA, 22 bp, Homo sapiens
atatcttttagagcaagcttgt

SEQ ID NO: 8299305 - DNA, 22 bp, Homo sapiens
actttgtataagacaataaaga

SEQ ID NO: 8299306 - DNA, 22 bp, Homo sapiens
actttgtataagacaataaaga

SEQ ID NO: 8299307 - DNA, 22 bp, Homo sapiens
actgaaggtctcagcaaggatg

SEQ ID NO: 8299308 - DNA, 22 bp, Homo sapiens
actgcaaagggaagccctttct

SEQ ID NO: 8299309 - DNA, 22 bp, Homo sapiens
actggacagaggaaatatggag

SEQ ID NO: 8299310 - DNA, 22 bp, Homo sapiens
actggcagaggttggacaccat

SEQ ID NO: 8299311 - DNA, 22 bp, Homo sapiens
actggcagccacaactggcagg

SEQ ID NO: 8299312 - DNA, 22 bp, Homo sapiens
actgcttacaaaaggaaagaat

SEQ ID NO: 8299313 - DNA, 22 bp, Homo sapiens
actgctttagacctagagctct

SEQ ID NO: 8299314 - DNA, 20 bp, Homo sapiens
actgcttctttctctgacct

SEQ ID NO: 8299315 - DNA, 22 bp, Homo sapiens
actgaaagataaatcagttagc

SEQ ID NO: 8299316 - DNA, 22 bp, Homo sapiens
actgaaatactgctcttggatt

SEQ ID NO: 8299317 - DNA, 22 bp, Homo sapiens
actgaaggaaacttttgtgttt

SEQ ID NO: 8299318 - DNA, 22 bp, Homo sapiens
actgaaggaaagcctttgcatg

SEQ ID NO: 8299319 - DNA, 22 bp, Homo sapiens
actgaaggaagcgggcaggggt

SEQ ID NO: 8299320 - DNA, 22 bp, Homo sapiens
actgaagggtaatgtgggagcc

SEQ ID NO: 8299321 - DNA, 22 bp, Homo sapiens
actgaaggcttaactctttcat

SEQ ID NO: 8299322 - DNA, 22 bp, Homo sapiens
actgaaggctttcccaaggtca

SEQ ID NO: 8299323 - DNA, 22 bp, Homo sapiens
agtctctgtgagctcccaatgg

SEQ ID NO: 8299324 - DNA, 20 bp, Homo sapiens
agtctctgtagtgcctgaga

SEQ ID NO: 8299325 - DNA, 20 bp, Homo sapiens
agtctctgtagtgcctgaga

SEQ ID NO: 8299326 - DNA, 22 bp, Homo sapiens
agtctctgccagcttgtcctct

SEQ ID NO: 8299327 - DNA, 22 bp, Homo sapiens
agtctctgctggttgtgcctat

SEQ ID NO: 8299328 - DNA, 22 bp, Homo sapiens
agtctctgctggttgtgcctat

SEQ ID NO: 8299329 - DNA, 22 bp, Homo sapiens
agtctctgcatgcctgctgtgc

SEQ ID NO: 8299330 - DNA, 22 bp, Homo sapiens
agtctctgcatgatgcagcaca

SEQ ID NO: 8299331 - DNA, 22 bp, Homo sapiens
agtctctgcacagtaagaagca

SEQ ID NO: 8299332 - DNA, 22 bp, Homo sapiens
actccagggctccatcccttgt

SEQ ID NO: 8299333 - DNA, 22 bp, Homo sapiens
agtctctgaggttcagatgcct

SEQ ID NO: 8299334 - DNA, 22 bp, Homo sapiens
agggctggtatgtccatgaaag

SEQ ID NO: 8299335 - DNA, 22 bp, Homo sapiens
agggctggtatgtccatgaaag

SEQ ID NO: 8299336 - DNA, 22 bp, Homo sapiens
agggtgcctggaagccactcac

SEQ ID NO: 8299337 - DNA, 22 bp, Homo sapiens
agggtgcctgctgcaggttcag

SEQ ID NO: 8299338 - DNA, 20 bp, Homo sapiens
agggtggggacgttctgact

SEQ ID NO: 8299339 - DNA, 22 bp, Homo sapiens
agggtgggctagactcttcccc

SEQ ID NO: 8299340 - DNA, 22 bp, Homo sapiens
agggtggggtgctacatcttta

SEQ ID NO: 8299341 - DNA, 22 bp, Homo sapiens
agggtggggtgctacatcttta

SEQ ID NO: 8299342 - DNA, 18 bp, Homo sapiens
acctccccattttctgaa

SEQ ID NO: 8299343 - DNA, 22 bp, Homo sapiens
acctgtgcacagtcagccctgg

SEQ ID NO: 8299344 - DNA, 22 bp, Homo sapiens
aggtagagctccagtagaaaat

SEQ ID NO: 8299345 - DNA, 22 bp, Homo sapiens
aggtacagtagacagacagtta

SEQ ID NO: 8299346 - DNA, 23 bp, Homo sapiens
acctgctccatgtcaccttcact

SEQ ID NO: 8299347 - DNA, 22 bp, Homo sapiens
acctgccttctcaaggacatga

SEQ ID NO: 8299348 - DNA, 22 bp, Homo sapiens
acctgccttctcaaggacatga

SEQ ID NO: 8299349 - DNA, 22 bp, Homo sapiens
accttaaaactgacacatggag

SEQ ID NO: 8299350 - DNA, 22 bp, Homo sapiens
acgttttcagtgactgtgcttc

SEQ ID NO: 8299351 - DNA, 22 bp, Homo sapiens
acgttttctagagaatatgcag

SEQ ID NO: 8299352 - DNA, 22 bp, Homo sapiens
acgttttcagccttaatgtaga

SEQ ID NO: 8299353 - DNA, 22 bp, Homo sapiens
acgtgttcaatttccatctgac

SEQ ID NO: 8299354 - DNA, 22 bp, Homo sapiens
actcaagatagggaaagtacaa

SEQ ID NO: 8299355 - DNA, 19 bp, Homo sapiens
actcaagtctaatgaaatc

SEQ ID NO: 8299356 - DNA, 23 bp, Homo sapiens
actcacaaagcaggatcatgttg

SEQ ID NO: 8299357 - DNA, 22 bp, Homo sapiens
caaatgcagtccctttgttgct

SEQ ID NO: 8299358 - DNA, 22 bp, Homo sapiens
caaatgcaaaatataaccctgt

SEQ ID NO: 8299359 - DNA, 22 bp, Homo sapiens
agcagaagaaagccacatgact

SEQ ID NO: 8299360 - DNA, 17 bp, Homo sapiens
agcagaagtcagaggga

SEQ ID NO: 8299361 - DNA, 22 bp, Homo sapiens
attttctggttgaggtttaaca

SEQ ID NO: 8299362 - DNA, 23 bp, Homo sapiens
agcacagactagaaaggtctttc

SEQ ID NO: 8299363 - DNA, 22 bp, Homo sapiens
agcacagagttgcagagagcgt

SEQ ID NO: 8299364 - DNA, 22 bp, Homo sapiens
agcacagattctgaagagtcct

SEQ ID NO: 8299365 - DNA, 22 bp, Homo sapiens
caaggcaggcagttcacttgag

SEQ ID NO: 8299366 - DNA, 21 bp, Homo sapiens
agcagagtgctttgactttgt

SEQ ID NO: 8299367 - DNA, 18 bp, Homo sapiens
agcagaattctagggttc

SEQ ID NO: 8299368 - DNA, 22 bp, Homo sapiens
agcagacaacccagatgaccca

SEQ ID NO: 8299369 - DNA, 22 bp, Homo sapiens
agcagcattctctggtatgggg

SEQ ID NO: 8299370 - DNA, 22 bp, Homo sapiens
agcagcatgttgggatgtgaaa

SEQ ID NO: 8299371 - DNA, 22 bp, Homo sapiens
agcagcatgatgacagagtctc

SEQ ID NO: 8299372 - DNA, 22 bp, Homo sapiens
agcagcatagaagctgggagga

SEQ ID NO: 8299373 - DNA, 22 bp, Homo sapiens
caaggcaggcagttcacttgag

SEQ ID NO: 8299374 - DNA, 22 bp, Homo sapiens
cactctgcgctgggcgccagcg

SEQ ID NO: 8299375 - DNA, 22 bp, Homo sapiens
cactctgcagctgaagggctgg

SEQ ID NO: 8299376 - DNA, 22 bp, Homo sapiens
agcaggtgcatggcgagcgcgg

SEQ ID NO: 8299377 - DNA, 22 bp, Homo sapiens
caccagggacaatgctaggggt

SEQ ID NO: 8299378 - DNA, 22 bp, Homo sapiens
caccagggctctgagctctgaa

SEQ ID NO: 8299379 - DNA, 22 bp, Homo sapiens
agcagtggctgaagatgttcct

SEQ ID NO: 8299380 - DNA, 22 bp, Homo sapiens
agcagtggcctggggctctgtg

SEQ ID NO: 8299381 - DNA, 22 bp, Homo sapiens
cacatccttcagctgagcccag

SEQ ID NO: 8299382 - DNA, 22 bp, Homo sapiens
agcagggcctctggcactggtc

SEQ ID NO: 8299383 - DNA, 22 bp, Homo sapiens
agcagggcagtgcttcagctct

SEQ ID NO: 8299384 - DNA, 16 bp, Homo sapiens
agcagggcgggaagga

SEQ ID NO: 8299385 - DNA, 22 bp, Homo sapiens
agcagctgtactttcatctgtt

SEQ ID NO: 8299386 - DNA, 22 bp, Homo sapiens
agcagctgtactttcatctgtt

SEQ ID NO: 8299387 - DNA, 22 bp, Homo sapiens
agcagctgtactttcatctgtt

SEQ ID NO: 8299388 - DNA, 18 bp, Homo sapiens
agcagctgtcagaatgcc

SEQ ID NO: 8299389 - DNA, 22 bp, Homo sapiens
agcagctgtcccttaacatcag

SEQ ID NO: 8299390 - DNA, 22 bp, Homo sapiens
agcagctgtggaaaagtaacta

SEQ ID NO: 8299391 - DNA, 22 bp, Homo sapiens
agcagctgtggaaaagtaacta

SEQ ID NO: 8299392 - DNA, 18 bp, Homo sapiens
agcagctgtgccacactg

SEQ ID NO: 8299393 - DNA, 22 bp, Homo sapiens
agcagcttacatgtggcctatc

SEQ ID NO: 8299394 - DNA, 20 bp, Homo sapiens
agcagctgtgttttcatcct

SEQ ID NO: 8299395 - DNA, 20 bp, Homo sapiens
agcagctgtgttttcatcct

SEQ ID NO: 8299396 - DNA, 22 bp, Homo sapiens
cacaggagctgtggggcagtgt

SEQ ID NO: 8299397 - DNA, 22 bp, Homo sapiens
agcagcttctttcactcctgga

SEQ ID NO: 8299398 - DNA, 22 bp, Homo sapiens
cacagggccttgtgtgactgca

SEQ ID NO: 8299399 - DNA, 22 bp, Homo sapiens
cacagggccactttcccagtaa

SEQ ID NO: 8299400 - DNA, 22 bp, Homo sapiens
cacagggcagtgctgcccactc

SEQ ID NO: 8299401 - DNA, 22 bp, Homo sapiens
cacagggcctggggcagctgct

SEQ ID NO: 8299402 - DNA, 22 bp, Homo sapiens
cacagggcagtgattgtccaca

SEQ ID NO: 8299403 - DNA, 19 bp, Homo sapiens
cacagggcaggtctcatgt

SEQ ID NO: 8299404 - DNA, 22 bp, Homo sapiens
cacagggctttgatggctgagt

SEQ ID NO: 8299405 - DNA, 22 bp, Homo sapiens
cacagggcttctcatggggtgc

SEQ ID NO: 8299406 - DNA, 22 bp, Homo sapiens
cacagggctaaatgaagggttg

SEQ ID NO: 8299407 - DNA, 22 bp, Homo sapiens
agcaggagagcagtgcgtggtc

SEQ ID NO: 8299408 - DNA, 22 bp, Homo sapiens
cacaggaggaggtgcccgggcc

SEQ ID NO: 8299409 - DNA, 22 bp, Homo sapiens
cacaggaggaggccagagcgta

SEQ ID NO: 8299410 - DNA, 22 bp, Homo sapiens
agccctccatctgtgctcaggc

SEQ ID NO: 8299411 - DNA, 22 bp, Homo sapiens
agccctcctcacatcagcgtcc

SEQ ID NO: 8299412 - DNA, 22 bp, Homo sapiens
cagaggctaagatgagtgggtg

SEQ ID NO: 8299413 - DNA, 22 bp, Homo sapiens
cagaggctcaccagcctttcac

SEQ ID NO: 8299414 - DNA, 22 bp, Homo sapiens
agccttcataatcttgggcttt

SEQ ID NO: 8299415 - DNA, 22 bp, Homo sapiens
agccttcagcagttcaggtgcc

SEQ ID NO: 8299416 - DNA, 23 bp, Homo sapiens
agccttcaggcaatgtcagtaga

SEQ ID NO: 8299417 - DNA, 22 bp, Homo sapiens
agccttcagtaaatccactgtg

SEQ ID NO: 8299418 - DNA, 22 bp, Homo sapiens
agcctgtccagaggacagggct

SEQ ID NO: 8299419 - DNA, 22 bp, Homo sapiens
cagcagaggttggaacagttct

SEQ ID NO: 8299420 - DNA, 22 bp, Homo sapiens
cagcagaggaaagcaaatctaa

SEQ ID NO: 8299421 - DNA, 22 bp, Homo sapiens
cagcagagcttatgttgggtca

SEQ ID NO: 8299422 - DNA, 22 bp, Homo sapiens
agcctccatcccatgcacaaag

SEQ ID NO: 8299423 - DNA, 22 bp, Homo sapiens
agcctccaaatgtcaggtcccg

SEQ ID NO: 8299424 - DNA, 22 bp, Homo sapiens
agcctccagtagctgaagagac

SEQ ID NO: 8299425 - DNA, 22 bp, Homo sapiens
agcctccacagatgcaaagggc

SEQ ID NO: 8299426 - DNA, 22 bp, Homo sapiens
agctcacagtgtccttcctcaa

SEQ ID NO: 8299427 - DNA, 22 bp, Homo sapiens
agctcacagaaatcctgcagga

SEQ ID NO: 8299428 - DNA, 22 bp, Homo sapiens
agctcccagcagagctggccac

SEQ ID NO: 8299429 - DNA, 22 bp, Homo sapiens
agctcccagctcctttgagaga

SEQ ID NO: 8299430 - DNA, 22 bp, Homo sapiens
agctcccagagtcctctgccca

SEQ ID NO: 8299431 - DNA, 22 bp, Homo sapiens
agctcccagggctgggcaagtt

SEQ ID NO: 8299432 - DNA, 22 bp, Homo sapiens
agctcccaggcagtcatgagga

SEQ ID NO: 8299433 - DNA, 22 bp, Homo sapiens
agctcccaggcagtcatgagga

SEQ ID NO: 8299434 - DNA, 22 bp, Homo sapiens
agctcccagtctcctctccatg

SEQ ID NO: 8299435 - DNA, 22 bp, Homo sapiens
agctcccagggctgggcaagtt

SEQ ID NO: 8299436 - DNA, 22 bp, Homo sapiens
agctcccagtctcctctccatg

SEQ ID NO: 8299437 - DNA, 22 bp, Homo sapiens
agctcccattatcttctgaaac

SEQ ID NO: 8299438 - DNA, 22 bp, Homo sapiens
agctccctgagatgccacagca

SEQ ID NO: 8299439 - DNA, 22 bp, Homo sapiens
cagccagctgaatgtaccatga

SEQ ID NO: 8299440 - DNA, 22 bp, Homo sapiens
cagccagcctctcaaccatgca

SEQ ID NO: 8299441 - DNA, 22 bp, Homo sapiens
cagccagagaaagggcactgcc

SEQ ID NO: 8299442 - DNA, 22 bp, Homo sapiens
agctcctcctgtgccaggccag

SEQ ID NO: 8299443 - DNA, 22 bp, Homo sapiens
cagccctggccccaggtggtct

SEQ ID NO: 8299444 - DNA, 22 bp, Homo sapiens
cagccctggctagggcgagggc

SEQ ID NO: 8299445 - DNA, 22 bp, Homo sapiens
cagacagacctgcaagggcaca

SEQ ID NO: 8299446 - DNA, 17 bp, Homo sapiens
cagacagatatcctggg

SEQ ID NO: 8299447 - DNA, 22 bp, Homo sapiens
cagacagctgctttcttgctgt

SEQ ID NO: 8299448 - DNA, 22 bp, Homo sapiens
agccctcatggaacagctccta

SEQ ID NO: 8299449 - DNA, 22 bp, Homo sapiens
agccctagagctggaggtcagt

SEQ ID NO: 8299450 - DNA, 22 bp, Homo sapiens
cagagctggagggaaccctggc

SEQ ID NO: 8299451 - DNA, 22 bp, Homo sapiens
agccccttccagttctcagatc

SEQ ID NO: 8299452 - DNA, 23 bp, Homo sapiens
cagagctggctcagagctgcctg

SEQ ID NO: 8299453 - DNA, 22 bp, Homo sapiens
cagagctggagcttgaatggag

SEQ ID NO: 8299454 - DNA, 22 bp, Homo sapiens
cagagctggagaagtggattta

SEQ ID NO: 8299455 - DNA, 22 bp, Homo sapiens
agcccaggagtttgaggctgtg

SEQ ID NO: 8299456 - DNA, 22 bp, Homo sapiens
agcccaggagtttgaggctgtg

SEQ ID NO: 8299457 - DNA, 22 bp, Homo sapiens
agccacagaggttgatgtggtt

SEQ ID NO: 8299458 - DNA, 22 bp, Homo sapiens
agccacagagcaggagaccttt

SEQ ID NO: 8299459 - DNA, 22 bp, Homo sapiens
agccacagagagggagctgcaa

SEQ ID NO: 8299460 - DNA, 22 bp, Homo sapiens
agccacacctgtcctgccagct

SEQ ID NO: 8299461 - DNA, 22 bp, Homo sapiens
agccaagctgatctcctgctga

SEQ ID NO: 8299462 - DNA, 22 bp, Homo sapiens
agccacagcaacaagtgcaatt

SEQ ID NO: 8299463 - DNA, 22 bp, Homo sapiens
agccacagcatgtgtgtatgta

SEQ ID NO: 8299464 - DNA, 22 bp, Homo sapiens
agccacagcccacaggactctt

SEQ ID NO: 8299465 - DNA, 22 bp, Homo sapiens
agccacagctccttggtggaga

SEQ ID NO: 8299466 - DNA, 22 bp, Homo sapiens
agccacagcgaacctctcttcc

SEQ ID NO: 8299467 - DNA, 22 bp, Homo sapiens
cagaactgggcagggagcagag

SEQ ID NO: 8299468 - DNA, 22 bp, Homo sapiens
cagaagaaagtggggagacaag

SEQ ID NO: 8299469 - DNA, 22 bp, Homo sapiens
cagaagaatggtgtctgagctc

SEQ ID NO: 8299470 - DNA, 22 bp, Homo sapiens
cagaagcctgcctcagatgcac

SEQ ID NO: 8299471 - DNA, 22 bp, Homo sapiens
cagaagcctgcctcagatgcac

SEQ ID NO: 8299472 - DNA, 22 bp, Homo sapiens
cagaagcattgactccttgctc

SEQ ID NO: 8299473 - DNA, 22 bp, Homo sapiens
cagaagcattgactccttgctc

SEQ ID NO: 8299474 - DNA, 22 bp, Homo sapiens
cagaagcattccagcaaatagt

SEQ ID NO: 8299475 - DNA, 22 bp, Homo sapiens
agccaggattggctgagcctta

SEQ ID NO: 8299476 - DNA, 22 bp, Homo sapiens
cagacagacagccgtggccacc

SEQ ID NO: 8299477 - DNA, 22 bp, Homo sapiens
agccaggacgttgctcagctcc

SEQ ID NO: 8299478 - DNA, 22 bp, Homo sapiens
agccaggatggtctcgatcggc

SEQ ID NO: 8299479 - DNA, 22 bp, Homo sapiens
atggataagaacaaatatctga

SEQ ID NO: 8299480 - DNA, 22 bp, Homo sapiens
atggataagtcaaagagtatcc

SEQ ID NO: 8299481 - DNA, 22 bp, Homo sapiens
atggcagcaaatgtctggctgg

SEQ ID NO: 8299482 - DNA, 22 bp, Homo sapiens
atggaaagggaagcaaggaaca

SEQ ID NO: 8299483 - DNA, 22 bp, Homo sapiens
atggaaagccagtgttccatca

SEQ ID NO: 8299484 - DNA, 22 bp, Homo sapiens
atggaaagctaagccatttacc

SEQ ID NO: 8299485 - DNA, 22 bp, Homo sapiens
atggaaaggctgtggaaactta

SEQ ID NO: 8299486 - DNA, 22 bp, Homo sapiens
atgtcccagctgagagacaact

SEQ ID NO: 8299487 - DNA, 19 bp, Homo sapiens
atgtcccaccgcccctgag

SEQ ID NO: 8299488 - DNA, 22 bp, Homo sapiens
atgtcccaagatacagctagag

SEQ ID NO: 8299489 - DNA, 19 bp, Homo sapiens
atgtctgttgaatttcata

SEQ ID NO: 8299490 - DNA, 22 bp, Homo sapiens
atgtacagtggaaactaacaaa

SEQ ID NO: 8299491 - DNA, 22 bp, Homo sapiens
atgtacagtttctagactcaaa

SEQ ID NO: 8299492 - DNA, 22 bp, Homo sapiens
atgtacacatgcatgcatgtgc

SEQ ID NO: 8299493 - DNA, 22 bp, Homo sapiens
atgggtgtgaaaatggtcatct

SEQ ID NO: 8299494 - DNA, 22 bp, Homo sapiens
atggtttgtaacccaatactcc

SEQ ID NO: 8299495 - DNA, 22 bp, Homo sapiens
atggtttgtgtggcccagatga

SEQ ID NO: 8299496 - DNA, 22 bp, Homo sapiens
atgggaggaagagaagatgtct

SEQ ID NO: 8299497 - DNA, 22 bp, Homo sapiens
atgggaggaaggaggcccttga

SEQ ID NO: 8299498 - DNA, 22 bp, Homo sapiens
atgggaggatcacttgaggcca

SEQ ID NO: 8299499 - DNA, 22 bp, Homo sapiens
atgggaggatgctcgggtgctc

SEQ ID NO: 8299500 - DNA, 22 bp, Homo sapiens
atgggaggcagcagagcccagc

SEQ ID NO: 8299501 - DNA, 22 bp, Homo sapiens
atgggaggcagacactaagttc

SEQ ID NO: 8299502 - DNA, 22 bp, Homo sapiens
atgggaggcaggctcagaaccg

SEQ ID NO: 8299503 - DNA, 21 bp, Homo sapiens
atctttattacgcagagaaga

SEQ ID NO: 8299504 - DNA, 22 bp, Homo sapiens
agaaggcctaacttgggggcaa

SEQ ID NO: 8299505 - DNA, 22 bp, Homo sapiens
agaatagtggcaatgactgcac

SEQ ID NO: 8299506 - DNA, 22 bp, Homo sapiens
agaagatttaggttgacgctat

SEQ ID NO: 8299507 - DNA, 22 bp, Homo sapiens
agaatgcaagataaactttatt

SEQ ID NO: 8299508 - DNA, 22 bp, Homo sapiens
agaatgcagtttgaaataaggt

SEQ ID NO: 8299509 - DNA, 22 bp, Homo sapiens
agaatgcattttgtgtagctat

SEQ ID NO: 8299510 - DNA, 22 bp, Homo sapiens
agaatgctccagagctgaaaga

SEQ ID NO: 8299511 - DNA, 22 bp, Homo sapiens
agaatgtagtcttggagattta

SEQ ID NO: 8299512 - DNA, 19 bp, Homo sapiens
agacacacttgatatgtgt

SEQ ID NO: 8299513 - DNA, 22 bp, Homo sapiens
agaattagtcacaattatagga

SEQ ID NO: 8299514 - DNA, 22 bp, Homo sapiens
agaattctccttcagggcagga

SEQ ID NO: 8299515 - DNA, 22 bp, Homo sapiens
agaattctgacaatagaattgg

SEQ ID NO: 8299516 - DNA, 22 bp, Homo sapiens
agaattctcttccattgaaaca

SEQ ID NO: 8299517 - DNA, 20 bp, Homo sapiens
agaattcttaccctttgatg

SEQ ID NO: 8299518 - DNA, 22 bp, Homo sapiens
agaattctggagttgggaggaa

SEQ ID NO: 8299519 - DNA, 22 bp, Homo sapiens
agaattctgttcttcgggtgtg

SEQ ID NO: 8299520 - DNA, 22 bp, Homo sapiens
agatggtgtttccccaggtgga

SEQ ID NO: 8299521 - DNA, 22 bp, Homo sapiens
agatgggcgccctggactgagg

SEQ ID NO: 8299522 - DNA, 20 bp, Homo sapiens
agatggtgaaggccagggag

SEQ ID NO: 8299523 - DNA, 23 bp, Homo sapiens
agatgaaagcttcccatcacagt

SEQ ID NO: 8299524 - DNA, 22 bp, Homo sapiens
agatgaagatatctgcaggggc

SEQ ID NO: 8299525 - DNA, 22 bp, Homo sapiens
agatgaagactcaggagcaggt

SEQ ID NO: 8299526 - DNA, 22 bp, Homo sapiens
atttcattgaagttaattcttc

SEQ ID NO: 8299527 - DNA, 22 bp, Homo sapiens
agatgaaaagataagcagcaat

SEQ ID NO: 8299528 - DNA, 22 bp, Homo sapiens
agatgtagtagtgggtctttta

SEQ ID NO: 8299529 - DNA, 22 bp, Homo sapiens
agatttcacatgctgctctatt

SEQ ID NO: 8299530 - DNA, 22 bp, Homo sapiens
agatttcagatgctcggcagtt

SEQ ID NO: 8299531 - DNA, 22 bp, Homo sapiens
agatttcaggttggggcagaag

SEQ ID NO: 8299532 - DNA, 22 bp, Homo sapiens
agatttccatctttttcatgtg

SEQ ID NO: 8299533 - DNA, 22 bp, Homo sapiens
atttaaattttctgatggagag

SEQ ID NO: 8299534 - DNA, 22 bp, Homo sapiens
agaggtagaggttgcagtgagc

SEQ ID NO: 8299535 - DNA, 22 bp, Homo sapiens
attcttcatgttgaagctgtca

SEQ ID NO: 8299536 - DNA, 23 bp, Homo sapiens
attcttcattatcttctagaaaa

SEQ ID NO: 8299537 - DNA, 22 bp, Homo sapiens
agagtgggcctctgagtcccag

SEQ ID NO: 8299538 - DNA, 22 bp, Homo sapiens
agagtggggaaggtgttgagaa

SEQ ID NO: 8299539 - DNA, 22 bp, Homo sapiens
atttagaagttggagggcaaga

SEQ ID NO: 8299540 - DNA, 22 bp, Homo sapiens
atttagtgtgtattgctattat

SEQ ID NO: 8299541 - DNA, 22 bp, Homo sapiens
attcagcagttcctgcttcagt

SEQ ID NO: 8299542 - DNA, 22 bp, Homo sapiens
attcagcataatcagtagcttg

SEQ ID NO: 8299543 - DNA, 22 bp, Homo sapiens
attcacagggacaatgggagag

SEQ ID NO: 8299544 - DNA, 22 bp, Homo sapiens
attataaagaacatgtgtgtgg

SEQ ID NO: 8299545 - DNA, 22 bp, Homo sapiens
attataaagaacatgtgtgtgg

SEQ ID NO: 8299546 - DNA, 22 bp, Homo sapiens
agaggggctcatatcctgtcat

SEQ ID NO: 8299547 - DNA, 22 bp, Homo sapiens
agagggagcccagtcatagctg

SEQ ID NO: 8299548 - DNA, 22 bp, Homo sapiens
agagggatcaccctgtttctgg

SEQ ID NO: 8299549 - DNA, 22 bp, Homo sapiens
attctgtatggaaaagcactat

SEQ ID NO: 8299550 - DNA, 22 bp, Homo sapiens
attctgtatttctaataagatc

SEQ ID NO: 8299551 - DNA, 22 bp, Homo sapiens
attctggattatcagtccacca

SEQ ID NO: 8299552 - DNA, 22 bp, Homo sapiens
attagctgacctctaaggagcc

SEQ ID NO: 8299553 - DNA, 22 bp, Homo sapiens
atgtgtgccccttttactcttt

SEQ ID NO: 8299554 - DNA, 22 bp, Homo sapiens
atgttaaatggtttattattaa

SEQ ID NO: 8299555 - DNA, 22 bp, Homo sapiens
atgtttatgttgggctatattt

SEQ ID NO: 8299556 - DNA, 22 bp, Homo sapiens
atgttacacataggcataaatg

SEQ ID NO: 8299557 - DNA, 22 bp, Homo sapiens
agctgcaggcctctcctgggga

SEQ ID NO: 8299558 - DNA, 22 bp, Homo sapiens
cagcttgcagtacttgtttttg

SEQ ID NO: 8299559 - DNA, 21 bp, Homo sapiens
cagctttgtctgtcttcgggg

SEQ ID NO: 8299560 - DNA, 22 bp, Homo sapiens
agctgcagtaaagctctccagg

SEQ ID NO: 8299561 - DNA, 22 bp, Homo sapiens
agctgcagtcaagctgggccac

SEQ ID NO: 8299562 - DNA, 22 bp, Homo sapiens
cagctctcacaccctcctccca

SEQ ID NO: 8299563 - DNA, 22 bp, Homo sapiens
cagctctctaaggtcttgcttt

SEQ ID NO: 8299564 - DNA, 22 bp, Homo sapiens
cagctctgaagaaaggtgtcta

SEQ ID NO: 8299565 - DNA, 22 bp, Homo sapiens
cagctcctgcctgggcagctgt

SEQ ID NO: 8299566 - DNA, 22 bp, Homo sapiens
agctggcatactttgctaggaa

SEQ ID NO: 8299567 - DNA, 22 bp, Homo sapiens
agctggaggataactcacttct

SEQ ID NO: 8299568 - DNA, 23 bp, Homo sapiens
agctggaggctgtctactcccaa

SEQ ID NO: 8299569 - DNA, 22 bp, Homo sapiens
caggacagagcccagactgtgt

SEQ ID NO: 8299570 - DNA, 22 bp, Homo sapiens
agctgctgagagtctgccgggc

SEQ ID NO: 8299571 - DNA, 22 bp, Homo sapiens
agctgctgaatgacactgcaag

SEQ ID NO: 8299572 - DNA, 22 bp, Homo sapiens
agctgctctttgaaggacactt

SEQ ID NO: 8299573 - DNA, 22 bp, Homo sapiens
agctgctcttgggtgacttcaa

SEQ ID NO: 8299574 - DNA, 22 bp, Homo sapiens
agctgctctgataaacctactt

SEQ ID NO: 8299575 - DNA, 22 bp, Homo sapiens
agctgctcctttcctgcaggcg

SEQ ID NO: 8299576 - DNA, 22 bp, Homo sapiens
agctgctcctttcctgcaggcg

SEQ ID NO: 8299577 - DNA, 22 bp, Homo sapiens
agctgctctcactggacgcctg

SEQ ID NO: 8299578 - DNA, 21 bp, Homo sapiens
agctgctccagggagctcagg

SEQ ID NO: 8299579 - DNA, 22 bp, Homo sapiens
agctgctccctatcctttcctt

SEQ ID NO: 8299580 - DNA, 21 bp, Homo sapiens
agctgctccagggagctcagg

SEQ ID NO: 8299581 - DNA, 22 bp, Homo sapiens
caggaaaaatgccaggagtcag

SEQ ID NO: 8299582 - DNA, 21 bp, Homo sapiens
caggaaaagcggaagtctagc

SEQ ID NO: 8299583 - DNA, 22 bp, Homo sapiens
agctggcctccgggtgcctggg

SEQ ID NO: 8299584 - DNA, 22 bp, Homo sapiens
caggcctccactccacgcagac

SEQ ID NO: 8299585 - DNA, 22 bp, Homo sapiens
caggcctcaggggctcaggctg

SEQ ID NO: 8299586 - DNA, 22 bp, Homo sapiens
caggcctcagagagtggcgggg

SEQ ID NO: 8299587 - DNA, 21 bp, Homo sapiens
caggccccaggcctggggtgc

SEQ ID NO: 8299588 - DNA, 22 bp, Homo sapiens
agctgtgtagggaatcagagaa

SEQ ID NO: 8299589 - DNA, 22 bp, Homo sapiens
caggcctgggcttcggggctga

SEQ ID NO: 8299590 - DNA, 22 bp, Homo sapiens
caggcctggggctggcttccag

SEQ ID NO: 8299591 - DNA, 22 bp, Homo sapiens
caggcctggggctggcttccag

SEQ ID NO: 8299592 - DNA, 22 bp, Homo sapiens
caggcctgggttcaaatccctt

SEQ ID NO: 8299593 - DNA, 22 bp, Homo sapiens
caggcctggctgcagctcgcct

SEQ ID NO: 8299594 - DNA, 22 bp, Homo sapiens
caggcctggctgcagctcgcct

SEQ ID NO: 8299595 - DNA, 22 bp, Homo sapiens
caggcctcccggtgcacactga

SEQ ID NO: 8299596 - DNA, 22 bp, Homo sapiens
caggcctggcccccggcacacc

SEQ ID NO: 8299597 - DNA, 22 bp, Homo sapiens
agcttgcctcttaatcacctca

SEQ ID NO: 8299598 - DNA, 22 bp, Homo sapiens
agcttgagttttggatgaagtg

SEQ ID NO: 8299599 - DNA, 22 bp, Homo sapiens
agcttgagttttggatgaagtg

SEQ ID NO: 8299600 - DNA, 22 bp, Homo sapiens
agcttctgttcatcttccaggc

SEQ ID NO: 8299601 - DNA, 22 bp, Homo sapiens
agctgtgtgtttccactgagct

SEQ ID NO: 8299602 - DNA, 22 bp, Homo sapiens
agctgtgtggtgtctgacagct

SEQ ID NO: 8299603 - DNA, 22 bp, Homo sapiens
agctgttccctcactgcagtca

SEQ ID NO: 8299604 - DNA, 21 bp, Homo sapiens
agcttgtgtgtatcacagtgt

SEQ ID NO: 8299605 - DNA, 22 bp, Homo sapiens
cagggccagagagggctggctg

SEQ ID NO: 8299606 - DNA, 22 bp, Homo sapiens
cagggccactgtagatgaggag

SEQ ID NO: 8299607 - DNA, 22 bp, Homo sapiens
cagggccagccatcctgctggg

SEQ ID NO: 8299608 - DNA, 22 bp, Homo sapiens
cagggccagccgcagcatccac

SEQ ID NO: 8299609 - DNA, 22 bp, Homo sapiens
aggaaagctcccagtagggctc

SEQ ID NO: 8299610 - DNA, 22 bp, Homo sapiens
aggaagctcggagagggcaaat

SEQ ID NO: 8299611 - DNA, 18 bp, Homo sapiens
aggaagcaggaggaaggc

SEQ ID NO: 8299612 - DNA, 20 bp, Homo sapiens
aggaactggaagggaggaaa

SEQ ID NO: 8299613 - DNA, 23 bp, Homo sapiens
aggaactgaggcctagggaggta

SEQ ID NO: 8299614 - DNA, 22 bp, Homo sapiens
aggaaatgctgatgctcctgga

SEQ ID NO: 8299615 - DNA, 22 bp, Homo sapiens
aggaaaggggtaggtgtggacg

SEQ ID NO: 8299616 - DNA, 22 bp, Homo sapiens
cagggccagcgtctcgggctat

SEQ ID NO: 8299617 - DNA, 22 bp, Homo sapiens
cagggccagcgcccaggcccag

SEQ ID NO: 8299618 - DNA, 23 bp, Homo sapiens
catgccagtttgtgcaggcagat

SEQ ID NO: 8299619 - DNA, 22 bp, Homo sapiens
catgccagttttgagatgcacc

SEQ ID NO: 8299620 - DNA, 22 bp, Homo sapiens
aggaggtggcctgagcgtgccc

SEQ ID NO: 8299621 - DNA, 22 bp, Homo sapiens
catgcacttacctgaaattcaa

SEQ ID NO: 8299622 - DNA, 22 bp, Homo sapiens
catgcacagtgatatctgaaga

SEQ ID NO: 8299623 - DNA, 22 bp, Homo sapiens
aggcagccagatggcagcctgc

SEQ ID NO: 8299624 - DNA, 22 bp, Homo sapiens
catttacagtgagagtttttac

SEQ ID NO: 8299625 - DNA, 22 bp, Homo sapiens
aggcagcagccacaaggcctga

SEQ ID NO: 8299626 - DNA, 22 bp, Homo sapiens
cattatgttcagtagcttaaaa

SEQ ID NO: 8299627 - DNA, 22 bp, Homo sapiens
cattatgtgggaaaatgttctt

SEQ ID NO: 8299628 - DNA, 18 bp, Homo sapiens
cattatgtggttatagaa

SEQ ID NO: 8299629 - DNA, 22 bp, Homo sapiens
cattatctgccattgacaccat

SEQ ID NO: 8299630 - DNA, 22 bp, Homo sapiens
cattatctcttctatatgctag

SEQ ID NO: 8299631 - DNA, 22 bp, Homo sapiens
catggccttgagtgactgcact

SEQ ID NO: 8299632 - DNA, 22 bp, Homo sapiens
cattaagatttttttctactgg

SEQ ID NO: 8299633 - DNA, 22 bp, Homo sapiens
catggccctcttctggagcaat

SEQ ID NO: 8299634 - DNA, 22 bp, Homo sapiens
catggcctcaaaggactgcaga

SEQ ID NO: 8299635 - DNA, 22 bp, Homo sapiens
catggcctgcctcctcctggtg

SEQ ID NO: 8299636 - DNA, 19 bp, Homo sapiens
aggcagcacccagtccttg

SEQ ID NO: 8299637 - DNA, 18 bp, Homo sapiens
cagtcccaaaccttagga

SEQ ID NO: 8299638 - DNA, 20 bp, Homo sapiens
aggagaaattcgggacacct

SEQ ID NO: 8299639 - DNA, 22 bp, Homo sapiens
aggagaaagactggacagccaa

SEQ ID NO: 8299640 - DNA, 22 bp, Homo sapiens
aggagaagccaagttgtgagca

SEQ ID NO: 8299641 - DNA, 22 bp, Homo sapiens
aggagaagccaagttgtgagca

SEQ ID NO: 8299642 - DNA, 23 bp, Homo sapiens
aggagaagagatttccacatgca

SEQ ID NO: 8299643 - DNA, 23 bp, Homo sapiens
aggagaagagatttccacatgca

SEQ ID NO: 8299644 - DNA, 22 bp, Homo sapiens
aggagctgacttgtaaagcatt

SEQ ID NO: 8299645 - DNA, 20 bp, Homo sapiens
aggagctgaattagagggtt

SEQ ID NO: 8299646 - DNA, 22 bp, Homo sapiens
aggagctgaagtctctgcactc

SEQ ID NO: 8299647 - DNA, 22 bp, Homo sapiens
aggagctgaaacttctcatatg

SEQ ID NO: 8299648 - DNA, 22 bp, Homo sapiens
aggagctgaaacttctcatatg

SEQ ID NO: 8299649 - DNA, 22 bp, Homo sapiens
aggagctgaagtctctgcactc

SEQ ID NO: 8299650 - DNA, 22 bp, Homo sapiens
aggagctgagggagcgcccttg

SEQ ID NO: 8299651 - DNA, 22 bp, Homo sapiens
aggagctgagtcagcccgacag

SEQ ID NO: 8299652 - DNA, 18 bp, Homo sapiens
aggagcctttgcactgga

SEQ ID NO: 8299653 - DNA, 22 bp, Homo sapiens
aggagagtaccattgggccgca

SEQ ID NO: 8299654 - DNA, 22 bp, Homo sapiens
aggagagtcttgagtcactggt

SEQ ID NO: 8299655 - DNA, 22 bp, Homo sapiens
aggagagttcacactggtcaga

SEQ ID NO: 8299656 - DNA, 22 bp, Homo sapiens
aggagagagctgagctttgctg

SEQ ID NO: 8299657 - DNA, 22 bp, Homo sapiens
aggagagagaacacttgggtcc

SEQ ID NO: 8299658 - DNA, 22 bp, Homo sapiens
aggagagaatgttccaggcttg

SEQ ID NO: 8299659 - DNA, 22 bp, Homo sapiens
aggcccagtagtgctgccttta

SEQ ID NO: 8299660 - DNA, 22 bp, Homo sapiens
aggcccagttatcctacttgtt

SEQ ID NO: 8299661 - DNA, 22 bp, Homo sapiens
aggccctgaagtcggcccctca

SEQ ID NO: 8299662 - DNA, 22 bp, Homo sapiens
aggccctgggttagggcccact

SEQ ID NO: 8299663 - DNA, 22 bp, Homo sapiens
aggccagctcaccctggctcct

SEQ ID NO: 8299664 - DNA, 22 bp, Homo sapiens
aggccagctgttactagagcca

SEQ ID NO: 8299665 - DNA, 22 bp, Homo sapiens
aggccaagtagctagcattgaa

SEQ ID NO: 8299666 - DNA, 22 bp, Homo sapiens
aggcatctgagtttgcaagctt

SEQ ID NO: 8299667 - DNA, 22 bp, Homo sapiens
ccactgggcgtttctgtccaat

SEQ ID NO: 8299668 - DNA, 22 bp, Homo sapiens
aggcatgtgaccctggactcag

SEQ ID NO: 8299669 - DNA, 22 bp, Homo sapiens
aggcagtgcagagtcctcttct

SEQ ID NO: 8299670 - DNA, 22 bp, Homo sapiens
aggcagtggctgagaccagggg

SEQ ID NO: 8299671 - DNA, 22 bp, Homo sapiens
aggcagcccacaggacacagga

SEQ ID NO: 8299672 - DNA, 22 bp, Homo sapiens
ccaggccaaattcagtcagcag

SEQ ID NO: 8299673 - DNA, 22 bp, Homo sapiens
ccaggcatcacgggcatgtggc

SEQ ID NO: 8299674 - DNA, 22 bp, Homo sapiens
ccaggcatccattgcttcctct

SEQ ID NO: 8299675 - DNA, 23 bp, Homo sapiens
ccaggcagtagctattgaagtga

SEQ ID NO: 8299676 - DNA, 22 bp, Homo sapiens
aggcctcctggctccaggcctt

SEQ ID NO: 8299677 - DNA, 22 bp, Homo sapiens
aggcctcctgcagggatgagtg

SEQ ID NO: 8299678 - DNA, 17 bp, Homo sapiens
aggcctccctccaggcc

SEQ ID NO: 8299679 - DNA, 22 bp, Homo sapiens
aggcctagaggaatggccaggg

SEQ ID NO: 8299680 - DNA, 22 bp, Homo sapiens
aggcctcactctcagagcttct

SEQ ID NO: 8299681 - DNA, 22 bp, Homo sapiens
aggcctcacattgggcttcaag

SEQ ID NO: 8299682 - DNA, 22 bp, Homo sapiens
aggcctcagtgatcatcatcag

SEQ ID NO: 8299683 - DNA, 22 bp, Homo sapiens
ccaggcctagcccctgagggta

SEQ ID NO: 8299684 - DNA, 22 bp, Homo sapiens
ccaggccctgctcctcacacca

SEQ ID NO: 8299685 - DNA, 22 bp, Homo sapiens
ccaggcctagcccctgagggta

SEQ ID NO: 8299686 - DNA, 22 bp, Homo sapiens
aggctccatgcaaaggctgttt

SEQ ID NO: 8299687 - DNA, 22 bp, Homo sapiens
ccaggctctgcgctggacatgg

SEQ ID NO: 8299688 - DNA, 22 bp, Homo sapiens
aggctctgatcaggtggctgtg

SEQ ID NO: 8299689 - DNA, 19 bp, Homo sapiens
aggctctgagctcctggag

SEQ ID NO: 8299690 - DNA, 22 bp, Homo sapiens
aggctctgcagaccccagctgt

SEQ ID NO: 8299691 - DNA, 22 bp, Homo sapiens
aggctctgcagtgctggaggac

SEQ ID NO: 8299692 - DNA, 22 bp, Homo sapiens
aggctgagataggtggatcatt

SEQ ID NO: 8299693 - DNA, 22 bp, Homo sapiens
ccagtcactggaaaatgggaat

SEQ ID NO: 8299694 - DNA, 22 bp, Homo sapiens
ccagtcacaggtgtgtttatat

SEQ ID NO: 8299695 - DNA, 22 bp, Homo sapiens
ccagtgcacagccaggcaggtg

SEQ ID NO: 8299696 - DNA, 22 bp, Homo sapiens
ccagtctgtgtgccagcctgcg

SEQ ID NO: 8299697 - DNA, 22 bp, Homo sapiens
ccagttggtttcaatgggacag

SEQ ID NO: 8299698 - DNA, 22 bp, Homo sapiens
aggctgaggcaggtggatcact

SEQ ID NO: 8299699 - DNA, 22 bp, Homo sapiens
aggctgaggcaggtggatcatt

SEQ ID NO: 8299700 - DNA, 22 bp, Homo sapiens
cccagcctcagctttacttcca

SEQ ID NO: 8299701 - DNA, 22 bp, Homo sapiens
cccagcatcctcagggagcggg

SEQ ID NO: 8299702 - DNA, 22 bp, Homo sapiens
cccagcatcccagtgggcagca

SEQ ID NO: 8299703 - DNA, 22 bp, Homo sapiens
cccagcagttgttggtgcacat

SEQ ID NO: 8299704 - DNA, 22 bp, Homo sapiens
cccagcacaggcaattccatac

SEQ ID NO: 8299705 - DNA, 22 bp, Homo sapiens
ccataaggagccagacattcca

SEQ ID NO: 8299706 - DNA, 22 bp, Homo sapiens
ccataaggttgaaaactgtaca

SEQ ID NO: 8299707 - DNA, 22 bp, Homo sapiens
ccataaggtttggggccatgca

SEQ ID NO: 8299708 - DNA, 22 bp, Homo sapiens
ccagtttttccagtgctttctg

SEQ ID NO: 8299709 - DNA, 22 bp, Homo sapiens
ccatctccactgtccctgtcaa

SEQ ID NO: 8299710 - DNA, 22 bp, Homo sapiens
cccagcctctgtttgctcctct

SEQ ID NO: 8299711 - DNA, 22 bp, Homo sapiens
cccagcctctgggctcacccaa

SEQ ID NO: 8299712 - DNA, 22 bp, Homo sapiens
cccagctccttggatgggcagg

SEQ ID NO: 8299713 - DNA, 22 bp, Homo sapiens
cccagcctggtgcactgtgggg

SEQ ID NO: 8299714 - DNA, 22 bp, Homo sapiens
cccagctctctcagttctgctt

SEQ ID NO: 8299715 - DNA, 22 bp, Homo sapiens
cccagctctctgctcttagcct

SEQ ID NO: 8299716 - DNA, 22 bp, Homo sapiens
cccagctctcgcacttactagc

SEQ ID NO: 8299717 - DNA, 22 bp, Homo sapiens
cccagctctggaaggtggggga

SEQ ID NO: 8299718 - DNA, 22 bp, Homo sapiens
cccagctctgcagacctgccct

SEQ ID NO: 8299719 - DNA, 22 bp, Homo sapiens
agggagaatgaccaaggtatat

SEQ ID NO: 8299720 - DNA, 22 bp, Homo sapiens
agggagaggttgaaacctcagt

SEQ ID NO: 8299721 - DNA, 22 bp, Homo sapiens
agggaaggaaaagctgtcgctt

SEQ ID NO: 8299722 - DNA, 19 bp, Homo sapiens
agggaaggattctgtcatt

SEQ ID NO: 8299723 - DNA, 22 bp, Homo sapiens
ccccatcccacctgagtgtcac

SEQ ID NO: 8299724 - DNA, 22 bp, Homo sapiens
agggagccagagttgggagctc

SEQ ID NO: 8299725 - DNA, 22 bp, Homo sapiens
agggagcatgggtgaagcaggc

SEQ ID NO: 8299726 - DNA, 22 bp, Homo sapiens
agggcagctctcacctctggcc

SEQ ID NO: 8299727 - DNA, 22 bp, Homo sapiens
agggccagagtctgtgtagata

SEQ ID NO: 8299728 - DNA, 22 bp, Homo sapiens
agggcagctaaggtgctgactg

SEQ ID NO: 8299729 - DNA, 22 bp, Homo sapiens
agggcagctagctgtagaaaga

SEQ ID NO: 8299730 - DNA, 22 bp, Homo sapiens
agggcagcctgagtgctggccc

SEQ ID NO: 8299731 - DNA, 22 bp, Homo sapiens
agggcagcagctcctcctagct

SEQ ID NO: 8299732 - DNA, 22 bp, Homo sapiens
agggcagatggaacttccccga

SEQ ID NO: 8299733 - DNA, 22 bp, Homo sapiens
agggcagcattgcctttctcca

SEQ ID NO: 8299734 - DNA, 22 bp, Homo sapiens
agggcagccatgagccttcagg

SEQ ID NO: 8299735 - DNA, 22 bp, Homo sapiens
agggcagagggtgcctcacctg

SEQ ID NO: 8299736 - DNA, 22 bp, Homo sapiens
agggaggagaatggactccttc

SEQ ID NO: 8299737 - DNA, 22 bp, Homo sapiens
agggccaggaacacctgaaggg

SEQ ID NO: 8299738 - DNA, 22 bp, Homo sapiens
agggccagctgatgagaatgag

SEQ ID NO: 8299739 - DNA, 22 bp, Homo sapiens
ccctgggcaagccctattttcc

SEQ ID NO: 8299740 - DNA, 22 bp, Homo sapiens
ccctgggcagtctgcacttcag

SEQ ID NO: 8299741 - DNA, 22 bp, Homo sapiens
ccctggggagcaggcgaaggag

SEQ ID NO: 8299742 - DNA, 22 bp, Homo sapiens
cccttcagctgagtgggacagc

SEQ ID NO: 8299743 - DNA, 21 bp, Homo sapiens
ccctgtgttccacagcagaca

SEQ ID NO: 8299744 - DNA, 22 bp, Homo sapiens
ccctgggttctggctgggctgc

SEQ ID NO: 8299745 - DNA, 19 bp, Homo sapiens
ccctgggggtttctggtac

SEQ ID NO: 8299746 - DNA, 22 bp, Homo sapiens
ccctggggctgagggatggccg

SEQ ID NO: 8299747 - DNA, 22 bp, Homo sapiens
ccctggggctgagggatggccg

SEQ ID NO: 8299748 - DNA, 20 bp, Homo sapiens
cctcaagcagactgacagct

SEQ ID NO: 8299749 - DNA, 20 bp, Homo sapiens
cctcaagcagactgacagct

SEQ ID NO: 8299750 - DNA, 22 bp, Homo sapiens
cctcagagcctccagaaggaat

SEQ ID NO: 8299751 - DNA, 22 bp, Homo sapiens
cctcagagaaaggtatggctga

SEQ ID NO: 8299752 - DNA, 22 bp, Homo sapiens
cctccagctgcctcagtctctt

SEQ ID NO: 8299753 - DNA, 22 bp, Homo sapiens
cctccaggaacttgagagacac

SEQ ID NO: 8299754 - DNA, 21 bp, Homo sapiens
cctccaggagcagagccctga

SEQ ID NO: 8299755 - DNA, 22 bp, Homo sapiens
cctccaggctgaatatctagaa

SEQ ID NO: 8299756 - DNA, 20 bp, Homo sapiens
cctccaggcacacccatgtg

SEQ ID NO: 8299757 - DNA, 22 bp, Homo sapiens
cctccaggataagtcagggcct

SEQ ID NO: 8299758 - DNA, 22 bp, Homo sapiens
cctcccagtgcctccagagcag

SEQ ID NO: 8299759 - DNA, 22 bp, Homo sapiens
cctctccttgcacccgtcccgc

SEQ ID NO: 8299760 - DNA, 21 bp, Homo sapiens
cctctctcattgtaatgaagt

SEQ ID NO: 8299761 - DNA, 22 bp, Homo sapiens
cctctctccaagggaaatccta

SEQ ID NO: 8299762 - DNA, 22 bp, Homo sapiens
cctctctcagcttgctgcaact

SEQ ID NO: 8299763 - DNA, 22 bp, Homo sapiens
aggtgggggctgtgtccttgac

SEQ ID NO: 8299764 - DNA, 22 bp, Homo sapiens
aggtggggtgagctgcagacta

SEQ ID NO: 8299765 - DNA, 22 bp, Homo sapiens
aggtggggtgagctgcagacta

SEQ ID NO: 8299766 - DNA, 22 bp, Homo sapiens
aggtggggtgttggatgtttat

SEQ ID NO: 8299767 - DNA, 22 bp, Homo sapiens
cggagctgcctgccaagcctgc

SEQ ID NO: 8299768 - DNA, 22 bp, Homo sapiens
cggagcctgcttgttgcagctg

SEQ ID NO: 8299769 - DNA, 22 bp, Homo sapiens
agtatcaaggatctccagcacc

SEQ ID NO: 8299770 - DNA, 22 bp, Homo sapiens
ccttggccctagcctcaggcaa

SEQ ID NO: 8299771 - DNA, 22 bp, Homo sapiens
aggtggggctgggaaagattcc

SEQ ID NO: 8299772 - DNA, 22 bp, Homo sapiens
ccttggagcggtcagcactggt

SEQ ID NO: 8299773 - DNA, 19 bp, Homo sapiens
ccttggagttccaggtgga

SEQ ID NO: 8299774 - DNA, 22 bp, Homo sapiens
ccttggaggactgctgcttctt

SEQ ID NO: 8299775 - DNA, 17 bp, Homo sapiens
aggtggctgctgcgcct

SEQ ID NO: 8299776 - DNA, 21 bp, Homo sapiens
aggtgggagaccatgtaggtc

SEQ ID NO: 8299777 - DNA, 22 bp, Homo sapiens
aggtgctgccccgagaaggatg

SEQ ID NO: 8299778 - DNA, 17 bp, Homo sapiens
aggtgctggagcatcag

SEQ ID NO: 8299779 - DNA, 22 bp, Homo sapiens
aggtgctggagtctgggcagga

SEQ ID NO: 8299780 - DNA, 22 bp, Homo sapiens
aggtgccagctctcaggcagga

SEQ ID NO: 8299781 - DNA, 22 bp, Homo sapiens
aggtgccagtgctgtggtcccc

SEQ ID NO: 8299782 - DNA, 22 bp, Homo sapiens
agggtctgtggatgcatctggg

SEQ ID NO: 8299783 - DNA, 22 bp, Homo sapiens
agggtctgacaatgtgacttag

SEQ ID NO: 8299784 - DNA, 22 bp, Homo sapiens
agggtctgactcctctggcaag

SEQ ID NO: 8299785 - DNA, 20 bp, Homo sapiens
agggtcagtagcacagagct

SEQ ID NO: 8299786 - DNA, 22 bp, Homo sapiens
agggtcaggagacactggcaac

SEQ ID NO: 8299787 - DNA, 22 bp, Homo sapiens
cctgccctagagatgacacaat

SEQ ID NO: 8299788 - DNA, 22 bp, Homo sapiens
cctgccaggacattgcttgaag

SEQ ID NO: 8299789 - DNA, 19 bp, Homo sapiens
cctctgccagcccgcctct

SEQ ID NO: 8299790 - DNA, 22 bp, Homo sapiens
cctctctccaattttcacctca

SEQ ID NO: 8299791 - DNA, 22 bp, Homo sapiens
cctctctccttcctttgccaaa

SEQ ID NO: 8299792 - DNA, 23 bp, Homo sapiens
cctctctccctgtttggcaaata

SEQ ID NO: 8299793 - DNA, 22 bp, Homo sapiens
cctctctctcctgcacacacac

SEQ ID NO: 8299794 - DNA, 22 bp, Homo sapiens
cctctctctgcatctggagggc

SEQ ID NO: 8299795 - DNA, 22 bp, Homo sapiens
cctctctctcctgcacacacac

SEQ ID NO: 8299796 - DNA, 22 bp, Homo sapiens
cctctctcttgtagtccctgcc

SEQ ID NO: 8299797 - DNA, 22 bp, Homo sapiens
cctctgccacctcccacgaggc

SEQ ID NO: 8299798 - DNA, 22 bp, Homo sapiens
cctctgcagcagagagccagag

SEQ ID NO: 8299799 - DNA, 22 bp, Homo sapiens
cctctgcaccatagccttcagc

SEQ ID NO: 8299800 - DNA, 22 bp, Homo sapiens
cctggcagcgtgccgagctgcg

SEQ ID NO: 8299801 - DNA, 22 bp, Homo sapiens
cctggcagcgccgaagctggcc

SEQ ID NO: 8299802 - DNA, 22 bp, Homo sapiens
cctggaaggcaggcatggattg

SEQ ID NO: 8299803 - DNA, 22 bp, Homo sapiens
cctggaaggtgatggtacagca

SEQ ID NO: 8299804 - DNA, 22 bp, Homo sapiens
cctggaagattcaccactacca

SEQ ID NO: 8299805 - DNA, 20 bp, Homo sapiens
cctggaagagctccccaggc

SEQ ID NO: 8299806 - DNA, 22 bp, Homo sapiens
cctggaagttggaggttgcagt

SEQ ID NO: 8299807 - DNA, 19 bp, Homo sapiens
cctgctgcccaccctctgc

SEQ ID NO: 8299808 - DNA, 22 bp, Homo sapiens
cctgctctccatacactttcta

SEQ ID NO: 8299809 - DNA, 22 bp, Homo sapiens
cctgcctggcttccagaagaga

SEQ ID NO: 8299810 - DNA, 22 bp, Homo sapiens
cctgcctggcttccagaagaga

SEQ ID NO: 8299811 - DNA, 22 bp, Homo sapiens
cctgctctggtttagtcagtct

SEQ ID NO: 8299812 - DNA, 22 bp, Homo sapiens
cctggctgggcctgatttctca

SEQ ID NO: 8299813 - DNA, 22 bp, Homo sapiens
cctggctggggtagaagtgagg

SEQ ID NO: 8299814 - DNA, 22 bp, Homo sapiens
cctggctggcaagatcgtgaag

SEQ ID NO: 8299815 - DNA, 23 bp, Homo sapiens
cctggctggattctctgcattca

SEQ ID NO: 8299816 - DNA, 22 bp, Homo sapiens
cctggctggtggcagcgacaag

SEQ ID NO: 8299817 - DNA, 22 bp, Homo sapiens
cctggctcttcagaggttccta

SEQ ID NO: 8299818 - DNA, 22 bp, Homo sapiens
cctggctgctttcactatggag

SEQ ID NO: 8299819 - DNA, 22 bp, Homo sapiens
cctggccactcaggtgtggggc

SEQ ID NO: 8299820 - DNA, 22 bp, Homo sapiens
cctggcagctcctccccggcgg

SEQ ID NO: 8299821 - DNA, 22 bp, Homo sapiens
cctggcagctaagtgctttgag

SEQ ID NO: 8299822 - DNA, 22 bp, Homo sapiens
cctggcagctgtttggcttggc

SEQ ID NO: 8299823 - DNA, 22 bp, Homo sapiens
ctctcccagtcaggctcaggat

SEQ ID NO: 8299824 - DNA, 20 bp, Homo sapiens
ctctcccagcacagcttcct

SEQ ID NO: 8299825 - DNA, 20 bp, Homo sapiens
ctctccttgccgacttggca

SEQ ID NO: 8299826 - DNA, 17 bp, Homo sapiens
ctctccttcctctgagg

SEQ ID NO: 8299827 - DNA, 22 bp, Homo sapiens
ctctccttgcagatggctgcct

SEQ ID NO: 8299828 - DNA, 22 bp, Homo sapiens
ctctcgccagcggggctgcgct

SEQ ID NO: 8299829 - DNA, 22 bp, Homo sapiens
ctcctgagtagtagcattgtca

SEQ ID NO: 8299830 - DNA, 22 bp, Homo sapiens
ctccttggtgtagtactgagca

SEQ ID NO: 8299831 - DNA, 22 bp, Homo sapiens
ctcgcctgcctgtgtctctccc

SEQ ID NO: 8299832 - DNA, 22 bp, Homo sapiens
ctctgtagaaagagcccaggtg

SEQ ID NO: 8299833 - DNA, 22 bp, Homo sapiens
ctctgtagaaacagggcagaag

SEQ ID NO: 8299834 - DNA, 22 bp, Homo sapiens
ctctggaccctcctgctgagag

SEQ ID NO: 8299835 - DNA, 22 bp, Homo sapiens
ctctggaccctcctgctgagag

SEQ ID NO: 8299836 - DNA, 22 bp, Homo sapiens
ctctggacactggcatggggtc

SEQ ID NO: 8299837 - DNA, 22 bp, Homo sapiens
ctctggacagcaggtgctgtgg

SEQ ID NO: 8299838 - DNA, 22 bp, Homo sapiens
ctctggagcaccgggctatcca

SEQ ID NO: 8299839 - DNA, 22 bp, Homo sapiens
ctctggagaactccttgtgtct

SEQ ID NO: 8299840 - DNA, 18 bp, Homo sapiens
agtggtctgttatatcat

SEQ ID NO: 8299841 - DNA, 22 bp, Homo sapiens
ctctgtccttgcacagttccta

SEQ ID NO: 8299842 - DNA, 22 bp, Homo sapiens
ctctgtccacaggtttgtccct

SEQ ID NO: 8299843 - DNA, 22 bp, Homo sapiens
ctctgtcccagacccacctctc

SEQ ID NO: 8299844 - DNA, 22 bp, Homo sapiens
ctctgtcctatgcttgatagaa

SEQ ID NO: 8299845 - DNA, 22 bp, Homo sapiens
agtggtgctgcgcgcggagctc

SEQ ID NO: 8299846 - DNA, 22 bp, Homo sapiens
ctcttgggagtgctctggagaa

SEQ ID NO: 8299847 - DNA, 22 bp, Homo sapiens
ctcttgaagcaggggccagttc

SEQ ID NO: 8299848 - DNA, 22 bp, Homo sapiens
ctcagagaaaaggagcaagggt

SEQ ID NO: 8299849 - DNA, 17 bp, Homo sapiens
ctcagagttgctttgtc

SEQ ID NO: 8299850 - DNA, 22 bp, Homo sapiens
ctcagagttctcctgggaggtg

SEQ ID NO: 8299851 - DNA, 22 bp, Homo sapiens
ctcagagtggggctccctgagg

SEQ ID NO: 8299852 - DNA, 22 bp, Homo sapiens
ctcagagtctgcatttctgtca

SEQ ID NO: 8299853 - DNA, 22 bp, Homo sapiens
ctcagagtcccttccctcgtgg

SEQ ID NO: 8299854 - DNA, 22 bp, Homo sapiens
ctcagagtccccagtgggtttg

SEQ ID NO: 8299855 - DNA, 22 bp, Homo sapiens
ctcagagtccccacatctgggt

SEQ ID NO: 8299856 - DNA, 22 bp, Homo sapiens
ctcagagtccatagtttacagt

SEQ ID NO: 8299857 - DNA, 22 bp, Homo sapiens
ctcagaattacatcccatttta

SEQ ID NO: 8299858 - DNA, 22 bp, Homo sapiens
ctcagaatctgccaagttcagg

SEQ ID NO: 8299859 - DNA, 22 bp, Homo sapiens
ctcagaagttcagcctagagta

SEQ ID NO: 8299860 - DNA, 22 bp, Homo sapiens
ctcaccaggaacagctgcggag

SEQ ID NO: 8299861 - DNA, 22 bp, Homo sapiens
agtcccagcctgtaggattggg

SEQ ID NO: 8299862 - DNA, 22 bp, Homo sapiens
agtcccagcctaggctgtgctg

SEQ ID NO: 8299863 - DNA, 22 bp, Homo sapiens
agtcccagcctaggctgtgctg

SEQ ID NO: 8299864 - DNA, 22 bp, Homo sapiens
agtcccagcccagtcctgtaag

SEQ ID NO: 8299865 - DNA, 22 bp, Homo sapiens
agtcccagatgacccagctact

SEQ ID NO: 8299866 - DNA, 22 bp, Homo sapiens
agtcccagcccagtcctgtaag

SEQ ID NO: 8299867 - DNA, 22 bp, Homo sapiens
agtcccagatgacccagctact

SEQ ID NO: 8299868 - DNA, 22 bp, Homo sapiens
agtcccagatctccattcggtc

SEQ ID NO: 8299869 - DNA, 22 bp, Homo sapiens
agtcccagatctacaggaggga

SEQ ID NO: 8299870 - DNA, 22 bp, Homo sapiens
agtcccagatctacaggaggga

SEQ ID NO: 8299871 - DNA, 20 bp, Homo sapiens
agtcccagatcaaatttctg

SEQ ID NO: 8299872 - DNA, 22 bp, Homo sapiens
agtcccagagaggtcggggcca

SEQ ID NO: 8299873 - DNA, 22 bp, Homo sapiens
cggggtggcactctaaatagaa

SEQ ID NO: 8299874 - DNA, 22 bp, Homo sapiens
agtcccagactccagttttctg

SEQ ID NO: 8299875 - DNA, 22 bp, Homo sapiens
agtcccagactccagttttctg

SEQ ID NO: 8299876 - DNA, 22 bp, Homo sapiens
agtctcagctacttgggaggct

SEQ ID NO: 8299877 - DNA, 22 bp, Homo sapiens
agtctcagccacacagacctat

SEQ ID NO: 8299878 - DNA, 18 bp, Homo sapiens
agtctcagcggaggagta

SEQ ID NO: 8299879 - DNA, 22 bp, Homo sapiens
agtctcagcaagcatggctagt

SEQ ID NO: 8299880 - DNA, 22 bp, Homo sapiens
agtctcagagtacctgagggac

SEQ ID NO: 8299881 - DNA, 22 bp, Homo sapiens
ctcagggacgttagaggacagg

SEQ ID NO: 8299882 - DNA, 19 bp, Homo sapiens
agtctcagtgtacagaggc

SEQ ID NO: 8299883 - DNA, 22 bp, Homo sapiens
agtctcagggccacccggggaa

SEQ ID NO: 8299884 - DNA, 22 bp, Homo sapiens
agtctcaggcagaggaaggcta

SEQ ID NO: 8299885 - DNA, 22 bp, Homo sapiens
agtctcaggcagaggaaggcta

SEQ ID NO: 8299886 - DNA, 23 bp, Homo sapiens
agtctcagctggaaacatgtgtc

SEQ ID NO: 8299887 - DNA, 23 bp, Homo sapiens
agtctcagctggaaacatgtgtc

SEQ ID NO: 8299888 - DNA, 22 bp, Homo sapiens
agtctccttggcctcaatgcct

SEQ ID NO: 8299889 - DNA, 20 bp, Homo sapiens
ctcagtgtggcctgagtgtt

SEQ ID NO: 8299890 - DNA, 20 bp, Homo sapiens
agtgacagagactgtgtggc

SEQ ID NO: 8299891 - DNA, 17 bp, Homo sapiens
agtgaaatttacattgc

SEQ ID NO: 8299892 - DNA, 22 bp, Homo sapiens
agtgacagctgggaaggtgaaa

SEQ ID NO: 8299893 - DNA, 22 bp, Homo sapiens
ctccagaagacccatcctcatg

SEQ ID NO: 8299894 - DNA, 22 bp, Homo sapiens
agttggagtgaacatgagattg

SEQ ID NO: 8299895 - DNA, 23 bp, Homo sapiens
agttctttccaatgtcctcctct

SEQ ID NO: 8299896 - DNA, 22 bp, Homo sapiens
ctgaggcctaagacatgaatga

SEQ ID NO: 8299897 - DNA, 22 bp, Homo sapiens
ctgaggcatgaatgtgggcttt

SEQ ID NO: 8299898 - DNA, 21 bp, Homo sapiens
ctgaggcagcacagctagtca

SEQ ID NO: 8299899 - DNA, 22 bp, Homo sapiens
ctgaggtcaattaatcaacaac

SEQ ID NO: 8299900 - DNA, 22 bp, Homo sapiens
ctgaggctttgtgtgcatgcct

SEQ ID NO: 8299901 - DNA, 22 bp, Homo sapiens
ctgaggcttggaggggtctggt

SEQ ID NO: 8299902 - DNA, 22 bp, Homo sapiens
ctgaggctggggaagggaagtg

SEQ ID NO: 8299903 - DNA, 22 bp, Homo sapiens
ctgaggcctctgttcaccagaa

SEQ ID NO: 8299904 - DNA, 23 bp, Homo sapiens
ctgaggcctgctgcgttcaggtt

SEQ ID NO: 8299905 - DNA, 22 bp, Homo sapiens
ctgaggcctctctcctgggctt

SEQ ID NO: 8299906 - DNA, 22 bp, Homo sapiens
ctgcagctatattttcccacag

SEQ ID NO: 8299907 - DNA, 22 bp, Homo sapiens
ctgcagctcccctgagatcaag

SEQ ID NO: 8299908 - DNA, 22 bp, Homo sapiens
ctgcagcctcctggggtacatg

SEQ ID NO: 8299909 - DNA, 23 bp, Homo sapiens
agtttgtaaagaaatatttgcac

SEQ ID NO: 8299910 - DNA, 20 bp, Homo sapiens
ataaaataactgccacaaga

SEQ ID NO: 8299911 - DNA, 22 bp, Homo sapiens
ataaaagtttccaatcatgcct

SEQ ID NO: 8299912 - DNA, 22 bp, Homo sapiens
agtttgtatcaatttgctttat

SEQ ID NO: 8299913 - DNA, 22 bp, Homo sapiens
ctgccaggactgacgtcttcag

SEQ ID NO: 8299914 - DNA, 22 bp, Homo sapiens
ataaaagtaggaccaacttaca

SEQ ID NO: 8299915 - DNA, 22 bp, Homo sapiens
atacttacttttcttcagacta

SEQ ID NO: 8299916 - DNA, 19 bp, Homo sapiens
ctggcagcctgtctgtgtc

SEQ ID NO: 8299917 - DNA, 22 bp, Homo sapiens
ctggcagcgcagcatgaagtcg

SEQ ID NO: 8299918 - DNA, 22 bp, Homo sapiens
ctggcagcggtttgcagcctgg

SEQ ID NO: 8299919 - DNA, 22 bp, Homo sapiens
ctggcagcgtgagcagcatcca

SEQ ID NO: 8299920 - DNA, 22 bp, Homo sapiens
ctggcagcgtgtttatgaacat

SEQ ID NO: 8299921 - DNA, 22 bp, Homo sapiens
ctggcagctctgagtcccttct

SEQ ID NO: 8299922 - DNA, 22 bp, Homo sapiens
ctggcagctctactcagagcct

SEQ ID NO: 8299923 - DNA, 22 bp, Homo sapiens
ctggagccactgggtcttgtat

SEQ ID NO: 8299924 - DNA, 17 bp, Homo sapiens
ctggagccaagagggcc

SEQ ID NO: 8299925 - DNA, 17 bp, Homo sapiens
ctggagccaagagggcc

SEQ ID NO: 8299926 - DNA, 22 bp, Homo sapiens
ctggagccactgggtcttgtat

SEQ ID NO: 8299927 - DNA, 22 bp, Homo sapiens
ctggagccagccagggccctct

SEQ ID NO: 8299928 - DNA, 22 bp, Homo sapiens
ctggagccagccagggccctct

SEQ ID NO: 8299929 - DNA, 22 bp, Homo sapiens
ctggagccactttttatccttt

SEQ ID NO: 8299930 - DNA, 22 bp, Homo sapiens
ctggagccccagacagggagag

SEQ ID NO: 8299931 - DNA, 22 bp, Homo sapiens
ctggagcccaggcctggtgtct

SEQ ID NO: 8299932 - DNA, 22 bp, Homo sapiens
ctggagcccaggcctggtgtct

SEQ ID NO: 8299933 - DNA, 22 bp, Homo sapiens
ctggagccatgtatagcctatg

SEQ ID NO: 8299934 - DNA, 22 bp, Homo sapiens
ctggagccatgtcttgactgct

SEQ ID NO: 8299935 - DNA, 22 bp, Homo sapiens
ctggagccatgtcttgactgct

SEQ ID NO: 8299936 - DNA, 22 bp, Homo sapiens
atacaagactcagcacagacgg

SEQ ID NO: 8299937 - DNA, 22 bp, Homo sapiens
ctgctctggctgtgtacttcag

SEQ ID NO: 8299938 - DNA, 22 bp, Homo sapiens
ctgctctggctgtgtacttcag

SEQ ID NO: 8299939 - DNA, 22 bp, Homo sapiens
ctgctctggtctcttcatgttt

SEQ ID NO: 8299940 - DNA, 21 bp, Homo sapiens
ctgctctggggaccggctgtg

SEQ ID NO: 8299941 - DNA, 22 bp, Homo sapiens
ctgctctggggaagccagatgt

SEQ ID NO: 8299942 - DNA, 22 bp, Homo sapiens
ctgctctgagtattaacggagg

SEQ ID NO: 8299943 - DNA, 22 bp, Homo sapiens
ctgctctgcaaggcacagtgat

SEQ ID NO: 8299944 - DNA, 22 bp, Homo sapiens
ctgctctgcagcttggactccc

SEQ ID NO: 8299945 - DNA, 22 bp, Homo sapiens
ctgctctgcagcttggactccc

SEQ ID NO: 8299946 - DNA, 22 bp, Homo sapiens
ctgctctgctgatcagtgtctc

SEQ ID NO: 8299947 - DNA, 22 bp, Homo sapiens
ctgctctggcgtactcggcatc

SEQ ID NO: 8299948 - DNA, 20 bp, Homo sapiens
ctgctctgctttgcaggtgg

SEQ ID NO: 8299949 - DNA, 22 bp, Homo sapiens
ctgcccaccacacctgctcctg

SEQ ID NO: 8299950 - DNA, 22 bp, Homo sapiens
ctgcccacttggccaccttcta

SEQ ID NO: 8299951 - DNA, 22 bp, Homo sapiens
ctgcccagaagccagatgggca

SEQ ID NO: 8299952 - DNA, 22 bp, Homo sapiens
ctgcccagaatcactcactcga

SEQ ID NO: 8299953 - DNA, 22 bp, Homo sapiens
ctgctctgagaggctcttccta

SEQ ID NO: 8299954 - DNA, 22 bp, Homo sapiens
ctgctctgagaggctcttccta

SEQ ID NO: 8299955 - DNA, 19 bp, Homo sapiens
ctgctcaggtcagtctgtc

SEQ ID NO: 8299956 - DNA, 22 bp, Homo sapiens
atccccagggaggcctgacctg

SEQ ID NO: 8299957 - DNA, 22 bp, Homo sapiens
atccctgccctcatggagctta

SEQ ID NO: 8299958 - DNA, 17 bp, Homo sapiens
atccccagcatctagaa

SEQ ID NO: 8299959 - DNA, 22 bp, Homo sapiens
atccctggacggcgcctcccca

SEQ ID NO: 8299960 - DNA, 22 bp, Homo sapiens
ctgtggagcttgtggcagtggg

SEQ ID NO: 8299961 - DNA, 22 bp, Homo sapiens
atcatgttccagaaacagtgat

SEQ ID NO: 8299962 - DNA, 22 bp, Homo sapiens
atccaaagatggaaagaacttt

SEQ ID NO: 8299963 - DNA, 22 bp, Homo sapiens
atccaaagccctaagttaactg

SEQ ID NO: 8299964 - DNA, 22 bp, Homo sapiens
atccaaatcatgtcagaagaac

SEQ ID NO: 8299965 - DNA, 22 bp, Homo sapiens
atccaaacctggacatgagtgg

SEQ ID NO: 8299966 - DNA, 22 bp, Homo sapiens
ctgtcctctgtcctcagcagga

SEQ ID NO: 8299967 - DNA, 22 bp, Homo sapiens
ctgtcctccggccacctacagt

SEQ ID NO: 8299968 - DNA, 22 bp, Homo sapiens
atcacaggtggtaggaaaagaa

SEQ ID NO: 8299969 - DNA, 22 bp, Homo sapiens
ctgtcctatgagtactcactag

SEQ ID NO: 8299970 - DNA, 18 bp, Homo sapiens
ctgtcttttttctctcca

SEQ ID NO: 8299971 - DNA, 22 bp, Homo sapiens
ctgtctctgtcttaactcccag

SEQ ID NO: 8299972 - DNA, 22 bp, Homo sapiens
ctgtctgtttctgattcaacct

SEQ ID NO: 8299973 - DNA, 22 bp, Homo sapiens
ctgtctgttttaccttctccag

SEQ ID NO: 8299974 - DNA, 22 bp, Homo sapiens
ctgtgcaagacttactttaata

SEQ ID NO: 8299975 - DNA, 22 bp, Homo sapiens
ctgtgcaagcccaagataaaac

SEQ ID NO: 8299976 - DNA, 22 bp, Homo sapiens
ctggcttctgggccagggcaga

SEQ ID NO: 8299977 - DNA, 22 bp, Homo sapiens
ctggcagctgtgtgaagaactg

SEQ ID NO: 8299978 - DNA, 22 bp, Homo sapiens
ctggcagctggaggctagaggc

SEQ ID NO: 8299979 - DNA, 22 bp, Homo sapiens
ctggcagctgcccgagatgccc

SEQ ID NO: 8299980 - DNA, 22 bp, Homo sapiens
ctgggacacccaaggaaagagc

SEQ ID NO: 8299981 - DNA, 22 bp, Homo sapiens
ctgggagagaagcgaagctggg

SEQ ID NO: 8299982 - DNA, 22 bp, Homo sapiens
ctgggactttaccctgtggccc

SEQ ID NO: 8299983 - DNA, 22 bp, Homo sapiens
ctgggcacagcgttgggctctt

SEQ ID NO: 8299984 - DNA, 22 bp, Homo sapiens
ctgggcacaggggagcagagtc

SEQ ID NO: 8299985 - DNA, 19 bp, Homo sapiens
ctgggaggtgttcagagaa

SEQ ID NO: 8299986 - DNA, 22 bp, Homo sapiens
ctgggcacacagtgactctgca

SEQ ID NO: 8299987 - DNA, 22 bp, Homo sapiens
ctgggcacaagtggccctggat

SEQ ID NO: 8299988 - DNA, 22 bp, Homo sapiens
ctgggcacattttgactagtgt

SEQ ID NO: 8299989 - DNA, 22 bp, Homo sapiens
atatttcttgagcacctggtat

SEQ ID NO: 8299990 - DNA, 22 bp, Homo sapiens
atatgtgtatttggttagccta

SEQ ID NO: 8299991 - DNA, 20 bp, Homo sapiens
atatgtgtacgtgtatacat

SEQ ID NO: 8299992 - DNA, 22 bp, Homo sapiens
atatgtgtacgtgcagtatata

SEQ ID NO: 8299993 - DNA, 22 bp, Homo sapiens
atatgtgtgccatttcagcagt

SEQ ID NO: 8299994 - DNA, 22 bp, Homo sapiens
atatgtgtgatgcatggactaa

SEQ ID NO: 8299995 - DNA, 22 bp, Homo sapiens
atatgtcgctacatcattagat

SEQ ID NO: 8299996 - DNA, 22 bp, Homo sapiens
ctgggcagtggtggcccttccc

SEQ ID NO: 8299997 - DNA, 22 bp, Homo sapiens
ctgggcagtggtggcatctttg

SEQ ID NO: 8299998 - DNA, 20 bp, Homo sapiens
ctgggcaggtgtttgatctc

SEQ ID NO: 8299999 - DNA, 22 bp, Homo sapiens
ctgggcagtgcagctatagaac

SEQ ID NO: 8300000 - DNA, 22 bp, Homo sapiens
atatgaagtcagacaaactggg

SEQ ID NO: 8300001 - DNA, 22 bp, Homo sapiens
atatgaagaattccaatttgga

SEQ ID NO: 8300002 - DNA, 22 bp, Homo sapiens
ggcagctgagcatggctacctt

SEQ ID NO: 8300003 - DNA, 22 bp, Homo sapiens
ggcagctgattagcatcaagga

SEQ ID NO: 8300004 - DNA, 22 bp, Homo sapiens
ggcagctgattagcatcaagga

SEQ ID NO: 8300005 - DNA, 22 bp, Homo sapiens
caccaggctggagtgcagtggc

SEQ ID NO: 8300006 - DNA, 22 bp, Homo sapiens
caccatcagcagcaggtgtcaa

SEQ ID NO: 8300007 - DNA, 22 bp, Homo sapiens
ggcagctgacctagcaccatcc

SEQ ID NO: 8300008 - DNA, 22 bp, Homo sapiens
ggcagctgacctagcaccatcc

SEQ ID NO: 8300009 - DNA, 21 bp, Homo sapiens
ggcagctgaccgcgcggtgca

SEQ ID NO: 8300010 - DNA, 22 bp, Homo sapiens
ggcagctctgtgtctgggaagc

SEQ ID NO: 8300011 - DNA, 22 bp, Homo sapiens
ggcagccagagggcagctggat

SEQ ID NO: 8300012 - DNA, 22 bp, Homo sapiens
cacccacccactgctcattggc

SEQ ID NO: 8300013 - DNA, 22 bp, Homo sapiens
cacccaggttggagtgcagtgg

SEQ ID NO: 8300014 - DNA, 18 bp, Homo sapiens
caccctccgcggctgccc

SEQ ID NO: 8300015 - DNA, 22 bp, Homo sapiens
cactctgagaagtacaagctcc

SEQ ID NO: 8300016 - DNA, 20 bp, Homo sapiens
cactgaagacttcttgctca

SEQ ID NO: 8300017 - DNA, 22 bp, Homo sapiens
cacccctcgccactgcccttgt

SEQ ID NO: 8300018 - DNA, 23 bp, Homo sapiens
ggcctcctggtctaggctagact

SEQ ID NO: 8300019 - DNA, 22 bp, Homo sapiens
cactgagaggtctcatttccaa

SEQ ID NO: 8300020 - DNA, 22 bp, Homo sapiens
cactgaaggctgcagctcagcc

SEQ ID NO: 8300021 - DNA, 22 bp, Homo sapiens
cactgaaggacagtaggaaggg

SEQ ID NO: 8300022 - DNA, 22 bp, Homo sapiens
cactgaaggctaggattagatg

SEQ ID NO: 8300023 - DNA, 22 bp, Homo sapiens
cactgaaggtaggaccaaggct

SEQ ID NO: 8300024 - DNA, 22 bp, Homo sapiens
cactgaatctcaaggggagggt

SEQ ID NO: 8300025 - DNA, 22 bp, Homo sapiens
cactgaagatgcgactagtgct

SEQ ID NO: 8300026 - DNA, 22 bp, Homo sapiens
cactgaagatgcgactagtgct

SEQ ID NO: 8300027 - DNA, 22 bp, Homo sapiens
cactgaagccactggaagagga

SEQ ID NO: 8300028 - DNA, 22 bp, Homo sapiens
cactgaagcctgggagtaagac

SEQ ID NO: 8300029 - DNA, 22 bp, Homo sapiens
cactgaaggaaggactactgca

SEQ ID NO: 8300030 - DNA, 22 bp, Homo sapiens
cactgaaggaaggactactgca

SEQ ID NO: 8300031 - DNA, 22 bp, Homo sapiens
cactgaagctttcattctcttg

SEQ ID NO: 8300032 - DNA, 22 bp, Homo sapiens
cactgcagcaccatgcagggct

SEQ ID NO: 8300033 - DNA, 23 bp, Homo sapiens
cactgcagcgtggtctggcagga

SEQ ID NO: 8300034 - DNA, 22 bp, Homo sapiens
cactgcaggtctgagatggggg

SEQ ID NO: 8300035 - DNA, 23 bp, Homo sapiens
cactgcagcgtggtctggcagga

SEQ ID NO: 8300036 - DNA, 21 bp, Homo sapiens
cactgcagccttgacctgggc

SEQ ID NO: 8300037 - DNA, 21 bp, Homo sapiens
cactgcagccttgacctgggc

SEQ ID NO: 8300038 - DNA, 22 bp, Homo sapiens
ggcctcggcccactgctgcggt

SEQ ID NO: 8300039 - DNA, 22 bp, Homo sapiens
ggcctcgcggcttctggtggct

SEQ ID NO: 8300040 - DNA, 22 bp, Homo sapiens
ggcctcgcggcttctggtggct

SEQ ID NO: 8300041 - DNA, 22 bp, Homo sapiens
ggcctctcatgtcctgggcttc

SEQ ID NO: 8300042 - DNA, 22 bp, Homo sapiens
cactggcatgtgaggcggtggc

SEQ ID NO: 8300043 - DNA, 22 bp, Homo sapiens
cactgcttttttggctatgtac

SEQ ID NO: 8300044 - DNA, 22 bp, Homo sapiens
cactgcctggaaggagagacat

SEQ ID NO: 8300045 - DNA, 22 bp, Homo sapiens
cactgcctggaaggagagacat

SEQ ID NO: 8300046 - DNA, 22 bp, Homo sapiens
cactgctttcacagtttgttcc

SEQ ID NO: 8300047 - DNA, 22 bp, Homo sapiens
ggctcaagcagtctgcctgcct

SEQ ID NO: 8300048 - DNA, 22 bp, Homo sapiens
cactgcatggatgatggctgta

SEQ ID NO: 8300049 - DNA, 22 bp, Homo sapiens
cactgcagttccccagtgcgca

SEQ ID NO: 8300050 - DNA, 22 bp, Homo sapiens
cactgcagtaactctaggactg

SEQ ID NO: 8300051 - DNA, 22 bp, Homo sapiens
ggcagatggaagaggctgggtc

SEQ ID NO: 8300052 - DNA, 22 bp, Homo sapiens
ggcagatggaagaggctgggtc

SEQ ID NO: 8300053 - DNA, 22 bp, Homo sapiens
ggcagcagtggctgctattgtc

SEQ ID NO: 8300054 - DNA, 22 bp, Homo sapiens
ggcagcatgagcctggtgaatt

SEQ ID NO: 8300055 - DNA, 20 bp, Homo sapiens
ggcagagctatgtctgttgc

SEQ ID NO: 8300056 - DNA, 22 bp, Homo sapiens
ggcagagctgcatgagcactca

SEQ ID NO: 8300057 - DNA, 22 bp, Homo sapiens
cacagtggcaggtgtgggttgt

SEQ ID NO: 8300058 - DNA, 22 bp, Homo sapiens
cacagtggattgggtgatgccc

SEQ ID NO: 8300059 - DNA, 22 bp, Homo sapiens
ggcagagcttgcagtgagccga

SEQ ID NO: 8300060 - DNA, 22 bp, Homo sapiens
cacagggcaggccccaggcctc

SEQ ID NO: 8300061 - DNA, 22 bp, Homo sapiens
cacagggcagagacctgggtgc

SEQ ID NO: 8300062 - DNA, 22 bp, Homo sapiens
cacagggcagagggtccgtggc

SEQ ID NO: 8300063 - DNA, 22 bp, Homo sapiens
ggcacagggagccgcagttgca

SEQ ID NO: 8300064 - DNA, 22 bp, Homo sapiens
ggcacagggaggccctggtgtg

SEQ ID NO: 8300065 - DNA, 22 bp, Homo sapiens
ggcacagggagccgcagttgca

SEQ ID NO: 8300066 - DNA, 20 bp, Homo sapiens
ggcactggaagcacacagga

SEQ ID NO: 8300067 - DNA, 22 bp, Homo sapiens
ggcactgggagaggtgagacgg

SEQ ID NO: 8300068 - DNA, 22 bp, Homo sapiens
ggcactgggcaccggctgaggg

SEQ ID NO: 8300069 - DNA, 22 bp, Homo sapiens
ggcactgggcaccggctgaggg

SEQ ID NO: 8300070 - DNA, 22 bp, Homo sapiens
ggcagagatgtgggtcagaatc

SEQ ID NO: 8300071 - DNA, 22 bp, Homo sapiens
ggagggagtcagctgattagaa

SEQ ID NO: 8300072 - DNA, 22 bp, Homo sapiens
ggatccttctttgacctcacag

SEQ ID NO: 8300073 - DNA, 22 bp, Homo sapiens
ggatccttaactatcacagtga

SEQ ID NO: 8300074 - DNA, 22 bp, Homo sapiens
ggagggagcatccccttgctga

SEQ ID NO: 8300075 - DNA, 22 bp, Homo sapiens
cacagggcaccagttggccatc

SEQ ID NO: 8300076 - DNA, 22 bp, Homo sapiens
cacagcttctgagtgaggattt

SEQ ID NO: 8300077 - DNA, 22 bp, Homo sapiens
cacagcttctccttgatatcgc

SEQ ID NO: 8300078 - DNA, 22 bp, Homo sapiens
cacagcttgggctctgacaata

SEQ ID NO: 8300079 - DNA, 20 bp, Homo sapiens
cacagcttgccttttatgac

SEQ ID NO: 8300080 - DNA, 22 bp, Homo sapiens
cacagcttgtttagtgactcac

SEQ ID NO: 8300081 - DNA, 22 bp, Homo sapiens
ggaggccaaggcaggtggatcg

SEQ ID NO: 8300082 - DNA, 22 bp, Homo sapiens
ggaggccttgaggccaggagct

SEQ ID NO: 8300083 - DNA, 22 bp, Homo sapiens
cacagcttccattagaatgaga

SEQ ID NO: 8300084 - DNA, 22 bp, Homo sapiens
cacagcttatgccactgattgg

SEQ ID NO: 8300085 - DNA, 22 bp, Homo sapiens
cacactagtctatccattagct

SEQ ID NO: 8300086 - DNA, 22 bp, Homo sapiens
cacagctggtgcactagctctg

SEQ ID NO: 8300087 - DNA, 22 bp, Homo sapiens
caagatgaaactacagggagga

SEQ ID NO: 8300088 - DNA, 22 bp, Homo sapiens
caagatgatccctgaaggcagc

SEQ ID NO: 8300089 - DNA, 22 bp, Homo sapiens
caagagctgcaaatagcgtgac

SEQ ID NO: 8300090 - DNA, 22 bp, Homo sapiens
caagagctggagaggcagtcta

SEQ ID NO: 8300091 - DNA, 22 bp, Homo sapiens
caagagctggagaggcagtcta

SEQ ID NO: 8300092 - DNA, 22 bp, Homo sapiens
caagagctgggtggcaagctag

SEQ ID NO: 8300093 - DNA, 22 bp, Homo sapiens
caagagctgtgacctcattcac

SEQ ID NO: 8300094 - DNA, 22 bp, Homo sapiens
caagagctttagaaatgctcat

SEQ ID NO: 8300095 - DNA, 22 bp, Homo sapiens
caagatggacataaggagagaa

SEQ ID NO: 8300096 - DNA, 22 bp, Homo sapiens
caagatgcccctggtagggatc

SEQ ID NO: 8300097 - DNA, 22 bp, Homo sapiens
caaggagaaaacggcttctgaa

SEQ ID NO: 8300098 - DNA, 22 bp, Homo sapiens
caaggagagtaattgaatgaga

SEQ ID NO: 8300099 - DNA, 22 bp, Homo sapiens
caaggagataaaatgttgagct

SEQ ID NO: 8300100 - DNA, 22 bp, Homo sapiens
caaggaggaagatgcaggggac

SEQ ID NO: 8300101 - DNA, 22 bp, Homo sapiens
caagagctgaggctggagaggt

SEQ ID NO: 8300102 - DNA, 22 bp, Homo sapiens
caagagctgaggctggagaggt

SEQ ID NO: 8300103 - DNA, 22 bp, Homo sapiens
caagagctcaccggagagcatt

SEQ ID NO: 8300104 - DNA, 22 bp, Homo sapiens
caagagctcaccggagagcatt

SEQ ID NO: 8300105 - DNA, 22 bp, Homo sapiens
caagagctcaccggagagcatt

SEQ ID NO: 8300106 - DNA, 22 bp, Homo sapiens
caagagctcccagacctgggca

SEQ ID NO: 8300107 - DNA, 22 bp, Homo sapiens
caagagctcagaaacccttgct

SEQ ID NO: 8300108 - DNA, 22 bp, Homo sapiens
gctgccttttgctcctcccacc

SEQ ID NO: 8300109 - DNA, 22 bp, Homo sapiens
gctgccttttaaagcctcgctt

SEQ ID NO: 8300110 - DNA, 22 bp, Homo sapiens
gctgcctttgtgagccaagggg

SEQ ID NO: 8300111 - DNA, 22 bp, Homo sapiens
gctgcctgccttgcctggagga

SEQ ID NO: 8300112 - DNA, 22 bp, Homo sapiens
gctgcctgccttgcctggagga

SEQ ID NO: 8300113 - DNA, 22 bp, Homo sapiens
gctgccttgaacttggcctggg

SEQ ID NO: 8300114 - DNA, 20 bp, Homo sapiens
gctgccttgtcctgcttggt

SEQ ID NO: 8300115 - DNA, 22 bp, Homo sapiens
caaagtatattggattgaatgg

SEQ ID NO: 8300116 - DNA, 18 bp, Homo sapiens
gctcctggaccaggtcac

SEQ ID NO: 8300117 - DNA, 22 bp, Homo sapiens
gctgcagcagaagttctcagag

SEQ ID NO: 8300118 - DNA, 22 bp, Homo sapiens
gctgcagcagaagttctcagag

SEQ ID NO: 8300119 - DNA, 22 bp, Homo sapiens
gctgcagcaagccctccagggg

SEQ ID NO: 8300120 - DNA, 22 bp, Homo sapiens
gctgcagcagctgcagggttgt

SEQ ID NO: 8300121 - DNA, 22 bp, Homo sapiens
gctgcagccaaattcattgtca

SEQ ID NO: 8300122 - DNA, 22 bp, Homo sapiens
gctgcagcccggcgcgcctgag

SEQ ID NO: 8300123 - DNA, 22 bp, Homo sapiens
gctgccaccgtggagatgagtg

SEQ ID NO: 8300124 - DNA, 22 bp, Homo sapiens
gctgccaatccagctgtgggag

SEQ ID NO: 8300125 - DNA, 22 bp, Homo sapiens
gctgccacattttcaggactaa

SEQ ID NO: 8300126 - DNA, 21 bp, Homo sapiens
gctgccaccgcgtgctccagg

SEQ ID NO: 8300127 - DNA, 17 bp, Homo sapiens
gctgcagcggtaggcag

SEQ ID NO: 8300128 - DNA, 17 bp, Homo sapiens
gctgcagcggtaggcag

SEQ ID NO: 8300129 - DNA, 22 bp, Homo sapiens
ggaaaaggccattgtttctctg

SEQ ID NO: 8300130 - DNA, 22 bp, Homo sapiens
ggaaaaggccacagggacacat

SEQ ID NO: 8300131 - DNA, 22 bp, Homo sapiens
ggaaaaggccacagggacacat

SEQ ID NO: 8300132 - DNA, 17 bp, Homo sapiens
ggaaaaggatgatacag

SEQ ID NO: 8300133 - DNA, 18 bp, Homo sapiens
ggaaaaggagtgtctagc

SEQ ID NO: 8300134 - DNA, 22 bp, Homo sapiens
cacaatgcgtacatatatcaaa

SEQ ID NO: 8300135 - DNA, 22 bp, Homo sapiens
cacaagtctgtggtctccaaca

SEQ ID NO: 8300136 - DNA, 22 bp, Homo sapiens
cacaccctcgtgctccctcccg

SEQ ID NO: 8300137 - DNA, 22 bp, Homo sapiens
cacacctgtaataccagctact

SEQ ID NO: 8300138 - DNA, 22 bp, Homo sapiens
cacacattgaattcattcttgt

SEQ ID NO: 8300139 - DNA, 23 bp, Homo sapiens
cacaccaggagccgtctgggcca

SEQ ID NO: 8300140 - DNA, 22 bp, Homo sapiens
cacaaaagtaggaggcaggcgg

SEQ ID NO: 8300141 - DNA, 22 bp, Homo sapiens
gcttgggatatgctgatgtaaa

SEQ ID NO: 8300142 - DNA, 22 bp, Homo sapiens
gcttctctggcctgcagggcat

SEQ ID NO: 8300143 - DNA, 22 bp, Homo sapiens
gcttctctctcagactgcaagc

SEQ ID NO: 8300144 - DNA, 22 bp, Homo sapiens
gctgtctccatagctgtgtgtc

SEQ ID NO: 8300145 - DNA, 22 bp, Homo sapiens
gctgtgctggaaggggacctgc

SEQ ID NO: 8300146 - DNA, 22 bp, Homo sapiens
gctgtggccaacaaaccacttt

SEQ ID NO: 8300147 - DNA, 22 bp, Homo sapiens
gctgtctgcaagccaggaaatg

SEQ ID NO: 8300148 - DNA, 22 bp, Homo sapiens
gctgtctgcatctctagagctt

SEQ ID NO: 8300149 - DNA, 19 bp, Homo sapiens
gctgtctgatgctgaggtc

SEQ ID NO: 8300150 - DNA, 22 bp, Homo sapiens
gctgtctcggggctttctcctg

SEQ ID NO: 8300151 - DNA, 21 bp, Homo sapiens
gctgtctctggctcctgggaa

SEQ ID NO: 8300152 - DNA, 18 bp, Homo sapiens
gctgtctgaggtctgagg

SEQ ID NO: 8300153 - DNA, 22 bp, Homo sapiens
gctgtctgagaacatggtggaa

SEQ ID NO: 8300154 - DNA, 22 bp, Homo sapiens
gctgtctgagaacatggtggaa

SEQ ID NO: 8300155 - DNA, 22 bp, Homo sapiens
gctgtctgactccaagttggag

SEQ ID NO: 8300156 - DNA, 22 bp, Homo sapiens
gggagcaggagcctgcctgcca

SEQ ID NO: 8300157 - DNA, 22 bp, Homo sapiens
gggactgggagatcctcctggc

SEQ ID NO: 8300158 - DNA, 22 bp, Homo sapiens
gggactgtaaattcatatggcc

SEQ ID NO: 8300159 - DNA, 22 bp, Homo sapiens
gggactgggagatcctcctggc

SEQ ID NO: 8300160 - DNA, 22 bp, Homo sapiens
cagacagaaggctccttgaggt

SEQ ID NO: 8300161 - DNA, 22 bp, Homo sapiens
gggaggtcagggtgcctgctgg

SEQ ID NO: 8300162 - DNA, 22 bp, Homo sapiens
cagacaggctagccagactcac

SEQ ID NO: 8300163 - DNA, 22 bp, Homo sapiens
gggcaaggcagaagagttggag

SEQ ID NO: 8300164 - DNA, 22 bp, Homo sapiens
gggcaagctcttcagaagctct

SEQ ID NO: 8300165 - DNA, 18 bp, Homo sapiens
gggcaagcggctgtcacc

SEQ ID NO: 8300166 - DNA, 22 bp, Homo sapiens
gggaaggaggtggcttgaagtg

SEQ ID NO: 8300167 - DNA, 22 bp, Homo sapiens
gggaaggagcctgcttgctaga

SEQ ID NO: 8300168 - DNA, 22 bp, Homo sapiens
gggacagacccatgggccaggt

SEQ ID NO: 8300169 - DNA, 22 bp, Homo sapiens
gggacagaaggaagtgagcaca

SEQ ID NO: 8300170 - DNA, 22 bp, Homo sapiens
gggacagaaggaagtgagcaca

SEQ ID NO: 8300171 - DNA, 22 bp, Homo sapiens
gggactggaactactggtgcag

SEQ ID NO: 8300172 - DNA, 22 bp, Homo sapiens
gggactggagtagaggccggtg

SEQ ID NO: 8300173 - DNA, 22 bp, Homo sapiens
gggactggcacagggctgggag

SEQ ID NO: 8300174 - DNA, 22 bp, Homo sapiens
gggactggcacagggctgggag

SEQ ID NO: 8300175 - DNA, 22 bp, Homo sapiens
cagaagcagtgagagatgtgca

SEQ ID NO: 8300176 - DNA, 18 bp, Homo sapiens
cagaagtccttcaaggcc

SEQ ID NO: 8300177 - DNA, 20 bp, Homo sapiens
cagaaggtctaagctttaga

SEQ ID NO: 8300178 - DNA, 22 bp, Homo sapiens
cagaagtaagattactgtgaga

SEQ ID NO: 8300179 - DNA, 22 bp, Homo sapiens
cagaagtaagattactgtgagt

SEQ ID NO: 8300180 - DNA, 22 bp, Homo sapiens
cagaagtaagattactgtgaga

SEQ ID NO: 8300181 - DNA, 22 bp, Homo sapiens
cagaagtaagattactgtgagt

SEQ ID NO: 8300182 - DNA, 21 bp, Homo sapiens
cagaagtaagggtaacttctc

SEQ ID NO: 8300183 - DNA, 22 bp, Homo sapiens
gggtgctgactggggcctgaaa

SEQ ID NO: 8300184 - DNA, 22 bp, Homo sapiens
cagaggtagccgagtgcaatcg

SEQ ID NO: 8300185 - DNA, 22 bp, Homo sapiens
cagaggctgtgtaggcagactg

SEQ ID NO: 8300186 - DNA, 22 bp, Homo sapiens
cagaggctgggacctcaggcat

SEQ ID NO: 8300187 - DNA, 22 bp, Homo sapiens
cagaggccatatttcttcactc

SEQ ID NO: 8300188 - DNA, 22 bp, Homo sapiens
cagaggccccagaactagctct

SEQ ID NO: 8300189 - DNA, 22 bp, Homo sapiens
cagaggccccagaactagctct

SEQ ID NO: 8300190 - DNA, 21 bp, Homo sapiens
cagaggcctcatgctctgtgc

SEQ ID NO: 8300191 - DNA, 22 bp, Homo sapiens
cagaggcctcacttccagccag

SEQ ID NO: 8300192 - DNA, 22 bp, Homo sapiens
cagaggcctatccagtgtccat

SEQ ID NO: 8300193 - DNA, 22 bp, Homo sapiens
cagagctggtgtgtcctggcat

SEQ ID NO: 8300194 - DNA, 22 bp, Homo sapiens
cagagctggtgttacaagtcca

SEQ ID NO: 8300195 - DNA, 22 bp, Homo sapiens
cagagctgtcatttgccagtga

SEQ ID NO: 8300196 - DNA, 22 bp, Homo sapiens
cagaggccacctgtggccactg

SEQ ID NO: 8300197 - DNA, 22 bp, Homo sapiens
cagagctggtaagtggtagagg

SEQ ID NO: 8300198 - DNA, 22 bp, Homo sapiens
cagagctggtgtgtcctggcat

SEQ ID NO: 8300199 - DNA, 22 bp, Homo sapiens
cagagctgcagattgaaggcat

SEQ ID NO: 8300200 - DNA, 22 bp, Homo sapiens
cagagctgcgctttttcctggt

SEQ ID NO: 8300201 - DNA, 19 bp, Homo sapiens
cagagctgctggcctcgtc

SEQ ID NO: 8300202 - DNA, 22 bp, Homo sapiens
cagagctgctcatggtggccag

SEQ ID NO: 8300203 - DNA, 22 bp, Homo sapiens
cagagctgcaaatgcccctccg

SEQ ID NO: 8300204 - DNA, 22 bp, Homo sapiens
cagagctgcacattctatgatg

SEQ ID NO: 8300205 - DNA, 22 bp, Homo sapiens
cagagctgattggatccagaga

SEQ ID NO: 8300206 - DNA, 22 bp, Homo sapiens
cagagctgacccaaggattgaa

SEQ ID NO: 8300207 - DNA, 22 bp, Homo sapiens
cagagctgagaatgttgatgct

SEQ ID NO: 8300208 - DNA, 21 bp, Homo sapiens
gggcgaggcctgatgtggctc

SEQ ID NO: 8300209 - DNA, 22 bp, Homo sapiens
gggcgaggactgactctgggca

SEQ ID NO: 8300210 - DNA, 22 bp, Homo sapiens
cagagccccccttctgatcaca

SEQ ID NO: 8300211 - DNA, 22 bp, Homo sapiens
cagagcccctcagctctctccc

SEQ ID NO: 8300212 - DNA, 22 bp, Homo sapiens
gggcactgtggggcccatgctg

SEQ ID NO: 8300213 - DNA, 22 bp, Homo sapiens
gggcactgtgctaggtgctgag

SEQ ID NO: 8300214 - DNA, 22 bp, Homo sapiens
gggcacagagggtcttgaagaa

SEQ ID NO: 8300215 - DNA, 19 bp, Homo sapiens
gggcagaatggcatctcag

SEQ ID NO: 8300216 - DNA, 19 bp, Homo sapiens
gggcagaatggcatctcag

SEQ ID NO: 8300217 - DNA, 22 bp, Homo sapiens
gggcagagaaatggacagttgg

SEQ ID NO: 8300218 - DNA, 22 bp, Homo sapiens
cagagccagctgtccttggcat

SEQ ID NO: 8300219 - DNA, 22 bp, Homo sapiens
cagagccagctgtccttggcat

SEQ ID NO: 8300220 - DNA, 22 bp, Homo sapiens
cagccacgtagcccttggccgt

SEQ ID NO: 8300221 - DNA, 22 bp, Homo sapiens
cagccaggttcaagtccttata

SEQ ID NO: 8300222 - DNA, 22 bp, Homo sapiens
cagcattgatcccaggctgtgg

SEQ ID NO: 8300223 - DNA, 22 bp, Homo sapiens
cagcattgggttacctttgttt

SEQ ID NO: 8300224 - DNA, 22 bp, Homo sapiens
gtatttgatacatgaaatggtg

SEQ ID NO: 8300225 - DNA, 22 bp, Homo sapiens
gtatttgatagatttcaaagga

SEQ ID NO: 8300226 - DNA, 22 bp, Homo sapiens
cagcccagcactaagtagattt

SEQ ID NO: 8300227 - DNA, 22 bp, Homo sapiens
cagcccagcagggtctggccct

SEQ ID NO: 8300228 - DNA, 22 bp, Homo sapiens
cagcccagcagtcttagcctgc

SEQ ID NO: 8300229 - DNA, 22 bp, Homo sapiens
cagcagcaaatctagaagagga

SEQ ID NO: 8300230 - DNA, 22 bp, Homo sapiens
gtaaacaagtctaccattagaa

SEQ ID NO: 8300231 - DNA, 22 bp, Homo sapiens
gtatcctttgcggaaatttcta

SEQ ID NO: 8300232 - DNA, 22 bp, Homo sapiens
gtatcttttacaccaggaaatt

SEQ ID NO: 8300233 - DNA, 22 bp, Homo sapiens
gtatcttttggtggaaaaataa

SEQ ID NO: 8300234 - DNA, 22 bp, Homo sapiens
gtatctttcccaccaatcacaa

SEQ ID NO: 8300235 - DNA, 22 bp, Homo sapiens
gtatctttccacatcttcagta

SEQ ID NO: 8300236 - DNA, 22 bp, Homo sapiens
cagcagctacttggagcagcag

SEQ ID NO: 8300237 - DNA, 22 bp, Homo sapiens
cagcaggcccaggtgctggtga

SEQ ID NO: 8300238 - DNA, 22 bp, Homo sapiens
cagcaggcagccatttcactgt

SEQ ID NO: 8300239 - DNA, 22 bp, Homo sapiens
cagcaggcccagagtttcatgg

SEQ ID NO: 8300240 - DNA, 22 bp, Homo sapiens
ggtgggtattgaatacaggtgt

SEQ ID NO: 8300241 - DNA, 22 bp, Homo sapiens
ggtggggtcacgacagagggaa

SEQ ID NO: 8300242 - DNA, 22 bp, Homo sapiens
ggtgggtatagttagggcctct

SEQ ID NO: 8300243 - DNA, 21 bp, Homo sapiens
gggtgggaggacacagcaggc

SEQ ID NO: 8300244 - DNA, 21 bp, Homo sapiens
gggtgggaggacacagcaggc

SEQ ID NO: 8300245 - DNA, 22 bp, Homo sapiens
gggtgggagaaatgagtatcta

SEQ ID NO: 8300246 - DNA, 22 bp, Homo sapiens
gggtgggagtctggccctcaaa

SEQ ID NO: 8300247 - DNA, 22 bp, Homo sapiens
ggtgggagagctctgtctccag

SEQ ID NO: 8300248 - DNA, 19 bp, Homo sapiens
cagagtacaccagatagga

SEQ ID NO: 8300249 - DNA, 22 bp, Homo sapiens
cagagtactgggagaacagaag

SEQ ID NO: 8300250 - DNA, 22 bp, Homo sapiens
gggtgggaaggctaagggattg

SEQ ID NO: 8300251 - DNA, 20 bp, Homo sapiens
gtaaaatatggtctttgggt

SEQ ID NO: 8300252 - DNA, 22 bp, Homo sapiens
ggttgccggggcaggactggaa

SEQ ID NO: 8300253 - DNA, 22 bp, Homo sapiens
cagcaataactcaaagccattt

SEQ ID NO: 8300254 - DNA, 22 bp, Homo sapiens
cagcaataagccaggttagaca

SEQ ID NO: 8300255 - DNA, 22 bp, Homo sapiens
cagcaataatgtctacaaatct

SEQ ID NO: 8300256 - DNA, 19 bp, Homo sapiens
cagcaataatgccagatgg

SEQ ID NO: 8300257 - DNA, 22 bp, Homo sapiens
cagcaataaggtaagcttctcc

SEQ ID NO: 8300258 - DNA, 22 bp, Homo sapiens
ggtgtgcctggggcttagctgc

SEQ ID NO: 8300259 - DNA, 22 bp, Homo sapiens
cagcaatatacacagtctatgg

SEQ ID NO: 8300260 - DNA, 22 bp, Homo sapiens
cagcaatagtgtgtttgtttca

SEQ ID NO: 8300261 - DNA, 22 bp, Homo sapiens
atggcaggcccaggtgttcatt

SEQ ID NO: 8300262 - DNA, 22 bp, Homo sapiens
atggcagggcagcctctcagag

SEQ ID NO: 8300263 - DNA, 22 bp, Homo sapiens
gagagctgtccggctgagcagc

SEQ ID NO: 8300264 - DNA, 22 bp, Homo sapiens
gagagctgtggtttgaccaggc

SEQ ID NO: 8300265 - DNA, 22 bp, Homo sapiens
gagagctgtgttcattctacca

SEQ ID NO: 8300266 - DNA, 22 bp, Homo sapiens
gagccagcgccttgcctctggg

SEQ ID NO: 8300267 - DNA, 22 bp, Homo sapiens
gagccagctgagctgcactgtc

SEQ ID NO: 8300268 - DNA, 22 bp, Homo sapiens
gagccaggcccgtacttgctgt

SEQ ID NO: 8300269 - DNA, 22 bp, Homo sapiens
gagccaggcaccttctgtgttg

SEQ ID NO: 8300270 - DNA, 22 bp, Homo sapiens
atggcccaggcctcctgtggct

SEQ ID NO: 8300271 - DNA, 22 bp, Homo sapiens
gagccagccttcttctgaggtc

SEQ ID NO: 8300272 - DNA, 22 bp, Homo sapiens
gagcagtgactggagcatgaga

SEQ ID NO: 8300273 - DNA, 22 bp, Homo sapiens
atgccactgcgctccagcctgg

SEQ ID NO: 8300274 - DNA, 23 bp, Homo sapiens
gacagagtgagaccttgtcttac

SEQ ID NO: 8300275 - DNA, 22 bp, Homo sapiens
gacagagttgttgatgtatgct

SEQ ID NO: 8300276 - DNA, 22 bp, Homo sapiens
gacagagtgcagggctagaaga

SEQ ID NO: 8300277 - DNA, 22 bp, Homo sapiens
atggacagtgtgtctgtttcca

SEQ ID NO: 8300278 - DNA, 22 bp, Homo sapiens
atggacagtgtgaagcagatag

SEQ ID NO: 8300279 - DNA, 22 bp, Homo sapiens
atggaaggtcctacagagcgca

SEQ ID NO: 8300280 - DNA, 21 bp, Homo sapiens
atggagcctaagagtggaggt

SEQ ID NO: 8300281 - DNA, 23 bp, Homo sapiens
atggagctggtactagctacctc

SEQ ID NO: 8300282 - DNA, 21 bp, Homo sapiens
gagctgggcgaggctccgggg

SEQ ID NO: 8300283 - DNA, 22 bp, Homo sapiens
atggggctgggattctcctcgg

SEQ ID NO: 8300284 - DNA, 22 bp, Homo sapiens
atggggctctgcggctgctccc

SEQ ID NO: 8300285 - DNA, 22 bp, Homo sapiens
atggtacaaaatgtataaagtc

SEQ ID NO: 8300286 - DNA, 22 bp, Homo sapiens
atgtacatttgtagtaatatca

SEQ ID NO: 8300287 - DNA, 22 bp, Homo sapiens
atgtacattttcctaatgtttt

SEQ ID NO: 8300288 - DNA, 22 bp, Homo sapiens
atgtacatttagatcatttctg

SEQ ID NO: 8300289 - DNA, 22 bp, Homo sapiens
atgtacatttgtagtaatatca

SEQ ID NO: 8300290 - DNA, 22 bp, Homo sapiens
gaggagctggcagcgtctccgc

SEQ ID NO: 8300291 - DNA, 22 bp, Homo sapiens
gaggcctggctgtcagtcccca

SEQ ID NO: 8300292 - DNA, 22 bp, Homo sapiens
gaggcctggctctgccctcctg

SEQ ID NO: 8300293 - DNA, 22 bp, Homo sapiens
gaggcctggctgggaggaggtg

SEQ ID NO: 8300294 - DNA, 22 bp, Homo sapiens
gaggcctggagccgcctaggcg

SEQ ID NO: 8300295 - DNA, 22 bp, Homo sapiens
gaggcctgggagcctgtcctcc

SEQ ID NO: 8300296 - DNA, 22 bp, Homo sapiens
atgtctttataaatgtataatg

SEQ ID NO: 8300297 - DNA, 22 bp, Homo sapiens
atgtctttcgcatcagtagcta

SEQ ID NO: 8300298 - DNA, 22 bp, Homo sapiens
atgtctttggctttgacatggc

SEQ ID NO: 8300299 - DNA, 22 bp, Homo sapiens
atgtctttctcacagccagttc

SEQ ID NO: 8300300 - DNA, 20 bp, Homo sapiens
gaggctgcggactgctggac

SEQ ID NO: 8300301 - DNA, 22 bp, Homo sapiens
gaggctgccccttcctcagctg

SEQ ID NO: 8300302 - DNA, 22 bp, Homo sapiens
gaggctgcggggaggagcctgc

SEQ ID NO: 8300303 - DNA, 22 bp, Homo sapiens
gaggctgcggggaggagcctgc

SEQ ID NO: 8300304 - DNA, 20 bp, Homo sapiens
gaggctgcggactgctggac

SEQ ID NO: 8300305 - DNA, 22 bp, Homo sapiens
gaggctgctgagagccctgttt

SEQ ID NO: 8300306 - DNA, 22 bp, Homo sapiens
atgtgtcaattttcaaatgctt

SEQ ID NO: 8300307 - DNA, 22 bp, Homo sapiens
atgtgtccacaggtgtgagaga

SEQ ID NO: 8300308 - DNA, 22 bp, Homo sapiens
gaggctgctgttagccctgggc

SEQ ID NO: 8300309 - DNA, 22 bp, Homo sapiens
gaggctgctttgatgacaggag

SEQ ID NO: 8300310 - DNA, 22 bp, Homo sapiens
cttgccttctgttcctatagaa

SEQ ID NO: 8300311 - DNA, 22 bp, Homo sapiens
cttgccttcttttcctatagaa

SEQ ID NO: 8300312 - DNA, 22 bp, Homo sapiens
atctaggatttgaatgcacagt

SEQ ID NO: 8300313 - DNA, 22 bp, Homo sapiens
cttgcctgtggctagttggctc

SEQ ID NO: 8300314 - DNA, 22 bp, Homo sapiens
atctagaaagtgttgaagatca

SEQ ID NO: 8300315 - DNA, 22 bp, Homo sapiens
atctagaagtggcatgaattac

SEQ ID NO: 8300316 - DNA, 22 bp, Homo sapiens
atctaggatttgaatgcacagt

SEQ ID NO: 8300317 - DNA, 22 bp, Homo sapiens
atctacaggctgaggtgggagg

SEQ ID NO: 8300318 - DNA, 22 bp, Homo sapiens
atctacagtgcacaggacagcc

SEQ ID NO: 8300319 - DNA, 22 bp, Homo sapiens
atctacaggattttacagagtt

SEQ ID NO: 8300320 - DNA, 22 bp, Homo sapiens
atctacagctgtctgcacagta

SEQ ID NO: 8300321 - DNA, 22 bp, Homo sapiens
cttggcctcttctcagggtggg

SEQ ID NO: 8300322 - DNA, 22 bp, Homo sapiens
cttggcagagggctgggctcag

SEQ ID NO: 8300323 - DNA, 22 bp, Homo sapiens
cttggcagatccaaaaatgaca

SEQ ID NO: 8300324 - DNA, 22 bp, Homo sapiens
cttggcagcttttggaggagcc

SEQ ID NO: 8300325 - DNA, 20 bp, Homo sapiens
cttggcctacttagctttgt

SEQ ID NO: 8300326 - DNA, 19 bp, Homo sapiens
cttggttatggtatgatgc

SEQ ID NO: 8300327 - DNA, 22 bp, Homo sapiens
atcttttttgtcttggtcactg

SEQ ID NO: 8300328 - DNA, 22 bp, Homo sapiens
atgaaaacggaccagagctatt

SEQ ID NO: 8300329 - DNA, 22 bp, Homo sapiens
atgaaaactttagcctcattag

SEQ ID NO: 8300330 - DNA, 22 bp, Homo sapiens
atctttttactaacactgctta

SEQ ID NO: 8300331 - DNA, 22 bp, Homo sapiens
atctttttatctgtttggaaca

SEQ ID NO: 8300332 - DNA, 22 bp, Homo sapiens
atctttttgacatggtgatggt

SEQ ID NO: 8300333 - DNA, 18 bp, Homo sapiens
cttgttcttctcttggcg

SEQ ID NO: 8300334 - DNA, 22 bp, Homo sapiens
atgaaacatgagaaatggagag

SEQ ID NO: 8300335 - DNA, 22 bp, Homo sapiens
cttgtggcccatggcttcctgc

SEQ ID NO: 8300336 - DNA, 22 bp, Homo sapiens
atgaaatatcttgaagaaattc

SEQ ID NO: 8300337 - DNA, 22 bp, Homo sapiens
atgcagcagtttacaaagcaat

SEQ ID NO: 8300338 - DNA, 22 bp, Homo sapiens
atgcatcatggaaaactcagtt

SEQ ID NO: 8300339 - DNA, 22 bp, Homo sapiens
atgcacttgcgtgtttgcaaat

SEQ ID NO: 8300340 - DNA, 22 bp, Homo sapiens
atgcagagacagatgtggcatg

SEQ ID NO: 8300341 - DNA, 22 bp, Homo sapiens
atgagcttcccagacaggatgg

SEQ ID NO: 8300342 - DNA, 22 bp, Homo sapiens
atgaagataagaccaggctgga

SEQ ID NO: 8300343 - DNA, 22 bp, Homo sapiens
atgagtaagaccataatttttg

SEQ ID NO: 8300344 - DNA, 22 bp, Homo sapiens
atgagtaaaaccactatttaca

SEQ ID NO: 8300345 - DNA, 22 bp, Homo sapiens
atgattcagcaattttatatct

SEQ ID NO: 8300346 - DNA, 22 bp, Homo sapiens
atgatacaagcaaaactaatca

SEQ ID NO: 8300347 - DNA, 22 bp, Homo sapiens
gcctgtctcttggaacttggta

SEQ ID NO: 8300348 - DNA, 22 bp, Homo sapiens
gcctgtctgcagggctgtcatt

SEQ ID NO: 8300349 - DNA, 22 bp, Homo sapiens
gcctgtcctggatgctctgcaa

SEQ ID NO: 8300350 - DNA, 20 bp, Homo sapiens
gcctgtcctgagtgtcatgg

SEQ ID NO: 8300351 - DNA, 22 bp, Homo sapiens
gcctgtgcatagcagcggactc

SEQ ID NO: 8300352 - DNA, 22 bp, Homo sapiens
gcctgtctgcgtcacgcttatt

SEQ ID NO: 8300353 - DNA, 22 bp, Homo sapiens
gcctgtgactcgtcttgggcca

SEQ ID NO: 8300354 - DNA, 22 bp, Homo sapiens
gcctgtccactaaacagccaag

SEQ ID NO: 8300355 - DNA, 22 bp, Homo sapiens
gcctgggagggcagcagtgtgg

SEQ ID NO: 8300356 - DNA, 18 bp, Homo sapiens
gcctgggaggaggaaatg

SEQ ID NO: 8300357 - DNA, 22 bp, Homo sapiens
gcctgggagtgcacagtgaggt

SEQ ID NO: 8300358 - DNA, 22 bp, Homo sapiens
caaaggcaacatatacttgttt

SEQ ID NO: 8300359 - DNA, 22 bp, Homo sapiens
caaaggtattctcattttggaa

SEQ ID NO: 8300360 - DNA, 22 bp, Homo sapiens
gctcaggatcccaggggtgtgc

SEQ ID NO: 8300361 - DNA, 22 bp, Homo sapiens
gctcaggatttcatccatgtgt

SEQ ID NO: 8300362 - DNA, 22 bp, Homo sapiens
gctcaggatcagccacctcttt

SEQ ID NO: 8300363 - DNA, 22 bp, Homo sapiens
gctcaggatcagccacctcttt

SEQ ID NO: 8300364 - DNA, 22 bp, Homo sapiens
gctcaggagctgacagcctcaa

SEQ ID NO: 8300365 - DNA, 22 bp, Homo sapiens
gctcaggagctcttggtggcgc

SEQ ID NO: 8300366 - DNA, 22 bp, Homo sapiens
gctcaggactggaggagcgggg

SEQ ID NO: 8300367 - DNA, 22 bp, Homo sapiens
gctcaggagctcttggtggcgc

SEQ ID NO: 8300368 - DNA, 22 bp, Homo sapiens
gctcaggaaacagcagggcttg

SEQ ID NO: 8300369 - DNA, 22 bp, Homo sapiens
gctcaggaaaacagtctagtaa

SEQ ID NO: 8300370 - DNA, 22 bp, Homo sapiens
gctcaggaaacagcagggcttg

SEQ ID NO: 8300371 - DNA, 22 bp, Homo sapiens
gctcaggaaatagtttagtgtt

SEQ ID NO: 8300372 - DNA, 22 bp, Homo sapiens
gctcaggaccgaggggtgggaa

SEQ ID NO: 8300373 - DNA, 22 bp, Homo sapiens
gctcaggacccaggtgtgacct

SEQ ID NO: 8300374 - DNA, 22 bp, Homo sapiens
gctcaggaaggctcaaccagga

SEQ ID NO: 8300375 - DNA, 22 bp, Homo sapiens
caaactgagcatcagaaagttt

SEQ ID NO: 8300376 - DNA, 22 bp, Homo sapiens
gcctgggagagggatagtgcag

SEQ ID NO: 8300377 - DNA, 22 bp, Homo sapiens
gcctggagctctccacttgggg

SEQ ID NO: 8300378 - DNA, 22 bp, Homo sapiens
gcctggagctcatgtgggcatt

SEQ ID NO: 8300379 - DNA, 22 bp, Homo sapiens
gcctggagctcatgtgggcatt

SEQ ID NO: 8300380 - DNA, 22 bp, Homo sapiens
gcctgctggctgtccattgcag

SEQ ID NO: 8300381 - DNA, 22 bp, Homo sapiens
gcctggagctactggacactga

SEQ ID NO: 8300382 - DNA, 22 bp, Homo sapiens
gcctggagctcggctgagggcg

SEQ ID NO: 8300383 - DNA, 22 bp, Homo sapiens
gcctggagctcggctgagggcg

SEQ ID NO: 8300384 - DNA, 22 bp, Homo sapiens
gcctggagctcggctgagggcg

SEQ ID NO: 8300385 - DNA, 22 bp, Homo sapiens
gcctgctggatgtggccaggcc

SEQ ID NO: 8300386 - DNA, 18 bp, Homo sapiens
gcctgcctagagcttgcc

SEQ ID NO: 8300387 - DNA, 18 bp, Homo sapiens
gcctgcctagagcttgcc

SEQ ID NO: 8300388 - DNA, 22 bp, Homo sapiens
gcctctctctacccagtatgat

SEQ ID NO: 8300389 - DNA, 22 bp, Homo sapiens
gcctcactgcagccccaggaag

SEQ ID NO: 8300390 - DNA, 22 bp, Homo sapiens
atttagaaattccaaaagtatt

SEQ ID NO: 8300391 - DNA, 19 bp, Homo sapiens
atttactgcctaaaatctc

SEQ ID NO: 8300392 - DNA, 19 bp, Homo sapiens
gccaggagggctctggctg

SEQ ID NO: 8300393 - DNA, 19 bp, Homo sapiens
gccaggagggctctggctg

SEQ ID NO: 8300394 - DNA, 22 bp, Homo sapiens
gccaggcatttgttaggtgctg

SEQ ID NO: 8300395 - DNA, 22 bp, Homo sapiens
gccaggcattctagaagtagtg

SEQ ID NO: 8300396 - DNA, 22 bp, Homo sapiens
gccaggcctgcaagtgctggtg

SEQ ID NO: 8300397 - DNA, 22 bp, Homo sapiens
atttcagcccagtatgagcccc

SEQ ID NO: 8300398 - DNA, 22 bp, Homo sapiens
atttcctagcctctcttgcagt

SEQ ID NO: 8300399 - DNA, 22 bp, Homo sapiens
atgttttatattttgcagcagt

SEQ ID NO: 8300400 - DNA, 22 bp, Homo sapiens
gatgagggcctggtggctgtgc

SEQ ID NO: 8300401 - DNA, 22 bp, Homo sapiens
gatgaggggtcattggctggga

SEQ ID NO: 8300402 - DNA, 22 bp, Homo sapiens
attaaaagcttcccaagagtta

SEQ ID NO: 8300403 - DNA, 22 bp, Homo sapiens
gatgatggacaaagcattggtg

SEQ ID NO: 8300404 - DNA, 22 bp, Homo sapiens
gcaaggctgagcacatttgcat

SEQ ID NO: 8300405 - DNA, 22 bp, Homo sapiens
gcaaggctgtgcactttgcatt

SEQ ID NO: 8300406 - DNA, 22 bp, Homo sapiens
gcaaggctgctgccacccatct

SEQ ID NO: 8300407 - DNA, 17 bp, Homo sapiens
gcaagggatgggagatt

SEQ ID NO: 8300408 - DNA, 22 bp, Homo sapiens
gcaaggctttgtgaattttaaa

SEQ ID NO: 8300409 - DNA, 21 bp, Homo sapiens
gcaaggcttttgtgtttccca

SEQ ID NO: 8300410 - DNA, 22 bp, Homo sapiens
attcttcactgtttcagaatga

SEQ ID NO: 8300411 - DNA, 22 bp, Homo sapiens
attctgtctttttaaaataata

SEQ ID NO: 8300412 - DNA, 22 bp, Homo sapiens
attctcaaacaagtggtttgat

SEQ ID NO: 8300413 - DNA, 22 bp, Homo sapiens
attctagatgctgtaagtagca

SEQ ID NO: 8300414 - DNA, 22 bp, Homo sapiens
attctaggcttgaaacatgaag

SEQ ID NO: 8300415 - DNA, 22 bp, Homo sapiens
attgaatagatgcattatacta

SEQ ID NO: 8300416 - DNA, 22 bp, Homo sapiens
attgacaaatggatgttgacat

SEQ ID NO: 8300417 - DNA, 22 bp, Homo sapiens
attgacaatctactatgttctg

SEQ ID NO: 8300418 - DNA, 22 bp, Homo sapiens
attgacaagtgagctgggctgc

SEQ ID NO: 8300419 - DNA, 22 bp, Homo sapiens
attgacaaggaaactataccag

SEQ ID NO: 8300420 - DNA, 22 bp, Homo sapiens
attgacaagacaatggctctta

SEQ ID NO: 8300421 - DNA, 22 bp, Homo sapiens
attgacaagcagtatgtcttag

SEQ ID NO: 8300422 - DNA, 22 bp, Homo sapiens
attgacaattagcccttaggtg

SEQ ID NO: 8300423 - DNA, 22 bp, Homo sapiens
attgacaatgtatttgtatctg

SEQ ID NO: 8300424 - DNA, 22 bp, Homo sapiens
gcagagctgtctaagtcacttc

SEQ ID NO: 8300425 - DNA, 20 bp, Homo sapiens
gcagagctgttctgtgggga

SEQ ID NO: 8300426 - DNA, 22 bp, Homo sapiens
gcagagctgttaatggagctga

SEQ ID NO: 8300427 - DNA, 22 bp, Homo sapiens
gcagagctgggtctgtatccaa

SEQ ID NO: 8300428 - DNA, 23 bp, Homo sapiens
gcagagctgccctattgccttgg

SEQ ID NO: 8300429 - DNA, 22 bp, Homo sapiens
attcagttaaaaactgtacttc

SEQ ID NO: 8300430 - DNA, 22 bp, Homo sapiens
gcagcaggcttttcataccttg

SEQ ID NO: 8300431 - DNA, 22 bp, Homo sapiens
attccctttgacgatccctagg

SEQ ID NO: 8300432 - DNA, 22 bp, Homo sapiens
gcagagcttctgtccttcagga

SEQ ID NO: 8300433 - DNA, 19 bp, Homo sapiens
attcctcaaggacagaaat

SEQ ID NO: 8300434 - DNA, 22 bp, Homo sapiens
tcagctgagttctagagcactc

SEQ ID NO: 8300435 - DNA, 22 bp, Homo sapiens
tcagctgagctccagctcatag

SEQ ID NO: 8300436 - DNA, 22 bp, Homo sapiens
tcagctgaagtggagaagcaga

SEQ ID NO: 8300437 - DNA, 22 bp, Homo sapiens
catactttgggataagagtgga

SEQ ID NO: 8300438 - DNA, 22 bp, Homo sapiens
catacttttgccctgacattct

SEQ ID NO: 8300439 - DNA, 22 bp, Homo sapiens
catacattttgcatatttacca

SEQ ID NO: 8300440 - DNA, 22 bp, Homo sapiens
catacctttctcaagcacatgt

SEQ ID NO: 8300441 - DNA, 22 bp, Homo sapiens
catacattgctcattcagtatc

SEQ ID NO: 8300442 - DNA, 22 bp, Homo sapiens
cagtttcttatcttcaaaattg

SEQ ID NO: 8300443 - DNA, 22 bp, Homo sapiens
cagtttctgttttaaatagcag

SEQ ID NO: 8300444 - DNA, 22 bp, Homo sapiens
cagtttcttcatcagttaagca

SEQ ID NO: 8300445 - DNA, 22 bp, Homo sapiens
tcagcagtgcagggtgaggcag

SEQ ID NO: 8300446 - DNA, 22 bp, Homo sapiens
tcagcagtggctctcatgcagt

SEQ ID NO: 8300447 - DNA, 22 bp, Homo sapiens
cagtttctgggcgttcacaggt

SEQ ID NO: 8300448 - DNA, 22 bp, Homo sapiens
catccaggctgaagtgcagtgg

SEQ ID NO: 8300449 - DNA, 22 bp, Homo sapiens
tcagggcatggctgcacttggc

SEQ ID NO: 8300450 - DNA, 22 bp, Homo sapiens
tcagggcattcaagaggcctgg

SEQ ID NO: 8300451 - DNA, 22 bp, Homo sapiens
tcagggcatgtatgtttcttta

SEQ ID NO: 8300452 - DNA, 20 bp, Homo sapiens
tcagggcatgggacagcccc

SEQ ID NO: 8300453 - DNA, 22 bp, Homo sapiens
catcacagatgttgtgtggagt

SEQ ID NO: 8300454 - DNA, 22 bp, Homo sapiens
catataaatacaacatgtgtta

SEQ ID NO: 8300455 - DNA, 22 bp, Homo sapiens
catatcccattggccaggacat

SEQ ID NO: 8300456 - DNA, 22 bp, Homo sapiens
tcatgtaagtatagaaagcagt

SEQ ID NO: 8300457 - DNA, 22 bp, Homo sapiens
tcatgtcagtttcttctataaa

SEQ ID NO: 8300458 - DNA, 22 bp, Homo sapiens
tcaggtgggacctgctaggaca

SEQ ID NO: 8300459 - DNA, 22 bp, Homo sapiens
tcaggtggtcctaagtgccatc

SEQ ID NO: 8300460 - DNA, 22 bp, Homo sapiens
tcaggtggcttcggggagtggc

SEQ ID NO: 8300461 - DNA, 22 bp, Homo sapiens
catccctggttcctgtgtttaa

SEQ ID NO: 8300462 - DNA, 22 bp, Homo sapiens
catccccagagcagttccacta

SEQ ID NO: 8300463 - DNA, 22 bp, Homo sapiens
catccccaattagcgcccagct

SEQ ID NO: 8300464 - DNA, 22 bp, Homo sapiens
catgtctgggtatatgcatatg

SEQ ID NO: 8300465 - DNA, 22 bp, Homo sapiens
catgtctgtgtacacatgcaca

SEQ ID NO: 8300466 - DNA, 18 bp, Homo sapiens
catgtctgcgccacaagg

SEQ ID NO: 8300467 - DNA, 22 bp, Homo sapiens
tccagccatgcatgacaatcac

SEQ ID NO: 8300468 - DNA, 22 bp, Homo sapiens
tccagccatgactcggacagtg

SEQ ID NO: 8300469 - DNA, 22 bp, Homo sapiens
catgggagctatctccatcact

SEQ ID NO: 8300470 - DNA, 22 bp, Homo sapiens
catgcacaacatactcaagagg

SEQ ID NO: 8300471 - DNA, 22 bp, Homo sapiens
catgcacaaaggtaagatgcgt

SEQ ID NO: 8300472 - DNA, 22 bp, Homo sapiens
tatgtttttcaagtgcacacta

SEQ ID NO: 8300473 - DNA, 22 bp, Homo sapiens
tatgtgtacatctggttgagca

SEQ ID NO: 8300474 - DNA, 22 bp, Homo sapiens
tatgtgtaggaggaggacaggg

SEQ ID NO: 8300475 - DNA, 22 bp, Homo sapiens
tatgtacatgttaaagggcaaa

SEQ ID NO: 8300476 - DNA, 22 bp, Homo sapiens
tatgcacacctgggtccttgtc

SEQ ID NO: 8300477 - DNA, 22 bp, Homo sapiens
tatgcacagaagtttgctgaat

SEQ ID NO: 8300478 - DNA, 22 bp, Homo sapiens
tatgcacacatgtatgcatgtg

SEQ ID NO: 8300479 - DNA, 22 bp, Homo sapiens
tatgcacacattagcacagggt

SEQ ID NO: 8300480 - DNA, 22 bp, Homo sapiens
tatgcacagttacaagaatatc

SEQ ID NO: 8300481 - DNA, 22 bp, Homo sapiens
tataagaaacaaggcaaatttt

SEQ ID NO: 8300482 - DNA, 22 bp, Homo sapiens
tataatccattcattgatttct

SEQ ID NO: 8300483 - DNA, 22 bp, Homo sapiens
cagggtcttataaggccaattt

SEQ ID NO: 8300484 - DNA, 22 bp, Homo sapiens
cagggtggaagctgtagagtgg

SEQ ID NO: 8300485 - DNA, 22 bp, Homo sapiens
cagggtggaaaagctagttgga

SEQ ID NO: 8300486 - DNA, 22 bp, Homo sapiens
caggggcagtctgtgtgcgtgg

SEQ ID NO: 8300487 - DNA, 22 bp, Homo sapiens
caggggcaggtgtgagatcatc

SEQ ID NO: 8300488 - DNA, 22 bp, Homo sapiens
caggggccaggctgtctgctgt

SEQ ID NO: 8300489 - DNA, 22 bp, Homo sapiens
caggggccggctgtccgtgccc

SEQ ID NO: 8300490 - DNA, 22 bp, Homo sapiens
tatctattccaaatatcagcgt

SEQ ID NO: 8300491 - DNA, 22 bp, Homo sapiens
cagggtggaatggaatgctggc

SEQ ID NO: 8300492 - DNA, 22 bp, Homo sapiens
tcaccaggctggaatgcagtgg

SEQ ID NO: 8300493 - DNA, 22 bp, Homo sapiens
tcaccaggctggagtgcagtgg

SEQ ID NO: 8300494 - DNA, 22 bp, Homo sapiens
tcaccaggctagagtgcagtgg

SEQ ID NO: 8300495 - DNA, 22 bp, Homo sapiens
tcaccagtctttcttaccattg

SEQ ID NO: 8300496 - DNA, 22 bp, Homo sapiens
tcagaaattttctcagtagttc

SEQ ID NO: 8300497 - DNA, 21 bp, Homo sapiens
tcagaacaattccatgcctcc

SEQ ID NO: 8300498 - DNA, 22 bp, Homo sapiens
tcagaagctggtgtcctttgaa

SEQ ID NO: 8300499 - DNA, 22 bp, Homo sapiens
tcagaaatactatcagcttttg

SEQ ID NO: 8300500 - DNA, 22 bp, Homo sapiens
tcagaaatgatcgttattcatt

SEQ ID NO: 8300501 - DNA, 22 bp, Homo sapiens
tcagaaatgtaagctgatgact

SEQ ID NO: 8300502 - DNA, 22 bp, Homo sapiens
tcagaaatagtctttaaaatga

SEQ ID NO: 8300503 - DNA, 17 bp, Homo sapiens
cagtgcagagccctttc

SEQ ID NO: 8300504 - DNA, 22 bp, Homo sapiens
cagtgcagaacacatggaaaat

SEQ ID NO: 8300505 - DNA, 22 bp, Homo sapiens
tatttagaacagacaatagaaa

SEQ ID NO: 8300506 - DNA, 20 bp, Homo sapiens
tatttagattcaagtatgga

SEQ ID NO: 8300507 - DNA, 22 bp, Homo sapiens
cagtcctggggaccaggctgag

SEQ ID NO: 8300508 - DNA, 22 bp, Homo sapiens
ccagctggtctgtgctcatgtt

SEQ ID NO: 8300509 - DNA, 22 bp, Homo sapiens
ccagctggtctgtgctcatgtt

SEQ ID NO: 8300510 - DNA, 22 bp, Homo sapiens
ccagctggtgacatccccaacc

SEQ ID NO: 8300511 - DNA, 22 bp, Homo sapiens
ccagctggtgggtctttctctg

SEQ ID NO: 8300512 - DNA, 22 bp, Homo sapiens
tctggagccttggatgggaaag

SEQ ID NO: 8300513 - DNA, 19 bp, Homo sapiens
tctggagctgatgcaggtg

SEQ ID NO: 8300514 - DNA, 22 bp, Homo sapiens
tctggagcgaggtccctgtctg

SEQ ID NO: 8300515 - DNA, 22 bp, Homo sapiens
ccagctggtgttccttaggacc

SEQ ID NO: 8300516 - DNA, 22 bp, Homo sapiens
ccagctggttaaaatagagaaa

SEQ ID NO: 8300517 - DNA, 22 bp, Homo sapiens
ccagctgcttgggaaaatgtct

SEQ ID NO: 8300518 - DNA, 22 bp, Homo sapiens
ccagctgggattaagggaaaat

SEQ ID NO: 8300519 - DNA, 22 bp, Homo sapiens
tctgcctgaaattcacatgtaa

SEQ ID NO: 8300520 - DNA, 22 bp, Homo sapiens
tctgccttggcaaccacagctt

SEQ ID NO: 8300521 - DNA, 22 bp, Homo sapiens
tctgcctgagaagtggggtgcc

SEQ ID NO: 8300522 - DNA, 22 bp, Homo sapiens
tctgcctgaaccactcttggag

SEQ ID NO: 8300523 - DNA, 22 bp, Homo sapiens
tctgccttttcactgccactaa

SEQ ID NO: 8300524 - DNA, 22 bp, Homo sapiens
tctgcgctgccttgatccttgg

SEQ ID NO: 8300525 - DNA, 22 bp, Homo sapiens
tctgcgtccatctgcctgcttg

SEQ ID NO: 8300526 - DNA, 22 bp, Homo sapiens
tctggctcataggaaggccatt

SEQ ID NO: 8300527 - DNA, 22 bp, Homo sapiens
tctggctcatctctccaggtaa

SEQ ID NO: 8300528 - DNA, 22 bp, Homo sapiens
tctggagctggagggcaaggca

SEQ ID NO: 8300529 - DNA, 22 bp, Homo sapiens
tctggagctggcagggccctgg

SEQ ID NO: 8300530 - DNA, 22 bp, Homo sapiens
tctggagcttcctcatttacag

SEQ ID NO: 8300531 - DNA, 22 bp, Homo sapiens
tctggagcttgtttcagatggt

SEQ ID NO: 8300532 - DNA, 22 bp, Homo sapiens
tctggctcatacaagcctgcaa

SEQ ID NO: 8300533 - DNA, 22 bp, Homo sapiens
tctgtggcacgattgcactgca

SEQ ID NO: 8300534 - DNA, 22 bp, Homo sapiens
tctgtggattttagtgttcatg

SEQ ID NO: 8300535 - DNA, 22 bp, Homo sapiens
tctgtcttggccagccatctgg

SEQ ID NO: 8300536 - DNA, 22 bp, Homo sapiens
tctgtcttagcatctttgctca

SEQ ID NO: 8300537 - DNA, 18 bp, Homo sapiens
tctgtctgtacaagtatc

SEQ ID NO: 8300538 - DNA, 21 bp, Homo sapiens
tctgtctggttttagagtggc

SEQ ID NO: 8300539 - DNA, 22 bp, Homo sapiens
tctgtcaggagattggcagctg

SEQ ID NO: 8300540 - DNA, 22 bp, Homo sapiens
tctgtcacttttatttactgaa

SEQ ID NO: 8300541 - DNA, 22 bp, Homo sapiens
tctgtcacttattaagatggat

SEQ ID NO: 8300542 - DNA, 23 bp, Homo sapiens
tctgtcactttctgctgtggagt

SEQ ID NO: 8300543 - DNA, 19 bp, Homo sapiens
tctgtcactgggggtattc

SEQ ID NO: 8300544 - DNA, 22 bp, Homo sapiens
tctgtcacccgagcaggcgaga

SEQ ID NO: 8300545 - DNA, 22 bp, Homo sapiens
tctgtcaccgagggcatccaaa

SEQ ID NO: 8300546 - DNA, 22 bp, Homo sapiens
tctgtcactgagctcaggattc

SEQ ID NO: 8300547 - DNA, 22 bp, Homo sapiens
tctgtcactctagagatggcag

SEQ ID NO: 8300548 - DNA, 22 bp, Homo sapiens
tctgtcactccctgatgatgaa

SEQ ID NO: 8300549 - DNA, 22 bp, Homo sapiens
tctgtcactattggccagaaca

SEQ ID NO: 8300550 - DNA, 23 bp, Homo sapiens
tctgtcacctatggctgctcttc

SEQ ID NO: 8300551 - DNA, 22 bp, Homo sapiens
ccaggaggcggaggttgcagcg

SEQ ID NO: 8300552 - DNA, 22 bp, Homo sapiens
ccaggaggcggaaggtacagtg

SEQ ID NO: 8300553 - DNA, 22 bp, Homo sapiens
ccaggaggcggaaggtacagtg

SEQ ID NO: 8300554 - DNA, 22 bp, Homo sapiens
ccaggaggcagaggttacagtg

SEQ ID NO: 8300555 - DNA, 22 bp, Homo sapiens
ccaggaggcagaagttgcagtg

SEQ ID NO: 8300556 - DNA, 22 bp, Homo sapiens
ccaggaggcagaagttgcagtg

SEQ ID NO: 8300557 - DNA, 22 bp, Homo sapiens
ccaggaagcggtgagggctgcc

SEQ ID NO: 8300558 - DNA, 22 bp, Homo sapiens
ccaggaagcctcagatgctgag

SEQ ID NO: 8300559 - DNA, 22 bp, Homo sapiens
ccagccagtccagcattggtgt

SEQ ID NO: 8300560 - DNA, 22 bp, Homo sapiens
ccagccagtcccgcatgaccgc

SEQ ID NO: 8300561 - DNA, 18 bp, Homo sapiens
tctcttgcatcttctgta

SEQ ID NO: 8300562 - DNA, 22 bp, Homo sapiens
tctctcttgaagtattagctag

SEQ ID NO: 8300563 - DNA, 22 bp, Homo sapiens
tctctcttcatgcttttagaat

SEQ ID NO: 8300564 - DNA, 22 bp, Homo sapiens
tctctcttcaacccttaactag

SEQ ID NO: 8300565 - DNA, 22 bp, Homo sapiens
tctctctgtgacagctttgctg

SEQ ID NO: 8300566 - DNA, 22 bp, Homo sapiens
ccagccctcactgaggcctctc

SEQ ID NO: 8300567 - DNA, 22 bp, Homo sapiens
ccagccctcactgaggcctctc

SEQ ID NO: 8300568 - DNA, 22 bp, Homo sapiens
tctgagagtctctgaggcagat

SEQ ID NO: 8300569 - DNA, 22 bp, Homo sapiens
tctgaggcccctgggcaggatg

SEQ ID NO: 8300570 - DNA, 22 bp, Homo sapiens
tctgaggcataacctgttctgc

SEQ ID NO: 8300571 - DNA, 22 bp, Homo sapiens
tctgaggcatacccaggccccc

SEQ ID NO: 8300572 - DNA, 22 bp, Homo sapiens
tctgaggcatacccaggccccc

SEQ ID NO: 8300573 - DNA, 22 bp, Homo sapiens
ccagctccttctgtctgtggag

SEQ ID NO: 8300574 - DNA, 22 bp, Homo sapiens
ccagctcctgggtcttagtcag

SEQ ID NO: 8300575 - DNA, 22 bp, Homo sapiens
ccagctctagccccatgtggct

SEQ ID NO: 8300576 - DNA, 22 bp, Homo sapiens
ccagctcctcttcccagtgtca

SEQ ID NO: 8300577 - DNA, 21 bp, Homo sapiens
ccagctccaggaccttggatc

SEQ ID NO: 8300578 - DNA, 22 bp, Homo sapiens
ccagctccaggactgggagctg

SEQ ID NO: 8300579 - DNA, 22 bp, Homo sapiens
tctgccagaagttctgagagta

SEQ ID NO: 8300580 - DNA, 22 bp, Homo sapiens
ccagccttctgagctgcctgga

SEQ ID NO: 8300581 - DNA, 22 bp, Homo sapiens
ccagcctggttcagaattggct

SEQ ID NO: 8300582 - DNA, 22 bp, Homo sapiens
ccagcctgggtgttagaagaca

SEQ ID NO: 8300583 - DNA, 22 bp, Homo sapiens
ccagctccaagtttgggcatca

SEQ ID NO: 8300584 - DNA, 22 bp, Homo sapiens
ccagcgcttcccatcagggagg

SEQ ID NO: 8300585 - DNA, 22 bp, Homo sapiens
ccagcctggagggcagtggtgg

SEQ ID NO: 8300586 - DNA, 22 bp, Homo sapiens
ccagcctggagggcagtggtgg

SEQ ID NO: 8300587 - DNA, 22 bp, Homo sapiens
ccagaggtgccacagaaagagc

SEQ ID NO: 8300588 - DNA, 21 bp, Homo sapiens
tctctacactttcactaggct

SEQ ID NO: 8300589 - DNA, 23 bp, Homo sapiens
tctccagtgtctcttcattgagt

SEQ ID NO: 8300590 - DNA, 22 bp, Homo sapiens
tctcccacagtctcccatggct

SEQ ID NO: 8300591 - DNA, 22 bp, Homo sapiens
tctcccacagccgtgcttcaag

SEQ ID NO: 8300592 - DNA, 20 bp, Homo sapiens
ccagacagcacctgcctggt

SEQ ID NO: 8300593 - DNA, 22 bp, Homo sapiens
ccagagcctgctgagccccatt

SEQ ID NO: 8300594 - DNA, 22 bp, Homo sapiens
ccagagctgattcctgggactt

SEQ ID NO: 8300595 - DNA, 22 bp, Homo sapiens
ccagagctgcatccagcaggtt

SEQ ID NO: 8300596 - DNA, 22 bp, Homo sapiens
ccagagcttcggggcggctgta

SEQ ID NO: 8300597 - DNA, 18 bp, Homo sapiens
ccagagctggctcctcgc

SEQ ID NO: 8300598 - DNA, 22 bp, Homo sapiens
ccagaagggctattgcagtgac

SEQ ID NO: 8300599 - DNA, 22 bp, Homo sapiens
ccagaagtcaggaatgagtctt

SEQ ID NO: 8300600 - DNA, 22 bp, Homo sapiens
ccacagggtcagccactctgca

SEQ ID NO: 8300601 - DNA, 22 bp, Homo sapiens
ccacagggtgtcatcagcttga

SEQ ID NO: 8300602 - DNA, 22 bp, Homo sapiens
ccactgaaggtcaacatagagc

SEQ ID NO: 8300603 - DNA, 22 bp, Homo sapiens
ccactctgattttggctccact

SEQ ID NO: 8300604 - DNA, 22 bp, Homo sapiens
ccactctgctgtgctccatgat

SEQ ID NO: 8300605 - DNA, 22 bp, Homo sapiens
ccacacagggggatgagttatt

SEQ ID NO: 8300606 - DNA, 22 bp, Homo sapiens
ccacaagtttcagcacccagag

SEQ ID NO: 8300607 - DNA, 22 bp, Homo sapiens
ccaaatgctccactgactttgg

SEQ ID NO: 8300608 - DNA, 23 bp, Homo sapiens
tcctcccaaatttcagcctcatt

SEQ ID NO: 8300609 - DNA, 23 bp, Homo sapiens
tcctcccaaatttcagcctcatt

SEQ ID NO: 8300610 - DNA, 22 bp, Homo sapiens
ccaaagtgctggggttacaggc

SEQ ID NO: 8300611 - DNA, 22 bp, Homo sapiens
tcctccccaaagcccagcctgg

SEQ ID NO: 8300612 - DNA, 22 bp, Homo sapiens
tcctcccacataggacaatggg

SEQ ID NO: 8300613 - DNA, 20 bp, Homo sapiens
tcctgcagttcctaggaggg

SEQ ID NO: 8300614 - DNA, 23 bp, Homo sapiens
ccacagagctgccaattcctgtg

SEQ ID NO: 8300615 - DNA, 22 bp, Homo sapiens
ccacagaggacaactgcctggc

SEQ ID NO: 8300616 - DNA, 22 bp, Homo sapiens
ccacagcatgcaggcctgacac

SEQ ID NO: 8300617 - DNA, 22 bp, Homo sapiens
ccacagagttacaaaacagtca

SEQ ID NO: 8300618 - DNA, 22 bp, Homo sapiens
ccacagccattccagggaggct

SEQ ID NO: 8300619 - DNA, 22 bp, Homo sapiens
ccaaagtgctaggattacaggc

SEQ ID NO: 8300620 - DNA, 23 bp, Homo sapiens
ccaaagtcgaagtctagtccaga

SEQ ID NO: 8300621 - DNA, 22 bp, Homo sapiens
ccaaagtcctttctccacctgc

SEQ ID NO: 8300622 - DNA, 22 bp, Homo sapiens
ccaaagtccatagtttacttta

SEQ ID NO: 8300623 - DNA, 22 bp, Homo sapiens
ccaaagtctgcattttaacatg

SEQ ID NO: 8300624 - DNA, 22 bp, Homo sapiens
ccaaagtctggagcagcagagc

SEQ ID NO: 8300625 - DNA, 22 bp, Homo sapiens
ccaaagtgctaggattacaggt

SEQ ID NO: 8300626 - DNA, 22 bp, Homo sapiens
ccaaagtgctgagattacaggt

SEQ ID NO: 8300627 - DNA, 22 bp, Homo sapiens
ccaaagtgctgggattacaggc

SEQ ID NO: 8300628 - DNA, 22 bp, Homo sapiens
ccaaagtgctgggattacaggt

SEQ ID NO: 8300629 - DNA, 22 bp, Homo sapiens
ccaaagtcagtgctcagtcgtc

SEQ ID NO: 8300630 - DNA, 22 bp, Homo sapiens
ccaaagtccatagtttacataa

SEQ ID NO: 8300631 - DNA, 22 bp, Homo sapiens
ccaaagtccatagtttacatta

SEQ ID NO: 8300632 - DNA, 22 bp, Homo sapiens
ccaaagtccacagtttacatta

SEQ ID NO: 8300633 - DNA, 22 bp, Homo sapiens
tccctgctcagctcacctggca

SEQ ID NO: 8300634 - DNA, 22 bp, Homo sapiens
tccctgctgcactcacacctac

SEQ ID NO: 8300635 - DNA, 21 bp, Homo sapiens
tccctgctttctggcccagtc

SEQ ID NO: 8300636 - DNA, 22 bp, Homo sapiens
catttgatgactcaactcataa

SEQ ID NO: 8300637 - DNA, 22 bp, Homo sapiens
catttagacatttgatttgggg

SEQ ID NO: 8300638 - DNA, 22 bp, Homo sapiens
catttagagtcttgcaatttta

SEQ ID NO: 8300639 - DNA, 22 bp, Homo sapiens
catttagaaactgtttttaaca

SEQ ID NO: 8300640 - DNA, 21 bp, Homo sapiens
tcccagggccaggtgccatca

SEQ ID NO: 8300641 - DNA, 22 bp, Homo sapiens
tcccagggcagctgtccagaag

SEQ ID NO: 8300642 - DNA, 22 bp, Homo sapiens
tcccagggtcagtggtgaggcc

SEQ ID NO: 8300643 - DNA, 22 bp, Homo sapiens
cagcttcccttggctgagcaga

SEQ ID NO: 8300644 - DNA, 22 bp, Homo sapiens
cagcttccatctccactgccct

SEQ ID NO: 8300645 - DNA, 22 bp, Homo sapiens
cagctgtgctgtattaagctct

SEQ ID NO: 8300646 - DNA, 22 bp, Homo sapiens
gttacacaggaaaacattagca

SEQ ID NO: 8300647 - DNA, 22 bp, Homo sapiens
gttatgtatgggggccttatga

SEQ ID NO: 8300648 - DNA, 22 bp, Homo sapiens
gttatgtattgggaaatccaag

SEQ ID NO: 8300649 - DNA, 22 bp, Homo sapiens
cagcttctgagcaagccagggg

SEQ ID NO: 8300650 - DNA, 22 bp, Homo sapiens
cagcttctcagaaagctgaggt

SEQ ID NO: 8300651 - DNA, 22 bp, Homo sapiens
cagcttgggagtttggttttat

SEQ ID NO: 8300652 - DNA, 22 bp, Homo sapiens
cagcttggcttccgctttactg

SEQ ID NO: 8300653 - DNA, 22 bp, Homo sapiens
cagcttgggtcaggtgcctgct

SEQ ID NO: 8300654 - DNA, 22 bp, Homo sapiens
cagcttgggtcaggtgcctgct

SEQ ID NO: 8300655 - DNA, 20 bp, Homo sapiens
cagcttggatgagaggctga

SEQ ID NO: 8300656 - DNA, 20 bp, Homo sapiens
cagcttggatgagaggctga

SEQ ID NO: 8300657 - DNA, 22 bp, Homo sapiens
cagcttggaggaggatctaaga

SEQ ID NO: 8300658 - DNA, 22 bp, Homo sapiens
cagcttgctaattttgacttca

SEQ ID NO: 8300659 - DNA, 22 bp, Homo sapiens
caggaaagaaatgagaacacca

SEQ ID NO: 8300660 - DNA, 22 bp, Homo sapiens
caggaaagagctgccaggcagg

SEQ ID NO: 8300661 - DNA, 22 bp, Homo sapiens
cagctttgattctttctgccat

SEQ ID NO: 8300662 - DNA, 22 bp, Homo sapiens
gtttgcatttattagtcttctg

SEQ ID NO: 8300663 - DNA, 22 bp, Homo sapiens
gtttgcatttcttgaactatat

SEQ ID NO: 8300664 - DNA, 22 bp, Homo sapiens
caggaacaatgtaagtctcatt

SEQ ID NO: 8300665 - DNA, 22 bp, Homo sapiens
caggaacacaagttcagggatg

SEQ ID NO: 8300666 - DNA, 22 bp, Homo sapiens
caggaacacaatgagtctcaaa

SEQ ID NO: 8300667 - DNA, 22 bp, Homo sapiens
caggaacagcaccaggagctag

SEQ ID NO: 8300668 - DNA, 22 bp, Homo sapiens
caggaacatttaaccacagggt

SEQ ID NO: 8300669 - DNA, 22 bp, Homo sapiens
gttcctatatagccttaaggat

SEQ ID NO: 8300670 - DNA, 22 bp, Homo sapiens
gttcccatacagtatcagtgct

SEQ ID NO: 8300671 - DNA, 22 bp, Homo sapiens
gttggcctgaatggtcaagagg

SEQ ID NO: 8300672 - DNA, 22 bp, Homo sapiens
gttgggaagcagatggatgagc

SEQ ID NO: 8300673 - DNA, 22 bp, Homo sapiens
gttgggaaggcaagaagtagaa

SEQ ID NO: 8300674 - DNA, 22 bp, Homo sapiens
caggaaagggatgggctgccac

SEQ ID NO: 8300675 - DNA, 22 bp, Homo sapiens
caggaaaggtgtgtcatgatgg

SEQ ID NO: 8300676 - DNA, 22 bp, Homo sapiens
caggaaaggtagtcacaatgta

SEQ ID NO: 8300677 - DNA, 22 bp, Homo sapiens
gtggcaggtcccattggagcag

SEQ ID NO: 8300678 - DNA, 22 bp, Homo sapiens
gtggagccctgccttgctcatg

SEQ ID NO: 8300679 - DNA, 22 bp, Homo sapiens
gtggagccctgccttgctcatg

SEQ ID NO: 8300680 - DNA, 22 bp, Homo sapiens
cagcccaggccgacagttcctc

SEQ ID NO: 8300681 - DNA, 22 bp, Homo sapiens
gtggccaggccgactgccaggc

SEQ ID NO: 8300682 - DNA, 19 bp, Homo sapiens
gtggccagggcaggggctg

SEQ ID NO: 8300683 - DNA, 22 bp, Homo sapiens
cagctctgctgggaggatgcag

SEQ ID NO: 8300684 - DNA, 22 bp, Homo sapiens
cagctctggcgtcagggagcga

SEQ ID NO: 8300685 - DNA, 20 bp, Homo sapiens
cagctctgggaaagaggcca

SEQ ID NO: 8300686 - DNA, 22 bp, Homo sapiens
cagctctgtgcaggcctgggga

SEQ ID NO: 8300687 - DNA, 22 bp, Homo sapiens
cagctctgtgggagcgtatgtg

SEQ ID NO: 8300688 - DNA, 22 bp, Homo sapiens
gtggcttgaccatccctgctac

SEQ ID NO: 8300689 - DNA, 22 bp, Homo sapiens
gtggcttctggctgggcctcag

SEQ ID NO: 8300690 - DNA, 22 bp, Homo sapiens
gtggcctttcctgaagaaatga

SEQ ID NO: 8300691 - DNA, 22 bp, Homo sapiens
gtggcttctgcggtgtgcgcag

SEQ ID NO: 8300692 - DNA, 22 bp, Homo sapiens
gtgggactcttctttggcagtg

SEQ ID NO: 8300693 - DNA, 23 bp, Homo sapiens
cagctgaagcagcctgggctgga

SEQ ID NO: 8300694 - DNA, 22 bp, Homo sapiens
cagctgagctcccaggccatca

SEQ ID NO: 8300695 - DNA, 22 bp, Homo sapiens
cagctgagctcccaggccatca

SEQ ID NO: 8300696 - DNA, 22 bp, Homo sapiens
cagctgaggtcaaagaagcagg

SEQ ID NO: 8300697 - DNA, 22 bp, Homo sapiens
cagctgagtctgaggttctttg

SEQ ID NO: 8300698 - DNA, 22 bp, Homo sapiens
cagctgagttactctgaggtct

SEQ ID NO: 8300699 - DNA, 22 bp, Homo sapiens
cagctgagtttccaagtctgcc

SEQ ID NO: 8300700 - DNA, 22 bp, Homo sapiens
cagctgagtgttggcatgttca

SEQ ID NO: 8300701 - DNA, 20 bp, Homo sapiens
gtggcctgtcctgttgtggg

SEQ ID NO: 8300702 - DNA, 20 bp, Homo sapiens
gtggcctgtcctgttgtggg

SEQ ID NO: 8300703 - DNA, 22 bp, Homo sapiens
gtggcctgtcagaagccgtggg

SEQ ID NO: 8300704 - DNA, 22 bp, Homo sapiens
gtggcctgtcagaagccgtggg

SEQ ID NO: 8300705 - DNA, 22 bp, Homo sapiens
cagctgaacatgtagagcatct

SEQ ID NO: 8300706 - DNA, 22 bp, Homo sapiens
cagctgccaagaatcttttcta

SEQ ID NO: 8300707 - DNA, 22 bp, Homo sapiens
cagctgccacttgctctcggct

SEQ ID NO: 8300708 - DNA, 22 bp, Homo sapiens
cagctgccacacctctttctct

SEQ ID NO: 8300709 - DNA, 22 bp, Homo sapiens
cagctgccacaggactttctga

SEQ ID NO: 8300710 - DNA, 22 bp, Homo sapiens
cagctgcctgtattgtcctcat

SEQ ID NO: 8300711 - DNA, 20 bp, Homo sapiens
cagctgcctggctctgggat

SEQ ID NO: 8300712 - DNA, 22 bp, Homo sapiens
cagctgcctgcaacacaagctt

SEQ ID NO: 8300713 - DNA, 22 bp, Homo sapiens
cagctgcctatgacctagcctc

SEQ ID NO: 8300714 - DNA, 22 bp, Homo sapiens
cagctgccctgccttgccctta

SEQ ID NO: 8300715 - DNA, 22 bp, Homo sapiens
cagctgcccctccagggctggg

SEQ ID NO: 8300716 - DNA, 22 bp, Homo sapiens
gtggggcagtggcctgggagca

SEQ ID NO: 8300717 - DNA, 22 bp, Homo sapiens
gtggggatcactggggacaatc

SEQ ID NO: 8300718 - DNA, 19 bp, Homo sapiens
cagctgcaccgtgaccatc

SEQ ID NO: 8300719 - DNA, 22 bp, Homo sapiens
cagctgcaggaacaaaaatgtg

SEQ ID NO: 8300720 - DNA, 22 bp, Homo sapiens
gtgggtggatcacctgaggtca

SEQ ID NO: 8300721 - DNA, 22 bp, Homo sapiens
cagctggctccacctctgggct

SEQ ID NO: 8300722 - DNA, 22 bp, Homo sapiens
cagctggccctttggtagcctt

SEQ ID NO: 8300723 - DNA, 22 bp, Homo sapiens
cagctggcctgatccctgtggc

SEQ ID NO: 8300724 - DNA, 22 bp, Homo sapiens
cagctggcgggcagagccgcca

SEQ ID NO: 8300725 - DNA, 22 bp, Homo sapiens
cagctggcgtggagtgattgca

SEQ ID NO: 8300726 - DNA, 22 bp, Homo sapiens
cagctgccttctgcgggaagtc

SEQ ID NO: 8300727 - DNA, 19 bp, Homo sapiens
cagctgccttttctttgca

SEQ ID NO: 8300728 - DNA, 22 bp, Homo sapiens
cagctgcctgtctggaggcaat

SEQ ID NO: 8300729 - DNA, 22 bp, Homo sapiens
gtgtacatagaattgtgctttg

SEQ ID NO: 8300730 - DNA, 22 bp, Homo sapiens
gtgtacatgagaaatcaacttt

SEQ ID NO: 8300731 - DNA, 22 bp, Homo sapiens
gtgtacatattgagtctgctga

SEQ ID NO: 8300732 - DNA, 22 bp, Homo sapiens
gtgtatcaaagcacagacttca

SEQ ID NO: 8300733 - DNA, 22 bp, Homo sapiens
gtgtataactatctatctagta

SEQ ID NO: 8300734 - DNA, 20 bp, Homo sapiens
gtgtgaagccctcaggagga

SEQ ID NO: 8300735 - DNA, 22 bp, Homo sapiens
cagctgtctaagttgagcagga

SEQ ID NO: 8300736 - DNA, 22 bp, Homo sapiens
cagctgtctaagttgagcagga

SEQ ID NO: 8300737 - DNA, 22 bp, Homo sapiens
cagctgggagctccattagata

SEQ ID NO: 8300738 - DNA, 22 bp, Homo sapiens
cagctggggcagccacgtgcgg

SEQ ID NO: 8300739 - DNA, 22 bp, Homo sapiens
cagctggctggtcagtgcacaa

SEQ ID NO: 8300740 - DNA, 22 bp, Homo sapiens
taaagtcatctttacatctttg

SEQ ID NO: 8300741 - DNA, 22 bp, Homo sapiens
caggagctcagatgacatctca

SEQ ID NO: 8300742 - DNA, 22 bp, Homo sapiens
caggagctactcaggttgggtt

SEQ ID NO: 8300743 - DNA, 22 bp, Homo sapiens
caggagcccgttgctccggcgg

SEQ ID NO: 8300744 - DNA, 22 bp, Homo sapiens
caggagctctcatcgtcagggc

SEQ ID NO: 8300745 - DNA, 22 bp, Homo sapiens
caggagctcttaaggatgtgat

SEQ ID NO: 8300746 - DNA, 19 bp, Homo sapiens
caggagagcatgcactttg

SEQ ID NO: 8300747 - DNA, 22 bp, Homo sapiens
taaatgtgagtgatgcggtgaa

SEQ ID NO: 8300748 - DNA, 22 bp, Homo sapiens
taaatgtgaccttcattttata

SEQ ID NO: 8300749 - DNA, 21 bp, Homo sapiens
taaatgtgagcagggctgggc

SEQ ID NO: 8300750 - DNA, 22 bp, Homo sapiens
caggagctgggtctggaagcag

SEQ ID NO: 8300751 - DNA, 22 bp, Homo sapiens
taaatgtaccttctgccttact

SEQ ID NO: 8300752 - DNA, 22 bp, Homo sapiens
taaatgtataggcactaaacct

SEQ ID NO: 8300753 - DNA, 20 bp, Homo sapiens
caggaggcaaggtcaaggtc

SEQ ID NO: 8300754 - DNA, 22 bp, Homo sapiens
caggaggaacaagaggttctgg

SEQ ID NO: 8300755 - DNA, 22 bp, Homo sapiens
caggaggaaatgtgaccctgct

SEQ ID NO: 8300756 - DNA, 22 bp, Homo sapiens
caggaggcccaaagggcgcaga

SEQ ID NO: 8300757 - DNA, 22 bp, Homo sapiens
caggaggcatcatggagcggac

SEQ ID NO: 8300758 - DNA, 22 bp, Homo sapiens
caggaggccaactgtgggactt

SEQ ID NO: 8300759 - DNA, 22 bp, Homo sapiens
caggaggccaactgtgggactt

SEQ ID NO: 8300760 - DNA, 22 bp, Homo sapiens
caggaggctcctagggctctgt

SEQ ID NO: 8300761 - DNA, 22 bp, Homo sapiens
caggaggctcctagggctctgt

SEQ ID NO: 8300762 - DNA, 22 bp, Homo sapiens
caggagtgcaggtggtgaggca

SEQ ID NO: 8300763 - DNA, 22 bp, Homo sapiens
caggagtgaaatgaggcccagg

SEQ ID NO: 8300764 - DNA, 22 bp, Homo sapiens
caggagtgagttggggtctaca

SEQ ID NO: 8300765 - DNA, 22 bp, Homo sapiens
caggagtgagatgcgatcactt

SEQ ID NO: 8300766 - DNA, 22 bp, Homo sapiens
caggagtggtgtgagggactcc

SEQ ID NO: 8300767 - DNA, 22 bp, Homo sapiens
caggagtggtgtgagggactcc

SEQ ID NO: 8300768 - DNA, 22 bp, Homo sapiens
caggagtgtctccacacagcaa

SEQ ID NO: 8300769 - DNA, 22 bp, Homo sapiens
caggacagtataggctttagga

SEQ ID NO: 8300770 - DNA, 22 bp, Homo sapiens
caggacaggtgttctagatcag

SEQ ID NO: 8300771 - DNA, 22 bp, Homo sapiens
caggaatgactgcagatggggc

SEQ ID NO: 8300772 - DNA, 22 bp, Homo sapiens
gtttggggtctgcagagcggcg

SEQ ID NO: 8300773 - DNA, 22 bp, Homo sapiens
gttttccttctcagccattgcc

SEQ ID NO: 8300774 - DNA, 22 bp, Homo sapiens
caggacagtttgctttgccctg

SEQ ID NO: 8300775 - DNA, 22 bp, Homo sapiens
caggagaaggtttggagtgcag

SEQ ID NO: 8300776 - DNA, 22 bp, Homo sapiens
caggaccccatattcactgaac

SEQ ID NO: 8300777 - DNA, 22 bp, Homo sapiens
caggagacaagttagcagctga

SEQ ID NO: 8300778 - DNA, 22 bp, Homo sapiens
caggagacaatggctgtggggc

SEQ ID NO: 8300779 - DNA, 22 bp, Homo sapiens
caggagactatggcccaaggcc

SEQ ID NO: 8300780 - DNA, 22 bp, Homo sapiens
caggatcctggctgcatggacg

SEQ ID NO: 8300781 - DNA, 22 bp, Homo sapiens
caggatccctggcctccgccca

SEQ ID NO: 8300782 - DNA, 22 bp, Homo sapiens
caggatccccaggtcgccgtcc

SEQ ID NO: 8300783 - DNA, 18 bp, Homo sapiens
caggatgagtgatgggga

SEQ ID NO: 8300784 - DNA, 20 bp, Homo sapiens
taacagaagtagaagtgggt

SEQ ID NO: 8300785 - DNA, 22 bp, Homo sapiens
taacagaaatagtaggtgaggg

SEQ ID NO: 8300786 - DNA, 22 bp, Homo sapiens
taacagaaatatttccaggtga

SEQ ID NO: 8300787 - DNA, 22 bp, Homo sapiens
taacagaaattttagttagggg

SEQ ID NO: 8300788 - DNA, 22 bp, Homo sapiens
taacagaagagcaggcagccct

SEQ ID NO: 8300789 - DNA, 22 bp, Homo sapiens
taacagaagaaaacatattgga

SEQ ID NO: 8300790 - DNA, 22 bp, Homo sapiens
taacagaagatgaaacttcttt

SEQ ID NO: 8300791 - DNA, 22 bp, Homo sapiens
taacagaaatagaaatgagagt

SEQ ID NO: 8300792 - DNA, 22 bp, Homo sapiens
taacagaaaggggacagaaata

SEQ ID NO: 8300793 - DNA, 22 bp, Homo sapiens
taacagaaacagataagtgtaa

SEQ ID NO: 8300794 - DNA, 22 bp, Homo sapiens
taacagaaaggctcaggtgctc

SEQ ID NO: 8300795 - DNA, 22 bp, Homo sapiens
taacagaaaagaactgagtttg

SEQ ID NO: 8300796 - DNA, 22 bp, Homo sapiens
caggatgtgaggaggccatttg

SEQ ID NO: 8300797 - DNA, 22 bp, Homo sapiens
caggcacagagttattcattta

SEQ ID NO: 8300798 - DNA, 22 bp, Homo sapiens
caggcactagcagaatgaggct

SEQ ID NO: 8300799 - DNA, 22 bp, Homo sapiens
taaggcacccttctgagtagag

SEQ ID NO: 8300800 - DNA, 22 bp, Homo sapiens
taaggcacgcataagagggggc

SEQ ID NO: 8300801 - DNA, 22 bp, Homo sapiens
taaggcacctgtccaggctggg

SEQ ID NO: 8300802 - DNA, 22 bp, Homo sapiens
taaggcacctgtccaggctggg

SEQ ID NO: 8300803 - DNA, 22 bp, Homo sapiens
taaggcagaaatatgagcaggg

SEQ ID NO: 8300804 - DNA, 22 bp, Homo sapiens
taaggcacgcggtgaatgccaa

SEQ ID NO: 8300805 - DNA, 22 bp, Homo sapiens
taaggcacttcaatgtttagaa

SEQ ID NO: 8300806 - DNA, 22 bp, Homo sapiens
taaggcacgcggtgaatgccaa

SEQ ID NO: 8300807 - DNA, 22 bp, Homo sapiens
taaggcacccatgttcatacag

SEQ ID NO: 8300808 - DNA, 22 bp, Homo sapiens
taaggcaccataatatatttaa

SEQ ID NO: 8300809 - DNA, 22 bp, Homo sapiens
taaggcacccgtgagctgccag

SEQ ID NO: 8300810 - DNA, 22 bp, Homo sapiens
taaggcacccgtgagctgccag

SEQ ID NO: 8300811 - DNA, 22 bp, Homo sapiens
taaggcacacagttgctgcatg

SEQ ID NO: 8300812 - DNA, 22 bp, Homo sapiens
taaggcacacagttgctgcatg

SEQ ID NO: 8300813 - DNA, 22 bp, Homo sapiens
taagacacatgcgtacaagata

SEQ ID NO: 8300814 - DNA, 23 bp, Homo sapiens
caggcaggatgaggactacactc

SEQ ID NO: 8300815 - DNA, 22 bp, Homo sapiens
caggcaggagccagggattcca

SEQ ID NO: 8300816 - DNA, 22 bp, Homo sapiens
caggcagctgaggactttgcta

SEQ ID NO: 8300817 - DNA, 22 bp, Homo sapiens
caggcagctgctgggttcagcc

SEQ ID NO: 8300818 - DNA, 22 bp, Homo sapiens
caggcagctgctgggttcagcc

SEQ ID NO: 8300819 - DNA, 22 bp, Homo sapiens
caggcagctgggtcaccgtccc

SEQ ID NO: 8300820 - DNA, 22 bp, Homo sapiens
caggcagcctgagggatctggg

SEQ ID NO: 8300821 - DNA, 22 bp, Homo sapiens
caggcagccaggggacctgtcc

SEQ ID NO: 8300822 - DNA, 22 bp, Homo sapiens
caggcagctgactgtcagatat

SEQ ID NO: 8300823 - DNA, 22 bp, Homo sapiens
caggcagctgactgtcagatat

SEQ ID NO: 8300824 - DNA, 22 bp, Homo sapiens
caggcagcaggagccctgctcg

SEQ ID NO: 8300825 - DNA, 22 bp, Homo sapiens
caggcagcagccactctggtat

SEQ ID NO: 8300826 - DNA, 22 bp, Homo sapiens
caggcagcatcagtctgctgta

SEQ ID NO: 8300827 - DNA, 22 bp, Homo sapiens
caggcagcatcagtctgctgta

SEQ ID NO: 8300828 - DNA, 22 bp, Homo sapiens
caggcagcatttactctgatga

SEQ ID NO: 8300829 - DNA, 22 bp, Homo sapiens
taatttaattccatggattcta

SEQ ID NO: 8300830 - DNA, 22 bp, Homo sapiens
taatttaatccaagtgttacat

SEQ ID NO: 8300831 - DNA, 22 bp, Homo sapiens
taatttaatttcatgccagcct

SEQ ID NO: 8300832 - DNA, 22 bp, Homo sapiens
caggcagaagaagtggaaggac

SEQ ID NO: 8300833 - DNA, 22 bp, Homo sapiens
tacaggggtaacagtggggaat

SEQ ID NO: 8300834 - DNA, 22 bp, Homo sapiens
tacaaatgaccatagccactta

SEQ ID NO: 8300835 - DNA, 22 bp, Homo sapiens
tacaaatgagttgtatgaacca

SEQ ID NO: 8300836 - DNA, 22 bp, Homo sapiens
tacaaatgaaccaactttgatg

SEQ ID NO: 8300837 - DNA, 22 bp, Homo sapiens
tacagtaaccagtctacttaga

SEQ ID NO: 8300838 - DNA, 22 bp, Homo sapiens
tacagtaacatgttgtacaagc

SEQ ID NO: 8300839 - DNA, 22 bp, Homo sapiens
tacagtaaagctgctatgaatt

SEQ ID NO: 8300840 - DNA, 22 bp, Homo sapiens
caggccctgggcaggatcagcc

SEQ ID NO: 8300841 - DNA, 22 bp, Homo sapiens
tacatatttgtctttgtactgt

SEQ ID NO: 8300842 - DNA, 22 bp, Homo sapiens
tctgtggcctgtgtccaagtgc

SEQ ID NO: 8300843 - DNA, 22 bp, Homo sapiens
cccagcctgtgacagccgtcct

SEQ ID NO: 8300844 - DNA, 22 bp, Homo sapiens
cccagcctgtctttcccaatga

SEQ ID NO: 8300845 - DNA, 22 bp, Homo sapiens
cccagcctttgcttcctggttc

SEQ ID NO: 8300846 - DNA, 22 bp, Homo sapiens
cccagcctttgcttcctggttc

SEQ ID NO: 8300847 - DNA, 22 bp, Homo sapiens
cccagctacctctgctaggaga

SEQ ID NO: 8300848 - DNA, 22 bp, Homo sapiens
cccagctcaagcagagagctaa

SEQ ID NO: 8300849 - DNA, 23 bp, Homo sapiens
cccagcgctgagccctgcaggca

SEQ ID NO: 8300850 - DNA, 22 bp, Homo sapiens
cccagctccgagctccgagccg

SEQ ID NO: 8300851 - DNA, 22 bp, Homo sapiens
cccagctccttacagggccgaa

SEQ ID NO: 8300852 - DNA, 22 bp, Homo sapiens
cccagctccttacagggccgaa

SEQ ID NO: 8300853 - DNA, 23 bp, Homo sapiens
cccagctttcccactgccgagag

SEQ ID NO: 8300854 - DNA, 22 bp, Homo sapiens
cccagcttgcccaggactgagg

SEQ ID NO: 8300855 - DNA, 19 bp, Homo sapiens
cccagcttgaccacctgct

SEQ ID NO: 8300856 - DNA, 22 bp, Homo sapiens
cccagctcttttagcggcatct

SEQ ID NO: 8300857 - DNA, 17 bp, Homo sapiens
cccagctggcagtgccg

SEQ ID NO: 8300858 - DNA, 22 bp, Homo sapiens
cccagctgcacctctatggcct

SEQ ID NO: 8300859 - DNA, 22 bp, Homo sapiens
tgcattatgctacccagaagct

SEQ ID NO: 8300860 - DNA, 22 bp, Homo sapiens
tgcattatgcttgtgctgtata

SEQ ID NO: 8300861 - DNA, 22 bp, Homo sapiens
tgcattatttgcatgtgcctgt

SEQ ID NO: 8300862 - DNA, 22 bp, Homo sapiens
tgcattatacttttagaaattt

SEQ ID NO: 8300863 - DNA, 22 bp, Homo sapiens
tgcattataactgaatgttgtt

SEQ ID NO: 8300864 - DNA, 23 bp, Homo sapiens
tgcattatcctctctgaagacca

SEQ ID NO: 8300865 - DNA, 22 bp, Homo sapiens
tgcattatctttaatgttctca

SEQ ID NO: 8300866 - DNA, 22 bp, Homo sapiens
tgccaagggtatgggcaagata

SEQ ID NO: 8300867 - DNA, 22 bp, Homo sapiens
cccaggaggtggaggttgcagc

SEQ ID NO: 8300868 - DNA, 22 bp, Homo sapiens
cccaggaggtggaggttgcagt

SEQ ID NO: 8300869 - DNA, 22 bp, Homo sapiens
cccaggaggtggaggctgcagt

SEQ ID NO: 8300870 - DNA, 22 bp, Homo sapiens
tgccaggcctcaggagtctcca

SEQ ID NO: 8300871 - DNA, 22 bp, Homo sapiens
tgccaggcctcaggagtctcca

SEQ ID NO: 8300872 - DNA, 22 bp, Homo sapiens
cccaggaggttgaggctgcagt

SEQ ID NO: 8300873 - DNA, 22 bp, Homo sapiens
cccaggcagagagctggtgagc

SEQ ID NO: 8300874 - DNA, 22 bp, Homo sapiens
tgccaggcgtggtggtgcgcac

SEQ ID NO: 8300875 - DNA, 21 bp, Homo sapiens
tgccaggcctgagctggggtc

SEQ ID NO: 8300876 - DNA, 21 bp, Homo sapiens
tgccaggcctgagctggggtc

SEQ ID NO: 8300877 - DNA, 22 bp, Homo sapiens
cccaggcagggacgtgctctgg

SEQ ID NO: 8300878 - DNA, 22 bp, Homo sapiens
cccaggcagtctggctctaaag

SEQ ID NO: 8300879 - DNA, 22 bp, Homo sapiens
tgcctgggatctgtgccctttg

SEQ ID NO: 8300880 - DNA, 22 bp, Homo sapiens
tgcctgggcctctgaggaaggc

SEQ ID NO: 8300881 - DNA, 22 bp, Homo sapiens
tgcctgggccttcccacctctg

SEQ ID NO: 8300882 - DNA, 22 bp, Homo sapiens
tgcctgggcctctgaggaaggc

SEQ ID NO: 8300883 - DNA, 22 bp, Homo sapiens
tgcctgggccttcccacctctg

SEQ ID NO: 8300884 - DNA, 22 bp, Homo sapiens
tgcctgggctcaccgcctcttt

SEQ ID NO: 8300885 - DNA, 22 bp, Homo sapiens
tgcctgctcttaccactctccc

SEQ ID NO: 8300886 - DNA, 22 bp, Homo sapiens
tgcctgctcttaccactctccc

SEQ ID NO: 8300887 - DNA, 20 bp, Homo sapiens
tgcctgggaaggcgtggagg

SEQ ID NO: 8300888 - DNA, 22 bp, Homo sapiens
tgcctgggacatgctgtggact

SEQ ID NO: 8300889 - DNA, 22 bp, Homo sapiens
tgcctgggactctgttatcttg

SEQ ID NO: 8300890 - DNA, 22 bp, Homo sapiens
tgcctgggagtgaccaagactc

SEQ ID NO: 8300891 - DNA, 22 bp, Homo sapiens
tgcctgggagtgaccaagactc

SEQ ID NO: 8300892 - DNA, 22 bp, Homo sapiens
tgcctgggactgtactaaattt

SEQ ID NO: 8300893 - DNA, 22 bp, Homo sapiens
tgctccagtgagctggccatcc

SEQ ID NO: 8300894 - DNA, 20 bp, Homo sapiens
tgctccatctaaagtgatta

SEQ ID NO: 8300895 - DNA, 22 bp, Homo sapiens
tgctccattctctagccagtgc

SEQ ID NO: 8300896 - DNA, 22 bp, Homo sapiens
tgctgcacgataaataatttct

SEQ ID NO: 8300897 - DNA, 22 bp, Homo sapiens
tgctgcactcaccaacagataa

SEQ ID NO: 8300898 - DNA, 22 bp, Homo sapiens
tgctgcacaattggaaagtatc

SEQ ID NO: 8300899 - DNA, 20 bp, Homo sapiens
cccagggacctgagctccat

SEQ ID NO: 8300900 - DNA, 22 bp, Homo sapiens
tgctcccaaacgacctactgtg

SEQ ID NO: 8300901 - DNA, 22 bp, Homo sapiens
cccagggagagcgcggaggcgg

SEQ ID NO: 8300902 - DNA, 22 bp, Homo sapiens
tgctctggagtggcttgtgcac

SEQ ID NO: 8300903 - DNA, 22 bp, Homo sapiens
cccagggaggtagcaggagaaa

SEQ ID NO: 8300904 - DNA, 22 bp, Homo sapiens
ccccagccttccatgggaattg

SEQ ID NO: 8300905 - DNA, 22 bp, Homo sapiens
tgctggagatcattaatgttca

SEQ ID NO: 8300906 - DNA, 22 bp, Homo sapiens
ccccagccagcaggacctctga

SEQ ID NO: 8300907 - DNA, 22 bp, Homo sapiens
ccccaccttgcaattgttccct

SEQ ID NO: 8300908 - DNA, 22 bp, Homo sapiens
ccccacctgtgcgtctgccgca

SEQ ID NO: 8300909 - DNA, 19 bp, Homo sapiens
ccctcaggtctgagcagtc

SEQ ID NO: 8300910 - DNA, 22 bp, Homo sapiens
ccctcagcttctccctgcagct

SEQ ID NO: 8300911 - DNA, 22 bp, Homo sapiens
ccctcaggagatgtcagctgga

SEQ ID NO: 8300912 - DNA, 22 bp, Homo sapiens
cccctccctgacctggttgggc

SEQ ID NO: 8300913 - DNA, 22 bp, Homo sapiens
cccccagccagcagtgctcagc

SEQ ID NO: 8300914 - DNA, 22 bp, Homo sapiens
cccccaaggccaggctgagacc

SEQ ID NO: 8300915 - DNA, 22 bp, Homo sapiens
cccccaggctctgacacaggag

SEQ ID NO: 8300916 - DNA, 22 bp, Homo sapiens
ccccctggcaggctggcctctc

SEQ ID NO: 8300917 - DNA, 22 bp, Homo sapiens
cctcccttggccatagccagcc

SEQ ID NO: 8300918 - DNA, 22 bp, Homo sapiens
cctccctggccagagcagcagc

SEQ ID NO: 8300919 - DNA, 22 bp, Homo sapiens
cctccagcgcgatccactccgg

SEQ ID NO: 8300920 - DNA, 22 bp, Homo sapiens
cctccaagtttgactcaggaca

SEQ ID NO: 8300921 - DNA, 22 bp, Homo sapiens
tggccctgctgggtcagagctg

SEQ ID NO: 8300922 - DNA, 22 bp, Homo sapiens
tggccctgctgtatcatctgct

SEQ ID NO: 8300923 - DNA, 22 bp, Homo sapiens
tggccctgctgtatcatctgct

SEQ ID NO: 8300924 - DNA, 22 bp, Homo sapiens
tggctcagctgtcacagcctgg

SEQ ID NO: 8300925 - DNA, 22 bp, Homo sapiens
tggccctgcttatgtctctctt

SEQ ID NO: 8300926 - DNA, 22 bp, Homo sapiens
tggctcagtttagcagctcagt

SEQ ID NO: 8300927 - DNA, 22 bp, Homo sapiens
tggctcagtttgggggattgaa

SEQ ID NO: 8300928 - DNA, 22 bp, Homo sapiens
tggctcagtttcagtcctggtt

SEQ ID NO: 8300929 - DNA, 22 bp, Homo sapiens
tggctcagtttcagtcctggtt

SEQ ID NO: 8300930 - DNA, 22 bp, Homo sapiens
tggctcagtttctgcccagctg

SEQ ID NO: 8300931 - DNA, 22 bp, Homo sapiens
tggccctgctatgatcctgcaa

SEQ ID NO: 8300932 - DNA, 22 bp, Homo sapiens
tggccctgctggccaaaggcta

SEQ ID NO: 8300933 - DNA, 22 bp, Homo sapiens
tggcccgacctctgctcatgca

SEQ ID NO: 8300934 - DNA, 22 bp, Homo sapiens
cctctgggggtcctcagagtct

SEQ ID NO: 8300935 - DNA, 22 bp, Homo sapiens
cctctggggtgagtgggccact

SEQ ID NO: 8300936 - DNA, 22 bp, Homo sapiens
cctctggggtgagtgggccact

SEQ ID NO: 8300937 - DNA, 22 bp, Homo sapiens
cctctgggtgggaggccgggcg

SEQ ID NO: 8300938 - DNA, 22 bp, Homo sapiens
cctctgggtatctgtggaagta

SEQ ID NO: 8300939 - DNA, 22 bp, Homo sapiens
cctctgggtatctgtggaagta

SEQ ID NO: 8300940 - DNA, 22 bp, Homo sapiens
cctctggtcccagctctgctgc

SEQ ID NO: 8300941 - DNA, 22 bp, Homo sapiens
cctctgtcctggggagtggagc

SEQ ID NO: 8300942 - DNA, 22 bp, Homo sapiens
cctctgtcctggggagtggagc

SEQ ID NO: 8300943 - DNA, 22 bp, Homo sapiens
cctctggctgtaccactggcac

SEQ ID NO: 8300944 - DNA, 22 bp, Homo sapiens
cctctgaggtcatggacttggc

SEQ ID NO: 8300945 - DNA, 22 bp, Homo sapiens
cctctgagagaaggccttcagc

SEQ ID NO: 8300946 - DNA, 22 bp, Homo sapiens
cctctgagaccagctctgcacc

SEQ ID NO: 8300947 - DNA, 22 bp, Homo sapiens
cctctcttggccgcagtcttct

SEQ ID NO: 8300948 - DNA, 23 bp, Homo sapiens
cctctctttttaggtggtgtttg

SEQ ID NO: 8300949 - DNA, 22 bp, Homo sapiens
tggctgcctagtgtctgagcag

SEQ ID NO: 8300950 - DNA, 22 bp, Homo sapiens
tggctgcctagtccctcagcct

SEQ ID NO: 8300951 - DNA, 21 bp, Homo sapiens
tggctgcctacatgctgcagg

SEQ ID NO: 8300952 - DNA, 22 bp, Homo sapiens
cctctcatcattatcgctttgt

SEQ ID NO: 8300953 - DNA, 22 bp, Homo sapiens
cctctcatagtctgtatccttt

SEQ ID NO: 8300954 - DNA, 19 bp, Homo sapiens
cctctccgcccaccagccc

SEQ ID NO: 8300955 - DNA, 22 bp, Homo sapiens
tggctgcctttcacctcatctc

SEQ ID NO: 8300956 - DNA, 20 bp, Homo sapiens
cctctctgaagaggtcatct

SEQ ID NO: 8300957 - DNA, 22 bp, Homo sapiens
cctctctgtaagggtccctccc

SEQ ID NO: 8300958 - DNA, 22 bp, Homo sapiens
cctctctgtaagggtccctccc

SEQ ID NO: 8300959 - DNA, 22 bp, Homo sapiens
cctctctgtgtggcctctccat

SEQ ID NO: 8300960 - DNA, 23 bp, Homo sapiens
ccctggccttggggcacaggctg

SEQ ID NO: 8300961 - DNA, 22 bp, Homo sapiens
ccctggcaaaacactctcttga

SEQ ID NO: 8300962 - DNA, 20 bp, Homo sapiens
ccctggcctgtttcatgccc

SEQ ID NO: 8300963 - DNA, 22 bp, Homo sapiens
ccctccagccatggacccaggt

SEQ ID NO: 8300964 - DNA, 22 bp, Homo sapiens
ccctccagagcttgacctgctg

SEQ ID NO: 8300965 - DNA, 20 bp, Homo sapiens
ccctccagcaaccaggactt

SEQ ID NO: 8300966 - DNA, 22 bp, Homo sapiens
ccctccagctcaaagcaaccgg

SEQ ID NO: 8300967 - DNA, 20 bp, Homo sapiens
ccctggagagaagctccacg

SEQ ID NO: 8300968 - DNA, 20 bp, Homo sapiens
ccctggagagaagctccacg

SEQ ID NO: 8300969 - DNA, 22 bp, Homo sapiens
ccctggagcatctctgctgtct

SEQ ID NO: 8300970 - DNA, 22 bp, Homo sapiens
ccctggagctagtctgagcaga

SEQ ID NO: 8300971 - DNA, 22 bp, Homo sapiens
ccctggagctagtctgagcaga

SEQ ID NO: 8300972 - DNA, 22 bp, Homo sapiens
tggagctgagagccaggctggc

SEQ ID NO: 8300973 - DNA, 22 bp, Homo sapiens
tggagctgagagccaggctggc

SEQ ID NO: 8300974 - DNA, 22 bp, Homo sapiens
tggagctgactcacaccagcta

SEQ ID NO: 8300975 - DNA, 22 bp, Homo sapiens
tggagctgagaagtggagctct

SEQ ID NO: 8300976 - DNA, 22 bp, Homo sapiens
tggagctgactcacaccagcta

SEQ ID NO: 8300977 - DNA, 23 bp, Homo sapiens
tggagctgacagtcagagggagg

SEQ ID NO: 8300978 - DNA, 22 bp, Homo sapiens
tggcagcactaggtactgagct

SEQ ID NO: 8300979 - DNA, 22 bp, Homo sapiens
tggcagctggagggcaatggcc

SEQ ID NO: 8300980 - DNA, 22 bp, Homo sapiens
tggcagcacaaggtggcccatg

SEQ ID NO: 8300981 - DNA, 22 bp, Homo sapiens
tggcagcaatttgtgatgttga

SEQ ID NO: 8300982 - DNA, 22 bp, Homo sapiens
tggcagcaattagctagagctg

SEQ ID NO: 8300983 - DNA, 22 bp, Homo sapiens
tggcagcaagttcttgggaggt

SEQ ID NO: 8300984 - DNA, 22 bp, Homo sapiens
tggcagcaaaaccagaatcaga

SEQ ID NO: 8300985 - DNA, 22 bp, Homo sapiens
tggcagaggtatattgggagga

SEQ ID NO: 8300986 - DNA, 22 bp, Homo sapiens
tggcagctgtctgtggggtctc

SEQ ID NO: 8300987 - DNA, 23 bp, Homo sapiens
tggcagctgtgtaagagaaagca

SEQ ID NO: 8300988 - DNA, 22 bp, Homo sapiens
tggcagcttcctgctcatagga

SEQ ID NO: 8300989 - DNA, 22 bp, Homo sapiens
tggcagcttgaatgcagtcttt

SEQ ID NO: 8300990 - DNA, 22 bp, Homo sapiens
tggcagctgtgtccaggtagaa

SEQ ID NO: 8300991 - DNA, 22 bp, Homo sapiens
tggcagctgtgtccaggtagaa

SEQ ID NO: 8300992 - DNA, 22 bp, Homo sapiens
cctatgcctgtcactctgcgct

SEQ ID NO: 8300993 - DNA, 22 bp, Homo sapiens
tggccaggcaggtagaacggcc

SEQ ID NO: 8300994 - DNA, 22 bp, Homo sapiens
cctggggaatagagtcaagggg

SEQ ID NO: 8300995 - DNA, 22 bp, Homo sapiens
cctggggaatcttgcaggggaa

SEQ ID NO: 8300996 - DNA, 22 bp, Homo sapiens
cctgggctttgctggcaaggcc

SEQ ID NO: 8300997 - DNA, 22 bp, Homo sapiens
cctggggaaaagcaggcattta

SEQ ID NO: 8300998 - DNA, 22 bp, Homo sapiens
tgtgtgtatatgcatttatcta

SEQ ID NO: 8300999 - DNA, 22 bp, Homo sapiens
cctgggtcttggttcatgctct

SEQ ID NO: 8301000 - DNA, 22 bp, Homo sapiens
cctgggtgaaatctctcctgca

SEQ ID NO: 8301001 - DNA, 22 bp, Homo sapiens
cctgggtggcagaggttgcagt

SEQ ID NO: 8301002 - DNA, 22 bp, Homo sapiens
cctgggtgacccgtgagcgtcc

SEQ ID NO: 8301003 - DNA, 22 bp, Homo sapiens
cctgggtgatgtgctgccctcg

SEQ ID NO: 8301004 - DNA, 22 bp, Homo sapiens
tgtgttccttcgtcttcccttc

SEQ ID NO: 8301005 - DNA, 22 bp, Homo sapiens
tgtgttcctgcctggctctggt

SEQ ID NO: 8301006 - DNA, 19 bp, Homo sapiens
cctgggtccactcagacta

SEQ ID NO: 8301007 - DNA, 21 bp, Homo sapiens
cctgggccaaattccctggac

SEQ ID NO: 8301008 - DNA, 23 bp, Homo sapiens
cctgggcattggctgcagcttct

SEQ ID NO: 8301009 - DNA, 22 bp, Homo sapiens
cctgggcatctcatgcacctgc

SEQ ID NO: 8301010 - DNA, 22 bp, Homo sapiens
cctgggcattctttgagttctc

SEQ ID NO: 8301011 - DNA, 22 bp, Homo sapiens
cctgggaggcggaggttgcagg

SEQ ID NO: 8301012 - DNA, 22 bp, Homo sapiens
cctgggaggcggaggttgcagt

SEQ ID NO: 8301013 - DNA, 22 bp, Homo sapiens
tgtgcttcttgcagctcctgta

SEQ ID NO: 8301014 - DNA, 22 bp, Homo sapiens
tgtggctgctcaggtgcagacc

SEQ ID NO: 8301015 - DNA, 22 bp, Homo sapiens
tgtggcttaagaatgcctttaa

SEQ ID NO: 8301016 - DNA, 22 bp, Homo sapiens
cctgggagctgtggaaaggctg

SEQ ID NO: 8301017 - DNA, 22 bp, Homo sapiens
cctgggagctgtggaaaggctg

SEQ ID NO: 8301018 - DNA, 17 bp, Homo sapiens
cctgggaggagttatga

SEQ ID NO: 8301019 - DNA, 19 bp, Homo sapiens
cctgggaggcggaggttgc

SEQ ID NO: 8301020 - DNA, 22 bp, Homo sapiens
cctgggaggcagaggttgcagt

SEQ ID NO: 8301021 - DNA, 22 bp, Homo sapiens
tgtggctgtgtccacctgctgc

SEQ ID NO: 8301022 - DNA, 22 bp, Homo sapiens
tgtggctgtctgttctcctagg

SEQ ID NO: 8301023 - DNA, 22 bp, Homo sapiens
cctgggagagccatctgtggcc

SEQ ID NO: 8301024 - DNA, 22 bp, Homo sapiens
cctgggagagtctgtggtctcc

SEQ ID NO: 8301025 - DNA, 22 bp, Homo sapiens
cctgggaagagctgacaggagg

SEQ ID NO: 8301026 - DNA, 21 bp, Homo sapiens
cctgggagatcagctgccttc

SEQ ID NO: 8301027 - DNA, 22 bp, Homo sapiens
tgtgccagcctctggctgtgtc

SEQ ID NO: 8301028 - DNA, 22 bp, Homo sapiens
tgtgccaggcacttgcccaggc

SEQ ID NO: 8301029 - DNA, 22 bp, Homo sapiens
tgtgccaggcacttgcccaggc

SEQ ID NO: 8301030 - DNA, 22 bp, Homo sapiens
tgtgccagaaaatatgctgagg

SEQ ID NO: 8301031 - DNA, 22 bp, Homo sapiens
tgtgccatgaggctctgatatg

SEQ ID NO: 8301032 - DNA, 22 bp, Homo sapiens
tgtgccatttctattctgcagc

SEQ ID NO: 8301033 - DNA, 20 bp, Homo sapiens
tgtgcccaatgtccaggttc

SEQ ID NO: 8301034 - DNA, 22 bp, Homo sapiens
tgtgcccatccctctggagtgt

SEQ ID NO: 8301035 - DNA, 22 bp, Homo sapiens
tgtgcccattacacagaggcat

SEQ ID NO: 8301036 - DNA, 22 bp, Homo sapiens
tgtgcttcatcacttctcagtt

SEQ ID NO: 8301037 - DNA, 22 bp, Homo sapiens
tgtgcttctgcagagactattt

SEQ ID NO: 8301038 - DNA, 22 bp, Homo sapiens
tgtgcttcaggttgtcgccacg

SEQ ID NO: 8301039 - DNA, 22 bp, Homo sapiens
tgtgctggtacatgtgaggatg

SEQ ID NO: 8301040 - DNA, 22 bp, Homo sapiens
tgtgcccattccacttgagtac

SEQ ID NO: 8301041 - DNA, 18 bp, Homo sapiens
cctggcttccatcttggt

SEQ ID NO: 8301042 - DNA, 22 bp, Homo sapiens
cctggcttcctggagctcacaa

SEQ ID NO: 8301043 - DNA, 21 bp, Homo sapiens
cctggcttcagggtgcactgg

SEQ ID NO: 8301044 - DNA, 22 bp, Homo sapiens
cctggctgtggcggtgctctca

SEQ ID NO: 8301045 - DNA, 20 bp, Homo sapiens
cctggctttgcatctgtgat

SEQ ID NO: 8301046 - DNA, 22 bp, Homo sapiens
cctggctgtcgttttgtgaaat

SEQ ID NO: 8301047 - DNA, 22 bp, Homo sapiens
cctggctgtgcattgccggccc

SEQ ID NO: 8301048 - DNA, 22 bp, Homo sapiens
cctggctgccgagtgtgcagcg

SEQ ID NO: 8301049 - DNA, 22 bp, Homo sapiens
cctggctgctatagcagcatgt

SEQ ID NO: 8301050 - DNA, 20 bp, Homo sapiens
cctggctgcattcaggacgg

SEQ ID NO: 8301051 - DNA, 22 bp, Homo sapiens
cctggctgcattttgctggatg

SEQ ID NO: 8301052 - DNA, 21 bp, Homo sapiens
cctggctgcacagttgctggt

SEQ ID NO: 8301053 - DNA, 22 bp, Homo sapiens
cctggctgaaccaatgaagtgg

SEQ ID NO: 8301054 - DNA, 22 bp, Homo sapiens
tgtctgtacaaattttctgtgt

SEQ ID NO: 8301055 - DNA, 22 bp, Homo sapiens
tgtctgtaaggtgtttatgtta

SEQ ID NO: 8301056 - DNA, 22 bp, Homo sapiens
tgtctggtgggttgacaggcag

SEQ ID NO: 8301057 - DNA, 22 bp, Homo sapiens
tgtctgtctgcaagccagaaag

SEQ ID NO: 8301058 - DNA, 22 bp, Homo sapiens
tgtgaggagaggcccagctccc

SEQ ID NO: 8301059 - DNA, 22 bp, Homo sapiens
tgtgaaggcagcagctctgtcc

SEQ ID NO: 8301060 - DNA, 22 bp, Homo sapiens
tgtgaagctggatcctggagct

SEQ ID NO: 8301061 - DNA, 17 bp, Homo sapiens
tggtggctggagtcagg

SEQ ID NO: 8301062 - DNA, 22 bp, Homo sapiens
tggtggccttgatggcatctgc

SEQ ID NO: 8301063 - DNA, 22 bp, Homo sapiens
tggtggcttctgaggatggcga

SEQ ID NO: 8301064 - DNA, 22 bp, Homo sapiens
tggtggctgttgcagaactgag

SEQ ID NO: 8301065 - DNA, 22 bp, Homo sapiens
tggtgctgtggaggggcagaag

SEQ ID NO: 8301066 - DNA, 22 bp, Homo sapiens
cctgccagtgaagctgacgggc

SEQ ID NO: 8301067 - DNA, 22 bp, Homo sapiens
tggtgctgacagttctgagtgc

SEQ ID NO: 8301068 - DNA, 22 bp, Homo sapiens
tggtgctgataatggcaggatt

SEQ ID NO: 8301069 - DNA, 22 bp, Homo sapiens
tggtgccttgggcctacagcgc

SEQ ID NO: 8301070 - DNA, 22 bp, Homo sapiens
tgtaggacatgtacttgtaaca

SEQ ID NO: 8301071 - DNA, 22 bp, Homo sapiens
tgtaggagtccaatcaggagac

SEQ ID NO: 8301072 - DNA, 22 bp, Homo sapiens
tgtaggattttcaccagacctt

SEQ ID NO: 8301073 - DNA, 22 bp, Homo sapiens
tgtagtaagtgcgcaataaata

SEQ ID NO: 8301074 - DNA, 22 bp, Homo sapiens
cctggagcacatggcaggaggc

SEQ ID NO: 8301075 - DNA, 22 bp, Homo sapiens
cctggaggtggaggttgcagtg

SEQ ID NO: 8301076 - DNA, 22 bp, Homo sapiens
cctggagcaaaaatctaaggag

SEQ ID NO: 8301077 - DNA, 22 bp, Homo sapiens
cctggagcacagcccagtccca

SEQ ID NO: 8301078 - DNA, 22 bp, Homo sapiens
cctggagattatttggtccaat

SEQ ID NO: 8301079 - DNA, 22 bp, Homo sapiens
cctggagcaaaaatctaaggag

SEQ ID NO: 8301080 - DNA, 22 bp, Homo sapiens
tgtattagatctgagaacttct

SEQ ID NO: 8301081 - DNA, 22 bp, Homo sapiens
tgtattagagcagtagaattat

SEQ ID NO: 8301082 - DNA, 22 bp, Homo sapiens
tgtcatgtgttcttaaatacat

SEQ ID NO: 8301083 - DNA, 22 bp, Homo sapiens
tgtcatgccaccgtttcccaga

SEQ ID NO: 8301084 - DNA, 20 bp, Homo sapiens
tgtcatgcattagatgaaga

SEQ ID NO: 8301085 - DNA, 22 bp, Homo sapiens
tgtcatgccatttaaaatgttt

SEQ ID NO: 8301086 - DNA, 22 bp, Homo sapiens
tgtcatgccaggaaatagtccc

SEQ ID NO: 8301087 - DNA, 22 bp, Homo sapiens
tgtcatgcccaggagcaaggta

SEQ ID NO: 8301088 - DNA, 22 bp, Homo sapiens
tgtcatgcttatgttacatact

SEQ ID NO: 8301089 - DNA, 22 bp, Homo sapiens
tgtatgtgtatgtacatatgca

SEQ ID NO: 8301090 - DNA, 22 bp, Homo sapiens
tgtatgtgcttgagaaggtggg

SEQ ID NO: 8301091 - DNA, 22 bp, Homo sapiens
cctggcagaatattaaagtgca

SEQ ID NO: 8301092 - DNA, 22 bp, Homo sapiens
cctggcagacagcactgaagct

SEQ ID NO: 8301093 - DNA, 21 bp, Homo sapiens
cctggcagaagcctgatatgc

SEQ ID NO: 8301094 - DNA, 21 bp, Homo sapiens
cctggcagaagcctgatatgc

SEQ ID NO: 8301095 - DNA, 22 bp, Homo sapiens
cctggcacgaagggctgaggtt

SEQ ID NO: 8301096 - DNA, 22 bp, Homo sapiens
tgtcccagcactttgggagtct

SEQ ID NO: 8301097 - DNA, 22 bp, Homo sapiens
tgtcccagcactttgggagtct

SEQ ID NO: 8301098 - DNA, 22 bp, Homo sapiens
tgtcccagatcacaggagggga

SEQ ID NO: 8301099 - DNA, 22 bp, Homo sapiens
tgtcccagatcacaggagggga

SEQ ID NO: 8301100 - DNA, 22 bp, Homo sapiens
tgtcccagatactggacataga

SEQ ID NO: 8301101 - DNA, 22 bp, Homo sapiens
tgtcccagatactggacataga

SEQ ID NO: 8301102 - DNA, 23 bp, Homo sapiens
tgtcccagagggagggataggct

SEQ ID NO: 8301103 - DNA, 23 bp, Homo sapiens
tgtcccagagggagggataggct

SEQ ID NO: 8301104 - DNA, 22 bp, Homo sapiens
tgtcccagacataagtggacat

SEQ ID NO: 8301105 - DNA, 22 bp, Homo sapiens
tgtcccagacacagtatgcgct

SEQ ID NO: 8301106 - DNA, 19 bp, Homo sapiens
tgtcccagactccgtgtct

SEQ ID NO: 8301107 - DNA, 22 bp, Homo sapiens
cctggcagttttgcccaggatt

SEQ ID NO: 8301108 - DNA, 22 bp, Homo sapiens
cctggcagtggtgaagaagagg

SEQ ID NO: 8301109 - DNA, 22 bp, Homo sapiens
cctggcaggcccctcctggatt

SEQ ID NO: 8301110 - DNA, 22 bp, Homo sapiens
cctggcaggctggggacagtgc

SEQ ID NO: 8301111 - DNA, 22 bp, Homo sapiens
cctggcaggtggcgccctcggc

SEQ ID NO: 8301112 - DNA, 22 bp, Homo sapiens
cctggcagtcaggggagtcctt

SEQ ID NO: 8301113 - DNA, 22 bp, Homo sapiens
cctggcaggtggaggttgcagt

SEQ ID NO: 8301114 - DNA, 22 bp, Homo sapiens
cctggcagcattggtagagatt

SEQ ID NO: 8301115 - DNA, 22 bp, Homo sapiens
cctggcagcattggtagagatt

SEQ ID NO: 8301116 - DNA, 18 bp, Homo sapiens
cctggcagccatgcgcgc

SEQ ID NO: 8301117 - DNA, 22 bp, Homo sapiens
cctggcagcagcacatgccttc

SEQ ID NO: 8301118 - DNA, 22 bp, Homo sapiens
cctggcagcaggtgggcccgtg

SEQ ID NO: 8301119 - DNA, 22 bp, Homo sapiens
cctggcagactgtgagggcagg

SEQ ID NO: 8301120 - DNA, 23 bp, Homo sapiens
cctggcagcaaacgaggaggtta

SEQ ID NO: 8301121 - DNA, 22 bp, Homo sapiens
cctggctctctgcagatcctgg

SEQ ID NO: 8301122 - DNA, 22 bp, Homo sapiens
cctggctcctgcctctgcaggg

SEQ ID NO: 8301123 - DNA, 22 bp, Homo sapiens
cctggcctgtgaatctgagagc

SEQ ID NO: 8301124 - DNA, 22 bp, Homo sapiens
cctggcctgtgaatctgagagc

SEQ ID NO: 8301125 - DNA, 22 bp, Homo sapiens
cctggcctggcactccctctgc

SEQ ID NO: 8301126 - DNA, 22 bp, Homo sapiens
cctggcctgctcggctcttaag

SEQ ID NO: 8301127 - DNA, 22 bp, Homo sapiens
cctggcctcgtgctcacggctc

SEQ ID NO: 8301128 - DNA, 22 bp, Homo sapiens
cctggcctctccgagtaacctg

SEQ ID NO: 8301129 - DNA, 22 bp, Homo sapiens
cctggcctcagcctagggctga

SEQ ID NO: 8301130 - DNA, 22 bp, Homo sapiens
cctggcctcagacagagggtgg

SEQ ID NO: 8301131 - DNA, 22 bp, Homo sapiens
cctggcctcgtgctcacggctc

SEQ ID NO: 8301132 - DNA, 22 bp, Homo sapiens
cctggcctcctggccttctcat

SEQ ID NO: 8301133 - DNA, 19 bp, Homo sapiens
cctggccctgctgcgcggg

SEQ ID NO: 8301134 - DNA, 22 bp, Homo sapiens
tgtcctctaattggcctcttgc

SEQ ID NO: 8301135 - DNA, 22 bp, Homo sapiens
tgtcctcttccagtgctccttc

SEQ ID NO: 8301136 - DNA, 22 bp, Homo sapiens
tgtcctgcaactgaaggagaag

SEQ ID NO: 8301137 - DNA, 22 bp, Homo sapiens
tgtctcagaatggctcataata

SEQ ID NO: 8301138 - DNA, 22 bp, Homo sapiens
tgtctcagaggcaggaagagcc

SEQ ID NO: 8301139 - DNA, 22 bp, Homo sapiens
tgtctcagagtatccctgaact

SEQ ID NO: 8301140 - DNA, 22 bp, Homo sapiens
tgtctcagatacgccatcaagg

SEQ ID NO: 8301141 - DNA, 22 bp, Homo sapiens
tgtctcagggcagcagcagggg

SEQ ID NO: 8301142 - DNA, 22 bp, Homo sapiens
tgtctcaggggcattgaaataa

SEQ ID NO: 8301143 - DNA, 18 bp, Homo sapiens
tgtctcaggctgaaacag

SEQ ID NO: 8301144 - DNA, 22 bp, Homo sapiens
tgtctcaggcccaagccagtaa

SEQ ID NO: 8301145 - DNA, 22 bp, Homo sapiens
tgtctcagttcccttctctgga

SEQ ID NO: 8301146 - DNA, 19 bp, Homo sapiens
tgtctcagtgtcccttcct

SEQ ID NO: 8301147 - DNA, 22 bp, Homo sapiens
tgtctcagtatacgaaacactt

SEQ ID NO: 8301148 - DNA, 22 bp, Homo sapiens
tgtctcagtacactccgatgtt

SEQ ID NO: 8301149 - DNA, 22 bp, Homo sapiens
tgtctcagttcccttctctgga

SEQ ID NO: 8301150 - DNA, 22 bp, Homo sapiens
tgtctctggcccatgagcagag

SEQ ID NO: 8301151 - DNA, 22 bp, Homo sapiens
tgtctctgtgactccttccgcc

SEQ ID NO: 8301152 - DNA, 22 bp, Homo sapiens
tgtctctggtattaggtgaaaa

SEQ ID NO: 8301153 - DNA, 22 bp, Homo sapiens
tgtctctgtgagatctgacgat

SEQ ID NO: 8301154 - DNA, 22 bp, Homo sapiens
ctggccaacttgcttgttggca

SEQ ID NO: 8301155 - DNA, 22 bp, Homo sapiens
ctggccacaactagcccaggac

SEQ ID NO: 8301156 - DNA, 22 bp, Homo sapiens
ctggccacatgtgtgctgagca

SEQ ID NO: 8301157 - DNA, 22 bp, Homo sapiens
ctggcagggtgggctttgcttt

SEQ ID NO: 8301158 - DNA, 22 bp, Homo sapiens
ctggcagcattaacagagagca

SEQ ID NO: 8301159 - DNA, 22 bp, Homo sapiens
ctggcagcagttatgaaacaat

SEQ ID NO: 8301160 - DNA, 22 bp, Homo sapiens
ctggcagcatggagcctgtgct

SEQ ID NO: 8301161 - DNA, 22 bp, Homo sapiens
ctggcagcatggagcctgtgct

SEQ ID NO: 8301162 - DNA, 22 bp, Homo sapiens
ctggatgcttcctctctgctag

SEQ ID NO: 8301163 - DNA, 22 bp, Homo sapiens
ctggcagcagcttctggatcga

SEQ ID NO: 8301164 - DNA, 22 bp, Homo sapiens
ctggcagcagcttctggatcga

SEQ ID NO: 8301165 - DNA, 22 bp, Homo sapiens
ctggcagcagcttctggatcga

SEQ ID NO: 8301166 - DNA, 22 bp, Homo sapiens
ctggcctgaggtcggctgtagg

SEQ ID NO: 8301167 - DNA, 22 bp, Homo sapiens
ctggcctgaggtcggctgtagg

SEQ ID NO: 8301168 - DNA, 22 bp, Homo sapiens
ctggcctgaggtcggctgtagg

SEQ ID NO: 8301169 - DNA, 22 bp, Homo sapiens
ctggcctgatctcatgctgtcc

SEQ ID NO: 8301170 - DNA, 22 bp, Homo sapiens
ctggcctggagcctctgggtgg

SEQ ID NO: 8301171 - DNA, 22 bp, Homo sapiens
ctggcctgctgggtgaggtcct

SEQ ID NO: 8301172 - DNA, 22 bp, Homo sapiens
ctggcctggcagggagggcatg

SEQ ID NO: 8301173 - DNA, 22 bp, Homo sapiens
ctggcctgagcacagcggctgc

SEQ ID NO: 8301174 - DNA, 22 bp, Homo sapiens
ctggcctgagcacagcggctgc

SEQ ID NO: 8301175 - DNA, 22 bp, Homo sapiens
ctggcctgaggccgccttcaga

SEQ ID NO: 8301176 - DNA, 22 bp, Homo sapiens
ctggcctgaggccgccttcaga

SEQ ID NO: 8301177 - DNA, 22 bp, Homo sapiens
ctggcctgagaatgctaccctt

SEQ ID NO: 8301178 - DNA, 22 bp, Homo sapiens
ctggcccagagagcagagctta

SEQ ID NO: 8301179 - DNA, 22 bp, Homo sapiens
ctggccagttgtcctggcttgg

SEQ ID NO: 8301180 - DNA, 22 bp, Homo sapiens
ctggccagttgtcctggcttgg

SEQ ID NO: 8301181 - DNA, 22 bp, Homo sapiens
ctggcctggcgcagtggctcac

SEQ ID NO: 8301182 - DNA, 22 bp, Homo sapiens
ctggcctgggagctgctagcgt

SEQ ID NO: 8301183 - DNA, 22 bp, Homo sapiens
ctggcctgggagctgctagcgt

SEQ ID NO: 8301184 - DNA, 22 bp, Homo sapiens
ctggcctggcgcagtggctcac

SEQ ID NO: 8301185 - DNA, 22 bp, Homo sapiens
ctggcctggcaggggacctcta

SEQ ID NO: 8301186 - DNA, 22 bp, Homo sapiens
ctggcctggggcctcagctgct

SEQ ID NO: 8301187 - DNA, 22 bp, Homo sapiens
ctggcctggggcctcagctgct

SEQ ID NO: 8301188 - DNA, 22 bp, Homo sapiens
ctggcctggggcctcagctgct

SEQ ID NO: 8301189 - DNA, 23 bp, Homo sapiens
ctggctccgaagactccaggatc

SEQ ID NO: 8301190 - DNA, 22 bp, Homo sapiens
ctggctcctccaaggcctggag

SEQ ID NO: 8301191 - DNA, 22 bp, Homo sapiens
ctggctccctcgctgaggtgct

SEQ ID NO: 8301192 - DNA, 22 bp, Homo sapiens
ctggctccactccctgcctgac

SEQ ID NO: 8301193 - DNA, 22 bp, Homo sapiens
ctggctctatctccaaggctgg

SEQ ID NO: 8301194 - DNA, 22 bp, Homo sapiens
ctggctctctgagatattgagt

SEQ ID NO: 8301195 - DNA, 22 bp, Homo sapiens
ctggctctctgagatattgagt

SEQ ID NO: 8301196 - DNA, 23 bp, Homo sapiens
ctggctctgtaggtggcatcctt

SEQ ID NO: 8301197 - DNA, 21 bp, Homo sapiens
ctgctttacttcagaggatct

SEQ ID NO: 8301198 - DNA, 23 bp, Homo sapiens
ctgctttcccactccatgctctt

SEQ ID NO: 8301199 - DNA, 22 bp, Homo sapiens
ctgcctggcccagggatgggcc

SEQ ID NO: 8301200 - DNA, 22 bp, Homo sapiens
ctgcctggctaaactcaagtcg

SEQ ID NO: 8301201 - DNA, 22 bp, Homo sapiens
ctgcctggcctgatctccacgc

SEQ ID NO: 8301202 - DNA, 19 bp, Homo sapiens
ctgcttccttccctcactg

SEQ ID NO: 8301203 - DNA, 22 bp, Homo sapiens
ctgcttctaagaacctgcagct

SEQ ID NO: 8301204 - DNA, 22 bp, Homo sapiens
ctgcctgggccggccaccctct

SEQ ID NO: 8301205 - DNA, 22 bp, Homo sapiens
ctgcctggaatgccagcttctc

SEQ ID NO: 8301206 - DNA, 22 bp, Homo sapiens
ctgcctggagcattctgaaggt

SEQ ID NO: 8301207 - DNA, 22 bp, Homo sapiens
ctgcctggaccggcagccctcc

SEQ ID NO: 8301208 - DNA, 22 bp, Homo sapiens
ctgcctggcatggagaagagaa

SEQ ID NO: 8301209 - DNA, 22 bp, Homo sapiens
ctgcctggcatggagaagagaa

SEQ ID NO: 8301210 - DNA, 20 bp, Homo sapiens
ctgcctggaggcctctacct

SEQ ID NO: 8301211 - DNA, 22 bp, Homo sapiens
ctggacagaaaaggccactgga

SEQ ID NO: 8301212 - DNA, 22 bp, Homo sapiens
ctggaaggttctttgtgtgcct

SEQ ID NO: 8301213 - DNA, 22 bp, Homo sapiens
ctggacagaaagggctgctgtg

SEQ ID NO: 8301214 - DNA, 22 bp, Homo sapiens
ctgctttggctcagtgacatca

SEQ ID NO: 8301215 - DNA, 22 bp, Homo sapiens
ctgctttgtggaatcacactgg

SEQ ID NO: 8301216 - DNA, 22 bp, Homo sapiens
ctgctttgtaaaatagacataa

SEQ ID NO: 8301217 - DNA, 17 bp, Homo sapiens
ctgctttgtgcaacgct

SEQ ID NO: 8301218 - DNA, 22 bp, Homo sapiens
ctgctttgaaaataaacttgtc

SEQ ID NO: 8301219 - DNA, 22 bp, Homo sapiens
ctgctttgattagaagagtaca

SEQ ID NO: 8301220 - DNA, 22 bp, Homo sapiens
ctgctttgaggggctctgtata

SEQ ID NO: 8301221 - DNA, 22 bp, Homo sapiens
ctgctttgcatagctgccagag

SEQ ID NO: 8301222 - DNA, 22 bp, Homo sapiens
ctgctttgtgtggtccctccag

SEQ ID NO: 8301223 - DNA, 22 bp, Homo sapiens
ctggagggtgagcctcatctct

SEQ ID NO: 8301224 - DNA, 22 bp, Homo sapiens
ctggaggctgagttgggtctcc

SEQ ID NO: 8301225 - DNA, 21 bp, Homo sapiens
ctggactgaggagacagtcgc

SEQ ID NO: 8301226 - DNA, 22 bp, Homo sapiens
ctggagctctccagagccccgt

SEQ ID NO: 8301227 - DNA, 22 bp, Homo sapiens
ctggactttggcccatctgcca

SEQ ID NO: 8301228 - DNA, 22 bp, Homo sapiens
ctggagctctgtgtgttcctga

SEQ ID NO: 8301229 - DNA, 22 bp, Homo sapiens
ctgccagctctctggaggctct

SEQ ID NO: 8301230 - DNA, 22 bp, Homo sapiens
ctgccagctctctggaggctct

SEQ ID NO: 8301231 - DNA, 23 bp, Homo sapiens
ctgcagccgcgtggggacgtgga

SEQ ID NO: 8301232 - DNA, 22 bp, Homo sapiens
ctgcagaggcctcgcctcctct

SEQ ID NO: 8301233 - DNA, 22 bp, Homo sapiens
ctgcagagctaggctgagtgaa

SEQ ID NO: 8301234 - DNA, 22 bp, Homo sapiens
ctgcagaggcctcgcctcctct

SEQ ID NO: 8301235 - DNA, 22 bp, Homo sapiens
ctgcagagggtttgagcatcct

SEQ ID NO: 8301236 - DNA, 22 bp, Homo sapiens
ctgcagaggtcttgctgatggt

SEQ ID NO: 8301237 - DNA, 22 bp, Homo sapiens
ctgcagagggtttgagcatcct

SEQ ID NO: 8301238 - DNA, 22 bp, Homo sapiens
ctgcagaggttggttctaagat

SEQ ID NO: 8301239 - DNA, 22 bp, Homo sapiens
ctgcagaggtcttgctgatggt

SEQ ID NO: 8301240 - DNA, 22 bp, Homo sapiens
ctgcagagtggagcctcggctg

SEQ ID NO: 8301241 - DNA, 22 bp, Homo sapiens
ctgccctggggggcctccttgc

SEQ ID NO: 8301242 - DNA, 22 bp, Homo sapiens
ctgccgagtacagccatagaaa

SEQ ID NO: 8301243 - DNA, 22 bp, Homo sapiens
ctgccgagtgggtcatgaggca

SEQ ID NO: 8301244 - DNA, 22 bp, Homo sapiens
ctgccaggttggcgctcgctct

SEQ ID NO: 8301245 - DNA, 20 bp, Homo sapiens
ctgccatgattgatagagtg

SEQ ID NO: 8301246 - DNA, 22 bp, Homo sapiens
ctgcctgcgttgcctcgtgcct

SEQ ID NO: 8301247 - DNA, 22 bp, Homo sapiens
ctgcctcatgctgcctgcagcc

SEQ ID NO: 8301248 - DNA, 22 bp, Homo sapiens
ctgcctcatgctgcctgcagcc

SEQ ID NO: 8301249 - DNA, 22 bp, Homo sapiens
ctgatgctataagccacagtgg

SEQ ID NO: 8301250 - DNA, 22 bp, Homo sapiens
ctgcagagcataaatctgaata

SEQ ID NO: 8301251 - DNA, 22 bp, Homo sapiens
ctgattcctgattcatgctctt

SEQ ID NO: 8301252 - DNA, 22 bp, Homo sapiens
ctgattcctgattcatgctctt

SEQ ID NO: 8301253 - DNA, 22 bp, Homo sapiens
ctgaggatggtgtggtcttctc

SEQ ID NO: 8301254 - DNA, 22 bp, Homo sapiens
ctgaggagtttgggttgttcaa

SEQ ID NO: 8301255 - DNA, 22 bp, Homo sapiens
ttttgttttcttagaaacctgg

SEQ ID NO: 8301256 - DNA, 22 bp, Homo sapiens
tttttaagagattctccagtct

SEQ ID NO: 8301257 - DNA, 22 bp, Homo sapiens
tttttaagagattctccagtct

SEQ ID NO: 8301258 - DNA, 22 bp, Homo sapiens
tttttaagctcctttgatgtca

SEQ ID NO: 8301259 - DNA, 22 bp, Homo sapiens
ctctttttcacctctgtcagcg

SEQ ID NO: 8301260 - DNA, 17 bp, Homo sapiens
ctcttttgtcttcttcc

SEQ ID NO: 8301261 - DNA, 22 bp, Homo sapiens
ctctttttcagccttaccaaag

SEQ ID NO: 8301262 - DNA, 22 bp, Homo sapiens
ctctggtgtcctttagaattta

SEQ ID NO: 8301263 - DNA, 22 bp, Homo sapiens
ctgagaaggaagcctccactct

SEQ ID NO: 8301264 - DNA, 22 bp, Homo sapiens
ctgaagagctctcctgtcccct

SEQ ID NO: 8301265 - DNA, 22 bp, Homo sapiens
ctgaagaggacgcagcagcaag

SEQ ID NO: 8301266 - DNA, 22 bp, Homo sapiens
ctgaagatgtctgagatgctca

SEQ ID NO: 8301267 - DNA, 22 bp, Homo sapiens
ctctcctggggagcacacacac

SEQ ID NO: 8301268 - DNA, 22 bp, Homo sapiens
tttgtgaaatgaagtcacaact

SEQ ID NO: 8301269 - DNA, 22 bp, Homo sapiens
tttgtgaagggaacagaagtgt

SEQ ID NO: 8301270 - DNA, 20 bp, Homo sapiens
ctctggctccgcgtgaccgc

SEQ ID NO: 8301271 - DNA, 22 bp, Homo sapiens
ctctggctgcggggcgcgtgga

SEQ ID NO: 8301272 - DNA, 22 bp, Homo sapiens
ctctggcttctaccttgcagtt

SEQ ID NO: 8301273 - DNA, 22 bp, Homo sapiens
ctctgggcaggaccagtggacc

SEQ ID NO: 8301274 - DNA, 22 bp, Homo sapiens
ctctgggcaccaaagagcagct

SEQ ID NO: 8301275 - DNA, 22 bp, Homo sapiens
ctctgggcaagtttcttcatga

SEQ ID NO: 8301276 - DNA, 22 bp, Homo sapiens
ctctgggcacattttccaggac

SEQ ID NO: 8301277 - DNA, 22 bp, Homo sapiens
ctctgggcaagtatgatagaaa

SEQ ID NO: 8301278 - DNA, 22 bp, Homo sapiens
ctctgggcaaagatgcctcatc

SEQ ID NO: 8301279 - DNA, 22 bp, Homo sapiens
ctcagcagagaccagggaggaa

SEQ ID NO: 8301280 - DNA, 22 bp, Homo sapiens
ctcagcagcagggaagaggtca

SEQ ID NO: 8301281 - DNA, 22 bp, Homo sapiens
ttgataaaatgatatcttcttt

SEQ ID NO: 8301282 - DNA, 23 bp, Homo sapiens
ttgatacagaagaatcagtttgt

SEQ ID NO: 8301283 - DNA, 22 bp, Homo sapiens
ttgatacaggccttctagatga

SEQ ID NO: 8301284 - DNA, 22 bp, Homo sapiens
ttgatacagcagcctgtgatcc

SEQ ID NO: 8301285 - DNA, 22 bp, Homo sapiens
ttgaggagtcaggggcacggaa

SEQ ID NO: 8301286 - DNA, 22 bp, Homo sapiens
ttgaggagcactagtcaggtat

SEQ ID NO: 8301287 - DNA, 22 bp, Homo sapiens
ttgaggagcaggatgggaggct

SEQ ID NO: 8301288 - DNA, 22 bp, Homo sapiens
ttctgtcacttaggaggtcata

SEQ ID NO: 8301289 - DNA, 22 bp, Homo sapiens
ttcttcctcacactctcaccca

SEQ ID NO: 8301290 - DNA, 22 bp, Homo sapiens
ctatttctgcctaatgacctgt

SEQ ID NO: 8301291 - DNA, 22 bp, Homo sapiens
ttccttccgggcaccaggcact

SEQ ID NO: 8301292 - DNA, 22 bp, Homo sapiens
ctaatactcatttctgtaactc

SEQ ID NO: 8301293 - DNA, 22 bp, Homo sapiens
ttcccttgaccccagaccctgg

SEQ ID NO: 8301294 - DNA, 22 bp, Homo sapiens
ttccgctggggccgcctggcgg

SEQ ID NO: 8301295 - DNA, 22 bp, Homo sapiens
ttccaaagaaattgaccaagac

SEQ ID NO: 8301296 - DNA, 22 bp, Homo sapiens
ttccaaaggaatggggagctat

SEQ ID NO: 8301297 - DNA, 22 bp, Homo sapiens
ttccaaagtcatgttgctgata

SEQ ID NO: 8301298 - DNA, 22 bp, Homo sapiens
cgctgggcgccgacctgctggc

SEQ ID NO: 8301299 - DNA, 22 bp, Homo sapiens
cgctgggggaacagcgagggtg

SEQ ID NO: 8301300 - DNA, 22 bp, Homo sapiens
cgctggggctttttgcttgaga

SEQ ID NO: 8301301 - DNA, 22 bp, Homo sapiens
cctgggtggttccggcaaggag

SEQ ID NO: 8301302 - DNA, 22 bp, Homo sapiens
cggctggggctgtccccatgac

SEQ ID NO: 8301303 - DNA, 22 bp, Homo sapiens
cggctgggtagaggtgccgggt

SEQ ID NO: 8301304 - DNA, 22 bp, Homo sapiens
ttcattcccaagagtaaacata

SEQ ID NO: 8301305 - DNA, 22 bp, Homo sapiens
ttcattcccttatattagcatt

SEQ ID NO: 8301306 - DNA, 20 bp, Homo sapiens
ttcattcattccacaacttc

SEQ ID NO: 8301307 - DNA, 22 bp, Homo sapiens
ttcattccttccctaagcaact

SEQ ID NO: 8301308 - DNA, 22 bp, Homo sapiens
ttcattcctgagcccatattta

SEQ ID NO: 8301309 - DNA, 22 bp, Homo sapiens
ttcattccttctgtaccttgcc

SEQ ID NO: 8301310 - DNA, 22 bp, Homo sapiens
ctcctgggctcaagtgatcctc

SEQ ID NO: 8301311 - DNA, 21 bp, Homo sapiens
ctcctgggctaagatatagtg

SEQ ID NO: 8301312 - DNA, 22 bp, Homo sapiens
ctctccagatctgctgagccag

SEQ ID NO: 8301313 - DNA, 22 bp, Homo sapiens
ctctccagccacagaagctgct

SEQ ID NO: 8301314 - DNA, 22 bp, Homo sapiens
ctctccagaatatgccgccgtg

SEQ ID NO: 8301315 - DNA, 22 bp, Homo sapiens
ctctccctatgcctcccaggag

SEQ ID NO: 8301316 - DNA, 22 bp, Homo sapiens
ctctcccccacagcagccttct

SEQ ID NO: 8301317 - DNA, 22 bp, Homo sapiens
ctctcctccaacagccctgccg

SEQ ID NO: 8301318 - DNA, 22 bp, Homo sapiens
ctctccctggccagctgtgcag

SEQ ID NO: 8301319 - DNA, 22 bp, Homo sapiens
ctcctctggaaattcctctgcc

SEQ ID NO: 8301320 - DNA, 22 bp, Homo sapiens
ctcctctggaaattcctctgcc

SEQ ID NO: 8301321 - DNA, 22 bp, Homo sapiens
ctcctctgtctaccacgagggt

SEQ ID NO: 8301322 - DNA, 22 bp, Homo sapiens
ctcctctgtctggccctgagcc

SEQ ID NO: 8301323 - DNA, 22 bp, Homo sapiens
ctcctctgtctggccctgagcc

SEQ ID NO: 8301324 - DNA, 22 bp, Homo sapiens
ctcctctggcttcctggaggca

SEQ ID NO: 8301325 - DNA, 22 bp, Homo sapiens
tttaaaaaactagtctgagtct

SEQ ID NO: 8301326 - DNA, 22 bp, Homo sapiens
ttgggtgctgtcatggggcacg

SEQ ID NO: 8301327 - DNA, 22 bp, Homo sapiens
ctccagggagcttggaaagacc

SEQ ID NO: 8301328 - DNA, 22 bp, Homo sapiens
ctccagggagctgtggaggttt

SEQ ID NO: 8301329 - DNA, 22 bp, Homo sapiens
ctccagggggcatccacacagc

SEQ ID NO: 8301330 - DNA, 22 bp, Homo sapiens
ctccaggggccagaagcctggc

SEQ ID NO: 8301331 - DNA, 22 bp, Homo sapiens
ctccagggcagcatggcagtgg

SEQ ID NO: 8301332 - DNA, 22 bp, Homo sapiens
ctccagggaggtctgcaggact

SEQ ID NO: 8301333 - DNA, 22 bp, Homo sapiens
ctccagggatgagacagagtag

SEQ ID NO: 8301334 - DNA, 22 bp, Homo sapiens
ttgttaaaatgcatattctggt

SEQ ID NO: 8301335 - DNA, 22 bp, Homo sapiens
ttgttacacataataacatttt

SEQ ID NO: 8301336 - DNA, 22 bp, Homo sapiens
ctccagtatctgtaggaaaagg

SEQ ID NO: 8301337 - DNA, 22 bp, Homo sapiens
ctcagtttctgacattaaaatc

SEQ ID NO: 8301338 - DNA, 22 bp, Homo sapiens
ctcagtttcttcatattgtagg

SEQ ID NO: 8301339 - DNA, 22 bp, Homo sapiens
ttgatacaggctctatttcatc

SEQ ID NO: 8301340 - DNA, 22 bp, Homo sapiens
ttgatacatagcacagtttagg

SEQ ID NO: 8301341 - DNA, 22 bp, Homo sapiens
ttgctttgtggtggttcttcca

SEQ ID NO: 8301342 - DNA, 22 bp, Homo sapiens
ctcatctcccacctgcgtgcag

SEQ ID NO: 8301343 - DNA, 22 bp, Homo sapiens
ttgggcaaagtgtttctggagc

SEQ ID NO: 8301344 - DNA, 22 bp, Homo sapiens
gctcagagcactcagactcagc

SEQ ID NO: 8301345 - DNA, 22 bp, Homo sapiens
gctcagagcatcccagtgaatg

SEQ ID NO: 8301346 - DNA, 22 bp, Homo sapiens
gctcagagatggggaatgaaaa

SEQ ID NO: 8301347 - DNA, 22 bp, Homo sapiens
gctcagagatgtctgctgcctt

SEQ ID NO: 8301348 - DNA, 22 bp, Homo sapiens
gctcagagatgttcagtagctt

SEQ ID NO: 8301349 - DNA, 22 bp, Homo sapiens
gctcagagatgttcagtagctt

SEQ ID NO: 8301350 - DNA, 22 bp, Homo sapiens
gctcactggcctgaagaggacg

SEQ ID NO: 8301351 - DNA, 22 bp, Homo sapiens
gctcagaaaagtgaggctcagt

SEQ ID NO: 8301352 - DNA, 22 bp, Homo sapiens
gctcactgcaacctccgccttc

SEQ ID NO: 8301353 - DNA, 22 bp, Homo sapiens
gctcactgcaacctctgcctcc

SEQ ID NO: 8301354 - DNA, 22 bp, Homo sapiens
gctcactgcaagctccgcctcc

SEQ ID NO: 8301355 - DNA, 22 bp, Homo sapiens
gctcactgcaagctctgcctcc

SEQ ID NO: 8301356 - DNA, 22 bp, Homo sapiens
gctcactgccattctctagatg

SEQ ID NO: 8301357 - DNA, 22 bp, Homo sapiens
gctcctggctccaggcagccaa

SEQ ID NO: 8301358 - DNA, 22 bp, Homo sapiens
gctccagatgaaaggccagagg

SEQ ID NO: 8301359 - DNA, 22 bp, Homo sapiens
gctccaggagagggaagcagat

SEQ ID NO: 8301360 - DNA, 22 bp, Homo sapiens
gctccacttgcagctaggcttg

SEQ ID NO: 8301361 - DNA, 23 bp, Homo sapiens
gctctgagggcttatccctccca

SEQ ID NO: 8301362 - DNA, 22 bp, Homo sapiens
gctctgaggctgtgaggtgctg

SEQ ID NO: 8301363 - DNA, 22 bp, Homo sapiens
gctctgaggctgggagcactct

SEQ ID NO: 8301364 - DNA, 22 bp, Homo sapiens
gctctgagccgggggcctgtcc

SEQ ID NO: 8301365 - DNA, 22 bp, Homo sapiens
gctctgagtctcagctaccaca

SEQ ID NO: 8301366 - DNA, 22 bp, Homo sapiens
gctcctgggctctaccttgcta

SEQ ID NO: 8301367 - DNA, 22 bp, Homo sapiens
gctctgagcactgtgcggctgg

SEQ ID NO: 8301368 - DNA, 22 bp, Homo sapiens
gctctgagattgagcctttggt

SEQ ID NO: 8301369 - DNA, 19 bp, Homo sapiens
gctcctgggcctcactcat

SEQ ID NO: 8301370 - DNA, 22 bp, Homo sapiens
gctgagagtgtaggatgtttac

SEQ ID NO: 8301371 - DNA, 22 bp, Homo sapiens
gctctgtgtccacagctggaaa

SEQ ID NO: 8301372 - DNA, 22 bp, Homo sapiens
gctctgtgttgtcagaggcacc

SEQ ID NO: 8301373 - DNA, 22 bp, Homo sapiens
gctcttccatttctcttgaact

SEQ ID NO: 8301374 - DNA, 22 bp, Homo sapiens
gctgctctgtgacagcctccgg

SEQ ID NO: 8301375 - DNA, 22 bp, Homo sapiens
gctgctctgtgacagcctccgg

SEQ ID NO: 8301376 - DNA, 22 bp, Homo sapiens
gctgctcttgaggggctcactg

SEQ ID NO: 8301377 - DNA, 22 bp, Homo sapiens
gctgctcttttcagagatgaga

SEQ ID NO: 8301378 - DNA, 21 bp, Homo sapiens
gctgctgcccctagtgaggcc

SEQ ID NO: 8301379 - DNA, 22 bp, Homo sapiens
gctgctgcgcttgtctactgtt

SEQ ID NO: 8301380 - DNA, 22 bp, Homo sapiens
gctgcctggtttctcagctgca

SEQ ID NO: 8301381 - DNA, 22 bp, Homo sapiens
gctgcctggtttctcagctgca

SEQ ID NO: 8301382 - DNA, 22 bp, Homo sapiens
gctgcctggtttctcagctgca

SEQ ID NO: 8301383 - DNA, 22 bp, Homo sapiens
gctgcctgggcaggaggcgctg

SEQ ID NO: 8301384 - DNA, 22 bp, Homo sapiens
gctgcctgggcaggaggcgctg

SEQ ID NO: 8301385 - DNA, 22 bp, Homo sapiens
gctgcctgtcccaggatgagga

SEQ ID NO: 8301386 - DNA, 22 bp, Homo sapiens
gctgcctgtcccaggatgagga

SEQ ID NO: 8301387 - DNA, 22 bp, Homo sapiens
gctgctctacccatgcatctgt

SEQ ID NO: 8301388 - DNA, 22 bp, Homo sapiens
gctgctctcagagctcatgctg

SEQ ID NO: 8301389 - DNA, 20 bp, Homo sapiens
gctgctctccacggtctgca

SEQ ID NO: 8301390 - DNA, 22 bp, Homo sapiens
gctgctctccatggccgtgagt

SEQ ID NO: 8301391 - DNA, 22 bp, Homo sapiens
gctgctctctccctaagttggg

SEQ ID NO: 8301392 - DNA, 22 bp, Homo sapiens
gctgctctgaaaatgactgttg

SEQ ID NO: 8301393 - DNA, 22 bp, Homo sapiens
gctgctctgctgtgtaagcagg

SEQ ID NO: 8301394 - DNA, 19 bp, Homo sapiens
gctgctctgggtctcatct

SEQ ID NO: 8301395 - DNA, 22 bp, Homo sapiens
gctgctctggctctgcagtgtc

SEQ ID NO: 8301396 - DNA, 22 bp, Homo sapiens
gctgcctggagctcagcctgcc

SEQ ID NO: 8301397 - DNA, 22 bp, Homo sapiens
gctgcctggagctcagcctgcc

SEQ ID NO: 8301398 - DNA, 22 bp, Homo sapiens
gctgcctggaataacggctggc

SEQ ID NO: 8301399 - DNA, 22 bp, Homo sapiens
gctgcctggaataacggctggc

SEQ ID NO: 8301400 - DNA, 22 bp, Homo sapiens
gctgcctggaataacggctggc

SEQ ID NO: 8301401 - DNA, 22 bp, Homo sapiens
gctgcctggagaggcagggatg

SEQ ID NO: 8301402 - DNA, 22 bp, Homo sapiens
gctgcctggagctcagcctgcc

SEQ ID NO: 8301403 - DNA, 22 bp, Homo sapiens
gctgcctggatttgcaatcctc

SEQ ID NO: 8301404 - DNA, 22 bp, Homo sapiens
gctgcctgggcaggaggcgctg

SEQ ID NO: 8301405 - DNA, 22 bp, Homo sapiens
gctgcctggctttagtccactt

SEQ ID NO: 8301406 - DNA, 22 bp, Homo sapiens
gctgcctgatgtccagcaggac

SEQ ID NO: 8301407 - DNA, 22 bp, Homo sapiens
gctgcctgatgtccagcaggac

SEQ ID NO: 8301408 - DNA, 22 bp, Homo sapiens
gctgcctgcttcatgtgggaga

SEQ ID NO: 8301409 - DNA, 22 bp, Homo sapiens
gctgcctgctcggctcctggga

SEQ ID NO: 8301410 - DNA, 22 bp, Homo sapiens
gctgcctgctcggctcctggga

SEQ ID NO: 8301411 - DNA, 22 bp, Homo sapiens
gctgcctgctcggctcctggga

SEQ ID NO: 8301412 - DNA, 22 bp, Homo sapiens
gctgcctgatcatacaccaggg

SEQ ID NO: 8301413 - DNA, 22 bp, Homo sapiens
gctgagctcccagcagtatctg

SEQ ID NO: 8301414 - DNA, 22 bp, Homo sapiens
gctgagctagaaaaggaccaca

SEQ ID NO: 8301415 - DNA, 22 bp, Homo sapiens
gctgagctagctatctcagtct

SEQ ID NO: 8301416 - DNA, 22 bp, Homo sapiens
gctgggcagcctggccgctgcc

SEQ ID NO: 8301417 - DNA, 22 bp, Homo sapiens
gctgggcagcccctacagagag

SEQ ID NO: 8301418 - DNA, 22 bp, Homo sapiens
gctgggcaccggagagacccca

SEQ ID NO: 8301419 - DNA, 22 bp, Homo sapiens
gctggcctgggcagcctgtcgg

SEQ ID NO: 8301420 - DNA, 22 bp, Homo sapiens
gctggcctgggcagaggctatg

SEQ ID NO: 8301421 - DNA, 22 bp, Homo sapiens
gctggcctgggcagaggctatg

SEQ ID NO: 8301422 - DNA, 22 bp, Homo sapiens
gctggcctgcgagggcaggctg

SEQ ID NO: 8301423 - DNA, 22 bp, Homo sapiens
gctggcctgctgggcaccaccg

SEQ ID NO: 8301424 - DNA, 22 bp, Homo sapiens
gctggcctgcgagggcaggctg

SEQ ID NO: 8301425 - DNA, 22 bp, Homo sapiens
gctggcctgggcagcctgtcgg

SEQ ID NO: 8301426 - DNA, 22 bp, Homo sapiens
gctggcctgggcagcctgtcgg

SEQ ID NO: 8301427 - DNA, 22 bp, Homo sapiens
gctggcctgggctcaagaccag

SEQ ID NO: 8301428 - DNA, 22 bp, Homo sapiens
gctggccttctgcagagttctg

SEQ ID NO: 8301429 - DNA, 22 bp, Homo sapiens
gctggcctgtctagagccttac

SEQ ID NO: 8301430 - DNA, 22 bp, Homo sapiens
gctggccttgtgtctgaggaag

SEQ ID NO: 8301431 - DNA, 22 bp, Homo sapiens
gctggccttgtgtctgaggaag

SEQ ID NO: 8301432 - DNA, 22 bp, Homo sapiens
gctgggagtgggcaagatgaga

SEQ ID NO: 8301433 - DNA, 22 bp, Homo sapiens
gctggcctttgaggaagctgcg

SEQ ID NO: 8301434 - DNA, 22 bp, Homo sapiens
gctggcctttgaggaagctgcg

SEQ ID NO: 8301435 - DNA, 22 bp, Homo sapiens
gctggccagggctgctcgcgga

SEQ ID NO: 8301436 - DNA, 22 bp, Homo sapiens
gctggagctgcagcctgggcct

SEQ ID NO: 8301437 - DNA, 22 bp, Homo sapiens
gctggagctgcagcctgggcct

SEQ ID NO: 8301438 - DNA, 22 bp, Homo sapiens
gctggccaggtgctttggttct

SEQ ID NO: 8301439 - DNA, 22 bp, Homo sapiens
gctggcctcatcactgacttct

SEQ ID NO: 8301440 - DNA, 22 bp, Homo sapiens
gctggcctgaccagccacaggc

SEQ ID NO: 8301441 - DNA, 22 bp, Homo sapiens
gctggcctgaccagccacaggc

SEQ ID NO: 8301442 - DNA, 22 bp, Homo sapiens
gctggcctgacctgaggctggg

SEQ ID NO: 8301443 - DNA, 22 bp, Homo sapiens
gctggcctgacctgaggctggg

SEQ ID NO: 8301444 - DNA, 22 bp, Homo sapiens
gctggcctgcaaagcccggctg

SEQ ID NO: 8301445 - DNA, 22 bp, Homo sapiens
gctggcctctacaggccggcca

SEQ ID NO: 8301446 - DNA, 22 bp, Homo sapiens
gctggcctctggagaagggctt

SEQ ID NO: 8301447 - DNA, 22 bp, Homo sapiens
gctggcctctacaggccggcca

SEQ ID NO: 8301448 - DNA, 22 bp, Homo sapiens
gctggcctcgcaggcaggatgt

SEQ ID NO: 8301449 - DNA, 22 bp, Homo sapiens
gctggcctcctgctagatggaa

SEQ ID NO: 8301450 - DNA, 22 bp, Homo sapiens
gctggcctcgcaggcaggatgt

SEQ ID NO: 8301451 - DNA, 22 bp, Homo sapiens
gctggagatagtaggatccata

SEQ ID NO: 8301452 - DNA, 22 bp, Homo sapiens
gctggagccattggcttggcct

SEQ ID NO: 8301453 - DNA, 22 bp, Homo sapiens
gctggagccaagctgctcttgg

SEQ ID NO: 8301454 - DNA, 22 bp, Homo sapiens
gctggagccattggcttggcct

SEQ ID NO: 8301455 - DNA, 22 bp, Homo sapiens
gctggagccttctgctctgttg

SEQ ID NO: 8301456 - DNA, 22 bp, Homo sapiens
gctggagccttctgctctgttg

SEQ ID NO: 8301457 - DNA, 22 bp, Homo sapiens
gctggagctgagttccctgggc

SEQ ID NO: 8301458 - DNA, 22 bp, Homo sapiens
gctggagctgagttccctgggc

SEQ ID NO: 8301459 - DNA, 23 bp, Homo sapiens
gcctctggagccccagtgctcag

SEQ ID NO: 8301460 - DNA, 21 bp, Homo sapiens
gcctctgctgtcttattgtga

SEQ ID NO: 8301461 - DNA, 17 bp, Homo sapiens
gcctctgcttgtgtcat

SEQ ID NO: 8301462 - DNA, 17 bp, Homo sapiens
gcctctgcttgtgtcat

SEQ ID NO: 8301463 - DNA, 23 bp, Homo sapiens
gcctgcctgacctgtgcaaagtc

SEQ ID NO: 8301464 - DNA, 21 bp, Homo sapiens
gcctgcctgcgtgaccctctt

SEQ ID NO: 8301465 - DNA, 23 bp, Homo sapiens
gcctgcctgacctgtgcaaagtc

SEQ ID NO: 8301466 - DNA, 22 bp, Homo sapiens
gcctgcctgaaggctgtaccag

SEQ ID NO: 8301467 - DNA, 22 bp, Homo sapiens
gcctgcctgaaggctgtaccag

SEQ ID NO: 8301468 - DNA, 20 bp, Homo sapiens
gcctgcctcagctagctgag

SEQ ID NO: 8301469 - DNA, 20 bp, Homo sapiens
gcctgcctcagctagctgag

SEQ ID NO: 8301470 - DNA, 22 bp, Homo sapiens
gcctgcctcaaaatcccagttc

SEQ ID NO: 8301471 - DNA, 22 bp, Homo sapiens
gcctgcctcaaaatcccagttc

SEQ ID NO: 8301472 - DNA, 22 bp, Homo sapiens
gcctgcctttgtatgaccctga

SEQ ID NO: 8301473 - DNA, 22 bp, Homo sapiens
gcctgcctttgtatgaccctga

SEQ ID NO: 8301474 - DNA, 22 bp, Homo sapiens
gcctgccttcggtgcgcagcgg

SEQ ID NO: 8301475 - DNA, 22 bp, Homo sapiens
gcctgccttcggtgcgcagcgg

SEQ ID NO: 8301476 - DNA, 22 bp, Homo sapiens
gcctgcctgttggctgaggtgc

SEQ ID NO: 8301477 - DNA, 22 bp, Homo sapiens
gcctgcctgttggctgaggtgc

SEQ ID NO: 8301478 - DNA, 19 bp, Homo sapiens
gcctgcctgggtttctgag

SEQ ID NO: 8301479 - DNA, 22 bp, Homo sapiens
gcctgcctgttggctgaggtgc

SEQ ID NO: 8301480 - DNA, 22 bp, Homo sapiens
gcctgcctgctgtgtgcaagtt

SEQ ID NO: 8301481 - DNA, 22 bp, Homo sapiens
gcctgcctgctgtgtgcaagtt

SEQ ID NO: 8301482 - DNA, 22 bp, Homo sapiens
gcctgcctggagcttgaggtga

SEQ ID NO: 8301483 - DNA, 22 bp, Homo sapiens
gcctgcctggagcttgaggtga

SEQ ID NO: 8301484 - DNA, 19 bp, Homo sapiens
gcctgcctgggtttctgag

SEQ ID NO: 8301485 - DNA, 22 bp, Homo sapiens
gcctgcctgctgtcatctgcct

SEQ ID NO: 8301486 - DNA, 22 bp, Homo sapiens
gcctgcctgctgtcatctgcct

SEQ ID NO: 8301487 - DNA, 21 bp, Homo sapiens
gcctgcctgcgtgaccctctt

SEQ ID NO: 8301488 - DNA, 22 bp, Homo sapiens
gcctgccttttggaggcacatt

SEQ ID NO: 8301489 - DNA, 22 bp, Homo sapiens
gcctgcctttgtgaggaagcgg

SEQ ID NO: 8301490 - DNA, 22 bp, Homo sapiens
gcctgcctttgtgaggaagcgg

SEQ ID NO: 8301491 - DNA, 22 bp, Homo sapiens
gcctgccttttggaggcacatt

SEQ ID NO: 8301492 - DNA, 22 bp, Homo sapiens
gcctgctctgacatccatccca

SEQ ID NO: 8301493 - DNA, 22 bp, Homo sapiens
gcctgctgttaactgcaggaat

SEQ ID NO: 8301494 - DNA, 22 bp, Homo sapiens
gcctggaggggccagggtggta

SEQ ID NO: 8301495 - DNA, 22 bp, Homo sapiens
gcctggagggtccctctctgga

SEQ ID NO: 8301496 - DNA, 22 bp, Homo sapiens
gcctggagggctctagagaggc

SEQ ID NO: 8301497 - DNA, 22 bp, Homo sapiens
gcctggagggctctagagaggc

SEQ ID NO: 8301498 - DNA, 22 bp, Homo sapiens
gcctggaggggacagtctctgg

SEQ ID NO: 8301499 - DNA, 22 bp, Homo sapiens
gcctggagcctcagcaaggagg

SEQ ID NO: 8301500 - DNA, 22 bp, Homo sapiens
gcctggagcctcagcaaggagg

SEQ ID NO: 8301501 - DNA, 22 bp, Homo sapiens
gcctggagcctcagcaaggagg

SEQ ID NO: 8301502 - DNA, 20 bp, Homo sapiens
gcctggaggcaatgggaaga

SEQ ID NO: 8301503 - DNA, 20 bp, Homo sapiens
gcctggaggcaatgggaaga

SEQ ID NO: 8301504 - DNA, 22 bp, Homo sapiens
gcctggagggatagaatgcaag

SEQ ID NO: 8301505 - DNA, 20 bp, Homo sapiens
gcctggaggcagagataaag

SEQ ID NO: 8301506 - DNA, 22 bp, Homo sapiens
gcctggcctgaactaggaggtg

SEQ ID NO: 8301507 - DNA, 22 bp, Homo sapiens
gcctggcctgaactaggaggtg

SEQ ID NO: 8301508 - DNA, 22 bp, Homo sapiens
gcctggccgggtcttggatttt

SEQ ID NO: 8301509 - DNA, 22 bp, Homo sapiens
gcctggccgctccgagctccgc

SEQ ID NO: 8301510 - DNA, 22 bp, Homo sapiens
gcctggccgctccgagctccgc

SEQ ID NO: 8301511 - DNA, 21 bp, Homo sapiens
gcctgggaaatctgggaagcc

SEQ ID NO: 8301512 - DNA, 22 bp, Homo sapiens
gcctggccaacgtggtgaaacc

SEQ ID NO: 8301513 - DNA, 23 bp, Homo sapiens
gcctggccaccccagggctgctt

SEQ ID NO: 8301514 - DNA, 22 bp, Homo sapiens
gcctggcccagggctccgcagg

SEQ ID NO: 8301515 - DNA, 17 bp, Homo sapiens
gcctggcccagcctggc

SEQ ID NO: 8301516 - DNA, 22 bp, Homo sapiens
gcctggcccagggctcttgttg

SEQ ID NO: 8301517 - DNA, 22 bp, Homo sapiens
gcctggccgctccgagctccgc

SEQ ID NO: 8301518 - DNA, 22 bp, Homo sapiens
gcctggcccagggctcttgttg

SEQ ID NO: 8301519 - DNA, 22 bp, Homo sapiens
gcctggcaggcctgggccagca

SEQ ID NO: 8301520 - DNA, 22 bp, Homo sapiens
gcctggcaggcctgggccagca

SEQ ID NO: 8301521 - DNA, 22 bp, Homo sapiens
gcctggcaggcctgttggggct

SEQ ID NO: 8301522 - DNA, 22 bp, Homo sapiens
gcctggagtagcatggcaagcc

SEQ ID NO: 8301523 - DNA, 22 bp, Homo sapiens
gcctggagtactccttgaagtg

SEQ ID NO: 8301524 - DNA, 22 bp, Homo sapiens
gcctggagggtccctctctgga

SEQ ID NO: 8301525 - DNA, 21 bp, Homo sapiens
gcctggcaggtggaagggctc

SEQ ID NO: 8301526 - DNA, 22 bp, Homo sapiens
gcctggcaggggcctgggagtg

SEQ ID NO: 8301527 - DNA, 22 bp, Homo sapiens
gcctggcaggggcctgggagtg

SEQ ID NO: 8301528 - DNA, 22 bp, Homo sapiens
gcctgtggccgactgagagcct

SEQ ID NO: 8301529 - DNA, 20 bp, Homo sapiens
gcctgtggaggaggacggac

SEQ ID NO: 8301530 - DNA, 22 bp, Homo sapiens
gcctgtggccactgcgtctgca

SEQ ID NO: 8301531 - DNA, 21 bp, Homo sapiens
gcctgtggagcccaagggccc

SEQ ID NO: 8301532 - DNA, 22 bp, Homo sapiens
gcctggtgtccagaggcgagtg

SEQ ID NO: 8301533 - DNA, 22 bp, Homo sapiens
gcctggtgtgcgccgcgcagct

SEQ ID NO: 8301534 - DNA, 22 bp, Homo sapiens
gcctggtgtctccccaaggaag

SEQ ID NO: 8301535 - DNA, 22 bp, Homo sapiens
gcctgtcaattttgtgtacaat

SEQ ID NO: 8301536 - DNA, 22 bp, Homo sapiens
gcctgtgggttggagcttggcc

SEQ ID NO: 8301537 - DNA, 22 bp, Homo sapiens
gcctgtggttgctttgggatcc

SEQ ID NO: 8301538 - DNA, 22 bp, Homo sapiens
gcctgttctgccctgagagcct

SEQ ID NO: 8301539 - DNA, 18 bp, Homo sapiens
gcctgttccctactatcc

SEQ ID NO: 8301540 - DNA, 20 bp, Homo sapiens
gcctgttcacaggcttcttg

SEQ ID NO: 8301541 - DNA, 22 bp, Homo sapiens
gcctgttccttagtggcttcac

SEQ ID NO: 8301542 - DNA, 22 bp, Homo sapiens
gcctgttctccagcatccaggt

SEQ ID NO: 8301543 - DNA, 22 bp, Homo sapiens
gcctgtgtggatgcgccggtgc

SEQ ID NO: 8301544 - DNA, 19 bp, Homo sapiens
gcctgggatgggcagaact

SEQ ID NO: 8301545 - DNA, 19 bp, Homo sapiens
gcctgggatgggcagaact

SEQ ID NO: 8301546 - DNA, 22 bp, Homo sapiens
gcctgggaagactaagtgggag

SEQ ID NO: 8301547 - DNA, 22 bp, Homo sapiens
gcctgggaactctgatctcctg

SEQ ID NO: 8301548 - DNA, 23 bp, Homo sapiens
gcctgggactcaggaggagctca

SEQ ID NO: 8301549 - DNA, 23 bp, Homo sapiens
gcctgggactcaggaggagctca

SEQ ID NO: 8301550 - DNA, 23 bp, Homo sapiens
gcctgggactggtagtgtgacct

SEQ ID NO: 8301551 - DNA, 22 bp, Homo sapiens
gccctctgctggcctcacctcg

SEQ ID NO: 8301552 - DNA, 22 bp, Homo sapiens
gccctctgcacagctctgagca

SEQ ID NO: 8301553 - DNA, 22 bp, Homo sapiens
gcccttccttagacagcaggat

SEQ ID NO: 8301554 - DNA, 22 bp, Homo sapiens
gcccttccaacccagagggcaa

SEQ ID NO: 8301555 - DNA, 21 bp, Homo sapiens
gccctcaggggaggatggcct

SEQ ID NO: 8301556 - DNA, 22 bp, Homo sapiens
gccctctcttctgcagcctcca

SEQ ID NO: 8301557 - DNA, 22 bp, Homo sapiens
gccctctcggcatagcaggggc

SEQ ID NO: 8301558 - DNA, 22 bp, Homo sapiens
gccctcagctcctggacacatg

SEQ ID NO: 8301559 - DNA, 22 bp, Homo sapiens
gccctcagagttccccacagtg

SEQ ID NO: 8301560 - DNA, 22 bp, Homo sapiens
gccctcagatgggaaaggaggg

SEQ ID NO: 8301561 - DNA, 22 bp, Homo sapiens
gccggggctggggagagacatg

SEQ ID NO: 8301562 - DNA, 22 bp, Homo sapiens
gccgaagctgccgtctggtcct

SEQ ID NO: 8301563 - DNA, 22 bp, Homo sapiens
gccggggctggggagagacatg

SEQ ID NO: 8301564 - DNA, 22 bp, Homo sapiens
gcctctgcatgctcagcaccca

SEQ ID NO: 8301565 - DNA, 22 bp, Homo sapiens
gcctctgccaagggggctgcgg

SEQ ID NO: 8301566 - DNA, 22 bp, Homo sapiens
gcctctgcatcttcgccgcact

SEQ ID NO: 8301567 - DNA, 22 bp, Homo sapiens
gcctctgcatcatcactccagc

SEQ ID NO: 8301568 - DNA, 22 bp, Homo sapiens
gcctctgcactgtggcacacca

SEQ ID NO: 8301569 - DNA, 23 bp, Homo sapiens
gcctctgcagcctagttagtgtc

SEQ ID NO: 8301570 - DNA, 22 bp, Homo sapiens
gcctctgcaggtgcggttatcc

SEQ ID NO: 8301571 - DNA, 22 bp, Homo sapiens
gcctctgcaccagtactgtgcc

SEQ ID NO: 8301572 - DNA, 22 bp, Homo sapiens
gcctctgcaattacattgtgcc

SEQ ID NO: 8301573 - DNA, 22 bp, Homo sapiens
gcctctgcaattacattgtgcc

SEQ ID NO: 8301574 - DNA, 22 bp, Homo sapiens
gcctctgcaactccgccttggt

SEQ ID NO: 8301575 - DNA, 22 bp, Homo sapiens
gcctctgcaattacattgtgcc

SEQ ID NO: 8301576 - DNA, 22 bp, Homo sapiens
gcctctgccctcctgggactgc

SEQ ID NO: 8301577 - DNA, 22 bp, Homo sapiens
gcctctgcccatccaccatcag

SEQ ID NO: 8301578 - DNA, 22 bp, Homo sapiens
gcctctgcggagctgtacatca

SEQ ID NO: 8301579 - DNA, 22 bp, Homo sapiens
gcctctgcggggcccgagcccg

SEQ ID NO: 8301580 - DNA, 22 bp, Homo sapiens
gcctctgctcggactttgcctc

SEQ ID NO: 8301581 - DNA, 22 bp, Homo sapiens
gcctctgctcggactttgcctc

SEQ ID NO: 8301582 - DNA, 22 bp, Homo sapiens
gcctctgcgcctcagccgacct

SEQ ID NO: 8301583 - DNA, 22 bp, Homo sapiens
gcctctgcggagctgtacatca

SEQ ID NO: 8301584 - DNA, 22 bp, Homo sapiens
gcctctgctgcaagcctggttg

SEQ ID NO: 8301585 - DNA, 19 bp, Homo sapiens
gcctctgctggggacaggc

SEQ ID NO: 8301586 - DNA, 23 bp, Homo sapiens
gcctctgctctgcgttggggact

SEQ ID NO: 8301587 - DNA, 22 bp, Homo sapiens
gcctctgctgacaagatggaca

SEQ ID NO: 8301588 - DNA, 22 bp, Homo sapiens
gcctctgctctcaggtagcctc

SEQ ID NO: 8301589 - DNA, 22 bp, Homo sapiens
gccatttagggaggcaaggtga

SEQ ID NO: 8301590 - DNA, 21 bp, Homo sapiens
gccattgttttctacctggag

SEQ ID NO: 8301591 - DNA, 22 bp, Homo sapiens
gcccaggctagcgtagagtgca

SEQ ID NO: 8301592 - DNA, 22 bp, Homo sapiens
gcccaggctggagtgcagtggc

SEQ ID NO: 8301593 - DNA, 22 bp, Homo sapiens
gcccaggctggagtgcagtagc

SEQ ID NO: 8301594 - DNA, 22 bp, Homo sapiens
gccagttcctgtggagtcagag

SEQ ID NO: 8301595 - DNA, 22 bp, Homo sapiens
gccaggctgtttttattactgt

SEQ ID NO: 8301596 - DNA, 22 bp, Homo sapiens
gccaggctggtgtcacaactct

SEQ ID NO: 8301597 - DNA, 22 bp, Homo sapiens
gccaggctgtggggaacttgaa

SEQ ID NO: 8301598 - DNA, 22 bp, Homo sapiens
gccaggctgctggctgctgtcc

SEQ ID NO: 8301599 - DNA, 22 bp, Homo sapiens
gccaggctgctccagggaggcc

SEQ ID NO: 8301600 - DNA, 22 bp, Homo sapiens
gccaggctgaggctctggaaga

SEQ ID NO: 8301601 - DNA, 22 bp, Homo sapiens
gccagcagggcccaaatgctgg

SEQ ID NO: 8301602 - DNA, 22 bp, Homo sapiens
gcagtggggaatgctggggaga

SEQ ID NO: 8301603 - DNA, 22 bp, Homo sapiens
gcagtggggcgctgggagttgg

SEQ ID NO: 8301604 - DNA, 22 bp, Homo sapiens
gcagtggtccagttcacaccca

SEQ ID NO: 8301605 - DNA, 22 bp, Homo sapiens
gcagtgggcaacaagagctgga

SEQ ID NO: 8301606 - DNA, 22 bp, Homo sapiens
gcagtggtggagcttacatatc

SEQ ID NO: 8301607 - DNA, 22 bp, Homo sapiens
gcagggtgccgacttcagggat

SEQ ID NO: 8301608 - DNA, 22 bp, Homo sapiens
gcagggtgatagtgaggctcag

SEQ ID NO: 8301609 - DNA, 22 bp, Homo sapiens
gcaggtggattatcagaagtgc

SEQ ID NO: 8301610 - DNA, 22 bp, Homo sapiens
gcaggtggcagaggtgggatct

SEQ ID NO: 8301611 - DNA, 23 bp, Homo sapiens
gcaggtggttcgaacagaagttt

SEQ ID NO: 8301612 - DNA, 22 bp, Homo sapiens
gcaggtggtccccgtggagtgg

SEQ ID NO: 8301613 - DNA, 22 bp, Homo sapiens
gcaggtgggggtcggtgcatct

SEQ ID NO: 8301614 - DNA, 22 bp, Homo sapiens
gcatgtgtctccccagtggagg

SEQ ID NO: 8301615 - DNA, 22 bp, Homo sapiens
gcatgtgtggaggagatgtgct

SEQ ID NO: 8301616 - DNA, 22 bp, Homo sapiens
gcatgggcaagaggactggggg

SEQ ID NO: 8301617 - DNA, 22 bp, Homo sapiens
gcatggtggccttagggtagcc

SEQ ID NO: 8301618 - DNA, 19 bp, Homo sapiens
gccagcagaatgatgaggc

SEQ ID NO: 8301619 - DNA, 22 bp, Homo sapiens
gccagcagccacagaagtcact

SEQ ID NO: 8301620 - DNA, 20 bp, Homo sapiens
gccagcacagggagcagttc

SEQ ID NO: 8301621 - DNA, 22 bp, Homo sapiens
gccagcagcccagaaggacttt

SEQ ID NO: 8301622 - DNA, 22 bp, Homo sapiens
gccacaggcacttaagggctgg

SEQ ID NO: 8301623 - DNA, 22 bp, Homo sapiens
gcaggcagagaggggtttccag

SEQ ID NO: 8301624 - DNA, 22 bp, Homo sapiens
gcaggcagagaaggaacattta

SEQ ID NO: 8301625 - DNA, 22 bp, Homo sapiens
gcaggctggaggctgttctggg

SEQ ID NO: 8301626 - DNA, 22 bp, Homo sapiens
gcagggacgccagggacagcaa

SEQ ID NO: 8301627 - DNA, 21 bp, Homo sapiens
gcaggctggtcaaacctcagt

SEQ ID NO: 8301628 - DNA, 22 bp, Homo sapiens
gcagggcacagacagtgccaag

SEQ ID NO: 8301629 - DNA, 22 bp, Homo sapiens
gcagggcaatgatcccgagagg

SEQ ID NO: 8301630 - DNA, 22 bp, Homo sapiens
gcaggggctgctgggaactcgg

SEQ ID NO: 8301631 - DNA, 22 bp, Homo sapiens
gcaggggctgctgggaactcgg

SEQ ID NO: 8301632 - DNA, 22 bp, Homo sapiens
gcaggggctgagcaccagcggg

SEQ ID NO: 8301633 - DNA, 22 bp, Homo sapiens
gcaggggctgagcaccagcggg

SEQ ID NO: 8301634 - DNA, 21 bp, Homo sapiens
gcaggggatagaaatggtctg

SEQ ID NO: 8301635 - DNA, 22 bp, Homo sapiens
gcaggggcaggagatctcaggc

SEQ ID NO: 8301636 - DNA, 22 bp, Homo sapiens
gcaggggcaggagatctcaggc

SEQ ID NO: 8301637 - DNA, 22 bp, Homo sapiens
gcaggggctactctgagcttcc

SEQ ID NO: 8301638 - DNA, 22 bp, Homo sapiens
gcaggggctaaggacacagaga

SEQ ID NO: 8301639 - DNA, 22 bp, Homo sapiens
gcagctgatggaagtcctattg

SEQ ID NO: 8301640 - DNA, 22 bp, Homo sapiens
gcagctgagagaagaacagggc

SEQ ID NO: 8301641 - DNA, 22 bp, Homo sapiens
gcagctgagcgtgaggaagagt

SEQ ID NO: 8301642 - DNA, 22 bp, Homo sapiens
gcagctgacatctggctgggcc

SEQ ID NO: 8301643 - DNA, 22 bp, Homo sapiens
gcaggagagccagcaggcttcc

SEQ ID NO: 8301644 - DNA, 22 bp, Homo sapiens
gcaggagctcgtttccaggctg

SEQ ID NO: 8301645 - DNA, 22 bp, Homo sapiens
gcaggagctgctctcctgacga

SEQ ID NO: 8301646 - DNA, 22 bp, Homo sapiens
gcaggagctcgtttccaggctg

SEQ ID NO: 8301647 - DNA, 22 bp, Homo sapiens
gcaggagccaggccgagctggt

SEQ ID NO: 8301648 - DNA, 22 bp, Homo sapiens
gcaggagccctggcatgttctt

SEQ ID NO: 8301649 - DNA, 19 bp, Homo sapiens
gcaggcacagccctgggtg

SEQ ID NO: 8301650 - DNA, 18 bp, Homo sapiens
gcagctgacactggagtt

SEQ ID NO: 8301651 - DNA, 18 bp, Homo sapiens
gcagctgacactggagtt

SEQ ID NO: 8301652 - DNA, 22 bp, Homo sapiens
gcagctgaatgtccattgctgc

SEQ ID NO: 8301653 - DNA, 22 bp, Homo sapiens
gcagctgaagctgcagttccag

SEQ ID NO: 8301654 - DNA, 20 bp, Homo sapiens
gcagctgaaagtatgacacc

SEQ ID NO: 8301655 - DNA, 22 bp, Homo sapiens
gcagctgaaagggatctctaca

SEQ ID NO: 8301656 - DNA, 22 bp, Homo sapiens
gcagagccttgcgtcatgtgcc

SEQ ID NO: 8301657 - DNA, 22 bp, Homo sapiens
gcagagcctgtgtctgagcaaa

SEQ ID NO: 8301658 - DNA, 21 bp, Homo sapiens
gcagagcctgaggttcttgag

SEQ ID NO: 8301659 - DNA, 22 bp, Homo sapiens
gcagagcctgggggtctgcgga

SEQ ID NO: 8301660 - DNA, 22 bp, Homo sapiens
gcagagcctgacgggatttttc

SEQ ID NO: 8301661 - DNA, 20 bp, Homo sapiens
gcagagcctcactgcaaggg

SEQ ID NO: 8301662 - DNA, 22 bp, Homo sapiens
gcagagccgtgaatggatttca

SEQ ID NO: 8301663 - DNA, 22 bp, Homo sapiens
gcagagccctgggggtatggtg

SEQ ID NO: 8301664 - DNA, 21 bp, Homo sapiens
gcagagccggggcgagaaggc

SEQ ID NO: 8301665 - DNA, 22 bp, Homo sapiens
gcagagctcaaggtgttcagct

SEQ ID NO: 8301666 - DNA, 22 bp, Homo sapiens
gcagagctatcttctggatttg

SEQ ID NO: 8301667 - DNA, 22 bp, Homo sapiens
gcagcgtggggacaggagctca

SEQ ID NO: 8301668 - DNA, 22 bp, Homo sapiens
gcagcgtggggctgagtcagct

SEQ ID NO: 8301669 - DNA, 22 bp, Homo sapiens
gatttagagaatgttttgtaag

SEQ ID NO: 8301670 - DNA, 22 bp, Homo sapiens
gatttattggtctttcattggt

SEQ ID NO: 8301671 - DNA, 22 bp, Homo sapiens
gatttcaaaagtagatccatca

SEQ ID NO: 8301672 - DNA, 20 bp, Homo sapiens
gatttcaaagcagagtggcc

SEQ ID NO: 8301673 - DNA, 22 bp, Homo sapiens
gatttcaaaggttctgcatgcc

SEQ ID NO: 8301674 - DNA, 22 bp, Homo sapiens
gatttcaacctaacagtatgac

SEQ ID NO: 8301675 - DNA, 22 bp, Homo sapiens
gattatataatggaagctcttg

SEQ ID NO: 8301676 - DNA, 22 bp, Homo sapiens
gatgctgaagtgaagtgatctt

SEQ ID NO: 8301677 - DNA, 22 bp, Homo sapiens
gatgcctgcatttcaggagagt

SEQ ID NO: 8301678 - DNA, 22 bp, Homo sapiens
gatgctgagaggtggagggaac

SEQ ID NO: 8301679 - DNA, 18 bp, Homo sapiens
gatgggagcaagagaaga

SEQ ID NO: 8301680 - DNA, 22 bp, Homo sapiens
gatgggaggaacctgggtccct

SEQ ID NO: 8301681 - DNA, 22 bp, Homo sapiens
gatggcctcatggctgcaggcc

SEQ ID NO: 8301682 - DNA, 22 bp, Homo sapiens
gatggggatgagaagtgagcag

SEQ ID NO: 8301683 - DNA, 22 bp, Homo sapiens
gatgggggccagggcctgcttt

SEQ ID NO: 8301684 - DNA, 22 bp, Homo sapiens
gatgggtggtctcagacttgcc

SEQ ID NO: 8301685 - DNA, 22 bp, Homo sapiens
gatggtttatgatagatgggaa

SEQ ID NO: 8301686 - DNA, 22 bp, Homo sapiens
gatggtttggaatgaagtagct

SEQ ID NO: 8301687 - DNA, 22 bp, Homo sapiens
gatggtttggtaaaagtatgtt

SEQ ID NO: 8301688 - DNA, 22 bp, Homo sapiens
gcagaagcccggtcagcgcacg

SEQ ID NO: 8301689 - DNA, 22 bp, Homo sapiens
gcagaagctgggcagcgaggtg

SEQ ID NO: 8301690 - DNA, 22 bp, Homo sapiens
gcagaacatttcacagtatctt

SEQ ID NO: 8301691 - DNA, 22 bp, Homo sapiens
gcagagccaggagagacccttg

SEQ ID NO: 8301692 - DNA, 22 bp, Homo sapiens
gcagagccagaatggccaggac

SEQ ID NO: 8301693 - DNA, 22 bp, Homo sapiens
gcagagccaggagcccaggatc

SEQ ID NO: 8301694 - DNA, 22 bp, Homo sapiens
gcagagcccctcaagccagcct

SEQ ID NO: 8301695 - DNA, 22 bp, Homo sapiens
gcagagccaggctggggcaggt

SEQ ID NO: 8301696 - DNA, 22 bp, Homo sapiens
gcagagccatgggaggtttttg

SEQ ID NO: 8301697 - DNA, 22 bp, Homo sapiens
gcagagccccattgctggcggg

SEQ ID NO: 8301698 - DNA, 22 bp, Homo sapiens
gcagagcagtgcttgcccagcg

SEQ ID NO: 8301699 - DNA, 22 bp, Homo sapiens
gcagagcatgtcctcaggacag

SEQ ID NO: 8301700 - DNA, 22 bp, Homo sapiens
gcacctggctgcccaggtggag

SEQ ID NO: 8301701 - DNA, 22 bp, Homo sapiens
gcacctgcaggatgagccaggg

SEQ ID NO: 8301702 - DNA, 22 bp, Homo sapiens
gcacctgcaggatgagccaggg

SEQ ID NO: 8301703 - DNA, 22 bp, Homo sapiens
gcacccaggcttgggcagcaac

SEQ ID NO: 8301704 - DNA, 22 bp, Homo sapiens
gcacccaggcttgggcagcaac

SEQ ID NO: 8301705 - DNA, 22 bp, Homo sapiens
gcacccagggacttggctggcc

SEQ ID NO: 8301706 - DNA, 22 bp, Homo sapiens
gcacccaggccggcgactgcag

SEQ ID NO: 8301707 - DNA, 22 bp, Homo sapiens
gatttcacctgatcttgtcatc

SEQ ID NO: 8301708 - DNA, 22 bp, Homo sapiens
gatttcttcattcattagatgg

SEQ ID NO: 8301709 - DNA, 22 bp, Homo sapiens
gatttcaagcccccagagattc

SEQ ID NO: 8301710 - DNA, 22 bp, Homo sapiens
gatttcaaggatgttagaggtg

SEQ ID NO: 8301711 - DNA, 22 bp, Homo sapiens
gatttcaaggagttttcacagt

SEQ ID NO: 8301712 - DNA, 22 bp, Homo sapiens
gatttcaatccagctttcttct

SEQ ID NO: 8301713 - DNA, 22 bp, Homo sapiens
gatttcaagtatcttgggcgag

SEQ ID NO: 8301714 - DNA, 22 bp, Homo sapiens
gcaaaaaatgcttgttgcttag

SEQ ID NO: 8301715 - DNA, 17 bp, Homo sapiens
gcaatctcagtctcctt

SEQ ID NO: 8301716 - DNA, 22 bp, Homo sapiens
gcaatgatattgaagtgatgaa

SEQ ID NO: 8301717 - DNA, 22 bp, Homo sapiens
cttctcttcccagggacacagg

SEQ ID NO: 8301718 - DNA, 22 bp, Homo sapiens
cttctctgcaccccacttttgc

SEQ ID NO: 8301719 - DNA, 22 bp, Homo sapiens
cttctctgacagtctgtttcac

SEQ ID NO: 8301720 - DNA, 22 bp, Homo sapiens
cttctctctgcataggcatggg

SEQ ID NO: 8301721 - DNA, 22 bp, Homo sapiens
cttctctcggtgcatccctcac

SEQ ID NO: 8301722 - DNA, 22 bp, Homo sapiens
cttctctctgcataggcatggg

SEQ ID NO: 8301723 - DNA, 22 bp, Homo sapiens
cttctttcccaggcatgtttta

SEQ ID NO: 8301724 - DNA, 21 bp, Homo sapiens
cttgaaaggtagagtctacag

SEQ ID NO: 8301725 - DNA, 22 bp, Homo sapiens
cttgaaagctttgcgtcttcta

SEQ ID NO: 8301726 - DNA, 22 bp, Homo sapiens
cttgaaagtcacatgcagccct

SEQ ID NO: 8301727 - DNA, 22 bp, Homo sapiens
cttgaaagatttggcctctgtg

SEQ ID NO: 8301728 - DNA, 22 bp, Homo sapiens
ctggctggtcatcagcagtacg

SEQ ID NO: 8301729 - DNA, 22 bp, Homo sapiens
ctggctggttactatttctggt

SEQ ID NO: 8301730 - DNA, 22 bp, Homo sapiens
cttctctccctggcactcagac

SEQ ID NO: 8301731 - DNA, 22 bp, Homo sapiens
cttctctccctggcactcagac

SEQ ID NO: 8301732 - DNA, 22 bp, Homo sapiens
ctttggcatggtcctcactata

SEQ ID NO: 8301733 - DNA, 22 bp, Homo sapiens
cttgggagacacaagaagacat

SEQ ID NO: 8301734 - DNA, 22 bp, Homo sapiens
cttggggctgtcactctggcat

SEQ ID NO: 8301735 - DNA, 22 bp, Homo sapiens
cttggctgtctataggaaagag

SEQ ID NO: 8301736 - DNA, 22 bp, Homo sapiens
gaacagaagaggctggtgccac

SEQ ID NO: 8301737 - DNA, 22 bp, Homo sapiens
gaacagaattaccgaagatctg

SEQ ID NO: 8301738 - DNA, 22 bp, Homo sapiens
gaacccagtccaggtgcagcct

SEQ ID NO: 8301739 - DNA, 22 bp, Homo sapiens
gaaagtttcttcattaagatgt

SEQ ID NO: 8301740 - DNA, 23 bp, Homo sapiens
cttttaacttgatctgagaccag

SEQ ID NO: 8301741 - DNA, 22 bp, Homo sapiens
gaaaagctaggccagttcagct

SEQ ID NO: 8301742 - DNA, 22 bp, Homo sapiens
gaaaagggcaagagagagggca

SEQ ID NO: 8301743 - DNA, 22 bp, Homo sapiens
gaaaagggcaagagagagggca

SEQ ID NO: 8301744 - DNA, 22 bp, Homo sapiens
gaaagtttataggttatataat

SEQ ID NO: 8301745 - DNA, 17 bp, Homo sapiens
gaaaggtcctagaaatc

SEQ ID NO: 8301746 - DNA, 21 bp, Homo sapiens
gaaaggtcttaacttacagag

SEQ ID NO: 8301747 - DNA, 22 bp, Homo sapiens
gaaaggtgccccataggcagga

SEQ ID NO: 8301748 - DNA, 22 bp, Homo sapiens
gaaaggtcttccggtcttccag

SEQ ID NO: 8301749 - DNA, 22 bp, Homo sapiens
gaaaggtcagttccacttccat

SEQ ID NO: 8301750 - DNA, 22 bp, Homo sapiens
gaagttcaggtgggaattgagc

SEQ ID NO: 8301751 - DNA, 22 bp, Homo sapiens
gaattgtacgctttacataggt

SEQ ID NO: 8301752 - DNA, 22 bp, Homo sapiens
gaattgtagagggaacagaagc

SEQ ID NO: 8301753 - DNA, 22 bp, Homo sapiens
gaattcttttctttctgaaagt

SEQ ID NO: 8301754 - DNA, 20 bp, Homo sapiens
gacaggagagttaggtaggt

SEQ ID NO: 8301755 - DNA, 22 bp, Homo sapiens
gacacagcactgtacaaggaat

SEQ ID NO: 8301756 - DNA, 22 bp, Homo sapiens
gaaggcttgcagctctgtggca

SEQ ID NO: 8301757 - DNA, 22 bp, Homo sapiens
gaaggctgatgacagattctgc

SEQ ID NO: 8301758 - DNA, 22 bp, Homo sapiens
gaaggaagtcattagtgcagac

SEQ ID NO: 8301759 - DNA, 22 bp, Homo sapiens
gaaggaagtgctcatactagtt

SEQ ID NO: 8301760 - DNA, 22 bp, Homo sapiens
gaaggagagagacatcgtccct

SEQ ID NO: 8301761 - DNA, 19 bp, Homo sapiens
gaaggagagctgagttagg

SEQ ID NO: 8301762 - DNA, 22 bp, Homo sapiens
gaaggagaccctgaagatgctg

SEQ ID NO: 8301763 - DNA, 22 bp, Homo sapiens
gaaggagaccctgaagatgctg

SEQ ID NO: 8301764 - DNA, 22 bp, Homo sapiens
gaaggagagggtcaaggataat

SEQ ID NO: 8301765 - DNA, 22 bp, Homo sapiens
gaaggcctcactctgcagcata

SEQ ID NO: 8301766 - DNA, 22 bp, Homo sapiens
gaaggcctagggatgctctgcg

SEQ ID NO: 8301767 - DNA, 22 bp, Homo sapiens
gaaggcctagggatgctctgcg

SEQ ID NO: 8301768 - DNA, 22 bp, Homo sapiens
gagagctgggttcaagtagctg

SEQ ID NO: 8301769 - DNA, 22 bp, Homo sapiens
gagagctgggggactgtggatg

SEQ ID NO: 8301770 - DNA, 20 bp, Homo sapiens
gagagctggggatgaggctg

SEQ ID NO: 8301771 - DNA, 22 bp, Homo sapiens
gagagctgggctttgggtgaag

SEQ ID NO: 8301772 - DNA, 22 bp, Homo sapiens
gagagctgggaaagccgtggag

SEQ ID NO: 8301773 - DNA, 22 bp, Homo sapiens
gagagctggattctggataggt

SEQ ID NO: 8301774 - DNA, 22 bp, Homo sapiens
gagagctggccagcttcagtat

SEQ ID NO: 8301775 - DNA, 23 bp, Homo sapiens
gagagctgactgtcaagactgtt

SEQ ID NO: 8301776 - DNA, 22 bp, Homo sapiens
gagacagagtttcactcttgtt

SEQ ID NO: 8301777 - DNA, 22 bp, Homo sapiens
gagagctgcagccgagaggggg

SEQ ID NO: 8301778 - DNA, 22 bp, Homo sapiens
gagagctgcaaggtagggcggg

SEQ ID NO: 8301779 - DNA, 22 bp, Homo sapiens
gagagctgatagatgagctact

SEQ ID NO: 8301780 - DNA, 17 bp, Homo sapiens
gagagctgctgcttccg

SEQ ID NO: 8301781 - DNA, 22 bp, Homo sapiens
gagagctgcattctcagacaca

SEQ ID NO: 8301782 - DNA, 21 bp, Homo sapiens
gagacagactttcgtcccctg

SEQ ID NO: 8301783 - DNA, 18 bp, Homo sapiens
gagacacaagggcctgga

SEQ ID NO: 8301784 - DNA, 22 bp, Homo sapiens
gagacacacacaggaggtggca

SEQ ID NO: 8301785 - DNA, 22 bp, Homo sapiens
gactgtcattctagtgcccatg

SEQ ID NO: 8301786 - DNA, 22 bp, Homo sapiens
gacccagggtttctgcacaggg

SEQ ID NO: 8301787 - DNA, 22 bp, Homo sapiens
gactgtgtccatgtgctggatt

SEQ ID NO: 8301788 - DNA, 22 bp, Homo sapiens
gacccagcttaagtcacatgtt

SEQ ID NO: 8301789 - DNA, 22 bp, Homo sapiens
gacaggaggcagagctcaggtg

SEQ ID NO: 8301790 - DNA, 22 bp, Homo sapiens
gagtgcatcgtggccattttaa

SEQ ID NO: 8301791 - DNA, 17 bp, Homo sapiens
gagtgctggtggagctc

SEQ ID NO: 8301792 - DNA, 22 bp, Homo sapiens
gagtggagcaaaagaggtagat

SEQ ID NO: 8301793 - DNA, 22 bp, Homo sapiens
gagtgaaaaaggaagggccata

SEQ ID NO: 8301794 - DNA, 22 bp, Homo sapiens
gagtgagggcagcaggggctgc

SEQ ID NO: 8301795 - DNA, 22 bp, Homo sapiens
gagtggggtctgggcatcagtc

SEQ ID NO: 8301796 - DNA, 22 bp, Homo sapiens
gagtggtaggcagtgttaggaa

SEQ ID NO: 8301797 - DNA, 21 bp, Homo sapiens
gagtgtctaatccaggctgtc

SEQ ID NO: 8301798 - DNA, 22 bp, Homo sapiens
gagtgttcccacaccccagttg

SEQ ID NO: 8301799 - DNA, 22 bp, Homo sapiens
gagtgttccagaaactggccct

SEQ ID NO: 8301800 - DNA, 23 bp, Homo sapiens
gagtgttcatagcaggctcttgc

SEQ ID NO: 8301801 - DNA, 22 bp, Homo sapiens
gagtgtgtcggtcagcgtggcg

SEQ ID NO: 8301802 - DNA, 22 bp, Homo sapiens
gagtgtggtgaacaggagcacc

SEQ ID NO: 8301803 - DNA, 22 bp, Homo sapiens
gagtgtgggcacgggggccttg

SEQ ID NO: 8301804 - DNA, 22 bp, Homo sapiens
gagttgttcaacgtgtgtgaaa

SEQ ID NO: 8301805 - DNA, 22 bp, Homo sapiens
gatcaaaagctgggttctaaaa

SEQ ID NO: 8301806 - DNA, 22 bp, Homo sapiens
gatacattttatctcctaacag

SEQ ID NO: 8301807 - DNA, 22 bp, Homo sapiens
gataccagacagggagggagaa

SEQ ID NO: 8301808 - DNA, 19 bp, Homo sapiens
gatctttgccaatttaagc

SEQ ID NO: 8301809 - DNA, 22 bp, Homo sapiens
gatcttttcaggtttctctagt

SEQ ID NO: 8301810 - DNA, 22 bp, Homo sapiens
gatgcacagtgaccctgccagt

SEQ ID NO: 8301811 - DNA, 22 bp, Homo sapiens
gatgcacatgtgagtatagaag

SEQ ID NO: 8301812 - DNA, 22 bp, Homo sapiens
gatgcactgcagtatatactgt

SEQ ID NO: 8301813 - DNA, 22 bp, Homo sapiens
gatgcactttcttttcaacagt

SEQ ID NO: 8301814 - DNA, 22 bp, Homo sapiens
gatgcagaaagtagacaccatc

SEQ ID NO: 8301815 - DNA, 22 bp, Homo sapiens
gatgcacttgcccctcctcaga

SEQ ID NO: 8301816 - DNA, 22 bp, Homo sapiens
gatgcagggctggcaggagctt

SEQ ID NO: 8301817 - DNA, 22 bp, Homo sapiens
gatgcagggctggcaggagctt

SEQ ID NO: 8301818 - DNA, 22 bp, Homo sapiens
gatgattttatgtcttgtcatt

SEQ ID NO: 8301819 - DNA, 21 bp, Homo sapiens
gatgaagcaatctttctgttg

SEQ ID NO: 8301820 - DNA, 22 bp, Homo sapiens
gatgaagcctgacttctcggtg

SEQ ID NO: 8301821 - DNA, 22 bp, Homo sapiens
gaggcctgaaaggggacctatg

SEQ ID NO: 8301822 - DNA, 22 bp, Homo sapiens
gaggcctgaaaggggacctatg

SEQ ID NO: 8301823 - DNA, 18 bp, Homo sapiens
gaggcctgagaaccaggt

SEQ ID NO: 8301824 - DNA, 18 bp, Homo sapiens
gaggcctgagaaccaggt

SEQ ID NO: 8301825 - DNA, 22 bp, Homo sapiens
gaggccctccagctgtcagctg

SEQ ID NO: 8301826 - DNA, 20 bp, Homo sapiens
gaggcctcagcctcagctcc

SEQ ID NO: 8301827 - DNA, 22 bp, Homo sapiens
gaggcagctgaaggagtgacag

SEQ ID NO: 8301828 - DNA, 22 bp, Homo sapiens
gaggcccaggtcaagcagccac

SEQ ID NO: 8301829 - DNA, 22 bp, Homo sapiens
gaggcccagtcctgcaagcacg

SEQ ID NO: 8301830 - DNA, 22 bp, Homo sapiens
gaggagggagctggaagctctt

SEQ ID NO: 8301831 - DNA, 22 bp, Homo sapiens
gaggaggctggcgccgcctgcc

SEQ ID NO: 8301832 - DNA, 22 bp, Homo sapiens
gaggcagaggttgcagtgagct

SEQ ID NO: 8301833 - DNA, 22 bp, Homo sapiens
gaggcagagtgcaccccaggag

SEQ ID NO: 8301834 - DNA, 22 bp, Homo sapiens
gaggcagcaaaatatatcataa

SEQ ID NO: 8301835 - DNA, 22 bp, Homo sapiens
gaggcagagtcacaaagagtct

SEQ ID NO: 8301836 - DNA, 22 bp, Homo sapiens
gagctgggacatgggtcctctc

SEQ ID NO: 8301837 - DNA, 22 bp, Homo sapiens
gagctggctaatactgacttat

SEQ ID NO: 8301838 - DNA, 22 bp, Homo sapiens
gagctggctccgccatgctgct

SEQ ID NO: 8301839 - DNA, 22 bp, Homo sapiens
gagctggcaggaggctccccga

SEQ ID NO: 8301840 - DNA, 22 bp, Homo sapiens
gagctgcttctgtgtgccgggt

SEQ ID NO: 8301841 - DNA, 22 bp, Homo sapiens
gagatatgttagaaagctattg

SEQ ID NO: 8301842 - DNA, 22 bp, Homo sapiens
gagagtgaggcatcaggggcag

SEQ ID NO: 8301843 - DNA, 22 bp, Homo sapiens
gagagtgaaggcttcccagcaa

SEQ ID NO: 8301844 - DNA, 22 bp, Homo sapiens
gagagtgagataatttcacata

SEQ ID NO: 8301845 - DNA, 22 bp, Homo sapiens
gagagtgagatcctcctgggga

SEQ ID NO: 8301846 - DNA, 22 bp, Homo sapiens
gagagtgaaggcttcccagcaa

SEQ ID NO: 8301847 - DNA, 17 bp, Homo sapiens
gagagtgtattggatgc

SEQ ID NO: 8301848 - DNA, 22 bp, Homo sapiens
gagagtgtcgggggccccagga

SEQ ID NO: 8301849 - DNA, 22 bp, Homo sapiens
gagagtgattccctcccataga

SEQ ID NO: 8301850 - DNA, 22 bp, Homo sapiens
gagagtgatgaatggttaaaca

SEQ ID NO: 8301851 - DNA, 22 bp, Homo sapiens
gagagtgaggcctgggaatcta

SEQ ID NO: 8301852 - DNA, 23 bp, Homo sapiens
gagctgggatacaggcttactgc

SEQ ID NO: 8301853 - DNA, 22 bp, Homo sapiens
gaggacagcttagggcttcctg

SEQ ID NO: 8301854 - DNA, 22 bp, Homo sapiens
gaggaatgtcagcacaggcctc

SEQ ID NO: 8301855 - DNA, 22 bp, Homo sapiens
gagggcagtagcctcgtaccct

SEQ ID NO: 8301856 - DNA, 20 bp, Homo sapiens
gagggcaggcacccatttca

SEQ ID NO: 8301857 - DNA, 22 bp, Homo sapiens
gagggcaggggtcttgcacggt

SEQ ID NO: 8301858 - DNA, 22 bp, Homo sapiens
gagggcagagtctaatgatgca

SEQ ID NO: 8301859 - DNA, 22 bp, Homo sapiens
gagggcagtgaattttgaagct

SEQ ID NO: 8301860 - DNA, 22 bp, Homo sapiens
gagggcagtgaattttgaagct

SEQ ID NO: 8301861 - DNA, 22 bp, Homo sapiens
gaggggcagaatgtgatcaggg

SEQ ID NO: 8301862 - DNA, 22 bp, Homo sapiens
gaggcctgcagcgtggtccctg

SEQ ID NO: 8301863 - DNA, 22 bp, Homo sapiens
gaggctgcccaactggagtgga

SEQ ID NO: 8301864 - DNA, 22 bp, Homo sapiens
gaggcctgctttggcactctgg

SEQ ID NO: 8301865 - DNA, 22 bp, Homo sapiens
gaggcctgaggctgcctggagc

SEQ ID NO: 8301866 - DNA, 22 bp, Homo sapiens
gaggcctgaggctgcctggagc

SEQ ID NO: 8301867 - DNA, 22 bp, Homo sapiens
gaggctggcagaaaagcacagg

SEQ ID NO: 8301868 - DNA, 22 bp, Homo sapiens
gagggcagagacagtgattcac

SEQ ID NO: 8301869 - DNA, 16 bp, Homo sapiens
gagggcagaggcggaa

SEQ ID NO: 8301870 - DNA, 22 bp, Homo sapiens
gagggcagagacagtgattcac

SEQ ID NO: 8301871 - DNA, 22 bp, Homo sapiens
gaggctgggaagtccaagacca

SEQ ID NO: 8301872 - DNA, 22 bp, Homo sapiens
gagtcacaaagcctttcttatt

SEQ ID NO: 8301873 - DNA, 22 bp, Homo sapiens
gagtcacattaatttaatttta

SEQ ID NO: 8301874 - DNA, 22 bp, Homo sapiens
gaggtggtcgaggaggggtacc

SEQ ID NO: 8301875 - DNA, 19 bp, Homo sapiens
gaggtgggtccccgcagcc

SEQ ID NO: 8301876 - DNA, 19 bp, Homo sapiens
gaggtgggtccccgcagcc

SEQ ID NO: 8301877 - DNA, 22 bp, Homo sapiens
gaggtgggtgtatcacaggtca

SEQ ID NO: 8301878 - DNA, 22 bp, Homo sapiens
gagtcagtaatggatatgtcat

SEQ ID NO: 8301879 - DNA, 22 bp, Homo sapiens
gagtccagttgttcacagaggc

SEQ ID NO: 8301880 - DNA, 22 bp, Homo sapiens
gagtcccatgatgatagccaca

SEQ ID NO: 8301881 - DNA, 22 bp, Homo sapiens
gaggtcaggcttgcagcagggt

SEQ ID NO: 8301882 - DNA, 22 bp, Homo sapiens
gaggtcaggggagaggctgatg

SEQ ID NO: 8301883 - DNA, 22 bp, Homo sapiens
gaggtcagtcagaccagggttt

SEQ ID NO: 8301884 - DNA, 22 bp, Homo sapiens
gaggtgggcggatcacaaggtc

SEQ ID NO: 8301885 - DNA, 22 bp, Homo sapiens
gaggtgggatgtgtgtgctact

SEQ ID NO: 8301886 - DNA, 22 bp, Homo sapiens
gaggggctcttgggcatgaagg

SEQ ID NO: 8301887 - DNA, 22 bp, Homo sapiens
gaggtatgtatgctacattctt

SEQ ID NO: 8301888 - DNA, 22 bp, Homo sapiens
gaggtcaataatatgtgcttta

SEQ ID NO: 8301889 - DNA, 22 bp, Homo sapiens
ggaaagagctaaaagggtgaga

SEQ ID NO: 8301890 - DNA, 22 bp, Homo sapiens
ggaaagaggatagtgggtaggt

SEQ ID NO: 8301891 - DNA, 23 bp, Homo sapiens
ggaaagagaggagttgtgcatag

SEQ ID NO: 8301892 - DNA, 22 bp, Homo sapiens
ggaaagagcccagcagtgcttg

SEQ ID NO: 8301893 - DNA, 22 bp, Homo sapiens
ggaaagacctgagataggaata

SEQ ID NO: 8301894 - DNA, 19 bp, Homo sapiens
ggaaacaggggccagagga

SEQ ID NO: 8301895 - DNA, 22 bp, Homo sapiens
gcttctggaggagctgggctga

SEQ ID NO: 8301896 - DNA, 22 bp, Homo sapiens
ggaaggtcgagctgcatctggc

SEQ ID NO: 8301897 - DNA, 22 bp, Homo sapiens
ggaagggcaaaagagatgaact

SEQ ID NO: 8301898 - DNA, 22 bp, Homo sapiens
gcttccttctaccacatcatgc

SEQ ID NO: 8301899 - DNA, 20 bp, Homo sapiens
gcttccttcccagcccccac

SEQ ID NO: 8301900 - DNA, 17 bp, Homo sapiens
gcttcctgtgctgggga

SEQ ID NO: 8301901 - DNA, 17 bp, Homo sapiens
gcttcctgtgctgggga

SEQ ID NO: 8301902 - DNA, 22 bp, Homo sapiens
gcttcctgtccctcagccatga

SEQ ID NO: 8301903 - DNA, 22 bp, Homo sapiens
gcttcattactgacagtctgtg

SEQ ID NO: 8301904 - DNA, 22 bp, Homo sapiens
gcttcctggagggagagagctg

SEQ ID NO: 8301905 - DNA, 22 bp, Homo sapiens
gcttagtcaattataaataggc

SEQ ID NO: 8301906 - DNA, 22 bp, Homo sapiens
gctgggctgagctagacttggc

SEQ ID NO: 8301907 - DNA, 22 bp, Homo sapiens
ggagaggtgaatggctgctcta

SEQ ID NO: 8301908 - DNA, 22 bp, Homo sapiens
ggagcctgtgcccaagcccaga

SEQ ID NO: 8301909 - DNA, 22 bp, Homo sapiens
ggagccttgggcgctctcccat

SEQ ID NO: 8301910 - DNA, 22 bp, Homo sapiens
ggagcctgttagttgagtgctc

SEQ ID NO: 8301911 - DNA, 22 bp, Homo sapiens
ggagccttccagactgcccaca

SEQ ID NO: 8301912 - DNA, 22 bp, Homo sapiens
ggagcctgtggctgcttgaagc

SEQ ID NO: 8301913 - DNA, 22 bp, Homo sapiens
ggagcctgtggccgtcacgact

SEQ ID NO: 8301914 - DNA, 22 bp, Homo sapiens
ggagcctgtgggatgagatgtg

SEQ ID NO: 8301915 - DNA, 22 bp, Homo sapiens
ggagcctgttagttgagtgctc

SEQ ID NO: 8301916 - DNA, 22 bp, Homo sapiens
ggagaaggaagaaagctactat

SEQ ID NO: 8301917 - DNA, 22 bp, Homo sapiens
ggaggccaaggtgggcggatca

SEQ ID NO: 8301918 - DNA, 22 bp, Homo sapiens
ggaggccaaggcgggcggatca

SEQ ID NO: 8301919 - DNA, 22 bp, Homo sapiens
ggaggccacctgacctgctgtt

SEQ ID NO: 8301920 - DNA, 22 bp, Homo sapiens
ggaggccacggtttagcaccga

SEQ ID NO: 8301921 - DNA, 22 bp, Homo sapiens
ggaggccagggtgggtggatcg

SEQ ID NO: 8301922 - DNA, 22 bp, Homo sapiens
ggaggccaggaaggctcggaga

SEQ ID NO: 8301923 - DNA, 22 bp, Homo sapiens
ggaggccatcagggagggcatt

SEQ ID NO: 8301924 - DNA, 22 bp, Homo sapiens
ggaggccagtcctggccgggct

SEQ ID NO: 8301925 - DNA, 22 bp, Homo sapiens
ggaggccatagtttgggagtca

SEQ ID NO: 8301926 - DNA, 22 bp, Homo sapiens
ggaggccatgaggctctaggtg

SEQ ID NO: 8301927 - DNA, 22 bp, Homo sapiens
ggaggccatctggctggaggct

SEQ ID NO: 8301928 - DNA, 22 bp, Homo sapiens
ggagctgatgacgtcaccatgg

SEQ ID NO: 8301929 - DNA, 22 bp, Homo sapiens
ggagctgcacgctctgaagcct

SEQ ID NO: 8301930 - DNA, 22 bp, Homo sapiens
ggagctgaaggggtgggctcag

SEQ ID NO: 8301931 - DNA, 22 bp, Homo sapiens
ggaggacctgctggccctgcaa

SEQ ID NO: 8301932 - DNA, 22 bp, Homo sapiens
ggaggaccccagcagctcccca

SEQ ID NO: 8301933 - DNA, 22 bp, Homo sapiens
ggaggacaggggctgcagcaca

SEQ ID NO: 8301934 - DNA, 22 bp, Homo sapiens
ggaggtgggctaaggactctct

SEQ ID NO: 8301935 - DNA, 22 bp, Homo sapiens
ggaggtggtggcagtgacaatt

SEQ ID NO: 8301936 - DNA, 22 bp, Homo sapiens
ggaggtgggagacataggcggc

SEQ ID NO: 8301937 - DNA, 22 bp, Homo sapiens
ggaggtgggagacataggcggc

SEQ ID NO: 8301938 - DNA, 22 bp, Homo sapiens
ggagggttagcaaaggcacaga

SEQ ID NO: 8301939 - DNA, 22 bp, Homo sapiens
ggaggtggaggttgcagtgagc

SEQ ID NO: 8301940 - DNA, 22 bp, Homo sapiens
ggagggtgcattttaccctgtg

SEQ ID NO: 8301941 - DNA, 22 bp, Homo sapiens
ggaggctgctgcctcacgtggg

SEQ ID NO: 8301942 - DNA, 22 bp, Homo sapiens
ggaggctctgctccgtgtgttc

SEQ ID NO: 8301943 - DNA, 22 bp, Homo sapiens
ggaggctcccacgcagctcaca

SEQ ID NO: 8301944 - DNA, 22 bp, Homo sapiens
ggaggctccactgctcttcctg

SEQ ID NO: 8301945 - DNA, 22 bp, Homo sapiens
ggaggcctagccagctccagtt

SEQ ID NO: 8301946 - DNA, 19 bp, Homo sapiens
ggaggcctgggtatttgcc

SEQ ID NO: 8301947 - DNA, 22 bp, Homo sapiens
ggaggccttgaggccaggagct

SEQ ID NO: 8301948 - DNA, 22 bp, Homo sapiens
ggaggcccagagaggtgaagtg

SEQ ID NO: 8301949 - DNA, 22 bp, Homo sapiens
ggagggctgagactggggtctg

SEQ ID NO: 8301950 - DNA, 22 bp, Homo sapiens
ggagggctcaattgactcctga

SEQ ID NO: 8301951 - DNA, 18 bp, Homo sapiens
ggagggctttggggactg

SEQ ID NO: 8301952 - DNA, 22 bp, Homo sapiens
ggagggctgccaggtggagcgg

SEQ ID NO: 8301953 - DNA, 21 bp, Homo sapiens
ggagggcagcccagactggct

SEQ ID NO: 8301954 - DNA, 22 bp, Homo sapiens
ggagggcatcaatcaggcctgg

SEQ ID NO: 8301955 - DNA, 22 bp, Homo sapiens
ggcagctctgatgatgctctgg

SEQ ID NO: 8301956 - DNA, 22 bp, Homo sapiens
ggcagctctgctccacatgagt

SEQ ID NO: 8301957 - DNA, 22 bp, Homo sapiens
ggcagctggcctcctcgcccac

SEQ ID NO: 8301958 - DNA, 22 bp, Homo sapiens
ggcagctggcctcctcgcccac

SEQ ID NO: 8301959 - DNA, 17 bp, Homo sapiens
ggcagctgccacttttt

SEQ ID NO: 8301960 - DNA, 23 bp, Homo sapiens
ggcagctctcatctgatgactga

SEQ ID NO: 8301961 - DNA, 22 bp, Homo sapiens
ggcagaggaagctggaagtggg

SEQ ID NO: 8301962 - DNA, 22 bp, Homo sapiens
ggcagaggaagctggaagtggg

SEQ ID NO: 8301963 - DNA, 22 bp, Homo sapiens
ggcagctgtaagatgagtgaat

SEQ ID NO: 8301964 - DNA, 22 bp, Homo sapiens
ggcagctggggcagtgccctgt

SEQ ID NO: 8301965 - DNA, 22 bp, Homo sapiens
ggcagctgggttggccagaaac

SEQ ID NO: 8301966 - DNA, 22 bp, Homo sapiens
ggcagctgggtcacaccgatct

SEQ ID NO: 8301967 - DNA, 22 bp, Homo sapiens
ggcagctgggtcacaccgatct

SEQ ID NO: 8301968 - DNA, 22 bp, Homo sapiens
ggcagctgggttggccagaaac

SEQ ID NO: 8301969 - DNA, 22 bp, Homo sapiens
ggcaggctggctttgttccagg

SEQ ID NO: 8301970 - DNA, 22 bp, Homo sapiens
ggcaggcaggagcgtgcttggg

SEQ ID NO: 8301971 - DNA, 22 bp, Homo sapiens
ggcaggctgcttgggtcatgtc

SEQ ID NO: 8301972 - DNA, 22 bp, Homo sapiens
ggcaaggccttgcccagcattc

SEQ ID NO: 8301973 - DNA, 22 bp, Homo sapiens
ggagttcactgtgcaggctctg

SEQ ID NO: 8301974 - DNA, 22 bp, Homo sapiens
ggagtgggcagcactgccctgt

SEQ ID NO: 8301975 - DNA, 22 bp, Homo sapiens
ggagtgggcagcactgccctgt

SEQ ID NO: 8301976 - DNA, 22 bp, Homo sapiens
ggagtgggaacaatgacatggt

SEQ ID NO: 8301977 - DNA, 23 bp, Homo sapiens
ggcagagagcatggctggggccc

SEQ ID NO: 8301978 - DNA, 22 bp, Homo sapiens
ggcagagcttgttccttctgtt

SEQ ID NO: 8301979 - DNA, 22 bp, Homo sapiens
ggcagagcttgttccttctgtt

SEQ ID NO: 8301980 - DNA, 22 bp, Homo sapiens
ggcagagactgggttggcagag

SEQ ID NO: 8301981 - DNA, 22 bp, Homo sapiens
ggcaggtgctctgtgggcctgg

SEQ ID NO: 8301982 - DNA, 22 bp, Homo sapiens
ggccagaagttggaaaagagcc

SEQ ID NO: 8301983 - DNA, 22 bp, Homo sapiens
ggccaccttccagttgcctgca

SEQ ID NO: 8301984 - DNA, 22 bp, Homo sapiens
ggccagaaagttaagctgtggc

SEQ ID NO: 8301985 - DNA, 22 bp, Homo sapiens
ggccagagaatatgccttacgt

SEQ ID NO: 8301986 - DNA, 22 bp, Homo sapiens
ggccagagagccgctgttagga

SEQ ID NO: 8301987 - DNA, 22 bp, Homo sapiens
ggccagaggccacagctgtgtc

SEQ ID NO: 8301988 - DNA, 22 bp, Homo sapiens
ggccagaggccatcctcctgct

SEQ ID NO: 8301989 - DNA, 19 bp, Homo sapiens
ggcccctctcacaggagtt

SEQ ID NO: 8301990 - DNA, 22 bp, Homo sapiens
ggcccctgcggactgcctagag

SEQ ID NO: 8301991 - DNA, 22 bp, Homo sapiens
ggccccacgggggagtcctagt

SEQ ID NO: 8301992 - DNA, 19 bp, Homo sapiens
ggcccaagtactgagtgcc

SEQ ID NO: 8301993 - DNA, 22 bp, Homo sapiens
ggcccacactgacagctgagct

SEQ ID NO: 8301994 - DNA, 22 bp, Homo sapiens
ggcccaaggcccaggtcgagct

SEQ ID NO: 8301995 - DNA, 22 bp, Homo sapiens
ggcccagccggcgagtctcgcg

SEQ ID NO: 8301996 - DNA, 22 bp, Homo sapiens
ggcccacttgaaatggagctca

SEQ ID NO: 8301997 - DNA, 22 bp, Homo sapiens
ggccatggttggggaagacatg

SEQ ID NO: 8301998 - DNA, 21 bp, Homo sapiens
ggctcctgctttgtgaggggc

SEQ ID NO: 8301999 - DNA, 22 bp, Homo sapiens
ggctcaggcctgtaatcctagc

SEQ ID NO: 8302000 - DNA, 22 bp, Homo sapiens
ggctcaggtttccttcccagct

SEQ ID NO: 8302001 - DNA, 22 bp, Homo sapiens
ggccttgggaggagggtcagaa

SEQ ID NO: 8302002 - DNA, 21 bp, Homo sapiens
ggccttggcgggggccgaatt

SEQ ID NO: 8302003 - DNA, 20 bp, Homo sapiens
ggccttggcctctttgcagc

SEQ ID NO: 8302004 - DNA, 22 bp, Homo sapiens
ggctcaggacctgggattgcca

SEQ ID NO: 8302005 - DNA, 22 bp, Homo sapiens
ggctcaggactgcagcgtagag

SEQ ID NO: 8302006 - DNA, 22 bp, Homo sapiens
ggctcaggacacagtggtttag

SEQ ID NO: 8302007 - DNA, 22 bp, Homo sapiens
ggctcaggccagaccacgactc

SEQ ID NO: 8302008 - DNA, 22 bp, Homo sapiens
ggctcaggatgagccttctcat

SEQ ID NO: 8302009 - DNA, 22 bp, Homo sapiens
ggctcaggagaggggctaaaag

SEQ ID NO: 8302010 - DNA, 22 bp, Homo sapiens
ggccctgagctgaagtactgtg

SEQ ID NO: 8302011 - DNA, 22 bp, Homo sapiens
ggcctgggcccactgtcaagag

SEQ ID NO: 8302012 - DNA, 22 bp, Homo sapiens
ggcctgggcccactgtcaagag

SEQ ID NO: 8302013 - DNA, 23 bp, Homo sapiens
ggcctgtgttttgtctgaagtac

SEQ ID NO: 8302014 - DNA, 22 bp, Homo sapiens
ggcctgggcccactgtcaagag

SEQ ID NO: 8302015 - DNA, 22 bp, Homo sapiens
ggccctccctgagccaggtggg

SEQ ID NO: 8302016 - DNA, 22 bp, Homo sapiens
ggcccctggcaccaggctgatt

SEQ ID NO: 8302017 - DNA, 22 bp, Homo sapiens
ggcctgggcctttgtgttttga

SEQ ID NO: 8302018 - DNA, 22 bp, Homo sapiens
ggccttcacgtgacctggcgtg

SEQ ID NO: 8302019 - DNA, 22 bp, Homo sapiens
ggcttcagtgactggtgccctc

SEQ ID NO: 8302020 - DNA, 22 bp, Homo sapiens
ggcttcagtgagctgagctcac

SEQ ID NO: 8302021 - DNA, 22 bp, Homo sapiens
ggcttcatggaggaggtgagtc

SEQ ID NO: 8302022 - DNA, 22 bp, Homo sapiens
ggcttcccaaggagccaggatg

SEQ ID NO: 8302023 - DNA, 22 bp, Homo sapiens
ggcttcccagcagagggcgcac

SEQ ID NO: 8302024 - DNA, 22 bp, Homo sapiens
ggctggcttgccaagctcaggg

SEQ ID NO: 8302025 - DNA, 22 bp, Homo sapiens
ggctggctggctggtagacaag

SEQ ID NO: 8302026 - DNA, 22 bp, Homo sapiens
ggctggctcagggcttgagaga

SEQ ID NO: 8302027 - DNA, 19 bp, Homo sapiens
gggaaattcacttgcttcc

SEQ ID NO: 8302028 - DNA, 21 bp, Homo sapiens
gggaaattaggattgctcatc

SEQ ID NO: 8302029 - DNA, 22 bp, Homo sapiens
gggaaattgtcaacactctcaa

SEQ ID NO: 8302030 - DNA, 22 bp, Homo sapiens
gggaaattgtgtgagatctttg

SEQ ID NO: 8302031 - DNA, 22 bp, Homo sapiens
ggcttcctaatactccctacac

SEQ ID NO: 8302032 - DNA, 22 bp, Homo sapiens
ggcttccctttccgagaggaga

SEQ ID NO: 8302033 - DNA, 22 bp, Homo sapiens
ggcttcctggggcctcctgcaa

SEQ ID NO: 8302034 - DNA, 22 bp, Homo sapiens
ggcttcctggagaaggtctgag

SEQ ID NO: 8302035 - DNA, 22 bp, Homo sapiens
ggcttcctggggcctcctgcaa

SEQ ID NO: 8302036 - DNA, 22 bp, Homo sapiens
ggcttcctttcactaccctcag

SEQ ID NO: 8302037 - DNA, 22 bp, Homo sapiens
ggcttctccaggtactgagcat

SEQ ID NO: 8302038 - DNA, 18 bp, Homo sapiens
gggaagaggatctggccc

SEQ ID NO: 8302039 - DNA, 22 bp, Homo sapiens
gggaaccagccgcttccgcctc

SEQ ID NO: 8302040 - DNA, 22 bp, Homo sapiens
ggctgccttcagactccagctt

SEQ ID NO: 8302041 - DNA, 22 bp, Homo sapiens
ggctgccttcagactccagctt

SEQ ID NO: 8302042 - DNA, 22 bp, Homo sapiens
ggctgcctgtgcccaggcacac

SEQ ID NO: 8302043 - DNA, 18 bp, Homo sapiens
ggctgcctgttcctgaag

SEQ ID NO: 8302044 - DNA, 22 bp, Homo sapiens
ggctgcctgtgcccaggcacac

SEQ ID NO: 8302045 - DNA, 22 bp, Homo sapiens
ggctgcctgggagccctcctct

SEQ ID NO: 8302046 - DNA, 19 bp, Homo sapiens
ggctgcctggagcgagggc

SEQ ID NO: 8302047 - DNA, 22 bp, Homo sapiens
ggctgcaggcagaggctgtctg

SEQ ID NO: 8302048 - DNA, 22 bp, Homo sapiens
ggctgctctgccttccagctgg

SEQ ID NO: 8302049 - DNA, 22 bp, Homo sapiens
ggctgctcttcttggcgacctc

SEQ ID NO: 8302050 - DNA, 22 bp, Homo sapiens
ggctgccttccctgagccccgg

SEQ ID NO: 8302051 - DNA, 23 bp, Homo sapiens
ggctggcccggggctgctcctga

SEQ ID NO: 8302052 - DNA, 23 bp, Homo sapiens
ggctggcccggggctgctcctga

SEQ ID NO: 8302053 - DNA, 22 bp, Homo sapiens
ggctggcctcagggtcctcgct

SEQ ID NO: 8302054 - DNA, 22 bp, Homo sapiens
ggctggcctgtgtggccgccac

SEQ ID NO: 8302055 - DNA, 22 bp, Homo sapiens
ggctcctggcatctggtgggta

SEQ ID NO: 8302056 - DNA, 22 bp, Homo sapiens
ggctcctgggatgggactgagc

SEQ ID NO: 8302057 - DNA, 22 bp, Homo sapiens
ggctcctggggaggtgagcttg

SEQ ID NO: 8302058 - DNA, 22 bp, Homo sapiens
ggctgagttgagaggattactt

SEQ ID NO: 8302059 - DNA, 19 bp, Homo sapiens
ggctctcccttgagagagc

SEQ ID NO: 8302060 - DNA, 19 bp, Homo sapiens
ggctctcccttgagagagc

SEQ ID NO: 8302061 - DNA, 22 bp, Homo sapiens
ggctgcagaagtacttccggat

SEQ ID NO: 8302062 - DNA, 22 bp, Homo sapiens
ggctgcagagctgggtgggcct

SEQ ID NO: 8302063 - DNA, 22 bp, Homo sapiens
gggagggaaagcttgatctgtc

SEQ ID NO: 8302064 - DNA, 22 bp, Homo sapiens
gggagggaaagcttgatctgtc

SEQ ID NO: 8302065 - DNA, 22 bp, Homo sapiens
gggaggctggctctggccacag

SEQ ID NO: 8302066 - DNA, 22 bp, Homo sapiens
gggagggaaggaggcgccgtgt

SEQ ID NO: 8302067 - DNA, 22 bp, Homo sapiens
gggagggaaggaccttatgaat

SEQ ID NO: 8302068 - DNA, 22 bp, Homo sapiens
gggagggaaggtacctgtgtga

SEQ ID NO: 8302069 - DNA, 22 bp, Homo sapiens
gggatggctcaaaggagtcagg

SEQ ID NO: 8302070 - DNA, 22 bp, Homo sapiens
gggatggctcaaaggagtcagg

SEQ ID NO: 8302071 - DNA, 22 bp, Homo sapiens
gggatggctttgtggctgactc

SEQ ID NO: 8302072 - DNA, 22 bp, Homo sapiens
gggatggacttggggactccag

SEQ ID NO: 8302073 - DNA, 19 bp, Homo sapiens
gggatgggccctcaccctc

SEQ ID NO: 8302074 - DNA, 19 bp, Homo sapiens
gggatgggccctcaccctc

SEQ ID NO: 8302075 - DNA, 22 bp, Homo sapiens
gggatggggagctggaaagggg

SEQ ID NO: 8302076 - DNA, 22 bp, Homo sapiens
gggcagaggggcgcttccctct

SEQ ID NO: 8302077 - DNA, 22 bp, Homo sapiens
gggatggggagctggaaagggg

SEQ ID NO: 8302078 - DNA, 22 bp, Homo sapiens
gggacgggcacggagggccctc

SEQ ID NO: 8302079 - DNA, 22 bp, Homo sapiens
gggaccaggtgggtgcattccg

SEQ ID NO: 8302080 - DNA, 22 bp, Homo sapiens
gggcctgtgcacagttctgtta

SEQ ID NO: 8302081 - DNA, 22 bp, Homo sapiens
gggcctgtgtgttcaggagcct

SEQ ID NO: 8302082 - DNA, 22 bp, Homo sapiens
gggcctggtgcttctgactcct

SEQ ID NO: 8302083 - DNA, 22 bp, Homo sapiens
gggcccagcgtggttccatctg

SEQ ID NO: 8302084 - DNA, 22 bp, Homo sapiens
gggcccactggctgtctgaccc

SEQ ID NO: 8302085 - DNA, 22 bp, Homo sapiens
gggctacattgtgagagaagtt

SEQ ID NO: 8302086 - DNA, 22 bp, Homo sapiens
gggctacagacatgctctaagc

SEQ ID NO: 8302087 - DNA, 22 bp, Homo sapiens
gggcgtggatggtcagtgcagg

SEQ ID NO: 8302088 - DNA, 22 bp, Homo sapiens
gggcggggtggctcatgcctgt

SEQ ID NO: 8302089 - DNA, 22 bp, Homo sapiens
gggcggatcacctgaggtcagg

SEQ ID NO: 8302090 - DNA, 22 bp, Homo sapiens
gggcggggggagctggaatgaa

SEQ ID NO: 8302091 - DNA, 22 bp, Homo sapiens
gggcggatcatttgaggtcagg

SEQ ID NO: 8302092 - DNA, 22 bp, Homo sapiens
gggcggggcttccgtcctccac

SEQ ID NO: 8302093 - DNA, 22 bp, Homo sapiens
gggcagcctcggtgcctgctgc

SEQ ID NO: 8302094 - DNA, 22 bp, Homo sapiens
gggcagcctcggtgcctgctgc

SEQ ID NO: 8302095 - DNA, 22 bp, Homo sapiens
gggcagctctcacagcagccaa

SEQ ID NO: 8302096 - DNA, 22 bp, Homo sapiens
gggccaggtcggtgaatggtca

SEQ ID NO: 8302097 - DNA, 22 bp, Homo sapiens
gggccacattgaagggtgggta

SEQ ID NO: 8302098 - DNA, 22 bp, Homo sapiens
gggcagatggggcacaggctga

SEQ ID NO: 8302099 - DNA, 22 bp, Homo sapiens
gggcagaggttcaacttcaaca

SEQ ID NO: 8302100 - DNA, 22 bp, Homo sapiens
gggctctggtacttcctggctc

SEQ ID NO: 8302101 - DNA, 22 bp, Homo sapiens
gggctctgtccattccttcata

SEQ ID NO: 8302102 - DNA, 22 bp, Homo sapiens
gggctaggcttggccagcactg

SEQ ID NO: 8302103 - DNA, 22 bp, Homo sapiens
gggctaggcttggccagcactg

SEQ ID NO: 8302104 - DNA, 22 bp, Homo sapiens
gggctgcttcctggggaatgct

SEQ ID NO: 8302105 - DNA, 22 bp, Homo sapiens
gggctgcttatactgatgataa

SEQ ID NO: 8302106 - DNA, 22 bp, Homo sapiens
gggctgcttttaagggtctcag

SEQ ID NO: 8302107 - DNA, 21 bp, Homo sapiens
gggctggacatggtggctcat

SEQ ID NO: 8302108 - DNA, 22 bp, Homo sapiens
gggctgcttttttcttagcaga

SEQ ID NO: 8302109 - DNA, 22 bp, Homo sapiens
gggctggatctcctgcaggcag

SEQ ID NO: 8302110 - DNA, 22 bp, Homo sapiens
gggctggcaggacctgggctga

SEQ ID NO: 8302111 - DNA, 22 bp, Homo sapiens
gggctggcatcagttgccgaga

SEQ ID NO: 8302112 - DNA, 22 bp, Homo sapiens
gggctggagccagctgtggctg

SEQ ID NO: 8302113 - DNA, 22 bp, Homo sapiens
ggggacagttaaagaccaagac

SEQ ID NO: 8302114 - DNA, 22 bp, Homo sapiens
gggtctggacggctgcaggaag

SEQ ID NO: 8302115 - DNA, 22 bp, Homo sapiens
gggtctctctcggctccacgcg

SEQ ID NO: 8302116 - DNA, 22 bp, Homo sapiens
gggtgacatttcccaatgagcc

SEQ ID NO: 8302117 - DNA, 22 bp, Homo sapiens
gggtctggcatgctgagatgga

SEQ ID NO: 8302118 - DNA, 22 bp, Homo sapiens
gggtgggcctgtctggccatgt

SEQ ID NO: 8302119 - DNA, 22 bp, Homo sapiens
gggtgggccactgagcagcgtg

SEQ ID NO: 8302120 - DNA, 23 bp, Homo sapiens
gggtgggccaaattaggtagcct

SEQ ID NO: 8302121 - DNA, 22 bp, Homo sapiens
gggtgaggagctgccagtcatg

SEQ ID NO: 8302122 - DNA, 20 bp, Homo sapiens
gggtgagatgtaggagaggg

SEQ ID NO: 8302123 - DNA, 22 bp, Homo sapiens
gggtgggaacaggatgccagga

SEQ ID NO: 8302124 - DNA, 22 bp, Homo sapiens
gggtgggatgccgctgtctcca

SEQ ID NO: 8302125 - DNA, 22 bp, Homo sapiens
gggggctctgactccctcagct

SEQ ID NO: 8302126 - DNA, 22 bp, Homo sapiens
ggggactgccttccacagacac

SEQ ID NO: 8302127 - DNA, 22 bp, Homo sapiens
ggggaccctcaggactgcgtct

SEQ ID NO: 8302128 - DNA, 22 bp, Homo sapiens
gggggctggaatatccatcaac

SEQ ID NO: 8302129 - DNA, 22 bp, Homo sapiens
gggggctggactttcccacaca

SEQ ID NO: 8302130 - DNA, 23 bp, Homo sapiens
gggggctggttgactctctgcag

SEQ ID NO: 8302131 - DNA, 22 bp, Homo sapiens
gggggcttggcccggtctggtt

SEQ ID NO: 8302132 - DNA, 22 bp, Homo sapiens
ggggggacgcagtcgctgccta

SEQ ID NO: 8302133 - DNA, 22 bp, Homo sapiens
gggggctgtcctgtgcattgta

SEQ ID NO: 8302134 - DNA, 22 bp, Homo sapiens
ggggtactggctggagccccac

SEQ ID NO: 8302135 - DNA, 22 bp, Homo sapiens
gggtccagctacatcagggtgg

SEQ ID NO: 8302136 - DNA, 22 bp, Homo sapiens
ggggggtgctgatcagtggagc

SEQ ID NO: 8302137 - DNA, 20 bp, Homo sapiens
taagaacaagactaggaagc

SEQ ID NO: 8302138 - DNA, 22 bp, Homo sapiens
taacagaatagcagaaacagaa

SEQ ID NO: 8302139 - DNA, 22 bp, Homo sapiens
taacagaatcctgttattgcca

SEQ ID NO: 8302140 - DNA, 22 bp, Homo sapiens
taacagaagttgttcattgtgg

SEQ ID NO: 8302141 - DNA, 22 bp, Homo sapiens
taagaaatttagttatagaatg

SEQ ID NO: 8302142 - DNA, 22 bp, Homo sapiens
taacagaatttgctaaactccg

SEQ ID NO: 8302143 - DNA, 22 bp, Homo sapiens
taacactggtatttcatttagt

SEQ ID NO: 8302144 - DNA, 22 bp, Homo sapiens
taacactgatttgttctcaggg

SEQ ID NO: 8302145 - DNA, 22 bp, Homo sapiens
taaatctcactgggtatattgg

SEQ ID NO: 8302146 - DNA, 22 bp, Homo sapiens
taaatccctacatctgtgtttt

SEQ ID NO: 8302147 - DNA, 22 bp, Homo sapiens
taaatcagtttctcttattggt

SEQ ID NO: 8302148 - DNA, 22 bp, Homo sapiens
taaatcactcctaataatcagt

SEQ ID NO: 8302149 - DNA, 22 bp, Homo sapiens
taaagcaggccacatatgtgat

SEQ ID NO: 8302150 - DNA, 22 bp, Homo sapiens
gtttttctttgtgtgaagacaa

SEQ ID NO: 8302151 - DNA, 22 bp, Homo sapiens
gttttttcatgagtagttatct

SEQ ID NO: 8302152 - DNA, 22 bp, Homo sapiens
gttttttgggtgtatatcttct

SEQ ID NO: 8302153 - DNA, 22 bp, Homo sapiens
gtttttctctgaaatagttgac

SEQ ID NO: 8302154 - DNA, 19 bp, Homo sapiens
gtttttcccagacgaggca

SEQ ID NO: 8302155 - DNA, 22 bp, Homo sapiens
gtttttccttgctgaggacccg

SEQ ID NO: 8302156 - DNA, 22 bp, Homo sapiens
gtttttcctgctgacttgggtc

SEQ ID NO: 8302157 - DNA, 22 bp, Homo sapiens
gtttttctagaaatctcctcct

SEQ ID NO: 8302158 - DNA, 22 bp, Homo sapiens
gtgtgcagaagacacaagacat

SEQ ID NO: 8302159 - DNA, 22 bp, Homo sapiens
gtgtgcagtagagaaagagcag

SEQ ID NO: 8302160 - DNA, 22 bp, Homo sapiens
gtgtccatcagcagccactgtg

SEQ ID NO: 8302161 - DNA, 22 bp, Homo sapiens
gtgtcccaaagattagaaatca

SEQ ID NO: 8302162 - DNA, 22 bp, Homo sapiens
gtgtcccactctggaggtgaag

SEQ ID NO: 8302163 - DNA, 22 bp, Homo sapiens
gtgtcccaatgttcaggacggc

SEQ ID NO: 8302164 - DNA, 22 bp, Homo sapiens
gtgtcccaatctacttttccct

SEQ ID NO: 8302165 - DNA, 22 bp, Homo sapiens
gtgtccagggccgtgttgtctt

SEQ ID NO: 8302166 - DNA, 22 bp, Homo sapiens
gtgtcatgcacactcagtgttg

SEQ ID NO: 8302167 - DNA, 22 bp, Homo sapiens
gtgtcatggggtttgttataca

SEQ ID NO: 8302168 - DNA, 22 bp, Homo sapiens
gtgtcatggaaaattgcaatgg

SEQ ID NO: 8302169 - DNA, 22 bp, Homo sapiens
gtgtcatgggagtcagaagtga

SEQ ID NO: 8302170 - DNA, 22 bp, Homo sapiens
gtgtcatgtagaaattgatgaa

SEQ ID NO: 8302171 - DNA, 21 bp, Homo sapiens
gtgtcatggttgactttggca

SEQ ID NO: 8302172 - DNA, 22 bp, Homo sapiens
gtgtccacggctgagaatgatt

SEQ ID NO: 8302173 - DNA, 22 bp, Homo sapiens
gtgtcattaaccaccatgcaaa

SEQ ID NO: 8302174 - DNA, 22 bp, Homo sapiens
gtgtccagagaaactcacagct

SEQ ID NO: 8302175 - DNA, 22 bp, Homo sapiens
gtgtcccagccccacaggcctg

SEQ ID NO: 8302176 - DNA, 22 bp, Homo sapiens
gtgtcccagcagcacattggct

SEQ ID NO: 8302177 - DNA, 22 bp, Homo sapiens
gtgtcccaggagaggagacaat

SEQ ID NO: 8302178 - DNA, 22 bp, Homo sapiens
gtgtcccaggcctctggaatta

SEQ ID NO: 8302179 - DNA, 22 bp, Homo sapiens
gttgtattcttcaatatcagag

SEQ ID NO: 8302180 - DNA, 22 bp, Homo sapiens
gttgtatagagggcatgaatct

SEQ ID NO: 8302181 - DNA, 22 bp, Homo sapiens
gttctctcagcgatagtgatgg

SEQ ID NO: 8302182 - DNA, 22 bp, Homo sapiens
gttctctctcttgcctgggtgg

SEQ ID NO: 8302183 - DNA, 22 bp, Homo sapiens
gttctctctgcttccaagatgg

SEQ ID NO: 8302184 - DNA, 22 bp, Homo sapiens
gttctctctgcttccaagatgg

SEQ ID NO: 8302185 - DNA, 16 bp, Homo sapiens
gttctctcactgtacc

SEQ ID NO: 8302186 - DNA, 22 bp, Homo sapiens
gttctctcaaactttgtgtttg

SEQ ID NO: 8302187 - DNA, 22 bp, Homo sapiens
gttctccattcagcttcctgtg

SEQ ID NO: 8302188 - DNA, 20 bp, Homo sapiens
gttctcactgatctgcaggg

SEQ ID NO: 8302189 - DNA, 22 bp, Homo sapiens
gttcaaagctcctggtacagta

SEQ ID NO: 8302190 - DNA, 22 bp, Homo sapiens
gtgtgtcctcagtagtggcatg

SEQ ID NO: 8302191 - DNA, 22 bp, Homo sapiens
gtgtgtccaggcgggagtcaag

SEQ ID NO: 8302192 - DNA, 18 bp, Homo sapiens
gttcaaggtcaagagaga

SEQ ID NO: 8302193 - DNA, 22 bp, Homo sapiens
gttcaagaccagcctggccaac

SEQ ID NO: 8302194 - DNA, 22 bp, Homo sapiens
gttcaagaccagcctggccaac

SEQ ID NO: 8302195 - DNA, 22 bp, Homo sapiens
gttcaagaccagcctggccaac

SEQ ID NO: 8302196 - DNA, 18 bp, Homo sapiens
gtggggtgttgtgaggat

SEQ ID NO: 8302197 - DNA, 22 bp, Homo sapiens
gtggggtgtccagcagcgagct

SEQ ID NO: 8302198 - DNA, 22 bp, Homo sapiens
gtggggtgcagcagtactgtgt

SEQ ID NO: 8302199 - DNA, 22 bp, Homo sapiens
gtggggtctctctgtacctccc

SEQ ID NO: 8302200 - DNA, 22 bp, Homo sapiens
gtggggtctgtcctcttctggg

SEQ ID NO: 8302201 - DNA, 22 bp, Homo sapiens
gtggggggacgttggtcacttt

SEQ ID NO: 8302202 - DNA, 22 bp, Homo sapiens
gtgggtggaggcgtcgagggca

SEQ ID NO: 8302203 - DNA, 22 bp, Homo sapiens
gtgggtgatgtactggaggcca

SEQ ID NO: 8302204 - DNA, 21 bp, Homo sapiens
gtggttattttcattagcatc

SEQ ID NO: 8302205 - DNA, 22 bp, Homo sapiens
gtggtgcaggccagcaggggcg

SEQ ID NO: 8302206 - DNA, 22 bp, Homo sapiens
gtggtgagttcaggctggggtg

SEQ ID NO: 8302207 - DNA, 22 bp, Homo sapiens
gtggtgcatccttgagtaagct

SEQ ID NO: 8302208 - DNA, 22 bp, Homo sapiens
gtgtcacatggtttactgcagc

SEQ ID NO: 8302209 - DNA, 22 bp, Homo sapiens
gtgtcacaagagcccaggaaac

SEQ ID NO: 8302210 - DNA, 22 bp, Homo sapiens
gtgtaattgaaattgagaacca

SEQ ID NO: 8302211 - DNA, 22 bp, Homo sapiens
gtgtaattatataaagatctac

SEQ ID NO: 8302212 - DNA, 22 bp, Homo sapiens
gtgtaaggccccaggttcttta

SEQ ID NO: 8302213 - DNA, 22 bp, Homo sapiens
gtgtaaggtgaaatcaacaaat

SEQ ID NO: 8302214 - DNA, 22 bp, Homo sapiens
gtggggaggcattcttctccct

SEQ ID NO: 8302215 - DNA, 22 bp, Homo sapiens
gtgggggcaggcagtgctagga

SEQ ID NO: 8302216 - DNA, 22 bp, Homo sapiens
gtgggctggaccctcctgctcc

SEQ ID NO: 8302217 - DNA, 22 bp, Homo sapiens
gtgggcttctgttagggaggct

SEQ ID NO: 8302218 - DNA, 22 bp, Homo sapiens
gtgggccttgcagggtgcaggg

SEQ ID NO: 8302219 - DNA, 22 bp, Homo sapiens
gtgggcctcttgagggtggcta

SEQ ID NO: 8302220 - DNA, 22 bp, Homo sapiens
gtgggcaaggtccctgccagct

SEQ ID NO: 8302221 - DNA, 20 bp, Homo sapiens
gtgggcagatgtgtgcatgg

SEQ ID NO: 8302222 - DNA, 20 bp, Homo sapiens
gtgggcagcaggcatactgg

SEQ ID NO: 8302223 - DNA, 22 bp, Homo sapiens
ggtgattttcgagtttcatgtt

SEQ ID NO: 8302224 - DNA, 17 bp, Homo sapiens
ggtgagtgtccaggtgg

SEQ ID NO: 8302225 - DNA, 22 bp, Homo sapiens
ggtggcagaggtgcatcagccc

SEQ ID NO: 8302226 - DNA, 22 bp, Homo sapiens
gggtggggttcaggaatcttca

SEQ ID NO: 8302227 - DNA, 22 bp, Homo sapiens
gggtggggttcaggaatcttca

SEQ ID NO: 8302228 - DNA, 22 bp, Homo sapiens
gggtggggtgtatcggatccta

SEQ ID NO: 8302229 - DNA, 22 bp, Homo sapiens
gggtggggtgtatcggatccta

SEQ ID NO: 8302230 - DNA, 22 bp, Homo sapiens
gggtggggcccaggaaatctat

SEQ ID NO: 8302231 - DNA, 22 bp, Homo sapiens
gggtggggcccaggaaatctat

SEQ ID NO: 8302232 - DNA, 22 bp, Homo sapiens
gggtggggccaggcaatttgca

SEQ ID NO: 8302233 - DNA, 22 bp, Homo sapiens
ggtgaggggagagtgaaagaaa

SEQ ID NO: 8302234 - DNA, 22 bp, Homo sapiens
ggtggcagcgtctatctgacat

SEQ ID NO: 8302235 - DNA, 23 bp, Homo sapiens
ggtggcaggagtggatgctgagc

SEQ ID NO: 8302236 - DNA, 22 bp, Homo sapiens
ggtggcaggccctgagcatccc

SEQ ID NO: 8302237 - DNA, 22 bp, Homo sapiens
ggtggccaggccagctctggcc

SEQ ID NO: 8302238 - DNA, 22 bp, Homo sapiens
ggtggttcacgcctataatccc

SEQ ID NO: 8302239 - DNA, 17 bp, Homo sapiens
ggtgtatggggagggaa

SEQ ID NO: 8302240 - DNA, 21 bp, Homo sapiens
ggtgtcagttttggtcattag

SEQ ID NO: 8302241 - DNA, 22 bp, Homo sapiens
ggtgtccatcaggctgtgcttc

SEQ ID NO: 8302242 - DNA, 22 bp, Homo sapiens
ggtgtcccaggccagctgtgtg

SEQ ID NO: 8302243 - DNA, 22 bp, Homo sapiens
gtacattggcaactctcttaga

SEQ ID NO: 8302244 - DNA, 22 bp, Homo sapiens
gtacatgtcaaaaaatgcataa

SEQ ID NO: 8302245 - DNA, 22 bp, Homo sapiens
gtacatgttggttgtttccagt

SEQ ID NO: 8302246 - DNA, 22 bp, Homo sapiens
gtacagttttcagtgttcactg

SEQ ID NO: 8302247 - DNA, 22 bp, Homo sapiens
gtaaagttctactagaatcaac

SEQ ID NO: 8302248 - DNA, 22 bp, Homo sapiens
gtaaagttctatttgaatttag

SEQ ID NO: 8302249 - DNA, 22 bp, Homo sapiens
gtcctgggtccccgcaggtcag

SEQ ID NO: 8302250 - DNA, 22 bp, Homo sapiens
gtcccaggtgggctccacctct

SEQ ID NO: 8302251 - DNA, 22 bp, Homo sapiens
gtcccagggaggttcagggctt

SEQ ID NO: 8302252 - DNA, 22 bp, Homo sapiens
gtcccagggatgcagacatgag

SEQ ID NO: 8302253 - DNA, 22 bp, Homo sapiens
gtcccagggatgcagacatgag

SEQ ID NO: 8302254 - DNA, 22 bp, Homo sapiens
gtcccagaaacatattgctggt

SEQ ID NO: 8302255 - DNA, 22 bp, Homo sapiens
gtcccacaccttgaggggtctt

SEQ ID NO: 8302256 - DNA, 22 bp, Homo sapiens
gtccagggctaaatcaggttcc

SEQ ID NO: 8302257 - DNA, 22 bp, Homo sapiens
gtccagggaaatagcgacaggg

SEQ ID NO: 8302258 - DNA, 22 bp, Homo sapiens
gtcagctgtctccccagagtgg

SEQ ID NO: 8302259 - DNA, 22 bp, Homo sapiens
gtcagaggggcagctgccaggc

SEQ ID NO: 8302260 - DNA, 22 bp, Homo sapiens
gtctgaggaagatgcaggggga

SEQ ID NO: 8302261 - DNA, 20 bp, Homo sapiens
gtctgaggagcagtgggaaa

SEQ ID NO: 8302262 - DNA, 22 bp, Homo sapiens
gtctctgcctggggggatcaga

SEQ ID NO: 8302263 - DNA, 19 bp, Homo sapiens
gtctctgctccagggtctc

SEQ ID NO: 8302264 - DNA, 22 bp, Homo sapiens
gtctcttttatggtgagttgat

SEQ ID NO: 8302265 - DNA, 22 bp, Homo sapiens
gtctctgctctagagtctgtga

SEQ ID NO: 8302266 - DNA, 22 bp, Homo sapiens
gtctgagaatcttgcatatcat

SEQ ID NO: 8302267 - DNA, 22 bp, Homo sapiens
gtctggggaagtcagggcatca

SEQ ID NO: 8302268 - DNA, 17 bp, Homo sapiens
gtctgggctttagagac

SEQ ID NO: 8302269 - DNA, 22 bp, Homo sapiens
gtggcagctggtatgcagacag

SEQ ID NO: 8302270 - DNA, 22 bp, Homo sapiens
gtggccaggacattgccaggca

SEQ ID NO: 8302271 - DNA, 22 bp, Homo sapiens
gtggcccaggcttggcgctggc

SEQ ID NO: 8302272 - DNA, 21 bp, Homo sapiens
gtggccctgccgcagtgtcca

SEQ ID NO: 8302273 - DNA, 22 bp, Homo sapiens
gtggccctctgatagggtcagg

SEQ ID NO: 8302274 - DNA, 22 bp, Homo sapiens
gtggccagaagactgcaatgct

SEQ ID NO: 8302275 - DNA, 22 bp, Homo sapiens
gtggccagcaagtgctgcctct

SEQ ID NO: 8302276 - DNA, 22 bp, Homo sapiens
gtgggatgcagtggtgagtggc

SEQ ID NO: 8302277 - DNA, 22 bp, Homo sapiens
gtgggatggtaggtaggtaata

SEQ ID NO: 8302278 - DNA, 22 bp, Homo sapiens
gtgggatgcagtggtgagtggc

SEQ ID NO: 8302279 - DNA, 22 bp, Homo sapiens
gtggctgctaagtctccttcct

SEQ ID NO: 8302280 - DNA, 22 bp, Homo sapiens
gtggctgctacagagctggagg

SEQ ID NO: 8302281 - DNA, 22 bp, Homo sapiens
gtggctgctcgggctccggccc

SEQ ID NO: 8302282 - DNA, 22 bp, Homo sapiens
gtggctgctgtcctctctggtt

SEQ ID NO: 8302283 - DNA, 22 bp, Homo sapiens
gtggctgcagagggcacagcat

SEQ ID NO: 8302284 - DNA, 22 bp, Homo sapiens
gtggctgcagcccagcggcacg

SEQ ID NO: 8302285 - DNA, 22 bp, Homo sapiens
gtggctgcagagggcacagcat

SEQ ID NO: 8302286 - DNA, 22 bp, Homo sapiens
gtggctgctgtcctctctggtt

SEQ ID NO: 8302287 - DNA, 22 bp, Homo sapiens
gtggctgggctccgagcggctt

SEQ ID NO: 8302288 - DNA, 22 bp, Homo sapiens
gtggctggtttcctgcatgcaa

SEQ ID NO: 8302289 - DNA, 22 bp, Homo sapiens
gtggctggtttcctgcatgcaa

SEQ ID NO: 8302290 - DNA, 22 bp, Homo sapiens
gtggcttcacatggcatttggc

SEQ ID NO: 8302291 - DNA, 21 bp, Homo sapiens
gtggctctgccaggactgaaa

SEQ ID NO: 8302292 - DNA, 22 bp, Homo sapiens
gtggctctccattgacatggaa

SEQ ID NO: 8302293 - DNA, 22 bp, Homo sapiens
gtggctctcgccagcctgcggg

SEQ ID NO: 8302294 - DNA, 22 bp, Homo sapiens
gtggctgcagagccagcaagct

SEQ ID NO: 8302295 - DNA, 22 bp, Homo sapiens
gtggcctggcgagctggcgcgg

SEQ ID NO: 8302296 - DNA, 22 bp, Homo sapiens
gtggcctggggtttgttctgag

SEQ ID NO: 8302297 - DNA, 22 bp, Homo sapiens
gtggcctggatgagcttcgaca

SEQ ID NO: 8302298 - DNA, 22 bp, Homo sapiens
gtggcctggatgagcttcgaca

SEQ ID NO: 8302299 - DNA, 22 bp, Homo sapiens
gtggcctggatagactccatct

SEQ ID NO: 8302300 - DNA, 22 bp, Homo sapiens
gtggcctggcgagctggcgcgg

SEQ ID NO: 8302301 - DNA, 22 bp, Homo sapiens
gtggctctaggtgagcatggag

SEQ ID NO: 8302302 - DNA, 22 bp, Homo sapiens
gtggcctggggtttgttctgag

SEQ ID NO: 8302303 - DNA, 22 bp, Homo sapiens
gtggcctggagtttgatgtagg

SEQ ID NO: 8302304 - DNA, 22 bp, Homo sapiens
gtggcctggaaaggctggtctg

SEQ ID NO: 8302305 - DNA, 22 bp, Homo sapiens
gtggcctggaaaggctggtctg

SEQ ID NO: 8302306 - DNA, 22 bp, Homo sapiens
gtggcctgccgtgtggtatggg

SEQ ID NO: 8302307 - DNA, 22 bp, Homo sapiens
gtggcctgccgtgtggtatggg

SEQ ID NO: 8302308 - DNA, 19 bp, Homo sapiens
gtggcctgcgctgggtgcg

SEQ ID NO: 8302309 - DNA, 22 bp, Homo sapiens
gtggcctgccagcagatggcgc

SEQ ID NO: 8302310 - DNA, 21 bp, Homo sapiens
gtggcctgattatgaatgggt

SEQ ID NO: 8302311 - DNA, 21 bp, Homo sapiens
gtggcctgattatgaatgggt

SEQ ID NO: 8302312 - DNA, 22 bp, Homo sapiens
gtggcctgatgccagccctgtg

SEQ ID NO: 8302313 - DNA, 22 bp, Homo sapiens
gtggcctgatgccagccctgtg

SEQ ID NO: 8302314 - DNA, 22 bp, Homo sapiens
gtggcctcatgtctataaagag

SEQ ID NO: 8302315 - DNA, 23 bp, Homo sapiens
gtggcctccccggaatgcctcgc

SEQ ID NO: 8302316 - DNA, 20 bp, Homo sapiens
gtggcctctcacattctgag

SEQ ID NO: 8302317 - DNA, 19 bp, Homo sapiens
gtggcctcggagcgcgcgg

SEQ ID NO: 8302318 - DNA, 22 bp, Homo sapiens
gtggcctctgttggctcctagg

SEQ ID NO: 8302319 - DNA, 22 bp, Homo sapiens
gtggcctctgtgctcctgccta

SEQ ID NO: 8302320 - DNA, 21 bp, Homo sapiens
gtggccctggtgtggctgcac

SEQ ID NO: 8302321 - DNA, 22 bp, Homo sapiens
gtggccctgtcccaggcctcct

SEQ ID NO: 8302322 - DNA, 22 bp, Homo sapiens
gtgcgccagctcaaggggaggc

SEQ ID NO: 8302323 - DNA, 22 bp, Homo sapiens
gtgccttccccggtggtctgtt

SEQ ID NO: 8302324 - DNA, 22 bp, Homo sapiens
gtgcgggcctgggggtttctct

SEQ ID NO: 8302325 - DNA, 22 bp, Homo sapiens
gtgcctggcatgcgccggtgct

SEQ ID NO: 8302326 - DNA, 22 bp, Homo sapiens
gtgcctggagctaatgtgtata

SEQ ID NO: 8302327 - DNA, 22 bp, Homo sapiens
gtgcctggcacacagaaggcaa

SEQ ID NO: 8302328 - DNA, 20 bp, Homo sapiens
gtgcctggagaagaggctgt

SEQ ID NO: 8302329 - DNA, 22 bp, Homo sapiens
gtgacagagttttagatctcat

SEQ ID NO: 8302330 - DNA, 18 bp, Homo sapiens
gtgacagctgctagctca

SEQ ID NO: 8302331 - DNA, 22 bp, Homo sapiens
gtgcctgccccactcctcagca

SEQ ID NO: 8302332 - DNA, 22 bp, Homo sapiens
gtgcctgctgcagagtcgctgt

SEQ ID NO: 8302333 - DNA, 22 bp, Homo sapiens
gtgcctgcagcaatccatggca

SEQ ID NO: 8302334 - DNA, 20 bp, Homo sapiens
gtgaccagaagacagtgggt

SEQ ID NO: 8302335 - DNA, 22 bp, Homo sapiens
gtggaggagaggcgccttgcgg

SEQ ID NO: 8302336 - DNA, 22 bp, Homo sapiens
gtggatggacatgggcaagagg

SEQ ID NO: 8302337 - DNA, 22 bp, Homo sapiens
gtggaggacaaaagaagccttt

SEQ ID NO: 8302338 - DNA, 22 bp, Homo sapiens
gtggagccctggtagggacccc

SEQ ID NO: 8302339 - DNA, 22 bp, Homo sapiens
gtggagacttctactagagacc

SEQ ID NO: 8302340 - DNA, 22 bp, Homo sapiens
gtggagacgggacagaagctaa

SEQ ID NO: 8302341 - DNA, 22 bp, Homo sapiens
gtggagacctcctaggatgtgt

SEQ ID NO: 8302342 - DNA, 22 bp, Homo sapiens
gtggatggattttgaggaatgg

SEQ ID NO: 8302343 - DNA, 22 bp, Homo sapiens
gtggatggattgaggcagtggg

SEQ ID NO: 8302344 - DNA, 22 bp, Homo sapiens
gtggcagcggcccaggccgtct

SEQ ID NO: 8302345 - DNA, 22 bp, Homo sapiens
gtggcagcaaaatcctgcattc

SEQ ID NO: 8302346 - DNA, 22 bp, Homo sapiens
gtggcagaggttcctcagtgtg

SEQ ID NO: 8302347 - DNA, 22 bp, Homo sapiens
tctgagcattgaattttcttcc

SEQ ID NO: 8302348 - DNA, 22 bp, Homo sapiens
tctgagccaatttctgtgtcca

SEQ ID NO: 8302349 - DNA, 22 bp, Homo sapiens
tctgagccaatttctgtgtcca

SEQ ID NO: 8302350 - DNA, 22 bp, Homo sapiens
tctgagccagggtctcctccct

SEQ ID NO: 8302351 - DNA, 23 bp, Homo sapiens
tctgagagaacaatgcctcctat

SEQ ID NO: 8302352 - DNA, 22 bp, Homo sapiens
tctgagagagggtcagatgcta

SEQ ID NO: 8302353 - DNA, 22 bp, Homo sapiens
tctgagctacgatgcctgtcac

SEQ ID NO: 8302354 - DNA, 22 bp, Homo sapiens
tctgagccgtatggcttggcta

SEQ ID NO: 8302355 - DNA, 22 bp, Homo sapiens
tctgagctggagcccatcacct

SEQ ID NO: 8302356 - DNA, 22 bp, Homo sapiens
tctgagggtgggagaaggagct

SEQ ID NO: 8302357 - DNA, 22 bp, Homo sapiens
tctgagggcttgaggggaagta

SEQ ID NO: 8302358 - DNA, 18 bp, Homo sapiens
tctgagggtgcgggagct

SEQ ID NO: 8302359 - DNA, 19 bp, Homo sapiens
tctgagggtccagatgcat

SEQ ID NO: 8302360 - DNA, 20 bp, Homo sapiens
tctgaggctgagctctactt

SEQ ID NO: 8302361 - DNA, 22 bp, Homo sapiens
tctgaggctatgttcaggctaa

SEQ ID NO: 8302362 - DNA, 22 bp, Homo sapiens
tctgaggcttcagactgtactg

SEQ ID NO: 8302363 - DNA, 22 bp, Homo sapiens
tctgagcttttattatcaacct

SEQ ID NO: 8302364 - DNA, 22 bp, Homo sapiens
tctgaggctaagagacagaggc

SEQ ID NO: 8302365 - DNA, 22 bp, Homo sapiens
tctgaggccctgcaggcagtgt

SEQ ID NO: 8302366 - DNA, 22 bp, Homo sapiens
tctgcctgttcaagtcttctag

SEQ ID NO: 8302367 - DNA, 22 bp, Homo sapiens
tctgcctgtggtggaggaagtt

SEQ ID NO: 8302368 - DNA, 22 bp, Homo sapiens
tctgccttgaggtcctcagctc

SEQ ID NO: 8302369 - DNA, 22 bp, Homo sapiens
tctgccttccccataatctgat

SEQ ID NO: 8302370 - DNA, 22 bp, Homo sapiens
tctgccttcgctgctccctgaa

SEQ ID NO: 8302371 - DNA, 22 bp, Homo sapiens
tctgctctagttgcttcctgcc

SEQ ID NO: 8302372 - DNA, 22 bp, Homo sapiens
tctgctcagtgcttatctctaa

SEQ ID NO: 8302373 - DNA, 20 bp, Homo sapiens
tctgctcagccctcagtggc

SEQ ID NO: 8302374 - DNA, 22 bp, Homo sapiens
tctgcctgctaactcctgcacc

SEQ ID NO: 8302375 - DNA, 22 bp, Homo sapiens
tctgcctgcggctgcaggtggc

SEQ ID NO: 8302376 - DNA, 22 bp, Homo sapiens
tctgcctgcggctgcaggtggc

SEQ ID NO: 8302377 - DNA, 22 bp, Homo sapiens
tctgcctgcgctcacggggccg

SEQ ID NO: 8302378 - DNA, 19 bp, Homo sapiens
tctgcctgcttgtaggggc

SEQ ID NO: 8302379 - DNA, 22 bp, Homo sapiens
tctgcctggaccctggtgagct

SEQ ID NO: 8302380 - DNA, 22 bp, Homo sapiens
tctgcctggatgatggcagggc

SEQ ID NO: 8302381 - DNA, 22 bp, Homo sapiens
tctgcctggatgatggcagggc

SEQ ID NO: 8302382 - DNA, 22 bp, Homo sapiens
tctgcctgggtgtggagcagag

SEQ ID NO: 8302383 - DNA, 22 bp, Homo sapiens
tctgcctgggtgtggagcagag

SEQ ID NO: 8302384 - DNA, 22 bp, Homo sapiens
tctgcctggcggactcccggaa

SEQ ID NO: 8302385 - DNA, 22 bp, Homo sapiens
tctgcctggcctggagggcaca

SEQ ID NO: 8302386 - DNA, 22 bp, Homo sapiens
tctgcctggattttggaaagct

SEQ ID NO: 8302387 - DNA, 22 bp, Homo sapiens
tctgcctggattccattctcca

SEQ ID NO: 8302388 - DNA, 20 bp, Homo sapiens
tctgcccaccccggctccca

SEQ ID NO: 8302389 - DNA, 22 bp, Homo sapiens
tctgcctgagggagctgaggaa

SEQ ID NO: 8302390 - DNA, 22 bp, Homo sapiens
tctgcctgagggagctgaggaa

SEQ ID NO: 8302391 - DNA, 18 bp, Homo sapiens
tctgcctgcagggcatct

SEQ ID NO: 8302392 - DNA, 22 bp, Homo sapiens
tctgcctgcagtgtggcagggc

SEQ ID NO: 8302393 - DNA, 22 bp, Homo sapiens
tctgcctgcagtgtggcagggc

SEQ ID NO: 8302394 - DNA, 22 bp, Homo sapiens
tctgcctgccagtctggtcctc

SEQ ID NO: 8302395 - DNA, 17 bp, Homo sapiens
tctgccgactgccagct

SEQ ID NO: 8302396 - DNA, 22 bp, Homo sapiens
tctgcctgagcagagggaggcc

SEQ ID NO: 8302397 - DNA, 22 bp, Homo sapiens
tctgccagtggtttggccctga

SEQ ID NO: 8302398 - DNA, 22 bp, Homo sapiens
tctgcaggaaaaaagtgcctgg

SEQ ID NO: 8302399 - DNA, 22 bp, Homo sapiens
tctgcaggactgaggcctgttt

SEQ ID NO: 8302400 - DNA, 22 bp, Homo sapiens
tctgcagctttttggtggggtg

SEQ ID NO: 8302401 - DNA, 22 bp, Homo sapiens
tctgcagcttgcacaggcaggc

SEQ ID NO: 8302402 - DNA, 22 bp, Homo sapiens
tctgcagcgtgcaggctggtgc

SEQ ID NO: 8302403 - DNA, 22 bp, Homo sapiens
tctgcagcttcttgccagagag

SEQ ID NO: 8302404 - DNA, 22 bp, Homo sapiens
tctgcagcttcttgccagagag

SEQ ID NO: 8302405 - DNA, 22 bp, Homo sapiens
tctgcaggaggctggctgcagg

SEQ ID NO: 8302406 - DNA, 22 bp, Homo sapiens
tctgcaggcctcgacaaggcca

SEQ ID NO: 8302407 - DNA, 22 bp, Homo sapiens
tctgcagatttatcagcagctg

SEQ ID NO: 8302408 - DNA, 22 bp, Homo sapiens
tctggagataagacagacagat

SEQ ID NO: 8302409 - DNA, 22 bp, Homo sapiens
tctggagataagacagacagat

SEQ ID NO: 8302410 - DNA, 22 bp, Homo sapiens
tctggagagtcacagtgccaga

SEQ ID NO: 8302411 - DNA, 22 bp, Homo sapiens
tctggagaacttgcaagaggat

SEQ ID NO: 8302412 - DNA, 22 bp, Homo sapiens
tctggaagttagaggaggaaag

SEQ ID NO: 8302413 - DNA, 22 bp, Homo sapiens
tctgctctgtactgcactggcc

SEQ ID NO: 8302414 - DNA, 22 bp, Homo sapiens
tctgctctgtggcttcagctaa

SEQ ID NO: 8302415 - DNA, 22 bp, Homo sapiens
tctgctctagttgcttcctgcc

SEQ ID NO: 8302416 - DNA, 23 bp, Homo sapiens
tctgctctgaagttcggctgagc

SEQ ID NO: 8302417 - DNA, 22 bp, Homo sapiens
tctgctctccatacttccgcac

SEQ ID NO: 8302418 - DNA, 22 bp, Homo sapiens
tctgctgcacaaattcatctct

SEQ ID NO: 8302419 - DNA, 22 bp, Homo sapiens
tctgctgcagcaggattctctg

SEQ ID NO: 8302420 - DNA, 22 bp, Homo sapiens
tctgctgcacaaattcatctct

SEQ ID NO: 8302421 - DNA, 22 bp, Homo sapiens
tctgctgctacagactctctag

SEQ ID NO: 8302422 - DNA, 22 bp, Homo sapiens
tctgctgtaaagaatttctgcc

SEQ ID NO: 8302423 - DNA, 22 bp, Homo sapiens
tctgctggccttagcaggtcta

SEQ ID NO: 8302424 - DNA, 22 bp, Homo sapiens
tctgctgctgagcacactccta

SEQ ID NO: 8302425 - DNA, 22 bp, Homo sapiens
tctgctgctgcagctacactat

SEQ ID NO: 8302426 - DNA, 19 bp, Homo sapiens
tctgctggcagaattccct

SEQ ID NO: 8302427 - DNA, 22 bp, Homo sapiens
tctggccagtgaaatgcagaat

SEQ ID NO: 8302428 - DNA, 22 bp, Homo sapiens
tctggccaggatggcaagacca

SEQ ID NO: 8302429 - DNA, 22 bp, Homo sapiens
tctggccatggcaagccgagtg

SEQ ID NO: 8302430 - DNA, 22 bp, Homo sapiens
tctggcccagcccctgaggtca

SEQ ID NO: 8302431 - DNA, 22 bp, Homo sapiens
tctggccacccgaggcccctgc

SEQ ID NO: 8302432 - DNA, 22 bp, Homo sapiens
tctggccaacaaaaactaagtc

SEQ ID NO: 8302433 - DNA, 22 bp, Homo sapiens
tctggatggtcagctcttcctg

SEQ ID NO: 8302434 - DNA, 22 bp, Homo sapiens
tctggatggtcagctcttcctg

SEQ ID NO: 8302435 - DNA, 22 bp, Homo sapiens
tctggagcaacagagcaggaca

SEQ ID NO: 8302436 - DNA, 22 bp, Homo sapiens
tctggagccacaaacctcagct

SEQ ID NO: 8302437 - DNA, 21 bp, Homo sapiens
tctggagccctaagctgagaa

SEQ ID NO: 8302438 - DNA, 22 bp, Homo sapiens
tctggagtccagatccatttgg

SEQ ID NO: 8302439 - DNA, 22 bp, Homo sapiens
tctgggagagctgctgtcagag

SEQ ID NO: 8302440 - DNA, 22 bp, Homo sapiens
tctgggagagctgctgtcagag

SEQ ID NO: 8302441 - DNA, 22 bp, Homo sapiens
tctgggagacgtgtgttgtcag

SEQ ID NO: 8302442 - DNA, 22 bp, Homo sapiens
tctgggaggtaaccatgctgat

SEQ ID NO: 8302443 - DNA, 21 bp, Homo sapiens
tctgggcccatgctgcctcac

SEQ ID NO: 8302444 - DNA, 22 bp, Homo sapiens
tctgggccctaaaccagctcta

SEQ ID NO: 8302445 - DNA, 22 bp, Homo sapiens
tctgggctcttagtgtaccctc

SEQ ID NO: 8302446 - DNA, 22 bp, Homo sapiens
tctgggcagcagcagctagtag

SEQ ID NO: 8302447 - DNA, 23 bp, Homo sapiens
tctgggcaccttgttgacatgat

SEQ ID NO: 8302448 - DNA, 22 bp, Homo sapiens
tctgggcactgctgagcctgta

SEQ ID NO: 8302449 - DNA, 22 bp, Homo sapiens
tctggctgctgcgtgagtgctt

SEQ ID NO: 8302450 - DNA, 22 bp, Homo sapiens
tctggctcctggctccactgcc

SEQ ID NO: 8302451 - DNA, 19 bp, Homo sapiens
tctggctcctgccaggctg

SEQ ID NO: 8302452 - DNA, 22 bp, Homo sapiens
tctggctcctggctccactgcc

SEQ ID NO: 8302453 - DNA, 22 bp, Homo sapiens
tctggctcggatttgtctagca

SEQ ID NO: 8302454 - DNA, 22 bp, Homo sapiens
tctggctctaactaggcatcag

SEQ ID NO: 8302455 - DNA, 22 bp, Homo sapiens
tctggctctataactcctagct

SEQ ID NO: 8302456 - DNA, 23 bp, Homo sapiens
tctggctctatgtgacagctctc

SEQ ID NO: 8302457 - DNA, 22 bp, Homo sapiens
tctggctctccagtgctcttag

SEQ ID NO: 8302458 - DNA, 22 bp, Homo sapiens
tctggctctcaacaaatattta

SEQ ID NO: 8302459 - DNA, 22 bp, Homo sapiens
tctggctctcatactcgccagt

SEQ ID NO: 8302460 - DNA, 22 bp, Homo sapiens
tctggctctttgggtgattgta

SEQ ID NO: 8302461 - DNA, 20 bp, Homo sapiens
tctggctctttgctcctccc

SEQ ID NO: 8302462 - DNA, 22 bp, Homo sapiens
tctggctctgtgtcctcaccca

SEQ ID NO: 8302463 - DNA, 22 bp, Homo sapiens
tctggctctgtgtccccaccca

SEQ ID NO: 8302464 - DNA, 22 bp, Homo sapiens
tctggctctggagtccacctgc

SEQ ID NO: 8302465 - DNA, 22 bp, Homo sapiens
tctggctctctcatcacccaat

SEQ ID NO: 8302466 - DNA, 22 bp, Homo sapiens
tctggctctgaattcacttctg

SEQ ID NO: 8302467 - DNA, 22 bp, Homo sapiens
tctggctctgacactactgtta

SEQ ID NO: 8302468 - DNA, 22 bp, Homo sapiens
tctggctccctggagctccaca

SEQ ID NO: 8302469 - DNA, 22 bp, Homo sapiens
tctggctcccagcctgctctca

SEQ ID NO: 8302470 - DNA, 23 bp, Homo sapiens
tctggctccatccttggggatcc

SEQ ID NO: 8302471 - DNA, 22 bp, Homo sapiens
tctggctcctgagtccatgctc

SEQ ID NO: 8302472 - DNA, 22 bp, Homo sapiens
tctggctccgtgtccgctccca

SEQ ID NO: 8302473 - DNA, 19 bp, Homo sapiens
tctggctccgcctcttagt

SEQ ID NO: 8302474 - DNA, 22 bp, Homo sapiens
tctggctccactttcttcattt

SEQ ID NO: 8302475 - DNA, 22 bp, Homo sapiens
tctggctccaggaccgggcaca

SEQ ID NO: 8302476 - DNA, 22 bp, Homo sapiens
tctggctccactctgtgcatgc

SEQ ID NO: 8302477 - DNA, 22 bp, Homo sapiens
tctggctccacctcctttacta

SEQ ID NO: 8302478 - DNA, 22 bp, Homo sapiens
tctggctccacacctcactgca

SEQ ID NO: 8302479 - DNA, 21 bp, Homo sapiens
tctgtacatcattgagtcccc

SEQ ID NO: 8302480 - DNA, 22 bp, Homo sapiens
tctgtatcacccgttcccagaa

SEQ ID NO: 8302481 - DNA, 22 bp, Homo sapiens
tctgtatctaattttacagtag

SEQ ID NO: 8302482 - DNA, 22 bp, Homo sapiens
tctgtcaccattcagcttgaat

SEQ ID NO: 8302483 - DNA, 22 bp, Homo sapiens
tctgtcacccaggctggagtgc

SEQ ID NO: 8302484 - DNA, 22 bp, Homo sapiens
tctgtcacccagagtgcagtgg

SEQ ID NO: 8302485 - DNA, 22 bp, Homo sapiens
tctgtcacaatttgcttactct

SEQ ID NO: 8302486 - DNA, 22 bp, Homo sapiens
tctgtagtaggttgtagttctt

SEQ ID NO: 8302487 - DNA, 22 bp, Homo sapiens
tctgtagcaagtgagaggcatt

SEQ ID NO: 8302488 - DNA, 22 bp, Homo sapiens
tctgtagcaagtgagaggcatt

SEQ ID NO: 8302489 - DNA, 22 bp, Homo sapiens
tctgtctgacagggtatgaact

SEQ ID NO: 8302490 - DNA, 22 bp, Homo sapiens
tctgtctctttgttctgtgagt

SEQ ID NO: 8302491 - DNA, 18 bp, Homo sapiens
tctgtctctgtccttgct

SEQ ID NO: 8302492 - DNA, 20 bp, Homo sapiens
tctgtctctgagctagactt

SEQ ID NO: 8302493 - DNA, 22 bp, Homo sapiens
tctgtctcctgccagtgcctct

SEQ ID NO: 8302494 - DNA, 21 bp, Homo sapiens
tctgtctctccactgccctgc

SEQ ID NO: 8302495 - DNA, 21 bp, Homo sapiens
tctgtctctccactgccctgc

SEQ ID NO: 8302496 - DNA, 21 bp, Homo sapiens
tctgtctctccactgccctgc

SEQ ID NO: 8302497 - DNA, 22 bp, Homo sapiens
tctgtcctctttgaagctgctc

SEQ ID NO: 8302498 - DNA, 22 bp, Homo sapiens
tctgtctcaagttcttgcactc

SEQ ID NO: 8302499 - DNA, 22 bp, Homo sapiens
tctgtctcaagttcttgcactc

SEQ ID NO: 8302500 - DNA, 22 bp, Homo sapiens
tctgtctcctctgaggtgccag

SEQ ID NO: 8302501 - DNA, 22 bp, Homo sapiens
tctgtctcctctgaggtgccag

SEQ ID NO: 8302502 - DNA, 17 bp, Homo sapiens
tctgtccagggagtgtg

SEQ ID NO: 8302503 - DNA, 22 bp, Homo sapiens
tctgggtgccctttgctctgtt

SEQ ID NO: 8302504 - DNA, 22 bp, Homo sapiens
tctgggtgatgaaatgcactgt

SEQ ID NO: 8302505 - DNA, 22 bp, Homo sapiens
tctgggggcgaccagggactgc

SEQ ID NO: 8302506 - DNA, 22 bp, Homo sapiens
tctgggctttacactgtgctta

SEQ ID NO: 8302507 - DNA, 22 bp, Homo sapiens
tctgggcttggttagggctgtt

SEQ ID NO: 8302508 - DNA, 22 bp, Homo sapiens
tctgggctgggagcgtgtggac

SEQ ID NO: 8302509 - DNA, 18 bp, Homo sapiens
tctgggcttcccgaggct

SEQ ID NO: 8302510 - DNA, 17 bp, Homo sapiens
tctgggcttcagtggtc

SEQ ID NO: 8302511 - DNA, 22 bp, Homo sapiens
tctgtgctaggcagcctggccc

SEQ ID NO: 8302512 - DNA, 19 bp, Homo sapiens
tctgtgctgggaggcagca

SEQ ID NO: 8302513 - DNA, 22 bp, Homo sapiens
tctgtgctcttctcagtatcac

SEQ ID NO: 8302514 - DNA, 22 bp, Homo sapiens
tctgtgctgccatcctgtggcc

SEQ ID NO: 8302515 - DNA, 22 bp, Homo sapiens
tctgtgaacatcacattgacag

SEQ ID NO: 8302516 - DNA, 22 bp, Homo sapiens
tctgtgacttgcgggaggagaa

SEQ ID NO: 8302517 - DNA, 22 bp, Homo sapiens
tctgtctttgagatctcagcct

SEQ ID NO: 8302518 - DNA, 22 bp, Homo sapiens
tctgtctgctcatttacctcag

SEQ ID NO: 8302519 - DNA, 22 bp, Homo sapiens
tctgtctgcgcttgccctggtg

SEQ ID NO: 8302520 - DNA, 22 bp, Homo sapiens
tctgtctgagggagtgacattt

SEQ ID NO: 8302521 - DNA, 22 bp, Homo sapiens
tctgtctgcacctaagcacagt

SEQ ID NO: 8302522 - DNA, 22 bp, Homo sapiens
tcttaaaagtatgccaattgga

SEQ ID NO: 8302523 - DNA, 22 bp, Homo sapiens
tctgttttctctgtattttgac

SEQ ID NO: 8302524 - DNA, 17 bp, Homo sapiens
tctgtttctcctttctt

SEQ ID NO: 8302525 - DNA, 22 bp, Homo sapiens
tctgtttaggcaaaatagctac

SEQ ID NO: 8302526 - DNA, 20 bp, Homo sapiens
tctgtgtgccatcacctaac

SEQ ID NO: 8302527 - DNA, 22 bp, Homo sapiens
tcttcctctctaattgatcaga

SEQ ID NO: 8302528 - DNA, 22 bp, Homo sapiens
tcttcctctagatctgaggccc

SEQ ID NO: 8302529 - DNA, 22 bp, Homo sapiens
tcttctctcatgtaggagggaa

SEQ ID NO: 8302530 - DNA, 22 bp, Homo sapiens
tcttctctacaccagcagcccc

SEQ ID NO: 8302531 - DNA, 22 bp, Homo sapiens
tcttctcccatctccaggcagg

SEQ ID NO: 8302532 - DNA, 22 bp, Homo sapiens
tcttctcagtttctctaggatg

SEQ ID NO: 8302533 - DNA, 22 bp, Homo sapiens
tcttctccagtgcttctgcaca

SEQ ID NO: 8302534 - DNA, 22 bp, Homo sapiens
tcttctttggatgaaagaatat

SEQ ID NO: 8302535 - DNA, 22 bp, Homo sapiens
tcttcttcctcatttatacata

SEQ ID NO: 8302536 - DNA, 22 bp, Homo sapiens
tcttcttcctccacagggccca

SEQ ID NO: 8302537 - DNA, 22 bp, Homo sapiens
tcttcacaccgggcagcaggaa

SEQ ID NO: 8302538 - DNA, 22 bp, Homo sapiens
tcttcagattgcactgagcaag

SEQ ID NO: 8302539 - DNA, 22 bp, Homo sapiens
tcttcagattgcactgagcaag

SEQ ID NO: 8302540 - DNA, 22 bp, Homo sapiens
tcttccagcaatgtgaaatcac

SEQ ID NO: 8302541 - DNA, 18 bp, Homo sapiens
tcttggagtaatgatcaa

SEQ ID NO: 8302542 - DNA, 22 bp, Homo sapiens
tcttggagactcttgtatattt

SEQ ID NO: 8302543 - DNA, 22 bp, Homo sapiens
tcttggagaatggcagagaagc

SEQ ID NO: 8302544 - DNA, 22 bp, Homo sapiens
tcttgggattgccctgcagttc

SEQ ID NO: 8302545 - DNA, 22 bp, Homo sapiens
tctttacagtcctctgtcaatc

SEQ ID NO: 8302546 - DNA, 23 bp, Homo sapiens
tctttacatactgatgagttctc

SEQ ID NO: 8302547 - DNA, 22 bp, Homo sapiens
tctttacacaagacaagaataa

SEQ ID NO: 8302548 - DNA, 22 bp, Homo sapiens
tctttcagccacttacctgtct

SEQ ID NO: 8302549 - DNA, 22 bp, Homo sapiens
tctttctctctaatcaagcaca

SEQ ID NO: 8302550 - DNA, 22 bp, Homo sapiens
tctttctctctaatcaagcaca

SEQ ID NO: 8302551 - DNA, 17 bp, Homo sapiens
tctttcctgccatgctc

SEQ ID NO: 8302552 - DNA, 21 bp, Homo sapiens
tctttcctgcccagttgccct

SEQ ID NO: 8302553 - DNA, 23 bp, Homo sapiens
tctttcctcagcacacaccaaga

SEQ ID NO: 8302554 - DNA, 22 bp, Homo sapiens
tctttcctctgagctcctgtag

SEQ ID NO: 8302555 - DNA, 22 bp, Homo sapiens
tctttcctgtaactgctgttca

SEQ ID NO: 8302556 - DNA, 22 bp, Homo sapiens
tctttccttagaataattcttt

SEQ ID NO: 8302557 - DNA, 22 bp, Homo sapiens
tctttcctactttattgtgaac

SEQ ID NO: 8302558 - DNA, 22 bp, Homo sapiens
tctttcccagtagctctcccag

SEQ ID NO: 8302559 - DNA, 22 bp, Homo sapiens
tctttcctagaggctgatgagt

SEQ ID NO: 8302560 - DNA, 22 bp, Homo sapiens
tctttcctaggtgatatgcaat

SEQ ID NO: 8302561 - DNA, 19 bp, Homo sapiens
tcgagtcaagacactaggc

SEQ ID NO: 8302562 - DNA, 22 bp, Homo sapiens
tcgagtcatgttctcccattaa

SEQ ID NO: 8302563 - DNA, 22 bp, Homo sapiens
tcctttttggtccaaggtgacc

SEQ ID NO: 8302564 - DNA, 22 bp, Homo sapiens
tccttttttatgaagctttgag

SEQ ID NO: 8302565 - DNA, 22 bp, Homo sapiens
tcctttttaagtcgttgtggta

SEQ ID NO: 8302566 - DNA, 22 bp, Homo sapiens
tcctttttatagttagagaaac

SEQ ID NO: 8302567 - DNA, 22 bp, Homo sapiens
tcctttttggtccaaggtgacc

SEQ ID NO: 8302568 - DNA, 22 bp, Homo sapiens
tcctttttctcacacaacgaac

SEQ ID NO: 8302569 - DNA, 22 bp, Homo sapiens
tcctttttaagtcgttgtggta

SEQ ID NO: 8302570 - DNA, 22 bp, Homo sapiens
tcctttttatagttagagaaac

SEQ ID NO: 8302571 - DNA, 22 bp, Homo sapiens
tcctttgacttcttgcagtcca

SEQ ID NO: 8302572 - DNA, 22 bp, Homo sapiens
tcctttgacttcttgcagtcca

SEQ ID NO: 8302573 - DNA, 22 bp, Homo sapiens
tcctttgcttctgtcattctcc

SEQ ID NO: 8302574 - DNA, 22 bp, Homo sapiens
tcctttccctttccatcctggc

SEQ ID NO: 8302575 - DNA, 22 bp, Homo sapiens
tcctttccatgcttctagaggc

SEQ ID NO: 8302576 - DNA, 22 bp, Homo sapiens
tccttggctttctggagcttct

SEQ ID NO: 8302577 - DNA, 22 bp, Homo sapiens
tccttggcatgccgtcttctcc

SEQ ID NO: 8302578 - DNA, 19 bp, Homo sapiens
tcctttgaatatcagttga

SEQ ID NO: 8302579 - DNA, 22 bp, Homo sapiens
tcgcaccattgcactccagcca

SEQ ID NO: 8302580 - DNA, 22 bp, Homo sapiens
tcgtgtcagatcagaggttcct

SEQ ID NO: 8302581 - DNA, 22 bp, Homo sapiens
tctaaaaaagtctgttcacttg

SEQ ID NO: 8302582 - DNA, 22 bp, Homo sapiens
tccttggcagcagggagcatga

SEQ ID NO: 8302583 - DNA, 22 bp, Homo sapiens
tccttgaagcttgtatctaata

SEQ ID NO: 8302584 - DNA, 22 bp, Homo sapiens
tccttgaagcaacgtgcagaca

SEQ ID NO: 8302585 - DNA, 22 bp, Homo sapiens
tccttgaagagtgggcggtcga

SEQ ID NO: 8302586 - DNA, 22 bp, Homo sapiens
tccttgaaaggggctgcagggc

SEQ ID NO: 8302587 - DNA, 20 bp, Homo sapiens
tccttgaaagtggggtatat

SEQ ID NO: 8302588 - DNA, 22 bp, Homo sapiens
tccttgaagaatgattcttgga

SEQ ID NO: 8302589 - DNA, 22 bp, Homo sapiens
tccttgaacagagggcctgggt

SEQ ID NO: 8302590 - DNA, 22 bp, Homo sapiens
tccttgaaaatcttggtttaga

SEQ ID NO: 8302591 - DNA, 22 bp, Homo sapiens
tccttgaaaagaatgtctccat

SEQ ID NO: 8302592 - DNA, 22 bp, Homo sapiens
tccttgaatgaatgttctctcc

SEQ ID NO: 8302593 - DNA, 22 bp, Homo sapiens
tccttgaatgaagagaggtgac

SEQ ID NO: 8302594 - DNA, 22 bp, Homo sapiens
tccttgaatcctagcatcctat

SEQ ID NO: 8302595 - DNA, 22 bp, Homo sapiens
tccttgaatataataacagtag

SEQ ID NO: 8302596 - DNA, 22 bp, Homo sapiens
tccttgaattgtgccacttacc

SEQ ID NO: 8302597 - DNA, 22 bp, Homo sapiens
tccttgaatggacattacactg

SEQ ID NO: 8302598 - DNA, 22 bp, Homo sapiens
tccttcctggggtctctgctgc

SEQ ID NO: 8302599 - DNA, 21 bp, Homo sapiens
tccttccttgaggtcctttcc

SEQ ID NO: 8302600 - DNA, 21 bp, Homo sapiens
tccttccttgaggtcctttcc

SEQ ID NO: 8302601 - DNA, 22 bp, Homo sapiens
tccttcctggggtctctgctgc

SEQ ID NO: 8302602 - DNA, 19 bp, Homo sapiens
tccttcagtcagatctggg

SEQ ID NO: 8302603 - DNA, 22 bp, Homo sapiens
tccttcagggttgaggccgact

SEQ ID NO: 8302604 - DNA, 23 bp, Homo sapiens
tccttcctttgagaggctccatc

SEQ ID NO: 8302605 - DNA, 22 bp, Homo sapiens
tccttcaaagctcctagtgagc

SEQ ID NO: 8302606 - DNA, 23 bp, Homo sapiens
tccttcagagcctccctccaagc

SEQ ID NO: 8302607 - DNA, 22 bp, Homo sapiens
tccttcagaggacggcagccag

SEQ ID NO: 8302608 - DNA, 22 bp, Homo sapiens
tccttcagccatgggctctcca

SEQ ID NO: 8302609 - DNA, 22 bp, Homo sapiens
tccttcagccatgggctctcca

SEQ ID NO: 8302610 - DNA, 22 bp, Homo sapiens
tccttcagattcctgcttctgg

SEQ ID NO: 8302611 - DNA, 22 bp, Homo sapiens
tccttcagaaaacctcagtctt

SEQ ID NO: 8302612 - DNA, 22 bp, Homo sapiens
tccttcagggggccgcctgcac

SEQ ID NO: 8302613 - DNA, 22 bp, Homo sapiens
tccttcagggggccgcctgcac

SEQ ID NO: 8302614 - DNA, 17 bp, Homo sapiens
tccttcagggcctcaca

SEQ ID NO: 8302615 - DNA, 17 bp, Homo sapiens
tccttcagggcctcaca

SEQ ID NO: 8302616 - DNA, 22 bp, Homo sapiens
tccttcagggctgaccacaggc

SEQ ID NO: 8302617 - DNA, 22 bp, Homo sapiens
tccttcaggcctcattctcata

SEQ ID NO: 8302618 - DNA, 20 bp, Homo sapiens
tccttcaggcagggcctagt

SEQ ID NO: 8302619 - DNA, 22 bp, Homo sapiens
tccttcagcctcccagctcaaa

SEQ ID NO: 8302620 - DNA, 22 bp, Homo sapiens
tccttcagctactcagtttcca

SEQ ID NO: 8302621 - DNA, 22 bp, Homo sapiens
tccttcagctctctatttagat

SEQ ID NO: 8302622 - DNA, 22 bp, Homo sapiens
tccttcagcttatttcttagga

SEQ ID NO: 8302623 - DNA, 22 bp, Homo sapiens
tctagctctgcttatcatggct

SEQ ID NO: 8302624 - DNA, 22 bp, Homo sapiens
tctaggagcatgaagggaaggc

SEQ ID NO: 8302625 - DNA, 22 bp, Homo sapiens
tctaggagaaccatcagggagg

SEQ ID NO: 8302626 - DNA, 22 bp, Homo sapiens
tctagaaaaaaactgctgtgga

SEQ ID NO: 8302627 - DNA, 22 bp, Homo sapiens
tctacttttccctatacagttt

SEQ ID NO: 8302628 - DNA, 22 bp, Homo sapiens
tctactctactgtctgtgccta

SEQ ID NO: 8302629 - DNA, 19 bp, Homo sapiens
tctaacagaagtgtcgtcc

SEQ ID NO: 8302630 - DNA, 19 bp, Homo sapiens
tctcaatgttcagaaagct

SEQ ID NO: 8302631 - DNA, 22 bp, Homo sapiens
tcctggagggaggcggtgctac

SEQ ID NO: 8302632 - DNA, 22 bp, Homo sapiens
tcctggaggcaaatgaagactc

SEQ ID NO: 8302633 - DNA, 22 bp, Homo sapiens
tcctggaggcaaatgagcacat

SEQ ID NO: 8302634 - DNA, 22 bp, Homo sapiens
tcctggaggcaaatgagcacat

SEQ ID NO: 8302635 - DNA, 22 bp, Homo sapiens
tcctggaggggacagcatgggc

SEQ ID NO: 8302636 - DNA, 22 bp, Homo sapiens
tcctggagtatttctgtggtgt

SEQ ID NO: 8302637 - DNA, 22 bp, Homo sapiens
tcctggagagtgggcgagcaca

SEQ ID NO: 8302638 - DNA, 22 bp, Homo sapiens
tcctggagataattgcagtgaa

SEQ ID NO: 8302639 - DNA, 22 bp, Homo sapiens
tcctggagaatcctgccacctg

SEQ ID NO: 8302640 - DNA, 22 bp, Homo sapiens
taagaacattttcggaaagata

SEQ ID NO: 8302641 - DNA, 21 bp, Homo sapiens
taagaacattatcttcttcct

SEQ ID NO: 8302642 - DNA, 22 bp, Homo sapiens
taagaagcttctgctaatgcct

SEQ ID NO: 8302643 - DNA, 22 bp, Homo sapiens
taagaacagtgacagccaacat

SEQ ID NO: 8302644 - DNA, 22 bp, Homo sapiens
taagaacatctgtccccagatt

SEQ ID NO: 8302645 - DNA, 22 bp, Homo sapiens
taagaacataaattcatacggg

SEQ ID NO: 8302646 - DNA, 22 bp, Homo sapiens
taagaacagtgtttcatctcta

SEQ ID NO: 8302647 - DNA, 22 bp, Homo sapiens
taagaacagtgtctgtctcaca

SEQ ID NO: 8302648 - DNA, 22 bp, Homo sapiens
taagaacaagctgggggttcca

SEQ ID NO: 8302649 - DNA, 22 bp, Homo sapiens
taagaacaagatgttcctgttt

SEQ ID NO: 8302650 - DNA, 23 bp, Homo sapiens
taagaacagacaagcatttacat

SEQ ID NO: 8302651 - DNA, 22 bp, Homo sapiens
taagaacagataaagtttcccc

SEQ ID NO: 8302652 - DNA, 22 bp, Homo sapiens
taagaacagtagaacagtaggt

SEQ ID NO: 8302653 - DNA, 22 bp, Homo sapiens
taagaattgtgttgaatagagt

SEQ ID NO: 8302654 - DNA, 22 bp, Homo sapiens
tcctggagttgtgcagtgcaca

SEQ ID NO: 8302655 - DNA, 22 bp, Homo sapiens
tcctggagtatttctgtggtgt

SEQ ID NO: 8302656 - DNA, 22 bp, Homo sapiens
tcctggattctgccctgaaggc

SEQ ID NO: 8302657 - DNA, 17 bp, Homo sapiens
tcctggctctgccactg

SEQ ID NO: 8302658 - DNA, 22 bp, Homo sapiens
tcctggcccactatgccagcat

SEQ ID NO: 8302659 - DNA, 22 bp, Homo sapiens
tcctgggtccatggcagccgaa

SEQ ID NO: 8302660 - DNA, 20 bp, Homo sapiens
tcctggggtaagccatggtc

SEQ ID NO: 8302661 - DNA, 22 bp, Homo sapiens
tcctgtctgtctttggtccctt

SEQ ID NO: 8302662 - DNA, 22 bp, Homo sapiens
tcctgtctgctcacagagctgg

SEQ ID NO: 8302663 - DNA, 22 bp, Homo sapiens
tcctgtgcctccacctgctccg

SEQ ID NO: 8302664 - DNA, 22 bp, Homo sapiens
tcctgtggaagacagtgttggg

SEQ ID NO: 8302665 - DNA, 17 bp, Homo sapiens
tcctgtgggtgcagcag

SEQ ID NO: 8302666 - DNA, 22 bp, Homo sapiens
tcctgtagttgctaagtttgtt

SEQ ID NO: 8302667 - DNA, 22 bp, Homo sapiens
tcctgtcagtgaggcagatgaa

SEQ ID NO: 8302668 - DNA, 22 bp, Homo sapiens
tcctgggaagagacctgagcat

SEQ ID NO: 8302669 - DNA, 19 bp, Homo sapiens
tcctgggctgggccaggtc

SEQ ID NO: 8302670 - DNA, 22 bp, Homo sapiens
tcctgggctgtgtgccactctg

SEQ ID NO: 8302671 - DNA, 22 bp, Homo sapiens
tcctgggctgtggccccgggca

SEQ ID NO: 8302672 - DNA, 22 bp, Homo sapiens
tcctgggctgcagggaagagca

SEQ ID NO: 8302673 - DNA, 22 bp, Homo sapiens
tcctgggcccaggctgccaggg

SEQ ID NO: 8302674 - DNA, 22 bp, Homo sapiens
tcctgggcccaggctgccaggg

SEQ ID NO: 8302675 - DNA, 22 bp, Homo sapiens
tcctgggcctgtactccatccg

SEQ ID NO: 8302676 - DNA, 22 bp, Homo sapiens
tctcttccagtaagagtcttta

SEQ ID NO: 8302677 - DNA, 21 bp, Homo sapiens
tctcttcctccgcgccgccgc

SEQ ID NO: 8302678 - DNA, 22 bp, Homo sapiens
tctcttccatgtttcagcccca

SEQ ID NO: 8302679 - DNA, 22 bp, Homo sapiens
tctcttcttgtgttttcctgcc

SEQ ID NO: 8302680 - DNA, 22 bp, Homo sapiens
tctcttcttgattttcactgga

SEQ ID NO: 8302681 - DNA, 22 bp, Homo sapiens
tctcttcttgattttcactgga

SEQ ID NO: 8302682 - DNA, 22 bp, Homo sapiens
tctcttctgaaacctgtcttta

SEQ ID NO: 8302683 - DNA, 22 bp, Homo sapiens
tctcttctgaaacctgtcttta

SEQ ID NO: 8302684 - DNA, 22 bp, Homo sapiens
tctcttctagcttcttgtggtt

SEQ ID NO: 8302685 - DNA, 22 bp, Homo sapiens
tctctgggtttttgtcctgtac

SEQ ID NO: 8302686 - DNA, 22 bp, Homo sapiens
tctctggtggctccatcagtag

SEQ ID NO: 8302687 - DNA, 22 bp, Homo sapiens
tctctgtctgagcctggcagac

SEQ ID NO: 8302688 - DNA, 22 bp, Homo sapiens
tctctgtctttgttgtcttcac

SEQ ID NO: 8302689 - DNA, 17 bp, Homo sapiens
tctctttccctttctgc

SEQ ID NO: 8302690 - DNA, 22 bp, Homo sapiens
tctctttctattgcaccatgct

SEQ ID NO: 8302691 - DNA, 19 bp, Homo sapiens
tctctttcatggggctagt

SEQ ID NO: 8302692 - DNA, 22 bp, Homo sapiens
tctctttctcagatggtggaga

SEQ ID NO: 8302693 - DNA, 18 bp, Homo sapiens
tctcttttcccctcattg

SEQ ID NO: 8302694 - DNA, 22 bp, Homo sapiens
tctcttttatgtacaccctgac

SEQ ID NO: 8302695 - DNA, 18 bp, Homo sapiens
tctcttttcccctcattg

SEQ ID NO: 8302696 - DNA, 22 bp, Homo sapiens
tctgaagaactgagtaaacatg

SEQ ID NO: 8302697 - DNA, 23 bp, Homo sapiens
tctctctggcaaatttcacatat

SEQ ID NO: 8302698 - DNA, 20 bp, Homo sapiens
tctctctggttggaggagct

SEQ ID NO: 8302699 - DNA, 22 bp, Homo sapiens
tctctcctaatttcaggtgctt

SEQ ID NO: 8302700 - DNA, 22 bp, Homo sapiens
tctctccttatcattgtgttta

SEQ ID NO: 8302701 - DNA, 22 bp, Homo sapiens
tctctctcctagtttttagtgg

SEQ ID NO: 8302702 - DNA, 22 bp, Homo sapiens
tctctctgagccctgctttttc

SEQ ID NO: 8302703 - DNA, 22 bp, Homo sapiens
tctctcactggtgcctctgttg

SEQ ID NO: 8302704 - DNA, 22 bp, Homo sapiens
tctctcagggggaaggctgaag

SEQ ID NO: 8302705 - DNA, 22 bp, Homo sapiens
tctctcagtcagatgctaaaga

SEQ ID NO: 8302706 - DNA, 22 bp, Homo sapiens
tctctcagaggccagggtcctg

SEQ ID NO: 8302707 - DNA, 22 bp, Homo sapiens
tctctcaggctggagtgcagtg

SEQ ID NO: 8302708 - DNA, 22 bp, Homo sapiens
tctctcagctttgagacctgct

SEQ ID NO: 8302709 - DNA, 22 bp, Homo sapiens
tctctggccgagagtccctggg

SEQ ID NO: 8302710 - DNA, 21 bp, Homo sapiens
tctctggaattagaccatgtt

SEQ ID NO: 8302711 - DNA, 22 bp, Homo sapiens
tctctggaattggctgaggcaa

SEQ ID NO: 8302712 - DNA, 22 bp, Homo sapiens
tctctggaagcgcagatctgtt

SEQ ID NO: 8302713 - DNA, 19 bp, Homo sapiens
tctctgcttctcttggcat

SEQ ID NO: 8302714 - DNA, 21 bp, Homo sapiens
tctctggagttagcagagaga

SEQ ID NO: 8302715 - DNA, 22 bp, Homo sapiens
tctctggagtataaccagggat

SEQ ID NO: 8302716 - DNA, 22 bp, Homo sapiens
tctctggagggctccaggcggg

SEQ ID NO: 8302717 - DNA, 22 bp, Homo sapiens
tctctggagctgcagatccagg

SEQ ID NO: 8302718 - DNA, 22 bp, Homo sapiens
tctctggaattttgagagtgac

SEQ ID NO: 8302719 - DNA, 22 bp, Homo sapiens
tctctgctaagattgtgtctag

SEQ ID NO: 8302720 - DNA, 22 bp, Homo sapiens
tctctgctcaggcaccagccct

SEQ ID NO: 8302721 - DNA, 22 bp, Homo sapiens
tctctgctgagaagggctggca

SEQ ID NO: 8302722 - DNA, 20 bp, Homo sapiens
tctctgctgtccacatttgc

SEQ ID NO: 8302723 - DNA, 20 bp, Homo sapiens
tctctgctgtccacatttgc

SEQ ID NO: 8302724 - DNA, 22 bp, Homo sapiens
tctctgctctgtgcctcagttt

SEQ ID NO: 8302725 - DNA, 22 bp, Homo sapiens
tctctgctctgtgcctcagttt

SEQ ID NO: 8302726 - DNA, 19 bp, Homo sapiens
tctctggggacactttcac

SEQ ID NO: 8302727 - DNA, 21 bp, Homo sapiens
tctctgggccctcctgtgggg

SEQ ID NO: 8302728 - DNA, 22 bp, Homo sapiens
tctctggggatggacctgggag

SEQ ID NO: 8302729 - DNA, 22 bp, Homo sapiens
tctctgggtgatggcagggcac

SEQ ID NO: 8302730 - DNA, 22 bp, Homo sapiens
tctccttcgaggcccagctccc

SEQ ID NO: 8302731 - DNA, 22 bp, Homo sapiens
tctcctttaagatttcctcagg

SEQ ID NO: 8302732 - DNA, 22 bp, Homo sapiens
tctcctttgaaagttaggactg

SEQ ID NO: 8302733 - DNA, 22 bp, Homo sapiens
tctcgtgcaggccttgctcgga

SEQ ID NO: 8302734 - DNA, 22 bp, Homo sapiens
tctcgctctgtcgcccaggctg

SEQ ID NO: 8302735 - DNA, 22 bp, Homo sapiens
tctcctggtcacctcagaagtc

SEQ ID NO: 8302736 - DNA, 22 bp, Homo sapiens
tctcctgtgcaccctccctgtg

SEQ ID NO: 8302737 - DNA, 22 bp, Homo sapiens
tctcctgcagcgagcccgacac

SEQ ID NO: 8302738 - DNA, 22 bp, Homo sapiens
tctcctggatggaccttctctt

SEQ ID NO: 8302739 - DNA, 22 bp, Homo sapiens
tctcctctgcgcggcagtgccc

SEQ ID NO: 8302740 - DNA, 22 bp, Homo sapiens
tctcctcaccaccagcagcaga

SEQ ID NO: 8302741 - DNA, 20 bp, Homo sapiens
tctcccaggctcagggaaga

SEQ ID NO: 8302742 - DNA, 22 bp, Homo sapiens
tctcccaggctgccctgtggac

SEQ ID NO: 8302743 - DNA, 22 bp, Homo sapiens
tctcccaggtgggtgcctggag

SEQ ID NO: 8302744 - DNA, 22 bp, Homo sapiens
tctcccaggtgggtgcctggag

SEQ ID NO: 8302745 - DNA, 22 bp, Homo sapiens
tctccctcattcctgcttccat

SEQ ID NO: 8302746 - DNA, 22 bp, Homo sapiens
tctcccagaggatcccagtgga

SEQ ID NO: 8302747 - DNA, 22 bp, Homo sapiens
tctcccactggccttgtatgat

SEQ ID NO: 8302748 - DNA, 21 bp, Homo sapiens
tctccagtatccttctctgag

SEQ ID NO: 8302749 - DNA, 22 bp, Homo sapiens
tctcccactgcaagcccaggct

SEQ ID NO: 8302750 - DNA, 22 bp, Homo sapiens
tctcccactgcaagcccaggct

SEQ ID NO: 8302751 - DNA, 22 bp, Homo sapiens
tctcatctagactctgcccttg

SEQ ID NO: 8302752 - DNA, 22 bp, Homo sapiens
tctcatctgcgagctctgccag

SEQ ID NO: 8302753 - DNA, 22 bp, Homo sapiens
tctcatcttcattgtctcccat

SEQ ID NO: 8302754 - DNA, 22 bp, Homo sapiens
tctcagggtttgtacaagtgta

SEQ ID NO: 8302755 - DNA, 20 bp, Homo sapiens
tctcagggttcagcaaagta

SEQ ID NO: 8302756 - DNA, 22 bp, Homo sapiens
tctcagggtttcctgggggctg

SEQ ID NO: 8302757 - DNA, 22 bp, Homo sapiens
tctcagggtgaggaaagaattt

SEQ ID NO: 8302758 - DNA, 22 bp, Homo sapiens
tctcagggcctccctctgtttc

SEQ ID NO: 8302759 - DNA, 22 bp, Homo sapiens
tctcagggcgcagtgaggcagt

SEQ ID NO: 8302760 - DNA, 22 bp, Homo sapiens
tctcaggggcctggagtcctgg

SEQ ID NO: 8302761 - DNA, 22 bp, Homo sapiens
tctcaggggattcactggcacc

SEQ ID NO: 8302762 - DNA, 22 bp, Homo sapiens
tctccaagcagggctgcaaggc

SEQ ID NO: 8302763 - DNA, 22 bp, Homo sapiens
tctcattcataccctacatgct

SEQ ID NO: 8302764 - DNA, 22 bp, Homo sapiens
tctcatgtattgccctggtgtg

SEQ ID NO: 8302765 - DNA, 19 bp, Homo sapiens
tctcacatcagctcctagc

SEQ ID NO: 8302766 - DNA, 22 bp, Homo sapiens
tctcaccatggtgcttgcttat

SEQ ID NO: 8302767 - DNA, 22 bp, Homo sapiens
tctcaccaaagccttgaccata

SEQ ID NO: 8302768 - DNA, 22 bp, Homo sapiens
tctcactgggtcacagcagagg

SEQ ID NO: 8302769 - DNA, 22 bp, Homo sapiens
tctcactgcaaatattatgtat

SEQ ID NO: 8302770 - DNA, 22 bp, Homo sapiens
tctcactgggtataaatgagta

SEQ ID NO: 8302771 - DNA, 22 bp, Homo sapiens
tctcactcatttcctaggtctt

SEQ ID NO: 8302772 - DNA, 22 bp, Homo sapiens
tctcagagaggggccgggcctt

SEQ ID NO: 8302773 - DNA, 22 bp, Homo sapiens
tctcagagagctgtgttttcct

SEQ ID NO: 8302774 - DNA, 22 bp, Homo sapiens
tctcagagatgttagggaagag

SEQ ID NO: 8302775 - DNA, 22 bp, Homo sapiens
tctcagagatgtcaagagtcta

SEQ ID NO: 8302776 - DNA, 22 bp, Homo sapiens
tctcagagatctttctgcatgt

SEQ ID NO: 8302777 - DNA, 19 bp, Homo sapiens
tctcagaggaaaaattgct

SEQ ID NO: 8302778 - DNA, 23 bp, Homo sapiens
tctcagaggattcctgggccttg

SEQ ID NO: 8302779 - DNA, 18 bp, Homo sapiens
tctcagaggccatcctag

SEQ ID NO: 8302780 - DNA, 22 bp, Homo sapiens
tctcagagcttcagttattttc

SEQ ID NO: 8302781 - DNA, 22 bp, Homo sapiens
tctcagagcctaactaacctaa

SEQ ID NO: 8302782 - DNA, 22 bp, Homo sapiens
tctcagagcttcagaaagcacc

SEQ ID NO: 8302783 - DNA, 22 bp, Homo sapiens
tctcagagctcacacctcctgg

SEQ ID NO: 8302784 - DNA, 19 bp, Homo sapiens
tctcagagccctagaggcc

SEQ ID NO: 8302785 - DNA, 22 bp, Homo sapiens
tctcagagatttatggaaaact

SEQ ID NO: 8302786 - DNA, 22 bp, Homo sapiens
tctcagagattttgtttccctt

SEQ ID NO: 8302787 - DNA, 22 bp, Homo sapiens
tctcagagcatcattttcttag

SEQ ID NO: 8302788 - DNA, 22 bp, Homo sapiens
tctcagagattcagggagaagt

SEQ ID NO: 8302789 - DNA, 22 bp, Homo sapiens
tctcaggctaccttgcacaagg

SEQ ID NO: 8302790 - DNA, 22 bp, Homo sapiens
tctcaggcccctgagtttctct

SEQ ID NO: 8302791 - DNA, 22 bp, Homo sapiens
tctcagggaccatgatgatgac

SEQ ID NO: 8302792 - DNA, 22 bp, Homo sapiens
tctcagggagggcgagtcagcg

SEQ ID NO: 8302793 - DNA, 22 bp, Homo sapiens
tctcagggccccaaaggctagt

SEQ ID NO: 8302794 - DNA, 22 bp, Homo sapiens
tctcagggcagcaaggaagcat

SEQ ID NO: 8302795 - DNA, 22 bp, Homo sapiens
tctcagagtggtggtccctctg

SEQ ID NO: 8302796 - DNA, 22 bp, Homo sapiens
tctcagagttcctctggagtcc

SEQ ID NO: 8302797 - DNA, 22 bp, Homo sapiens
tctcagagtgacaatgagaatt

SEQ ID NO: 8302798 - DNA, 22 bp, Homo sapiens
tctcagagtaattctttaaggt

SEQ ID NO: 8302799 - DNA, 22 bp, Homo sapiens
tctcagagggaaacatgagtga

SEQ ID NO: 8302800 - DNA, 22 bp, Homo sapiens
tctcagaggcccgacgttctcc

SEQ ID NO: 8302801 - DNA, 22 bp, Homo sapiens
tctcagaggtcttcagcctctg

SEQ ID NO: 8302802 - DNA, 22 bp, Homo sapiens
tctcagaggtgccctggcatct

SEQ ID NO: 8302803 - DNA, 22 bp, Homo sapiens
tctcagagggaaaggccaattt

SEQ ID NO: 8302804 - DNA, 22 bp, Homo sapiens
tctcagagggaggattactgcc

SEQ ID NO: 8302805 - DNA, 22 bp, Homo sapiens
tctcagagtttagagctgagcc

SEQ ID NO: 8302806 - DNA, 22 bp, Homo sapiens
tctcagagtttacggggctgaa

SEQ ID NO: 8302807 - DNA, 22 bp, Homo sapiens
tctcagagtttttttccaggac

SEQ ID NO: 8302808 - DNA, 22 bp, Homo sapiens
tctcagagtttgaatctggagt

SEQ ID NO: 8302809 - DNA, 22 bp, Homo sapiens
tgcctctgttgagccttggctg

SEQ ID NO: 8302810 - DNA, 22 bp, Homo sapiens
tgcctctgttgagccttggctg

SEQ ID NO: 8302811 - DNA, 22 bp, Homo sapiens
tgcctctgtgtgcaggtgagca

SEQ ID NO: 8302812 - DNA, 22 bp, Homo sapiens
tgcctgaggagtcagggcaggt

SEQ ID NO: 8302813 - DNA, 22 bp, Homo sapiens
tgcctgagtgatgtggcagcca

SEQ ID NO: 8302814 - DNA, 22 bp, Homo sapiens
tgcctctgtgggccttcctggc

SEQ ID NO: 8302815 - DNA, 22 bp, Homo sapiens
tgcctctgctgctgtggcatca

SEQ ID NO: 8302816 - DNA, 22 bp, Homo sapiens
tgcctctgggtgaccaaggagc

SEQ ID NO: 8302817 - DNA, 22 bp, Homo sapiens
tgcctctggttatctggtacct

SEQ ID NO: 8302818 - DNA, 22 bp, Homo sapiens
tgcctctgtggaaatggtggtc

SEQ ID NO: 8302819 - DNA, 22 bp, Homo sapiens
tgcctctggttatctggtacct

SEQ ID NO: 8302820 - DNA, 22 bp, Homo sapiens
tgcctctgaggaagattgtgtt

SEQ ID NO: 8302821 - DNA, 23 bp, Homo sapiens
tgcctctgcctccctagtctgca

SEQ ID NO: 8302822 - DNA, 22 bp, Homo sapiens
tgcctcagagtgggcttgctat

SEQ ID NO: 8302823 - DNA, 22 bp, Homo sapiens
tgcctcagagttgtccctacca

SEQ ID NO: 8302824 - DNA, 22 bp, Homo sapiens
tgcctcagctgaggccgctcca

SEQ ID NO: 8302825 - DNA, 22 bp, Homo sapiens
tgcctggcaatgccagaagcca

SEQ ID NO: 8302826 - DNA, 19 bp, Homo sapiens
tgcctggcaccagctccac

SEQ ID NO: 8302827 - DNA, 22 bp, Homo sapiens
tgcctggcaactgtggtgggct

SEQ ID NO: 8302828 - DNA, 22 bp, Homo sapiens
tgcctggcaactgtggtgggct

SEQ ID NO: 8302829 - DNA, 22 bp, Homo sapiens
tgcctggcaagaggggctggct

SEQ ID NO: 8302830 - DNA, 22 bp, Homo sapiens
tgcctggatgtgctggcctcac

SEQ ID NO: 8302831 - DNA, 22 bp, Homo sapiens
tgcctggatgtgctggcctcac

SEQ ID NO: 8302832 - DNA, 22 bp, Homo sapiens
tgcctgcagcgtctccagcagg

SEQ ID NO: 8302833 - DNA, 22 bp, Homo sapiens
tgcctgatgcaggagtatcaga

SEQ ID NO: 8302834 - DNA, 22 bp, Homo sapiens
tgcctgagtttaaccctcagag

SEQ ID NO: 8302835 - DNA, 22 bp, Homo sapiens
tgcctgccatgcagaaagctga

SEQ ID NO: 8302836 - DNA, 22 bp, Homo sapiens
tgcctgctttctcctcaactca

SEQ ID NO: 8302837 - DNA, 22 bp, Homo sapiens
tgcctgctttctgggctgccat

SEQ ID NO: 8302838 - DNA, 22 bp, Homo sapiens
tgcctgctgccactgctgttac

SEQ ID NO: 8302839 - DNA, 22 bp, Homo sapiens
tgcctgctgctaagctctttgt

SEQ ID NO: 8302840 - DNA, 22 bp, Homo sapiens
tgcctaggaaacctcatgcttc

SEQ ID NO: 8302841 - DNA, 22 bp, Homo sapiens
tgccctgtctaagctgtcagta

SEQ ID NO: 8302842 - DNA, 22 bp, Homo sapiens
tgccctgttcctgcctccagct

SEQ ID NO: 8302843 - DNA, 22 bp, Homo sapiens
tgcccttgggtaacttgctgat

SEQ ID NO: 8302844 - DNA, 22 bp, Homo sapiens
tgccctgtgtgtgcaagcactg

SEQ ID NO: 8302845 - DNA, 22 bp, Homo sapiens
tgccctgttatcttggaagagt

SEQ ID NO: 8302846 - DNA, 22 bp, Homo sapiens
tgccctgcagtgagtgcgtctg

SEQ ID NO: 8302847 - DNA, 22 bp, Homo sapiens
tgccctgcccatctaccctgtc

SEQ ID NO: 8302848 - DNA, 21 bp, Homo sapiens
tgccagggatttacagagcct

SEQ ID NO: 8302849 - DNA, 21 bp, Homo sapiens
tgccagggatttacagagcct

SEQ ID NO: 8302850 - DNA, 20 bp, Homo sapiens
tgccagggccagcagaggct

SEQ ID NO: 8302851 - DNA, 22 bp, Homo sapiens
tgccagggtgtcaggagagcta

SEQ ID NO: 8302852 - DNA, 22 bp, Homo sapiens
tgccagggctgctactggctga

SEQ ID NO: 8302853 - DNA, 22 bp, Homo sapiens
tgccaggggacctagggatgtc

SEQ ID NO: 8302854 - DNA, 22 bp, Homo sapiens
tgccaggcatatggcctctttg

SEQ ID NO: 8302855 - DNA, 17 bp, Homo sapiens
tgccagcctgtcccagg

SEQ ID NO: 8302856 - DNA, 22 bp, Homo sapiens
tgccaggcccagctccagagct

SEQ ID NO: 8302857 - DNA, 22 bp, Homo sapiens
tgccaggccctgtgctggatgc

SEQ ID NO: 8302858 - DNA, 22 bp, Homo sapiens
tgcccaggatctggcgatgctc

SEQ ID NO: 8302859 - DNA, 22 bp, Homo sapiens
tgcccagggtggagtgcagcgg

SEQ ID NO: 8302860 - DNA, 22 bp, Homo sapiens
tgcccacattcaaaaggtgatg

SEQ ID NO: 8302861 - DNA, 22 bp, Homo sapiens
tgcccacatggtgccatggcca

SEQ ID NO: 8302862 - DNA, 22 bp, Homo sapiens
tgcccagcactgtgccagtcac

SEQ ID NO: 8302863 - DNA, 20 bp, Homo sapiens
tgccatggtaacagagtgtg

SEQ ID NO: 8302864 - DNA, 22 bp, Homo sapiens
tgcccaagtcctccaccgaggt

SEQ ID NO: 8302865 - DNA, 22 bp, Homo sapiens
tgcccaagtgtttggctgagtc

SEQ ID NO: 8302866 - DNA, 22 bp, Homo sapiens
tgcccaagcagaggagtgattc

SEQ ID NO: 8302867 - DNA, 22 bp, Homo sapiens
tgcccacaggaagacaccagcg

SEQ ID NO: 8302868 - DNA, 21 bp, Homo sapiens
tgcccacagcaaatgcagagg

SEQ ID NO: 8302869 - DNA, 22 bp, Homo sapiens
tgccagccaggttctgaggcta

SEQ ID NO: 8302870 - DNA, 22 bp, Homo sapiens
tgccagcccaccttggggcctc

SEQ ID NO: 8302871 - DNA, 22 bp, Homo sapiens
tgccagcagtagcagtaggcca

SEQ ID NO: 8302872 - DNA, 19 bp, Homo sapiens
tgccagcattaggctgaag

SEQ ID NO: 8302873 - DNA, 19 bp, Homo sapiens
tgccagcattaggctgaag

SEQ ID NO: 8302874 - DNA, 21 bp, Homo sapiens
tgccagcatgtaggctagttg

SEQ ID NO: 8302875 - DNA, 21 bp, Homo sapiens
tgccagcattaaacagtcatt

SEQ ID NO: 8302876 - DNA, 22 bp, Homo sapiens
tgccagcacaagttaagagatc

SEQ ID NO: 8302877 - DNA, 22 bp, Homo sapiens
tgccagcacttctggctgtctg

SEQ ID NO: 8302878 - DNA, 23 bp, Homo sapiens
tgccagaggcagtcacagtggtg

SEQ ID NO: 8302879 - DNA, 22 bp, Homo sapiens
tgccagaagattctctatcaga

SEQ ID NO: 8302880 - DNA, 22 bp, Homo sapiens
tgccagaagtgctttataagtg

SEQ ID NO: 8302881 - DNA, 22 bp, Homo sapiens
tgccacccagccaggagtggga

SEQ ID NO: 8302882 - DNA, 22 bp, Homo sapiens
tgcatttcagaagaaaattcgg

SEQ ID NO: 8302883 - DNA, 22 bp, Homo sapiens
tgcatttgtcttgtctcatgaa

SEQ ID NO: 8302884 - DNA, 22 bp, Homo sapiens
tgcattgttgatgagttgaata

SEQ ID NO: 8302885 - DNA, 22 bp, Homo sapiens
tgcattgttgaccagttgtgca

SEQ ID NO: 8302886 - DNA, 22 bp, Homo sapiens
tgcattgttgaatatttcatag

SEQ ID NO: 8302887 - DNA, 17 bp, Homo sapiens
tgcattgtaggctagcc

SEQ ID NO: 8302888 - DNA, 22 bp, Homo sapiens
tgcattgtaggatgtttagcag

SEQ ID NO: 8302889 - DNA, 22 bp, Homo sapiens
tgcattgtttgataggtgaatt

SEQ ID NO: 8302890 - DNA, 22 bp, Homo sapiens
tgcattgtttagaactctttgg

SEQ ID NO: 8302891 - DNA, 17 bp, Homo sapiens
tgcattgttggaaattt

SEQ ID NO: 8302892 - DNA, 22 bp, Homo sapiens
tgcattgcagttaactcagtat

SEQ ID NO: 8302893 - DNA, 22 bp, Homo sapiens
tgcattgcatttgtcatgaaga

SEQ ID NO: 8302894 - DNA, 22 bp, Homo sapiens
tgcattcctccacctcctgcac

SEQ ID NO: 8302895 - DNA, 21 bp, Homo sapiens
tgcatgctatgtttttatttc

SEQ ID NO: 8302896 - DNA, 22 bp, Homo sapiens
tgcatgcataaatgtacacaca

SEQ ID NO: 8302897 - DNA, 22 bp, Homo sapiens
tgcatgcagctggtgataagaa

SEQ ID NO: 8302898 - DNA, 22 bp, Homo sapiens
tgcatcttacgttttgaaaggg

SEQ ID NO: 8302899 - DNA, 17 bp, Homo sapiens
tgcatgtcctttgttcc

SEQ ID NO: 8302900 - DNA, 22 bp, Homo sapiens
tgcatccttaaccagcatcact

SEQ ID NO: 8302901 - DNA, 22 bp, Homo sapiens
tgcatctgttcagagctgtcga

SEQ ID NO: 8302902 - DNA, 21 bp, Homo sapiens
tgcataaagaaatacaaatac

SEQ ID NO: 8302903 - DNA, 22 bp, Homo sapiens
tgcaggtgaaaattatgaggat

SEQ ID NO: 8302904 - DNA, 20 bp, Homo sapiens
tgcagggctgcctcccagct

SEQ ID NO: 8302905 - DNA, 20 bp, Homo sapiens
tgcagggctctgcttctctc

SEQ ID NO: 8302906 - DNA, 22 bp, Homo sapiens
tgcagggcttcctcttggagtt

SEQ ID NO: 8302907 - DNA, 23 bp, Homo sapiens
tgcaggggaggcttaaagcaggt

SEQ ID NO: 8302908 - DNA, 22 bp, Homo sapiens
tgcaggggcttgtctgggcctg

SEQ ID NO: 8302909 - DNA, 22 bp, Homo sapiens
tgcaggtggtttggacactgct

SEQ ID NO: 8302910 - DNA, 22 bp, Homo sapiens
tgcaggtgtggttcctcagcca

SEQ ID NO: 8302911 - DNA, 22 bp, Homo sapiens
tgcagtggttgagagcccagac

SEQ ID NO: 8302912 - DNA, 22 bp, Homo sapiens
tgcagtggtgtccaggtgtact

SEQ ID NO: 8302913 - DNA, 22 bp, Homo sapiens
tgcagtggtggtaaagatgctc

SEQ ID NO: 8302914 - DNA, 22 bp, Homo sapiens
tgcagtgggccggaggccaggg

SEQ ID NO: 8302915 - DNA, 22 bp, Homo sapiens
tgcagtggcgccatctcagctc

SEQ ID NO: 8302916 - DNA, 22 bp, Homo sapiens
tgcagggctacaggactacaac

SEQ ID NO: 8302917 - DNA, 22 bp, Homo sapiens
tgcagggccgctggaggtcatg

SEQ ID NO: 8302918 - DNA, 22 bp, Homo sapiens
tgcagggcccttggggttgaac

SEQ ID NO: 8302919 - DNA, 22 bp, Homo sapiens
tgcagggccagactgggttgga

SEQ ID NO: 8302920 - DNA, 22 bp, Homo sapiens
tgcagggcacacgcacgggtgt

SEQ ID NO: 8302921 - DNA, 22 bp, Homo sapiens
tgcaggctgtaatctgaggcta

SEQ ID NO: 8302922 - DNA, 22 bp, Homo sapiens
tgcaggctttagccccatggct

SEQ ID NO: 8302923 - DNA, 21 bp, Homo sapiens
tgcagagatatctgaagcaga

SEQ ID NO: 8302924 - DNA, 22 bp, Homo sapiens
tgcagacctcccatggctgcct

SEQ ID NO: 8302925 - DNA, 20 bp, Homo sapiens
tgcagagctggctggctcct

SEQ ID NO: 8302926 - DNA, 22 bp, Homo sapiens
tgcagaggaccattgtcctgga

SEQ ID NO: 8302927 - DNA, 22 bp, Homo sapiens
tgcagaggagctggaaggctgg

SEQ ID NO: 8302928 - DNA, 22 bp, Homo sapiens
tgcagaggagctggaaggctgg

SEQ ID NO: 8302929 - DNA, 22 bp, Homo sapiens
tgcagaggagtcagcctgggca

SEQ ID NO: 8302930 - DNA, 22 bp, Homo sapiens
tgcagattcaaatgaaatgcaa

SEQ ID NO: 8302931 - DNA, 22 bp, Homo sapiens
tgcagagggacagccacagctc

SEQ ID NO: 8302932 - DNA, 23 bp, Homo sapiens
tgcagagggactgaagccagctt

SEQ ID NO: 8302933 - DNA, 22 bp, Homo sapiens
tgcaccctcatcagtcaaatgg

SEQ ID NO: 8302934 - DNA, 22 bp, Homo sapiens
tgcacctgagaggtctctgagg

SEQ ID NO: 8302935 - DNA, 22 bp, Homo sapiens
tgcacctgagaggtctctgagg

SEQ ID NO: 8302936 - DNA, 22 bp, Homo sapiens
tgcaccccattttacatttaca

SEQ ID NO: 8302937 - DNA, 22 bp, Homo sapiens
tgcaccattttgtcaggctact

SEQ ID NO: 8302938 - DNA, 22 bp, Homo sapiens
tgcaccatgtaagtggccacgt

SEQ ID NO: 8302939 - DNA, 22 bp, Homo sapiens
tgcaccattaatttatgtgaga

SEQ ID NO: 8302940 - DNA, 22 bp, Homo sapiens
tgcaccatacccattcccctct

SEQ ID NO: 8302941 - DNA, 22 bp, Homo sapiens
tgcacagcgggtgtctgtcagg

SEQ ID NO: 8302942 - DNA, 22 bp, Homo sapiens
tgcacacagttctcaggaaaga

SEQ ID NO: 8302943 - DNA, 22 bp, Homo sapiens
tgcagaagaaaacagctgtgtg

SEQ ID NO: 8302944 - DNA, 20 bp, Homo sapiens
tgcagaagaacgttctggtt

SEQ ID NO: 8302945 - DNA, 22 bp, Homo sapiens
tgcagaagaatgagcttggagt

SEQ ID NO: 8302946 - DNA, 22 bp, Homo sapiens
tgcagaagaatgtaggcataag

SEQ ID NO: 8302947 - DNA, 22 bp, Homo sapiens
tgcagaagacacaaggtaacgt

SEQ ID NO: 8302948 - DNA, 19 bp, Homo sapiens
tgcagaagacacagtggtg

SEQ ID NO: 8302949 - DNA, 22 bp, Homo sapiens
tgcagaagaccttccagggctg

SEQ ID NO: 8302950 - DNA, 22 bp, Homo sapiens
tgcagaaggaggaggaaatcca

SEQ ID NO: 8302951 - DNA, 22 bp, Homo sapiens
tgcagaaggcctgacattgcac

SEQ ID NO: 8302952 - DNA, 22 bp, Homo sapiens
tgcagaagtattccaggcccca

SEQ ID NO: 8302953 - DNA, 22 bp, Homo sapiens
tgcagaagtgagtcatgaggaa

SEQ ID NO: 8302954 - DNA, 22 bp, Homo sapiens
tgcagaagtgagtcatgaggaa

SEQ ID NO: 8302955 - DNA, 22 bp, Homo sapiens
tgcagaagatggtctgagcacc

SEQ ID NO: 8302956 - DNA, 22 bp, Homo sapiens
tgcagaagcagagagttgccaa

SEQ ID NO: 8302957 - DNA, 22 bp, Homo sapiens
tgcagaagcagagccggtggcc

SEQ ID NO: 8302958 - DNA, 22 bp, Homo sapiens
tgcagaagctgcaggtcagtgg

SEQ ID NO: 8302959 - DNA, 21 bp, Homo sapiens
tgcaggaaagtgctgcgaccc

SEQ ID NO: 8302960 - DNA, 22 bp, Homo sapiens
tgcagcttcttgtcctgtgatt

SEQ ID NO: 8302961 - DNA, 22 bp, Homo sapiens
tgcagcttctccatctccttgt

SEQ ID NO: 8302962 - DNA, 20 bp, Homo sapiens
tgcagcttcacctgtgtcat

SEQ ID NO: 8302963 - DNA, 22 bp, Homo sapiens
tgcagctgttacggaccctgtc

SEQ ID NO: 8302964 - DNA, 22 bp, Homo sapiens
tgcagctgtaacagaggcctca

SEQ ID NO: 8302965 - DNA, 22 bp, Homo sapiens
tgcagctgtaacagaggcctca

SEQ ID NO: 8302966 - DNA, 21 bp, Homo sapiens
tgcaggaaagtgctgcgaccc

SEQ ID NO: 8302967 - DNA, 22 bp, Homo sapiens
tgcaggagaaagtacggagcgt

SEQ ID NO: 8302968 - DNA, 22 bp, Homo sapiens
tgcaggagcagagatggctgga

SEQ ID NO: 8302969 - DNA, 21 bp, Homo sapiens
tgcaggagtctgtgagtcagg

SEQ ID NO: 8302970 - DNA, 19 bp, Homo sapiens
tgcaggaggactgagcaga

SEQ ID NO: 8302971 - DNA, 22 bp, Homo sapiens
tgcaggagctgtgcggtgaggg

SEQ ID NO: 8302972 - DNA, 22 bp, Homo sapiens
tgcagcccttccttcctctggg

SEQ ID NO: 8302973 - DNA, 21 bp, Homo sapiens
tgcagccattcagccctatgc

SEQ ID NO: 8302974 - DNA, 22 bp, Homo sapiens
tgcagccattttctgccaatgc

SEQ ID NO: 8302975 - DNA, 22 bp, Homo sapiens
tgcagccattttctgccaatgc

SEQ ID NO: 8302976 - DNA, 22 bp, Homo sapiens
tgcagccatctttcttggagga

SEQ ID NO: 8302977 - DNA, 21 bp, Homo sapiens
tgcagccattcagccctatgc

SEQ ID NO: 8302978 - DNA, 22 bp, Homo sapiens
tgcagccatcgcagagtctgta

SEQ ID NO: 8302979 - DNA, 19 bp, Homo sapiens
tgcagccacgtgagagact

SEQ ID NO: 8302980 - DNA, 22 bp, Homo sapiens
tgcagccaggaaatatttgctg

SEQ ID NO: 8302981 - DNA, 22 bp, Homo sapiens
tgcagccaggaaatatttgctg

SEQ ID NO: 8302982 - DNA, 23 bp, Homo sapiens
tgcagccactcaggagctcagtg

SEQ ID NO: 8302983 - DNA, 22 bp, Homo sapiens
tgcagcagcagggaggaggctc

SEQ ID NO: 8302984 - DNA, 22 bp, Homo sapiens
tgcagcaggagccaggcctggt

SEQ ID NO: 8302985 - DNA, 22 bp, Homo sapiens
tgcagcaggcacaggacggaag

SEQ ID NO: 8302986 - DNA, 21 bp, Homo sapiens
tgcagcagagtaagcagggga

SEQ ID NO: 8302987 - DNA, 22 bp, Homo sapiens
tgcagcagactgagtatgagaa

SEQ ID NO: 8302988 - DNA, 22 bp, Homo sapiens
tgcagctggtttagaactagat

SEQ ID NO: 8302989 - DNA, 20 bp, Homo sapiens
tgcagctggtttcacaggga

SEQ ID NO: 8302990 - DNA, 22 bp, Homo sapiens
tgcagctgctggcccaggtgct

SEQ ID NO: 8302991 - DNA, 22 bp, Homo sapiens
tgcagctgcttgattcatcttg

SEQ ID NO: 8302992 - DNA, 22 bp, Homo sapiens
tgcagccttgcctcctcccagc

SEQ ID NO: 8302993 - DNA, 22 bp, Homo sapiens
tgcagctcattggtgtcctggt

SEQ ID NO: 8302994 - DNA, 22 bp, Homo sapiens
tgcagctcctctggctgcctga

SEQ ID NO: 8302995 - DNA, 22 bp, Homo sapiens
tgcagctcattgctggggtctg

SEQ ID NO: 8302996 - DNA, 19 bp, Homo sapiens
tgcagctcagggcaggggc

SEQ ID NO: 8302997 - DNA, 22 bp, Homo sapiens
tgcagctctgaacagtcatgaa

SEQ ID NO: 8302998 - DNA, 21 bp, Homo sapiens
tgcagctgacactggtatgcc

SEQ ID NO: 8302999 - DNA, 22 bp, Homo sapiens
tgcagctgaggccagctatgcc

SEQ ID NO: 8303000 - DNA, 22 bp, Homo sapiens
tgcaaacaggagagtaagtata

SEQ ID NO: 8303001 - DNA, 22 bp, Homo sapiens
tgatttcaagtagtgacatgct

SEQ ID NO: 8303002 - DNA, 22 bp, Homo sapiens
tgatttccacagtcaggggtgc

SEQ ID NO: 8303003 - DNA, 22 bp, Homo sapiens
tgatttccaataaggagaatgt

SEQ ID NO: 8303004 - DNA, 22 bp, Homo sapiens
tgatttccaaaaggcttctaag

SEQ ID NO: 8303005 - DNA, 22 bp, Homo sapiens
tgatttcatagtatatacatga

SEQ ID NO: 8303006 - DNA, 22 bp, Homo sapiens
tgatttccatgaagctgaaggc

SEQ ID NO: 8303007 - DNA, 21 bp, Homo sapiens
tgatttccatcttaaaataaa

SEQ ID NO: 8303008 - DNA, 22 bp, Homo sapiens
tgatttccagttgctgggtgct

SEQ ID NO: 8303009 - DNA, 22 bp, Homo sapiens
tgatttccacgtgcacccaggt

SEQ ID NO: 8303010 - DNA, 23 bp, Homo sapiens
tgatttccagtgagtcagtggga

SEQ ID NO: 8303011 - DNA, 21 bp, Homo sapiens
tgatttccagaaaattggccc

SEQ ID NO: 8303012 - DNA, 22 bp, Homo sapiens
tgatttccctcatcataacaga

SEQ ID NO: 8303013 - DNA, 22 bp, Homo sapiens
tgatttccccagtcttgctgct

SEQ ID NO: 8303014 - DNA, 15 bp, Homo sapiens
tgatttcctactaac

SEQ ID NO: 8303015 - DNA, 22 bp, Homo sapiens
tgatttccctgtagcctctgaa

SEQ ID NO: 8303016 - DNA, 22 bp, Homo sapiens
tgatttcctaggtctggagaag

SEQ ID NO: 8303017 - DNA, 22 bp, Homo sapiens
tgatttcctagctgacatgaaa

SEQ ID NO: 8303018 - DNA, 22 bp, Homo sapiens
tgatttttagctattctgaaga

SEQ ID NO: 8303019 - DNA, 22 bp, Homo sapiens
tgatttttagctattctgaaga

SEQ ID NO: 8303020 - DNA, 22 bp, Homo sapiens
tgatttcctctactagcaatta

SEQ ID NO: 8303021 - DNA, 22 bp, Homo sapiens
tgatttcctggctttggagttc

SEQ ID NO: 8303022 - DNA, 22 bp, Homo sapiens
tgatttcctgtgcgcccttagg

SEQ ID NO: 8303023 - DNA, 22 bp, Homo sapiens
tgcaatctcggcactttgggag

SEQ ID NO: 8303024 - DNA, 22 bp, Homo sapiens
tgcacacaaatgtgaacgtgcc

SEQ ID NO: 8303025 - DNA, 22 bp, Homo sapiens
tgcacacaagttggagaatgaa

SEQ ID NO: 8303026 - DNA, 22 bp, Homo sapiens
tgcacacacgcggcacatctgt

SEQ ID NO: 8303027 - DNA, 22 bp, Homo sapiens
tgcacacacatgaagtagcatg

SEQ ID NO: 8303028 - DNA, 22 bp, Homo sapiens
tgcaagggcttagggggctgtg

SEQ ID NO: 8303029 - DNA, 22 bp, Homo sapiens
tgcaagcactcaatgcaaacag

SEQ ID NO: 8303030 - DNA, 21 bp, Homo sapiens
tgcaatccagcctgggcgaca

SEQ ID NO: 8303031 - DNA, 22 bp, Homo sapiens
tgcaagaggtaaaatgaaagga

SEQ ID NO: 8303032 - DNA, 22 bp, Homo sapiens
tgcaagaggaattctagaagca

SEQ ID NO: 8303033 - DNA, 22 bp, Homo sapiens
tgatcagtcccatgatcttcca

SEQ ID NO: 8303034 - DNA, 21 bp, Homo sapiens
tgatcctttcccccatgttgc

SEQ ID NO: 8303035 - DNA, 19 bp, Homo sapiens
tgagtgggcccctgcagac

SEQ ID NO: 8303036 - DNA, 20 bp, Homo sapiens
tgagtgatggaggcgggtca

SEQ ID NO: 8303037 - DNA, 22 bp, Homo sapiens
tgagtgcctgaacatagagtag

SEQ ID NO: 8303038 - DNA, 22 bp, Homo sapiens
tgagtgaggaagcggtggagga

SEQ ID NO: 8303039 - DNA, 22 bp, Homo sapiens
tgatgctgagcctgggactgac

SEQ ID NO: 8303040 - DNA, 22 bp, Homo sapiens
tgatgctgctgggagtggtgct

SEQ ID NO: 8303041 - DNA, 22 bp, Homo sapiens
tgatgcttcacgctgaatatgc

SEQ ID NO: 8303042 - DNA, 22 bp, Homo sapiens
tgatgatgtttatcttggtatt

SEQ ID NO: 8303043 - DNA, 23 bp, Homo sapiens
tgatgggaaggaacgactaccac

SEQ ID NO: 8303044 - DNA, 22 bp, Homo sapiens
tgatgggaaaatgaggcctggg

SEQ ID NO: 8303045 - DNA, 22 bp, Homo sapiens
tgatgggaggtgctgcaggacc

SEQ ID NO: 8303046 - DNA, 22 bp, Homo sapiens
tgatgggactgccagctgctga

SEQ ID NO: 8303047 - DNA, 22 bp, Homo sapiens
tgatggctatccctggaagggc

SEQ ID NO: 8303048 - DNA, 22 bp, Homo sapiens
tgatggttgattataaatcagt

SEQ ID NO: 8303049 - DNA, 20 bp, Homo sapiens
tgatggttctttccgggttg

SEQ ID NO: 8303050 - DNA, 22 bp, Homo sapiens
tgatggttttattaataggacc

SEQ ID NO: 8303051 - DNA, 22 bp, Homo sapiens
tgattaactgtctattaatcat

SEQ ID NO: 8303052 - DNA, 22 bp, Homo sapiens
tgaaacagtctccagacttgga

SEQ ID NO: 8303053 - DNA, 22 bp, Homo sapiens
tgaaagaactagcatcttcaag

SEQ ID NO: 8303054 - DNA, 22 bp, Homo sapiens
tctttttttcctgtgcagagct

SEQ ID NO: 8303055 - DNA, 23 bp, Homo sapiens
tctttttaagagatctagtgacg

SEQ ID NO: 8303056 - DNA, 22 bp, Homo sapiens
tctttttatattgacaaaaggt

SEQ ID NO: 8303057 - DNA, 22 bp, Homo sapiens
tctttttctgcacacgtgtccc

SEQ ID NO: 8303058 - DNA, 22 bp, Homo sapiens
tgaaaagggtagatccctaagt

SEQ ID NO: 8303059 - DNA, 20 bp, Homo sapiens
tgaaaaggtcaggagacatg

SEQ ID NO: 8303060 - DNA, 22 bp, Homo sapiens
tgaaaaggagtccttgttttca

SEQ ID NO: 8303061 - DNA, 22 bp, Homo sapiens
tgaaaaggagccttaggtaggt

SEQ ID NO: 8303062 - DNA, 22 bp, Homo sapiens
tcttttatagtgaattttcttg

SEQ ID NO: 8303063 - DNA, 18 bp, Homo sapiens
tctttgtttccttcttgc

SEQ ID NO: 8303064 - DNA, 22 bp, Homo sapiens
tctttgttattgctttatctat

SEQ ID NO: 8303065 - DNA, 20 bp, Homo sapiens
tctttgttaattttatctcc

SEQ ID NO: 8303066 - DNA, 22 bp, Homo sapiens
tctttggatatcgctagaccgt

SEQ ID NO: 8303067 - DNA, 22 bp, Homo sapiens
tctttgcagaatttaactttgc

SEQ ID NO: 8303068 - DNA, 22 bp, Homo sapiens
tctttgcaggagccctttgaac

SEQ ID NO: 8303069 - DNA, 22 bp, Homo sapiens
tctttgcaaatgttattatctt

SEQ ID NO: 8303070 - DNA, 22 bp, Homo sapiens
tctttgcaactcccatttccat

SEQ ID NO: 8303071 - DNA, 21 bp, Homo sapiens
tctttgcatcagttgttttct

SEQ ID NO: 8303072 - DNA, 22 bp, Homo sapiens
tctttgcatcccttccatagtt

SEQ ID NO: 8303073 - DNA, 22 bp, Homo sapiens
tctttgcatgcattttccctta

SEQ ID NO: 8303074 - DNA, 22 bp, Homo sapiens
tctttgcatgtgcttcttggcc

SEQ ID NO: 8303075 - DNA, 22 bp, Homo sapiens
tgaacgcaggtccacatggctc

SEQ ID NO: 8303076 - DNA, 22 bp, Homo sapiens
tgaaccaggaggcagccagcac

SEQ ID NO: 8303077 - DNA, 22 bp, Homo sapiens
tgaaccagagtctccagtggtt

SEQ ID NO: 8303078 - DNA, 22 bp, Homo sapiens
tgaacatattcacctctaaata

SEQ ID NO: 8303079 - DNA, 19 bp, Homo sapiens
tgaagcaataccatttttg

SEQ ID NO: 8303080 - DNA, 22 bp, Homo sapiens
tgaagcaactggacaagttggc

SEQ ID NO: 8303081 - DNA, 22 bp, Homo sapiens
tgaagcaaacgcttctgttcct

SEQ ID NO: 8303082 - DNA, 22 bp, Homo sapiens
tgaagcagagtgaaggtgaatt

SEQ ID NO: 8303083 - DNA, 22 bp, Homo sapiens
tgaagcagagaatttgacagtc

SEQ ID NO: 8303084 - DNA, 22 bp, Homo sapiens
tgaagcagaggggtcttgagct

SEQ ID NO: 8303085 - DNA, 22 bp, Homo sapiens
tgaagcagcaccattttagagc

SEQ ID NO: 8303086 - DNA, 22 bp, Homo sapiens
tgaagcagcaaatgatgggaga

SEQ ID NO: 8303087 - DNA, 20 bp, Homo sapiens
tgaagcagccttgattctgt

SEQ ID NO: 8303088 - DNA, 19 bp, Homo sapiens
tgaagcagcaaactctcag

SEQ ID NO: 8303089 - DNA, 22 bp, Homo sapiens
tgaagcagatggtctggtcatt

SEQ ID NO: 8303090 - DNA, 22 bp, Homo sapiens
tgaagcagcttctttctgtcaa

SEQ ID NO: 8303091 - DNA, 20 bp, Homo sapiens
tgaagcagccttgattctgt

SEQ ID NO: 8303092 - DNA, 22 bp, Homo sapiens
tgaagcaggaaacttcttgttt

SEQ ID NO: 8303093 - DNA, 22 bp, Homo sapiens
tgaagcaggaaccagcagcatt

SEQ ID NO: 8303094 - DNA, 22 bp, Homo sapiens
tgaagcaggcattgactgatga

SEQ ID NO: 8303095 - DNA, 22 bp, Homo sapiens
tgaagcaggatcgtttgcttca

SEQ ID NO: 8303096 - DNA, 19 bp, Homo sapiens
tgaagcaggcagagaagat

SEQ ID NO: 8303097 - DNA, 22 bp, Homo sapiens
tgaagcagttctcagaagtggg

SEQ ID NO: 8303098 - DNA, 22 bp, Homo sapiens
tgaagcagttactgggtgttaa

SEQ ID NO: 8303099 - DNA, 22 bp, Homo sapiens
tgaagcagggtggccagattgt

SEQ ID NO: 8303100 - DNA, 22 bp, Homo sapiens
tgaagcaggtgaatggatgtcg

SEQ ID NO: 8303101 - DNA, 22 bp, Homo sapiens
tgaagacacatacaagggaatg

SEQ ID NO: 8303102 - DNA, 22 bp, Homo sapiens
tgaagacagaccaaggagaatg

SEQ ID NO: 8303103 - DNA, 22 bp, Homo sapiens
tgaaagcactcacttctgctct

SEQ ID NO: 8303104 - DNA, 22 bp, Homo sapiens
tgaaaggttaaaagtagtattg

SEQ ID NO: 8303105 - DNA, 20 bp, Homo sapiens
tgaaaggtgggaattgtggg

SEQ ID NO: 8303106 - DNA, 22 bp, Homo sapiens
tgaaaggtgtccaatatttctc

SEQ ID NO: 8303107 - DNA, 22 bp, Homo sapiens
tgaaaggtgacatttcttggat

SEQ ID NO: 8303108 - DNA, 22 bp, Homo sapiens
tgaaaggtagctggcctcatag

SEQ ID NO: 8303109 - DNA, 22 bp, Homo sapiens
tgaaaggttatttaggtctgct

SEQ ID NO: 8303110 - DNA, 22 bp, Homo sapiens
tgaaagttacaggaaaacagat

SEQ ID NO: 8303111 - DNA, 22 bp, Homo sapiens
tgaaagttgcacataagagaat

SEQ ID NO: 8303112 - DNA, 21 bp, Homo sapiens
tgaaagttggagtcaaatgta

SEQ ID NO: 8303113 - DNA, 22 bp, Homo sapiens
tgaaatatttagagagtaagtt

SEQ ID NO: 8303114 - DNA, 22 bp, Homo sapiens
tgaaatctttagtttctgtccc

SEQ ID NO: 8303115 - DNA, 22 bp, Homo sapiens
tgaaatcttatactttggtagt

SEQ ID NO: 8303116 - DNA, 22 bp, Homo sapiens
tgaaatcttcactaagtctctt

SEQ ID NO: 8303117 - DNA, 22 bp, Homo sapiens
tgaaatctcctctttatatatc

SEQ ID NO: 8303118 - DNA, 22 bp, Homo sapiens
tgaaatctaccctattcagggt

SEQ ID NO: 8303119 - DNA, 21 bp, Homo sapiens
tgaaatctgatgggacaaatg

SEQ ID NO: 8303120 - DNA, 22 bp, Homo sapiens
tgaaatcttagccattctgcct

SEQ ID NO: 8303121 - DNA, 22 bp, Homo sapiens
tgaaatctgtcccactttagct

SEQ ID NO: 8303122 - DNA, 22 bp, Homo sapiens
tgaaatctgcatgcaaagtcct

SEQ ID NO: 8303123 - DNA, 22 bp, Homo sapiens
tgaaatgtttgaagaccactga

SEQ ID NO: 8303124 - DNA, 22 bp, Homo sapiens
tgaatggtcactgagcatctgt

SEQ ID NO: 8303125 - DNA, 22 bp, Homo sapiens
tgaagctgtgggcagtggagcc

SEQ ID NO: 8303126 - DNA, 22 bp, Homo sapiens
tgaaggagctcaatgatgatgc

SEQ ID NO: 8303127 - DNA, 19 bp, Homo sapiens
tgaaggagggggatggcca

SEQ ID NO: 8303128 - DNA, 22 bp, Homo sapiens
tgaagccacagagcatctgcct

SEQ ID NO: 8303129 - DNA, 22 bp, Homo sapiens
tgaagccagctttggaagacac

SEQ ID NO: 8303130 - DNA, 22 bp, Homo sapiens
tgaagccatccctcagatggcc

SEQ ID NO: 8303131 - DNA, 22 bp, Homo sapiens
tgaagccatcaggaagccagca

SEQ ID NO: 8303132 - DNA, 22 bp, Homo sapiens
tgaagccttgtgtggcctctct

SEQ ID NO: 8303133 - DNA, 21 bp, Homo sapiens
tgaagcctgaggcatagcccc

SEQ ID NO: 8303134 - DNA, 22 bp, Homo sapiens
tgaagccctgtgtcagcttcca

SEQ ID NO: 8303135 - DNA, 22 bp, Homo sapiens
tgaaggtggcataggagagatg

SEQ ID NO: 8303136 - DNA, 22 bp, Homo sapiens
tgaaggcattgatgaaggaatc

SEQ ID NO: 8303137 - DNA, 22 bp, Homo sapiens
tgaaggctgttggatggggaag

SEQ ID NO: 8303138 - DNA, 22 bp, Homo sapiens
tgacagggtgattatgagagct

SEQ ID NO: 8303139 - DNA, 22 bp, Homo sapiens
tgacagggctagaggcaatgca

SEQ ID NO: 8303140 - DNA, 19 bp, Homo sapiens
tgacaggctgttgccttga

SEQ ID NO: 8303141 - DNA, 22 bp, Homo sapiens
tgacagctgagccccaggcaag

SEQ ID NO: 8303142 - DNA, 22 bp, Homo sapiens
tgacagcataacactggtcttg

SEQ ID NO: 8303143 - DNA, 22 bp, Homo sapiens
tgacacagaaattaagctgtca

SEQ ID NO: 8303144 - DNA, 22 bp, Homo sapiens
tgacacagattagagacatacc

SEQ ID NO: 8303145 - DNA, 22 bp, Homo sapiens
tgacacaggcagctcccagcac

SEQ ID NO: 8303146 - DNA, 22 bp, Homo sapiens
tgacaccacaactagccattga

SEQ ID NO: 8303147 - DNA, 23 bp, Homo sapiens
tgacacatttcctttccactgca

SEQ ID NO: 8303148 - DNA, 22 bp, Homo sapiens
tgacacattaaatgctcacaaa

SEQ ID NO: 8303149 - DNA, 22 bp, Homo sapiens
tgacagaaatagttcttaattt

SEQ ID NO: 8303150 - DNA, 22 bp, Homo sapiens
tgacagaaagaatatgtcaatc

SEQ ID NO: 8303151 - DNA, 22 bp, Homo sapiens
tgacagaatgtgactctcagat

SEQ ID NO: 8303152 - DNA, 22 bp, Homo sapiens
tgacagaacaggttgggagcaa

SEQ ID NO: 8303153 - DNA, 18 bp, Homo sapiens
tgacagaacctggagcct

SEQ ID NO: 8303154 - DNA, 22 bp, Homo sapiens
tgacttcaaaggctctactcct

SEQ ID NO: 8303155 - DNA, 22 bp, Homo sapiens
tgacttcctgcactcaggtgat

SEQ ID NO: 8303156 - DNA, 18 bp, Homo sapiens
tgactcaccctgtcagtg

SEQ ID NO: 8303157 - DNA, 22 bp, Homo sapiens
tgactctgtacctgtctgcctt

SEQ ID NO: 8303158 - DNA, 20 bp, Homo sapiens
tgactctgcaaccgtctctc

SEQ ID NO: 8303159 - DNA, 22 bp, Homo sapiens
tgagccagaggaggctgtgtgg

SEQ ID NO: 8303160 - DNA, 22 bp, Homo sapiens
tgagccagataagggctcacgc

SEQ ID NO: 8303161 - DNA, 22 bp, Homo sapiens
tgagccagagtggagtgtgcct

SEQ ID NO: 8303162 - DNA, 22 bp, Homo sapiens
tgagccagccttgcagctgtgc

SEQ ID NO: 8303163 - DNA, 22 bp, Homo sapiens
tgagccaggctcaagtgatcct

SEQ ID NO: 8303164 - DNA, 21 bp, Homo sapiens
tgagccaggctgacggctgtg

SEQ ID NO: 8303165 - DNA, 22 bp, Homo sapiens
tgagcttcctccctgcatccat

SEQ ID NO: 8303166 - DNA, 22 bp, Homo sapiens
tgagcttctttatttggccaga

SEQ ID NO: 8303167 - DNA, 22 bp, Homo sapiens
tgagctgtagcagatgctgttg

SEQ ID NO: 8303168 - DNA, 22 bp, Homo sapiens
tgagcttacgtgggaacagact

SEQ ID NO: 8303169 - DNA, 22 bp, Homo sapiens
tgagcttacttctgtacacaga

SEQ ID NO: 8303170 - DNA, 22 bp, Homo sapiens
tgagcttcaaaatatgtgaatc

SEQ ID NO: 8303171 - DNA, 22 bp, Homo sapiens
tgagctggtcactccttctgaa

SEQ ID NO: 8303172 - DNA, 22 bp, Homo sapiens
tgagctggtcttgagtgtagct

SEQ ID NO: 8303173 - DNA, 22 bp, Homo sapiens
tgagccagtctgtctgggtgaa

SEQ ID NO: 8303174 - DNA, 22 bp, Homo sapiens
tgagcccagtctgtctgacatg

SEQ ID NO: 8303175 - DNA, 22 bp, Homo sapiens
tgagccctaagggtcaagcagg

SEQ ID NO: 8303176 - DNA, 22 bp, Homo sapiens
tgagcctgtggggtgacaacca

SEQ ID NO: 8303177 - DNA, 22 bp, Homo sapiens
tgagcctgtcctgtgcatgtga

SEQ ID NO: 8303178 - DNA, 22 bp, Homo sapiens
tgagcctgggtggtcgaggctg

SEQ ID NO: 8303179 - DNA, 22 bp, Homo sapiens
tgagcctggggcctgggcagcg

SEQ ID NO: 8303180 - DNA, 22 bp, Homo sapiens
tgagcctggttgcagtgtctgg

SEQ ID NO: 8303181 - DNA, 22 bp, Homo sapiens
tgagcctgggagatggaggctg

SEQ ID NO: 8303182 - DNA, 22 bp, Homo sapiens
tgagcctgcaataagcacagcc

SEQ ID NO: 8303183 - DNA, 22 bp, Homo sapiens
tgagcctgagttcaaggctgca

SEQ ID NO: 8303184 - DNA, 22 bp, Homo sapiens
tgagcctggcctgcagagacca

SEQ ID NO: 8303185 - DNA, 22 bp, Homo sapiens
tgagcctggcggaagcagcgtg

SEQ ID NO: 8303186 - DNA, 22 bp, Homo sapiens
tgagcctggagtcgtggagggg

SEQ ID NO: 8303187 - DNA, 22 bp, Homo sapiens
tgagcctgctgtcgctggaccc

SEQ ID NO: 8303188 - DNA, 19 bp, Homo sapiens
tgagaggcttaaggcagct

SEQ ID NO: 8303189 - DNA, 22 bp, Homo sapiens
tgagaggccccagctcttggcc

SEQ ID NO: 8303190 - DNA, 22 bp, Homo sapiens
tgagaggcagaatggtgcctgc

SEQ ID NO: 8303191 - DNA, 21 bp, Homo sapiens
tgagagcctccaaccggctac

SEQ ID NO: 8303192 - DNA, 22 bp, Homo sapiens
tgagagagcctgaatctcttac

SEQ ID NO: 8303193 - DNA, 22 bp, Homo sapiens
tgagaaagtgggtgcctagcaa

SEQ ID NO: 8303194 - DNA, 22 bp, Homo sapiens
tgagaaccatgaaaagctgtca

SEQ ID NO: 8303195 - DNA, 17 bp, Homo sapiens
tgagacagggcaggccc

SEQ ID NO: 8303196 - DNA, 22 bp, Homo sapiens
tgagaattacaaatgagtcaca

SEQ ID NO: 8303197 - DNA, 22 bp, Homo sapiens
tgaggtgaagagtggagctcag

SEQ ID NO: 8303198 - DNA, 22 bp, Homo sapiens
tgaggtgaccgcagatgggaag

SEQ ID NO: 8303199 - DNA, 22 bp, Homo sapiens
tgagggtgggcctgcaggaaga

SEQ ID NO: 8303200 - DNA, 22 bp, Homo sapiens
tgagggtggcacaggcacaaag

SEQ ID NO: 8303201 - DNA, 22 bp, Homo sapiens
tgagggtgggccctgggcatct

SEQ ID NO: 8303202 - DNA, 22 bp, Homo sapiens
tgagggtggccttgtgtggact

SEQ ID NO: 8303203 - DNA, 22 bp, Homo sapiens
tgagggtgcatttagcatgtag

SEQ ID NO: 8303204 - DNA, 22 bp, Homo sapiens
tgaggtggctagggaggcactc

SEQ ID NO: 8303205 - DNA, 22 bp, Homo sapiens
tgaggtgtgtccccagggaggt

SEQ ID NO: 8303206 - DNA, 22 bp, Homo sapiens
tgagtagcggctatgtgtaact

SEQ ID NO: 8303207 - DNA, 22 bp, Homo sapiens
tgaggctgttctaccagggcca

SEQ ID NO: 8303208 - DNA, 21 bp, Homo sapiens
tgaggctgttgtaccagggag

SEQ ID NO: 8303209 - DNA, 22 bp, Homo sapiens
tgaggctggcaaggctggtatt

SEQ ID NO: 8303210 - DNA, 22 bp, Homo sapiens
tgaggctcaaggtctggtggag

SEQ ID NO: 8303211 - DNA, 22 bp, Homo sapiens
tgaggggagaagcagcagcctg

SEQ ID NO: 8303212 - DNA, 22 bp, Homo sapiens
tgagggagttgggtgtatagga

SEQ ID NO: 8303213 - DNA, 22 bp, Homo sapiens
tgagggaggccctttgagcaga

SEQ ID NO: 8303214 - DNA, 22 bp, Homo sapiens
tgaggcaggaggttgagaactg

SEQ ID NO: 8303215 - DNA, 22 bp, Homo sapiens
tgaggcaggagttcaggctgcg

SEQ ID NO: 8303216 - DNA, 22 bp, Homo sapiens
tgaggcaggagttcaggctgcg

SEQ ID NO: 8303217 - DNA, 22 bp, Homo sapiens
tgaggcagttcttacttgtatt

SEQ ID NO: 8303218 - DNA, 19 bp, Homo sapiens
tgaggccaaggtcacagat

SEQ ID NO: 8303219 - DNA, 17 bp, Homo sapiens
tgaggcctgcatcagtg

SEQ ID NO: 8303220 - DNA, 22 bp, Homo sapiens
tgaggccaggatcccaggctct

SEQ ID NO: 8303221 - DNA, 22 bp, Homo sapiens
tgaggccaatgaccctgggcag

SEQ ID NO: 8303222 - DNA, 22 bp, Homo sapiens
tgaggccacttccccacagccc

SEQ ID NO: 8303223 - DNA, 22 bp, Homo sapiens
tgaggcagctttttctgtgtgt

SEQ ID NO: 8303224 - DNA, 22 bp, Homo sapiens
tgaggatgacgatggcaatggc

SEQ ID NO: 8303225 - DNA, 22 bp, Homo sapiens
tgaggaggtcagagtctggctg

SEQ ID NO: 8303226 - DNA, 22 bp, Homo sapiens
tggcagggcctgaatcttatac

SEQ ID NO: 8303227 - DNA, 22 bp, Homo sapiens
tggcagggcctgaatcttatac

SEQ ID NO: 8303228 - DNA, 22 bp, Homo sapiens
tggcagggcctaccccaatatc

SEQ ID NO: 8303229 - DNA, 22 bp, Homo sapiens
tggcagggcctgctcatcatcc

SEQ ID NO: 8303230 - DNA, 22 bp, Homo sapiens
tggcagggagttgcaggatttc

SEQ ID NO: 8303231 - DNA, 22 bp, Homo sapiens
tggcaggggaggtgcttgctta

SEQ ID NO: 8303232 - DNA, 21 bp, Homo sapiens
tggcaggggtagtagtacagc

SEQ ID NO: 8303233 - DNA, 18 bp, Homo sapiens
tggcagggaggaaatata

SEQ ID NO: 8303234 - DNA, 19 bp, Homo sapiens
tggcagggagtgatattag

SEQ ID NO: 8303235 - DNA, 22 bp, Homo sapiens
tggcagctgaggggaggctttg

SEQ ID NO: 8303236 - DNA, 22 bp, Homo sapiens
tggcagctgattagatggtgcc

SEQ ID NO: 8303237 - DNA, 22 bp, Homo sapiens
tggcagctgattagatggtgcc

SEQ ID NO: 8303238 - DNA, 22 bp, Homo sapiens
tggcaggaggttttctccagga

SEQ ID NO: 8303239 - DNA, 19 bp, Homo sapiens
tggcagcattggtaccttg

SEQ ID NO: 8303240 - DNA, 22 bp, Homo sapiens
tggcagcattttttccagaaca

SEQ ID NO: 8303241 - DNA, 22 bp, Homo sapiens
tggcagccacatctcgtggatt

SEQ ID NO: 8303242 - DNA, 22 bp, Homo sapiens
tggcagctacagacagaggtga

SEQ ID NO: 8303243 - DNA, 22 bp, Homo sapiens
tggcagctacagacagaggtga

SEQ ID NO: 8303244 - DNA, 22 bp, Homo sapiens
tggcagctccgggtaggggctg

SEQ ID NO: 8303245 - DNA, 22 bp, Homo sapiens
tggcagctcctggggccagcac

SEQ ID NO: 8303246 - DNA, 22 bp, Homo sapiens
tggcagcagtggaggtagaaag

SEQ ID NO: 8303247 - DNA, 22 bp, Homo sapiens
tggcagcatgttatgtaaggaa

SEQ ID NO: 8303248 - DNA, 22 bp, Homo sapiens
tggcagcagggcccctggagga

SEQ ID NO: 8303249 - DNA, 22 bp, Homo sapiens
tggcagcagggaggccagtgtt

SEQ ID NO: 8303250 - DNA, 22 bp, Homo sapiens
tggcagcagccatggaaggccc

SEQ ID NO: 8303251 - DNA, 18 bp, Homo sapiens
tggcagcaggaagccatt

SEQ ID NO: 8303252 - DNA, 23 bp, Homo sapiens
tggcagcagatcttaaagtgacc

SEQ ID NO: 8303253 - DNA, 22 bp, Homo sapiens
tggcagcagacaaaaggccatt

SEQ ID NO: 8303254 - DNA, 22 bp, Homo sapiens
tggcagagttggaggtggaaga

SEQ ID NO: 8303255 - DNA, 22 bp, Homo sapiens
tggcagcacttgaacttgagcc

SEQ ID NO: 8303256 - DNA, 21 bp, Homo sapiens
tggcagagttgagtagttatg

SEQ ID NO: 8303257 - DNA, 22 bp, Homo sapiens
tggcagagttcgctcctattca

SEQ ID NO: 8303258 - DNA, 22 bp, Homo sapiens
tggcagagttcgctgtgccttt

SEQ ID NO: 8303259 - DNA, 22 bp, Homo sapiens
tggcagagttatgggtatttat

SEQ ID NO: 8303260 - DNA, 18 bp, Homo sapiens
tggcagagtgtctgttct

SEQ ID NO: 8303261 - DNA, 22 bp, Homo sapiens
tggcagagtggaccatactcaa

SEQ ID NO: 8303262 - DNA, 22 bp, Homo sapiens
tggcagagtcatcacatctgga

SEQ ID NO: 8303263 - DNA, 22 bp, Homo sapiens
tggcagagtaggatggccctgt

SEQ ID NO: 8303264 - DNA, 22 bp, Homo sapiens
tggcagagtctgggcttgggca

SEQ ID NO: 8303265 - DNA, 22 bp, Homo sapiens
tggcagagtctctcctttccag

SEQ ID NO: 8303266 - DNA, 22 bp, Homo sapiens
tggcactgagcagccgcggcag

SEQ ID NO: 8303267 - DNA, 22 bp, Homo sapiens
tggcactgaccccaggcctgtg

SEQ ID NO: 8303268 - DNA, 22 bp, Homo sapiens
tggcactgccaacctgctaggt

SEQ ID NO: 8303269 - DNA, 21 bp, Homo sapiens
tggcactgcttagcaggttcc

SEQ ID NO: 8303270 - DNA, 22 bp, Homo sapiens
tggcactgcctggcagggcccc

SEQ ID NO: 8303271 - DNA, 22 bp, Homo sapiens
tggcactggaatcgtagccttg

SEQ ID NO: 8303272 - DNA, 22 bp, Homo sapiens
tggcactggcgcaggatggcgg

SEQ ID NO: 8303273 - DNA, 22 bp, Homo sapiens
tggcactgggatgctactgtta

SEQ ID NO: 8303274 - DNA, 22 bp, Homo sapiens
tggcactgggacagatgctctc

SEQ ID NO: 8303275 - DNA, 22 bp, Homo sapiens
tggcactggcgcaggatggcgg

SEQ ID NO: 8303276 - DNA, 23 bp, Homo sapiens
tggcaccaggcattctaggggta

SEQ ID NO: 8303277 - DNA, 22 bp, Homo sapiens
tggcacctgaacttagaggtgt

SEQ ID NO: 8303278 - DNA, 22 bp, Homo sapiens
tggcagagctggctgcggatga

SEQ ID NO: 8303279 - DNA, 22 bp, Homo sapiens
tggcagaggaaaaagtcactgg

SEQ ID NO: 8303280 - DNA, 22 bp, Homo sapiens
tggcagagatgaagagttgttt

SEQ ID NO: 8303281 - DNA, 22 bp, Homo sapiens
tggcagagcaaaaagatagaat

SEQ ID NO: 8303282 - DNA, 22 bp, Homo sapiens
tggcagagcccagaactgagca

SEQ ID NO: 8303283 - DNA, 22 bp, Homo sapiens
tggcagagcccagactccagtc

SEQ ID NO: 8303284 - DNA, 23 bp, Homo sapiens
tggcagagacccagaatctacat

SEQ ID NO: 8303285 - DNA, 22 bp, Homo sapiens
tggcagagaataaatcttgact

SEQ ID NO: 8303286 - DNA, 22 bp, Homo sapiens
tggcagagaacacggctgatct

SEQ ID NO: 8303287 - DNA, 22 bp, Homo sapiens
tggcagagaacctgggctttgt

SEQ ID NO: 8303288 - DNA, 22 bp, Homo sapiens
tggcagagagactctccttgat

SEQ ID NO: 8303289 - DNA, 22 bp, Homo sapiens
tggcagagagagtgcagtcgac

SEQ ID NO: 8303290 - DNA, 22 bp, Homo sapiens
tggcagtgccccttgaccagtg

SEQ ID NO: 8303291 - DNA, 22 bp, Homo sapiens
tggcagtggctcagagtgcaga

SEQ ID NO: 8303292 - DNA, 22 bp, Homo sapiens
tggcagggtgccagttgcgagt

SEQ ID NO: 8303293 - DNA, 22 bp, Homo sapiens
tggcagggtcttgctgtgttgc

SEQ ID NO: 8303294 - DNA, 23 bp, Homo sapiens
tggcagtgatcaaaagcttacat

SEQ ID NO: 8303295 - DNA, 22 bp, Homo sapiens
tggcagtcggacttctatctca

SEQ ID NO: 8303296 - DNA, 22 bp, Homo sapiens
tggccacccagctgacgccttc

SEQ ID NO: 8303297 - DNA, 19 bp, Homo sapiens
tggcattggtccagataaa

SEQ ID NO: 8303298 - DNA, 22 bp, Homo sapiens
tggccacagcctctgccagttc

SEQ ID NO: 8303299 - DNA, 19 bp, Homo sapiens
tggccaggtactgtctgct

SEQ ID NO: 8303300 - DNA, 22 bp, Homo sapiens
tggccaggttgggctttgcagc

SEQ ID NO: 8303301 - DNA, 22 bp, Homo sapiens
tggccaggtgtgggttctcaga

SEQ ID NO: 8303302 - DNA, 22 bp, Homo sapiens
tggccaggggagttcccctcca

SEQ ID NO: 8303303 - DNA, 22 bp, Homo sapiens
tggcctggccacatccagcagg

SEQ ID NO: 8303304 - DNA, 22 bp, Homo sapiens
tggcctggcagagcaaggcctg

SEQ ID NO: 8303305 - DNA, 23 bp, Homo sapiens
tggcctggagagaaaagatgagt

SEQ ID NO: 8303306 - DNA, 18 bp, Homo sapiens
tggcctggagacaactct

SEQ ID NO: 8303307 - DNA, 22 bp, Homo sapiens
tggcctggaagagaggtcgagg

SEQ ID NO: 8303308 - DNA, 22 bp, Homo sapiens
tggcctggaagagaggtcgagg

SEQ ID NO: 8303309 - DNA, 22 bp, Homo sapiens
tggcctgcctgggagcagcagg

SEQ ID NO: 8303310 - DNA, 22 bp, Homo sapiens
tggcctgccttcgctgagctga

SEQ ID NO: 8303311 - DNA, 22 bp, Homo sapiens
tggcctgctttcatttgatgct

SEQ ID NO: 8303312 - DNA, 22 bp, Homo sapiens
tggcctggaacctggcagggac

SEQ ID NO: 8303313 - DNA, 22 bp, Homo sapiens
tggcctggaaaaatgcagatgg

SEQ ID NO: 8303314 - DNA, 22 bp, Homo sapiens
tggcctctgggaaagcagattc

SEQ ID NO: 8303315 - DNA, 22 bp, Homo sapiens
tggcctctggctgaggactaac

SEQ ID NO: 8303316 - DNA, 22 bp, Homo sapiens
tggcctctctaccaggcagcct

SEQ ID NO: 8303317 - DNA, 22 bp, Homo sapiens
tggcctctgcaatggattcacc

SEQ ID NO: 8303318 - DNA, 22 bp, Homo sapiens
tggcctctgtgggagctgagca

SEQ ID NO: 8303319 - DNA, 22 bp, Homo sapiens
tggcctcttaggacatcctcta

SEQ ID NO: 8303320 - DNA, 22 bp, Homo sapiens
tggcctcttacgacatagcctt

SEQ ID NO: 8303321 - DNA, 22 bp, Homo sapiens
tggcctgactgtcaggctgtat

SEQ ID NO: 8303322 - DNA, 22 bp, Homo sapiens
tggcctgaattatggcagatct

SEQ ID NO: 8303323 - DNA, 22 bp, Homo sapiens
tggcctgccccgagatcctggc

SEQ ID NO: 8303324 - DNA, 22 bp, Homo sapiens
tggcctgcctcccggcttcttt

SEQ ID NO: 8303325 - DNA, 22 bp, Homo sapiens
tggcctgcctcccggcttcttt

SEQ ID NO: 8303326 - DNA, 22 bp, Homo sapiens
tggcctgcccagagcagctctg

SEQ ID NO: 8303327 - DNA, 22 bp, Homo sapiens
tggcctgcagctctcagggaag

SEQ ID NO: 8303328 - DNA, 22 bp, Homo sapiens
tggcctgaggctcggcatgggt

SEQ ID NO: 8303329 - DNA, 22 bp, Homo sapiens
tggcctgattttgctaagagaa

SEQ ID NO: 8303330 - DNA, 23 bp, Homo sapiens
tggcctgcagagtttctgctggg

SEQ ID NO: 8303331 - DNA, 22 bp, Homo sapiens
tggcctgcagaggctgtggggc

SEQ ID NO: 8303332 - DNA, 22 bp, Homo sapiens
tggccctgtccctggagcctgg

SEQ ID NO: 8303333 - DNA, 22 bp, Homo sapiens
tggccctgccactcactgctga

SEQ ID NO: 8303334 - DNA, 21 bp, Homo sapiens
tggccctggccacggctgcca

SEQ ID NO: 8303335 - DNA, 22 bp, Homo sapiens
tggccctgtgtcctgctgccag

SEQ ID NO: 8303336 - DNA, 22 bp, Homo sapiens
tggccctgtgtgcaggctgcac

SEQ ID NO: 8303337 - DNA, 22 bp, Homo sapiens
tggccctgtggaggtcagtgag

SEQ ID NO: 8303338 - DNA, 23 bp, Homo sapiens
tggccctgtgcatgctgcttccc

SEQ ID NO: 8303339 - DNA, 22 bp, Homo sapiens
tggccgggccgggcgcctccac

SEQ ID NO: 8303340 - DNA, 20 bp, Homo sapiens
tggccctgttttctccaggc

SEQ ID NO: 8303341 - DNA, 22 bp, Homo sapiens
tggccctgaggacccagtgtgg

SEQ ID NO: 8303342 - DNA, 22 bp, Homo sapiens
tggccctgacttggaggcctga

SEQ ID NO: 8303343 - DNA, 22 bp, Homo sapiens
tggccctgactgatgtggaggg

SEQ ID NO: 8303344 - DNA, 22 bp, Homo sapiens
tggccctgacaggtcctgggca

SEQ ID NO: 8303345 - DNA, 22 bp, Homo sapiens
tggccctgacacgtggtactgg

SEQ ID NO: 8303346 - DNA, 22 bp, Homo sapiens
tggccctgcagaactagcctgg

SEQ ID NO: 8303347 - DNA, 22 bp, Homo sapiens
tggccctgaggggctgtgcccc

SEQ ID NO: 8303348 - DNA, 22 bp, Homo sapiens
tggccctcagtcttgctcctgc

SEQ ID NO: 8303349 - DNA, 23 bp, Homo sapiens
tggccctgaatctgtcctggagg

SEQ ID NO: 8303350 - DNA, 20 bp, Homo sapiens
tggctcctgcggtggaacca

SEQ ID NO: 8303351 - DNA, 20 bp, Homo sapiens
tggctcctgcggtggaacca

SEQ ID NO: 8303352 - DNA, 19 bp, Homo sapiens
tggctcctgcctgccttct

SEQ ID NO: 8303353 - DNA, 22 bp, Homo sapiens
tggctcctcacgtcctcagagc

SEQ ID NO: 8303354 - DNA, 20 bp, Homo sapiens
tggctcctcttggctgtggc

SEQ ID NO: 8303355 - DNA, 22 bp, Homo sapiens
tggctcctaggatggtgcctgg

SEQ ID NO: 8303356 - DNA, 22 bp, Homo sapiens
tggctcctatcaaggagtgggt

SEQ ID NO: 8303357 - DNA, 22 bp, Homo sapiens
tggctcctatcaaggagtgggt

SEQ ID NO: 8303358 - DNA, 21 bp, Homo sapiens
tggctcagttgctgggcacag

SEQ ID NO: 8303359 - DNA, 22 bp, Homo sapiens
tggctcagttaggtcagaaaca

SEQ ID NO: 8303360 - DNA, 22 bp, Homo sapiens
tggctcagttccatcatctgga

SEQ ID NO: 8303361 - DNA, 22 bp, Homo sapiens
tggctcaggagggatctttgct

SEQ ID NO: 8303362 - DNA, 22 bp, Homo sapiens
tggctcaggatctaagcagaat

SEQ ID NO: 8303363 - DNA, 22 bp, Homo sapiens
tggctcaggataattttcccaa

SEQ ID NO: 8303364 - DNA, 22 bp, Homo sapiens
tggctcaggccacttcttttat

SEQ ID NO: 8303365 - DNA, 22 bp, Homo sapiens
tggctcaggcttgaaaatagat

SEQ ID NO: 8303366 - DNA, 22 bp, Homo sapiens
tggctcaggcctacgacgcctt

SEQ ID NO: 8303367 - DNA, 22 bp, Homo sapiens
tggctcagcattcactggtctt

SEQ ID NO: 8303368 - DNA, 22 bp, Homo sapiens
tggctcagcaggttagaaacta

SEQ ID NO: 8303369 - DNA, 22 bp, Homo sapiens
tggctcagcaagacattgacct

SEQ ID NO: 8303370 - DNA, 22 bp, Homo sapiens
tggctcagccagccctaggaac

SEQ ID NO: 8303371 - DNA, 22 bp, Homo sapiens
tggctcagcttacttttgaggg

SEQ ID NO: 8303372 - DNA, 22 bp, Homo sapiens
tggctcagctttccccatctgg

SEQ ID NO: 8303373 - DNA, 22 bp, Homo sapiens
tggctcaggggtctggctctgt

SEQ ID NO: 8303374 - DNA, 23 bp, Homo sapiens
tggctcagggtctcttatgaagt

SEQ ID NO: 8303375 - DNA, 22 bp, Homo sapiens
tggctcagggtccccaaatggt

SEQ ID NO: 8303376 - DNA, 22 bp, Homo sapiens
tggctcaggtgtgagctgaaga

SEQ ID NO: 8303377 - DNA, 22 bp, Homo sapiens
tggctcagtaatcgagtctcct

SEQ ID NO: 8303378 - DNA, 22 bp, Homo sapiens
tggctcagtagcagtgtggtca

SEQ ID NO: 8303379 - DNA, 22 bp, Homo sapiens
tggctcagtggcagccgcagct

SEQ ID NO: 8303380 - DNA, 22 bp, Homo sapiens
tggctcagtgacattcctccca

SEQ ID NO: 8303381 - DNA, 22 bp, Homo sapiens
tggctcagtgcattcacagtaa

SEQ ID NO: 8303382 - DNA, 22 bp, Homo sapiens
tggctcagtcatggatgagtaa

SEQ ID NO: 8303383 - DNA, 22 bp, Homo sapiens
tggctcagtctgggttgactga

SEQ ID NO: 8303384 - DNA, 22 bp, Homo sapiens
tggctcagtgaagagataactt

SEQ ID NO: 8303385 - DNA, 22 bp, Homo sapiens
tggcctggccctgaggccctgt

SEQ ID NO: 8303386 - DNA, 22 bp, Homo sapiens
tggcctggccctgaggccctgt

SEQ ID NO: 8303387 - DNA, 22 bp, Homo sapiens
tggcctggctcacagtgagatt

SEQ ID NO: 8303388 - DNA, 22 bp, Homo sapiens
tggcctgggtcacaccagggtc

SEQ ID NO: 8303389 - DNA, 22 bp, Homo sapiens
tggcctggtaccacatagattt

SEQ ID NO: 8303390 - DNA, 22 bp, Homo sapiens
tggcctgggtgctgctgacatc

SEQ ID NO: 8303391 - DNA, 22 bp, Homo sapiens
tggcctgggtgctgctgacatc

SEQ ID NO: 8303392 - DNA, 22 bp, Homo sapiens
tggcctggttgttgctgccgtt

SEQ ID NO: 8303393 - DNA, 22 bp, Homo sapiens
tggcctggttatattgctatca

SEQ ID NO: 8303394 - DNA, 22 bp, Homo sapiens
tggcctggtgtctgcgaggcct

SEQ ID NO: 8303395 - DNA, 22 bp, Homo sapiens
tggcctggtccttgtcaaggca

SEQ ID NO: 8303396 - DNA, 22 bp, Homo sapiens
tggcctggtgctcaggcagtag

SEQ ID NO: 8303397 - DNA, 22 bp, Homo sapiens
tggcctggtgctcaggcagtag

SEQ ID NO: 8303398 - DNA, 22 bp, Homo sapiens
tggcctggtgtctgcgaggcct

SEQ ID NO: 8303399 - DNA, 22 bp, Homo sapiens
tggccttggacagagcgctcct

SEQ ID NO: 8303400 - DNA, 22 bp, Homo sapiens
tggcctgtggcttaaggtctgt

SEQ ID NO: 8303401 - DNA, 22 bp, Homo sapiens
tggcctgtcttgttgtgctaga

SEQ ID NO: 8303402 - DNA, 22 bp, Homo sapiens
tggccttcctggtgactcatga

SEQ ID NO: 8303403 - DNA, 22 bp, Homo sapiens
tggccttgggcaggtggcctgc

SEQ ID NO: 8303404 - DNA, 22 bp, Homo sapiens
tggccttggcagtgagaagagt

SEQ ID NO: 8303405 - DNA, 22 bp, Homo sapiens
tggccttgtgttttagagaaag

SEQ ID NO: 8303406 - DNA, 22 bp, Homo sapiens
tggctcagagcagggactctgg

SEQ ID NO: 8303407 - DNA, 22 bp, Homo sapiens
tggctcagagccttgagagctg

SEQ ID NO: 8303408 - DNA, 22 bp, Homo sapiens
tggctcagaaggctgccttcac

SEQ ID NO: 8303409 - DNA, 22 bp, Homo sapiens
tggctcagagagggagtgtgga

SEQ ID NO: 8303410 - DNA, 22 bp, Homo sapiens
tggctcagatgctcttccagtg

SEQ ID NO: 8303411 - DNA, 22 bp, Homo sapiens
tggctcagatttttgtaggctt

SEQ ID NO: 8303412 - DNA, 18 bp, Homo sapiens
tggctcagatggctttaa

SEQ ID NO: 8303413 - DNA, 22 bp, Homo sapiens
tggctcagagttcatcttttag

SEQ ID NO: 8303414 - DNA, 22 bp, Homo sapiens
tggctcagataattcaaggggc

SEQ ID NO: 8303415 - DNA, 22 bp, Homo sapiens
tggctcagaggggaagtggttt

SEQ ID NO: 8303416 - DNA, 22 bp, Homo sapiens
tggctcagaactacttctagtt

SEQ ID NO: 8303417 - DNA, 22 bp, Homo sapiens
tggctcagaagaaaaggtaaac

SEQ ID NO: 8303418 - DNA, 22 bp, Homo sapiens
tggcgtgccctccagacttggc

SEQ ID NO: 8303419 - DNA, 22 bp, Homo sapiens
tggctccttcattctcctgcca

SEQ ID NO: 8303420 - DNA, 22 bp, Homo sapiens
tggctctgagacacaggctctc

SEQ ID NO: 8303421 - DNA, 23 bp, Homo sapiens
tggctctgagaggttcagatgct

SEQ ID NO: 8303422 - DNA, 21 bp, Homo sapiens
tggctctgagcctcatggctg

SEQ ID NO: 8303423 - DNA, 21 bp, Homo sapiens
tggctctgagcctcatggctg

SEQ ID NO: 8303424 - DNA, 17 bp, Homo sapiens
tggctctgaggctgaat

SEQ ID NO: 8303425 - DNA, 17 bp, Homo sapiens
tggctctgaggctgaat

SEQ ID NO: 8303426 - DNA, 23 bp, Homo sapiens
tggctctgagcttcctggtggcc

SEQ ID NO: 8303427 - DNA, 22 bp, Homo sapiens
tggctctgctgaacctagtgca

SEQ ID NO: 8303428 - DNA, 18 bp, Homo sapiens
tggctctggacttgctcc

SEQ ID NO: 8303429 - DNA, 21 bp, Homo sapiens
tggctctgctcagagcagtcc

SEQ ID NO: 8303430 - DNA, 21 bp, Homo sapiens
tggctctgctcagagcagtcc

SEQ ID NO: 8303431 - DNA, 21 bp, Homo sapiens
tggctctgctcagagcagtcc

SEQ ID NO: 8303432 - DNA, 22 bp, Homo sapiens
tggctctgccactaacttggta

SEQ ID NO: 8303433 - DNA, 18 bp, Homo sapiens
tggctctgcagccagatg

SEQ ID NO: 8303434 - DNA, 22 bp, Homo sapiens
tggctctgatcagatgtccagt

SEQ ID NO: 8303435 - DNA, 22 bp, Homo sapiens
tggctctgatcagatgtccagt

SEQ ID NO: 8303436 - DNA, 22 bp, Homo sapiens
tggctctgcacctcagtgtacc

SEQ ID NO: 8303437 - DNA, 22 bp, Homo sapiens
tggctctgtgcttctagtatct

SEQ ID NO: 8303438 - DNA, 22 bp, Homo sapiens
tggctctggggacagtaagtcc

SEQ ID NO: 8303439 - DNA, 23 bp, Homo sapiens
tggctctgtggatccctcaggag

SEQ ID NO: 8303440 - DNA, 22 bp, Homo sapiens
tggctctgggcaccgtgtccac

SEQ ID NO: 8303441 - DNA, 22 bp, Homo sapiens
tggctctgggaatctgttgctt

SEQ ID NO: 8303442 - DNA, 22 bp, Homo sapiens
tggctctggcgtgaagcccaga

SEQ ID NO: 8303443 - DNA, 22 bp, Homo sapiens
tggctctggattaatctaggaa

SEQ ID NO: 8303444 - DNA, 22 bp, Homo sapiens
tggctctggattaatctaggaa

SEQ ID NO: 8303445 - DNA, 22 bp, Homo sapiens
tggctctgttcgccatcaggag

SEQ ID NO: 8303446 - DNA, 22 bp, Homo sapiens
tggctctgttgaggtatggatt

SEQ ID NO: 8303447 - DNA, 21 bp, Homo sapiens
tggctctgttcaatatatgga

SEQ ID NO: 8303448 - DNA, 22 bp, Homo sapiens
tggctctgtgtctcccagcagc

SEQ ID NO: 8303449 - DNA, 23 bp, Homo sapiens
tggctctgtgtcacatacaggat

SEQ ID NO: 8303450 - DNA, 22 bp, Homo sapiens
tggctctgttttatgagtacca

SEQ ID NO: 8303451 - DNA, 22 bp, Homo sapiens
tggctctgtttgttaactagac

SEQ ID NO: 8303452 - DNA, 22 bp, Homo sapiens
tggctctgttgtgctgagccag

SEQ ID NO: 8303453 - DNA, 22 bp, Homo sapiens
tggctctgttgtgctgagccag

SEQ ID NO: 8303454 - DNA, 22 bp, Homo sapiens
tggctgaatctgcagcaggaag

SEQ ID NO: 8303455 - DNA, 22 bp, Homo sapiens
tggctgaataatattctgttgt

SEQ ID NO: 8303456 - DNA, 22 bp, Homo sapiens
tggctgaaggaagattcttcta

SEQ ID NO: 8303457 - DNA, 22 bp, Homo sapiens
tggctgaataaaatatggtgtt

SEQ ID NO: 8303458 - DNA, 22 bp, Homo sapiens
tggctgaactaatgtgctgttt

SEQ ID NO: 8303459 - DNA, 22 bp, Homo sapiens
tggctgcttgttttagtgaggc

SEQ ID NO: 8303460 - DNA, 22 bp, Homo sapiens
tggctgctgcttggtcttcttc

SEQ ID NO: 8303461 - DNA, 21 bp, Homo sapiens
tggctgctggccctctctcca

SEQ ID NO: 8303462 - DNA, 22 bp, Homo sapiens
tggctgctgagaaggcagctgt

SEQ ID NO: 8303463 - DNA, 22 bp, Homo sapiens
tggcttctgggacttgtgagca

SEQ ID NO: 8303464 - DNA, 19 bp, Homo sapiens
tggcttctgttttcatgtt

SEQ ID NO: 8303465 - DNA, 22 bp, Homo sapiens
tggcttctgctttcagtggagg

SEQ ID NO: 8303466 - DNA, 23 bp, Homo sapiens
tggcttctgccccattctctcca

SEQ ID NO: 8303467 - DNA, 22 bp, Homo sapiens
tggcttcagacttctgctacgt

SEQ ID NO: 8303468 - DNA, 22 bp, Homo sapiens
tggcttcctgcatggatcctct

SEQ ID NO: 8303469 - DNA, 22 bp, Homo sapiens
tggcttcctgcatggatcctct

SEQ ID NO: 8303470 - DNA, 22 bp, Homo sapiens
tggcttcctgcacagtgtctgc

SEQ ID NO: 8303471 - DNA, 22 bp, Homo sapiens
tggcttcctccagagcaggagg

SEQ ID NO: 8303472 - DNA, 22 bp, Homo sapiens
tggcttccgccgcgggcctcgg

SEQ ID NO: 8303473 - DNA, 17 bp, Homo sapiens
tggcttccctgggccac

SEQ ID NO: 8303474 - DNA, 17 bp, Homo sapiens
tggcttccctgggccac

SEQ ID NO: 8303475 - DNA, 22 bp, Homo sapiens
tggcttcctggacagatgcggt

SEQ ID NO: 8303476 - DNA, 22 bp, Homo sapiens
tggcttcttagaccagtggcct

SEQ ID NO: 8303477 - DNA, 22 bp, Homo sapiens
tggctttctcccccagcttctc

SEQ ID NO: 8303478 - DNA, 22 bp, Homo sapiens
tgggaaatgtgtttctggacca

SEQ ID NO: 8303479 - DNA, 19 bp, Homo sapiens
tggctgggcgtgcctccgt

SEQ ID NO: 8303480 - DNA, 22 bp, Homo sapiens
tggctgggccgggccttgtgcc

SEQ ID NO: 8303481 - DNA, 22 bp, Homo sapiens
tggctggggccacagttttcct

SEQ ID NO: 8303482 - DNA, 22 bp, Homo sapiens
tggctggggagccccgactccc

SEQ ID NO: 8303483 - DNA, 22 bp, Homo sapiens
tggctggggcctgaatcctgca

SEQ ID NO: 8303484 - DNA, 19 bp, Homo sapiens
tggctgggtgccaatggcc

SEQ ID NO: 8303485 - DNA, 22 bp, Homo sapiens
tggctgggggtgctatagctgc

SEQ ID NO: 8303486 - DNA, 22 bp, Homo sapiens
tggctgggtgctatccagtact

SEQ ID NO: 8303487 - DNA, 22 bp, Homo sapiens
tggctgtcagctgcctggtgcg

SEQ ID NO: 8303488 - DNA, 22 bp, Homo sapiens
tggctggcagtaggctagtggc

SEQ ID NO: 8303489 - DNA, 23 bp, Homo sapiens
tggctggcagaaactgaagcatg

SEQ ID NO: 8303490 - DNA, 23 bp, Homo sapiens
tggctggcagaaactgaagcatg

SEQ ID NO: 8303491 - DNA, 22 bp, Homo sapiens
tggctggcgccgggctagccac

SEQ ID NO: 8303492 - DNA, 22 bp, Homo sapiens
tggctggccctgggagtgcaga

SEQ ID NO: 8303493 - DNA, 22 bp, Homo sapiens
tggctgggagctggaactgggc

SEQ ID NO: 8303494 - DNA, 22 bp, Homo sapiens
tggctgggcccccacctgcctc

SEQ ID NO: 8303495 - DNA, 22 bp, Homo sapiens
tggctggacagtgggcagtgga

SEQ ID NO: 8303496 - DNA, 22 bp, Homo sapiens
tggctggcaaggctggagtcag

SEQ ID NO: 8303497 - DNA, 22 bp, Homo sapiens
tgggaggacttgtgggcttcat

SEQ ID NO: 8303498 - DNA, 22 bp, Homo sapiens
tgggaggaatgtcactgagcca

SEQ ID NO: 8303499 - DNA, 20 bp, Homo sapiens
tgggagctggtgaggtctca

SEQ ID NO: 8303500 - DNA, 22 bp, Homo sapiens
tgggagctggggttggacgtct

SEQ ID NO: 8303501 - DNA, 22 bp, Homo sapiens
tgggaggatcgcttgagcccag

SEQ ID NO: 8303502 - DNA, 22 bp, Homo sapiens
tgggaggagccctctgggaagg

SEQ ID NO: 8303503 - DNA, 22 bp, Homo sapiens
tgggagcaagctggtgctggag

SEQ ID NO: 8303504 - DNA, 22 bp, Homo sapiens
tgggagaagcagcagccaagtg

SEQ ID NO: 8303505 - DNA, 22 bp, Homo sapiens
tgggagagtgctcaatgtgcaa

SEQ ID NO: 8303506 - DNA, 21 bp, Homo sapiens
tgggagagggctcagctaccc

SEQ ID NO: 8303507 - DNA, 22 bp, Homo sapiens
tgggactgctcttgctggggtc

SEQ ID NO: 8303508 - DNA, 22 bp, Homo sapiens
tgggaccaagtcatttctttag

SEQ ID NO: 8303509 - DNA, 22 bp, Homo sapiens
tgggacagtgtgccttgctcct

SEQ ID NO: 8303510 - DNA, 22 bp, Homo sapiens
tgggacagttgtcctccactct

SEQ ID NO: 8303511 - DNA, 22 bp, Homo sapiens
tgggacaccctcacgcctgcac

SEQ ID NO: 8303512 - DNA, 22 bp, Homo sapiens
tgggaatggatgctaagtgcta

SEQ ID NO: 8303513 - DNA, 22 bp, Homo sapiens
tgggaaggggagctggaaagga

SEQ ID NO: 8303514 - DNA, 22 bp, Homo sapiens
tgctttatgttatcagaagggt

SEQ ID NO: 8303515 - DNA, 22 bp, Homo sapiens
tgctttctctctaccccacttt

SEQ ID NO: 8303516 - DNA, 21 bp, Homo sapiens
tgctttatgggaaaaatgtca

SEQ ID NO: 8303517 - DNA, 22 bp, Homo sapiens
tgcttgagacacatatgaattt

SEQ ID NO: 8303518 - DNA, 22 bp, Homo sapiens
tggaaagatgaagatgtttaag

SEQ ID NO: 8303519 - DNA, 21 bp, Homo sapiens
tggaaagattcaaagaccagg

SEQ ID NO: 8303520 - DNA, 22 bp, Homo sapiens
tggaaagaggtagaggatctgg

SEQ ID NO: 8303521 - DNA, 22 bp, Homo sapiens
tgcttttaagaacaatgctgct

SEQ ID NO: 8303522 - DNA, 22 bp, Homo sapiens
tgctttggccactagaattcag

SEQ ID NO: 8303523 - DNA, 22 bp, Homo sapiens
tgctttttagtactgtcttatt

SEQ ID NO: 8303524 - DNA, 22 bp, Homo sapiens
tggaaggagctaaggacctggg

SEQ ID NO: 8303525 - DNA, 22 bp, Homo sapiens
tggaaggggagctggaaagggg

SEQ ID NO: 8303526 - DNA, 22 bp, Homo sapiens
tggaaggcaacggagtgagctg

SEQ ID NO: 8303527 - DNA, 22 bp, Homo sapiens
tggaagggggaagacagctctg

SEQ ID NO: 8303528 - DNA, 16 bp, Homo sapiens
tggaaggggtctccgg

SEQ ID NO: 8303529 - DNA, 22 bp, Homo sapiens
tggaagagggagctgggtggcc

SEQ ID NO: 8303530 - DNA, 22 bp, Homo sapiens
tggaagcacttgggttttgttg

SEQ ID NO: 8303531 - DNA, 22 bp, Homo sapiens
tggaagcagtgattcttgtctg

SEQ ID NO: 8303532 - DNA, 22 bp, Homo sapiens
tggaagcatcacttcttgcctg

SEQ ID NO: 8303533 - DNA, 22 bp, Homo sapiens
tggaagccaggcccgctcctaa

SEQ ID NO: 8303534 - DNA, 22 bp, Homo sapiens
tggacagcgaaagtgcctggga

SEQ ID NO: 8303535 - DNA, 22 bp, Homo sapiens
tggacaggatctgagactgaga

SEQ ID NO: 8303536 - DNA, 23 bp, Homo sapiens
tggacctgaaccagtgcctctgt

SEQ ID NO: 8303537 - DNA, 22 bp, Homo sapiens
tggacctgctggatgggcaggt

SEQ ID NO: 8303538 - DNA, 17 bp, Homo sapiens
tggacccttgggcctcc

SEQ ID NO: 8303539 - DNA, 22 bp, Homo sapiens
tggactcaagtccaagttcacg

SEQ ID NO: 8303540 - DNA, 22 bp, Homo sapiens
tggactcagaagtgttctttta

SEQ ID NO: 8303541 - DNA, 22 bp, Homo sapiens
tggactcagtgctgccattccc

SEQ ID NO: 8303542 - DNA, 18 bp, Homo sapiens
tggacagggtggagaaaa

SEQ ID NO: 8303543 - DNA, 22 bp, Homo sapiens
tggacaggtgagtgactcaggg

SEQ ID NO: 8303544 - DNA, 22 bp, Homo sapiens
tggagcagagatggtggccttc

SEQ ID NO: 8303545 - DNA, 22 bp, Homo sapiens
tggagcagctaagcctctgaga

SEQ ID NO: 8303546 - DNA, 22 bp, Homo sapiens
tggagcagccatgatgacagag

SEQ ID NO: 8303547 - DNA, 22 bp, Homo sapiens
tggagcagcatcactttgagct

SEQ ID NO: 8303548 - DNA, 22 bp, Homo sapiens
tggagcagagatgggagcccaa

SEQ ID NO: 8303549 - DNA, 22 bp, Homo sapiens
tggagaagtcaaagtgaacagg

SEQ ID NO: 8303550 - DNA, 18 bp, Homo sapiens
tggagcaggaagcctggc

SEQ ID NO: 8303551 - DNA, 22 bp, Homo sapiens
tggagcaggaagtctatggctg

SEQ ID NO: 8303552 - DNA, 22 bp, Homo sapiens
tggagcaggaagtctatggctg

SEQ ID NO: 8303553 - DNA, 22 bp, Homo sapiens
tggagcaggtgccaggtgtgtg

SEQ ID NO: 8303554 - DNA, 18 bp, Homo sapiens
tggagccagctctaggat

SEQ ID NO: 8303555 - DNA, 22 bp, Homo sapiens
tggagccaggagcctgggagtc

SEQ ID NO: 8303556 - DNA, 22 bp, Homo sapiens
tggagccagagcgcagcctggg

SEQ ID NO: 8303557 - DNA, 22 bp, Homo sapiens
tggagccagcccaggcccctct

SEQ ID NO: 8303558 - DNA, 20 bp, Homo sapiens
tggagccacagtcaggttcc

SEQ ID NO: 8303559 - DNA, 22 bp, Homo sapiens
tggagcaggtgctcagggtaat

SEQ ID NO: 8303560 - DNA, 22 bp, Homo sapiens
tggagcaggtgggatgtcgtga

SEQ ID NO: 8303561 - DNA, 22 bp, Homo sapiens
tggagcatattctggagcttgg

SEQ ID NO: 8303562 - DNA, 22 bp, Homo sapiens
tggagccaaggccagttctcag

SEQ ID NO: 8303563 - DNA, 20 bp, Homo sapiens
tggagccaaggtgtgtctgg

SEQ ID NO: 8303564 - DNA, 21 bp, Homo sapiens
tggagctgaatttttggcatc

SEQ ID NO: 8303565 - DNA, 23 bp, Homo sapiens
tggagctgacagtcagagggagg

SEQ ID NO: 8303566 - DNA, 22 bp, Homo sapiens
tggagctgaactttgaggccag

SEQ ID NO: 8303567 - DNA, 20 bp, Homo sapiens
tggagctccagcgtccatgt

SEQ ID NO: 8303568 - DNA, 22 bp, Homo sapiens
tggagcctgtgtttctgcccag

SEQ ID NO: 8303569 - DNA, 22 bp, Homo sapiens
tggagctcaaaggcctgtggga

SEQ ID NO: 8303570 - DNA, 22 bp, Homo sapiens
tggagccataaccctttcgtac

SEQ ID NO: 8303571 - DNA, 22 bp, Homo sapiens
tggagcccagacactggcattg

SEQ ID NO: 8303572 - DNA, 18 bp, Homo sapiens
tggagccattgccaccat

SEQ ID NO: 8303573 - DNA, 22 bp, Homo sapiens
tggagccatgcctggcctttcc

SEQ ID NO: 8303574 - DNA, 22 bp, Homo sapiens
tggagcctgagtcagcggaggc

SEQ ID NO: 8303575 - DNA, 22 bp, Homo sapiens
tggagcccagggtgagaaggag

SEQ ID NO: 8303576 - DNA, 21 bp, Homo sapiens
tggagctgccacttgtcctcc

SEQ ID NO: 8303577 - DNA, 17 bp, Homo sapiens
tggagctgcgtgtgttc

SEQ ID NO: 8303578 - DNA, 18 bp, Homo sapiens
tggagctgagtgctgtgc

SEQ ID NO: 8303579 - DNA, 22 bp, Homo sapiens
tggagctgatacagctggcttt

SEQ ID NO: 8303580 - DNA, 22 bp, Homo sapiens
tggagctggaatttgagctgga

SEQ ID NO: 8303581 - DNA, 22 bp, Homo sapiens
tggagctggaatttgagctgga

SEQ ID NO: 8303582 - DNA, 22 bp, Homo sapiens
tggagctggaatttctgggcct

SEQ ID NO: 8303583 - DNA, 22 bp, Homo sapiens
tggaggctggagtgcagtggcg

SEQ ID NO: 8303584 - DNA, 22 bp, Homo sapiens
tggaggcaccactggctgcccg

SEQ ID NO: 8303585 - DNA, 22 bp, Homo sapiens
tggaggatgccatccaggatac

SEQ ID NO: 8303586 - DNA, 22 bp, Homo sapiens
tggaggatgagtgtgggctctg

SEQ ID NO: 8303587 - DNA, 22 bp, Homo sapiens
tggaggatgcctggggaggcct

SEQ ID NO: 8303588 - DNA, 22 bp, Homo sapiens
tggaggagggctggtgtctgta

SEQ ID NO: 8303589 - DNA, 22 bp, Homo sapiens
tggaggagaatttatggtcgaa

SEQ ID NO: 8303590 - DNA, 22 bp, Homo sapiens
tggaggaaaattactggggtct

SEQ ID NO: 8303591 - DNA, 19 bp, Homo sapiens
tggaggagaggaaaagtca

SEQ ID NO: 8303592 - DNA, 20 bp, Homo sapiens
tggagctgtggtaaggagca

SEQ ID NO: 8303593 - DNA, 20 bp, Homo sapiens
tggagctgtaatcttgtctg

SEQ ID NO: 8303594 - DNA, 22 bp, Homo sapiens
tggagctggtaaacagtgacat

SEQ ID NO: 8303595 - DNA, 22 bp, Homo sapiens
tggagctgggagtcctgggctg

SEQ ID NO: 8303596 - DNA, 23 bp, Homo sapiens
tggagctgggctcagaccctggg

SEQ ID NO: 8303597 - DNA, 22 bp, Homo sapiens
tggagctggggtttgaatctgg

SEQ ID NO: 8303598 - DNA, 22 bp, Homo sapiens
tggagtgaagtaaagaggacaa

SEQ ID NO: 8303599 - DNA, 22 bp, Homo sapiens
tggagtgaagtaaagaggacaa

SEQ ID NO: 8303600 - DNA, 22 bp, Homo sapiens
tggataaactcactgtaagttg

SEQ ID NO: 8303601 - DNA, 23 bp, Homo sapiens
tggataaagctgtgctgcatagg

SEQ ID NO: 8303602 - DNA, 22 bp, Homo sapiens
tggatgctgtaggacacgctct

SEQ ID NO: 8303603 - DNA, 22 bp, Homo sapiens
tggaggctggagtgcagtggcg

SEQ ID NO: 8303604 - DNA, 22 bp, Homo sapiens
tggagggaacccaggctgctct

SEQ ID NO: 8303605 - DNA, 22 bp, Homo sapiens
tggagggcatctgtggtcaggc

SEQ ID NO: 8303606 - DNA, 22 bp, Homo sapiens
tggagggcatgctgtccatggg

SEQ ID NO: 8303607 - DNA, 22 bp, Homo sapiens
tggagggctctttcacctggta

SEQ ID NO: 8303608 - DNA, 18 bp, Homo sapiens
tggagggcttgctgcagc

SEQ ID NO: 8303609 - DNA, 22 bp, Homo sapiens
tgcctgggaaccaatcctggct

SEQ ID NO: 8303610 - DNA, 22 bp, Homo sapiens
tgcctgggaaccaatcctggct

SEQ ID NO: 8303611 - DNA, 22 bp, Homo sapiens
tgcctgggctcggtagccatcg

SEQ ID NO: 8303612 - DNA, 22 bp, Homo sapiens
tgcctgggtccaggccaagcct

SEQ ID NO: 8303613 - DNA, 22 bp, Homo sapiens
tgcctgggtccaggccaagcct

SEQ ID NO: 8303614 - DNA, 22 bp, Homo sapiens
tgcctggggttggcaaactgct

SEQ ID NO: 8303615 - DNA, 22 bp, Homo sapiens
tgcctggggttggcaaactgct

SEQ ID NO: 8303616 - DNA, 22 bp, Homo sapiens
tgcctgggggactaaggccaaa

SEQ ID NO: 8303617 - DNA, 22 bp, Homo sapiens
tgcctgggggactaaggccaaa

SEQ ID NO: 8303618 - DNA, 22 bp, Homo sapiens
tgcctggggattgctctgggcc

SEQ ID NO: 8303619 - DNA, 22 bp, Homo sapiens
tgcctgtcttggagtcctggcc

SEQ ID NO: 8303620 - DNA, 22 bp, Homo sapiens
tgcctgtctttcctccctcgta

SEQ ID NO: 8303621 - DNA, 22 bp, Homo sapiens
tgcctgtctctgactgccatta

SEQ ID NO: 8303622 - DNA, 22 bp, Homo sapiens
tgcctgtctcctctgcagggtg

SEQ ID NO: 8303623 - DNA, 22 bp, Homo sapiens
tgcctgtcctgaggatgagggt

SEQ ID NO: 8303624 - DNA, 19 bp, Homo sapiens
tgcctgtcagtagatctca

SEQ ID NO: 8303625 - DNA, 22 bp, Homo sapiens
tgcctgtcttcaggagtgtcac

SEQ ID NO: 8303626 - DNA, 22 bp, Homo sapiens
tgcctgtcttaatatctggaaa

SEQ ID NO: 8303627 - DNA, 22 bp, Homo sapiens
tgcctgtcagggggagtgggaa

SEQ ID NO: 8303628 - DNA, 22 bp, Homo sapiens
tgcctgggttgactcttagctg

SEQ ID NO: 8303629 - DNA, 22 bp, Homo sapiens
tgcctgggtgtaaagggccaac

SEQ ID NO: 8303630 - DNA, 22 bp, Homo sapiens
tgcctgggttcccaccccaaag

SEQ ID NO: 8303631 - DNA, 22 bp, Homo sapiens
tgcctgggttcccaccccaaag

SEQ ID NO: 8303632 - DNA, 22 bp, Homo sapiens
tgcctgggtgtaaagggccaac

SEQ ID NO: 8303633 - DNA, 22 bp, Homo sapiens
tgcctgggtgccctctgctcct

SEQ ID NO: 8303634 - DNA, 22 bp, Homo sapiens
tgcctgggtgctggctggtcac

SEQ ID NO: 8303635 - DNA, 22 bp, Homo sapiens
tgccttggtgcttcttcatgtg

SEQ ID NO: 8303636 - DNA, 22 bp, Homo sapiens
tgccttggttctctacttggag

SEQ ID NO: 8303637 - DNA, 22 bp, Homo sapiens
tgcctgtgtcacagtgatgttt

SEQ ID NO: 8303638 - DNA, 22 bp, Homo sapiens
tgcgttgcgctcctgcagcagg

SEQ ID NO: 8303639 - DNA, 22 bp, Homo sapiens
tgctataagaattatattactc

SEQ ID NO: 8303640 - DNA, 22 bp, Homo sapiens
tgctatctctatatccatttat

SEQ ID NO: 8303641 - DNA, 22 bp, Homo sapiens
tgctattgtgaacagtgccaca

SEQ ID NO: 8303642 - DNA, 21 bp, Homo sapiens
tgctcatgcaatgcatgtcca

SEQ ID NO: 8303643 - DNA, 19 bp, Homo sapiens
tgctcatggggacttctcc

SEQ ID NO: 8303644 - DNA, 22 bp, Homo sapiens
tgctcattggcgatctgaggga

SEQ ID NO: 8303645 - DNA, 22 bp, Homo sapiens
tgctcattggcgatctgaggga

SEQ ID NO: 8303646 - DNA, 22 bp, Homo sapiens
tgctcacagcccagaacataat

SEQ ID NO: 8303647 - DNA, 21 bp, Homo sapiens
tgctcacagatgtgctcagtg

SEQ ID NO: 8303648 - DNA, 22 bp, Homo sapiens
tgctcactgaactcttgctgtc

SEQ ID NO: 8303649 - DNA, 22 bp, Homo sapiens
tgctcactgaactcttgctgtc

SEQ ID NO: 8303650 - DNA, 22 bp, Homo sapiens
tgctcagacaagctgaacagta

SEQ ID NO: 8303651 - DNA, 22 bp, Homo sapiens
tgctgaggaggtggctgtgctt

SEQ ID NO: 8303652 - DNA, 22 bp, Homo sapiens
tgctctgtattctatggcagtt

SEQ ID NO: 8303653 - DNA, 22 bp, Homo sapiens
tgctctgtaaggtcagaaaagg

SEQ ID NO: 8303654 - DNA, 22 bp, Homo sapiens
tgctctgtaacaaattgacatg

SEQ ID NO: 8303655 - DNA, 20 bp, Homo sapiens
tgctctgtctaaaacttccc

SEQ ID NO: 8303656 - DNA, 22 bp, Homo sapiens
tgctctgtcaagaaaagatgcc

SEQ ID NO: 8303657 - DNA, 22 bp, Homo sapiens
tgctctgtggtccaagatggct

SEQ ID NO: 8303658 - DNA, 23 bp, Homo sapiens
tgctctgtgaatagttggtgact

SEQ ID NO: 8303659 - DNA, 22 bp, Homo sapiens
tgctcttcggggccactgcttg

SEQ ID NO: 8303660 - DNA, 18 bp, Homo sapiens
tgctctgtttaatgattt

SEQ ID NO: 8303661 - DNA, 22 bp, Homo sapiens
tgctctgttgtgcatgtgggat

SEQ ID NO: 8303662 - DNA, 22 bp, Homo sapiens
tgctctgggtcctgggcctcct

SEQ ID NO: 8303663 - DNA, 22 bp, Homo sapiens
tgctctggtaactcacttccat

SEQ ID NO: 8303664 - DNA, 22 bp, Homo sapiens
tgctctggtcctccctcggcgc

SEQ ID NO: 8303665 - DNA, 22 bp, Homo sapiens
tgctctggtcctccctcggcgc

SEQ ID NO: 8303666 - DNA, 18 bp, Homo sapiens
tgctctggtctcacttgg

SEQ ID NO: 8303667 - DNA, 22 bp, Homo sapiens
tgctgaggtcaccttgctgcta

SEQ ID NO: 8303668 - DNA, 21 bp, Homo sapiens
tgctccttagctgcccctgcc

SEQ ID NO: 8303669 - DNA, 22 bp, Homo sapiens
tgctccttcctcatcctgtgca

SEQ ID NO: 8303670 - DNA, 22 bp, Homo sapiens
tgctctccggcttccgtggcct

SEQ ID NO: 8303671 - DNA, 22 bp, Homo sapiens
tgctctctcaggcctggcccac

SEQ ID NO: 8303672 - DNA, 22 bp, Homo sapiens
tgctctctcaggcctggcccac

SEQ ID NO: 8303673 - DNA, 23 bp, Homo sapiens
tgctctgggaggccctggagagc

SEQ ID NO: 8303674 - DNA, 22 bp, Homo sapiens
tgctctgggcaacagcctccct

SEQ ID NO: 8303675 - DNA, 22 bp, Homo sapiens
tgctctggggagctcctctgcg

SEQ ID NO: 8303676 - DNA, 23 bp, Homo sapiens
tgctcccaggtgacgctgctgtt

SEQ ID NO: 8303677 - DNA, 22 bp, Homo sapiens
tgctcccaggcattctctgttg

SEQ ID NO: 8303678 - DNA, 22 bp, Homo sapiens
tgctcccaggctctgtggtctg

SEQ ID NO: 8303679 - DNA, 22 bp, Homo sapiens
tgctcccagggactctggctgg

SEQ ID NO: 8303680 - DNA, 18 bp, Homo sapiens
tgctggcaactactattg

SEQ ID NO: 8303681 - DNA, 22 bp, Homo sapiens
tgctggaggcctgactgtgttt

SEQ ID NO: 8303682 - DNA, 22 bp, Homo sapiens
tgctggaggagtttactgtggc

SEQ ID NO: 8303683 - DNA, 22 bp, Homo sapiens
tgctggaggggcctgaccagga

SEQ ID NO: 8303684 - DNA, 22 bp, Homo sapiens
tgctggctcagtttgcagactc

SEQ ID NO: 8303685 - DNA, 22 bp, Homo sapiens
tgctggctactgatggcaggcc

SEQ ID NO: 8303686 - DNA, 22 bp, Homo sapiens
tgctggccaacaaggctccaag

SEQ ID NO: 8303687 - DNA, 22 bp, Homo sapiens
tgctggctgtatatgtgagagt

SEQ ID NO: 8303688 - DNA, 22 bp, Homo sapiens
tgctggctggcctggcctggac

SEQ ID NO: 8303689 - DNA, 22 bp, Homo sapiens
tgctggctgggctgctggagac

SEQ ID NO: 8303690 - DNA, 22 bp, Homo sapiens
tgctgcatttatcttctcaaac

SEQ ID NO: 8303691 - DNA, 20 bp, Homo sapiens
tgctgcagtttcatgggact

SEQ ID NO: 8303692 - DNA, 22 bp, Homo sapiens
tgctgccaagcccgtgctcctg

SEQ ID NO: 8303693 - DNA, 22 bp, Homo sapiens
tgctgccaaatgcgagctctgt

SEQ ID NO: 8303694 - DNA, 22 bp, Homo sapiens
tgctgccacaaattcagctgcc

SEQ ID NO: 8303695 - DNA, 17 bp, Homo sapiens
tgctgccaagtcccaac

SEQ ID NO: 8303696 - DNA, 22 bp, Homo sapiens
tgctgccacccctcaccagagc

SEQ ID NO: 8303697 - DNA, 22 bp, Homo sapiens
tgctgccacctggtggctgaag

SEQ ID NO: 8303698 - DNA, 22 bp, Homo sapiens
tgctgccacatttaaagagggg

SEQ ID NO: 8303699 - DNA, 22 bp, Homo sapiens
tgctgccactggtagtctcatt

SEQ ID NO: 8303700 - DNA, 22 bp, Homo sapiens
tgctgccagagagacagggact

SEQ ID NO: 8303701 - DNA, 22 bp, Homo sapiens
tgctgccagccaggccatggag

SEQ ID NO: 8303702 - DNA, 21 bp, Homo sapiens
tgctgccatcatgcagagatg

SEQ ID NO: 8303703 - DNA, 21 bp, Homo sapiens
tgctgccatagacctgaggga

SEQ ID NO: 8303704 - DNA, 22 bp, Homo sapiens
tgctgccaggtcttgctgtcca

SEQ ID NO: 8303705 - DNA, 22 bp, Homo sapiens
tgctgccagggctctgcccaca

SEQ ID NO: 8303706 - DNA, 22 bp, Homo sapiens
tgctgcctaataagtcgagggt

SEQ ID NO: 8303707 - DNA, 22 bp, Homo sapiens
tgctgcctccaactcctgggct

SEQ ID NO: 8303708 - DNA, 22 bp, Homo sapiens
tgctgcctcagcttcctgggct

SEQ ID NO: 8303709 - DNA, 22 bp, Homo sapiens
tgctgccatgcagagcaacaga

SEQ ID NO: 8303710 - DNA, 22 bp, Homo sapiens
tgctgccatggtcgctggtgtc

SEQ ID NO: 8303711 - DNA, 18 bp, Homo sapiens
tgctgcccaactctcccc

SEQ ID NO: 8303712 - DNA, 22 bp, Homo sapiens
tgctgcccactgtatttctcca

SEQ ID NO: 8303713 - DNA, 22 bp, Homo sapiens
tgctgcccgtacctgtgcactt

SEQ ID NO: 8303714 - DNA, 22 bp, Homo sapiens
tgctgctccccagcacacagca

SEQ ID NO: 8303715 - DNA, 22 bp, Homo sapiens
tgctgctcctgcctggctccca

SEQ ID NO: 8303716 - DNA, 22 bp, Homo sapiens
tgctgctctcagccaccaggaa

SEQ ID NO: 8303717 - DNA, 22 bp, Homo sapiens
tgctgctctgtaaagtgatgag

SEQ ID NO: 8303718 - DNA, 22 bp, Homo sapiens
tgctgctcttcaccatggcctc

SEQ ID NO: 8303719 - DNA, 23 bp, Homo sapiens
tgctgggcagagctggtgctgag

SEQ ID NO: 8303720 - DNA, 22 bp, Homo sapiens
tgctgggctagaagctgaggcc

SEQ ID NO: 8303721 - DNA, 22 bp, Homo sapiens
tgctgggctagggtggagctct

SEQ ID NO: 8303722 - DNA, 22 bp, Homo sapiens
tgctgggcttgaaagctgctaa

SEQ ID NO: 8303723 - DNA, 23 bp, Homo sapiens
tgctggggtagtttgtggcacag

SEQ ID NO: 8303724 - DNA, 22 bp, Homo sapiens
tgctggggtcatggggcgcccg

SEQ ID NO: 8303725 - DNA, 20 bp, Homo sapiens
tgctggggacatacagggtg

SEQ ID NO: 8303726 - DNA, 22 bp, Homo sapiens
tgctggggagtgattgaccatc

SEQ ID NO: 8303727 - DNA, 22 bp, Homo sapiens
tgctggggatccgtaccaaccc

SEQ ID NO: 8303728 - DNA, 22 bp, Homo sapiens
tgctggtggagaaagtggaggt

SEQ ID NO: 8303729 - DNA, 23 bp, Homo sapiens
tgctggtgtttttgggaccaggg

SEQ ID NO: 8303730 - DNA, 20 bp, Homo sapiens
tgctgtaagattagagagct

SEQ ID NO: 8303731 - DNA, 22 bp, Homo sapiens
tgctgtagccctgcacagtgca

SEQ ID NO: 8303732 - DNA, 22 bp, Homo sapiens
tgctgtcccccgtgtctgggct

SEQ ID NO: 8303733 - DNA, 23 bp, Homo sapiens
tgctgtccaacagactggccatg

SEQ ID NO: 8303734 - DNA, 22 bp, Homo sapiens
tgctgtcagttggcaggatgag

SEQ ID NO: 8303735 - DNA, 22 bp, Homo sapiens
tgcttcaggagatgtcaccatg

SEQ ID NO: 8303736 - DNA, 22 bp, Homo sapiens
tgcttcaggaagaaacgccagg

SEQ ID NO: 8303737 - DNA, 22 bp, Homo sapiens
tgcttccctcacttcacctggc

SEQ ID NO: 8303738 - DNA, 22 bp, Homo sapiens
tgcttctcccaaccagggcctg

SEQ ID NO: 8303739 - DNA, 21 bp, Homo sapiens
tgcttctctagatcaactact

SEQ ID NO: 8303740 - DNA, 23 bp, Homo sapiens
tgcttctctgcttgacagttctg

SEQ ID NO: 8303741 - DNA, 22 bp, Homo sapiens
tgcttaatattgtgatgtaata

SEQ ID NO: 8303742 - DNA, 19 bp, Homo sapiens
tgcttaccatctgtgctgg

SEQ ID NO: 8303743 - DNA, 22 bp, Homo sapiens
tgctgtctgtttactggctata

SEQ ID NO: 8303744 - DNA, 22 bp, Homo sapiens
tgctgtcttccaggatggtgaa

SEQ ID NO: 8303745 - DNA, 22 bp, Homo sapiens
tgctgtctgattcagggtgatt

SEQ ID NO: 8303746 - DNA, 22 bp, Homo sapiens
tgctgtctgcaacagtactaca

SEQ ID NO: 8303747 - DNA, 22 bp, Homo sapiens
tgctgtccctaagtctcttcaa

SEQ ID NO: 8303748 - DNA, 22 bp, Homo sapiens
tgctgtgaggttgagaaggaag

SEQ ID NO: 8303749 - DNA, 22 bp, Homo sapiens
tggtttatttctctgaaaggtt

SEQ ID NO: 8303750 - DNA, 22 bp, Homo sapiens
tggtttcccattatctgcagga

SEQ ID NO: 8303751 - DNA, 22 bp, Homo sapiens
tggtttcccattatctgcagga

SEQ ID NO: 8303752 - DNA, 23 bp, Homo sapiens
tggtggggtcttggagacagcac

SEQ ID NO: 8303753 - DNA, 22 bp, Homo sapiens
tggtgtgggcgtggcaggcaag

SEQ ID NO: 8303754 - DNA, 22 bp, Homo sapiens
tggttttgctccagtataaata

SEQ ID NO: 8303755 - DNA, 22 bp, Homo sapiens
tggtttgcccactcgagtgatt

SEQ ID NO: 8303756 - DNA, 21 bp, Homo sapiens
tggtttgcggccaaagttaaa

SEQ ID NO: 8303757 - DNA, 23 bp, Homo sapiens
tgtaaaatggggtagtgttacca

SEQ ID NO: 8303758 - DNA, 22 bp, Homo sapiens
tgtacaatagctattatctcca

SEQ ID NO: 8303759 - DNA, 22 bp, Homo sapiens
tgtacaatgccagggaacacca

SEQ ID NO: 8303760 - DNA, 22 bp, Homo sapiens
tgtacaatgccgagactaactc

SEQ ID NO: 8303761 - DNA, 22 bp, Homo sapiens
tgtacacaattcttaacataca

SEQ ID NO: 8303762 - DNA, 20 bp, Homo sapiens
tgtacacagtactttacaat

SEQ ID NO: 8303763 - DNA, 22 bp, Homo sapiens
tgtacactgcaggatgcattgc

SEQ ID NO: 8303764 - DNA, 22 bp, Homo sapiens
tgtacagtaggaacttgttatt

SEQ ID NO: 8303765 - DNA, 22 bp, Homo sapiens
tgtacagtatatttcaaagcca

SEQ ID NO: 8303766 - DNA, 22 bp, Homo sapiens
tgtacctttttctgtgcatgct

SEQ ID NO: 8303767 - DNA, 22 bp, Homo sapiens
tgtaagatattcagcttattga

SEQ ID NO: 8303768 - DNA, 22 bp, Homo sapiens
tgtaacagtaagcctgtgagct

SEQ ID NO: 8303769 - DNA, 23 bp, Homo sapiens
tggtgcctcagaagcagtgggct

SEQ ID NO: 8303770 - DNA, 21 bp, Homo sapiens
tggtggagtgtgctgagcatg

SEQ ID NO: 8303771 - DNA, 21 bp, Homo sapiens
tggtggagtgtgctgagcatg

SEQ ID NO: 8303772 - DNA, 16 bp, Homo sapiens
tggtggggaggacagc

SEQ ID NO: 8303773 - DNA, 22 bp, Homo sapiens
tggtggggctttccttctgctt

SEQ ID NO: 8303774 - DNA, 22 bp, Homo sapiens
tggtggggccagacttcagctc

SEQ ID NO: 8303775 - DNA, 22 bp, Homo sapiens
tggtggggattccctccctggc

SEQ ID NO: 8303776 - DNA, 22 bp, Homo sapiens
tggtgggggaggctgtctagca

SEQ ID NO: 8303777 - DNA, 22 bp, Homo sapiens
tggtggggtcatcgtcagatgc

SEQ ID NO: 8303778 - DNA, 22 bp, Homo sapiens
tggtggccaattcacagggctc

SEQ ID NO: 8303779 - DNA, 22 bp, Homo sapiens
tggtggcaatgtcctggagaag

SEQ ID NO: 8303780 - DNA, 22 bp, Homo sapiens
tggtctctgactctgaagaccc

SEQ ID NO: 8303781 - DNA, 18 bp, Homo sapiens
tggtgaagggtggaggag

SEQ ID NO: 8303782 - DNA, 22 bp, Homo sapiens
tggtgaagtcagcggagcccgg

SEQ ID NO: 8303783 - DNA, 22 bp, Homo sapiens
tggtgcaagtctctgaggaggg

SEQ ID NO: 8303784 - DNA, 22 bp, Homo sapiens
tggtcctgccccgtgcacagag

SEQ ID NO: 8303785 - DNA, 22 bp, Homo sapiens
tggtcctggggatctgcagtga

SEQ ID NO: 8303786 - DNA, 22 bp, Homo sapiens
tggtcctgagcaccagcctgac

SEQ ID NO: 8303787 - DNA, 22 bp, Homo sapiens
tggtccagggtgtagtacagag

SEQ ID NO: 8303788 - DNA, 22 bp, Homo sapiens
tggtcaggctgctctgcggcgt

SEQ ID NO: 8303789 - DNA, 22 bp, Homo sapiens
tggtcagttgcatcagagaagt

SEQ ID NO: 8303790 - DNA, 22 bp, Homo sapiens
tggtccagatgccttggcttta

SEQ ID NO: 8303791 - DNA, 22 bp, Homo sapiens
tggtccagacatttctgaggta

SEQ ID NO: 8303792 - DNA, 22 bp, Homo sapiens
tgtccacatcactcacttgtca

SEQ ID NO: 8303793 - DNA, 22 bp, Homo sapiens
tgtcattttctaatctgttgtc

SEQ ID NO: 8303794 - DNA, 22 bp, Homo sapiens
tgtcatttagtcctctgtgtgt

SEQ ID NO: 8303795 - DNA, 20 bp, Homo sapiens
tgtcattgtttctaggacct

SEQ ID NO: 8303796 - DNA, 23 bp, Homo sapiens
tgtcattgtgactacagaaccag

SEQ ID NO: 8303797 - DNA, 22 bp, Homo sapiens
tgtcattgaggaaaactaggtg

SEQ ID NO: 8303798 - DNA, 18 bp, Homo sapiens
tgtcattgccagggaagc

SEQ ID NO: 8303799 - DNA, 22 bp, Homo sapiens
tgtcatgcaggtttgttataga

SEQ ID NO: 8303800 - DNA, 22 bp, Homo sapiens
tgtcagggcatgcggtccagcc

SEQ ID NO: 8303801 - DNA, 19 bp, Homo sapiens
tgtcactgtcatggcccag

SEQ ID NO: 8303802 - DNA, 22 bp, Homo sapiens
tgtcacttcaggaatgcaggga

SEQ ID NO: 8303803 - DNA, 21 bp, Homo sapiens
tgtcagaaataagcatgtgat

SEQ ID NO: 8303804 - DNA, 22 bp, Homo sapiens
tgtcagaactctattgatgtcc

SEQ ID NO: 8303805 - DNA, 22 bp, Homo sapiens
tgtcagtgagttagttgcaagt

SEQ ID NO: 8303806 - DNA, 20 bp, Homo sapiens
tgtcagtgcctgaggcacag

SEQ ID NO: 8303807 - DNA, 22 bp, Homo sapiens
tgtcagtggtagacccagaggt

SEQ ID NO: 8303808 - DNA, 22 bp, Homo sapiens
tgtcagtgtatacatacagtat

SEQ ID NO: 8303809 - DNA, 22 bp, Homo sapiens
tgtcataaaacacaagctgttg

SEQ ID NO: 8303810 - DNA, 22 bp, Homo sapiens
tgtcatagtgtggtagcagtgg

SEQ ID NO: 8303811 - DNA, 22 bp, Homo sapiens
tgtcccagcagctgggttctct

SEQ ID NO: 8303812 - DNA, 22 bp, Homo sapiens
tgtcccagttcccagggttgct

SEQ ID NO: 8303813 - DNA, 22 bp, Homo sapiens
tgtcccagtcaaggctgtcatc

SEQ ID NO: 8303814 - DNA, 22 bp, Homo sapiens
tgtcccagtttatctgggactg

SEQ ID NO: 8303815 - DNA, 22 bp, Homo sapiens
tgtcccatggacacaacttctt

SEQ ID NO: 8303816 - DNA, 22 bp, Homo sapiens
tgtcccagttttgcaggttaga

SEQ ID NO: 8303817 - DNA, 22 bp, Homo sapiens
tgtcccaggcctcatgttgcca

SEQ ID NO: 8303818 - DNA, 22 bp, Homo sapiens
tgtcccaggctgaagtacagtg

SEQ ID NO: 8303819 - DNA, 22 bp, Homo sapiens
tgtcccagcagctgggttctct

SEQ ID NO: 8303820 - DNA, 22 bp, Homo sapiens
tgtcccaggtcctagatgacca

SEQ ID NO: 8303821 - DNA, 22 bp, Homo sapiens
tgtcccagggaaggcccagcac

SEQ ID NO: 8303822 - DNA, 22 bp, Homo sapiens
tgtccctggaactatggctcca

SEQ ID NO: 8303823 - DNA, 22 bp, Homo sapiens
tgtccctctgaggcttccctgg

SEQ ID NO: 8303824 - DNA, 18 bp, Homo sapiens
tgtccctgcaaataacat

SEQ ID NO: 8303825 - DNA, 22 bp, Homo sapiens
tgtccctcattgacgctgtgcc

SEQ ID NO: 8303826 - DNA, 22 bp, Homo sapiens
tgtcccatggataccaggctat

SEQ ID NO: 8303827 - DNA, 22 bp, Homo sapiens
tgtccttcttgtcttgcccaaa

SEQ ID NO: 8303828 - DNA, 22 bp, Homo sapiens
tgtcctgggaatgggatgcagt

SEQ ID NO: 8303829 - DNA, 22 bp, Homo sapiens
tgtcctcaaggagcttcagtct

SEQ ID NO: 8303830 - DNA, 22 bp, Homo sapiens
tgtcctcacaggaatgaacttt

SEQ ID NO: 8303831 - DNA, 22 bp, Homo sapiens
tgtattttcttctggaagctta

SEQ ID NO: 8303832 - DNA, 22 bp, Homo sapiens
tgtattttctgaagataatcaa

SEQ ID NO: 8303833 - DNA, 22 bp, Homo sapiens
tgtatgcttgtgtataatataa

SEQ ID NO: 8303834 - DNA, 21 bp, Homo sapiens
tgtatgcacgcacatgcacac

SEQ ID NO: 8303835 - DNA, 22 bp, Homo sapiens
tgtatgcagcaaaacaattagt

SEQ ID NO: 8303836 - DNA, 22 bp, Homo sapiens
tgtatgcagggcttgtatgcag

SEQ ID NO: 8303837 - DNA, 22 bp, Homo sapiens
tgtatgcaccattgtattacct

SEQ ID NO: 8303838 - DNA, 22 bp, Homo sapiens
tgtatgctttccaaaaatgctg

SEQ ID NO: 8303839 - DNA, 22 bp, Homo sapiens
tgtatgtaaagtttgtaataga

SEQ ID NO: 8303840 - DNA, 22 bp, Homo sapiens
tgtcacaaacatacattataga

SEQ ID NO: 8303841 - DNA, 22 bp, Homo sapiens
tgtatttttaggaatgcgctat

SEQ ID NO: 8303842 - DNA, 22 bp, Homo sapiens
tgtattttgtgaggatcactct

SEQ ID NO: 8303843 - DNA, 22 bp, Homo sapiens
tgtcaccagctgctcctcagga

SEQ ID NO: 8303844 - DNA, 22 bp, Homo sapiens
tgtcaccagttccaggaaataa

SEQ ID NO: 8303845 - DNA, 22 bp, Homo sapiens
tgtcaccatgccagcttctgcc

SEQ ID NO: 8303846 - DNA, 22 bp, Homo sapiens
tgtcacctctttggctgcagct

SEQ ID NO: 8303847 - DNA, 22 bp, Homo sapiens
tgtcacattgaatatgatttat

SEQ ID NO: 8303848 - DNA, 23 bp, Homo sapiens
tgtcacatttagttggcattgtt

SEQ ID NO: 8303849 - DNA, 22 bp, Homo sapiens
tgtcacattgaatatgatttat

SEQ ID NO: 8303850 - DNA, 22 bp, Homo sapiens
tgtcacatgtgtggcatttttc

SEQ ID NO: 8303851 - DNA, 22 bp, Homo sapiens
tgtcacataggcaaaatgtttt

SEQ ID NO: 8303852 - DNA, 22 bp, Homo sapiens
tgtcacataatttatctgtagg

SEQ ID NO: 8303853 - DNA, 22 bp, Homo sapiens
tgtcacagggataccatggggc

SEQ ID NO: 8303854 - DNA, 22 bp, Homo sapiens
tgtagcatgtaaattggttatt

SEQ ID NO: 8303855 - DNA, 23 bp, Homo sapiens
tgtagcatctcttatttctcagc

SEQ ID NO: 8303856 - DNA, 22 bp, Homo sapiens
tgtagctctccagccagcaagg

SEQ ID NO: 8303857 - DNA, 22 bp, Homo sapiens
tgtagcacagagctttgacact

SEQ ID NO: 8303858 - DNA, 19 bp, Homo sapiens
tgtagcagtttaaaacaac

SEQ ID NO: 8303859 - DNA, 22 bp, Homo sapiens
tgtacttccccaatgacagcac

SEQ ID NO: 8303860 - DNA, 22 bp, Homo sapiens
tgtagaaagaatatgtttcata

SEQ ID NO: 8303861 - DNA, 20 bp, Homo sapiens
tgtatattttctggtgtaaa

SEQ ID NO: 8303862 - DNA, 22 bp, Homo sapiens
tgtatattctgcctaaaagctt

SEQ ID NO: 8303863 - DNA, 22 bp, Homo sapiens
tgtatcaagggtttatgtaagc

SEQ ID NO: 8303864 - DNA, 22 bp, Homo sapiens
tgtatcaaaccaaattaattct

SEQ ID NO: 8303865 - DNA, 22 bp, Homo sapiens
tgtatgcaaatttattagcaca

SEQ ID NO: 8303866 - DNA, 22 bp, Homo sapiens
tgtatagagttggaagatgact

SEQ ID NO: 8303867 - DNA, 22 bp, Homo sapiens
tgtatacatttaactagataga

SEQ ID NO: 8303868 - DNA, 22 bp, Homo sapiens
tgggtaaactgggtctggagag

SEQ ID NO: 8303869 - DNA, 22 bp, Homo sapiens
tgggtagagacacagtctgggg

SEQ ID NO: 8303870 - DNA, 22 bp, Homo sapiens
tgggtagagcaggctggggctt

SEQ ID NO: 8303871 - DNA, 22 bp, Homo sapiens
tgggtagaggaattgggctacc

SEQ ID NO: 8303872 - DNA, 22 bp, Homo sapiens
tgggggtgaaagtctggacagt

SEQ ID NO: 8303873 - DNA, 22 bp, Homo sapiens
tgggggtgactatctcgggaat

SEQ ID NO: 8303874 - DNA, 22 bp, Homo sapiens
tgggggtcctcctctgcttaag

SEQ ID NO: 8303875 - DNA, 23 bp, Homo sapiens
tgggggtgcacgggccacatctt

SEQ ID NO: 8303876 - DNA, 22 bp, Homo sapiens
tgggggtgccctatgaggaagc

SEQ ID NO: 8303877 - DNA, 20 bp, Homo sapiens
tggggtctagttggcctggg

SEQ ID NO: 8303878 - DNA, 22 bp, Homo sapiens
tggggtctgagtatctgcattt

SEQ ID NO: 8303879 - DNA, 22 bp, Homo sapiens
tggggtggatagaaagtgatgt

SEQ ID NO: 8303880 - DNA, 22 bp, Homo sapiens
tggggtggaacccttctgctgg

SEQ ID NO: 8303881 - DNA, 22 bp, Homo sapiens
tggggtgccgacagggagggca

SEQ ID NO: 8303882 - DNA, 22 bp, Homo sapiens
tggggtggtaatacaccgttct

SEQ ID NO: 8303883 - DNA, 22 bp, Homo sapiens
tggggtggggttactcattctg

SEQ ID NO: 8303884 - DNA, 22 bp, Homo sapiens
tggggtgggcatgcgctgtcct

SEQ ID NO: 8303885 - DNA, 22 bp, Homo sapiens
tggggtgggcatgcgctgtcct

SEQ ID NO: 8303886 - DNA, 22 bp, Homo sapiens
tggtaaagaaggctagatctga

SEQ ID NO: 8303887 - DNA, 22 bp, Homo sapiens
tggtaaagtgtactgaatatga

SEQ ID NO: 8303888 - DNA, 22 bp, Homo sapiens
tggtatcagagccatctgtatt

SEQ ID NO: 8303889 - DNA, 21 bp, Homo sapiens
tgggtgggcagagtctcttca

SEQ ID NO: 8303890 - DNA, 22 bp, Homo sapiens
tgggtgggagcgccctgtctgg

SEQ ID NO: 8303891 - DNA, 16 bp, Homo sapiens
tgggtgggaggagcgg

SEQ ID NO: 8303892 - DNA, 22 bp, Homo sapiens
tgggtgggagcgccctgtctgg

SEQ ID NO: 8303893 - DNA, 22 bp, Homo sapiens
tgggtgaggatgatgaggcagc

SEQ ID NO: 8303894 - DNA, 22 bp, Homo sapiens
tgggtggaataaatcagttctg

SEQ ID NO: 8303895 - DNA, 22 bp, Homo sapiens
tgggtgcttcgtcagctctgag

SEQ ID NO: 8303896 - DNA, 22 bp, Homo sapiens
tgggtgagtgggaaaagcccag

SEQ ID NO: 8303897 - DNA, 16 bp, Homo sapiens
tggggatggggaagag

SEQ ID NO: 8303898 - DNA, 22 bp, Homo sapiens
tggggaggtaacaatttcaggc

SEQ ID NO: 8303899 - DNA, 21 bp, Homo sapiens
tggggaggggacctgattatg

SEQ ID NO: 8303900 - DNA, 22 bp, Homo sapiens
tggggaggttcgggaatcttgt

SEQ ID NO: 8303901 - DNA, 22 bp, Homo sapiens
tggggagtgatgcctcggataa

SEQ ID NO: 8303902 - DNA, 22 bp, Homo sapiens
tggggaggaagtcagatttcag

SEQ ID NO: 8303903 - DNA, 22 bp, Homo sapiens
tggggacatagccagtctggct

SEQ ID NO: 8303904 - DNA, 23 bp, Homo sapiens
tggggagggaagtcatttctgta

SEQ ID NO: 8303905 - DNA, 22 bp, Homo sapiens
tggggaggacgggcgccttcct

SEQ ID NO: 8303906 - DNA, 22 bp, Homo sapiens
tggggaggacgggcgccttcct

SEQ ID NO: 8303907 - DNA, 22 bp, Homo sapiens
tggggaggatatgtgagttatt

SEQ ID NO: 8303908 - DNA, 22 bp, Homo sapiens
tggggaagggcaccctggagac

SEQ ID NO: 8303909 - DNA, 22 bp, Homo sapiens
tggggacaggagacttacagct

SEQ ID NO: 8303910 - DNA, 22 bp, Homo sapiens
tggggacacagaggttcgttgg

SEQ ID NO: 8303911 - DNA, 22 bp, Homo sapiens
tggggacacagagccaaactat

SEQ ID NO: 8303912 - DNA, 22 bp, Homo sapiens
tgggctggctgaggcattcact

SEQ ID NO: 8303913 - DNA, 22 bp, Homo sapiens
tgggctggctgaggcattcact

SEQ ID NO: 8303914 - DNA, 22 bp, Homo sapiens
tgggctggtgagggatcattta

SEQ ID NO: 8303915 - DNA, 22 bp, Homo sapiens
tgggctgtccagcacctgggct

SEQ ID NO: 8303916 - DNA, 22 bp, Homo sapiens
tgggctggctgaacttcaacct

SEQ ID NO: 8303917 - DNA, 22 bp, Homo sapiens
tgggctggctgaacttcaacct

SEQ ID NO: 8303918 - DNA, 22 bp, Homo sapiens
tgggctggcgtggagagtttag

SEQ ID NO: 8303919 - DNA, 19 bp, Homo sapiens
tgggcttccccagggcaga

SEQ ID NO: 8303920 - DNA, 22 bp, Homo sapiens
tgggctgtggagcacctttgca

SEQ ID NO: 8303921 - DNA, 22 bp, Homo sapiens
tgggggagccttcacagtagct

SEQ ID NO: 8303922 - DNA, 22 bp, Homo sapiens
tggggctgtccttagtctgaga

SEQ ID NO: 8303923 - DNA, 22 bp, Homo sapiens
tgggggagattagagcttctta

SEQ ID NO: 8303924 - DNA, 22 bp, Homo sapiens
tgggggagattgtgcatctcta

SEQ ID NO: 8303925 - DNA, 22 bp, Homo sapiens
tggggctggggatcttgagcct

SEQ ID NO: 8303926 - DNA, 22 bp, Homo sapiens
tggggctggggatcttgagcct

SEQ ID NO: 8303927 - DNA, 22 bp, Homo sapiens
tggggctgtcccggtttggcga

SEQ ID NO: 8303928 - DNA, 22 bp, Homo sapiens
tggggctggctattgtctccct

SEQ ID NO: 8303929 - DNA, 22 bp, Homo sapiens
tggggctggctattgtctccct

SEQ ID NO: 8303930 - DNA, 22 bp, Homo sapiens
tggggctggcacagtctctatt

SEQ ID NO: 8303931 - DNA, 22 bp, Homo sapiens
tggggcacttatgatgtgccac

SEQ ID NO: 8303932 - DNA, 20 bp, Homo sapiens
tggggcacatgcagattggt

SEQ ID NO: 8303933 - DNA, 19 bp, Homo sapiens
tggggcctcctgtccctgg

SEQ ID NO: 8303934 - DNA, 19 bp, Homo sapiens
tggggcctcctgtccctgg

SEQ ID NO: 8303935 - DNA, 22 bp, Homo sapiens
tggggctgaggagcctcactct

SEQ ID NO: 8303936 - DNA, 23 bp, Homo sapiens
tggggctgatggagacggaccag

SEQ ID NO: 8303937 - DNA, 22 bp, Homo sapiens
tggggctggcacagtctctatt

SEQ ID NO: 8303938 - DNA, 22 bp, Homo sapiens
tggggcctggtcagagctgcac

SEQ ID NO: 8303939 - DNA, 22 bp, Homo sapiens
tggggcctgaggtggagctgca

SEQ ID NO: 8303940 - DNA, 22 bp, Homo sapiens
tggggcctgaggtggagctgca

SEQ ID NO: 8303941 - DNA, 20 bp, Homo sapiens
tggggcctgtttctgtggtt

SEQ ID NO: 8303942 - DNA, 20 bp, Homo sapiens
tggggcctgtttctgtggtt

SEQ ID NO: 8303943 - DNA, 22 bp, Homo sapiens
tgggaggcaggtaggtgatgat

SEQ ID NO: 8303944 - DNA, 22 bp, Homo sapiens
tgggaggcttccagaccttgct

SEQ ID NO: 8303945 - DNA, 22 bp, Homo sapiens
tgggagtgcacctgggacacga

SEQ ID NO: 8303946 - DNA, 22 bp, Homo sapiens
tgggatagtggccaggaccccc

SEQ ID NO: 8303947 - DNA, 23 bp, Homo sapiens
tgggatggattcaccagtgtgct

SEQ ID NO: 8303948 - DNA, 22 bp, Homo sapiens
tgggatggcatcctgggccttg

SEQ ID NO: 8303949 - DNA, 22 bp, Homo sapiens
tgggatggagcctgagtatagt

SEQ ID NO: 8303950 - DNA, 18 bp, Homo sapiens
tgggatggagagtaactg

SEQ ID NO: 8303951 - DNA, 22 bp, Homo sapiens
tgggatgggatctcgctgtgtc

SEQ ID NO: 8303952 - DNA, 22 bp, Homo sapiens
tgggatgggatctcgctgtgtc

SEQ ID NO: 8303953 - DNA, 22 bp, Homo sapiens
tgggatggcatcctgggccttg

SEQ ID NO: 8303954 - DNA, 21 bp, Homo sapiens
tgggatgggtctgggaccagc

SEQ ID NO: 8303955 - DNA, 22 bp, Homo sapiens
tgggcacaaacatctgcctgtt

SEQ ID NO: 8303956 - DNA, 22 bp, Homo sapiens
tgggcaagtcacttctgtcttt

SEQ ID NO: 8303957 - DNA, 22 bp, Homo sapiens
tgggcaagtatcggactctgag

SEQ ID NO: 8303958 - DNA, 22 bp, Homo sapiens
tgggcaagggacaggcctggct

SEQ ID NO: 8303959 - DNA, 22 bp, Homo sapiens
tgggcactatggctctgtgcac

SEQ ID NO: 8303960 - DNA, 22 bp, Homo sapiens
tgggcagactgagccctgtccc

SEQ ID NO: 8303961 - DNA, 22 bp, Homo sapiens
tgggcagagagtagaggcaacg

SEQ ID NO: 8303962 - DNA, 22 bp, Homo sapiens
tgggcacaggggaatggatgaa

SEQ ID NO: 8303963 - DNA, 22 bp, Homo sapiens
tgggcagagtagctcagaagaa

SEQ ID NO: 8303964 - DNA, 22 bp, Homo sapiens
tgggcagaggctctgaagtcca

SEQ ID NO: 8303965 - DNA, 22 bp, Homo sapiens
tgggcagagtcatacaggagac

SEQ ID NO: 8303966 - DNA, 22 bp, Homo sapiens
tgggcagagtcgtggggaatag

SEQ ID NO: 8303967 - DNA, 22 bp, Homo sapiens
tgggcagaggacagggaagatc

SEQ ID NO: 8303968 - DNA, 22 bp, Homo sapiens
tgggcagagatctggatcaaac

SEQ ID NO: 8303969 - DNA, 22 bp, Homo sapiens
tgggcagaggcagcagaaacct

SEQ ID NO: 8303970 - DNA, 22 bp, Homo sapiens
tgggcagattaatgcagtggct

SEQ ID NO: 8303971 - DNA, 22 bp, Homo sapiens
tgggcagatgtggctctccttg

SEQ ID NO: 8303972 - DNA, 21 bp, Homo sapiens
tgggcagatggcagtgtggct

SEQ ID NO: 8303973 - DNA, 22 bp, Homo sapiens
tgggcagatgtcctctgaagtg

SEQ ID NO: 8303974 - DNA, 16 bp, Homo sapiens
tgggcagatgagaaga

SEQ ID NO: 8303975 - DNA, 22 bp, Homo sapiens
tgggcagatctttggtggctag

SEQ ID NO: 8303976 - DNA, 15 bp, Homo sapiens
tgggcagatcacttg

SEQ ID NO: 8303977 - DNA, 22 bp, Homo sapiens
tgggcagagttgtgatgaactg

SEQ ID NO: 8303978 - DNA, 22 bp, Homo sapiens
tgggcagcagcaaagccagact

SEQ ID NO: 8303979 - DNA, 20 bp, Homo sapiens
tgggcagcactgctggctgg

SEQ ID NO: 8303980 - DNA, 23 bp, Homo sapiens
tgggcatctcctctgtgccaggc

SEQ ID NO: 8303981 - DNA, 22 bp, Homo sapiens
tgggccaggatttcaagaccct

SEQ ID NO: 8303982 - DNA, 22 bp, Homo sapiens
tgggccacaagccatgggacca

SEQ ID NO: 8303983 - DNA, 22 bp, Homo sapiens
tgggccacgggggtggagagct

SEQ ID NO: 8303984 - DNA, 22 bp, Homo sapiens
tgggccagcaattgctgctcag

SEQ ID NO: 8303985 - DNA, 22 bp, Homo sapiens
tgggctctcctggaggacaaca

SEQ ID NO: 8303986 - DNA, 22 bp, Homo sapiens
tgggctctctggcaggaaggct

SEQ ID NO: 8303987 - DNA, 22 bp, Homo sapiens
tgggctctgctgcgtaccagtt

SEQ ID NO: 8303988 - DNA, 22 bp, Homo sapiens
tgggctctgcatcagtgcccat

SEQ ID NO: 8303989 - DNA, 22 bp, Homo sapiens
tgggctctgaagtcagtctgct

SEQ ID NO: 8303990 - DNA, 22 bp, Homo sapiens
tgggctgccggcaggctctgcc

SEQ ID NO: 8303991 - DNA, 22 bp, Homo sapiens
tgggctgccggcaggctctgcc

SEQ ID NO: 8303992 - DNA, 22 bp, Homo sapiens
tgggctgccctgatggtcctca

SEQ ID NO: 8303993 - DNA, 22 bp, Homo sapiens
tgggctgccctgatggtcctca

SEQ ID NO: 8303994 - DNA, 22 bp, Homo sapiens
tgggctgccagctctccagatg

SEQ ID NO: 8303995 - DNA, 22 bp, Homo sapiens
tgggctgcaggggttgagagct

SEQ ID NO: 8303996 - DNA, 22 bp, Homo sapiens
tgggctgccagctctccagatg

SEQ ID NO: 8303997 - DNA, 22 bp, Homo sapiens
tgggctgcccaaggtggccatg

SEQ ID NO: 8303998 - DNA, 22 bp, Homo sapiens
tgggctgcccaaggtggccatg

SEQ ID NO: 8303999 - DNA, 22 bp, Homo sapiens
tgggctgcagagcccggccttc

SEQ ID NO: 8304000 - DNA, 22 bp, Homo sapiens
tgggctgcaccctcagcctctg

SEQ ID NO: 8304001 - DNA, 22 bp, Homo sapiens
tgggctgcaccctcagcctctg

SEQ ID NO: 8304002 - DNA, 22 bp, Homo sapiens
tgggctctgtgccaggttggtg

SEQ ID NO: 8304003 - DNA, 22 bp, Homo sapiens
tgggcgaggcccagggctgcgt

SEQ ID NO: 8304004 - DNA, 23 bp, Homo sapiens
tgggcggggcttttcactctgcc

SEQ ID NO: 8304005 - DNA, 22 bp, Homo sapiens
tgggctactctgggagcctaac

SEQ ID NO: 8304006 - DNA, 22 bp, Homo sapiens
tgggcctgttggggttgagtta

SEQ ID NO: 8304007 - DNA, 22 bp, Homo sapiens
tgggcctgttgcctgagtccat

SEQ ID NO: 8304008 - DNA, 20 bp, Homo sapiens
tgggcctgtggcagaagtct

SEQ ID NO: 8304009 - DNA, 22 bp, Homo sapiens
tgggcctgtggcttggctctag

SEQ ID NO: 8304010 - DNA, 22 bp, Homo sapiens
tgggcctgggttcctcctgggc

SEQ ID NO: 8304011 - DNA, 22 bp, Homo sapiens
tgggcctgtgatgctgggctat

SEQ ID NO: 8304012 - DNA, 22 bp, Homo sapiens
tgggcctgattcttgaatcctg

SEQ ID NO: 8304013 - DNA, 22 bp, Homo sapiens
tgggcctgccccaggcttcagc

SEQ ID NO: 8304014 - DNA, 19 bp, Homo sapiens
tgggcctgcatctgggtct

SEQ ID NO: 8304015 - DNA, 23 bp, Homo sapiens
tgggcctggaaagccttagagag

SEQ ID NO: 8304016 - DNA, 22 bp, Homo sapiens
tgggcctggacaaggccactag

SEQ ID NO: 8304017 - DNA, 22 bp, Homo sapiens
tgggcctgggctcctgtcctct

SEQ ID NO: 8304018 - DNA, 22 bp, Homo sapiens
tgggcctgggtctttgctgcca

SEQ ID NO: 8304019 - DNA, 22 bp, Homo sapiens
tgggcctgagtttgggaactgg

SEQ ID NO: 8304020 - DNA, 22 bp, Homo sapiens
tgggcctgactcacctgcctcc

SEQ ID NO: 8304021 - DNA, 22 bp, Homo sapiens
tgggcctgactcacctgcctcc

SEQ ID NO: 8304022 - DNA, 20 bp, Homo sapiens
tgggcctgagcctgtgggct

SEQ ID NO: 8304023 - DNA, 22 bp, Homo sapiens
tgggcctgaaggagctgcgccc

SEQ ID NO: 8304024 - DNA, 22 bp, Homo sapiens
tgggcctccaattccagcggga

SEQ ID NO: 8304025 - DNA, 22 bp, Homo sapiens
ttagatatgtttttgctaatgc

SEQ ID NO: 8304026 - DNA, 22 bp, Homo sapiens
ttagataaattgcaacttgatt

SEQ ID NO: 8304027 - DNA, 22 bp, Homo sapiens
ttagataacagtagaatatcaa

SEQ ID NO: 8304028 - DNA, 22 bp, Homo sapiens
ttagataatgtagagatatgag

SEQ ID NO: 8304029 - DNA, 22 bp, Homo sapiens
ttagataatgttattgtaattt

SEQ ID NO: 8304030 - DNA, 22 bp, Homo sapiens
ttagaaatcacctctgaagatc

SEQ ID NO: 8304031 - DNA, 22 bp, Homo sapiens
ttagaaatgatttcacctcttt

SEQ ID NO: 8304032 - DNA, 22 bp, Homo sapiens
ttagaaatctgctgccatgcaa

SEQ ID NO: 8304033 - DNA, 22 bp, Homo sapiens
ttagaaatacaagtgaggttga

SEQ ID NO: 8304034 - DNA, 22 bp, Homo sapiens
ttagaaaggaatcttcatttca

SEQ ID NO: 8304035 - DNA, 22 bp, Homo sapiens
ttagaaaggagcttatttcttt

SEQ ID NO: 8304036 - DNA, 22 bp, Homo sapiens
ttaggaaattatggtttcagat

SEQ ID NO: 8304037 - DNA, 22 bp, Homo sapiens
ttagggcttttctgaataggcc

SEQ ID NO: 8304038 - DNA, 22 bp, Homo sapiens
ttagtaaataaagtctactttc

SEQ ID NO: 8304039 - DNA, 22 bp, Homo sapiens
ttagtaatgtgttaatatgaat

SEQ ID NO: 8304040 - DNA, 17 bp, Homo sapiens
ttagcaaaatagcactt

SEQ ID NO: 8304041 - DNA, 22 bp, Homo sapiens
ttatgacatatgagtacaagta

SEQ ID NO: 8304042 - DNA, 22 bp, Homo sapiens
ttatgaaagacatttctgttgg

SEQ ID NO: 8304043 - DNA, 22 bp, Homo sapiens
ttatgacaggaaaatcacagaa

SEQ ID NO: 8304044 - DNA, 22 bp, Homo sapiens
ttagtcttcttccttatatgtt

SEQ ID NO: 8304045 - DNA, 22 bp, Homo sapiens
ttagtcaatagtgaatatagag

SEQ ID NO: 8304046 - DNA, 22 bp, Homo sapiens
ttacatggttgttggaaatgct

SEQ ID NO: 8304047 - DNA, 22 bp, Homo sapiens
ttacattagacccactttcatg

SEQ ID NO: 8304048 - DNA, 22 bp, Homo sapiens
ttacattttagttaacctgtga

SEQ ID NO: 8304049 - DNA, 22 bp, Homo sapiens
ttacatttggctatgtcctcta

SEQ ID NO: 8304050 - DNA, 22 bp, Homo sapiens
ttacaaagagaagttgtagaat

SEQ ID NO: 8304051 - DNA, 22 bp, Homo sapiens
ttacaaagttctgagttcaaac

SEQ ID NO: 8304052 - DNA, 22 bp, Homo sapiens
ttaataaagtatgaattggaaa

SEQ ID NO: 8304053 - DNA, 22 bp, Homo sapiens
ttaataaagtatgaattggaaa

SEQ ID NO: 8304054 - DNA, 22 bp, Homo sapiens
ttaatacagtctccagaagtaa

SEQ ID NO: 8304055 - DNA, 22 bp, Homo sapiens
ttcattcatctctaaaatgcct

SEQ ID NO: 8304056 - DNA, 22 bp, Homo sapiens
ttcattactgcggtagtcacac

SEQ ID NO: 8304057 - DNA, 22 bp, Homo sapiens
ttcattcattacgtgccaggca

SEQ ID NO: 8304058 - DNA, 22 bp, Homo sapiens
ttcaccctgagccccacctctg

SEQ ID NO: 8304059 - DNA, 22 bp, Homo sapiens
ttcagcagtgcagacacccagt

SEQ ID NO: 8304060 - DNA, 22 bp, Homo sapiens
ttcagcagtcgtccaggaaaag

SEQ ID NO: 8304061 - DNA, 21 bp, Homo sapiens
ttcagcagtcctctagagata

SEQ ID NO: 8304062 - DNA, 20 bp, Homo sapiens
ttatttctcattctcctact

SEQ ID NO: 8304063 - DNA, 22 bp, Homo sapiens
ttcacattggtgatatgtttct

SEQ ID NO: 8304064 - DNA, 19 bp, Homo sapiens
ttcacattggaagaagtag

SEQ ID NO: 8304065 - DNA, 22 bp, Homo sapiens
ttcacattgtgcagattatggt

SEQ ID NO: 8304066 - DNA, 22 bp, Homo sapiens
ttcacattgtgcagattatggt

SEQ ID NO: 8304067 - DNA, 22 bp, Homo sapiens
ttcacattggttcttgatagct

SEQ ID NO: 8304068 - DNA, 22 bp, Homo sapiens
ttcacatttgcccttatgtgtg

SEQ ID NO: 8304069 - DNA, 18 bp, Homo sapiens
ttcaccagtgtgatgggt

SEQ ID NO: 8304070 - DNA, 19 bp, Homo sapiens
tgtcttaattaactcagag

SEQ ID NO: 8304071 - DNA, 22 bp, Homo sapiens
tgtcttcctcttggcttgagct

SEQ ID NO: 8304072 - DNA, 22 bp, Homo sapiens
tgtcttcatctccatgcacaga

SEQ ID NO: 8304073 - DNA, 22 bp, Homo sapiens
tgtcttcagtaaaatacactat

SEQ ID NO: 8304074 - DNA, 22 bp, Homo sapiens
tgtcttttggagcatctttctt

SEQ ID NO: 8304075 - DNA, 22 bp, Homo sapiens
tgtcttttctactgtaagcata

SEQ ID NO: 8304076 - DNA, 22 bp, Homo sapiens
tgtctctgaacagcttactaaa

SEQ ID NO: 8304077 - DNA, 19 bp, Homo sapiens
tgtctctgaaagatgagct

SEQ ID NO: 8304078 - DNA, 18 bp, Homo sapiens
tgtctctgaattccagtg

SEQ ID NO: 8304079 - DNA, 22 bp, Homo sapiens
tgtctctgagatgactcccacc

SEQ ID NO: 8304080 - DNA, 22 bp, Homo sapiens
tgtctctgataagtagttcagt

SEQ ID NO: 8304081 - DNA, 22 bp, Homo sapiens
tgtctctgccagctagcagaat

SEQ ID NO: 8304082 - DNA, 22 bp, Homo sapiens
tgtctctgctttccttgcaggg

SEQ ID NO: 8304083 - DNA, 22 bp, Homo sapiens
tgtctgctacttggttctacca

SEQ ID NO: 8304084 - DNA, 20 bp, Homo sapiens
tgtctgctgagctgctgccc

SEQ ID NO: 8304085 - DNA, 22 bp, Homo sapiens
tgtctgctcggggttcccacct

SEQ ID NO: 8304086 - DNA, 22 bp, Homo sapiens
tgtctgagtgtgcctgggcatt

SEQ ID NO: 8304087 - DNA, 22 bp, Homo sapiens
tgtctcctcaactcatgctcga

SEQ ID NO: 8304088 - DNA, 22 bp, Homo sapiens
tgtctcctcatactgtcatatt

SEQ ID NO: 8304089 - DNA, 22 bp, Homo sapiens
tgtctcctgggtcccttccacc

SEQ ID NO: 8304090 - DNA, 18 bp, Homo sapiens
tgtctctcctttctgtgt

SEQ ID NO: 8304091 - DNA, 22 bp, Homo sapiens
tgtctagggagctgctcaggct

SEQ ID NO: 8304092 - DNA, 22 bp, Homo sapiens
tgtgatggttcactgggcatga

SEQ ID NO: 8304093 - DNA, 22 bp, Homo sapiens
tgtgacatgtgtcatcttttct

SEQ ID NO: 8304094 - DNA, 22 bp, Homo sapiens
tgtgacatcgctgtgtctgttt

SEQ ID NO: 8304095 - DNA, 22 bp, Homo sapiens
tgtgacagatctttaaataatg

SEQ ID NO: 8304096 - DNA, 22 bp, Homo sapiens
tgtgaaagtcaaattaattgaa

SEQ ID NO: 8304097 - DNA, 22 bp, Homo sapiens
tgtgaaaggagccatagacagt

SEQ ID NO: 8304098 - DNA, 22 bp, Homo sapiens
tgtgaaaggggtcacagggaaa

SEQ ID NO: 8304099 - DNA, 22 bp, Homo sapiens
tgtgaaagatactaggcagagg

SEQ ID NO: 8304100 - DNA, 22 bp, Homo sapiens
tgtgcagctagtcctggacttg

SEQ ID NO: 8304101 - DNA, 22 bp, Homo sapiens
tgtgcagggaagggcatgctat

SEQ ID NO: 8304102 - DNA, 22 bp, Homo sapiens
tgtgcagtttctatgttgtcca

SEQ ID NO: 8304103 - DNA, 22 bp, Homo sapiens
tgtgctctggagttgccttcac

SEQ ID NO: 8304104 - DNA, 22 bp, Homo sapiens
tgtgccttctcagtcctgctca

SEQ ID NO: 8304105 - DNA, 22 bp, Homo sapiens
tgtgcctgtcaccctcagagag

SEQ ID NO: 8304106 - DNA, 22 bp, Homo sapiens
tgtgcctgagttggctgagtac

SEQ ID NO: 8304107 - DNA, 22 bp, Homo sapiens
tgtgcctggcattctgggcttc

SEQ ID NO: 8304108 - DNA, 22 bp, Homo sapiens
tgtgcctggcattctgggcttc

SEQ ID NO: 8304109 - DNA, 22 bp, Homo sapiens
tgtgcctggatctctgtgacaa

SEQ ID NO: 8304110 - DNA, 22 bp, Homo sapiens
tgtgtgccagcctacgaggagc

SEQ ID NO: 8304111 - DNA, 22 bp, Homo sapiens
tgtgtgcctgagccgtgcctgg

SEQ ID NO: 8304112 - DNA, 22 bp, Homo sapiens
tgtgtgcattcacatgcatgcc

SEQ ID NO: 8304113 - DNA, 22 bp, Homo sapiens
tgtgtcagaggtagagatggca

SEQ ID NO: 8304114 - DNA, 22 bp, Homo sapiens
tgtgtacttgaaagggcaggtc

SEQ ID NO: 8304115 - DNA, 22 bp, Homo sapiens
tgtgtattaccattttacagct

SEQ ID NO: 8304116 - DNA, 22 bp, Homo sapiens
tgtgtattcagcaagcgaaaca

SEQ ID NO: 8304117 - DNA, 22 bp, Homo sapiens
tgtgtatttctggaacagacta

SEQ ID NO: 8304118 - DNA, 21 bp, Homo sapiens
tgtgtcactaactagaggcta

SEQ ID NO: 8304119 - DNA, 22 bp, Homo sapiens
tgtgtcagaaggcaatggggat

SEQ ID NO: 8304120 - DNA, 22 bp, Homo sapiens
tgtgtacaagagtgtttactgt

SEQ ID NO: 8304121 - DNA, 22 bp, Homo sapiens
tgtgtacatatctatcctagat

SEQ ID NO: 8304122 - DNA, 22 bp, Homo sapiens
tgtgtactcaattgagccattt

SEQ ID NO: 8304123 - DNA, 22 bp, Homo sapiens
tgtgtacaggccttgctagact

SEQ ID NO: 8304124 - DNA, 22 bp, Homo sapiens
tgtgtacagcaggatttctcaa

SEQ ID NO: 8304125 - DNA, 22 bp, Homo sapiens
tgtgtacaggccttgctagact

SEQ ID NO: 8304126 - DNA, 22 bp, Homo sapiens
tgtgtacacaatgattgcagag

SEQ ID NO: 8304127 - DNA, 22 bp, Homo sapiens
tgtgggctccccctcactctgt

SEQ ID NO: 8304128 - DNA, 22 bp, Homo sapiens
tgtgggcaggcccgggtctgag

SEQ ID NO: 8304129 - DNA, 22 bp, Homo sapiens
tgtggctgactcctggtcccca

SEQ ID NO: 8304130 - DNA, 22 bp, Homo sapiens
tgtggctctcagatcctccaat

SEQ ID NO: 8304131 - DNA, 22 bp, Homo sapiens
tgtggctctcagatcctccaat

SEQ ID NO: 8304132 - DNA, 22 bp, Homo sapiens
tgtggctctcatgcactcccag

SEQ ID NO: 8304133 - DNA, 22 bp, Homo sapiens
tgtggccttgcagcctggaggt

SEQ ID NO: 8304134 - DNA, 22 bp, Homo sapiens
tgtttataccttggtataacca

SEQ ID NO: 8304135 - DNA, 22 bp, Homo sapiens
tgtttaagctgatgaggtatcg

SEQ ID NO: 8304136 - DNA, 19 bp, Homo sapiens
tgttggtgcggatgtggag

SEQ ID NO: 8304137 - DNA, 22 bp, Homo sapiens
tgttaacatcttggactcgtga

SEQ ID NO: 8304138 - DNA, 22 bp, Homo sapiens
tgttaaatgttcctttactgga

SEQ ID NO: 8304139 - DNA, 22 bp, Homo sapiens
tgttacttatctcacgtgatgc

SEQ ID NO: 8304140 - DNA, 22 bp, Homo sapiens
tgttcttgagcctttagaccta

SEQ ID NO: 8304141 - DNA, 16 bp, Homo sapiens
tgttagctgtgcatta

SEQ ID NO: 8304142 - DNA, 22 bp, Homo sapiens
tgtttgttccctctctttcctg

SEQ ID NO: 8304143 - DNA, 22 bp, Homo sapiens
tgttttatttctccaagaggga

SEQ ID NO: 8304144 - DNA, 22 bp, Homo sapiens
tgttttatgagccatataacct

SEQ ID NO: 8304145 - DNA, 22 bp, Homo sapiens
ttaaaatgcagattctgattca

SEQ ID NO: 8304146 - DNA, 22 bp, Homo sapiens
ttaaaaccatcagctgtaagat

SEQ ID NO: 8304147 - DNA, 22 bp, Homo sapiens
ttaaacagtcccagaggctgac

SEQ ID NO: 8304148 - DNA, 22 bp, Homo sapiens
ttaaacagtgtttcatgtgggg

SEQ ID NO: 8304149 - DNA, 22 bp, Homo sapiens
ttaaacagagtctgaaatgtaa

SEQ ID NO: 8304150 - DNA, 22 bp, Homo sapiens
ttaaacaggtttttgaatggcc

SEQ ID NO: 8304151 - DNA, 22 bp, Homo sapiens
ttaaacagacagtaaatgaaac

SEQ ID NO: 8304152 - DNA, 22 bp, Homo sapiens
aagttttaacaagtacttacta

SEQ ID NO: 8304153 - DNA, 22 bp, Homo sapiens
aataaatgttaagattgtctca

SEQ ID NO: 8304154 - DNA, 22 bp, Homo sapiens
acctgggagtcacacctgagaa

SEQ ID NO: 8304155 - DNA, 20 bp, Homo sapiens
accttgaacccgccagccat

SEQ ID NO: 8304156 - DNA, 18 bp, Homo sapiens
acctgcctgttcttctct

SEQ ID NO: 8304157 - DNA, 18 bp, Homo sapiens
acctgcctgttcttctct

SEQ ID NO: 8304158 - DNA, 22 bp, Homo sapiens
aagtaacaatgctgttgaattg

SEQ ID NO: 8304159 - DNA, 18 bp, Homo sapiens
aagtaacagaagagcaca

SEQ ID NO: 8304160 - DNA, 21 bp, Homo sapiens
aagtaaatcagagaaataacc

SEQ ID NO: 8304161 - DNA, 22 bp, Homo sapiens
aagtgagtggcctggagaggtg

SEQ ID NO: 8304162 - DNA, 22 bp, Homo sapiens
aagtgagattatatgtacggga

SEQ ID NO: 8304163 - DNA, 22 bp, Homo sapiens
aagtgacaaaagggtatccaaa

SEQ ID NO: 8304164 - DNA, 22 bp, Homo sapiens
aagtgacacatggcacttctat

SEQ ID NO: 8304165 - DNA, 22 bp, Homo sapiens
aagtgacacctcttccctttcc

SEQ ID NO: 8304166 - DNA, 22 bp, Homo sapiens
aatatgttcaaaatagatcact

SEQ ID NO: 8304167 - DNA, 22 bp, Homo sapiens
aatatgcatgtatacatgtgta

SEQ ID NO: 8304168 - DNA, 22 bp, Homo sapiens
aatatgtgaggtatgttcagtg

SEQ ID NO: 8304169 - DNA, 21 bp, Homo sapiens
agaaaatggcgttttagattt

SEQ ID NO: 8304170 - DNA, 22 bp, Homo sapiens
aatctttccctattaaatgtgg

SEQ ID NO: 8304171 - DNA, 22 bp, Homo sapiens
actgtgctttctctggaggcat

SEQ ID NO: 8304172 - DNA, 22 bp, Homo sapiens
aataacaggctcatcagatgct

SEQ ID NO: 8304173 - DNA, 22 bp, Homo sapiens
actgtctgcaaaactcatactc

SEQ ID NO: 8304174 - DNA, 22 bp, Homo sapiens
actgtctgccctgagatgccag

SEQ ID NO: 8304175 - DNA, 22 bp, Homo sapiens
acttagtatttttcagctttga

SEQ ID NO: 8304176 - DNA, 22 bp, Homo sapiens
acttcctgcagcttctcagccc

SEQ ID NO: 8304177 - DNA, 22 bp, Homo sapiens
acttcctgcaatcgtccactcc

SEQ ID NO: 8304178 - DNA, 19 bp, Homo sapiens
acaggcagaattgggtgtg

SEQ ID NO: 8304179 - DNA, 20 bp, Homo sapiens
acaggagatctgaggaaagg

SEQ ID NO: 8304180 - DNA, 22 bp, Homo sapiens
acagcttgcaatggctttcaac

SEQ ID NO: 8304181 - DNA, 22 bp, Homo sapiens
acagcttttcaattctgctgag

SEQ ID NO: 8304182 - DNA, 22 bp, Homo sapiens
acaggcttctcacagaaaaggg

SEQ ID NO: 8304183 - DNA, 22 bp, Homo sapiens
acaggcttacaggctgcaagta

SEQ ID NO: 8304184 - DNA, 22 bp, Homo sapiens
acaggctgacttcctgccatgt

SEQ ID NO: 8304185 - DNA, 22 bp, Homo sapiens
acaggcttttttagaatgacat

SEQ ID NO: 8304186 - DNA, 21 bp, Homo sapiens
acaggctttagaaaatgactc

SEQ ID NO: 8304187 - DNA, 22 bp, Homo sapiens
acaggtgacctgctcatatgaa

SEQ ID NO: 8304188 - DNA, 22 bp, Homo sapiens
acaggtgtgagaacatgccttg

SEQ ID NO: 8304189 - DNA, 22 bp, Homo sapiens
acaggtgattcaggctctggga

SEQ ID NO: 8304190 - DNA, 22 bp, Homo sapiens
acagtgtccttgtggtccctgt

SEQ ID NO: 8304191 - DNA, 22 bp, Homo sapiens
acagtgtcatgtcgtgttcccc

SEQ ID NO: 8304192 - DNA, 22 bp, Homo sapiens
aagggcagcctgactcacggtc

SEQ ID NO: 8304193 - DNA, 22 bp, Homo sapiens
aagggcagctattatcgtcatc

SEQ ID NO: 8304194 - DNA, 22 bp, Homo sapiens
aagggcagctgacagatgctta

SEQ ID NO: 8304195 - DNA, 22 bp, Homo sapiens
aagggcagcttaaattggtagc

SEQ ID NO: 8304196 - DNA, 22 bp, Homo sapiens
aagtaaaagctttaccatgcgc

SEQ ID NO: 8304197 - DNA, 22 bp, Homo sapiens
aaggtgtcactgggacaggaaa

SEQ ID NO: 8304198 - DNA, 22 bp, Homo sapiens
accagctgtgtcctggctgcag

SEQ ID NO: 8304199 - DNA, 22 bp, Homo sapiens
acatactatgaatacatgtgtc

SEQ ID NO: 8304200 - DNA, 18 bp, Homo sapiens
acatacattctgtctgca

SEQ ID NO: 8304201 - DNA, 22 bp, Homo sapiens
acatactttttaaaagattgct

SEQ ID NO: 8304202 - DNA, 22 bp, Homo sapiens
acatgcattctctaaaagcaaa

SEQ ID NO: 8304203 - DNA, 22 bp, Homo sapiens
acattatccctggcacaactgc

SEQ ID NO: 8304204 - DNA, 22 bp, Homo sapiens
acattctctccatgtcttcttt

SEQ ID NO: 8304205 - DNA, 22 bp, Homo sapiens
aaggccagcttgtagggctggt

SEQ ID NO: 8304206 - DNA, 22 bp, Homo sapiens
aaggccaggacaccaggggact

SEQ ID NO: 8304207 - DNA, 22 bp, Homo sapiens
acagaactgggaaatgcacata

SEQ ID NO: 8304208 - DNA, 21 bp, Homo sapiens
acagaactgtatagtgataaa

SEQ ID NO: 8304209 - DNA, 22 bp, Homo sapiens
acagaactgcaggaggaaaagc

SEQ ID NO: 8304210 - DNA, 18 bp, Homo sapiens
acagaactcaggggcacc

SEQ ID NO: 8304211 - DNA, 21 bp, Homo sapiens
acagacagggccagtgtcccc

SEQ ID NO: 8304212 - DNA, 22 bp, Homo sapiens
agcattgcctgcctattgctaa

SEQ ID NO: 8304213 - DNA, 22 bp, Homo sapiens
agccaggaattggacaacacat

SEQ ID NO: 8304214 - DNA, 22 bp, Homo sapiens
agccaggaatgcatgctctgct

SEQ ID NO: 8304215 - DNA, 22 bp, Homo sapiens
agcatctggtcatgagtgagaa

SEQ ID NO: 8304216 - DNA, 22 bp, Homo sapiens
agcatctggtgagggcctagtt

SEQ ID NO: 8304217 - DNA, 22 bp, Homo sapiens
agcctgtgttgctctggcgata

SEQ ID NO: 8304218 - DNA, 22 bp, Homo sapiens
agcctgtgtgctttggacaggg

SEQ ID NO: 8304219 - DNA, 22 bp, Homo sapiens
agcctgtggatccctgcactgg

SEQ ID NO: 8304220 - DNA, 22 bp, Homo sapiens
agcctgtggaaactgggtgcag

SEQ ID NO: 8304221 - DNA, 22 bp, Homo sapiens
agcctgtgagggatgctgcagt

SEQ ID NO: 8304222 - DNA, 22 bp, Homo sapiens
agcctgtctgtctccaaagctg

SEQ ID NO: 8304223 - DNA, 22 bp, Homo sapiens
agcctggctgtaacctcatggt

SEQ ID NO: 8304224 - DNA, 22 bp, Homo sapiens
agctcagggcgatctgtctcgg

SEQ ID NO: 8304225 - DNA, 22 bp, Homo sapiens
agctcatggtgctatctcaggg

SEQ ID NO: 8304226 - DNA, 22 bp, Homo sapiens
agcctggcctgggcaggcacat

SEQ ID NO: 8304227 - DNA, 21 bp, Homo sapiens
agcctggcccagggggaggct

SEQ ID NO: 8304228 - DNA, 22 bp, Homo sapiens
agcctggccctgctgaactctg

SEQ ID NO: 8304229 - DNA, 22 bp, Homo sapiens
agcactttcctggcaaatgtgg

SEQ ID NO: 8304230 - DNA, 22 bp, Homo sapiens
agatttcctgcactgcctttga

SEQ ID NO: 8304231 - DNA, 22 bp, Homo sapiens
agatttcccactccatgtattg

SEQ ID NO: 8304232 - DNA, 22 bp, Homo sapiens
agatttccctcttgtatttgca

SEQ ID NO: 8304233 - DNA, 22 bp, Homo sapiens
agatttcccaaatacttgttat

SEQ ID NO: 8304234 - DNA, 22 bp, Homo sapiens
agcagaaccacagcactgttga

SEQ ID NO: 8304235 - DNA, 21 bp, Homo sapiens
agcagaacagtcgagcactgc

SEQ ID NO: 8304236 - DNA, 22 bp, Homo sapiens
agcagaacattttcagggctgt

SEQ ID NO: 8304237 - DNA, 22 bp, Homo sapiens
agcagcaacttatttttcttat

SEQ ID NO: 8304238 - DNA, 22 bp, Homo sapiens
agcagccaggaatctgcagagc

SEQ ID NO: 8304239 - DNA, 22 bp, Homo sapiens
agcagccagtgggagtgataca

SEQ ID NO: 8304240 - DNA, 22 bp, Homo sapiens
agcagccaggaatctgcagagc

SEQ ID NO: 8304241 - DNA, 16 bp, Homo sapiens
agcagccagcactgga

SEQ ID NO: 8304242 - DNA, 22 bp, Homo sapiens
agcagccagagtctgaacatta

SEQ ID NO: 8304243 - DNA, 23 bp, Homo sapiens
agcagccagagatcctcggccct

SEQ ID NO: 8304244 - DNA, 22 bp, Homo sapiens
acacagaacctcatagcctctc

SEQ ID NO: 8304245 - DNA, 22 bp, Homo sapiens
agcaggtgacagggctgtggtg

SEQ ID NO: 8304246 - DNA, 22 bp, Homo sapiens
agcaggtgaattcctggatgtg

SEQ ID NO: 8304247 - DNA, 22 bp, Homo sapiens
agcaggtgacccaagcaggctg

SEQ ID NO: 8304248 - DNA, 19 bp, Homo sapiens
agcatccagtcatgggatc

SEQ ID NO: 8304249 - DNA, 22 bp, Homo sapiens
agcagggcttctgtgcctgtgc

SEQ ID NO: 8304250 - DNA, 22 bp, Homo sapiens
agcagggcttgccgcttgtcct

SEQ ID NO: 8304251 - DNA, 22 bp, Homo sapiens
agcagggctttgcagacttggg

SEQ ID NO: 8304252 - DNA, 22 bp, Homo sapiens
agcagctgaccagtgagtcctg

SEQ ID NO: 8304253 - DNA, 17 bp, Homo sapiens
agcagctgaagcagcca

SEQ ID NO: 8304254 - DNA, 22 bp, Homo sapiens
agcagctctgagaggccagcac

SEQ ID NO: 8304255 - DNA, 22 bp, Homo sapiens
agcagctcctgccatgagtgct

SEQ ID NO: 8304256 - DNA, 22 bp, Homo sapiens
agcagctctgtttacctggagg

SEQ ID NO: 8304257 - DNA, 22 bp, Homo sapiens
agcagctcttaacaaagcatgg

SEQ ID NO: 8304258 - DNA, 22 bp, Homo sapiens
agcagctctggcactgtagcat

SEQ ID NO: 8304259 - DNA, 22 bp, Homo sapiens
agcagctctggcactgtagcat

SEQ ID NO: 8304260 - DNA, 22 bp, Homo sapiens
agcagccatccttagagaaaga

SEQ ID NO: 8304261 - DNA, 22 bp, Homo sapiens
agcagccatagatagcatgcaa

SEQ ID NO: 8304262 - DNA, 22 bp, Homo sapiens
agcagccatagatagcatgcaa

SEQ ID NO: 8304263 - DNA, 23 bp, Homo sapiens
agcagccatagggaagcaataca

SEQ ID NO: 8304264 - DNA, 22 bp, Homo sapiens
agcagccatagatagcatgcaa

SEQ ID NO: 8304265 - DNA, 19 bp, Homo sapiens
agcagccatagacaatatg

SEQ ID NO: 8304266 - DNA, 22 bp, Homo sapiens
agcagccagttctctgtggtag

SEQ ID NO: 8304267 - DNA, 21 bp, Homo sapiens
agcagccatttcacagagact

SEQ ID NO: 8304268 - DNA, 19 bp, Homo sapiens
agcagccatcgaccatgga

SEQ ID NO: 8304269 - DNA, 19 bp, Homo sapiens
agcagccatcgaccatgga

SEQ ID NO: 8304270 - DNA, 22 bp, Homo sapiens
agcagccatttaaaatgaattg

SEQ ID NO: 8304271 - DNA, 21 bp, Homo sapiens
agcagccatggatggtatgta

SEQ ID NO: 8304272 - DNA, 21 bp, Homo sapiens
agcaggaggcagtcacagctc

SEQ ID NO: 8304273 - DNA, 22 bp, Homo sapiens
agcaggagggttttgtagagtc

SEQ ID NO: 8304274 - DNA, 22 bp, Homo sapiens
agcaggagggttttgtagagtc

SEQ ID NO: 8304275 - DNA, 22 bp, Homo sapiens
agcaggagtgtcccctggctgt

SEQ ID NO: 8304276 - DNA, 22 bp, Homo sapiens
agcaggagcccttatcaccagg

SEQ ID NO: 8304277 - DNA, 22 bp, Homo sapiens
agcagctgagatggtaagattc

SEQ ID NO: 8304278 - DNA, 22 bp, Homo sapiens
agcaggagctgtgggaagatgg

SEQ ID NO: 8304279 - DNA, 22 bp, Homo sapiens
agagcaggcataaagctttgaa

SEQ ID NO: 8304280 - DNA, 23 bp, Homo sapiens
agaggccaacttcttgcccctcc

SEQ ID NO: 8304281 - DNA, 22 bp, Homo sapiens
agaggcagtatacaatccgagc

SEQ ID NO: 8304282 - DNA, 18 bp, Homo sapiens
agagcagcggcatcacac

SEQ ID NO: 8304283 - DNA, 22 bp, Homo sapiens
agagggcccatgttgggctgct

SEQ ID NO: 8304284 - DNA, 22 bp, Homo sapiens
agagggcccatgttgggctgct

SEQ ID NO: 8304285 - DNA, 22 bp, Homo sapiens
agagggcattaactctgtcttg

SEQ ID NO: 8304286 - DNA, 22 bp, Homo sapiens
aatttcaagtcttgaagaagta

SEQ ID NO: 8304287 - DNA, 22 bp, Homo sapiens
aatttcaaactaataggaacca

SEQ ID NO: 8304288 - DNA, 22 bp, Homo sapiens
aatttcaatgcactcatggttg

SEQ ID NO: 8304289 - DNA, 20 bp, Homo sapiens
agagtaactggcacataggg

SEQ ID NO: 8304290 - DNA, 21 bp, Homo sapiens
agagtctgcatttctgacaag

SEQ ID NO: 8304291 - DNA, 22 bp, Homo sapiens
agagtgaaggttgacacttcac

SEQ ID NO: 8304292 - DNA, 22 bp, Homo sapiens
agagtgaaggccaggttacagt

SEQ ID NO: 8304293 - DNA, 22 bp, Homo sapiens
agagtcttccaggcagcctgag

SEQ ID NO: 8304294 - DNA, 22 bp, Homo sapiens
agagtgaaaagctagagcagta

SEQ ID NO: 8304295 - DNA, 22 bp, Homo sapiens
agatctcacctctgtgtattat

SEQ ID NO: 8304296 - DNA, 22 bp, Homo sapiens
agatatgactagaagctcattt

SEQ ID NO: 8304297 - DNA, 22 bp, Homo sapiens
agagatatgagtagttgtgaca

SEQ ID NO: 8304298 - DNA, 17 bp, Homo sapiens
agagagagcatgccacc

SEQ ID NO: 8304299 - DNA, 22 bp, Homo sapiens
agagacagggttttgccatgtt

SEQ ID NO: 8304300 - DNA, 22 bp, Homo sapiens
agagacagggttttgccatgtt

SEQ ID NO: 8304301 - DNA, 22 bp, Homo sapiens
agaataaatcaaatgtcctgag

SEQ ID NO: 8304302 - DNA, 22 bp, Homo sapiens
aatgctgtaaagatgctatctg

SEQ ID NO: 8304303 - DNA, 22 bp, Homo sapiens
aatggacaggagagcatagtca

SEQ ID NO: 8304304 - DNA, 19 bp, Homo sapiens
aatgtagtgttatgtcaac

SEQ ID NO: 8304305 - DNA, 22 bp, Homo sapiens
aatgtataaagtgttaataact

SEQ ID NO: 8304306 - DNA, 22 bp, Homo sapiens
agaatttttgattatctactcg

SEQ ID NO: 8304307 - DNA, 22 bp, Homo sapiens
agaattgtaagcaatttgatta

SEQ ID NO: 8304308 - DNA, 22 bp, Homo sapiens
agaattgttggggtaataaaag

SEQ ID NO: 8304309 - DNA, 23 bp, Homo sapiens
agaattgtaaatagaatatacct

SEQ ID NO: 8304310 - DNA, 22 bp, Homo sapiens
agaatcctgatgaaaaggagag

SEQ ID NO: 8304311 - DNA, 20 bp, Homo sapiens
agaatctgacccagagagac

SEQ ID NO: 8304312 - DNA, 22 bp, Homo sapiens
aagaatgttcattaaactgttg

SEQ ID NO: 8304313 - DNA, 22 bp, Homo sapiens
aagaatgttagtttctgataca

SEQ ID NO: 8304314 - DNA, 22 bp, Homo sapiens
aagaatgttagtttctgataca

SEQ ID NO: 8304315 - DNA, 22 bp, Homo sapiens
aagaatgttcttgtagtcatga

SEQ ID NO: 8304316 - DNA, 22 bp, Homo sapiens
aagacagaccacgtgacagggc

SEQ ID NO: 8304317 - DNA, 17 bp, Homo sapiens
aagacagaagccatgag

SEQ ID NO: 8304318 - DNA, 20 bp, Homo sapiens
aagagcatagtacaggaaga

SEQ ID NO: 8304319 - DNA, 22 bp, Homo sapiens
aagacagagggaagcaatgatg

SEQ ID NO: 8304320 - DNA, 22 bp, Homo sapiens
aagaggaagtctccatggagag

SEQ ID NO: 8304321 - DNA, 22 bp, Homo sapiens
aagagcatattaatagtggaga

SEQ ID NO: 8304322 - DNA, 22 bp, Homo sapiens
aagaatgtgggtggatatgatg

SEQ ID NO: 8304323 - DNA, 22 bp, Homo sapiens
aagaatgtgggtggatatgatg

SEQ ID NO: 8304324 - DNA, 22 bp, Homo sapiens
aagaatgtcgttggtattttaa

SEQ ID NO: 8304325 - DNA, 22 bp, Homo sapiens
aagaatgtcgttggtattttaa

SEQ ID NO: 8304326 - DNA, 22 bp, Homo sapiens
aagcagcataattgctatttta

SEQ ID NO: 8304327 - DNA, 22 bp, Homo sapiens
aagcagcagacctgattttgaa

SEQ ID NO: 8304328 - DNA, 22 bp, Homo sapiens
aagcagcacagtaatattggtg

SEQ ID NO: 8304329 - DNA, 22 bp, Homo sapiens
aagccagatagaagaactcatt

SEQ ID NO: 8304330 - DNA, 18 bp, Homo sapiens
aagccagagaccactgcc

SEQ ID NO: 8304331 - DNA, 22 bp, Homo sapiens
aagcacttagaagagtgcctgc

SEQ ID NO: 8304332 - DNA, 22 bp, Homo sapiens
aagcagaaaaactgagctccaa

SEQ ID NO: 8304333 - DNA, 22 bp, Homo sapiens
aagcagatgggactccaaggca

SEQ ID NO: 8304334 - DNA, 22 bp, Homo sapiens
aagcaaagagtttagtgggtga

SEQ ID NO: 8304335 - DNA, 18 bp, Homo sapiens
aagaggaggagcaggttg

SEQ ID NO: 8304336 - DNA, 22 bp, Homo sapiens
aagattctcagagtgaaagaat

SEQ ID NO: 8304337 - DNA, 22 bp, Homo sapiens
aactcagtcataaagcgaatgc

SEQ ID NO: 8304338 - DNA, 22 bp, Homo sapiens
aactcagcatcctgcacagaga

SEQ ID NO: 8304339 - DNA, 21 bp, Homo sapiens
aacatttctgggagaactcac

SEQ ID NO: 8304340 - DNA, 22 bp, Homo sapiens
aacagtatcttttatcagaaat

SEQ ID NO: 8304341 - DNA, 22 bp, Homo sapiens
aacagtgagaaggtggacagga

SEQ ID NO: 8304342 - DNA, 22 bp, Homo sapiens
aacagtaatgtggtgttgggtt

SEQ ID NO: 8304343 - DNA, 22 bp, Homo sapiens
aacagctttgcttctggagaca

SEQ ID NO: 8304344 - DNA, 22 bp, Homo sapiens
aacacaaagaagctgcaggatc

SEQ ID NO: 8304345 - DNA, 22 bp, Homo sapiens
aaatggtaagacaacacattat

SEQ ID NO: 8304346 - DNA, 22 bp, Homo sapiens
aaatggtatttactctgtatta

SEQ ID NO: 8304347 - DNA, 22 bp, Homo sapiens
aacaaatgtgttttgtaattaa

SEQ ID NO: 8304348 - DNA, 22 bp, Homo sapiens
aacaactgaaaagctttttctg

SEQ ID NO: 8304349 - DNA, 22 bp, Homo sapiens
aaactgtaaacacagcagtaca

SEQ ID NO: 8304350 - DNA, 22 bp, Homo sapiens
aaacatgagcatctcttcaagc

SEQ ID NO: 8304351 - DNA, 22 bp, Homo sapiens
aaactttaagacagtcctcaag

SEQ ID NO: 8304352 - DNA, 22 bp, Homo sapiens
aaagaaggacctggaggaggat

SEQ ID NO: 8304353 - DNA, 18 bp, Homo sapiens
aaagaaggattggagagc

SEQ ID NO: 8304354 - DNA, 22 bp, Homo sapiens
aaaaatgaaacggctggttggc

SEQ ID NO: 8304355 - DNA, 22 bp, Homo sapiens
aaaaagatgtcctgaagtttag

SEQ ID NO: 8304356 - DNA, 22 bp, Homo sapiens
aaaaactgtaattacttttgca

SEQ ID NO: 8304357 - DNA, 22 bp, Homo sapiens
aaaaatgcttggacttaataaa

SEQ ID NO: 8304358 - DNA, 22 bp, Homo sapiens
aaaaatgctgtggtagctgtgt

SEQ ID NO: 8304359 - DNA, 22 bp, Homo sapiens
aaaaatgaattcttcagtggca

SEQ ID NO: 8304360 - DNA, 22 bp, Homo sapiens
aaaaatgtcattatggaactga

SEQ ID NO: 8304361 - DNA, 22 bp, Homo sapiens
aaaagtcagtctctcctagctc

SEQ ID NO: 8304362 - DNA, 22 bp, Homo sapiens
aaaagtgtccagattatgaaga

SEQ ID NO: 8304363 - DNA, 22 bp, Homo sapiens
aaagcaatgatggtagacacgt

SEQ ID NO: 8304364 - DNA, 22 bp, Homo sapiens
aaagatgtcatacacattaaga

SEQ ID NO: 8304365 - DNA, 18 bp, Homo sapiens
aaatgctaggctacatga

SEQ ID NO: 8304366 - DNA, 22 bp, Homo sapiens
aaatgcctctgctgtacacaat

SEQ ID NO: 8304367 - DNA, 22 bp, Homo sapiens
aaatcagtgctcatttgaaagg

SEQ ID NO: 8304368 - DNA, 22 bp, Homo sapiens
aaatcagtccctcttggaattt

SEQ ID NO: 8304369 - DNA, 22 bp, Homo sapiens
aaatcagttcacgttctgaggt

SEQ ID NO: 8304370 - DNA, 22 bp, Homo sapiens
aaatcagttaagatgaggccat

SEQ ID NO: 8304371 - DNA, 22 bp, Homo sapiens
aaatcagttagtggtaggattg

SEQ ID NO: 8304372 - DNA, 22 bp, Homo sapiens
aaatcagttctccctttcttca

SEQ ID NO: 8304373 - DNA, 22 bp, Homo sapiens
aaatcagttggaacacaagcag

SEQ ID NO: 8304374 - DNA, 22 bp, Homo sapiens
aaatcagttgttatattaaaga

SEQ ID NO: 8304375 - DNA, 22 bp, Homo sapiens
aaatatgtaagattagcactag

SEQ ID NO: 8304376 - DNA, 22 bp, Homo sapiens
aaatatgtatggagttcatgaa

SEQ ID NO: 8304377 - DNA, 22 bp, Homo sapiens
aacatttatggtagtcattgca

SEQ ID NO: 8304378 - DNA, 22 bp, Homo sapiens
aatcagaaaattcagtggaatt

SEQ ID NO: 8304379 - DNA, 23 bp, Homo sapiens
aaccagataaatggctccagggc

SEQ ID NO: 8304380 - DNA, 22 bp, Homo sapiens
aaccaggacaatttgaatagaa

SEQ ID NO: 8304381 - DNA, 22 bp, Homo sapiens
aaccaggacaattttgaaagta

SEQ ID NO: 8304382 - DNA, 22 bp, Homo sapiens
aactcagttctttccacaatgc

SEQ ID NO: 8304383 - DNA, 22 bp, Homo sapiens
aactcagtgtgtttcttagtat

SEQ ID NO: 8304384 - DNA, 22 bp, Homo sapiens
aactcagttacatattagaata

SEQ ID NO: 8304385 - DNA, 22 bp, Homo sapiens
aagttgaagcatgaaccaaggt

SEQ ID NO: 8304386 - DNA, 22 bp, Homo sapiens
aagttgaatgcgtacgtgacat

SEQ ID NO: 8304387 - DNA, 22 bp, Homo sapiens
aagtttgagagcctttagtata

SEQ ID NO: 8304388 - DNA, 22 bp, Homo sapiens
aagtttgagaagcttatagata

SEQ ID NO: 8304389 - DNA, 22 bp, Homo sapiens
aagtttgacagaagtttctaat

SEQ ID NO: 8304390 - DNA, 22 bp, Homo sapiens
aataaactgctcaattgcatca

SEQ ID NO: 8304391 - DNA, 22 bp, Homo sapiens
aagccagccagtgccagtctta

SEQ ID NO: 8304392 - DNA, 22 bp, Homo sapiens
aagccagcattttcccattcct

SEQ ID NO: 8304393 - DNA, 22 bp, Homo sapiens
aagccagccagtgccagtctta

SEQ ID NO: 8304394 - DNA, 22 bp, Homo sapiens
aagctggcaattatcaaaactg

SEQ ID NO: 8304395 - DNA, 21 bp, Homo sapiens
aaggaaaagcttggtctctga

SEQ ID NO: 8304396 - DNA, 21 bp, Homo sapiens
aaggaaaagcttggtctctga

SEQ ID NO: 8304397 - DNA, 22 bp, Homo sapiens
aaattgttgatctacagtaagg

SEQ ID NO: 8304398 - DNA, 22 bp, Homo sapiens
aaatttaagaagtgtgtgcgtg

SEQ ID NO: 8304399 - DNA, 22 bp, Homo sapiens
aaggagaaatggtagatgtgca

SEQ ID NO: 8304400 - DNA, 22 bp, Homo sapiens
aaggactccaattctttcatct

SEQ ID NO: 8304401 - DNA, 22 bp, Homo sapiens
aacaaatgtgtggcagtgtggg

SEQ ID NO: 8304402 - DNA, 22 bp, Homo sapiens
aagggagacagttgtgtgagga

SEQ ID NO: 8304403 - DNA, 22 bp, Homo sapiens
aagtatgacatttaagacaatt

SEQ ID NO: 8304404 - DNA, 23 bp, Homo sapiens
aacaataggttttggcagaatag

SEQ ID NO: 8304405 - DNA, 21 bp, Homo sapiens
aagggagataggaatcaggcc

SEQ ID NO: 8304406 - DNA, 22 bp, Homo sapiens
aagggaggaggatttattgtac

SEQ ID NO: 8304407 - DNA, 22 bp, Homo sapiens
aagcaaaaggttacacttctgg

SEQ ID NO: 8304408 - DNA, 22 bp, Homo sapiens
acagaagagcacatttagtatg

SEQ ID NO: 8304409 - DNA, 22 bp, Homo sapiens
aagatactgatgatgtaggcta

SEQ ID NO: 8304410 - DNA, 18 bp, Homo sapiens
acagaggcagacatgtat

SEQ ID NO: 8304411 - DNA, 22 bp, Homo sapiens
acagaggaaggctgagctgccc

SEQ ID NO: 8304412 - DNA, 22 bp, Homo sapiens
aagcaaacaggagaagagctgt

SEQ ID NO: 8304413 - DNA, 22 bp, Homo sapiens
acagagcacatagattggagtt

SEQ ID NO: 8304414 - DNA, 22 bp, Homo sapiens
acagagcttcccagcctgagca

SEQ ID NO: 8304415 - DNA, 22 bp, Homo sapiens
acagagcttaggatgactccca

SEQ ID NO: 8304416 - DNA, 22 bp, Homo sapiens
acagagcttaattcaggagctt

SEQ ID NO: 8304417 - DNA, 22 bp, Homo sapiens
acacacaggtaaaggagcctgg

SEQ ID NO: 8304418 - DNA, 22 bp, Homo sapiens
aagaggtcataccagataaggg

SEQ ID NO: 8304419 - DNA, 22 bp, Homo sapiens
aagaggtagcagtcacaaaaga

SEQ ID NO: 8304420 - DNA, 22 bp, Homo sapiens
aagacatttatttgaatcaatt

SEQ ID NO: 8304421 - DNA, 22 bp, Homo sapiens
aagagttaagcaacagatacca

SEQ ID NO: 8304422 - DNA, 22 bp, Homo sapiens
aagaggttgtctgtgatgagtt

SEQ ID NO: 8304423 - DNA, 22 bp, Homo sapiens
aattagagatcagttctttgac

SEQ ID NO: 8304424 - DNA, 22 bp, Homo sapiens
aagaattattgcaatactagat

SEQ ID NO: 8304425 - DNA, 22 bp, Homo sapiens
aagaattcactggtagagtcaa

SEQ ID NO: 8304426 - DNA, 22 bp, Homo sapiens
aagaattattgcaatactagat

SEQ ID NO: 8304427 - DNA, 22 bp, Homo sapiens
aagacaagcatcaaatcaggca

SEQ ID NO: 8304428 - DNA, 22 bp, Homo sapiens
aatgtacaataagacaaagagg

SEQ ID NO: 8304429 - DNA, 22 bp, Homo sapiens
aatgttaaaaccttcagtgctt

SEQ ID NO: 8304430 - DNA, 22 bp, Homo sapiens
aactttattgttaggggctaaa

SEQ ID NO: 8304431 - DNA, 21 bp, Homo sapiens
cagcaaatcattgggcagact

SEQ ID NO: 8304432 - DNA, 22 bp, Homo sapiens
agcctgggcaacaacacagcga

SEQ ID NO: 8304433 - DNA, 22 bp, Homo sapiens
agcctgggcaactccattcact

SEQ ID NO: 8304434 - DNA, 22 bp, Homo sapiens
agcctgggcaacagagcaaaac

SEQ ID NO: 8304435 - DNA, 17 bp, Homo sapiens
agcctgggaaggagtga

SEQ ID NO: 8304436 - DNA, 22 bp, Homo sapiens
agcctgggaatttagagttcgg

SEQ ID NO: 8304437 - DNA, 22 bp, Homo sapiens
agcctgggagacactaagttgt

SEQ ID NO: 8304438 - DNA, 21 bp, Homo sapiens
agcctgggaggcggaggttgc

SEQ ID NO: 8304439 - DNA, 22 bp, Homo sapiens
agcctggccactcagggcctga

SEQ ID NO: 8304440 - DNA, 19 bp, Homo sapiens
agcctggctttgctctgct

SEQ ID NO: 8304441 - DNA, 19 bp, Homo sapiens
agcctggctttgctctgct

SEQ ID NO: 8304442 - DNA, 22 bp, Homo sapiens
agcctgggttagggttcttccc

SEQ ID NO: 8304443 - DNA, 22 bp, Homo sapiens
agcctgggtgggggttcggaga

SEQ ID NO: 8304444 - DNA, 21 bp, Homo sapiens
agcctgggtatcctttgagga

SEQ ID NO: 8304445 - DNA, 22 bp, Homo sapiens
agcctggtgtggggctgcagag

SEQ ID NO: 8304446 - DNA, 22 bp, Homo sapiens
agcctgggtttttattaaggag

SEQ ID NO: 8304447 - DNA, 18 bp, Homo sapiens
agcctgggctctgcctgg

SEQ ID NO: 8304448 - DNA, 22 bp, Homo sapiens
agcctgggcctggcttcccgcc

SEQ ID NO: 8304449 - DNA, 22 bp, Homo sapiens
agcctgggccctgcctcttctc

SEQ ID NO: 8304450 - DNA, 22 bp, Homo sapiens
agcctgggcatgggacgggagg

SEQ ID NO: 8304451 - DNA, 22 bp, Homo sapiens
agcctgggggcgcagaaaccgg

SEQ ID NO: 8304452 - DNA, 22 bp, Homo sapiens
agcctggggtttcagtttgcac

SEQ ID NO: 8304453 - DNA, 23 bp, Homo sapiens
agcctgggtagcctaaataacag

SEQ ID NO: 8304454 - DNA, 22 bp, Homo sapiens
agcctggggcacttctccaaac

SEQ ID NO: 8304455 - DNA, 20 bp, Homo sapiens
agcctggggaattccacccc

SEQ ID NO: 8304456 - DNA, 22 bp, Homo sapiens
agctctgggccaggaaccctaa

SEQ ID NO: 8304457 - DNA, 19 bp, Homo sapiens
agctcctgggctctgggcc

SEQ ID NO: 8304458 - DNA, 21 bp, Homo sapiens
agctccaggctcctggggttc

SEQ ID NO: 8304459 - DNA, 22 bp, Homo sapiens
agctaggaaattgaggctgaga

SEQ ID NO: 8304460 - DNA, 22 bp, Homo sapiens
cagagacattaagtgccatgat

SEQ ID NO: 8304461 - DNA, 22 bp, Homo sapiens
cagagaccccgctgcccttctg

SEQ ID NO: 8304462 - DNA, 20 bp, Homo sapiens
cagagacccaggcttcagct

SEQ ID NO: 8304463 - DNA, 22 bp, Homo sapiens
cagagccttcctagcagactct

SEQ ID NO: 8304464 - DNA, 22 bp, Homo sapiens
cagagccttcctagcagactct

SEQ ID NO: 8304465 - DNA, 22 bp, Homo sapiens
cagagctcagagcagggcactc

SEQ ID NO: 8304466 - DNA, 22 bp, Homo sapiens
agccagccgggggaccacagtg

SEQ ID NO: 8304467 - DNA, 22 bp, Homo sapiens
agccagccagttcactaggaaa

SEQ ID NO: 8304468 - DNA, 22 bp, Homo sapiens
agccagcatgaagacagaggcc

SEQ ID NO: 8304469 - DNA, 22 bp, Homo sapiens
agccagcagggcttagaggaca

SEQ ID NO: 8304470 - DNA, 22 bp, Homo sapiens
agccagcaggtgagtgcagcct

SEQ ID NO: 8304471 - DNA, 22 bp, Homo sapiens
agccagcaggtgagtgcagcct

SEQ ID NO: 8304472 - DNA, 22 bp, Homo sapiens
agcccccaaaagtgcttatgat

SEQ ID NO: 8304473 - DNA, 22 bp, Homo sapiens
cagatggccagaggcagctgca

SEQ ID NO: 8304474 - DNA, 22 bp, Homo sapiens
agccctgggcagccaaggaagc

SEQ ID NO: 8304475 - DNA, 22 bp, Homo sapiens
agccctggcccggctgtgcttt

SEQ ID NO: 8304476 - DNA, 22 bp, Homo sapiens
agccctgggcacctgtgagggg

SEQ ID NO: 8304477 - DNA, 22 bp, Homo sapiens
agccctgggaggccagcttgta

SEQ ID NO: 8304478 - DNA, 22 bp, Homo sapiens
agcccaggttgaggctgcagtg

SEQ ID NO: 8304479 - DNA, 22 bp, Homo sapiens
agccagtgcaacagcagtgaag

SEQ ID NO: 8304480 - DNA, 22 bp, Homo sapiens
agcccaggttgaggctgcagtg

SEQ ID NO: 8304481 - DNA, 22 bp, Homo sapiens
agcccaggttgaggctgcagtg

SEQ ID NO: 8304482 - DNA, 22 bp, Homo sapiens
agcccatgcaacaggcctagcg

SEQ ID NO: 8304483 - DNA, 22 bp, Homo sapiens
agccccacactctctctgagaa

SEQ ID NO: 8304484 - DNA, 22 bp, Homo sapiens
agccccagtaagggagggcctg

SEQ ID NO: 8304485 - DNA, 22 bp, Homo sapiens
agccccagtaagggagggcctg

SEQ ID NO: 8304486 - DNA, 22 bp, Homo sapiens
agccccagtccgctgcgggcgg

SEQ ID NO: 8304487 - DNA, 22 bp, Homo sapiens
agccccaggcccggacgcctct

SEQ ID NO: 8304488 - DNA, 22 bp, Homo sapiens
agccccagcccctctctcacaa

SEQ ID NO: 8304489 - DNA, 20 bp, Homo sapiens
agcagagtgcccatcccgga

SEQ ID NO: 8304490 - DNA, 22 bp, Homo sapiens
agcagagtctgtgtgcacttta

SEQ ID NO: 8304491 - DNA, 21 bp, Homo sapiens
agcagaggggacatgtttgat

SEQ ID NO: 8304492 - DNA, 22 bp, Homo sapiens
caataatatcctgtgctgtttg

SEQ ID NO: 8304493 - DNA, 21 bp, Homo sapiens
agcagaggcagaatgtatgca

SEQ ID NO: 8304494 - DNA, 22 bp, Homo sapiens
agcagagcggggcctccggaag

SEQ ID NO: 8304495 - DNA, 22 bp, Homo sapiens
agcagagctattcttgtgcaat

SEQ ID NO: 8304496 - DNA, 22 bp, Homo sapiens
agcagagcgcctgctcagaggg

SEQ ID NO: 8304497 - DNA, 22 bp, Homo sapiens
agcagagctgcagtggcctgct

SEQ ID NO: 8304498 - DNA, 22 bp, Homo sapiens
agcaccttcacaggctctcagg

SEQ ID NO: 8304499 - DNA, 22 bp, Homo sapiens
agcacctgtggctcatgctcgt

SEQ ID NO: 8304500 - DNA, 22 bp, Homo sapiens
caaaggcagttactgaatgaag

SEQ ID NO: 8304501 - DNA, 22 bp, Homo sapiens
agcacctgcttaatgtgcagtg

SEQ ID NO: 8304502 - DNA, 19 bp, Homo sapiens
agcacctgtgagagcctgg

SEQ ID NO: 8304503 - DNA, 22 bp, Homo sapiens
agcacctggtctcctggcgctg

SEQ ID NO: 8304504 - DNA, 22 bp, Homo sapiens
agcagcagaggtcagaaaggta

SEQ ID NO: 8304505 - DNA, 22 bp, Homo sapiens
agcagcagatccaaaaaatgtg

SEQ ID NO: 8304506 - DNA, 21 bp, Homo sapiens
agcagcagatctggtgagggc

SEQ ID NO: 8304507 - DNA, 22 bp, Homo sapiens
agcagccagagaatgatgcagt

SEQ ID NO: 8304508 - DNA, 22 bp, Homo sapiens
agcagctcaaagcctgcaagga

SEQ ID NO: 8304509 - DNA, 22 bp, Homo sapiens
agcagctcacaggattcctgaa

SEQ ID NO: 8304510 - DNA, 21 bp, Homo sapiens
agcagctgggcaacatggagg

SEQ ID NO: 8304511 - DNA, 17 bp, Homo sapiens
agcagctggcacaggag

SEQ ID NO: 8304512 - DNA, 19 bp, Homo sapiens
agcagctggaggtggagtg

SEQ ID NO: 8304513 - DNA, 22 bp, Homo sapiens
agcatggggcaatgcatgtgct

SEQ ID NO: 8304514 - DNA, 22 bp, Homo sapiens
agcatggggctccgcaatgaac

SEQ ID NO: 8304515 - DNA, 22 bp, Homo sapiens
agcatgctggtgttcatggcag

SEQ ID NO: 8304516 - DNA, 22 bp, Homo sapiens
cactggtgacttctgagctgga

SEQ ID NO: 8304517 - DNA, 22 bp, Homo sapiens
cactgtgtcagtttggttagac

SEQ ID NO: 8304518 - DNA, 22 bp, Homo sapiens
cactgtgtaagaagatgggctt

SEQ ID NO: 8304519 - DNA, 22 bp, Homo sapiens
agcagtggagcgagatgtttaa

SEQ ID NO: 8304520 - DNA, 22 bp, Homo sapiens
agcatgcacatgactggcttaa

SEQ ID NO: 8304521 - DNA, 22 bp, Homo sapiens
agcatgaaagcataggacagtc

SEQ ID NO: 8304522 - DNA, 22 bp, Homo sapiens
agcagtgatgcatgacagccta

SEQ ID NO: 8304523 - DNA, 22 bp, Homo sapiens
agcagtggacctcagtgctatt

SEQ ID NO: 8304524 - DNA, 22 bp, Homo sapiens
cacagcagaaagtgtaggagga

SEQ ID NO: 8304525 - DNA, 22 bp, Homo sapiens
cacagcagaaatatgaaggcag

SEQ ID NO: 8304526 - DNA, 22 bp, Homo sapiens
cacagcagagggagccattgaa

SEQ ID NO: 8304527 - DNA, 20 bp, Homo sapiens
agcaggaatgatgctttcat

SEQ ID NO: 8304528 - DNA, 22 bp, Homo sapiens
agcaggaagtagtctgtaagca

SEQ ID NO: 8304529 - DNA, 23 bp, Homo sapiens
caccactttctccttctccttgg

SEQ ID NO: 8304530 - DNA, 22 bp, Homo sapiens
caccagcagaagactgagggtg

SEQ ID NO: 8304531 - DNA, 22 bp, Homo sapiens
agcagggctgcagtgtgtcttt

SEQ ID NO: 8304532 - DNA, 22 bp, Homo sapiens
agcagggctctgtggagggtgg

SEQ ID NO: 8304533 - DNA, 22 bp, Homo sapiens
caccagctacagactactgtgt

SEQ ID NO: 8304534 - DNA, 22 bp, Homo sapiens
cacatttaatcctttataagta

SEQ ID NO: 8304535 - DNA, 22 bp, Homo sapiens
caccactgtatccctagcactt

SEQ ID NO: 8304536 - DNA, 22 bp, Homo sapiens
agcagggcagtgatcagaaagg

SEQ ID NO: 8304537 - DNA, 22 bp, Homo sapiens
agcagggcaggtaaggatcaga

SEQ ID NO: 8304538 - DNA, 22 bp, Homo sapiens
agcagggcaaagtcaggctaac

SEQ ID NO: 8304539 - DNA, 22 bp, Homo sapiens
agcagggcagctgatgcgcacg

SEQ ID NO: 8304540 - DNA, 22 bp, Homo sapiens
agatcaaagccatgagagattt

SEQ ID NO: 8304541 - DNA, 17 bp, Homo sapiens
agatgctggccacatgt

SEQ ID NO: 8304542 - DNA, 22 bp, Homo sapiens
agatgctgtcacacacactgtt

SEQ ID NO: 8304543 - DNA, 22 bp, Homo sapiens
agatgctgtgaggaagctagga

SEQ ID NO: 8304544 - DNA, 22 bp, Homo sapiens
agatgctgtgtctgttcccttg

SEQ ID NO: 8304545 - DNA, 21 bp, Homo sapiens
agatgctgtgctccaggagca

SEQ ID NO: 8304546 - DNA, 22 bp, Homo sapiens
agatgcttcagtgtttaattta

SEQ ID NO: 8304547 - DNA, 17 bp, Homo sapiens
agatggcaggaggcaga

SEQ ID NO: 8304548 - DNA, 22 bp, Homo sapiens
attttcaaaacatctgctgtgt

SEQ ID NO: 8304549 - DNA, 22 bp, Homo sapiens
agatgtgtttctagttcctgca

SEQ ID NO: 8304550 - DNA, 22 bp, Homo sapiens
agatgttccagccaatgggaat

SEQ ID NO: 8304551 - DNA, 22 bp, Homo sapiens
caaagatgctgatgttggatca

SEQ ID NO: 8304552 - DNA, 22 bp, Homo sapiens
agaggggctcaagcagtggtct

SEQ ID NO: 8304553 - DNA, 22 bp, Homo sapiens
agagtgatcagatatcaggtgt

SEQ ID NO: 8304554 - DNA, 22 bp, Homo sapiens
agagtgatgggttgtgctgacc

SEQ ID NO: 8304555 - DNA, 22 bp, Homo sapiens
agagtgattctagttagggaat

SEQ ID NO: 8304556 - DNA, 22 bp, Homo sapiens
agagtctgaggcagctgcagcc

SEQ ID NO: 8304557 - DNA, 22 bp, Homo sapiens
agaggctgtcccttgctattcc

SEQ ID NO: 8304558 - DNA, 19 bp, Homo sapiens
agaggctgtcacctgtagc

SEQ ID NO: 8304559 - DNA, 22 bp, Homo sapiens
agaggctgggaagggtccccgg

SEQ ID NO: 8304560 - DNA, 23 bp, Homo sapiens
agaggcaggagtggcttgcccgg

SEQ ID NO: 8304561 - DNA, 22 bp, Homo sapiens
agaggcaggaggttgacttgag

SEQ ID NO: 8304562 - DNA, 21 bp, Homo sapiens
agagctgggacttgcctgaga

SEQ ID NO: 8304563 - DNA, 22 bp, Homo sapiens
agaggctgcacttgctcatgat

SEQ ID NO: 8304564 - DNA, 22 bp, Homo sapiens
agaggctccttcactctggcac

SEQ ID NO: 8304565 - DNA, 22 bp, Homo sapiens
agaggctggattgagcatagac

SEQ ID NO: 8304566 - DNA, 22 bp, Homo sapiens
agaggccactttgcctgtgatg

SEQ ID NO: 8304567 - DNA, 22 bp, Homo sapiens
agaggccagcagtgcctatctg

SEQ ID NO: 8304568 - DNA, 22 bp, Homo sapiens
agagcagagggctctgggacaa

SEQ ID NO: 8304569 - DNA, 22 bp, Homo sapiens
agagcagaggcatggccgtggg

SEQ ID NO: 8304570 - DNA, 22 bp, Homo sapiens
agagcagcacgttgtccccaca

SEQ ID NO: 8304571 - DNA, 22 bp, Homo sapiens
agagcagatggagctggaagag

SEQ ID NO: 8304572 - DNA, 22 bp, Homo sapiens
agagcagatggccagggggcct

SEQ ID NO: 8304573 - DNA, 22 bp, Homo sapiens
agagccaggcaggcaatgttga

SEQ ID NO: 8304574 - DNA, 21 bp, Homo sapiens
agagcctgagatcttccagca

SEQ ID NO: 8304575 - DNA, 22 bp, Homo sapiens
agagcctgaggatgtcccagct

SEQ ID NO: 8304576 - DNA, 22 bp, Homo sapiens
agagcctgaggccaggaaaatg

SEQ ID NO: 8304577 - DNA, 22 bp, Homo sapiens
agagctgaaaaagctgacccgg

SEQ ID NO: 8304578 - DNA, 22 bp, Homo sapiens
agagcctgcagctgtgaagaaa

SEQ ID NO: 8304579 - DNA, 22 bp, Homo sapiens
agagccctgaagcagagctaaa

SEQ ID NO: 8304580 - DNA, 22 bp, Homo sapiens
agagccctctcattggcttatt

SEQ ID NO: 8304581 - DNA, 22 bp, Homo sapiens
agagccctcttcactgcccctt

SEQ ID NO: 8304582 - DNA, 22 bp, Homo sapiens
agagccctttctccaggcacct

SEQ ID NO: 8304583 - DNA, 22 bp, Homo sapiens
agagctggatggtcaagatggc

SEQ ID NO: 8304584 - DNA, 22 bp, Homo sapiens
agagctggacgtctgagcccta

SEQ ID NO: 8304585 - DNA, 22 bp, Homo sapiens
agagctggaatcagacctcagg

SEQ ID NO: 8304586 - DNA, 22 bp, Homo sapiens
agagctggctggtagccctgat

SEQ ID NO: 8304587 - DNA, 22 bp, Homo sapiens
agagctggccagggatcactct

SEQ ID NO: 8304588 - DNA, 22 bp, Homo sapiens
agacttctcagttttattagta

SEQ ID NO: 8304589 - DNA, 22 bp, Homo sapiens
agactttgagctcttagagaag

SEQ ID NO: 8304590 - DNA, 22 bp, Homo sapiens
agagaaggtcactaaggaccca

SEQ ID NO: 8304591 - DNA, 22 bp, Homo sapiens
agagaaaactcattgaggtgtc

SEQ ID NO: 8304592 - DNA, 22 bp, Homo sapiens
agagaaaagagttcaggctttg

SEQ ID NO: 8304593 - DNA, 22 bp, Homo sapiens
agagaattacagaagaatgtca

SEQ ID NO: 8304594 - DNA, 20 bp, Homo sapiens
agagaattccctttggagat

SEQ ID NO: 8304595 - DNA, 21 bp, Homo sapiens
agagaattgccttagatgttc

SEQ ID NO: 8304596 - DNA, 22 bp, Homo sapiens
agagaattttaaaagccttgaa

SEQ ID NO: 8304597 - DNA, 22 bp, Homo sapiens
agagacaccgcgcatcatggct

SEQ ID NO: 8304598 - DNA, 21 bp, Homo sapiens
agagagaaggccatatggtcc

SEQ ID NO: 8304599 - DNA, 22 bp, Homo sapiens
agagagcccgggccagggcaca

SEQ ID NO: 8304600 - DNA, 22 bp, Homo sapiens
agagaggcgagttacctgtgct

SEQ ID NO: 8304601 - DNA, 22 bp, Homo sapiens
agagaggctgggcgtagggctt

SEQ ID NO: 8304602 - DNA, 19 bp, Homo sapiens
agagaggctgtgtgaggga

SEQ ID NO: 8304603 - DNA, 22 bp, Homo sapiens
atgaacacatgtacacatttct

SEQ ID NO: 8304604 - DNA, 22 bp, Homo sapiens
atgaagtctgcacatgcatgtg

SEQ ID NO: 8304605 - DNA, 22 bp, Homo sapiens
atgaagtctagcaagcattgaa

SEQ ID NO: 8304606 - DNA, 21 bp, Homo sapiens
atgaagtctatgcttctgtgt

SEQ ID NO: 8304607 - DNA, 22 bp, Homo sapiens
atgaaggatggctggctgccct

SEQ ID NO: 8304608 - DNA, 22 bp, Homo sapiens
atgaagctggttttggcttggg

SEQ ID NO: 8304609 - DNA, 22 bp, Homo sapiens
atgaagctaaaccctgcagcca

SEQ ID NO: 8304610 - DNA, 22 bp, Homo sapiens
atgaagctgaccttgtcttgct

SEQ ID NO: 8304611 - DNA, 21 bp, Homo sapiens
agacagaacaactgctctcca

SEQ ID NO: 8304612 - DNA, 22 bp, Homo sapiens
agacaacaccaaatgctagtgt

SEQ ID NO: 8304613 - DNA, 22 bp, Homo sapiens
agacagaacagaataattgttg

SEQ ID NO: 8304614 - DNA, 22 bp, Homo sapiens
atgatacatcttcatgtcagtg

SEQ ID NO: 8304615 - DNA, 22 bp, Homo sapiens
atgcaggttgggcaagtgtggg

SEQ ID NO: 8304616 - DNA, 22 bp, Homo sapiens
agacctggatgtgagggaagta

SEQ ID NO: 8304617 - DNA, 22 bp, Homo sapiens
agacctggtaagcaggttgggc

SEQ ID NO: 8304618 - DNA, 22 bp, Homo sapiens
atgcctggtatgaagcaaggaa

SEQ ID NO: 8304619 - DNA, 22 bp, Homo sapiens
atgcctgtaatcccagtgcttt

SEQ ID NO: 8304620 - DNA, 22 bp, Homo sapiens
acagccatagatgcttatgtaa

SEQ ID NO: 8304621 - DNA, 22 bp, Homo sapiens
agctgcaggcccatgctcagtc

SEQ ID NO: 8304622 - DNA, 22 bp, Homo sapiens
agctgctcaggagagccaggtc

SEQ ID NO: 8304623 - DNA, 22 bp, Homo sapiens
agctcccaattgacttgaacta

SEQ ID NO: 8304624 - DNA, 22 bp, Homo sapiens
agctcccagaagccagagtcgg

SEQ ID NO: 8304625 - DNA, 22 bp, Homo sapiens
acagccagaggtggtcctgggt

SEQ ID NO: 8304626 - DNA, 22 bp, Homo sapiens
acagccagggtctcaggaggcg

SEQ ID NO: 8304627 - DNA, 22 bp, Homo sapiens
acagccaggtaaaggcatggca

SEQ ID NO: 8304628 - DNA, 22 bp, Homo sapiens
agctgctgtggggctcggcctg

SEQ ID NO: 8304629 - DNA, 22 bp, Homo sapiens
agctgctgtgtgctcaggcagg

SEQ ID NO: 8304630 - DNA, 22 bp, Homo sapiens
agctgctgtcctaggcactgta

SEQ ID NO: 8304631 - DNA, 22 bp, Homo sapiens
acagcctgagagtggagctggc

SEQ ID NO: 8304632 - DNA, 20 bp, Homo sapiens
agctggcctgtcctaggcct

SEQ ID NO: 8304633 - DNA, 20 bp, Homo sapiens
agctggcctgtcctaggcct

SEQ ID NO: 8304634 - DNA, 22 bp, Homo sapiens
agctggcctgttagagctgagt

SEQ ID NO: 8304635 - DNA, 22 bp, Homo sapiens
agctggccttagtgagcacctg

SEQ ID NO: 8304636 - DNA, 22 bp, Homo sapiens
agctggccttcggtgtcactgg

SEQ ID NO: 8304637 - DNA, 22 bp, Homo sapiens
agcttaggaggatgatgaacat

SEQ ID NO: 8304638 - DNA, 20 bp, Homo sapiens
agctggttatcttaattctt

SEQ ID NO: 8304639 - DNA, 22 bp, Homo sapiens
agctggttagcaatctaagtga

SEQ ID NO: 8304640 - DNA, 22 bp, Homo sapiens
agctgggatgataacctcagtc

SEQ ID NO: 8304641 - DNA, 22 bp, Homo sapiens
agctggttcagaaattagatgg

SEQ ID NO: 8304642 - DNA, 22 bp, Homo sapiens
agctgggagcagagccacagcc

SEQ ID NO: 8304643 - DNA, 22 bp, Homo sapiens
agctgggaggtgggcagtgaga

SEQ ID NO: 8304644 - DNA, 20 bp, Homo sapiens
aggaagccaaaggctgtctt

SEQ ID NO: 8304645 - DNA, 22 bp, Homo sapiens
aggaagccatggtggacgtcta

SEQ ID NO: 8304646 - DNA, 22 bp, Homo sapiens
aggaaaaacctgttaatggtag

SEQ ID NO: 8304647 - DNA, 22 bp, Homo sapiens
aggaaaaagagttgctgccttc

SEQ ID NO: 8304648 - DNA, 22 bp, Homo sapiens
aggaaaaaagtctgtgattata

SEQ ID NO: 8304649 - DNA, 22 bp, Homo sapiens
aggaagcctggggctgccctcg

SEQ ID NO: 8304650 - DNA, 22 bp, Homo sapiens
aggaagcccttgtcatttctgt

SEQ ID NO: 8304651 - DNA, 22 bp, Homo sapiens
aggaagcctgcaggtgactgct

SEQ ID NO: 8304652 - DNA, 22 bp, Homo sapiens
aggacttctccgataagtcaga

SEQ ID NO: 8304653 - DNA, 22 bp, Homo sapiens
acaggggctccgaaggtgaggg

SEQ ID NO: 8304654 - DNA, 22 bp, Homo sapiens
aggagctgcaaatattagtaat

SEQ ID NO: 8304655 - DNA, 22 bp, Homo sapiens
aggagcctccttctcatgtgca

SEQ ID NO: 8304656 - DNA, 22 bp, Homo sapiens
aggagccctgcgggaggcagag

SEQ ID NO: 8304657 - DNA, 22 bp, Homo sapiens
aggagcccctcttcagtcctgg

SEQ ID NO: 8304658 - DNA, 22 bp, Homo sapiens
aggagctgcttaaatggttggt

SEQ ID NO: 8304659 - DNA, 22 bp, Homo sapiens
aggagctgcatggatacctggt

SEQ ID NO: 8304660 - DNA, 22 bp, Homo sapiens
aggagctgcagattctgccttg

SEQ ID NO: 8304661 - DNA, 22 bp, Homo sapiens
aggagctgcagattctgccttg

SEQ ID NO: 8304662 - DNA, 20 bp, Homo sapiens
aggagccattgactgcagca

SEQ ID NO: 8304663 - DNA, 22 bp, Homo sapiens
aggagcagaccgtagtcctgca

SEQ ID NO: 8304664 - DNA, 22 bp, Homo sapiens
aggagccatgagtgacatcaca

SEQ ID NO: 8304665 - DNA, 22 bp, Homo sapiens
aggagcagaccgtagtcctgca

SEQ ID NO: 8304666 - DNA, 22 bp, Homo sapiens
acagggtcattttatgatctgt

SEQ ID NO: 8304667 - DNA, 22 bp, Homo sapiens
acagggtcaagggtgctacaag

SEQ ID NO: 8304668 - DNA, 18 bp, Homo sapiens
aggcacagagcatacata

SEQ ID NO: 8304669 - DNA, 22 bp, Homo sapiens
acatacatatgacaactttcct

SEQ ID NO: 8304670 - DNA, 22 bp, Homo sapiens
aggaggctgtggagcactccat

SEQ ID NO: 8304671 - DNA, 22 bp, Homo sapiens
aggaggccgctgatgggctccc

SEQ ID NO: 8304672 - DNA, 22 bp, Homo sapiens
aggcaaaattacaaagttatta

SEQ ID NO: 8304673 - DNA, 22 bp, Homo sapiens
acattcatgtcccacttctagc

SEQ ID NO: 8304674 - DNA, 22 bp, Homo sapiens
acattctagaagtctttgcaat

SEQ ID NO: 8304675 - DNA, 22 bp, Homo sapiens
aggcttcccagctgagctcagc

SEQ ID NO: 8304676 - DNA, 22 bp, Homo sapiens
aggcttcccaagcagctgcaaa

SEQ ID NO: 8304677 - DNA, 18 bp, Homo sapiens
aggcttcccaggcaggcc

SEQ ID NO: 8304678 - DNA, 22 bp, Homo sapiens
aggcttccgagtagctgggact

SEQ ID NO: 8304679 - DNA, 17 bp, Homo sapiens
aggcatggtctggggtg

SEQ ID NO: 8304680 - DNA, 21 bp, Homo sapiens
aggcccagctttcctcttgct

SEQ ID NO: 8304681 - DNA, 22 bp, Homo sapiens
aggcccagggctgctctctgaa

SEQ ID NO: 8304682 - DNA, 18 bp, Homo sapiens
aggccagccctgctactg

SEQ ID NO: 8304683 - DNA, 22 bp, Homo sapiens
accaggaggcctggagcacaaa

SEQ ID NO: 8304684 - DNA, 23 bp, Homo sapiens
aggcttcctatcttagagctggg

SEQ ID NO: 8304685 - DNA, 22 bp, Homo sapiens
accaaggaagaatctatttgag

SEQ ID NO: 8304686 - DNA, 22 bp, Homo sapiens
accaaggagacaaaggtgtatt

SEQ ID NO: 8304687 - DNA, 22 bp, Homo sapiens
accaaggaagagattctcagtt

SEQ ID NO: 8304688 - DNA, 22 bp, Homo sapiens
accaaggagaaggtgcaagctt

SEQ ID NO: 8304689 - DNA, 22 bp, Homo sapiens
accaaggagtttggtattttag

SEQ ID NO: 8304690 - DNA, 22 bp, Homo sapiens
accaaggagccacatacaacct

SEQ ID NO: 8304691 - DNA, 22 bp, Homo sapiens
accaggggtgtcaacagcattt

SEQ ID NO: 8304692 - DNA, 22 bp, Homo sapiens
accaggggatggttggcactgt

SEQ ID NO: 8304693 - DNA, 20 bp, Homo sapiens
accataatgttaattacaaa

SEQ ID NO: 8304694 - DNA, 22 bp, Homo sapiens
accagtccgcggagctccgggg

SEQ ID NO: 8304695 - DNA, 22 bp, Homo sapiens
accaggtggccccagcgtggtt

SEQ ID NO: 8304696 - DNA, 22 bp, Homo sapiens
agggcctctgacgcccccagcc

SEQ ID NO: 8304697 - DNA, 22 bp, Homo sapiens
agggcctgacacccttgccagc

SEQ ID NO: 8304698 - DNA, 22 bp, Homo sapiens
agggcctgacacccttgccagc

SEQ ID NO: 8304699 - DNA, 22 bp, Homo sapiens
acccacgaagatgagcggcatg

SEQ ID NO: 8304700 - DNA, 22 bp, Homo sapiens
acccagggtagagtgcagtggc

SEQ ID NO: 8304701 - DNA, 22 bp, Homo sapiens
acccagggtagagtgcagtggc

SEQ ID NO: 8304702 - DNA, 22 bp, Homo sapiens
accccagccctgcttctgggag

SEQ ID NO: 8304703 - DNA, 20 bp, Homo sapiens
accccagcccctctatctga

SEQ ID NO: 8304704 - DNA, 22 bp, Homo sapiens
accccagctctgagccacacca

SEQ ID NO: 8304705 - DNA, 22 bp, Homo sapiens
accccagctctgagccacacca

SEQ ID NO: 8304706 - DNA, 18 bp, Homo sapiens
accctctggcttctgagc

SEQ ID NO: 8304707 - DNA, 22 bp, Homo sapiens
accccagaggcggaggctgcag

SEQ ID NO: 8304708 - DNA, 22 bp, Homo sapiens
accccaagacagtagaagagaa

SEQ ID NO: 8304709 - DNA, 22 bp, Homo sapiens
accctgggcttggcctgctcag

SEQ ID NO: 8304710 - DNA, 21 bp, Homo sapiens
accctgggttctccataccct

SEQ ID NO: 8304711 - DNA, 22 bp, Homo sapiens
accctgggttcccgcagcacca

SEQ ID NO: 8304712 - DNA, 22 bp, Homo sapiens
accctgggggtggccagtgcca

SEQ ID NO: 8304713 - DNA, 22 bp, Homo sapiens
accctgggtcatatacagtgtg

SEQ ID NO: 8304714 - DNA, 22 bp, Homo sapiens
aggtccagctgttgcagcctcc

SEQ ID NO: 8304715 - DNA, 22 bp, Homo sapiens
acctttcaaagtggctatcact

SEQ ID NO: 8304716 - DNA, 20 bp, Homo sapiens
acctttcaaatgattcagca

SEQ ID NO: 8304717 - DNA, 22 bp, Homo sapiens
acctttcacggtatcagacatc

SEQ ID NO: 8304718 - DNA, 22 bp, Homo sapiens
acctttcattaaagtctgtagt

SEQ ID NO: 8304719 - DNA, 22 bp, Homo sapiens
aggtcaaggccaaaagagtggt

SEQ ID NO: 8304720 - DNA, 22 bp, Homo sapiens
aggtcaagtttagatagagtta

SEQ ID NO: 8304721 - DNA, 22 bp, Homo sapiens
aggtcattgttaagtcaccata

SEQ ID NO: 8304722 - DNA, 22 bp, Homo sapiens
aggtcatttccttagaggcaga

SEQ ID NO: 8304723 - DNA, 22 bp, Homo sapiens
aggtcatttttgccttctattt

SEQ ID NO: 8304724 - DNA, 22 bp, Homo sapiens
aggtcaaaccacagctctaggc

SEQ ID NO: 8304725 - DNA, 22 bp, Homo sapiens
aggtgaagttgaggaggcagaa

SEQ ID NO: 8304726 - DNA, 22 bp, Homo sapiens
aggtgaagttgaggaggcagaa

SEQ ID NO: 8304727 - DNA, 22 bp, Homo sapiens
accttttttcagaactctaaag

SEQ ID NO: 8304728 - DNA, 22 bp, Homo sapiens
accttttttcagaactctaaag

SEQ ID NO: 8304729 - DNA, 22 bp, Homo sapiens
acctttttgttctgttctcagc

SEQ ID NO: 8304730 - DNA, 22 bp, Homo sapiens
acctttttgttctgttctcagc

SEQ ID NO: 8304731 - DNA, 22 bp, Homo sapiens
acctttttccaatgagggaagt

SEQ ID NO: 8304732 - DNA, 22 bp, Homo sapiens
acctttttccaaagcttcttac

SEQ ID NO: 8304733 - DNA, 22 bp, Homo sapiens
actactttgggccatttgttta

SEQ ID NO: 8304734 - DNA, 22 bp, Homo sapiens
agtactttacttcttacagttt

SEQ ID NO: 8304735 - DNA, 22 bp, Homo sapiens
agtactttgcactttgctcaga

SEQ ID NO: 8304736 - DNA, 20 bp, Homo sapiens
agtaccttttgtatgttacc

SEQ ID NO: 8304737 - DNA, 22 bp, Homo sapiens
agtactttacttcttacagttt

SEQ ID NO: 8304738 - DNA, 22 bp, Homo sapiens
agtacttcagaggctgcccagg

SEQ ID NO: 8304739 - DNA, 18 bp, Homo sapiens
agtagtgggtttagcttc

SEQ ID NO: 8304740 - DNA, 22 bp, Homo sapiens
agtagaaagaaggcactgggcc

SEQ ID NO: 8304741 - DNA, 22 bp, Homo sapiens
aggtggggaaaccagcgatccc

SEQ ID NO: 8304742 - DNA, 22 bp, Homo sapiens
aggtggggaaaccagcgatccc

SEQ ID NO: 8304743 - DNA, 22 bp, Homo sapiens
agtacatttattaatggtaaaa

SEQ ID NO: 8304744 - DNA, 23 bp, Homo sapiens
agtacattcgaaaaattctgtga

SEQ ID NO: 8304745 - DNA, 22 bp, Homo sapiens
actctctcacacacgcctatat

SEQ ID NO: 8304746 - DNA, 22 bp, Homo sapiens
actctctcacagcttggctgat

SEQ ID NO: 8304747 - DNA, 22 bp, Homo sapiens
actctctgtggttctactttgc

SEQ ID NO: 8304748 - DNA, 22 bp, Homo sapiens
actccctgtacttgcctctctt

SEQ ID NO: 8304749 - DNA, 22 bp, Homo sapiens
actcctgggtgctgaccagcgt

SEQ ID NO: 8304750 - DNA, 22 bp, Homo sapiens
actcctggggctgccatcacag

SEQ ID NO: 8304751 - DNA, 22 bp, Homo sapiens
actcctggggatccattccttt

SEQ ID NO: 8304752 - DNA, 22 bp, Homo sapiens
actgcagcctagggaccacagt

SEQ ID NO: 8304753 - DNA, 22 bp, Homo sapiens
actctgcctttcagcagatgaa

SEQ ID NO: 8304754 - DNA, 22 bp, Homo sapiens
actctgccccgagttctgggaa

SEQ ID NO: 8304755 - DNA, 22 bp, Homo sapiens
actctgccatcccaggtgctgt

SEQ ID NO: 8304756 - DNA, 22 bp, Homo sapiens
actctgagcatcccaagtctta

SEQ ID NO: 8304757 - DNA, 22 bp, Homo sapiens
actctgaggcaggtcagggcag

SEQ ID NO: 8304758 - DNA, 22 bp, Homo sapiens
actctgaggagtgactagaggt

SEQ ID NO: 8304759 - DNA, 22 bp, Homo sapiens
agtgaaatttgtttagataggt

SEQ ID NO: 8304760 - DNA, 23 bp, Homo sapiens
actgagccagggcctgggtcagc

SEQ ID NO: 8304761 - DNA, 22 bp, Homo sapiens
actgccaggatggcactagagg

SEQ ID NO: 8304762 - DNA, 22 bp, Homo sapiens
actgggcctggattggcgtgtc

SEQ ID NO: 8304763 - DNA, 22 bp, Homo sapiens
actgggccggtgcagagtagtt

SEQ ID NO: 8304764 - DNA, 21 bp, Homo sapiens
agtgtccttgatcttgccttg

SEQ ID NO: 8304765 - DNA, 22 bp, Homo sapiens
acttctcttcataggtggcaat

SEQ ID NO: 8304766 - DNA, 22 bp, Homo sapiens
acttctcttcataggtggcaat

SEQ ID NO: 8304767 - DNA, 22 bp, Homo sapiens
actttgtgcccaacagaaagaa

SEQ ID NO: 8304768 - DNA, 22 bp, Homo sapiens
actttggatctgatgtaatcag

SEQ ID NO: 8304769 - DNA, 22 bp, Homo sapiens
atagatacattaggtaacttgt

SEQ ID NO: 8304770 - DNA, 22 bp, Homo sapiens
actttgcagagccagaagagaa

SEQ ID NO: 8304771 - DNA, 19 bp, Homo sapiens
actttgcatgtgtgtctaa

SEQ ID NO: 8304772 - DNA, 22 bp, Homo sapiens
actttgcaatacttaatacaaa

SEQ ID NO: 8304773 - DNA, 22 bp, Homo sapiens
actttgcaatgggcagaaccca

SEQ ID NO: 8304774 - DNA, 22 bp, Homo sapiens
actttgcactaagttactcatt

SEQ ID NO: 8304775 - DNA, 22 bp, Homo sapiens
acttcctggctgggtgacctgg

SEQ ID NO: 8304776 - DNA, 22 bp, Homo sapiens
acttcctgggcatgcagagtcc

SEQ ID NO: 8304777 - DNA, 22 bp, Homo sapiens
acttcctgttatgtgtgcctct

SEQ ID NO: 8304778 - DNA, 22 bp, Homo sapiens
acttcctgtgttggtcttgctg

SEQ ID NO: 8304779 - DNA, 22 bp, Homo sapiens
agtttctaccggtacattcagg

SEQ ID NO: 8304780 - DNA, 22 bp, Homo sapiens
actgggccttgccatggcagcc

SEQ ID NO: 8304781 - DNA, 22 bp, Homo sapiens
agttttatgcagtgttctgata

SEQ ID NO: 8304782 - DNA, 22 bp, Homo sapiens
agtttttctcccctggcttcat

SEQ ID NO: 8304783 - DNA, 22 bp, Homo sapiens
agtttttctgggaggcactgct

SEQ ID NO: 8304784 - DNA, 22 bp, Homo sapiens
agtttttctgctggtctcacta

SEQ ID NO: 8304785 - DNA, 23 bp, Homo sapiens
agtttttctgcatggttctgtat

SEQ ID NO: 8304786 - DNA, 22 bp, Homo sapiens
agtttttccgtggctacgataa

SEQ ID NO: 8304787 - DNA, 22 bp, Homo sapiens
agtttttcctgattttacagaa

SEQ ID NO: 8304788 - DNA, 22 bp, Homo sapiens
acttttttataaggaagaagat

SEQ ID NO: 8304789 - DNA, 22 bp, Homo sapiens
actttttacagggtgtatacca

SEQ ID NO: 8304790 - DNA, 22 bp, Homo sapiens
actttttacagggtgtatacca

SEQ ID NO: 8304791 - DNA, 21 bp, Homo sapiens
agaaaaaccagcatgttttca

SEQ ID NO: 8304792 - DNA, 22 bp, Homo sapiens
atatttctccaaatgttttcaa

SEQ ID NO: 8304793 - DNA, 22 bp, Homo sapiens
agaaatcatgactaagagcagt

SEQ ID NO: 8304794 - DNA, 22 bp, Homo sapiens
agaaatcattcccaaacccata

SEQ ID NO: 8304795 - DNA, 22 bp, Homo sapiens
atcagtttaaatgggctgttgg

SEQ ID NO: 8304796 - DNA, 22 bp, Homo sapiens
atcagtttaactgtcaagagcc

SEQ ID NO: 8304797 - DNA, 22 bp, Homo sapiens
atcagtgctaaagcaaatgccc

SEQ ID NO: 8304798 - DNA, 22 bp, Homo sapiens
atcaaaatgctccagtgatggt

SEQ ID NO: 8304799 - DNA, 22 bp, Homo sapiens
agaaagcactctgtcttttacc

SEQ ID NO: 8304800 - DNA, 22 bp, Homo sapiens
atcagcaatcaaattgcagagt

SEQ ID NO: 8304801 - DNA, 22 bp, Homo sapiens
atcagcaatctcgtgtattagg

SEQ ID NO: 8304802 - DNA, 22 bp, Homo sapiens
atccccagaaagaccgatgtac

SEQ ID NO: 8304803 - DNA, 22 bp, Homo sapiens
atccccagaaaataggtgccta

SEQ ID NO: 8304804 - DNA, 22 bp, Homo sapiens
atccccagaaaataggtgccta

SEQ ID NO: 8304805 - DNA, 22 bp, Homo sapiens
atctctgctagccttcttcagg

SEQ ID NO: 8304806 - DNA, 22 bp, Homo sapiens
atctcagggctggagccctgga

SEQ ID NO: 8304807 - DNA, 22 bp, Homo sapiens
agaaatctgactgctgtgcaca

SEQ ID NO: 8304808 - DNA, 19 bp, Homo sapiens
agaaatctcgagatttgtt

SEQ ID NO: 8304809 - DNA, 22 bp, Homo sapiens
agaaatctcagtatctcaggga

SEQ ID NO: 8304810 - DNA, 22 bp, Homo sapiens
agaaatctaagatgctcaagga

SEQ ID NO: 8304811 - DNA, 22 bp, Homo sapiens
agaaggagtgtacaggtcatgc

SEQ ID NO: 8304812 - DNA, 22 bp, Homo sapiens
agaaggagtgtacaggtcatgc

SEQ ID NO: 8304813 - DNA, 22 bp, Homo sapiens
agaagccaacagggcaggagag

SEQ ID NO: 8304814 - DNA, 22 bp, Homo sapiens
agaagccaattctgtgtgagtc

SEQ ID NO: 8304815 - DNA, 22 bp, Homo sapiens
aggtaacactacttagtatact

SEQ ID NO: 8304816 - DNA, 22 bp, Homo sapiens
aggtaaagactgcaaggagaat

SEQ ID NO: 8304817 - DNA, 22 bp, Homo sapiens
aggtaaagacagtgaaagaggg

SEQ ID NO: 8304818 - DNA, 22 bp, Homo sapiens
aggtaagggtcacagttcatat

SEQ ID NO: 8304819 - DNA, 22 bp, Homo sapiens
aggtaaggctgtaagctaagcc

SEQ ID NO: 8304820 - DNA, 22 bp, Homo sapiens
aggtacagatgaaagtctagtt

SEQ ID NO: 8304821 - DNA, 22 bp, Homo sapiens
aggtcacacaactgtcagaggc

SEQ ID NO: 8304822 - DNA, 22 bp, Homo sapiens
aggtcacacttggatcatagaa

SEQ ID NO: 8304823 - DNA, 22 bp, Homo sapiens
cctgaggtggctgcagcactgc

SEQ ID NO: 8304824 - DNA, 18 bp, Homo sapiens
cctgaggtgggaggaagg

SEQ ID NO: 8304825 - DNA, 19 bp, Homo sapiens
cctgaggtggggtggaagg

SEQ ID NO: 8304826 - DNA, 22 bp, Homo sapiens
agggtgggctagactcttcccc

SEQ ID NO: 8304827 - DNA, 22 bp, Homo sapiens
aggtcacatggataatgatcag

SEQ ID NO: 8304828 - DNA, 22 bp, Homo sapiens
aggtcaccatggcatgctccac

SEQ ID NO: 8304829 - DNA, 22 bp, Homo sapiens
aggtcaccatggcatgctccac

SEQ ID NO: 8304830 - DNA, 22 bp, Homo sapiens
aggtcacccgtttgactatcca

SEQ ID NO: 8304831 - DNA, 22 bp, Homo sapiens
aggtcacccgtttgactatcca

SEQ ID NO: 8304832 - DNA, 22 bp, Homo sapiens
aggtcagaagtgccagggaatt

SEQ ID NO: 8304833 - DNA, 22 bp, Homo sapiens
cctgggaggctgaggctgcagt

SEQ ID NO: 8304834 - DNA, 22 bp, Homo sapiens
cctgggaggctgaggctgcagt

SEQ ID NO: 8304835 - DNA, 22 bp, Homo sapiens
cctgggaggtggaggttgcagc

SEQ ID NO: 8304836 - DNA, 22 bp, Homo sapiens
cctgggaggtggaggttgcagt

SEQ ID NO: 8304837 - DNA, 22 bp, Homo sapiens
cctgggaggctgtttccagcct

SEQ ID NO: 8304838 - DNA, 22 bp, Homo sapiens
cctgggagggcaagtgctgatg

SEQ ID NO: 8304839 - DNA, 22 bp, Homo sapiens
cctgggaggctgtgggtctgct

SEQ ID NO: 8304840 - DNA, 23 bp, Homo sapiens
aggtgcagccctggacctgcccc

SEQ ID NO: 8304841 - DNA, 17 bp, Homo sapiens
aggtgcagaggcagagc

SEQ ID NO: 8304842 - DNA, 22 bp, Homo sapiens
aggtgcagcatgagtccaacgg

SEQ ID NO: 8304843 - DNA, 22 bp, Homo sapiens
aggtgcagctgacaccatgtgg

SEQ ID NO: 8304844 - DNA, 22 bp, Homo sapiens
aggtgcagctggtggagtctgg

SEQ ID NO: 8304845 - DNA, 22 bp, Homo sapiens
cctgggtcactcaggcaggcgg

SEQ ID NO: 8304846 - DNA, 21 bp, Homo sapiens
aggtgcagagccagggaccag

SEQ ID NO: 8304847 - DNA, 17 bp, Homo sapiens
aggtgcagaggcagagc

SEQ ID NO: 8304848 - DNA, 22 bp, Homo sapiens
cctgggctttgagggcaggatg

SEQ ID NO: 8304849 - DNA, 20 bp, Homo sapiens
cctggggtacactggcatgt

SEQ ID NO: 8304850 - DNA, 22 bp, Homo sapiens
cctgtgggccctggacagagac

SEQ ID NO: 8304851 - DNA, 22 bp, Homo sapiens
ccttccaggagtctctgcaggt

SEQ ID NO: 8304852 - DNA, 22 bp, Homo sapiens
agtaacaagtgccaacgttaga

SEQ ID NO: 8304853 - DNA, 19 bp, Homo sapiens
agtagcagaaagtgcagtg

SEQ ID NO: 8304854 - DNA, 22 bp, Homo sapiens
agtaggaggcgggagcatgaag

SEQ ID NO: 8304855 - DNA, 20 bp, Homo sapiens
agtagcagtgtgacattgac

SEQ ID NO: 8304856 - DNA, 20 bp, Homo sapiens
agtaggggaatgcaagagca

SEQ ID NO: 8304857 - DNA, 22 bp, Homo sapiens
agtatttctgctcatgaaagag

SEQ ID NO: 8304858 - DNA, 22 bp, Homo sapiens
agtatttctagttggttctact

SEQ ID NO: 8304859 - DNA, 22 bp, Homo sapiens
ccttctctactcctgatgcatg

SEQ ID NO: 8304860 - DNA, 22 bp, Homo sapiens
ccttccaggtgcaggcaagcct

SEQ ID NO: 8304861 - DNA, 22 bp, Homo sapiens
agtaaacatcaccctggggtga

SEQ ID NO: 8304862 - DNA, 22 bp, Homo sapiens
agtaaacataatttacctgtag

SEQ ID NO: 8304863 - DNA, 22 bp, Homo sapiens
ctaggaggcgggggctgcagta

SEQ ID NO: 8304864 - DNA, 22 bp, Homo sapiens
ctatctttcgattctagcttaa

SEQ ID NO: 8304865 - DNA, 20 bp, Homo sapiens
ctatctcctggcgtgccttc

SEQ ID NO: 8304866 - DNA, 22 bp, Homo sapiens
ctattgaaagtgtacaattcaa

SEQ ID NO: 8304867 - DNA, 22 bp, Homo sapiens
ctattgaattaactattaaagt

SEQ ID NO: 8304868 - DNA, 22 bp, Homo sapiens
ctattgaatagcccaaatcatt

SEQ ID NO: 8304869 - DNA, 22 bp, Homo sapiens
agtcagcagcctggccaggaga

SEQ ID NO: 8304870 - DNA, 22 bp, Homo sapiens
agtggccagtgctgctctgggg

SEQ ID NO: 8304871 - DNA, 22 bp, Homo sapiens
agtggcctggagccccgcctgg

SEQ ID NO: 8304872 - DNA, 22 bp, Homo sapiens
agtggtaactaagtcctgctta

SEQ ID NO: 8304873 - DNA, 22 bp, Homo sapiens
ctctggagtgggtggccgggag

SEQ ID NO: 8304874 - DNA, 22 bp, Homo sapiens
ctctggagtgtctggccagggt

SEQ ID NO: 8304875 - DNA, 22 bp, Homo sapiens
ctctggagttagtgatctgggc

SEQ ID NO: 8304876 - DNA, 22 bp, Homo sapiens
ctctggagtgtctggccagggt

SEQ ID NO: 8304877 - DNA, 22 bp, Homo sapiens
ctctggagttcttcaagctact

SEQ ID NO: 8304878 - DNA, 22 bp, Homo sapiens
ctctggagttctcatgaggaac

SEQ ID NO: 8304879 - DNA, 22 bp, Homo sapiens
agtgtattgattggaacagcct

SEQ ID NO: 8304880 - DNA, 22 bp, Homo sapiens
agtgtcattccagggaccctcg

SEQ ID NO: 8304881 - DNA, 19 bp, Homo sapiens
agtgtcatcagctactcag

SEQ ID NO: 8304882 - DNA, 22 bp, Homo sapiens
agtgtcatatgccactgcatcc

SEQ ID NO: 8304883 - DNA, 22 bp, Homo sapiens
agtgtgaccttatttggaaaca

SEQ ID NO: 8304884 - DNA, 22 bp, Homo sapiens
agtgtcccctccaagggcctgg

SEQ ID NO: 8304885 - DNA, 22 bp, Homo sapiens
agtgtccaactcagcttgtcaa

SEQ ID NO: 8304886 - DNA, 22 bp, Homo sapiens
agtgtcccctacagaggcattc

SEQ ID NO: 8304887 - DNA, 22 bp, Homo sapiens
agtgtcattttgtccatcttct

SEQ ID NO: 8304888 - DNA, 22 bp, Homo sapiens
ctgagctgctcccgctgcagcg

SEQ ID NO: 8304889 - DNA, 22 bp, Homo sapiens
ctgagctgcggcaggcacctgg

SEQ ID NO: 8304890 - DNA, 22 bp, Homo sapiens
ctgagctgaaacttgagaggct

SEQ ID NO: 8304891 - DNA, 20 bp, Homo sapiens
ctgagctgagctccatgggt

SEQ ID NO: 8304892 - DNA, 23 bp, Homo sapiens
agttccagaaaaatgctcaagca

SEQ ID NO: 8304893 - DNA, 21 bp, Homo sapiens
agttcatactgagtaacaaaa

SEQ ID NO: 8304894 - DNA, 22 bp, Homo sapiens
ctgagccaaggggacagtgaca

SEQ ID NO: 8304895 - DNA, 22 bp, Homo sapiens
ctgagccagagggagtcgggtc

SEQ ID NO: 8304896 - DNA, 22 bp, Homo sapiens
ctgagccactgcttgttcagtg

SEQ ID NO: 8304897 - DNA, 22 bp, Homo sapiens
ctgagctctaatgtcagccttg

SEQ ID NO: 8304898 - DNA, 22 bp, Homo sapiens
ctgagccagcgggctcactttt

SEQ ID NO: 8304899 - DNA, 22 bp, Homo sapiens
ctgagccagggccacacatgga

SEQ ID NO: 8304900 - DNA, 22 bp, Homo sapiens
ctgagccagctggcatgtgcta

SEQ ID NO: 8304901 - DNA, 22 bp, Homo sapiens
agttaaagtctgaaatagagaa

SEQ ID NO: 8304902 - DNA, 22 bp, Homo sapiens
agtgtttctcagaagggcctat

SEQ ID NO: 8304903 - DNA, 22 bp, Homo sapiens
agtgtttctggcaaatgaaagt

SEQ ID NO: 8304904 - DNA, 22 bp, Homo sapiens
agtgtttcccagtaggatgaaa

SEQ ID NO: 8304905 - DNA, 20 bp, Homo sapiens
agtgtgcatttagagtctgc

SEQ ID NO: 8304906 - DNA, 22 bp, Homo sapiens
agtgtgctgcttaaacagttgt

SEQ ID NO: 8304907 - DNA, 22 bp, Homo sapiens
agtgcattgcatctctgcttca

SEQ ID NO: 8304908 - DNA, 22 bp, Homo sapiens
agtgcattatatgtttcaatgg

SEQ ID NO: 8304909 - DNA, 20 bp, Homo sapiens
agtgccagggcaggtgagag

SEQ ID NO: 8304910 - DNA, 22 bp, Homo sapiens
agtgccaggagcaaggagctcc

SEQ ID NO: 8304911 - DNA, 22 bp, Homo sapiens
agtgcctggaccccatgacata

SEQ ID NO: 8304912 - DNA, 22 bp, Homo sapiens
agtggcaggcggagatgtagga

SEQ ID NO: 8304913 - DNA, 17 bp, Homo sapiens
agtgacttggaaagagc

SEQ ID NO: 8304914 - DNA, 22 bp, Homo sapiens
agtgaggctaataggcaatggt

SEQ ID NO: 8304915 - DNA, 21 bp, Homo sapiens
agtgaaattgcatcagaggga

SEQ ID NO: 8304916 - DNA, 22 bp, Homo sapiens
agtgaaattcctggtctttgtt

SEQ ID NO: 8304917 - DNA, 22 bp, Homo sapiens
agtgaaattgctgtaagaggaa

SEQ ID NO: 8304918 - DNA, 22 bp, Homo sapiens
agtgaaatcctggtcaacaggt

SEQ ID NO: 8304919 - DNA, 22 bp, Homo sapiens
agtgaaatgactgaatcagata

SEQ ID NO: 8304920 - DNA, 21 bp, Homo sapiens
agtgaaatgaagtgtatgctc

SEQ ID NO: 8304921 - DNA, 22 bp, Homo sapiens
agtgaaatgatagtgtaaatac

SEQ ID NO: 8304922 - DNA, 22 bp, Homo sapiens
agtgaaatggatgctgctactg

SEQ ID NO: 8304923 - DNA, 19 bp, Homo sapiens
agtgaaatggagtattcaa

SEQ ID NO: 8304924 - DNA, 22 bp, Homo sapiens
agtgaaatgattctgagcaaga

SEQ ID NO: 8304925 - DNA, 22 bp, Homo sapiens
agtgaaatcaggttttgactgc

SEQ ID NO: 8304926 - DNA, 22 bp, Homo sapiens
agtgaaatatgcccattgctgt

SEQ ID NO: 8304927 - DNA, 22 bp, Homo sapiens
agtgaaatagcatttatgaagc

SEQ ID NO: 8304928 - DNA, 22 bp, Homo sapiens
agtgaaatactgtcgtttttag

SEQ ID NO: 8304929 - DNA, 22 bp, Homo sapiens
agtgaaataaagctgcctatgg

SEQ ID NO: 8304930 - DNA, 22 bp, Homo sapiens
agtgaaaacactagttcttgcc

SEQ ID NO: 8304931 - DNA, 22 bp, Homo sapiens
agtgagtgggttacagatggga

SEQ ID NO: 8304932 - DNA, 22 bp, Homo sapiens
agtgatggagcttcctctgcta

SEQ ID NO: 8304933 - DNA, 22 bp, Homo sapiens
agtgatggtgagtgagaagctc

SEQ ID NO: 8304934 - DNA, 22 bp, Homo sapiens
agtgagggatgaagaactgcgg

SEQ ID NO: 8304935 - DNA, 22 bp, Homo sapiens
agtgagtggaccctgcaaggaa

SEQ ID NO: 8304936 - DNA, 22 bp, Homo sapiens
ctcaccacagagcctgtccagc

SEQ ID NO: 8304937 - DNA, 22 bp, Homo sapiens
agtctcagaaaatatgcttttt

SEQ ID NO: 8304938 - DNA, 22 bp, Homo sapiens
agtctcagaaaagaagcatgga

SEQ ID NO: 8304939 - DNA, 22 bp, Homo sapiens
ctggcaggtggatggggactcc

SEQ ID NO: 8304940 - DNA, 22 bp, Homo sapiens
ctggcaggtccagctggactca

SEQ ID NO: 8304941 - DNA, 22 bp, Homo sapiens
ctggcaggtctcgctgacgtgt

SEQ ID NO: 8304942 - DNA, 22 bp, Homo sapiens
ctggcaggttatagagctgccc

SEQ ID NO: 8304943 - DNA, 22 bp, Homo sapiens
ctggcaggtttggtgtctggtg

SEQ ID NO: 8304944 - DNA, 22 bp, Homo sapiens
ctggccactggaggtggcaccc

SEQ ID NO: 8304945 - DNA, 22 bp, Homo sapiens
ctggcctcacctcagacttact

SEQ ID NO: 8304946 - DNA, 23 bp, Homo sapiens
ctggcctccgacactggccaaga

SEQ ID NO: 8304947 - DNA, 22 bp, Homo sapiens
ctggcctcatagccaagctgtg

SEQ ID NO: 8304948 - DNA, 22 bp, Homo sapiens
ctggcctcatagccaagctgtg

SEQ ID NO: 8304949 - DNA, 22 bp, Homo sapiens
ctggccggtatttgcctctggg

SEQ ID NO: 8304950 - DNA, 22 bp, Homo sapiens
ctggcctaaaaatacagaacaa

SEQ ID NO: 8304951 - DNA, 22 bp, Homo sapiens
ctggcctagctctctgcttgaa

SEQ ID NO: 8304952 - DNA, 22 bp, Homo sapiens
ctggcccttctcttgcttcctg

SEQ ID NO: 8304953 - DNA, 22 bp, Homo sapiens
ctggccagactacacatgtgtg

SEQ ID NO: 8304954 - DNA, 22 bp, Homo sapiens
atacatgtcatcatatgtttgt

SEQ ID NO: 8304955 - DNA, 22 bp, Homo sapiens
atacatgtaactgcattgtaat

SEQ ID NO: 8304956 - DNA, 22 bp, Homo sapiens
ctggcagcttagcactctggtt

SEQ ID NO: 8304957 - DNA, 22 bp, Homo sapiens
ctggcagcttagcactctggtt

SEQ ID NO: 8304958 - DNA, 22 bp, Homo sapiens
ctggcctgtgggctgtctccgg

SEQ ID NO: 8304959 - DNA, 22 bp, Homo sapiens
ctggcctcggcagcaggaacag

SEQ ID NO: 8304960 - DNA, 22 bp, Homo sapiens
ctggccttcagactcggactga

SEQ ID NO: 8304961 - DNA, 22 bp, Homo sapiens
ctggccttggaagggagcccgt

SEQ ID NO: 8304962 - DNA, 22 bp, Homo sapiens
ctggccttggtgcttgcagaca

SEQ ID NO: 8304963 - DNA, 22 bp, Homo sapiens
ctggcctttaaaatgaccttat

SEQ ID NO: 8304964 - DNA, 22 bp, Homo sapiens
ctggcctttagccccagtgtct

SEQ ID NO: 8304965 - DNA, 22 bp, Homo sapiens
atagtggtgagctgcatttatg

SEQ ID NO: 8304966 - DNA, 22 bp, Homo sapiens
atagtggttggatatgtcagag

SEQ ID NO: 8304967 - DNA, 22 bp, Homo sapiens
ctggctcacaggtgagatgcat

SEQ ID NO: 8304968 - DNA, 22 bp, Homo sapiens
ctggccttttgtttctggagaa

SEQ ID NO: 8304969 - DNA, 22 bp, Homo sapiens
ctggctcaatttgtactgctgt

SEQ ID NO: 8304970 - DNA, 22 bp, Homo sapiens
ctggctcaataaatattagctg

SEQ ID NO: 8304971 - DNA, 22 bp, Homo sapiens
atataaagtgtttagaaagctg

SEQ ID NO: 8304972 - DNA, 19 bp, Homo sapiens
ctggctcttgggtggagga

SEQ ID NO: 8304973 - DNA, 22 bp, Homo sapiens
atatacttggagactatcattg

SEQ ID NO: 8304974 - DNA, 22 bp, Homo sapiens
ctgggagctgtcaggagcgtgt

SEQ ID NO: 8304975 - DNA, 22 bp, Homo sapiens
ctgcctgggttcaagtcctgtt

SEQ ID NO: 8304976 - DNA, 22 bp, Homo sapiens
ctgcctgggttcaagtcctgtt

SEQ ID NO: 8304977 - DNA, 22 bp, Homo sapiens
ctgcctggtctcaggcatgggg

SEQ ID NO: 8304978 - DNA, 22 bp, Homo sapiens
ctgcctggaaggagcaagggga

SEQ ID NO: 8304979 - DNA, 22 bp, Homo sapiens
ctgcctggaaggagcaagggga

SEQ ID NO: 8304980 - DNA, 22 bp, Homo sapiens
ctgcctgtgcatgcagtcagaa

SEQ ID NO: 8304981 - DNA, 22 bp, Homo sapiens
ctgcctgtgatttttctctagt

SEQ ID NO: 8304982 - DNA, 22 bp, Homo sapiens
ctgcctggtctcaggcatgggg

SEQ ID NO: 8304983 - DNA, 22 bp, Homo sapiens
ctgcctgtgccaatgctccttt

SEQ ID NO: 8304984 - DNA, 22 bp, Homo sapiens
ctgcctgtgccaccgcctcatt

SEQ ID NO: 8304985 - DNA, 22 bp, Homo sapiens
ctgctcacgccaccgttcatca

SEQ ID NO: 8304986 - DNA, 22 bp, Homo sapiens
ctgctgggcagaggctgcatga

SEQ ID NO: 8304987 - DNA, 22 bp, Homo sapiens
ctgctgcccagtgtgcattggg

SEQ ID NO: 8304988 - DNA, 22 bp, Homo sapiens
ctgctgggctcctcatgtgact

SEQ ID NO: 8304989 - DNA, 19 bp, Homo sapiens
atacacatacgtaaactga

SEQ ID NO: 8304990 - DNA, 20 bp, Homo sapiens
atacacatattcttgcaact

SEQ ID NO: 8304991 - DNA, 22 bp, Homo sapiens
ctgctggggtcagagcactggg

SEQ ID NO: 8304992 - DNA, 22 bp, Homo sapiens
ataaaacttattagaattgtgt

SEQ ID NO: 8304993 - DNA, 22 bp, Homo sapiens
ataaagaggatgtatttacagc

SEQ ID NO: 8304994 - DNA, 22 bp, Homo sapiens
ctgcaggctgagcgcctgccgg

SEQ ID NO: 8304995 - DNA, 22 bp, Homo sapiens
atcacaaaggctgcttcatgat

SEQ ID NO: 8304996 - DNA, 22 bp, Homo sapiens
atcagctgaaaaacaggcagca

SEQ ID NO: 8304997 - DNA, 22 bp, Homo sapiens
ctgtaatcccagctactcggga

SEQ ID NO: 8304998 - DNA, 22 bp, Homo sapiens
ctgtaatcccagctacctggga

SEQ ID NO: 8304999 - DNA, 22 bp, Homo sapiens
atcataaagtgctatctgattg

SEQ ID NO: 8305000 - DNA, 22 bp, Homo sapiens
atcagtttgtatatgaaacact

SEQ ID NO: 8305001 - DNA, 22 bp, Homo sapiens
atcagttttgggggacatactg

SEQ ID NO: 8305002 - DNA, 22 bp, Homo sapiens
atcagtttttattaatgtagct

SEQ ID NO: 8305003 - DNA, 22 bp, Homo sapiens
atcagttttgttcactactata

SEQ ID NO: 8305004 - DNA, 22 bp, Homo sapiens
atcagtttgagtgctgtgtcaa

SEQ ID NO: 8305005 - DNA, 22 bp, Homo sapiens
atcagtttgataataaggcttg

SEQ ID NO: 8305006 - DNA, 22 bp, Homo sapiens
atcagtttggaacattcaggcc

SEQ ID NO: 8305007 - DNA, 22 bp, Homo sapiens
atcagtttggtgctttcagtga

SEQ ID NO: 8305008 - DNA, 22 bp, Homo sapiens
atcagtttatacttataaatct

SEQ ID NO: 8305009 - DNA, 22 bp, Homo sapiens
atcagtttcacttgcttgcaaa

SEQ ID NO: 8305010 - DNA, 22 bp, Homo sapiens
atcagtttctaccatgtggaat

SEQ ID NO: 8305011 - DNA, 22 bp, Homo sapiens
atcagtttctgtgaagaacaca

SEQ ID NO: 8305012 - DNA, 19 bp, Homo sapiens
ctgtccttggctgcactgt

SEQ ID NO: 8305013 - DNA, 22 bp, Homo sapiens
ctgtctccagggcaggtgcagg

SEQ ID NO: 8305014 - DNA, 22 bp, Homo sapiens
ctgtctcctccactgcatggga

SEQ ID NO: 8305015 - DNA, 23 bp, Homo sapiens
ctgtctcctgggctaggtggaat

SEQ ID NO: 8305016 - DNA, 22 bp, Homo sapiens
ctgtctctgataagctcgaggg

SEQ ID NO: 8305017 - DNA, 22 bp, Homo sapiens
ctgtctctctaggacactgggg

SEQ ID NO: 8305018 - DNA, 22 bp, Homo sapiens
ctgtctctctaggacactgggg

SEQ ID NO: 8305019 - DNA, 22 bp, Homo sapiens
ctgggtggctgtccagccagcc

SEQ ID NO: 8305020 - DNA, 22 bp, Homo sapiens
ctgggtggctgtccagccagcc

SEQ ID NO: 8305021 - DNA, 22 bp, Homo sapiens
ctgggtggcgtctggggccagt

SEQ ID NO: 8305022 - DNA, 22 bp, Homo sapiens
atattcactgagcataaagcca

SEQ ID NO: 8305023 - DNA, 22 bp, Homo sapiens
ctgggtggcagagcctgcagtg

SEQ ID NO: 8305024 - DNA, 22 bp, Homo sapiens
ctgggtggcagagcctgcagtg

SEQ ID NO: 8305025 - DNA, 20 bp, Homo sapiens
ctgggtggcaagcaaggggg

SEQ ID NO: 8305026 - DNA, 22 bp, Homo sapiens
ctgggtggatcgcagccccagg

SEQ ID NO: 8305027 - DNA, 23 bp, Homo sapiens
ctggggctttcaaatctgggcag

SEQ ID NO: 8305028 - DNA, 23 bp, Homo sapiens
ctggggctttcaaatctgggcag

SEQ ID NO: 8305029 - DNA, 22 bp, Homo sapiens
ctggggcttcaatgcttcggtg

SEQ ID NO: 8305030 - DNA, 22 bp, Homo sapiens
ctgggggcaatggtcagagtgt

SEQ ID NO: 8305031 - DNA, 22 bp, Homo sapiens
ctgggggcaagcagacagctgt

SEQ ID NO: 8305032 - DNA, 19 bp, Homo sapiens
ctggggctttggtactgcc

SEQ ID NO: 8305033 - DNA, 22 bp, Homo sapiens
ctgggaggatacacaagatcag

SEQ ID NO: 8305034 - DNA, 22 bp, Homo sapiens
ctgggaggacaacttggagctc

SEQ ID NO: 8305035 - DNA, 22 bp, Homo sapiens
ctgggaggtgcagcaaaaatca

SEQ ID NO: 8305036 - DNA, 22 bp, Homo sapiens
ctgggaggtgaacagaaaaact

SEQ ID NO: 8305037 - DNA, 22 bp, Homo sapiens
ctgggaggtggaggttgcattg

SEQ ID NO: 8305038 - DNA, 22 bp, Homo sapiens
ctgggaggggtagccaatccta

SEQ ID NO: 8305039 - DNA, 20 bp, Homo sapiens
ctgggaggtcttccaaatca

SEQ ID NO: 8305040 - DNA, 22 bp, Homo sapiens
ctgggaggcggaggttgtagtg

SEQ ID NO: 8305041 - DNA, 22 bp, Homo sapiens
atctggtttggggatccttgtg

SEQ ID NO: 8305042 - DNA, 20 bp, Homo sapiens
atctggctcagatcctgcag

SEQ ID NO: 8305043 - DNA, 22 bp, Homo sapiens
atctggctcgctaggctctggg

SEQ ID NO: 8305044 - DNA, 22 bp, Homo sapiens
atctggctcattcagggaacgg

SEQ ID NO: 8305045 - DNA, 22 bp, Homo sapiens
atctggctcctacacttgaaga

SEQ ID NO: 8305046 - DNA, 22 bp, Homo sapiens
atctggctcccttggaatccgt

SEQ ID NO: 8305047 - DNA, 22 bp, Homo sapiens
atctggctctctcatttacaaa

SEQ ID NO: 8305048 - DNA, 22 bp, Homo sapiens
atctggctcttcctggagttcc

SEQ ID NO: 8305049 - DNA, 23 bp, Homo sapiens
atctctctttattcttggggata

SEQ ID NO: 8305050 - DNA, 17 bp, Homo sapiens
atctctctaaggcaggc

SEQ ID NO: 8305051 - DNA, 23 bp, Homo sapiens
atctctctggtggtcacagtcag

SEQ ID NO: 8305052 - DNA, 22 bp, Homo sapiens
atctctctgcccaggggctgtg

SEQ ID NO: 8305053 - DNA, 22 bp, Homo sapiens
atctctctatgcactgaggact

SEQ ID NO: 8305054 - DNA, 15 bp, Homo sapiens
atctctctagctgct

SEQ ID NO: 8305055 - DNA, 18 bp, Homo sapiens
atctcccattggccaagg

SEQ ID NO: 8305056 - DNA, 22 bp, Homo sapiens
cttctgtgcttcacagttgcca

SEQ ID NO: 8305057 - DNA, 22 bp, Homo sapiens
cttatgtataatgttccacata

SEQ ID NO: 8305058 - DNA, 22 bp, Homo sapiens
cttatgtatatttggaacgtac

SEQ ID NO: 8305059 - DNA, 22 bp, Homo sapiens
cttatgtacacacatatattgt

SEQ ID NO: 8305060 - DNA, 22 bp, Homo sapiens
cttatgtaaaacggaaagggaa

SEQ ID NO: 8305061 - DNA, 22 bp, Homo sapiens
cttatgtaaactacagataata

SEQ ID NO: 8305062 - DNA, 22 bp, Homo sapiens
cttattataaaatcctgtttga

SEQ ID NO: 8305063 - DNA, 22 bp, Homo sapiens
cttatgtatgctactttgtggt

SEQ ID NO: 8305064 - DNA, 22 bp, Homo sapiens
cttcaagaagacagcagagcat

SEQ ID NO: 8305065 - DNA, 22 bp, Homo sapiens
cttcaagatccatagatattgc

SEQ ID NO: 8305066 - DNA, 22 bp, Homo sapiens
cttcaagagaatgcagggatgt

SEQ ID NO: 8305067 - DNA, 22 bp, Homo sapiens
cttcaagatatttctagaatca

SEQ ID NO: 8305068 - DNA, 22 bp, Homo sapiens
cttaacagcaagatctgtgtca

SEQ ID NO: 8305069 - DNA, 22 bp, Homo sapiens
cttaacagagagaagtgttgct

SEQ ID NO: 8305070 - DNA, 22 bp, Homo sapiens
cttaacagatacatctgtggtt

SEQ ID NO: 8305071 - DNA, 22 bp, Homo sapiens
cttaagaatattgaagttgtgg

SEQ ID NO: 8305072 - DNA, 21 bp, Homo sapiens
atccatccatcttggcctaac

SEQ ID NO: 8305073 - DNA, 22 bp, Homo sapiens
caggaacctaatgaaggctcac

SEQ ID NO: 8305074 - DNA, 22 bp, Homo sapiens
caggaacctaaagagacattac

SEQ ID NO: 8305075 - DNA, 22 bp, Homo sapiens
caggaaatatctcctggcagag

SEQ ID NO: 8305076 - DNA, 22 bp, Homo sapiens
agctgcctgcttatgagctcca

SEQ ID NO: 8305077 - DNA, 21 bp, Homo sapiens
agctgctttcagctcctagag

SEQ ID NO: 8305078 - DNA, 22 bp, Homo sapiens
agctgcctgcttatgagctcca

SEQ ID NO: 8305079 - DNA, 22 bp, Homo sapiens
agctgccctgggtcttgctgct

SEQ ID NO: 8305080 - DNA, 22 bp, Homo sapiens
agctgcccttctcttgcccttg

SEQ ID NO: 8305081 - DNA, 22 bp, Homo sapiens
agctgcccccagggctgtgctt

SEQ ID NO: 8305082 - DNA, 22 bp, Homo sapiens
agctgccagatgacagtgctat

SEQ ID NO: 8305083 - DNA, 22 bp, Homo sapiens
agctgccctggcggagctgctc

SEQ ID NO: 8305084 - DNA, 22 bp, Homo sapiens
agctggtatgaacaggatagga

SEQ ID NO: 8305085 - DNA, 22 bp, Homo sapiens
agctgggtgtgtatcagataaa

SEQ ID NO: 8305086 - DNA, 22 bp, Homo sapiens
agctgggtggagggcccacggt

SEQ ID NO: 8305087 - DNA, 23 bp, Homo sapiens
agctgggtggcctgcgtgaagct

SEQ ID NO: 8305088 - DNA, 19 bp, Homo sapiens
agctggggcggtgtgtgtt

SEQ ID NO: 8305089 - DNA, 21 bp, Homo sapiens
agctgggcctcagcctgcagt

SEQ ID NO: 8305090 - DNA, 22 bp, Homo sapiens
agctgggcctgagctggaagct

SEQ ID NO: 8305091 - DNA, 22 bp, Homo sapiens
agctggagatcatgctgatact

SEQ ID NO: 8305092 - DNA, 22 bp, Homo sapiens
agctggagatgcccagcaccgg

SEQ ID NO: 8305093 - DNA, 20 bp, Homo sapiens
agctggagaagggcccttcc

SEQ ID NO: 8305094 - DNA, 22 bp, Homo sapiens
agctggagcttcaagcaggtaa

SEQ ID NO: 8305095 - DNA, 22 bp, Homo sapiens
caggtcccgccccgggctgacc

SEQ ID NO: 8305096 - DNA, 22 bp, Homo sapiens
caggtcccctcccctaccaggc

SEQ ID NO: 8305097 - DNA, 17 bp, Homo sapiens
aggaaacattttctttc

SEQ ID NO: 8305098 - DNA, 22 bp, Homo sapiens
cagggtttcaccatgttagcag

SEQ ID NO: 8305099 - DNA, 22 bp, Homo sapiens
aggaaaaataaggcagcagggc

SEQ ID NO: 8305100 - DNA, 20 bp, Homo sapiens
aggaaaaatggaaactggag

SEQ ID NO: 8305101 - DNA, 20 bp, Homo sapiens
aggaaaagggtggtggtaga

SEQ ID NO: 8305102 - DNA, 22 bp, Homo sapiens
aggaaaatcgagtctggaggca

SEQ ID NO: 8305103 - DNA, 22 bp, Homo sapiens
cagggacatgactggtctctgt

SEQ ID NO: 8305104 - DNA, 22 bp, Homo sapiens
cagggactgagatccagactgt

SEQ ID NO: 8305105 - DNA, 22 bp, Homo sapiens
cagggacattggtggccaggtt

SEQ ID NO: 8305106 - DNA, 22 bp, Homo sapiens
agctttatttgtcattcacggc

SEQ ID NO: 8305107 - DNA, 22 bp, Homo sapiens
agctttattcatgatttcaggg

SEQ ID NO: 8305108 - DNA, 22 bp, Homo sapiens
agctttatatttaatgaattct

SEQ ID NO: 8305109 - DNA, 22 bp, Homo sapiens
agcttctggaagcctggcagca

SEQ ID NO: 8305110 - DNA, 22 bp, Homo sapiens
agcttctggaaggcaaggcttg

SEQ ID NO: 8305111 - DNA, 22 bp, Homo sapiens
agctggtgctgaagctcttgag

SEQ ID NO: 8305112 - DNA, 22 bp, Homo sapiens
agcttctcaggagtctgaggca

SEQ ID NO: 8305113 - DNA, 22 bp, Homo sapiens
caggcttgctgctagagcactt

SEQ ID NO: 8305114 - DNA, 22 bp, Homo sapiens
caggcttgattattcagacaat

SEQ ID NO: 8305115 - DNA, 22 bp, Homo sapiens
aggcaggctcaggcccatgctt

SEQ ID NO: 8305116 - DNA, 22 bp, Homo sapiens
ccaaagagctagaattataggc

SEQ ID NO: 8305117 - DNA, 22 bp, Homo sapiens
ccaaaatgtttgaatgcatgtg

SEQ ID NO: 8305118 - DNA, 19 bp, Homo sapiens
aggcagaggcttggctagc

SEQ ID NO: 8305119 - DNA, 22 bp, Homo sapiens
aggcagctggcagcacccaggg

SEQ ID NO: 8305120 - DNA, 23 bp, Homo sapiens
aggcagagccaaggtcaaaaccc

SEQ ID NO: 8305121 - DNA, 20 bp, Homo sapiens
aggcagagcgcacttttaga

SEQ ID NO: 8305122 - DNA, 22 bp, Homo sapiens
aggcagagctgatgttctgtga

SEQ ID NO: 8305123 - DNA, 22 bp, Homo sapiens
aggcagagctgatgttctgtga

SEQ ID NO: 8305124 - DNA, 22 bp, Homo sapiens
aggcagagctgggttttgaaat

SEQ ID NO: 8305125 - DNA, 22 bp, Homo sapiens
aggcagaggaagggtggatttg

SEQ ID NO: 8305126 - DNA, 22 bp, Homo sapiens
aggcagaggagaatgatcttcc

SEQ ID NO: 8305127 - DNA, 22 bp, Homo sapiens
aggcagaggagaatgatcttcc

SEQ ID NO: 8305128 - DNA, 22 bp, Homo sapiens
aggatcctccttagaaaagacc

SEQ ID NO: 8305129 - DNA, 22 bp, Homo sapiens
aggatcctgcgctttgggggag

SEQ ID NO: 8305130 - DNA, 23 bp, Homo sapiens
aggatcctggtacaggagcagag

SEQ ID NO: 8305131 - DNA, 22 bp, Homo sapiens
aggatcctttttctgctgtttg

SEQ ID NO: 8305132 - DNA, 22 bp, Homo sapiens
aggatcctttggccacttctta

SEQ ID NO: 8305133 - DNA, 22 bp, Homo sapiens
aggatcctgtatggagaagctg

SEQ ID NO: 8305134 - DNA, 22 bp, Homo sapiens
aggcactgattctgttttccat

SEQ ID NO: 8305135 - DNA, 22 bp, Homo sapiens
aggcagagagcagtggccgtct

SEQ ID NO: 8305136 - DNA, 22 bp, Homo sapiens
aggcactgattctcagagttac

SEQ ID NO: 8305137 - DNA, 22 bp, Homo sapiens
aggcactgagaggctgtgttgc

SEQ ID NO: 8305138 - DNA, 22 bp, Homo sapiens
aggcactgacctgcttccttga

SEQ ID NO: 8305139 - DNA, 22 bp, Homo sapiens
aggcactgactcaagggagcca

SEQ ID NO: 8305140 - DNA, 22 bp, Homo sapiens
aggcactgacaattctggactg

SEQ ID NO: 8305141 - DNA, 22 bp, Homo sapiens
aggcactgacagattctgtgtc

SEQ ID NO: 8305142 - DNA, 22 bp, Homo sapiens
aggcactgaaggaagcttgcgc

SEQ ID NO: 8305143 - DNA, 22 bp, Homo sapiens
aggcactgaagtggtaaatgta

SEQ ID NO: 8305144 - DNA, 23 bp, Homo sapiens
aggcactgaatgtgtcagtgagt

SEQ ID NO: 8305145 - DNA, 22 bp, Homo sapiens
aggcactgaatatccagtaaaa

SEQ ID NO: 8305146 - DNA, 22 bp, Homo sapiens
aggcactgaagaactctttttg

SEQ ID NO: 8305147 - DNA, 22 bp, Homo sapiens
aggcactgaagaactctttttg

SEQ ID NO: 8305148 - DNA, 22 bp, Homo sapiens
cagtgcagccaaggacaggcac

SEQ ID NO: 8305149 - DNA, 23 bp, Homo sapiens
cagtgcagggcaactcagactcc

SEQ ID NO: 8305150 - DNA, 20 bp, Homo sapiens
aggagatgatccagagtcag

SEQ ID NO: 8305151 - DNA, 22 bp, Homo sapiens
aggagcagcccactcctgtcct

SEQ ID NO: 8305152 - DNA, 22 bp, Homo sapiens
aggagcagcccactcctgtcct

SEQ ID NO: 8305153 - DNA, 22 bp, Homo sapiens
aggagccaagatggggcaagta

SEQ ID NO: 8305154 - DNA, 22 bp, Homo sapiens
aggagccaagcagaactaagga

SEQ ID NO: 8305155 - DNA, 22 bp, Homo sapiens
aggagccaagcagaactaagga

SEQ ID NO: 8305156 - DNA, 22 bp, Homo sapiens
aggagctgggctgctgctggga

SEQ ID NO: 8305157 - DNA, 22 bp, Homo sapiens
aggagctgggctgctgctggga

SEQ ID NO: 8305158 - DNA, 22 bp, Homo sapiens
catcactgacgctgagattcca

SEQ ID NO: 8305159 - DNA, 22 bp, Homo sapiens
catcactgtccaaagttcagtt

SEQ ID NO: 8305160 - DNA, 22 bp, Homo sapiens
catcactgtcctcagcattcca

SEQ ID NO: 8305161 - DNA, 22 bp, Homo sapiens
cagttattatgaggtcattagg

SEQ ID NO: 8305162 - DNA, 22 bp, Homo sapiens
aggaggctggttcaggccatat

SEQ ID NO: 8305163 - DNA, 22 bp, Homo sapiens
aggaggtgacagcctgcatctg

SEQ ID NO: 8305164 - DNA, 22 bp, Homo sapiens
aggagtgtggccagggctctgg

SEQ ID NO: 8305165 - DNA, 22 bp, Homo sapiens
aggagtgtggccagggctctgg

SEQ ID NO: 8305166 - DNA, 22 bp, Homo sapiens
ccaggctggagtatagtggcgc

SEQ ID NO: 8305167 - DNA, 22 bp, Homo sapiens
ccaggctgcttagccttatctt

SEQ ID NO: 8305168 - DNA, 22 bp, Homo sapiens
ccaggctgggcggggaacctgg

SEQ ID NO: 8305169 - DNA, 22 bp, Homo sapiens
ccaggctgggctacaagttgag

SEQ ID NO: 8305170 - DNA, 22 bp, Homo sapiens
ccaggctgggctacaagttgag

SEQ ID NO: 8305171 - DNA, 22 bp, Homo sapiens
ccagggcctcgtgttctgagtg

SEQ ID NO: 8305172 - DNA, 22 bp, Homo sapiens
ccagggctgggtttgtcggtgt

SEQ ID NO: 8305173 - DNA, 22 bp, Homo sapiens
ccagggctggtgggagatgctg

SEQ ID NO: 8305174 - DNA, 22 bp, Homo sapiens
aggctgaggcaggtggatcacc

SEQ ID NO: 8305175 - DNA, 18 bp, Homo sapiens
ccatttcatgattattac

SEQ ID NO: 8305176 - DNA, 22 bp, Homo sapiens
aggctggccctactggctgcct

SEQ ID NO: 8305177 - DNA, 22 bp, Homo sapiens
aggctggccctactggctgcct

SEQ ID NO: 8305178 - DNA, 22 bp, Homo sapiens
aggctggcgacatctggcgggc

SEQ ID NO: 8305179 - DNA, 22 bp, Homo sapiens
ccatttgtcacctctgcactcc

SEQ ID NO: 8305180 - DNA, 22 bp, Homo sapiens
ccatttgttcgcccagctccaa

SEQ ID NO: 8305181 - DNA, 22 bp, Homo sapiens
aggctggctggcaggggacaca

SEQ ID NO: 8305182 - DNA, 22 bp, Homo sapiens
aggctgggaaggtaaagttgta

SEQ ID NO: 8305183 - DNA, 22 bp, Homo sapiens
aggctggggaattgaatttgct

SEQ ID NO: 8305184 - DNA, 20 bp, Homo sapiens
aggctggggtgttttgccca

SEQ ID NO: 8305185 - DNA, 22 bp, Homo sapiens
aggctgggtacctgtcatatgc

SEQ ID NO: 8305186 - DNA, 22 bp, Homo sapiens
aggctgggcaccgttttgatcc

SEQ ID NO: 8305187 - DNA, 22 bp, Homo sapiens
aggctgggctccgcccaactcc

SEQ ID NO: 8305188 - DNA, 22 bp, Homo sapiens
aggctgctttcatggccgcccc

SEQ ID NO: 8305189 - DNA, 22 bp, Homo sapiens
aggctgcttccttacgtggctg

SEQ ID NO: 8305190 - DNA, 22 bp, Homo sapiens
aggctgcttcagctgcagggag

SEQ ID NO: 8305191 - DNA, 22 bp, Homo sapiens
aggctggagtacagtggctatt

SEQ ID NO: 8305192 - DNA, 22 bp, Homo sapiens
ccagaccctccattcaagctcc

SEQ ID NO: 8305193 - DNA, 22 bp, Homo sapiens
ccagaccaccctggccatgcac

SEQ ID NO: 8305194 - DNA, 21 bp, Homo sapiens
ccagactggcctatgtggtag

SEQ ID NO: 8305195 - DNA, 22 bp, Homo sapiens
ccagactgtggagttcctggtg

SEQ ID NO: 8305196 - DNA, 22 bp, Homo sapiens
ccagaaaatgcagaacatagaa

SEQ ID NO: 8305197 - DNA, 22 bp, Homo sapiens
ccactgggggctgcaggcactc

SEQ ID NO: 8305198 - DNA, 22 bp, Homo sapiens
aggccaggcaacattctgaagt

SEQ ID NO: 8305199 - DNA, 22 bp, Homo sapiens
aggccaggtggtcatgcttgct

SEQ ID NO: 8305200 - DNA, 22 bp, Homo sapiens
aggccaggttcctcaatcttga

SEQ ID NO: 8305201 - DNA, 19 bp, Homo sapiens
ccagcagctttgattctct

SEQ ID NO: 8305202 - DNA, 21 bp, Homo sapiens
ccagagcctgctgagccccct

SEQ ID NO: 8305203 - DNA, 22 bp, Homo sapiens
ccagagcctggcatctgcataa

SEQ ID NO: 8305204 - DNA, 22 bp, Homo sapiens
ccagagctccagggctacagaa

SEQ ID NO: 8305205 - DNA, 17 bp, Homo sapiens
ccagagctactgagact

SEQ ID NO: 8305206 - DNA, 22 bp, Homo sapiens
ccagctggcactgtggctgccc

SEQ ID NO: 8305207 - DNA, 22 bp, Homo sapiens
ccagctggcaggagagtcaggg

SEQ ID NO: 8305208 - DNA, 22 bp, Homo sapiens
ccagctggcaggagagtcaggg

SEQ ID NO: 8305209 - DNA, 22 bp, Homo sapiens
ccagctgagaagtgtaaagtga

SEQ ID NO: 8305210 - DNA, 22 bp, Homo sapiens
ccagctgacgatgcctggtctc

SEQ ID NO: 8305211 - DNA, 22 bp, Homo sapiens
ccagctggagctcgcagatagg

SEQ ID NO: 8305212 - DNA, 22 bp, Homo sapiens
ccagctggagccaaggtggact

SEQ ID NO: 8305213 - DNA, 22 bp, Homo sapiens
ccagctggaagagtgcagaact

SEQ ID NO: 8305214 - DNA, 22 bp, Homo sapiens
ccagctctggcttcttgctggg

SEQ ID NO: 8305215 - DNA, 22 bp, Homo sapiens
ccagctcttttggctgagtgag

SEQ ID NO: 8305216 - DNA, 22 bp, Homo sapiens
ccagctcttggtgcacttacat

SEQ ID NO: 8305217 - DNA, 23 bp, Homo sapiens
ccagctccgtgagcctcgggctc

SEQ ID NO: 8305218 - DNA, 22 bp, Homo sapiens
ccaggaatgaaatgtagataaa

SEQ ID NO: 8305219 - DNA, 18 bp, Homo sapiens
aggcctgggaagctgagg

SEQ ID NO: 8305220 - DNA, 22 bp, Homo sapiens
aggcctgggacgggagccgtga

SEQ ID NO: 8305221 - DNA, 22 bp, Homo sapiens
aggcctggccccagttgctagg

SEQ ID NO: 8305222 - DNA, 22 bp, Homo sapiens
aggcctggcatgagacctgaga

SEQ ID NO: 8305223 - DNA, 22 bp, Homo sapiens
aggcctggcatgagacctgaga

SEQ ID NO: 8305224 - DNA, 22 bp, Homo sapiens
aggcctggcctgggcggcattg

SEQ ID NO: 8305225 - DNA, 22 bp, Homo sapiens
aggcctggcctgggcggcattg

SEQ ID NO: 8305226 - DNA, 22 bp, Homo sapiens
aggcctggcctgggcggcattg

SEQ ID NO: 8305227 - DNA, 22 bp, Homo sapiens
aggcctggctttggtttgctga

SEQ ID NO: 8305228 - DNA, 22 bp, Homo sapiens
aggcctggcctttatgttcaag

SEQ ID NO: 8305229 - DNA, 22 bp, Homo sapiens
cctgaagatgctgtggcctggt

SEQ ID NO: 8305230 - DNA, 22 bp, Homo sapiens
cctgaagagcactctagagttg

SEQ ID NO: 8305231 - DNA, 22 bp, Homo sapiens
cctgagagcagcttcctgctta

SEQ ID NO: 8305232 - DNA, 22 bp, Homo sapiens
cctgagagagaagcgacctggt

SEQ ID NO: 8305233 - DNA, 22 bp, Homo sapiens
cctgagagcattccacactgaa

SEQ ID NO: 8305234 - DNA, 22 bp, Homo sapiens
cctgagaggccctctcactgtc

SEQ ID NO: 8305235 - DNA, 22 bp, Homo sapiens
cctgagagcgagtggcctcatg

SEQ ID NO: 8305236 - DNA, 22 bp, Homo sapiens
agggtagggcccggagacagac

SEQ ID NO: 8305237 - DNA, 22 bp, Homo sapiens
aggggtgaaggcccgataggag

SEQ ID NO: 8305238 - DNA, 22 bp, Homo sapiens
agggtataaagagcaagcagaa

SEQ ID NO: 8305239 - DNA, 22 bp, Homo sapiens
agggtatgtttttatctactgt

SEQ ID NO: 8305240 - DNA, 22 bp, Homo sapiens
cctgaggtctagagtcagggtg

SEQ ID NO: 8305241 - DNA, 22 bp, Homo sapiens
cctcttccactgggccccatcc

SEQ ID NO: 8305242 - DNA, 22 bp, Homo sapiens
aggggagagttaatgtgaatgt

SEQ ID NO: 8305243 - DNA, 22 bp, Homo sapiens
agggctggctccgttaccttga

SEQ ID NO: 8305244 - DNA, 22 bp, Homo sapiens
agggctggctaggtgcgttccc

SEQ ID NO: 8305245 - DNA, 22 bp, Homo sapiens
agggctggctaggtgcgttccc

SEQ ID NO: 8305246 - DNA, 22 bp, Homo sapiens
agggctggccacatgatttggt

SEQ ID NO: 8305247 - DNA, 22 bp, Homo sapiens
agggctggccacatgatttggt

SEQ ID NO: 8305248 - DNA, 22 bp, Homo sapiens
agggctggcatctctaatgctg

SEQ ID NO: 8305249 - DNA, 22 bp, Homo sapiens
agggctggcatctctaatgctg

SEQ ID NO: 8305250 - DNA, 22 bp, Homo sapiens
aggggaggcagcgataaacctg

SEQ ID NO: 8305251 - DNA, 22 bp, Homo sapiens
aggggaggagcttttcttgcct

SEQ ID NO: 8305252 - DNA, 22 bp, Homo sapiens
aggggaggtgtccccaaatctc

SEQ ID NO: 8305253 - DNA, 22 bp, Homo sapiens
agggctggagggtactagttta

SEQ ID NO: 8305254 - DNA, 22 bp, Homo sapiens
agggctggagccacagctggga

SEQ ID NO: 8305255 - DNA, 22 bp, Homo sapiens
agggctggagccacagctggga

SEQ ID NO: 8305256 - DNA, 22 bp, Homo sapiens
agggctggcaagggattgaaat

SEQ ID NO: 8305257 - DNA, 22 bp, Homo sapiens
agggctgcatctgcctggtgaa

SEQ ID NO: 8305258 - DNA, 22 bp, Homo sapiens
agggctgctgctccgggcccag

SEQ ID NO: 8305259 - DNA, 22 bp, Homo sapiens
agggctgctgaggaagccttgc

SEQ ID NO: 8305260 - DNA, 22 bp, Homo sapiens
agggcctgagctggctgacctc

SEQ ID NO: 8305261 - DNA, 22 bp, Homo sapiens
agggcctggcgcgtggccgccg

SEQ ID NO: 8305262 - DNA, 22 bp, Homo sapiens
agggcctggaactgtgggcagg

SEQ ID NO: 8305263 - DNA, 22 bp, Homo sapiens
agggcctggaactggagaccac

SEQ ID NO: 8305264 - DNA, 22 bp, Homo sapiens
agggcctgcatcaggagcttgg

SEQ ID NO: 8305265 - DNA, 22 bp, Homo sapiens
agggcctgctctatcactctca

SEQ ID NO: 8305266 - DNA, 22 bp, Homo sapiens
cccatgccttctgactcacagg

SEQ ID NO: 8305267 - DNA, 22 bp, Homo sapiens
ccccttccacagtgcttcctaa

SEQ ID NO: 8305268 - DNA, 22 bp, Homo sapiens
ccccttccaggaagcagaatcg

SEQ ID NO: 8305269 - DNA, 22 bp, Homo sapiens
ccctgctgtcaggtgctgggag

SEQ ID NO: 8305270 - DNA, 22 bp, Homo sapiens
ccctgctgccttcacccaggac

SEQ ID NO: 8305271 - DNA, 22 bp, Homo sapiens
ccctcccaggagtggccagaga

SEQ ID NO: 8305272 - DNA, 22 bp, Homo sapiens
ccctcccagatgggcttgaggt

SEQ ID NO: 8305273 - DNA, 22 bp, Homo sapiens
ccctcccagatgggcttgaggt

SEQ ID NO: 8305274 - DNA, 18 bp, Homo sapiens
ccctgccagctcccagca

SEQ ID NO: 8305275 - DNA, 17 bp, Homo sapiens
ccctgccaccaggaagc

SEQ ID NO: 8305276 - DNA, 22 bp, Homo sapiens
ccctcccaagcactctgacata

SEQ ID NO: 8305277 - DNA, 22 bp, Homo sapiens
ccctcccaagcactctgacata

SEQ ID NO: 8305278 - DNA, 20 bp, Homo sapiens
ccctcccagatgcttcccaa

SEQ ID NO: 8305279 - DNA, 20 bp, Homo sapiens
ccctcccagatgcttcccaa

SEQ ID NO: 8305280 - DNA, 22 bp, Homo sapiens
ccctcagctccaccctcagcag

SEQ ID NO: 8305281 - DNA, 22 bp, Homo sapiens
cccaggctgatgttcagcgggt

SEQ ID NO: 8305282 - DNA, 22 bp, Homo sapiens
cccaggctgatgggatgggcca

SEQ ID NO: 8305283 - DNA, 22 bp, Homo sapiens
cccaggaggtggagcttgcagt

SEQ ID NO: 8305284 - DNA, 22 bp, Homo sapiens
cccaggaggtcaaggctgcagt

SEQ ID NO: 8305285 - DNA, 22 bp, Homo sapiens
cccaggaggtcgaagctgcagt

SEQ ID NO: 8305286 - DNA, 22 bp, Homo sapiens
cccatccctgattttcactcgt

SEQ ID NO: 8305287 - DNA, 22 bp, Homo sapiens
cccatcaggaacccaggagccc

SEQ ID NO: 8305288 - DNA, 22 bp, Homo sapiens
aggctgtctgaccccagagccc

SEQ ID NO: 8305289 - DNA, 21 bp, Homo sapiens
aggctgtcctttgccagccct

SEQ ID NO: 8305290 - DNA, 22 bp, Homo sapiens
aggctgtcatctttgcaggcag

SEQ ID NO: 8305291 - DNA, 22 bp, Homo sapiens
cccaggaggtagaggttgcagt

SEQ ID NO: 8305292 - DNA, 22 bp, Homo sapiens
cccaggagatggaggttgcagt

SEQ ID NO: 8305293 - DNA, 22 bp, Homo sapiens
gctctgagaggtgcagcagtaa

SEQ ID NO: 8305294 - DNA, 19 bp, Homo sapiens
gctctgagaggggcatggg

SEQ ID NO: 8305295 - DNA, 22 bp, Homo sapiens
caaatccagatcccagtcgtag

SEQ ID NO: 8305296 - DNA, 22 bp, Homo sapiens
gctctgggtgaacttggagcaa

SEQ ID NO: 8305297 - DNA, 22 bp, Homo sapiens
caaatgaagaaccttctcacct

SEQ ID NO: 8305298 - DNA, 22 bp, Homo sapiens
caaatgtgtagagcttttgggg

SEQ ID NO: 8305299 - DNA, 22 bp, Homo sapiens
caaatgtgttttttcttctaca

SEQ ID NO: 8305300 - DNA, 22 bp, Homo sapiens
gctgagctgctgttcatcctgc

SEQ ID NO: 8305301 - DNA, 22 bp, Homo sapiens
gctgagctgggacagtcctggg

SEQ ID NO: 8305302 - DNA, 22 bp, Homo sapiens
gctgagctgggacagtcctggg

SEQ ID NO: 8305303 - DNA, 22 bp, Homo sapiens
gctgagctgaggcagggctggg

SEQ ID NO: 8305304 - DNA, 22 bp, Homo sapiens
gctgagctgctgttcatcctgc

SEQ ID NO: 8305305 - DNA, 22 bp, Homo sapiens
gcctggctcctaaggactggct

SEQ ID NO: 8305306 - DNA, 22 bp, Homo sapiens
gcgtggtgctgccctgcacaca

SEQ ID NO: 8305307 - DNA, 22 bp, Homo sapiens
gcctggctcctaagagcacaac

SEQ ID NO: 8305308 - DNA, 18 bp, Homo sapiens
attttgaacaatgctgta

SEQ ID NO: 8305309 - DNA, 22 bp, Homo sapiens
attttgaaaccaagttatttcc

SEQ ID NO: 8305310 - DNA, 22 bp, Homo sapiens
attttgaaaagcatttgagtaa

SEQ ID NO: 8305311 - DNA, 22 bp, Homo sapiens
gcctgcctagaattgcagcttt

SEQ ID NO: 8305312 - DNA, 22 bp, Homo sapiens
gcctgcctagaattgcagcttt

SEQ ID NO: 8305313 - DNA, 22 bp, Homo sapiens
atttgagatggtaaataacttt

SEQ ID NO: 8305314 - DNA, 23 bp, Homo sapiens
atttgagaaagtatttttaagac

SEQ ID NO: 8305315 - DNA, 22 bp, Homo sapiens
atttgcagagctctgaattttg

SEQ ID NO: 8305316 - DNA, 22 bp, Homo sapiens
atttgtctttgagtgccctgct

SEQ ID NO: 8305317 - DNA, 22 bp, Homo sapiens
atttgtcttcagtaggttcttc

SEQ ID NO: 8305318 - DNA, 22 bp, Homo sapiens
atttgtctttggacctgtgaga

SEQ ID NO: 8305319 - DNA, 22 bp, Homo sapiens
atttgtctgcttgctgccttcc

SEQ ID NO: 8305320 - DNA, 22 bp, Homo sapiens
atttcttcctctgtcagtaact

SEQ ID NO: 8305321 - DNA, 19 bp, Homo sapiens
gccctgcaggaggtggggc

SEQ ID NO: 8305322 - DNA, 22 bp, Homo sapiens
gccctcccctctgggtggtgag

SEQ ID NO: 8305323 - DNA, 23 bp, Homo sapiens
gccctccctcccaggtgggtgtt

SEQ ID NO: 8305324 - DNA, 22 bp, Homo sapiens
gccctccctacagcctatttct

SEQ ID NO: 8305325 - DNA, 22 bp, Homo sapiens
gccctcctggcaggcagtgatg

SEQ ID NO: 8305326 - DNA, 20 bp, Homo sapiens
gcccactctaatccactgtc

SEQ ID NO: 8305327 - DNA, 22 bp, Homo sapiens
gcccagcaggacagagtggttt

SEQ ID NO: 8305328 - DNA, 22 bp, Homo sapiens
gcccagcaggacagagtggttt

SEQ ID NO: 8305329 - DNA, 22 bp, Homo sapiens
gcagtgctaagtagctggccca

SEQ ID NO: 8305330 - DNA, 22 bp, Homo sapiens
gcagtgctgatcccatggcaga

SEQ ID NO: 8305331 - DNA, 22 bp, Homo sapiens
gcagtgccttgcttctctgtct

SEQ ID NO: 8305332 - DNA, 22 bp, Homo sapiens
attgtacaatgcctggaacatt

SEQ ID NO: 8305333 - DNA, 22 bp, Homo sapiens
attgtacaatgcctggaacatt

SEQ ID NO: 8305334 - DNA, 22 bp, Homo sapiens
attgtaagtagaaatgttatgg

SEQ ID NO: 8305335 - DNA, 22 bp, Homo sapiens
attgtaattttagagaaagtgg

SEQ ID NO: 8305336 - DNA, 22 bp, Homo sapiens
gcattattaatagctgcatgag

SEQ ID NO: 8305337 - DNA, 22 bp, Homo sapiens
atttaaatgcttaagagggttt

SEQ ID NO: 8305338 - DNA, 22 bp, Homo sapiens
atttaaatgcttaagagggttt

SEQ ID NO: 8305339 - DNA, 21 bp, Homo sapiens
gccactgcactccagcctggg

SEQ ID NO: 8305340 - DNA, 22 bp, Homo sapiens
gccactgcactccagcccaggc

SEQ ID NO: 8305341 - DNA, 19 bp, Homo sapiens
gccactcctgatgctgccc

SEQ ID NO: 8305342 - DNA, 21 bp, Homo sapiens
gccacgtttcagtcttctcag

SEQ ID NO: 8305343 - DNA, 22 bp, Homo sapiens
gccacgttgccacccgggtgac

SEQ ID NO: 8305344 - DNA, 22 bp, Homo sapiens
gcattcatcttcctccatgcag

SEQ ID NO: 8305345 - DNA, 22 bp, Homo sapiens
gcattcctacaggctgctatga

SEQ ID NO: 8305346 - DNA, 22 bp, Homo sapiens
gcattcctgagaatgcagagtg

SEQ ID NO: 8305347 - DNA, 22 bp, Homo sapiens
gcaggatggtgccctttctgcc

SEQ ID NO: 8305348 - DNA, 22 bp, Homo sapiens
gcaggatgggagcttcactttg

SEQ ID NO: 8305349 - DNA, 22 bp, Homo sapiens
gcaggatgggagcttcactctg

SEQ ID NO: 8305350 - DNA, 22 bp, Homo sapiens
gcaggatgccagggcagcagcg

SEQ ID NO: 8305351 - DNA, 22 bp, Homo sapiens
gcaggatgagtgagtacattta

SEQ ID NO: 8305352 - DNA, 21 bp, Homo sapiens
gcaggatgcatcttggtgtct

SEQ ID NO: 8305353 - DNA, 22 bp, Homo sapiens
gcaggagcagtcaggggcagct

SEQ ID NO: 8305354 - DNA, 22 bp, Homo sapiens
gcaggagccacttcagggatgc

SEQ ID NO: 8305355 - DNA, 22 bp, Homo sapiens
gcaggatgaaggcagaggctga

SEQ ID NO: 8305356 - DNA, 22 bp, Homo sapiens
gcagggaggaagagatgcttcc

SEQ ID NO: 8305357 - DNA, 22 bp, Homo sapiens
gcagggactgtgatctcacaga

SEQ ID NO: 8305358 - DNA, 22 bp, Homo sapiens
gcaggctgtgaggctcagatgg

SEQ ID NO: 8305359 - DNA, 22 bp, Homo sapiens
gcaggctgtctaaagttagagt

SEQ ID NO: 8305360 - DNA, 22 bp, Homo sapiens
gcaggtggatcacctgaggtca

SEQ ID NO: 8305361 - DNA, 22 bp, Homo sapiens
gcagggtgaaggtcacatagaa

SEQ ID NO: 8305362 - DNA, 22 bp, Homo sapiens
gcagggaggtttgctgacctgg

SEQ ID NO: 8305363 - DNA, 22 bp, Homo sapiens
gcagggtcttgagaggcagcca

SEQ ID NO: 8305364 - DNA, 21 bp, Homo sapiens
gcagggtcctttccattccta

SEQ ID NO: 8305365 - DNA, 22 bp, Homo sapiens
gcagggtcgctctaggagatca

SEQ ID NO: 8305366 - DNA, 22 bp, Homo sapiens
gcagggtctgaggccacagagg

SEQ ID NO: 8305367 - DNA, 22 bp, Homo sapiens
gcagggtctgaggccacagagg

SEQ ID NO: 8305368 - DNA, 22 bp, Homo sapiens
gcagggtccatggaggcagccc

SEQ ID NO: 8305369 - DNA, 22 bp, Homo sapiens
gcagggtataatacttaggtga

SEQ ID NO: 8305370 - DNA, 22 bp, Homo sapiens
gcagggtaggtgacaggtagtc

SEQ ID NO: 8305371 - DNA, 22 bp, Homo sapiens
gatttctgtaacacttcagata

SEQ ID NO: 8305372 - DNA, 22 bp, Homo sapiens
gcaactgaacatgtgtgtggcc

SEQ ID NO: 8305373 - DNA, 22 bp, Homo sapiens
gcaaatgctctccttggtcagg

SEQ ID NO: 8305374 - DNA, 20 bp, Homo sapiens
gcaaatggatcccacaagcc

SEQ ID NO: 8305375 - DNA, 22 bp, Homo sapiens
gcacagggagcaggtctctggt

SEQ ID NO: 8305376 - DNA, 21 bp, Homo sapiens
gcacagggacagatcatcaca

SEQ ID NO: 8305377 - DNA, 22 bp, Homo sapiens
gcacagggagacagccgtggcc

SEQ ID NO: 8305378 - DNA, 22 bp, Homo sapiens
gcacagggagacagccgtggcc

SEQ ID NO: 8305379 - DNA, 22 bp, Homo sapiens
gcacagggaggctggcctggcc

SEQ ID NO: 8305380 - DNA, 22 bp, Homo sapiens
gcacagggcaacaggtctgtta

SEQ ID NO: 8305381 - DNA, 22 bp, Homo sapiens
gcacagggccctgtgcgtaggt

SEQ ID NO: 8305382 - DNA, 22 bp, Homo sapiens
gcagaaggtctggcacttcagg

SEQ ID NO: 8305383 - DNA, 22 bp, Homo sapiens
gcagaagggaataaggagcttt

SEQ ID NO: 8305384 - DNA, 22 bp, Homo sapiens
gcagaggctccattttacagat

SEQ ID NO: 8305385 - DNA, 19 bp, Homo sapiens
gcagccaggtgctctacct

SEQ ID NO: 8305386 - DNA, 18 bp, Homo sapiens
gcaggagatgggtggggt

SEQ ID NO: 8305387 - DNA, 18 bp, Homo sapiens
gcaggagatgggtggggt

SEQ ID NO: 8305388 - DNA, 22 bp, Homo sapiens
gcaggagagtctgtgccaggtt

SEQ ID NO: 8305389 - DNA, 22 bp, Homo sapiens
gcagcctgatgatctgggttgt

SEQ ID NO: 8305390 - DNA, 22 bp, Homo sapiens
gcagcctgggcaacagagtgag

SEQ ID NO: 8305391 - DNA, 22 bp, Homo sapiens
gcagcctgttgtaccagcctgt

SEQ ID NO: 8305392 - DNA, 22 bp, Homo sapiens
gagttattaatggctgagtttg

SEQ ID NO: 8305393 - DNA, 19 bp, Homo sapiens
gagttattgccagggcatg

SEQ ID NO: 8305394 - DNA, 22 bp, Homo sapiens
gagttattctaggtcctttgta

SEQ ID NO: 8305395 - DNA, 22 bp, Homo sapiens
gagttatttgtagggattatat

SEQ ID NO: 8305396 - DNA, 22 bp, Homo sapiens
gagttatttcagaaggaaagat

SEQ ID NO: 8305397 - DNA, 22 bp, Homo sapiens
gagttattgggtggaaaggtag

SEQ ID NO: 8305398 - DNA, 22 bp, Homo sapiens
gatccttgcaactctgtgaggt

SEQ ID NO: 8305399 - DNA, 22 bp, Homo sapiens
gatccttgcacttgacttggca

SEQ ID NO: 8305400 - DNA, 21 bp, Homo sapiens
gagtgcagcaaggtagagtct

SEQ ID NO: 8305401 - DNA, 22 bp, Homo sapiens
gagtgcagatgaacagaagatt

SEQ ID NO: 8305402 - DNA, 22 bp, Homo sapiens
gagtgcagatgaacagaagatt

SEQ ID NO: 8305403 - DNA, 23 bp, Homo sapiens
gagtgcagaatagacatgcagtg

SEQ ID NO: 8305404 - DNA, 21 bp, Homo sapiens
gagtgcaggtctgatgccatc

SEQ ID NO: 8305405 - DNA, 22 bp, Homo sapiens
gagggggcgtgcaaggctccgc

SEQ ID NO: 8305406 - DNA, 22 bp, Homo sapiens
gagggcagaaaattatgcggtg

SEQ ID NO: 8305407 - DNA, 22 bp, Homo sapiens
gaggtacatgaggatacacagg

SEQ ID NO: 8305408 - DNA, 23 bp, Homo sapiens
gaggtacagcaccagtgaatagg

SEQ ID NO: 8305409 - DNA, 22 bp, Homo sapiens
gaggtacagagtgttccaatgt

SEQ ID NO: 8305410 - DNA, 22 bp, Homo sapiens
gaggtagcatgctggaagggac

SEQ ID NO: 8305411 - DNA, 22 bp, Homo sapiens
gaggtagccacagatagagact

SEQ ID NO: 8305412 - DNA, 22 bp, Homo sapiens
gaggccacagctatcagggaca

SEQ ID NO: 8305413 - DNA, 22 bp, Homo sapiens
gaggctgctttgatgacaggag

SEQ ID NO: 8305414 - DNA, 22 bp, Homo sapiens
gaggcatgtctggcctgtccca

SEQ ID NO: 8305415 - DNA, 22 bp, Homo sapiens
gagggaaaggttaatacatgat

SEQ ID NO: 8305416 - DNA, 22 bp, Homo sapiens
gagggatggtgtgagaggctca

SEQ ID NO: 8305417 - DNA, 22 bp, Homo sapiens
gagcagtgaagacagaagtaca

SEQ ID NO: 8305418 - DNA, 22 bp, Homo sapiens
gagcagggccacttctgtacct

SEQ ID NO: 8305419 - DNA, 22 bp, Homo sapiens
gagcagggagacaactctggtg

SEQ ID NO: 8305420 - DNA, 19 bp, Homo sapiens
gagcagctgcacccattga

SEQ ID NO: 8305421 - DNA, 22 bp, Homo sapiens
gagcagctctgggtgacccagt

SEQ ID NO: 8305422 - DNA, 22 bp, Homo sapiens
gagcagctgagctggaatgaga

SEQ ID NO: 8305423 - DNA, 22 bp, Homo sapiens
gagcctggcctcctgcctcagc

SEQ ID NO: 8305424 - DNA, 20 bp, Homo sapiens
gagcctgggaagtctaaggt

SEQ ID NO: 8305425 - DNA, 20 bp, Homo sapiens
gagcctgggaagtctaaggt

SEQ ID NO: 8305426 - DNA, 22 bp, Homo sapiens
gagcctgggactgggggtcatg

SEQ ID NO: 8305427 - DNA, 22 bp, Homo sapiens
gagcctggggaccctcctgagt

SEQ ID NO: 8305428 - DNA, 22 bp, Homo sapiens
gagcctggggaccctcctgagt

SEQ ID NO: 8305429 - DNA, 21 bp, Homo sapiens
gagccttccctctgccctttc

SEQ ID NO: 8305430 - DNA, 20 bp, Homo sapiens
gagccttcccctcaccactg

SEQ ID NO: 8305431 - DNA, 22 bp, Homo sapiens
gagccttcatcgcagccttgtt

SEQ ID NO: 8305432 - DNA, 22 bp, Homo sapiens
gagcctgtgtttcctgtagcca

SEQ ID NO: 8305433 - DNA, 22 bp, Homo sapiens
gagcctgtgtttcctgtagcca

SEQ ID NO: 8305434 - DNA, 22 bp, Homo sapiens
atgcttttcctaaaatgatgcc

SEQ ID NO: 8305435 - DNA, 22 bp, Homo sapiens
gagaggtcatctcccatcagca

SEQ ID NO: 8305436 - DNA, 22 bp, Homo sapiens
gagaggctgaaatcacaggagc

SEQ ID NO: 8305437 - DNA, 22 bp, Homo sapiens
gagaggctgactggctgtcctg

SEQ ID NO: 8305438 - DNA, 22 bp, Homo sapiens
gagcagctagataaagcccttc

SEQ ID NO: 8305439 - DNA, 22 bp, Homo sapiens
gagcagctcgagaaggaagcag

SEQ ID NO: 8305440 - DNA, 22 bp, Homo sapiens
gagcagctccagccgcatgact

SEQ ID NO: 8305441 - DNA, 22 bp, Homo sapiens
gagaggtggaggttgcagtgag

SEQ ID NO: 8305442 - DNA, 22 bp, Homo sapiens
gagctctggcagggcaggtctg

SEQ ID NO: 8305443 - DNA, 22 bp, Homo sapiens
gagctctgggaaacaaagtgta

SEQ ID NO: 8305444 - DNA, 22 bp, Homo sapiens
gagcttggtgatgcctcctggt

SEQ ID NO: 8305445 - DNA, 22 bp, Homo sapiens
gagctttgctggaagcctgggg

SEQ ID NO: 8305446 - DNA, 22 bp, Homo sapiens
gaggaagcagggcttggctgag

SEQ ID NO: 8305447 - DNA, 22 bp, Homo sapiens
atgtcacagctcccattcctcc

SEQ ID NO: 8305448 - DNA, 22 bp, Homo sapiens
atgtcacagtctgactcagtga

SEQ ID NO: 8305449 - DNA, 22 bp, Homo sapiens
atgtcacagtctgactcagtga

SEQ ID NO: 8305450 - DNA, 22 bp, Homo sapiens
atgtacaaaatgccactgaatt

SEQ ID NO: 8305451 - DNA, 22 bp, Homo sapiens
atgtaacaggtgaagctctgag

SEQ ID NO: 8305452 - DNA, 22 bp, Homo sapiens
atgtaacttctgtgaatctgac

SEQ ID NO: 8305453 - DNA, 22 bp, Homo sapiens
atgtaactgttatattttgttg

SEQ ID NO: 8305454 - DNA, 22 bp, Homo sapiens
atgtaaggttcagagtatgtga

SEQ ID NO: 8305455 - DNA, 22 bp, Homo sapiens
atgtaaggctgcctatgacact

SEQ ID NO: 8305456 - DNA, 22 bp, Homo sapiens
atcttccttcactttctcccac

SEQ ID NO: 8305457 - DNA, 22 bp, Homo sapiens
atcttcaacttgatcatttgaa

SEQ ID NO: 8305458 - DNA, 22 bp, Homo sapiens
atcttcaaagcacatcgtttgt

SEQ ID NO: 8305459 - DNA, 22 bp, Homo sapiens
atgaatccagcaaacagtgagg

SEQ ID NO: 8305460 - DNA, 22 bp, Homo sapiens
ctttttccagcttcagggtggg

SEQ ID NO: 8305461 - DNA, 22 bp, Homo sapiens
ctttttccagcttcagggtggg

SEQ ID NO: 8305462 - DNA, 22 bp, Homo sapiens
gaaaagagaacatctgaggatc

SEQ ID NO: 8305463 - DNA, 22 bp, Homo sapiens
gaaaatagcagatagaccaatg

SEQ ID NO: 8305464 - DNA, 22 bp, Homo sapiens
gaaatctgcttcttgcatagta

SEQ ID NO: 8305465 - DNA, 22 bp, Homo sapiens
gaaatctgtctttgtttgaata

SEQ ID NO: 8305466 - DNA, 22 bp, Homo sapiens
gaaatctgcggtgaggcctgag

SEQ ID NO: 8305467 - DNA, 22 bp, Homo sapiens
gaaatctgaatcttctgttggt

SEQ ID NO: 8305468 - DNA, 22 bp, Homo sapiens
gaaatctgcccagtgcactggt

SEQ ID NO: 8305469 - DNA, 22 bp, Homo sapiens
gaaaatgtgcctttgggtattg

SEQ ID NO: 8305470 - DNA, 22 bp, Homo sapiens
gaaaatgtgtcatccctactgt

SEQ ID NO: 8305471 - DNA, 22 bp, Homo sapiens
gaaatctgaacaacagctgtca

SEQ ID NO: 8305472 - DNA, 22 bp, Homo sapiens
gaaatctgaactctgtatcctt

SEQ ID NO: 8305473 - DNA, 22 bp, Homo sapiens
atgcaagatgtatagaagactt

SEQ ID NO: 8305474 - DNA, 22 bp, Homo sapiens
gactttctctcctcccaggtgt

SEQ ID NO: 8305475 - DNA, 22 bp, Homo sapiens
gaccctgccatgagtgacaggg

SEQ ID NO: 8305476 - DNA, 22 bp, Homo sapiens
gaccctctagatggaagcactg

SEQ ID NO: 8305477 - DNA, 22 bp, Homo sapiens
atgctttacagttttccaaaca

SEQ ID NO: 8305478 - DNA, 22 bp, Homo sapiens
gacagggcaagactctgtctaa

SEQ ID NO: 8305479 - DNA, 22 bp, Homo sapiens
gacagggcatggtgcagagttc

SEQ ID NO: 8305480 - DNA, 22 bp, Homo sapiens
gacagggccgcagatggagact

SEQ ID NO: 8305481 - DNA, 22 bp, Homo sapiens
gacagggcgcccagcctgtttc

SEQ ID NO: 8305482 - DNA, 22 bp, Homo sapiens
gacagggcgagactcagtctca

SEQ ID NO: 8305483 - DNA, 23 bp, Homo sapiens
gaagcagatgtctgagtaggcag

SEQ ID NO: 8305484 - DNA, 22 bp, Homo sapiens
atgcacaagaggctagaaaaga

SEQ ID NO: 8305485 - DNA, 22 bp, Homo sapiens
gaatgtgtcaccctgtcccatg

SEQ ID NO: 8305486 - DNA, 22 bp, Homo sapiens
gaatgtgtgactctattgagca

SEQ ID NO: 8305487 - DNA, 22 bp, Homo sapiens
gaatgtgtactgagtgcccctt

SEQ ID NO: 8305488 - DNA, 22 bp, Homo sapiens
gaatgtaatagtcagtagaaca

SEQ ID NO: 8305489 - DNA, 22 bp, Homo sapiens
atgcataatgtatgtattgact

SEQ ID NO: 8305490 - DNA, 20 bp, Homo sapiens
atgcctctaattttgcaaac

SEQ ID NO: 8305491 - DNA, 22 bp, Homo sapiens
atgcctggactgacatgcactg

SEQ ID NO: 8305492 - DNA, 22 bp, Homo sapiens
atgcccgatacctagttaactc

SEQ ID NO: 8305493 - DNA, 22 bp, Homo sapiens
atgccccagtgtgtgcttcctt

SEQ ID NO: 8305494 - DNA, 22 bp, Homo sapiens
atgccccaggaggtgccatcca

SEQ ID NO: 8305495 - DNA, 22 bp, Homo sapiens
atgcccaatgtcacaatttttg

SEQ ID NO: 8305496 - DNA, 22 bp, Homo sapiens
atgccacttcattccagcctcg

SEQ ID NO: 8305497 - DNA, 22 bp, Homo sapiens
ggcaggtgtgagatcgaggcca

SEQ ID NO: 8305498 - DNA, 22 bp, Homo sapiens
ggcagtagccagggactggcag

SEQ ID NO: 8305499 - DNA, 22 bp, Homo sapiens
cacatttctgtgagtcaatatt

SEQ ID NO: 8305500 - DNA, 22 bp, Homo sapiens
cacatttctctacctcacacaa

SEQ ID NO: 8305501 - DNA, 22 bp, Homo sapiens
cacatttctaggaaattaaatg

SEQ ID NO: 8305502 - DNA, 22 bp, Homo sapiens
cacatgcataaggataattact

SEQ ID NO: 8305503 - DNA, 22 bp, Homo sapiens
ggcaggagaaaggtctcttctt

SEQ ID NO: 8305504 - DNA, 22 bp, Homo sapiens
ggcagcttttatccctgacaga

SEQ ID NO: 8305505 - DNA, 22 bp, Homo sapiens
ggataagaaaattgtaataact

SEQ ID NO: 8305506 - DNA, 22 bp, Homo sapiens
ggatcattaacacatccatcac

SEQ ID NO: 8305507 - DNA, 22 bp, Homo sapiens
ggaggtggaggttgcagtgagc

SEQ ID NO: 8305508 - DNA, 22 bp, Homo sapiens
ggagtgactcacagctgggaca

SEQ ID NO: 8305509 - DNA, 22 bp, Homo sapiens
ggagtgaatcactagatgcaga

SEQ ID NO: 8305510 - DNA, 22 bp, Homo sapiens
ggagtgactctcggggccacta

SEQ ID NO: 8305511 - DNA, 22 bp, Homo sapiens
cacccagcagcacttaagacta

SEQ ID NO: 8305512 - DNA, 22 bp, Homo sapiens
cacccagccttcacacaggagt

SEQ ID NO: 8305513 - DNA, 22 bp, Homo sapiens
cacccagccttcacacaggagt

SEQ ID NO: 8305514 - DNA, 22 bp, Homo sapiens
cacccaggcaggtggctgagaa

SEQ ID NO: 8305515 - DNA, 22 bp, Homo sapiens
cacccaggctagagtgcagtgg

SEQ ID NO: 8305516 - DNA, 20 bp, Homo sapiens
caccacagaattggggacag

SEQ ID NO: 8305517 - DNA, 22 bp, Homo sapiens
cacatttgaaggaattagcatt

SEQ ID NO: 8305518 - DNA, 17 bp, Homo sapiens
ggcctgtgtggctgcag

SEQ ID NO: 8305519 - DNA, 17 bp, Homo sapiens
ggcctgtgtggctgcag

SEQ ID NO: 8305520 - DNA, 22 bp, Homo sapiens
ggccccaggacctccacggtcc

SEQ ID NO: 8305521 - DNA, 22 bp, Homo sapiens
ggcgagggagcagtgcggtggg

SEQ ID NO: 8305522 - DNA, 17 bp, Homo sapiens
ggcctgtgtggctgcag

SEQ ID NO: 8305523 - DNA, 22 bp, Homo sapiens
ggcccagcacagtgcttggggg

SEQ ID NO: 8305524 - DNA, 19 bp, Homo sapiens
cagaacagaggtcatggcc

SEQ ID NO: 8305525 - DNA, 22 bp, Homo sapiens
cagaacattcactcatatgtgg

SEQ ID NO: 8305526 - DNA, 22 bp, Homo sapiens
cagaacattccatgtgccctgc

SEQ ID NO: 8305527 - DNA, 22 bp, Homo sapiens
ggcttgcttcttgtccaggaat

SEQ ID NO: 8305528 - DNA, 22 bp, Homo sapiens
ggctgggagctggacaggccgg

SEQ ID NO: 8305529 - DNA, 22 bp, Homo sapiens
ggcttcttcctgtgaacatgtt

SEQ ID NO: 8305530 - DNA, 22 bp, Homo sapiens
ggctggctttctctccgcacct

SEQ ID NO: 8305531 - DNA, 22 bp, Homo sapiens
cagaaattcccatttcagattc

SEQ ID NO: 8305532 - DNA, 22 bp, Homo sapiens
cagaaatgttctaatgattcag

SEQ ID NO: 8305533 - DNA, 22 bp, Homo sapiens
cagaaatgtttatatgtggtgt

SEQ ID NO: 8305534 - DNA, 22 bp, Homo sapiens
ggctgctgtgacctcaggtgat

SEQ ID NO: 8305535 - DNA, 22 bp, Homo sapiens
cagaaatggagcccaggaatct

SEQ ID NO: 8305536 - DNA, 22 bp, Homo sapiens
cagaaatggaattttccatcac

SEQ ID NO: 8305537 - DNA, 22 bp, Homo sapiens
ggctgctgtactgatgtcagtt

SEQ ID NO: 8305538 - DNA, 22 bp, Homo sapiens
ggctgctggtggaatggtaggc

SEQ ID NO: 8305539 - DNA, 19 bp, Homo sapiens
ggctgctggttacagaggc

SEQ ID NO: 8305540 - DNA, 22 bp, Homo sapiens
ggctgctggtaggggtaggaag

SEQ ID NO: 8305541 - DNA, 22 bp, Homo sapiens
ggctgctggtggaatggtaggc

SEQ ID NO: 8305542 - DNA, 22 bp, Homo sapiens
ggctgcctcaaagctcaagctc

SEQ ID NO: 8305543 - DNA, 22 bp, Homo sapiens
cactgtcttttgtgaagacaat

SEQ ID NO: 8305544 - DNA, 22 bp, Homo sapiens
ggctgccttgaccctggctccg

SEQ ID NO: 8305545 - DNA, 22 bp, Homo sapiens
ggctgcctcaaagctcaagctc

SEQ ID NO: 8305546 - DNA, 19 bp, Homo sapiens
ggctgcctttccttaccag

SEQ ID NO: 8305547 - DNA, 22 bp, Homo sapiens
ggctgcagatagccagccacca

SEQ ID NO: 8305548 - DNA, 22 bp, Homo sapiens
cactgcctccccaggctccaca

SEQ ID NO: 8305549 - DNA, 22 bp, Homo sapiens
ggctgcagcggattggggattg

SEQ ID NO: 8305550 - DNA, 22 bp, Homo sapiens
ggctgcagcagagggactcacg

SEQ ID NO: 8305551 - DNA, 22 bp, Homo sapiens
ggctcctgggggtgctcctgcc

SEQ ID NO: 8305552 - DNA, 22 bp, Homo sapiens
ggctcctgtcccctcagctgct

SEQ ID NO: 8305553 - DNA, 22 bp, Homo sapiens
ggctcctgtcctcctggagctc

SEQ ID NO: 8305554 - DNA, 22 bp, Homo sapiens
ggctcctgtcctcctggagctc

SEQ ID NO: 8305555 - DNA, 22 bp, Homo sapiens
ggctcctgtggcaagacagctt

SEQ ID NO: 8305556 - DNA, 19 bp, Homo sapiens
ggctcctgtggctgcagcc

SEQ ID NO: 8305557 - DNA, 22 bp, Homo sapiens
cactgagttccctgacatttca

SEQ ID NO: 8305558 - DNA, 22 bp, Homo sapiens
gctggtgccttgttgttgttac

SEQ ID NO: 8305559 - DNA, 22 bp, Homo sapiens
gctggtgcattagctgcagttc

SEQ ID NO: 8305560 - DNA, 22 bp, Homo sapiens
gctggtgagcaaaggagaagga

SEQ ID NO: 8305561 - DNA, 22 bp, Homo sapiens
gctggtgagcaaaggagaagga

SEQ ID NO: 8305562 - DNA, 20 bp, Homo sapiens
caatgcacacagctgcttct

SEQ ID NO: 8305563 - DNA, 22 bp, Homo sapiens
gctggttagaaaacagagctca

SEQ ID NO: 8305564 - DNA, 22 bp, Homo sapiens
gctggttaggtgagggtgcgcc

SEQ ID NO: 8305565 - DNA, 22 bp, Homo sapiens
caagtgtctatatcagtgcttg

SEQ ID NO: 8305566 - DNA, 22 bp, Homo sapiens
caatggtggtgtcagaagagat

SEQ ID NO: 8305567 - DNA, 22 bp, Homo sapiens
gctgggaggaatttggggaata

SEQ ID NO: 8305568 - DNA, 22 bp, Homo sapiens
gctgggagccgtacctgtcacg

SEQ ID NO: 8305569 - DNA, 22 bp, Homo sapiens
gctggccatagaagccaaagag

SEQ ID NO: 8305570 - DNA, 22 bp, Homo sapiens
gctggccatatattttgctgtt

SEQ ID NO: 8305571 - DNA, 22 bp, Homo sapiens
gctggccatggcctgcgccatc

SEQ ID NO: 8305572 - DNA, 22 bp, Homo sapiens
gctggccattctctttgagatg

SEQ ID NO: 8305573 - DNA, 22 bp, Homo sapiens
gctggccatggggagtgaggag

SEQ ID NO: 8305574 - DNA, 22 bp, Homo sapiens
gctggccatggggagtgaggag

SEQ ID NO: 8305575 - DNA, 22 bp, Homo sapiens
gctgggagccctggtctgctcc

SEQ ID NO: 8305576 - DNA, 22 bp, Homo sapiens
gctgggagccccgagccagcgc

SEQ ID NO: 8305577 - DNA, 22 bp, Homo sapiens
gctgggagcaaagccatgcata

SEQ ID NO: 8305578 - DNA, 22 bp, Homo sapiens
gctgggagcaagtactcatctt

SEQ ID NO: 8305579 - DNA, 22 bp, Homo sapiens
gctgaggtggagattgcagtga

SEQ ID NO: 8305580 - DNA, 22 bp, Homo sapiens
gctggccagtgtggtgaccacc

SEQ ID NO: 8305581 - DNA, 19 bp, Homo sapiens
gctggcagatgtggccgtg

SEQ ID NO: 8305582 - DNA, 20 bp, Homo sapiens
gctgaggtcattatgcctca

SEQ ID NO: 8305583 - DNA, 22 bp, Homo sapiens
gctgaggtaggaggttgcagtg

SEQ ID NO: 8305584 - DNA, 22 bp, Homo sapiens
ggaagagagggctgggcctcaa

SEQ ID NO: 8305585 - DNA, 19 bp, Homo sapiens
ggaagagaggaaaggtgga

SEQ ID NO: 8305586 - DNA, 22 bp, Homo sapiens
ggacacaagctccggggctgca

SEQ ID NO: 8305587 - DNA, 19 bp, Homo sapiens
ggacacagaaagctgcatt

SEQ ID NO: 8305588 - DNA, 22 bp, Homo sapiens
ggacacagataatcacacagat

SEQ ID NO: 8305589 - DNA, 22 bp, Homo sapiens
ggacagccgagtggccttctcc

SEQ ID NO: 8305590 - DNA, 22 bp, Homo sapiens
ggacagcccatacacatgtctg

SEQ ID NO: 8305591 - DNA, 22 bp, Homo sapiens
ggagagtgggagcaactgttgc

SEQ ID NO: 8305592 - DNA, 16 bp, Homo sapiens
ggagagtgtctgcaaa

SEQ ID NO: 8305593 - DNA, 22 bp, Homo sapiens
ggagagtggattccagctgtat

SEQ ID NO: 8305594 - DNA, 17 bp, Homo sapiens
ggagagtgggaatggcc

SEQ ID NO: 8305595 - DNA, 22 bp, Homo sapiens
ggagagtggattccagctgtat

SEQ ID NO: 8305596 - DNA, 18 bp, Homo sapiens
ggagagtgagatcaaaca

SEQ ID NO: 8305597 - DNA, 18 bp, Homo sapiens
ggagagtgacagagtcgt

SEQ ID NO: 8305598 - DNA, 22 bp, Homo sapiens
ggagatagacttggtgagccac

SEQ ID NO: 8305599 - DNA, 22 bp, Homo sapiens
ggaggagaccctgtgtcagttt

SEQ ID NO: 8305600 - DNA, 22 bp, Homo sapiens
ggaggagacagtaaaaagcacg

SEQ ID NO: 8305601 - DNA, 22 bp, Homo sapiens
ggaggggcagccatggaactcc

SEQ ID NO: 8305602 - DNA, 22 bp, Homo sapiens
ggaggggccggctgcctgccac

SEQ ID NO: 8305603 - DNA, 22 bp, Homo sapiens
cacaggagagctgggaggtgcc

SEQ ID NO: 8305604 - DNA, 22 bp, Homo sapiens
cacagctgaagtagccatgtgg

SEQ ID NO: 8305605 - DNA, 22 bp, Homo sapiens
cacagcctgctgcactcaagaa

SEQ ID NO: 8305606 - DNA, 22 bp, Homo sapiens
gggctctgcgctcagctccagc

SEQ ID NO: 8305607 - DNA, 18 bp, Homo sapiens
gggctctgatccttcacc

SEQ ID NO: 8305608 - DNA, 22 bp, Homo sapiens
gggggaggtgaatgcaataagg

SEQ ID NO: 8305609 - DNA, 22 bp, Homo sapiens
ggggcggggctctgagaagcat

SEQ ID NO: 8305610 - DNA, 22 bp, Homo sapiens
cagaggcagaggtcatctctgg

SEQ ID NO: 8305611 - DNA, 18 bp, Homo sapiens
cagaagcaggcagtgcag

SEQ ID NO: 8305612 - DNA, 20 bp, Homo sapiens
cagagacctgtcttcacaga

SEQ ID NO: 8305613 - DNA, 22 bp, Homo sapiens
cagagagagtcaaatctttgct

SEQ ID NO: 8305614 - DNA, 22 bp, Homo sapiens
cagagagaggccactgctatta

SEQ ID NO: 8305615 - DNA, 23 bp, Homo sapiens
cagaagcacctgttgactgctgc

SEQ ID NO: 8305616 - DNA, 22 bp, Homo sapiens
cagaagcactaggaggaaacgt

SEQ ID NO: 8305617 - DNA, 22 bp, Homo sapiens
cagaagcaaatgccttgctgag

SEQ ID NO: 8305618 - DNA, 22 bp, Homo sapiens
cagaagcaaatgccttgctgag

SEQ ID NO: 8305619 - DNA, 22 bp, Homo sapiens
gggccctggacgtggcggcaga

SEQ ID NO: 8305620 - DNA, 22 bp, Homo sapiens
gggccctggacgtggcggcaga

SEQ ID NO: 8305621 - DNA, 22 bp, Homo sapiens
gggccctggatttaagcatgga

SEQ ID NO: 8305622 - DNA, 22 bp, Homo sapiens
cagagagagtggggtgtggatt

SEQ ID NO: 8305623 - DNA, 22 bp, Homo sapiens
cagagagcttagtgtgctgcat

SEQ ID NO: 8305624 - DNA, 22 bp, Homo sapiens
cagagcagagtgattgttctgg

SEQ ID NO: 8305625 - DNA, 22 bp, Homo sapiens
cagagcagcagagcttccatgg

SEQ ID NO: 8305626 - DNA, 22 bp, Homo sapiens
cagagcagcagagcttccatgg

SEQ ID NO: 8305627 - DNA, 18 bp, Homo sapiens
gggccctggcgtccgccc

SEQ ID NO: 8305628 - DNA, 21 bp, Homo sapiens
cagagcagcgttctgctgtgg

SEQ ID NO: 8305629 - DNA, 21 bp, Homo sapiens
cagagcagcgttctgctgtgg

SEQ ID NO: 8305630 - DNA, 22 bp, Homo sapiens
cagagtgaaaactgagctcaaa

SEQ ID NO: 8305631 - DNA, 22 bp, Homo sapiens
cagagtgaaaactgagctcaaa

SEQ ID NO: 8305632 - DNA, 22 bp, Homo sapiens
ggggtctgcgccactgtctgcg

SEQ ID NO: 8305633 - DNA, 22 bp, Homo sapiens
cagagtgttgaccataagccca

SEQ ID NO: 8305634 - DNA, 22 bp, Homo sapiens
cagagtgtatctgtgtaagcat

SEQ ID NO: 8305635 - DNA, 22 bp, Homo sapiens
cagagtgtggcatcttccaact

SEQ ID NO: 8305636 - DNA, 22 bp, Homo sapiens
cagagtgtattctgcagttgca

SEQ ID NO: 8305637 - DNA, 16 bp, Homo sapiens
cagagtgtaaacagga

SEQ ID NO: 8305638 - DNA, 22 bp, Homo sapiens
cagagtgtttctttgggtgggt

SEQ ID NO: 8305639 - DNA, 22 bp, Homo sapiens
cagagtgttagcgctggttggg

SEQ ID NO: 8305640 - DNA, 21 bp, Homo sapiens
cagaggctgagagggcaatct

SEQ ID NO: 8305641 - DNA, 22 bp, Homo sapiens
cagaggctgatgtgggatgggc

SEQ ID NO: 8305642 - DNA, 22 bp, Homo sapiens
cagaggcctttctacagtgata

SEQ ID NO: 8305643 - DNA, 22 bp, Homo sapiens
cagaggctgctctgggtggcat

SEQ ID NO: 8305644 - DNA, 22 bp, Homo sapiens
cagaggctgctctgggtggcat

SEQ ID NO: 8305645 - DNA, 22 bp, Homo sapiens
cagataaaggcttactagtagt

SEQ ID NO: 8305646 - DNA, 22 bp, Homo sapiens
ggtgcagaggagccagctgggg

SEQ ID NO: 8305647 - DNA, 22 bp, Homo sapiens
ggtgcagaaggaagggagctgg

SEQ ID NO: 8305648 - DNA, 22 bp, Homo sapiens
ggtgcagatctttctcttcagg

SEQ ID NO: 8305649 - DNA, 22 bp, Homo sapiens
ggtgcagctgcagcctgggagc

SEQ ID NO: 8305650 - DNA, 22 bp, Homo sapiens
cagcactgctgctgtacacaca

SEQ ID NO: 8305651 - DNA, 22 bp, Homo sapiens
ggtggctggaggagctgatgga

SEQ ID NO: 8305652 - DNA, 18 bp, Homo sapiens
ggtggcaggtcagatgcc

SEQ ID NO: 8305653 - DNA, 22 bp, Homo sapiens
ggtggcagtcttaagagatctt

SEQ ID NO: 8305654 - DNA, 22 bp, Homo sapiens
ggtgctggttcagggtggctgt

SEQ ID NO: 8305655 - DNA, 22 bp, Homo sapiens
gtaactgaggcagcttttaaga

SEQ ID NO: 8305656 - DNA, 22 bp, Homo sapiens
gtaagcatctgtctcttctgca

SEQ ID NO: 8305657 - DNA, 22 bp, Homo sapiens
gtaagagcactgtctcctgctg

SEQ ID NO: 8305658 - DNA, 18 bp, Homo sapiens
cagcagagacattcaaaa

SEQ ID NO: 8305659 - DNA, 22 bp, Homo sapiens
gtctttcttaattcaagtgctt

SEQ ID NO: 8305660 - DNA, 22 bp, Homo sapiens
gtctctgggttaagcagtgcat

SEQ ID NO: 8305661 - DNA, 22 bp, Homo sapiens
gtctcagattcagacatctaca

SEQ ID NO: 8305662 - DNA, 22 bp, Homo sapiens
gtctcagataacatgtattcta

SEQ ID NO: 8305663 - DNA, 22 bp, Homo sapiens
gtctcagggactgcttctgggg

SEQ ID NO: 8305664 - DNA, 22 bp, Homo sapiens
gtgcagctgtgtgagagctcca

SEQ ID NO: 8305665 - DNA, 22 bp, Homo sapiens
gtgcagcagggggaagacagtg

SEQ ID NO: 8305666 - DNA, 22 bp, Homo sapiens
gtcctctgtgtaggctgcagac

SEQ ID NO: 8305667 - DNA, 22 bp, Homo sapiens
cagcagtgtacaaggtgtcaga

SEQ ID NO: 8305668 - DNA, 18 bp, Homo sapiens
gtcctgagctctgctgta

SEQ ID NO: 8305669 - DNA, 22 bp, Homo sapiens
cagcatgcaagtccagatgtgg

SEQ ID NO: 8305670 - DNA, 20 bp, Homo sapiens
gtctcaagtatctcacagtc

SEQ ID NO: 8305671 - DNA, 22 bp, Homo sapiens
gtctcagagtcctacttattcc

SEQ ID NO: 8305672 - DNA, 22 bp, Homo sapiens
gtctcagaccaccctctttggc

SEQ ID NO: 8305673 - DNA, 22 bp, Homo sapiens
gtctcagagagctactctctta

SEQ ID NO: 8305674 - DNA, 20 bp, Homo sapiens
gtctcagaatggatttgcat

SEQ ID NO: 8305675 - DNA, 22 bp, Homo sapiens
cagcatctttctcttctggagt

SEQ ID NO: 8305676 - DNA, 22 bp, Homo sapiens
cagcaggtatgtttgttcagca

SEQ ID NO: 8305677 - DNA, 22 bp, Homo sapiens
cagcagggttaagtgactcacc

SEQ ID NO: 8305678 - DNA, 22 bp, Homo sapiens
cagcagggttaagtgactcacc

SEQ ID NO: 8305679 - DNA, 22 bp, Homo sapiens
cagcagggaagctgtgctgttt

SEQ ID NO: 8305680 - DNA, 22 bp, Homo sapiens
cagcagggaagctgtgctgttt

SEQ ID NO: 8305681 - DNA, 22 bp, Homo sapiens
cagcagagctgtgtgggaaggg

SEQ ID NO: 8305682 - DNA, 22 bp, Homo sapiens
cagcagagcatttggtaggagg

SEQ ID NO: 8305683 - DNA, 22 bp, Homo sapiens
cagcagagacggtaagcagaac

SEQ ID NO: 8305684 - DNA, 22 bp, Homo sapiens
cagcagagacggtaagcagaac

SEQ ID NO: 8305685 - DNA, 22 bp, Homo sapiens
cagcagtgatgtgtgagggttc

SEQ ID NO: 8305686 - DNA, 22 bp, Homo sapiens
cagcagtgatgtgtgagggttc

SEQ ID NO: 8305687 - DNA, 22 bp, Homo sapiens
cagcagtggccatctgtgtggt

SEQ ID NO: 8305688 - DNA, 22 bp, Homo sapiens
cagcagtgcttcagtgtgagat

SEQ ID NO: 8305689 - DNA, 22 bp, Homo sapiens
cagcagtggaactacccaggga

SEQ ID NO: 8305690 - DNA, 20 bp, Homo sapiens
cagcagtggatgagagtttt

SEQ ID NO: 8305691 - DNA, 22 bp, Homo sapiens
cagctccctatggtgaggcgac

SEQ ID NO: 8305692 - DNA, 22 bp, Homo sapiens
cagctccctatggtgaggcgac

SEQ ID NO: 8305693 - DNA, 22 bp, Homo sapiens
cagctcccgccatcgggaggca

SEQ ID NO: 8305694 - DNA, 22 bp, Homo sapiens
cagctctgaggaacactccttt

SEQ ID NO: 8305695 - DNA, 22 bp, Homo sapiens
cagctcctgcagctgctgccgt

SEQ ID NO: 8305696 - DNA, 22 bp, Homo sapiens
cagccctttccttctcagcttt

SEQ ID NO: 8305697 - DNA, 22 bp, Homo sapiens
gtgcctgggcatgagcttgttg

SEQ ID NO: 8305698 - DNA, 22 bp, Homo sapiens
gtgcatgtcggggtgcatgtca

SEQ ID NO: 8305699 - DNA, 22 bp, Homo sapiens
gtgcatgtgcatccatgtgtac

SEQ ID NO: 8305700 - DNA, 22 bp, Homo sapiens
gtgcatgtgtctttatagtaga

SEQ ID NO: 8305701 - DNA, 23 bp, Homo sapiens
gtgcatgtgtctttacagtagca

SEQ ID NO: 8305702 - DNA, 22 bp, Homo sapiens
gtgcatgtgtctttatagtagc

SEQ ID NO: 8305703 - DNA, 22 bp, Homo sapiens
gtgcatgttaatggtgtacaaa

SEQ ID NO: 8305704 - DNA, 22 bp, Homo sapiens
cagctccagcccaggcagctcc

SEQ ID NO: 8305705 - DNA, 22 bp, Homo sapiens
cagctcccagtggcagctcctt

SEQ ID NO: 8305706 - DNA, 22 bp, Homo sapiens
cagctccccatggttcctgaag

SEQ ID NO: 8305707 - DNA, 22 bp, Homo sapiens
cagctcccctctgtggggcagt

SEQ ID NO: 8305708 - DNA, 22 bp, Homo sapiens
cagctcccagagtgaccagcag

SEQ ID NO: 8305709 - DNA, 22 bp, Homo sapiens
gtgcctgtgccaggggtgtgct

SEQ ID NO: 8305710 - DNA, 22 bp, Homo sapiens
gtgcctgtgcggactcagggaa

SEQ ID NO: 8305711 - DNA, 22 bp, Homo sapiens
gtgcctggtttggggaatgttc

SEQ ID NO: 8305712 - DNA, 22 bp, Homo sapiens
gtgcctggtttggggagtgttc

SEQ ID NO: 8305713 - DNA, 22 bp, Homo sapiens
gtgcctggggttgagctatgaa

SEQ ID NO: 8305714 - DNA, 22 bp, Homo sapiens
tatgcacacatcgcagcaggaa

SEQ ID NO: 8305715 - DNA, 22 bp, Homo sapiens
caggtgggccggggtttgttct

SEQ ID NO: 8305716 - DNA, 22 bp, Homo sapiens
caggtgggcgtggcgagaaggc

SEQ ID NO: 8305717 - DNA, 22 bp, Homo sapiens
caggtgggcttgggagaacact

SEQ ID NO: 8305718 - DNA, 22 bp, Homo sapiens
caggtggggcagctgtgggagc

SEQ ID NO: 8305719 - DNA, 22 bp, Homo sapiens
caggtggggcagctgtgggagc

SEQ ID NO: 8305720 - DNA, 22 bp, Homo sapiens
caggtggggagagtgtggagca

SEQ ID NO: 8305721 - DNA, 22 bp, Homo sapiens
caggtggggcgccctcaggcag

SEQ ID NO: 8305722 - DNA, 22 bp, Homo sapiens
cagtacttatttctatttaggg

SEQ ID NO: 8305723 - DNA, 22 bp, Homo sapiens
cagtacttcttggaaactggat

SEQ ID NO: 8305724 - DNA, 22 bp, Homo sapiens
cagtacttggggggttctaagt

SEQ ID NO: 8305725 - DNA, 22 bp, Homo sapiens
cagtacttgggaatgctgggga

SEQ ID NO: 8305726 - DNA, 23 bp, Homo sapiens
cagtacttagtgtagcgttaatt

SEQ ID NO: 8305727 - DNA, 22 bp, Homo sapiens
cagtacttaacttataggagag

SEQ ID NO: 8305728 - DNA, 22 bp, Homo sapiens
cagtacttagttctcatggttt

SEQ ID NO: 8305729 - DNA, 22 bp, Homo sapiens
tatgtacatcgttgaattcaaa

SEQ ID NO: 8305730 - DNA, 22 bp, Homo sapiens
tatgtacatgatttcatttgct

SEQ ID NO: 8305731 - DNA, 22 bp, Homo sapiens
tatgtacatggagagcaattga

SEQ ID NO: 8305732 - DNA, 22 bp, Homo sapiens
tatgaagaagttctgtgaaatg

SEQ ID NO: 8305733 - DNA, 22 bp, Homo sapiens
tatgaagacaatgatagcatga

SEQ ID NO: 8305734 - DNA, 22 bp, Homo sapiens
tatgaagatatatctgatctct

SEQ ID NO: 8305735 - DNA, 22 bp, Homo sapiens
tatgcacaatatgatctatttg

SEQ ID NO: 8305736 - DNA, 22 bp, Homo sapiens
tatgcacacaggcttaattcat

SEQ ID NO: 8305737 - DNA, 21 bp, Homo sapiens
tatacatgtgtgcatacgtgt

SEQ ID NO: 8305738 - DNA, 22 bp, Homo sapiens
tatatagaaaagcagatgttgg

SEQ ID NO: 8305739 - DNA, 22 bp, Homo sapiens
tagtaacagatttatacagtct

SEQ ID NO: 8305740 - DNA, 22 bp, Homo sapiens
cagggccaccgtgtttgctgct

SEQ ID NO: 8305741 - DNA, 22 bp, Homo sapiens
cagggccaccctctgctgggtg

SEQ ID NO: 8305742 - DNA, 20 bp, Homo sapiens
cagggccacgctccaaggca

SEQ ID NO: 8305743 - DNA, 22 bp, Homo sapiens
cagggccaagttggtgcctttt

SEQ ID NO: 8305744 - DNA, 22 bp, Homo sapiens
cagggctggatcctccagactc

SEQ ID NO: 8305745 - DNA, 22 bp, Homo sapiens
cagggctgctggccgtgccctc

SEQ ID NO: 8305746 - DNA, 22 bp, Homo sapiens
tcaaagcatcagtcaatttagg

SEQ ID NO: 8305747 - DNA, 22 bp, Homo sapiens
cagtcccagacccagaaggtgg

SEQ ID NO: 8305748 - DNA, 19 bp, Homo sapiens
tcaaagcaagcatgttctg

SEQ ID NO: 8305749 - DNA, 21 bp, Homo sapiens
tcaaagcacatatttgcacat

SEQ ID NO: 8305750 - DNA, 22 bp, Homo sapiens
cagtacttggtcaaggaagcag

SEQ ID NO: 8305751 - DNA, 22 bp, Homo sapiens
cagtactttgaagatattttag

SEQ ID NO: 8305752 - DNA, 22 bp, Homo sapiens
cagtacttgtcctcaggtgtta

SEQ ID NO: 8305753 - DNA, 22 bp, Homo sapiens
cagtactttgcatcattccact

SEQ ID NO: 8305754 - DNA, 22 bp, Homo sapiens
cagtacttttctggctttctac

SEQ ID NO: 8305755 - DNA, 22 bp, Homo sapiens
cagtacttttcaaccagtatga

SEQ ID NO: 8305756 - DNA, 22 bp, Homo sapiens
cagtagcagggattattttagg

SEQ ID NO: 8305757 - DNA, 22 bp, Homo sapiens
cagtagcactctgtcagtgaag

SEQ ID NO: 8305758 - DNA, 22 bp, Homo sapiens
cagtagcactagatatgtgtgg

SEQ ID NO: 8305759 - DNA, 20 bp, Homo sapiens
cagtagcaataattagaagc

SEQ ID NO: 8305760 - DNA, 22 bp, Homo sapiens
cagtagcaggcactcagcacgt

SEQ ID NO: 8305761 - DNA, 22 bp, Homo sapiens
cagtagcaggcaggtgcttttg

SEQ ID NO: 8305762 - DNA, 19 bp, Homo sapiens
tcaaatgccaatgtcacag

SEQ ID NO: 8305763 - DNA, 22 bp, Homo sapiens
tcaaatgctgtattgtagtaat

SEQ ID NO: 8305764 - DNA, 22 bp, Homo sapiens
tcaaatgcttctactcctaaga

SEQ ID NO: 8305765 - DNA, 22 bp, Homo sapiens
tcaaatgctgcctttgtgtgcc

SEQ ID NO: 8305766 - DNA, 22 bp, Homo sapiens
tcaaatgctctttgcagagagg

SEQ ID NO: 8305767 - DNA, 22 bp, Homo sapiens
tcaaatgcggtcatggctttta

SEQ ID NO: 8305768 - DNA, 22 bp, Homo sapiens
tcaaatgctcagactcctgtgg

SEQ ID NO: 8305769 - DNA, 22 bp, Homo sapiens
tcaaatgttccctgtactggcc

SEQ ID NO: 8305770 - DNA, 15 bp, Homo sapiens
cagtcccagggaccc

SEQ ID NO: 8305771 - DNA, 22 bp, Homo sapiens
cagtcccagctgctcagaaggc

SEQ ID NO: 8305772 - DNA, 22 bp, Homo sapiens
cagtcccagctgctcagaaggc

SEQ ID NO: 8305773 - DNA, 22 bp, Homo sapiens
cagtcccagtttgagactctgg

SEQ ID NO: 8305774 - DNA, 22 bp, Homo sapiens
cagtcccagggttggttcagct

SEQ ID NO: 8305775 - DNA, 22 bp, Homo sapiens
cagtcccagggttggttcagct

SEQ ID NO: 8305776 - DNA, 22 bp, Homo sapiens
cagtcccatctcccaggtggct

SEQ ID NO: 8305777 - DNA, 22 bp, Homo sapiens
cagtcccatctcccaggtggct

SEQ ID NO: 8305778 - DNA, 22 bp, Homo sapiens
cagtcccatgagcccagaacat

SEQ ID NO: 8305779 - DNA, 22 bp, Homo sapiens
cagtgcagttggtggcaggggt

SEQ ID NO: 8305780 - DNA, 22 bp, Homo sapiens
cagtgcagtttcccagatgctg

SEQ ID NO: 8305781 - DNA, 22 bp, Homo sapiens
cagtgcataatctaaatggggg

SEQ ID NO: 8305782 - DNA, 22 bp, Homo sapiens
cagtgcatagatcctgaggcct

SEQ ID NO: 8305783 - DNA, 19 bp, Homo sapiens
cagtggagattggaggagg

SEQ ID NO: 8305784 - DNA, 22 bp, Homo sapiens
tcacacctgtaatcccaggcct

SEQ ID NO: 8305785 - DNA, 22 bp, Homo sapiens
tcacacgtccttgctactcctc

SEQ ID NO: 8305786 - DNA, 22 bp, Homo sapiens
tcacacgtgaggttctatcctg

SEQ ID NO: 8305787 - DNA, 22 bp, Homo sapiens
cagtggaggctcaagtgtgctt

SEQ ID NO: 8305788 - DNA, 22 bp, Homo sapiens
cagtggaggccttgggaccttt

SEQ ID NO: 8305789 - DNA, 22 bp, Homo sapiens
tcacatgcttgaggaaagaaaa

SEQ ID NO: 8305790 - DNA, 22 bp, Homo sapiens
cagtgggtgatgagtcctgggg

SEQ ID NO: 8305791 - DNA, 22 bp, Homo sapiens
cagtggcagagaacagagacct

SEQ ID NO: 8305792 - DNA, 22 bp, Homo sapiens
tcactgcactccagcctgggtg

SEQ ID NO: 8305793 - DNA, 22 bp, Homo sapiens
tcactgcactccagcctgggca

SEQ ID NO: 8305794 - DNA, 22 bp, Homo sapiens
tcactgcagacaacctcagtca

SEQ ID NO: 8305795 - DNA, 22 bp, Homo sapiens
tcactgcacttcagcttgggca

SEQ ID NO: 8305796 - DNA, 22 bp, Homo sapiens
tcactgcagagacctctagtca

SEQ ID NO: 8305797 - DNA, 22 bp, Homo sapiens
tcactgcagcctctgcctcccg

SEQ ID NO: 8305798 - DNA, 19 bp, Homo sapiens
tcactctccctgtctgtcc

SEQ ID NO: 8305799 - DNA, 22 bp, Homo sapiens
tcactgcaacctctgcctcccg

SEQ ID NO: 8305800 - DNA, 22 bp, Homo sapiens
tcactgcaacctccgcctgctg

SEQ ID NO: 8305801 - DNA, 22 bp, Homo sapiens
tcactgcaatctctgccttcca

SEQ ID NO: 8305802 - DNA, 22 bp, Homo sapiens
tcactgcaatctcagcctcctg

SEQ ID NO: 8305803 - DNA, 22 bp, Homo sapiens
tcactgcaaggaggcttctcaa

SEQ ID NO: 8305804 - DNA, 22 bp, Homo sapiens
tcactgcaagctcctcctcctg

SEQ ID NO: 8305805 - DNA, 22 bp, Homo sapiens
tcactgcaagctctgccttccg

SEQ ID NO: 8305806 - DNA, 22 bp, Homo sapiens
tcactgcaacctctgcctcttg

SEQ ID NO: 8305807 - DNA, 22 bp, Homo sapiens
tcactgcaacctctgcctgcca

SEQ ID NO: 8305808 - DNA, 22 bp, Homo sapiens
tcactgcaacctctgccttccg

SEQ ID NO: 8305809 - DNA, 22 bp, Homo sapiens
tcactgcaagctccacctcccg

SEQ ID NO: 8305810 - DNA, 22 bp, Homo sapiens
tcactgcaagctcagcctcccg

SEQ ID NO: 8305811 - DNA, 22 bp, Homo sapiens
cagggacagccttggggtggcg

SEQ ID NO: 8305812 - DNA, 22 bp, Homo sapiens
cagggagaaatctccaggaggt

SEQ ID NO: 8305813 - DNA, 22 bp, Homo sapiens
tagaacagagggttgcccagat

SEQ ID NO: 8305814 - DNA, 22 bp, Homo sapiens
tagaacagagttccagtgatca

SEQ ID NO: 8305815 - DNA, 22 bp, Homo sapiens
tagaaatgttggtattaacatt

SEQ ID NO: 8305816 - DNA, 22 bp, Homo sapiens
tagaaatgttagatgtattgag

SEQ ID NO: 8305817 - DNA, 22 bp, Homo sapiens
cagggagaggcatcatagggaa

SEQ ID NO: 8305818 - DNA, 22 bp, Homo sapiens
cagggagaagtctggtcagtcc

SEQ ID NO: 8305819 - DNA, 22 bp, Homo sapiens
caggctgatcagggctgggatg

SEQ ID NO: 8305820 - DNA, 22 bp, Homo sapiens
caggctgcagaggcctttcatg

SEQ ID NO: 8305821 - DNA, 22 bp, Homo sapiens
caggctgcagcagcagtggccc

SEQ ID NO: 8305822 - DNA, 22 bp, Homo sapiens
tacccaggagaaacagcagggc

SEQ ID NO: 8305823 - DNA, 22 bp, Homo sapiens
tagcagtgtctaggtaggccat

SEQ ID NO: 8305824 - DNA, 22 bp, Homo sapiens
cagggccaagctgcagcatctg

SEQ ID NO: 8305825 - DNA, 22 bp, Homo sapiens
cagggccaagcccctttggctg

SEQ ID NO: 8305826 - DNA, 22 bp, Homo sapiens
cagggcagttttacttctctct

SEQ ID NO: 8305827 - DNA, 22 bp, Homo sapiens
cagggcagtttgtgcctatgag

SEQ ID NO: 8305828 - DNA, 22 bp, Homo sapiens
cagggcagtgaagaacacacgt

SEQ ID NO: 8305829 - DNA, 22 bp, Homo sapiens
cagggcaggacagatacattac

SEQ ID NO: 8305830 - DNA, 22 bp, Homo sapiens
cagggcagtaccgccctctggc

SEQ ID NO: 8305831 - DNA, 22 bp, Homo sapiens
cagggagggacaattgtcacct

SEQ ID NO: 8305832 - DNA, 22 bp, Homo sapiens
cagggagtttttgttcctctag

SEQ ID NO: 8305833 - DNA, 22 bp, Homo sapiens
caggccacaagttgggttcaag

SEQ ID NO: 8305834 - DNA, 22 bp, Homo sapiens
gtggagccaggggctgtaggta

SEQ ID NO: 8305835 - DNA, 22 bp, Homo sapiens
gtggagccaggatctccgcaca

SEQ ID NO: 8305836 - DNA, 23 bp, Homo sapiens
gtggagccacatcacaggctcct

SEQ ID NO: 8305837 - DNA, 23 bp, Homo sapiens
gtggagccacatcacaggctcct

SEQ ID NO: 8305838 - DNA, 22 bp, Homo sapiens
caggcctgtgacaccgtgtctg

SEQ ID NO: 8305839 - DNA, 22 bp, Homo sapiens
caggcctgtgagttgaggcccc

SEQ ID NO: 8305840 - DNA, 22 bp, Homo sapiens
caggcctgtgagttgaggcccc

SEQ ID NO: 8305841 - DNA, 22 bp, Homo sapiens
caggcctgtctgcacatgaggc

SEQ ID NO: 8305842 - DNA, 22 bp, Homo sapiens
caggcctggagtgcaatggcac

SEQ ID NO: 8305843 - DNA, 22 bp, Homo sapiens
tacagttcacagtatcataaat

SEQ ID NO: 8305844 - DNA, 22 bp, Homo sapiens
catcaaatggcaagtgaaagct

SEQ ID NO: 8305845 - DNA, 22 bp, Homo sapiens
tcaggcagagctgtggagctct

SEQ ID NO: 8305846 - DNA, 22 bp, Homo sapiens
tcaggcagaccaccgtgggcag

SEQ ID NO: 8305847 - DNA, 22 bp, Homo sapiens
tcaggcagaggatggggagcgt

SEQ ID NO: 8305848 - DNA, 22 bp, Homo sapiens
tcaggctgcctatcagactgtg

SEQ ID NO: 8305849 - DNA, 22 bp, Homo sapiens
tcaggctgcccgttcagggctc

SEQ ID NO: 8305850 - DNA, 22 bp, Homo sapiens
cagtgtacttggaatgtaacag

SEQ ID NO: 8305851 - DNA, 22 bp, Homo sapiens
cagtgtcctcagccagcagcta

SEQ ID NO: 8305852 - DNA, 22 bp, Homo sapiens
tcacttaaaaattctagttatg

SEQ ID NO: 8305853 - DNA, 22 bp, Homo sapiens
tcacttagatggggatcatcac

SEQ ID NO: 8305854 - DNA, 22 bp, Homo sapiens
tcacttataaaatgcaagatct

SEQ ID NO: 8305855 - DNA, 21 bp, Homo sapiens
tcacttataatgtatttgctg

SEQ ID NO: 8305856 - DNA, 22 bp, Homo sapiens
tcacttattgctcatctcatgc

SEQ ID NO: 8305857 - DNA, 22 bp, Homo sapiens
catcagtgtggcagttcactgt

SEQ ID NO: 8305858 - DNA, 22 bp, Homo sapiens
catcagcagtcacatgatgctg

SEQ ID NO: 8305859 - DNA, 22 bp, Homo sapiens
catcagcaggcaacactcttgg

SEQ ID NO: 8305860 - DNA, 22 bp, Homo sapiens
catcagcactatgattaaagta

SEQ ID NO: 8305861 - DNA, 22 bp, Homo sapiens
tcagtgtcttgggcttgaatgc

SEQ ID NO: 8305862 - DNA, 22 bp, Homo sapiens
tcagtgtcttgacctgggtgtg

SEQ ID NO: 8305863 - DNA, 22 bp, Homo sapiens
tcatcactcattggacaacaga

SEQ ID NO: 8305864 - DNA, 22 bp, Homo sapiens
tcatcactgtatcattgataga

SEQ ID NO: 8305865 - DNA, 22 bp, Homo sapiens
tcatcaaagtcaaagaatgact

SEQ ID NO: 8305866 - DNA, 22 bp, Homo sapiens
tcatcacatatgtcatgatttg

SEQ ID NO: 8305867 - DNA, 22 bp, Homo sapiens
tcatacataacttgtacagtga

SEQ ID NO: 8305868 - DNA, 22 bp, Homo sapiens
tcataatacaaagagttctgca

SEQ ID NO: 8305869 - DNA, 19 bp, Homo sapiens
tcataaggagagaggaaat

SEQ ID NO: 8305870 - DNA, 22 bp, Homo sapiens
tcataacagctaagtccctttc

SEQ ID NO: 8305871 - DNA, 23 bp, Homo sapiens
catgtacacacagctgtacagtg

SEQ ID NO: 8305872 - DNA, 23 bp, Homo sapiens
catgtacagagtttgataaagtg

SEQ ID NO: 8305873 - DNA, 22 bp, Homo sapiens
catgtacactcatgtaactata

SEQ ID NO: 8305874 - DNA, 23 bp, Homo sapiens
catgtacagagtttgataaagtg

SEQ ID NO: 8305875 - DNA, 22 bp, Homo sapiens
catgtacagtttttctgtcctg

SEQ ID NO: 8305876 - DNA, 17 bp, Homo sapiens
catgtgtatgtgggagt

SEQ ID NO: 8305877 - DNA, 22 bp, Homo sapiens
catgtgtcaaatgatgtagctg

SEQ ID NO: 8305878 - DNA, 22 bp, Homo sapiens
catgttttctaggctttcacaa

SEQ ID NO: 8305879 - DNA, 22 bp, Homo sapiens
tccaggggtaccggccaggcag

SEQ ID NO: 8305880 - DNA, 22 bp, Homo sapiens
tccagcagaaaagaggtaggga

SEQ ID NO: 8305881 - DNA, 22 bp, Homo sapiens
catgctttaccaaagcagtgat

SEQ ID NO: 8305882 - DNA, 22 bp, Homo sapiens
catgctttctgtccaaatgtta

SEQ ID NO: 8305883 - DNA, 22 bp, Homo sapiens
catgctttgggtcagaaatgcc

SEQ ID NO: 8305884 - DNA, 22 bp, Homo sapiens
catgtacaaaaggcaaatgcct

SEQ ID NO: 8305885 - DNA, 22 bp, Homo sapiens
catgtaaaacactcagaacagt

SEQ ID NO: 8305886 - DNA, 22 bp, Homo sapiens
catgggctcttctggactgcac

SEQ ID NO: 8305887 - DNA, 22 bp, Homo sapiens
tccagaggtatgtagagagtat

SEQ ID NO: 8305888 - DNA, 18 bp, Homo sapiens
tccagaggtgttggagcc

SEQ ID NO: 8305889 - DNA, 22 bp, Homo sapiens
tccagagtacggaagagtcatc

SEQ ID NO: 8305890 - DNA, 22 bp, Homo sapiens
tccaagaagtcatctaaactgt

SEQ ID NO: 8305891 - DNA, 22 bp, Homo sapiens
tccaagatctacagcagtttag

SEQ ID NO: 8305892 - DNA, 22 bp, Homo sapiens
catgctccaaaaacaagagaat

SEQ ID NO: 8305893 - DNA, 20 bp, Homo sapiens
ccaagagcatgcatgaggaa

SEQ ID NO: 8305894 - DNA, 22 bp, Homo sapiens
tcctggagccacggagctttca

SEQ ID NO: 8305895 - DNA, 22 bp, Homo sapiens
tcctgccttgcctgggacatca

SEQ ID NO: 8305896 - DNA, 22 bp, Homo sapiens
tcctgccttgcctgggacatca

SEQ ID NO: 8305897 - DNA, 22 bp, Homo sapiens
tcctgccttcatactgctgtat

SEQ ID NO: 8305898 - DNA, 22 bp, Homo sapiens
tcctgccttcatactgctgtat

SEQ ID NO: 8305899 - DNA, 21 bp, Homo sapiens
tcctgccttagtccagagcag

SEQ ID NO: 8305900 - DNA, 22 bp, Homo sapiens
tcctgccttagagcaaggaaaa

SEQ ID NO: 8305901 - DNA, 21 bp, Homo sapiens
tcctgccttagtccagagcag

SEQ ID NO: 8305902 - DNA, 20 bp, Homo sapiens
tcctggccttctcgggcagt

SEQ ID NO: 8305903 - DNA, 22 bp, Homo sapiens
tcctggcctgtctggagtagct

SEQ ID NO: 8305904 - DNA, 22 bp, Homo sapiens
ccacaggggtctctgtagctga

SEQ ID NO: 8305905 - DNA, 21 bp, Homo sapiens
ccacaggggctcccctgtcag

SEQ ID NO: 8305906 - DNA, 22 bp, Homo sapiens
ccacaggggcccacgagccgct

SEQ ID NO: 8305907 - DNA, 22 bp, Homo sapiens
ccacagggctctaggcgcttcc

SEQ ID NO: 8305908 - DNA, 22 bp, Homo sapiens
ccacagggaacatgacagcctt

SEQ ID NO: 8305909 - DNA, 22 bp, Homo sapiens
ccacagggactgttaaaaccct

SEQ ID NO: 8305910 - DNA, 22 bp, Homo sapiens
ccacagggcctttcctgctggc

SEQ ID NO: 8305911 - DNA, 22 bp, Homo sapiens
ccacagggcacagacaggaagc

SEQ ID NO: 8305912 - DNA, 16 bp, Homo sapiens
ccacagggcaaggggc

SEQ ID NO: 8305913 - DNA, 22 bp, Homo sapiens
ccacagggataggaatggggct

SEQ ID NO: 8305914 - DNA, 22 bp, Homo sapiens
ccacagggcacaagggaggttg

SEQ ID NO: 8305915 - DNA, 22 bp, Homo sapiens
ccacagctgaccgcaggtgagc

SEQ ID NO: 8305916 - DNA, 22 bp, Homo sapiens
tcctggagcttccttcatggta

SEQ ID NO: 8305917 - DNA, 21 bp, Homo sapiens
catttctattgatgagaaaag

SEQ ID NO: 8305918 - DNA, 22 bp, Homo sapiens
cattttctcaatgaaccctctt

SEQ ID NO: 8305919 - DNA, 22 bp, Homo sapiens
tcctgagggcgattcagcaggt

SEQ ID NO: 8305920 - DNA, 20 bp, Homo sapiens
tccagttttggagacattct

SEQ ID NO: 8305921 - DNA, 21 bp, Homo sapiens
tccataagagaccatctccta

SEQ ID NO: 8305922 - DNA, 19 bp, Homo sapiens
tccataagcttgtgttcat

SEQ ID NO: 8305923 - DNA, 22 bp, Homo sapiens
tccataagcaggttcttcctga

SEQ ID NO: 8305924 - DNA, 22 bp, Homo sapiens
tctctgggataaactgggccag

SEQ ID NO: 8305925 - DNA, 22 bp, Homo sapiens
ccagaggtctcctgcacgggat

SEQ ID NO: 8305926 - DNA, 22 bp, Homo sapiens
ccagagcccagcacacggtgct

SEQ ID NO: 8305927 - DNA, 22 bp, Homo sapiens
ccagagcccagggtcatgcagg

SEQ ID NO: 8305928 - DNA, 22 bp, Homo sapiens
ccagagccagagaggtgcctgc

SEQ ID NO: 8305929 - DNA, 20 bp, Homo sapiens
ccagagcagccactgaagtt

SEQ ID NO: 8305930 - DNA, 22 bp, Homo sapiens
ccagagccggctccctcagctt

SEQ ID NO: 8305931 - DNA, 22 bp, Homo sapiens
ccagagccggattgtgaagtgc

SEQ ID NO: 8305932 - DNA, 22 bp, Homo sapiens
ccagagcccgggacctggactt

SEQ ID NO: 8305933 - DNA, 19 bp, Homo sapiens
ccagagcccgccagatggg

SEQ ID NO: 8305934 - DNA, 22 bp, Homo sapiens
ccagagcccctgagcttccctg

SEQ ID NO: 8305935 - DNA, 22 bp, Homo sapiens
ccagaggctgggttcacctcag

SEQ ID NO: 8305936 - DNA, 22 bp, Homo sapiens
ccagagcctcttatgaagatcg

SEQ ID NO: 8305937 - DNA, 22 bp, Homo sapiens
ccagagcctcgcccggagcctc

SEQ ID NO: 8305938 - DNA, 22 bp, Homo sapiens
ccagagcctaagatctgatcct

SEQ ID NO: 8305939 - DNA, 22 bp, Homo sapiens
ccaccctgagccgcaagagcag

SEQ ID NO: 8305940 - DNA, 22 bp, Homo sapiens
ccaccctgagccgcaagagcag

SEQ ID NO: 8305941 - DNA, 22 bp, Homo sapiens
tctagaaacatgacattgatct

SEQ ID NO: 8305942 - DNA, 22 bp, Homo sapiens
tctagaaattttgccttgtatt

SEQ ID NO: 8305943 - DNA, 22 bp, Homo sapiens
tctcaggatctaatacatggta

SEQ ID NO: 8305944 - DNA, 22 bp, Homo sapiens
tctcaggagtagtgggatccat

SEQ ID NO: 8305945 - DNA, 23 bp, Homo sapiens
tctcaggacacacatgtctatca

SEQ ID NO: 8305946 - DNA, 20 bp, Homo sapiens
tctcaggccccagttttctt

SEQ ID NO: 8305947 - DNA, 22 bp, Homo sapiens
tctcagagacctgaactccctg

SEQ ID NO: 8305948 - DNA, 22 bp, Homo sapiens
tctcagagagatgaaacttcca

SEQ ID NO: 8305949 - DNA, 22 bp, Homo sapiens
tctcaggaagattagggctaag

SEQ ID NO: 8305950 - DNA, 22 bp, Homo sapiens
tctcaggaatagagtggcagca

SEQ ID NO: 8305951 - DNA, 22 bp, Homo sapiens
tctcagagaagtgatgagcaat

SEQ ID NO: 8305952 - DNA, 22 bp, Homo sapiens
ccagggcagggaccacgtgtct

SEQ ID NO: 8305953 - DNA, 22 bp, Homo sapiens
ccagggcaggagaaagactcac

SEQ ID NO: 8305954 - DNA, 22 bp, Homo sapiens
ccagggcaggggctggagttca

SEQ ID NO: 8305955 - DNA, 22 bp, Homo sapiens
ccagggcacgttgggacagtac

SEQ ID NO: 8305956 - DNA, 22 bp, Homo sapiens
ccagggcaacgctgtctcagag

SEQ ID NO: 8305957 - DNA, 22 bp, Homo sapiens
ccagggcaaatgagatcatagc

SEQ ID NO: 8305958 - DNA, 22 bp, Homo sapiens
ccagggcaattatttggagggt

SEQ ID NO: 8305959 - DNA, 22 bp, Homo sapiens
ccagggcaataggaacactttt

SEQ ID NO: 8305960 - DNA, 17 bp, Homo sapiens
ccagggaggggccgcgc

SEQ ID NO: 8305961 - DNA, 22 bp, Homo sapiens
ccagggctccattgctcatcct

SEQ ID NO: 8305962 - DNA, 22 bp, Homo sapiens
ccagggctgagctgtgaccatg

SEQ ID NO: 8305963 - DNA, 22 bp, Homo sapiens
tgaagtcctagaactcctggta

SEQ ID NO: 8305964 - DNA, 22 bp, Homo sapiens
ccagggcatcacatccagtgtt

SEQ ID NO: 8305965 - DNA, 22 bp, Homo sapiens
ccagggcagtgggagaaggtgc

SEQ ID NO: 8305966 - DNA, 22 bp, Homo sapiens
tgaaggtgtctttgtgaacatc

SEQ ID NO: 8305967 - DNA, 22 bp, Homo sapiens
ccagggcatcctcacatcgcag

SEQ ID NO: 8305968 - DNA, 22 bp, Homo sapiens
ccaggctgtggtttagatagag

SEQ ID NO: 8305969 - DNA, 22 bp, Homo sapiens
tgaaacaagatccacagacttg

SEQ ID NO: 8305970 - DNA, 22 bp, Homo sapiens
tcttttgtgattctttagttac

SEQ ID NO: 8305971 - DNA, 22 bp, Homo sapiens
tcttttgtggatgaagaaatgg

SEQ ID NO: 8305972 - DNA, 21 bp, Homo sapiens
tcttttgtaactatttcagcc

SEQ ID NO: 8305973 - DNA, 22 bp, Homo sapiens
tcttttctggactctgcatgga

SEQ ID NO: 8305974 - DNA, 22 bp, Homo sapiens
ccaggcctctggctgcttagtc

SEQ ID NO: 8305975 - DNA, 23 bp, Homo sapiens
ccaggcctctcagagggtgtgcc

SEQ ID NO: 8305976 - DNA, 23 bp, Homo sapiens
ccaggcctctcagagggtgtgcc

SEQ ID NO: 8305977 - DNA, 19 bp, Homo sapiens
ccaggcctctggggcctgt

SEQ ID NO: 8305978 - DNA, 22 bp, Homo sapiens
ccaggcctgattgggaatcttg

SEQ ID NO: 8305979 - DNA, 21 bp, Homo sapiens
ccaggcagagctgtgagttct

SEQ ID NO: 8305980 - DNA, 22 bp, Homo sapiens
ccaggcagagggatccccatcc

SEQ ID NO: 8305981 - DNA, 22 bp, Homo sapiens
ccaggcagagggatccccatcc

SEQ ID NO: 8305982 - DNA, 22 bp, Homo sapiens
ccaggcagagtgctccagaaag

SEQ ID NO: 8305983 - DNA, 22 bp, Homo sapiens
ccaggcagcaaattttctgaat

SEQ ID NO: 8305984 - DNA, 22 bp, Homo sapiens
tcttacatatagcatgagtaca

SEQ ID NO: 8305985 - DNA, 22 bp, Homo sapiens
ccaggaggcggaggttgcagtg

SEQ ID NO: 8305986 - DNA, 22 bp, Homo sapiens
ccaggaggcggaggttgcagtg

SEQ ID NO: 8305987 - DNA, 22 bp, Homo sapiens
tcttctctgtggcctggtggtg

SEQ ID NO: 8305988 - DNA, 22 bp, Homo sapiens
tcttagaaatgaagttctttct

SEQ ID NO: 8305989 - DNA, 22 bp, Homo sapiens
ccaggcaggcagcgttctcagg

SEQ ID NO: 8305990 - DNA, 22 bp, Homo sapiens
ccaggcaggcgatggtgcagtg

SEQ ID NO: 8305991 - DNA, 22 bp, Homo sapiens
ccaggcagccaagtgtgtgtgt

SEQ ID NO: 8305992 - DNA, 22 bp, Homo sapiens
ccaggcagctctgatttatgtc

SEQ ID NO: 8305993 - DNA, 22 bp, Homo sapiens
ccaggcctcctgtgagtggacc

SEQ ID NO: 8305994 - DNA, 19 bp, Homo sapiens
ccaggcctcctgggaggtc

SEQ ID NO: 8305995 - DNA, 22 bp, Homo sapiens
ccaggcaggcgatggtgcagtg

SEQ ID NO: 8305996 - DNA, 22 bp, Homo sapiens
tctgttccagtagaaaggtgca

SEQ ID NO: 8305997 - DNA, 22 bp, Homo sapiens
tctgttccatgttttgttccat

SEQ ID NO: 8305998 - DNA, 22 bp, Homo sapiens
ccaggaggcggaggttgcagcg

SEQ ID NO: 8305999 - DNA, 22 bp, Homo sapiens
ccaggagcaggagctggacaga

SEQ ID NO: 8306000 - DNA, 22 bp, Homo sapiens
ccaggagcagatatggacataa

SEQ ID NO: 8306001 - DNA, 22 bp, Homo sapiens
ccaggagcagggctggctgcac

SEQ ID NO: 8306002 - DNA, 22 bp, Homo sapiens
ccaggagcattaagagaacata

SEQ ID NO: 8306003 - DNA, 22 bp, Homo sapiens
ccaggagccactcaggcccaca

SEQ ID NO: 8306004 - DNA, 22 bp, Homo sapiens
tctgggctctgtcagcacctct

SEQ ID NO: 8306005 - DNA, 22 bp, Homo sapiens
ccaggagcaacttgaaggcaag

SEQ ID NO: 8306006 - DNA, 22 bp, Homo sapiens
ccagcaccttgatcttggagtt

SEQ ID NO: 8306007 - DNA, 22 bp, Homo sapiens
tgagttttgtaatattcaagat

SEQ ID NO: 8306008 - DNA, 22 bp, Homo sapiens
tgaggccagtctcatcacaggc

SEQ ID NO: 8306009 - DNA, 22 bp, Homo sapiens
ccatcagcatgggagcatgggc

SEQ ID NO: 8306010 - DNA, 22 bp, Homo sapiens
ccatcagctccagtatcttctg

SEQ ID NO: 8306011 - DNA, 17 bp, Homo sapiens
tgagcagtagaagatgc

SEQ ID NO: 8306012 - DNA, 22 bp, Homo sapiens
tgagcagtaggtctgaatagtg

SEQ ID NO: 8306013 - DNA, 22 bp, Homo sapiens
ccagggctgctgtgggactcca

SEQ ID NO: 8306014 - DNA, 22 bp, Homo sapiens
ccaggtggaggtgtgaggtcct

SEQ ID NO: 8306015 - DNA, 22 bp, Homo sapiens
ccaggtggacggcgagtacagg

SEQ ID NO: 8306016 - DNA, 22 bp, Homo sapiens
ccaggtgggaggaaagcagaga

SEQ ID NO: 8306017 - DNA, 22 bp, Homo sapiens
ccaggtggcttctgcccgatgt

SEQ ID NO: 8306018 - DNA, 22 bp, Homo sapiens
ccagtcagccaagctgcagcgg

SEQ ID NO: 8306019 - DNA, 22 bp, Homo sapiens
ccagtccagtgccatgcatggc

SEQ ID NO: 8306020 - DNA, 19 bp, Homo sapiens
ccagtcccatacaggagat

SEQ ID NO: 8306021 - DNA, 22 bp, Homo sapiens
ccagtcccatctctgtcgctta

SEQ ID NO: 8306022 - DNA, 22 bp, Homo sapiens
ccagtcccaggcagaaatccag

SEQ ID NO: 8306023 - DNA, 22 bp, Homo sapiens
ccagtcccagctctgccatgct

SEQ ID NO: 8306024 - DNA, 22 bp, Homo sapiens
ccagtcccagctctgccatgct

SEQ ID NO: 8306025 - DNA, 22 bp, Homo sapiens
tgagccagtggaagatggcagt

SEQ ID NO: 8306026 - DNA, 23 bp, Homo sapiens
tgagcccaggaggtcaaggctgc

SEQ ID NO: 8306027 - DNA, 22 bp, Homo sapiens
tgagcccagagcccttgtaggg

SEQ ID NO: 8306028 - DNA, 22 bp, Homo sapiens
tgagcccagagatctgagctat

SEQ ID NO: 8306029 - DNA, 22 bp, Homo sapiens
tgagcccaggagttggagaccg

SEQ ID NO: 8306030 - DNA, 22 bp, Homo sapiens
tgagcccaggagtatgaggctg

SEQ ID NO: 8306031 - DNA, 22 bp, Homo sapiens
ccagtgcaggtgagcaccaggt

SEQ ID NO: 8306032 - DNA, 22 bp, Homo sapiens
cccaagggagtgcctggtcaac

SEQ ID NO: 8306033 - DNA, 22 bp, Homo sapiens
cccaaggctgcagtgagcatga

SEQ ID NO: 8306034 - DNA, 22 bp, Homo sapiens
cccaaggcctctccttggcttg

SEQ ID NO: 8306035 - DNA, 22 bp, Homo sapiens
cccaaggcatggcatggtggca

SEQ ID NO: 8306036 - DNA, 19 bp, Homo sapiens
cccaaggccctgggcaggc

SEQ ID NO: 8306037 - DNA, 22 bp, Homo sapiens
tgcaataaagtgctataaatcc

SEQ ID NO: 8306038 - DNA, 22 bp, Homo sapiens
tgcaataacccagtatctgtga

SEQ ID NO: 8306039 - DNA, 22 bp, Homo sapiens
tgcaataaagtgctataaatcc

SEQ ID NO: 8306040 - DNA, 22 bp, Homo sapiens
tgcaataaggagtaatagtaaa

SEQ ID NO: 8306041 - DNA, 22 bp, Homo sapiens
tgcaataagttgtgttatcact

SEQ ID NO: 8306042 - DNA, 22 bp, Homo sapiens
tgcaataactactttaatgttg

SEQ ID NO: 8306043 - DNA, 22 bp, Homo sapiens
tgcaataaggagtaatagtaaa

SEQ ID NO: 8306044 - DNA, 22 bp, Homo sapiens
tgcactggggtcccagcgcacg

SEQ ID NO: 8306045 - DNA, 22 bp, Homo sapiens
cccagagctccggtcctgccca

SEQ ID NO: 8306046 - DNA, 22 bp, Homo sapiens
cccagagctgagtctgatatat

SEQ ID NO: 8306047 - DNA, 22 bp, Homo sapiens
cccagagcctcattctgttggg

SEQ ID NO: 8306048 - DNA, 23 bp, Homo sapiens
tgcagctgcctctggcgggccgg

SEQ ID NO: 8306049 - DNA, 22 bp, Homo sapiens
tgcagccaccacctctgctgaa

SEQ ID NO: 8306050 - DNA, 22 bp, Homo sapiens
tgcagccaattcattcattctt

SEQ ID NO: 8306051 - DNA, 22 bp, Homo sapiens
tgcagctgattaaagggcagac

SEQ ID NO: 8306052 - DNA, 22 bp, Homo sapiens
tgcagctgattaaagggcagac

SEQ ID NO: 8306053 - DNA, 20 bp, Homo sapiens
tgcagctgcaggagggtggg

SEQ ID NO: 8306054 - DNA, 22 bp, Homo sapiens
tgcaggccggccctaggcctca

SEQ ID NO: 8306055 - DNA, 22 bp, Homo sapiens
tgcaggcctcacacctggcacc

SEQ ID NO: 8306056 - DNA, 22 bp, Homo sapiens
tgcaggcaggggatgagcagcc

SEQ ID NO: 8306057 - DNA, 21 bp, Homo sapiens
tgcaggcaggcagagatgctg

SEQ ID NO: 8306058 - DNA, 22 bp, Homo sapiens
cccagcaggtcggtgctgcctg

SEQ ID NO: 8306059 - DNA, 22 bp, Homo sapiens
tgcagggccttctagaccatgg

SEQ ID NO: 8306060 - DNA, 22 bp, Homo sapiens
tggcttccccggagtgacatgt

SEQ ID NO: 8306061 - DNA, 22 bp, Homo sapiens
cctcctggtccagcatctcttt

SEQ ID NO: 8306062 - DNA, 20 bp, Homo sapiens
cctcctggtcaggtgtgcag

SEQ ID NO: 8306063 - DNA, 22 bp, Homo sapiens
cctctcccacgtggcagaggct

SEQ ID NO: 8306064 - DNA, 22 bp, Homo sapiens
cctctccagttttaacgtgacc

SEQ ID NO: 8306065 - DNA, 22 bp, Homo sapiens
tgggcactgtagctggtgctgg

SEQ ID NO: 8306066 - DNA, 22 bp, Homo sapiens
tgggcactggaagcctgctgtg

SEQ ID NO: 8306067 - DNA, 21 bp, Homo sapiens
tgggcactgagggtgctgctc

SEQ ID NO: 8306068 - DNA, 22 bp, Homo sapiens
tgggcagaaatcagtatcagat

SEQ ID NO: 8306069 - DNA, 22 bp, Homo sapiens
tgggcagaaggaagagccacct

SEQ ID NO: 8306070 - DNA, 22 bp, Homo sapiens
tgggcagaatgtgggatccaga

SEQ ID NO: 8306071 - DNA, 22 bp, Homo sapiens
tgggcagaattgtggtagttaa

SEQ ID NO: 8306072 - DNA, 22 bp, Homo sapiens
tgggcagacattgagtttgttc

SEQ ID NO: 8306073 - DNA, 22 bp, Homo sapiens
tgggcagacgctgttggaaggc

SEQ ID NO: 8306074 - DNA, 22 bp, Homo sapiens
tgggcagactaaggtcaaagct

SEQ ID NO: 8306075 - DNA, 22 bp, Homo sapiens
tgggcagacgggagcttgcctt

SEQ ID NO: 8306076 - DNA, 22 bp, Homo sapiens
tgggacagggaatctgatcccc

SEQ ID NO: 8306077 - DNA, 22 bp, Homo sapiens
tgggacagagtgagctttggcc

SEQ ID NO: 8306078 - DNA, 22 bp, Homo sapiens
tgggacagagtgagctttggcc

SEQ ID NO: 8306079 - DNA, 22 bp, Homo sapiens
cctcctgggccttgctctgtga

SEQ ID NO: 8306080 - DNA, 22 bp, Homo sapiens
cctcctgggctcctgtctgcac

SEQ ID NO: 8306081 - DNA, 23 bp, Homo sapiens
cctcctgggcacaggcctgatgg

SEQ ID NO: 8306082 - DNA, 22 bp, Homo sapiens
cctcctgggacaggctggcaca

SEQ ID NO: 8306083 - DNA, 22 bp, Homo sapiens
cctcccacttcttgctgaggtc

SEQ ID NO: 8306084 - DNA, 19 bp, Homo sapiens
cctcccacggattccttcc

SEQ ID NO: 8306085 - DNA, 23 bp, Homo sapiens
cctcccacctatttcactttctt

SEQ ID NO: 8306086 - DNA, 22 bp, Homo sapiens
cctcccaccgtatctcagtggc

SEQ ID NO: 8306087 - DNA, 22 bp, Homo sapiens
cctcccaccgtatctcagtggc

SEQ ID NO: 8306088 - DNA, 22 bp, Homo sapiens
cctcccaccatttagagagagc

SEQ ID NO: 8306089 - DNA, 22 bp, Homo sapiens
cctcccacattgaggacatgct

SEQ ID NO: 8306090 - DNA, 22 bp, Homo sapiens
cctcccacattgaggacatgct

SEQ ID NO: 8306091 - DNA, 22 bp, Homo sapiens
cctccaggtgttacatatgact

SEQ ID NO: 8306092 - DNA, 22 bp, Homo sapiens
cctcccacatcctagctctgct

SEQ ID NO: 8306093 - DNA, 17 bp, Homo sapiens
cctcccacaccgccctg

SEQ ID NO: 8306094 - DNA, 22 bp, Homo sapiens
tggcagtgtataggtggctcct

SEQ ID NO: 8306095 - DNA, 21 bp, Homo sapiens
cctccaggtgattccgtgctc

SEQ ID NO: 8306096 - DNA, 22 bp, Homo sapiens
cctccagggcagacggggagca

SEQ ID NO: 8306097 - DNA, 22 bp, Homo sapiens
tgggctccagcacctgtgctct

SEQ ID NO: 8306098 - DNA, 22 bp, Homo sapiens
tgggcctgggagggcagacgct

SEQ ID NO: 8306099 - DNA, 22 bp, Homo sapiens
tgggctcatggcccagcactgg

SEQ ID NO: 8306100 - DNA, 23 bp, Homo sapiens
tgggcctggcctcccagtccagc

SEQ ID NO: 8306101 - DNA, 22 bp, Homo sapiens
tgggcctggccctgtggaggag

SEQ ID NO: 8306102 - DNA, 22 bp, Homo sapiens
tgggcaggataatatctcatgt

SEQ ID NO: 8306103 - DNA, 22 bp, Homo sapiens
tgggcaggatgcgttgattctt

SEQ ID NO: 8306104 - DNA, 22 bp, Homo sapiens
tgggcctggagccctggagagt

SEQ ID NO: 8306105 - DNA, 22 bp, Homo sapiens
tgggcctggagtttgtccagag

SEQ ID NO: 8306106 - DNA, 22 bp, Homo sapiens
cctgatggagccctgctgcatg

SEQ ID NO: 8306107 - DNA, 22 bp, Homo sapiens
cctgagtgaattccctcactgt

SEQ ID NO: 8306108 - DNA, 22 bp, Homo sapiens
tgggctcctcgtcactcgctgt

SEQ ID NO: 8306109 - DNA, 22 bp, Homo sapiens
cctgcagaccacactcagtcct

SEQ ID NO: 8306110 - DNA, 22 bp, Homo sapiens
cctgcagctgtaggagaaggcg

SEQ ID NO: 8306111 - DNA, 23 bp, Homo sapiens
tggggagagttaccctggaagcg

SEQ ID NO: 8306112 - DNA, 22 bp, Homo sapiens
tgggtgggagcaccctgtctgg

SEQ ID NO: 8306113 - DNA, 22 bp, Homo sapiens
tgggtgggagcaccctgtctgg

SEQ ID NO: 8306114 - DNA, 22 bp, Homo sapiens
tgggtggcacttctggggtcca

SEQ ID NO: 8306115 - DNA, 18 bp, Homo sapiens
tgggtggctagggagttt

SEQ ID NO: 8306116 - DNA, 22 bp, Homo sapiens
tgggtggcggcctggttctgag

SEQ ID NO: 8306117 - DNA, 22 bp, Homo sapiens
tgggtggcacttctggggtcca

SEQ ID NO: 8306118 - DNA, 22 bp, Homo sapiens
cctgcaggttgcagaggcggaa

SEQ ID NO: 8306119 - DNA, 19 bp, Homo sapiens
cctgcagggatgagaggtt

SEQ ID NO: 8306120 - DNA, 22 bp, Homo sapiens
cctgcaggggagagacttctag

SEQ ID NO: 8306121 - DNA, 22 bp, Homo sapiens
cctgcaggtaaggctaactgcc

SEQ ID NO: 8306122 - DNA, 22 bp, Homo sapiens
cctgcaggtccccggatgcgca

SEQ ID NO: 8306123 - DNA, 22 bp, Homo sapiens
cctgcccagcttcacctcaggc

SEQ ID NO: 8306124 - DNA, 22 bp, Homo sapiens
tggtacttggaggcagaaaaat

SEQ ID NO: 8306125 - DNA, 22 bp, Homo sapiens
cctgcctcatcaacttgtcgtg

SEQ ID NO: 8306126 - DNA, 22 bp, Homo sapiens
cctgcctatgagacgttttgcc

SEQ ID NO: 8306127 - DNA, 19 bp, Homo sapiens
cctgcctgagctgtccctc

SEQ ID NO: 8306128 - DNA, 17 bp, Homo sapiens
cctgcctgagccatagc

SEQ ID NO: 8306129 - DNA, 22 bp, Homo sapiens
cctgcctgacagagaaggttca

SEQ ID NO: 8306130 - DNA, 19 bp, Homo sapiens
cctgcctgaccccggctac

SEQ ID NO: 8306131 - DNA, 22 bp, Homo sapiens
cctgcctgaaggtcagccaccc

SEQ ID NO: 8306132 - DNA, 22 bp, Homo sapiens
cctgcctgcaaaatgggacaag

SEQ ID NO: 8306133 - DNA, 22 bp, Homo sapiens
cctgcctgcaccttctctgggg

SEQ ID NO: 8306134 - DNA, 22 bp, Homo sapiens
cctgcctgcaccttctctgggg

SEQ ID NO: 8306135 - DNA, 22 bp, Homo sapiens
cctgcctgattccaggatggct

SEQ ID NO: 8306136 - DNA, 22 bp, Homo sapiens
cctgcctgattccaggatggct

SEQ ID NO: 8306137 - DNA, 22 bp, Homo sapiens
cctgcctgcaaaatgggacaag

SEQ ID NO: 8306138 - DNA, 22 bp, Homo sapiens
cctgcctgcagaaagtatctcc

SEQ ID NO: 8306139 - DNA, 22 bp, Homo sapiens
tggaggcattttaggttgtcac

SEQ ID NO: 8306140 - DNA, 22 bp, Homo sapiens
ccctggagggatttctcaatca

SEQ ID NO: 8306141 - DNA, 22 bp, Homo sapiens
ccctggaggaccccaatgtggc

SEQ ID NO: 8306142 - DNA, 22 bp, Homo sapiens
ccctggaggaccccaatgtggc

SEQ ID NO: 8306143 - DNA, 22 bp, Homo sapiens
tggaggcatcagagtgcttggc

SEQ ID NO: 8306144 - DNA, 22 bp, Homo sapiens
tggaggcataggcctgggccct

SEQ ID NO: 8306145 - DNA, 23 bp, Homo sapiens
tggagatgccccactccctgtct

SEQ ID NO: 8306146 - DNA, 22 bp, Homo sapiens
tggaggaagtggctggccagaa

SEQ ID NO: 8306147 - DNA, 22 bp, Homo sapiens
tggaggaatcagggcttaggct

SEQ ID NO: 8306148 - DNA, 22 bp, Homo sapiens
tggaaagaaaaacaggccatga

SEQ ID NO: 8306149 - DNA, 22 bp, Homo sapiens
tggagatgaatatgtgtacctg

SEQ ID NO: 8306150 - DNA, 22 bp, Homo sapiens
tggaaagaaagtaaaggcgtat

SEQ ID NO: 8306151 - DNA, 22 bp, Homo sapiens
tggaaagaattcctatggttca

SEQ ID NO: 8306152 - DNA, 22 bp, Homo sapiens
tggcagagaacacacatgattc

SEQ ID NO: 8306153 - DNA, 22 bp, Homo sapiens
ccctggagtgtgacgaggcatt

SEQ ID NO: 8306154 - DNA, 22 bp, Homo sapiens
tggcagaagtacacaagcatgc

SEQ ID NO: 8306155 - DNA, 22 bp, Homo sapiens
tggcagaagttcactagtagct

SEQ ID NO: 8306156 - DNA, 22 bp, Homo sapiens
ccctggaggtggaggttgcagg

SEQ ID NO: 8306157 - DNA, 22 bp, Homo sapiens
ccctggaggttgaggctgcagt

SEQ ID NO: 8306158 - DNA, 22 bp, Homo sapiens
ccctggaggttgaggctgcagt

SEQ ID NO: 8306159 - DNA, 22 bp, Homo sapiens
ccctggagggcagacagatgcc

SEQ ID NO: 8306160 - DNA, 22 bp, Homo sapiens
ccctggagggcagacagatgcc

SEQ ID NO: 8306161 - DNA, 22 bp, Homo sapiens
ccctggaggtcagaggcctggg

SEQ ID NO: 8306162 - DNA, 22 bp, Homo sapiens
ccctggaggtcagaggcctggg

SEQ ID NO: 8306163 - DNA, 22 bp, Homo sapiens
ccctggagtagcactgggtcgc

SEQ ID NO: 8306164 - DNA, 23 bp, Homo sapiens
ccctggagtaaattcttggaagg

SEQ ID NO: 8306165 - DNA, 22 bp, Homo sapiens
ccctggagtcaggttggcctgg

SEQ ID NO: 8306166 - DNA, 22 bp, Homo sapiens
ccctggagtcaggttggcctgg

SEQ ID NO: 8306167 - DNA, 22 bp, Homo sapiens
ccctggagtagcactgggtcgc

SEQ ID NO: 8306168 - DNA, 22 bp, Homo sapiens
ccctggagtcctggcagttgat

SEQ ID NO: 8306169 - DNA, 22 bp, Homo sapiens
ccctggagtccggagctcacct

SEQ ID NO: 8306170 - DNA, 22 bp, Homo sapiens
ccctggagtgccggaatcaaga

SEQ ID NO: 8306171 - DNA, 22 bp, Homo sapiens
ccctgggacccgctgcagaggc

SEQ ID NO: 8306172 - DNA, 19 bp, Homo sapiens
tggcaggcccaggatggac

SEQ ID NO: 8306173 - DNA, 21 bp, Homo sapiens
cccttgcctgcactcctcggc

SEQ ID NO: 8306174 - DNA, 22 bp, Homo sapiens
tggcagggaatacagatgttta

SEQ ID NO: 8306175 - DNA, 19 bp, Homo sapiens
tggcagggagagtttgaag

SEQ ID NO: 8306176 - DNA, 22 bp, Homo sapiens
tgctgctcaatgagatgccatc

SEQ ID NO: 8306177 - DNA, 22 bp, Homo sapiens
tgctgcctttgggacctggcct

SEQ ID NO: 8306178 - DNA, 22 bp, Homo sapiens
ccccagctgcatacttgccaag

SEQ ID NO: 8306179 - DNA, 22 bp, Homo sapiens
ccccagctcagtgcagggacat

SEQ ID NO: 8306180 - DNA, 22 bp, Homo sapiens
tgctgggggtgtctcaccaggc

SEQ ID NO: 8306181 - DNA, 22 bp, Homo sapiens
tgctgggggttcagatgagtaa

SEQ ID NO: 8306182 - DNA, 22 bp, Homo sapiens
tgctgggggctttctggatacc

SEQ ID NO: 8306183 - DNA, 22 bp, Homo sapiens
tgctggggctctgaccactcca

SEQ ID NO: 8306184 - DNA, 22 bp, Homo sapiens
ccctccccacaaagcttcacac

SEQ ID NO: 8306185 - DNA, 22 bp, Homo sapiens
ccctccccacaaagcttcacac

SEQ ID NO: 8306186 - DNA, 20 bp, Homo sapiens
tgcttgtcatgcactcaggc

SEQ ID NO: 8306187 - DNA, 22 bp, Homo sapiens
tgcttgggaatgtggagtcaga

SEQ ID NO: 8306188 - DNA, 20 bp, Homo sapiens
tgcttcctggccactgcggg

SEQ ID NO: 8306189 - DNA, 22 bp, Homo sapiens
tgcttccttcccgttcttctcc

SEQ ID NO: 8306190 - DNA, 22 bp, Homo sapiens
tgcttccttgagctctccaatc

SEQ ID NO: 8306191 - DNA, 21 bp, Homo sapiens
tgcttccctgggccacactga

SEQ ID NO: 8306192 - DNA, 22 bp, Homo sapiens
tgcttcctgaggccgtcttctc

SEQ ID NO: 8306193 - DNA, 22 bp, Homo sapiens
tgcttcctgaggccgtcttctc

SEQ ID NO: 8306194 - DNA, 19 bp, Homo sapiens
tgcttcctcaccatctccc

SEQ ID NO: 8306195 - DNA, 19 bp, Homo sapiens
tgcttcctcaccatctccc

SEQ ID NO: 8306196 - DNA, 22 bp, Homo sapiens
tgcttccctgctctgcacacct

SEQ ID NO: 8306197 - DNA, 22 bp, Homo sapiens
tgcaggtgcgttttcaagcctc

SEQ ID NO: 8306198 - DNA, 22 bp, Homo sapiens
tgcagggctaagtcagagcctg

SEQ ID NO: 8306199 - DNA, 22 bp, Homo sapiens
tgcaggtgcctcttgagcttgt

SEQ ID NO: 8306200 - DNA, 22 bp, Homo sapiens
tgctagaaatctgaaactagca

SEQ ID NO: 8306201 - DNA, 22 bp, Homo sapiens
tgctagaatacctacctggagg

SEQ ID NO: 8306202 - DNA, 19 bp, Homo sapiens
tgctcaggccaaggagccc

SEQ ID NO: 8306203 - DNA, 22 bp, Homo sapiens
tgctcagggacaatggagaggg

SEQ ID NO: 8306204 - DNA, 20 bp, Homo sapiens
tgctcaggatggagaggtgt

SEQ ID NO: 8306205 - DNA, 22 bp, Homo sapiens
cccagtcctaaagcagacgcca

SEQ ID NO: 8306206 - DNA, 22 bp, Homo sapiens
tgctctgcaagcaggagcaaga

SEQ ID NO: 8306207 - DNA, 22 bp, Homo sapiens
tgctctggagggtgaagctttt

SEQ ID NO: 8306208 - DNA, 22 bp, Homo sapiens
tgctgccttagcagccaggcaa

SEQ ID NO: 8306209 - DNA, 22 bp, Homo sapiens
tgctgccttctaggcgtgccct

SEQ ID NO: 8306210 - DNA, 22 bp, Homo sapiens
tgctgccttgacctcctgggct

SEQ ID NO: 8306211 - DNA, 22 bp, Homo sapiens
gaaaatgtttcctgttatttgc

SEQ ID NO: 8306212 - DNA, 22 bp, Homo sapiens
gaaaatgttagcttcatagtca

SEQ ID NO: 8306213 - DNA, 22 bp, Homo sapiens
gaaaatgtttgtccggagctga

SEQ ID NO: 8306214 - DNA, 22 bp, Homo sapiens
gaaagaggaaggagatgtatta

SEQ ID NO: 8306215 - DNA, 22 bp, Homo sapiens
ctttgcaatagaggcacacatg

SEQ ID NO: 8306216 - DNA, 22 bp, Homo sapiens
cttgtgcatttcattcctcagg

SEQ ID NO: 8306217 - DNA, 22 bp, Homo sapiens
cttgtgcaattgacattgaatc

SEQ ID NO: 8306218 - DNA, 22 bp, Homo sapiens
cttgtttttaagagatgtttac

SEQ ID NO: 8306219 - DNA, 22 bp, Homo sapiens
cttctggggatggagcccagaa

SEQ ID NO: 8306220 - DNA, 22 bp, Homo sapiens
cttctgggcattcagctgcaca

SEQ ID NO: 8306221 - DNA, 22 bp, Homo sapiens
cttctggaggacactggcccca

SEQ ID NO: 8306222 - DNA, 22 bp, Homo sapiens
ctttgaaaacttaaataacagc

SEQ ID NO: 8306223 - DNA, 22 bp, Homo sapiens
ctttgaaagctcccaggactta

SEQ ID NO: 8306224 - DNA, 22 bp, Homo sapiens
cttccaaacccagggtatgggc

SEQ ID NO: 8306225 - DNA, 22 bp, Homo sapiens
cttccaaagcactttatggacc

SEQ ID NO: 8306226 - DNA, 22 bp, Homo sapiens
cttatagtatgatgttgagaat

SEQ ID NO: 8306227 - DNA, 22 bp, Homo sapiens
cttccagagatagggcctcaag

SEQ ID NO: 8306228 - DNA, 20 bp, Homo sapiens
cttccacacaagaagcacag

SEQ ID NO: 8306229 - DNA, 22 bp, Homo sapiens
cttcctggtttgaagctcgccg

SEQ ID NO: 8306230 - DNA, 22 bp, Homo sapiens
cttcctgttgtcacagtctgcg

SEQ ID NO: 8306231 - DNA, 22 bp, Homo sapiens
cttctaggcttctcagggggca

SEQ ID NO: 8306232 - DNA, 22 bp, Homo sapiens
ctgttttcaaagagagagaatg

SEQ ID NO: 8306233 - DNA, 22 bp, Homo sapiens
ctgtttttgtgctgtgtctccc

SEQ ID NO: 8306234 - DNA, 22 bp, Homo sapiens
ctgtttttgtgctgtgtctccc

SEQ ID NO: 8306235 - DNA, 22 bp, Homo sapiens
ctgtttataaatagaggggagt

SEQ ID NO: 8306236 - DNA, 22 bp, Homo sapiens
ctgtttatacgacaggtggagg

SEQ ID NO: 8306237 - DNA, 21 bp, Homo sapiens
ctgtttcttgtgaagtgacac

SEQ ID NO: 8306238 - DNA, 20 bp, Homo sapiens
ctgtgctttggaacctggaa

SEQ ID NO: 8306239 - DNA, 21 bp, Homo sapiens
ctgtgctttttaagtgtgatg

SEQ ID NO: 8306240 - DNA, 22 bp, Homo sapiens
ctgtgcttgcgggtgtggagcc

SEQ ID NO: 8306241 - DNA, 19 bp, Homo sapiens
ctgtgctttaaactcctat

SEQ ID NO: 8306242 - DNA, 22 bp, Homo sapiens
ctgtgcttgacagtgggaagca

SEQ ID NO: 8306243 - DNA, 22 bp, Homo sapiens
ctgtgcttcgcaactccaaggt

SEQ ID NO: 8306244 - DNA, 22 bp, Homo sapiens
ctgtgcttccaggatggcagct

SEQ ID NO: 8306245 - DNA, 21 bp, Homo sapiens
ctgtgcttcttcctaagccag

SEQ ID NO: 8306246 - DNA, 22 bp, Homo sapiens
cttagaaatcgaactcaggtta

SEQ ID NO: 8306247 - DNA, 22 bp, Homo sapiens
cttagaaatgcagattctcagg

SEQ ID NO: 8306248 - DNA, 22 bp, Homo sapiens
cttagaaataatggtttcagtt

SEQ ID NO: 8306249 - DNA, 22 bp, Homo sapiens
cttacatttaatcatgtgtcat

SEQ ID NO: 8306250 - DNA, 22 bp, Homo sapiens
cttacattgtgtgcatgagggg

SEQ ID NO: 8306251 - DNA, 22 bp, Homo sapiens
cttacattgtcttagttttcaa

SEQ ID NO: 8306252 - DNA, 22 bp, Homo sapiens
cttacattaagtaagagattga

SEQ ID NO: 8306253 - DNA, 22 bp, Homo sapiens
ctgggccttggattgacactgt

SEQ ID NO: 8306254 - DNA, 22 bp, Homo sapiens
ctgggctacgtgttgacagcat

SEQ ID NO: 8306255 - DNA, 22 bp, Homo sapiens
ctgggctggagtgcaatggcgc

SEQ ID NO: 8306256 - DNA, 22 bp, Homo sapiens
ctgggctggcgcatccgacacg

SEQ ID NO: 8306257 - DNA, 22 bp, Homo sapiens
ctgggcctgtcagggctttttg

SEQ ID NO: 8306258 - DNA, 22 bp, Homo sapiens
ctgggcacttgctcacagctct

SEQ ID NO: 8306259 - DNA, 22 bp, Homo sapiens
ctgggagcggctgtcactggtt

SEQ ID NO: 8306260 - DNA, 22 bp, Homo sapiens
ctgggagcccgcgtcctggtgg

SEQ ID NO: 8306261 - DNA, 22 bp, Homo sapiens
ctgggagccctgactagcctgg

SEQ ID NO: 8306262 - DNA, 22 bp, Homo sapiens
ctgggcagcctcacacaatgtt

SEQ ID NO: 8306263 - DNA, 22 bp, Homo sapiens
ctgggcagctaccaccactgct

SEQ ID NO: 8306264 - DNA, 22 bp, Homo sapiens
ctgggcactttggggagcctac

SEQ ID NO: 8306265 - DNA, 22 bp, Homo sapiens
ctgggcagaattttaggatggc

SEQ ID NO: 8306266 - DNA, 22 bp, Homo sapiens
ctgggcagagctaacacctgag

SEQ ID NO: 8306267 - DNA, 22 bp, Homo sapiens
ctgggagatgactcagagcagg

SEQ ID NO: 8306268 - DNA, 22 bp, Homo sapiens
ctgggagattgctagagatgca

SEQ ID NO: 8306269 - DNA, 22 bp, Homo sapiens
ctgggacagctgagacaggaga

SEQ ID NO: 8306270 - DNA, 22 bp, Homo sapiens
ctgggacagctgagacaggaga

SEQ ID NO: 8306271 - DNA, 20 bp, Homo sapiens
ctgctgtgtgtgcctcagcc

SEQ ID NO: 8306272 - DNA, 20 bp, Homo sapiens
ctgcttccaggctcaccccc

SEQ ID NO: 8306273 - DNA, 22 bp, Homo sapiens
ctgcttccatgcaatggcagtc

SEQ ID NO: 8306274 - DNA, 22 bp, Homo sapiens
ctgcttccatggtctggagact

SEQ ID NO: 8306275 - DNA, 22 bp, Homo sapiens
ctgggacacccaaggaaagagc

SEQ ID NO: 8306276 - DNA, 22 bp, Homo sapiens
ctgtagcaagttattcaataaa

SEQ ID NO: 8306277 - DNA, 22 bp, Homo sapiens
ctgtagcagtgtgctctttttc

SEQ ID NO: 8306278 - DNA, 22 bp, Homo sapiens
ctgtagccagtttggcctcacc

SEQ ID NO: 8306279 - DNA, 22 bp, Homo sapiens
ctgtagccagaagcagaaggcc

SEQ ID NO: 8306280 - DNA, 22 bp, Homo sapiens
ctgtacatctctgaggacagta

SEQ ID NO: 8306281 - DNA, 22 bp, Homo sapiens
ctgtacatatacatttttttcc

SEQ ID NO: 8306282 - DNA, 22 bp, Homo sapiens
ctgtacatcccgagagccagta

SEQ ID NO: 8306283 - DNA, 22 bp, Homo sapiens
ctgtacaggtgaggagggggct

SEQ ID NO: 8306284 - DNA, 22 bp, Homo sapiens
ctggtgccattctgtggcctag

SEQ ID NO: 8306285 - DNA, 22 bp, Homo sapiens
ctggtgcaggaaggagctggca

SEQ ID NO: 8306286 - DNA, 22 bp, Homo sapiens
ctggtgagacggttgacaggag

SEQ ID NO: 8306287 - DNA, 22 bp, Homo sapiens
ctggtccttgacgcgtgggagg

SEQ ID NO: 8306288 - DNA, 22 bp, Homo sapiens
ctggtctgagggctcttgaggc

SEQ ID NO: 8306289 - DNA, 22 bp, Homo sapiens
ctggggacttgcagacacaatt

SEQ ID NO: 8306290 - DNA, 22 bp, Homo sapiens
ctgggcttctccccctggcaga

SEQ ID NO: 8306291 - DNA, 22 bp, Homo sapiens
ctgtctgctagaacatctatac

SEQ ID NO: 8306292 - DNA, 17 bp, Homo sapiens
ctgtctgcgcatgaggt

SEQ ID NO: 8306293 - DNA, 17 bp, Homo sapiens
ctgtctgctgcttcctc

SEQ ID NO: 8306294 - DNA, 22 bp, Homo sapiens
ctgtctgtcaagttcatctcca

SEQ ID NO: 8306295 - DNA, 22 bp, Homo sapiens
ctgtgccctggccaggcctctc

SEQ ID NO: 8306296 - DNA, 22 bp, Homo sapiens
ctgtgctgattcagcacaggcc

SEQ ID NO: 8306297 - DNA, 22 bp, Homo sapiens
ctgtgcttacctgcccaggtga

SEQ ID NO: 8306298 - DNA, 22 bp, Homo sapiens
ctgtgctggcagacctggagtt

SEQ ID NO: 8306299 - DNA, 22 bp, Homo sapiens
ctgtgctggagatgggccagag

SEQ ID NO: 8306300 - DNA, 22 bp, Homo sapiens
ctgtgctggagatgggccagag

SEQ ID NO: 8306301 - DNA, 22 bp, Homo sapiens
ctgtctctgttgcctgtaggtg

SEQ ID NO: 8306302 - DNA, 22 bp, Homo sapiens
ctgtccttgctggccaggtatg

SEQ ID NO: 8306303 - DNA, 22 bp, Homo sapiens
ctgtccttactgcttctggctt

SEQ ID NO: 8306304 - DNA, 22 bp, Homo sapiens
ctgtcaggttggtctcagagct

SEQ ID NO: 8306305 - DNA, 22 bp, Homo sapiens
ctgtcctgtggacctgaggacg

SEQ ID NO: 8306306 - DNA, 22 bp, Homo sapiens
ctgtcctgtggacctgaggacg

SEQ ID NO: 8306307 - DNA, 22 bp, Homo sapiens
ctgtcagcactctactacagat

SEQ ID NO: 8306308 - DNA, 22 bp, Homo sapiens
ctgtcacctgttcactgcagca

SEQ ID NO: 8306309 - DNA, 22 bp, Homo sapiens
ctgtcaggggcgggtggagcgg

SEQ ID NO: 8306310 - DNA, 19 bp, Homo sapiens
ctgtcaggggctggatgtt

SEQ ID NO: 8306311 - DNA, 22 bp, Homo sapiens
ctgtcacactgatatcaggctt

SEQ ID NO: 8306312 - DNA, 22 bp, Homo sapiens
ctgtattttcatgcctacgtac

SEQ ID NO: 8306313 - DNA, 20 bp, Homo sapiens
ctgtagggtgcagcaggctc

SEQ ID NO: 8306314 - DNA, 21 bp, Homo sapiens
gagcatggcttacatcagcag

SEQ ID NO: 8306315 - DNA, 22 bp, Homo sapiens
gagcagtggttgaacagaggca

SEQ ID NO: 8306316 - DNA, 22 bp, Homo sapiens
gagcaggcttgcagagaagggg

SEQ ID NO: 8306317 - DNA, 22 bp, Homo sapiens
gagcagtgggaaggaacagggt

SEQ ID NO: 8306318 - DNA, 22 bp, Homo sapiens
gagcagtgggaaggaacagggt

SEQ ID NO: 8306319 - DNA, 22 bp, Homo sapiens
gagcagtgagtgaatgttgcct

SEQ ID NO: 8306320 - DNA, 22 bp, Homo sapiens
gagccatacaacctataaagtg

SEQ ID NO: 8306321 - DNA, 22 bp, Homo sapiens
gagccaggtttgaatctcagtc

SEQ ID NO: 8306322 - DNA, 22 bp, Homo sapiens
gagcccaggcagaggttgcagt

SEQ ID NO: 8306323 - DNA, 22 bp, Homo sapiens
gagcccaggttctgcttccagc

SEQ ID NO: 8306324 - DNA, 22 bp, Homo sapiens
gaggagagagggactgtctgca

SEQ ID NO: 8306325 - DNA, 22 bp, Homo sapiens
gaggaaaatggagtgtaattaa

SEQ ID NO: 8306326 - DNA, 22 bp, Homo sapiens
gagctgctggttgctggtgcct

SEQ ID NO: 8306327 - DNA, 19 bp, Homo sapiens
gagctgccttttgaagacc

SEQ ID NO: 8306328 - DNA, 22 bp, Homo sapiens
gagctgcctgttgcatagcaac

SEQ ID NO: 8306329 - DNA, 22 bp, Homo sapiens
gagctgcctgtgtgccatgatg

SEQ ID NO: 8306330 - DNA, 22 bp, Homo sapiens
gagccctggcagtctgggatgg

SEQ ID NO: 8306331 - DNA, 18 bp, Homo sapiens
gagccctgagtctgcaca

SEQ ID NO: 8306332 - DNA, 22 bp, Homo sapiens
gagctgcctacattgccaagag

SEQ ID NO: 8306333 - DNA, 22 bp, Homo sapiens
gagctgcctgaacaagcagcag

SEQ ID NO: 8306334 - DNA, 22 bp, Homo sapiens
gagctgcctacattgccaagag

SEQ ID NO: 8306335 - DNA, 22 bp, Homo sapiens
gagctgagcctgggtggaccgc

SEQ ID NO: 8306336 - DNA, 22 bp, Homo sapiens
gaggctcagagggagcatggtc

SEQ ID NO: 8306337 - DNA, 22 bp, Homo sapiens
gaggctgaggcaggaggatcac

SEQ ID NO: 8306338 - DNA, 22 bp, Homo sapiens
gaggcagggtgttgattacaga

SEQ ID NO: 8306339 - DNA, 22 bp, Homo sapiens
gaggagcacatgaggctgaggg

SEQ ID NO: 8306340 - DNA, 22 bp, Homo sapiens
gaggagagggctgcgggcccac

SEQ ID NO: 8306341 - DNA, 22 bp, Homo sapiens
gaggcagcttggggctgtgggt

SEQ ID NO: 8306342 - DNA, 22 bp, Homo sapiens
gaggcaggcactgttatcagca

SEQ ID NO: 8306343 - DNA, 22 bp, Homo sapiens
gaggcaggaggattgcttgagc

SEQ ID NO: 8306344 - DNA, 22 bp, Homo sapiens
gaggcaggccctgaatgagtca

SEQ ID NO: 8306345 - DNA, 22 bp, Homo sapiens
gaggcaggcagattgcttgagg

SEQ ID NO: 8306346 - DNA, 22 bp, Homo sapiens
gaggctgcaggcaatgctgccc

SEQ ID NO: 8306347 - DNA, 22 bp, Homo sapiens
gagggagagtgatggaccattg

SEQ ID NO: 8306348 - DNA, 22 bp, Homo sapiens
gaggggctgggcagtccctgga

SEQ ID NO: 8306349 - DNA, 22 bp, Homo sapiens
gaggggctggctgtggtcccat

SEQ ID NO: 8306350 - DNA, 22 bp, Homo sapiens
gaggggctggcacgatggctgc

SEQ ID NO: 8306351 - DNA, 22 bp, Homo sapiens
gaggggctgccctggtgtcagg

SEQ ID NO: 8306352 - DNA, 22 bp, Homo sapiens
gaggggctgccctggtgtcagg

SEQ ID NO: 8306353 - DNA, 22 bp, Homo sapiens
gaggggctctttaatagtaaca

SEQ ID NO: 8306354 - DNA, 22 bp, Homo sapiens
gagggctgccacgttgggcgag

SEQ ID NO: 8306355 - DNA, 22 bp, Homo sapiens
gagggctgcaatgagacagaga

SEQ ID NO: 8306356 - DNA, 22 bp, Homo sapiens
gaaggcaggcttctgattaggt

SEQ ID NO: 8306357 - DNA, 22 bp, Homo sapiens
gaaggagctaaagggagccctg

SEQ ID NO: 8306358 - DNA, 18 bp, Homo sapiens
gaagggagctggaatgca

SEQ ID NO: 8306359 - DNA, 22 bp, Homo sapiens
gaaggccattgcgtcctgggat

SEQ ID NO: 8306360 - DNA, 22 bp, Homo sapiens
gaaaggagggaaacagagcggt

SEQ ID NO: 8306361 - DNA, 22 bp, Homo sapiens
gaaaggagggaaacagagcggt

SEQ ID NO: 8306362 - DNA, 18 bp, Homo sapiens
gaaaggagagacagtagg

SEQ ID NO: 8306363 - DNA, 22 bp, Homo sapiens
gaagcagcagctggggacagtt

SEQ ID NO: 8306364 - DNA, 22 bp, Homo sapiens
gaagcagccacggggagacaga

SEQ ID NO: 8306365 - DNA, 22 bp, Homo sapiens
gaagcagccacggggagacaga

SEQ ID NO: 8306366 - DNA, 22 bp, Homo sapiens
gaagcagcgaagtggaagggac

SEQ ID NO: 8306367 - DNA, 22 bp, Homo sapiens
gaagcagcgaagtggaagggac

SEQ ID NO: 8306368 - DNA, 22 bp, Homo sapiens
gaagcagctaggatcttcattt

SEQ ID NO: 8306369 - DNA, 22 bp, Homo sapiens
gaagcagctagcccactagtca

SEQ ID NO: 8306370 - DNA, 22 bp, Homo sapiens
gaagcagctggtgagatggagc

SEQ ID NO: 8306371 - DNA, 22 bp, Homo sapiens
gaagcagctgccagagatgtct

SEQ ID NO: 8306372 - DNA, 22 bp, Homo sapiens
gaagcagctgccagagatgtct

SEQ ID NO: 8306373 - DNA, 22 bp, Homo sapiens
gaagcagctcagattgactgaa

SEQ ID NO: 8306374 - DNA, 22 bp, Homo sapiens
gaagccaacattccaagtagaa

SEQ ID NO: 8306375 - DNA, 22 bp, Homo sapiens
gaagccaagtgcaaatgcctta

SEQ ID NO: 8306376 - DNA, 22 bp, Homo sapiens
gaagcagctttctggtgaggag

SEQ ID NO: 8306377 - DNA, 22 bp, Homo sapiens
gaagcagctttctggtgaggag

SEQ ID NO: 8306378 - DNA, 20 bp, Homo sapiens
gaagcagcttcatgtagaca

SEQ ID NO: 8306379 - DNA, 22 bp, Homo sapiens
gaagcagctggtgagatggagc

SEQ ID NO: 8306380 - DNA, 20 bp, Homo sapiens
gaagcagcttcatgtagaca

SEQ ID NO: 8306381 - DNA, 22 bp, Homo sapiens
gacagaagaggaacttggacag

SEQ ID NO: 8306382 - DNA, 22 bp, Homo sapiens
gaccagagaaaggcactggaag

SEQ ID NO: 8306383 - DNA, 22 bp, Homo sapiens
gactctgctacaggccgaggtt

SEQ ID NO: 8306384 - DNA, 22 bp, Homo sapiens
gacagacatttcctgatccaat

SEQ ID NO: 8306385 - DNA, 22 bp, Homo sapiens
gacagaggcaagaccagaagcc

SEQ ID NO: 8306386 - DNA, 22 bp, Homo sapiens
gacagcagacagaactacctgc

SEQ ID NO: 8306387 - DNA, 22 bp, Homo sapiens
gacattcacaggtaaacattcc

SEQ ID NO: 8306388 - DNA, 22 bp, Homo sapiens
gacattcacagtttccgatggt

SEQ ID NO: 8306389 - DNA, 20 bp, Homo sapiens
gacattcatagttattacca

SEQ ID NO: 8306390 - DNA, 22 bp, Homo sapiens
gagagggccgggggccagctcc

SEQ ID NO: 8306391 - DNA, 22 bp, Homo sapiens
gagactgatggggctcccagaa

SEQ ID NO: 8306392 - DNA, 22 bp, Homo sapiens
gagactgcattgtccaagggtt

SEQ ID NO: 8306393 - DNA, 22 bp, Homo sapiens
gagaaagacgtaggctgggagg

SEQ ID NO: 8306394 - DNA, 22 bp, Homo sapiens
gagaaacttggagttattctgg

SEQ ID NO: 8306395 - DNA, 22 bp, Homo sapiens
gagaaagatgtaggctgggagg

SEQ ID NO: 8306396 - DNA, 22 bp, Homo sapiens
gagaaagcttctttcccacagg

SEQ ID NO: 8306397 - DNA, 22 bp, Homo sapiens
gagaccaggaagtacagcagcc

SEQ ID NO: 8306398 - DNA, 22 bp, Homo sapiens
ctctggagcatttcacctacat

SEQ ID NO: 8306399 - DNA, 22 bp, Homo sapiens
ctctggagcgctgcttcccgcg

SEQ ID NO: 8306400 - DNA, 19 bp, Homo sapiens
ctctggagcagacactgga

SEQ ID NO: 8306401 - DNA, 21 bp, Homo sapiens
ctctggaggcaagggagagtg

SEQ ID NO: 8306402 - DNA, 22 bp, Homo sapiens
ctctggaggcctaaggaagtgg

SEQ ID NO: 8306403 - DNA, 22 bp, Homo sapiens
ctctggagggaggctgagctgg

SEQ ID NO: 8306404 - DNA, 22 bp, Homo sapiens
ctctggaggttgagcccagcaa

SEQ ID NO: 8306405 - DNA, 22 bp, Homo sapiens
ctctggaggtggaggttgcagt

SEQ ID NO: 8306406 - DNA, 21 bp, Homo sapiens
ctctggagtcaagagcttcca

SEQ ID NO: 8306407 - DNA, 21 bp, Homo sapiens
ctctggagtcaagagcttcca

SEQ ID NO: 8306408 - DNA, 22 bp, Homo sapiens
ctctgctggtgaccactgggcc

SEQ ID NO: 8306409 - DNA, 22 bp, Homo sapiens
ctctgctggcagcccccgggcc

SEQ ID NO: 8306410 - DNA, 22 bp, Homo sapiens
ctctgctgtctcagatgggcca

SEQ ID NO: 8306411 - DNA, 22 bp, Homo sapiens
ctctgcttggaactggacagaa

SEQ ID NO: 8306412 - DNA, 22 bp, Homo sapiens
ctctgcttggaacaggggtttg

SEQ ID NO: 8306413 - DNA, 22 bp, Homo sapiens
ctctgctgtgccgccagggcct

SEQ ID NO: 8306414 - DNA, 19 bp, Homo sapiens
ctctgcctctggctgtggc

SEQ ID NO: 8306415 - DNA, 22 bp, Homo sapiens
ctctgctgcccaggcctgctag

SEQ ID NO: 8306416 - DNA, 19 bp, Homo sapiens
ctctgcctctggctgtggc

SEQ ID NO: 8306417 - DNA, 20 bp, Homo sapiens
ctctgctgcccgccggctgc

SEQ ID NO: 8306418 - DNA, 22 bp, Homo sapiens
tttcttatattctgtcattgtt

SEQ ID NO: 8306419 - DNA, 22 bp, Homo sapiens
tttcttaggctctaaaatgact

SEQ ID NO: 8306420 - DNA, 22 bp, Homo sapiens
ctctgagctgaaacatgagcat

SEQ ID NO: 8306421 - DNA, 22 bp, Homo sapiens
ctctgagctgaaacatgagcat

SEQ ID NO: 8306422 - DNA, 22 bp, Homo sapiens
ctctgagctcctggaagcgtgc

SEQ ID NO: 8306423 - DNA, 22 bp, Homo sapiens
tttctctcctccaaaccaaaga

SEQ ID NO: 8306424 - DNA, 19 bp, Homo sapiens
tttctctccctcatcccga

SEQ ID NO: 8306425 - DNA, 22 bp, Homo sapiens
tttctctctacagtactttcat

SEQ ID NO: 8306426 - DNA, 22 bp, Homo sapiens
tttctctccccaagtggaattg

SEQ ID NO: 8306427 - DNA, 22 bp, Homo sapiens
tttctctcagcctgtagaaact

SEQ ID NO: 8306428 - DNA, 16 bp, Homo sapiens
tttctctctgctattt

SEQ ID NO: 8306429 - DNA, 22 bp, Homo sapiens
tttctctctgactgggagctga

SEQ ID NO: 8306430 - DNA, 22 bp, Homo sapiens
tttctctctatttagacaggta

SEQ ID NO: 8306431 - DNA, 22 bp, Homo sapiens
tttctctctggccctgattgtc

SEQ ID NO: 8306432 - DNA, 20 bp, Homo sapiens
ctctctggaaggtgggagcc

SEQ ID NO: 8306433 - DNA, 20 bp, Homo sapiens
ctctctggaaggtgggagcc

SEQ ID NO: 8306434 - DNA, 22 bp, Homo sapiens
tttctctgaggctggcctccct

SEQ ID NO: 8306435 - DNA, 23 bp, Homo sapiens
ctccctggagtttctggaagatg

SEQ ID NO: 8306436 - DNA, 22 bp, Homo sapiens
ctccctggcacagcgagaggtt

SEQ ID NO: 8306437 - DNA, 22 bp, Homo sapiens
ctccctgggcagatgtggctct

SEQ ID NO: 8306438 - DNA, 22 bp, Homo sapiens
ctccctgggcagatgtggctct

SEQ ID NO: 8306439 - DNA, 22 bp, Homo sapiens
ctccctggctttgtcctgaggc

SEQ ID NO: 8306440 - DNA, 22 bp, Homo sapiens
ctccctggaggtgagctggcac

SEQ ID NO: 8306441 - DNA, 22 bp, Homo sapiens
ctccctggaggcccagacctgg

SEQ ID NO: 8306442 - DNA, 22 bp, Homo sapiens
ctccctgcttgtttcccttcag

SEQ ID NO: 8306443 - DNA, 22 bp, Homo sapiens
ctccctgccctgtgagttggcc

SEQ ID NO: 8306444 - DNA, 22 bp, Homo sapiens
ctccctctgtcttgtccagaaa

SEQ ID NO: 8306445 - DNA, 22 bp, Homo sapiens
ctccctggtgtcccctccagga

SEQ ID NO: 8306446 - DNA, 18 bp, Homo sapiens
ctccccagctgcccccag

SEQ ID NO: 8306447 - DNA, 22 bp, Homo sapiens
ctccccagcattctgacttcct

SEQ ID NO: 8306448 - DNA, 22 bp, Homo sapiens
ctccccagctcgcgggtgacgg

SEQ ID NO: 8306449 - DNA, 22 bp, Homo sapiens
ctccccaggttcaggaggtggg

SEQ ID NO: 8306450 - DNA, 22 bp, Homo sapiens
ctccccaggttcaggaggtggg

SEQ ID NO: 8306451 - DNA, 22 bp, Homo sapiens
ctccccacatttctccctgtct

SEQ ID NO: 8306452 - DNA, 22 bp, Homo sapiens
ctcccagggccatcgagtcact

SEQ ID NO: 8306453 - DNA, 22 bp, Homo sapiens
ctcctgagctctgaggaagctt

SEQ ID NO: 8306454 - DNA, 22 bp, Homo sapiens
ctcctggacatggagcggagga

SEQ ID NO: 8306455 - DNA, 22 bp, Homo sapiens
ctcctgtatgttgggcttcaca

SEQ ID NO: 8306456 - DNA, 22 bp, Homo sapiens
tttcaaatggagtcgtgaaatg

SEQ ID NO: 8306457 - DNA, 22 bp, Homo sapiens
tttcaaataccataaacctaat

SEQ ID NO: 8306458 - DNA, 18 bp, Homo sapiens
ctcggggacaagggcggc

SEQ ID NO: 8306459 - DNA, 22 bp, Homo sapiens
ctgcctgcactgcctggctcca

SEQ ID NO: 8306460 - DNA, 22 bp, Homo sapiens
ctgcctcttgacagatcgtggc

SEQ ID NO: 8306461 - DNA, 22 bp, Homo sapiens
ctgcctctgttgggcatggtct

SEQ ID NO: 8306462 - DNA, 22 bp, Homo sapiens
ctgcctctgttgggcatggtct

SEQ ID NO: 8306463 - DNA, 22 bp, Homo sapiens
ctgctccacacctccatttcct

SEQ ID NO: 8306464 - DNA, 22 bp, Homo sapiens
ctgctcctggtcatcctccact

SEQ ID NO: 8306465 - DNA, 19 bp, Homo sapiens
ctgctctccttgacttgga

SEQ ID NO: 8306466 - DNA, 22 bp, Homo sapiens
ctgctctctgttcccctggatc

SEQ ID NO: 8306467 - DNA, 22 bp, Homo sapiens
ctgctctgaagccaggattctg

SEQ ID NO: 8306468 - DNA, 22 bp, Homo sapiens
ctgctgccggcgagcctccctt

SEQ ID NO: 8306469 - DNA, 22 bp, Homo sapiens
ctgctgccggcgagcctccctt

SEQ ID NO: 8306470 - DNA, 20 bp, Homo sapiens
ctgctgccctgtcagcctct

SEQ ID NO: 8306471 - DNA, 22 bp, Homo sapiens
ctgctgccctagacccagtcct

SEQ ID NO: 8306472 - DNA, 22 bp, Homo sapiens
ctgctgcccctgagctcagcct

SEQ ID NO: 8306473 - DNA, 22 bp, Homo sapiens
ctgctgagccctggcacaggtg

SEQ ID NO: 8306474 - DNA, 22 bp, Homo sapiens
ctgctgctgctatctacccagg

SEQ ID NO: 8306475 - DNA, 22 bp, Homo sapiens
ctgctgctgagagctcagcctg

SEQ ID NO: 8306476 - DNA, 22 bp, Homo sapiens
ctgctgctcgaccagtcccagg

SEQ ID NO: 8306477 - DNA, 22 bp, Homo sapiens
ctgctgctcagtgtcatcatgt

SEQ ID NO: 8306478 - DNA, 22 bp, Homo sapiens
ctgctggcctagcccatcctct

SEQ ID NO: 8306479 - DNA, 22 bp, Homo sapiens
ctgctggaggttggagcatgca

SEQ ID NO: 8306480 - DNA, 22 bp, Homo sapiens
ctgcctctataggagtccacca

SEQ ID NO: 8306481 - DNA, 22 bp, Homo sapiens
ctgcctctattcactgaggcag

SEQ ID NO: 8306482 - DNA, 22 bp, Homo sapiens
ctgcctctattcactgaggcag

SEQ ID NO: 8306483 - DNA, 22 bp, Homo sapiens
ctgcctctggcctcaggcccag

SEQ ID NO: 8306484 - DNA, 22 bp, Homo sapiens
ctgcctctgttgggcatggtct

SEQ ID NO: 8306485 - DNA, 22 bp, Homo sapiens
ctgcctctggttttggtccctg

SEQ ID NO: 8306486 - DNA, 22 bp, Homo sapiens
ctgccctgggatggtctgtgcg

SEQ ID NO: 8306487 - DNA, 22 bp, Homo sapiens
ctgccctgggagtacctgtcct

SEQ ID NO: 8306488 - DNA, 22 bp, Homo sapiens
ctgccctggcagcctaccatgg

SEQ ID NO: 8306489 - DNA, 22 bp, Homo sapiens
ctgccctgcttgatgacagcga

SEQ ID NO: 8306490 - DNA, 22 bp, Homo sapiens
ctgccctgagtcatgccagatg

SEQ ID NO: 8306491 - DNA, 22 bp, Homo sapiens
ctgccctgagggcctgtgtgtt

SEQ ID NO: 8306492 - DNA, 22 bp, Homo sapiens
ctgccctgagggcctgtgtgtt

SEQ ID NO: 8306493 - DNA, 22 bp, Homo sapiens
ctgccctgcccaggccttgggc

SEQ ID NO: 8306494 - DNA, 22 bp, Homo sapiens
ctgccctgcctggccagtgtgg

SEQ ID NO: 8306495 - DNA, 22 bp, Homo sapiens
ctgagggccttggctcctgccc

SEQ ID NO: 8306496 - DNA, 21 bp, Homo sapiens
ctgagggccgcagctgggctc

SEQ ID NO: 8306497 - DNA, 22 bp, Homo sapiens
ctgcaggggcctcgagcacagg

SEQ ID NO: 8306498 - DNA, 22 bp, Homo sapiens
ctgcagtgttctggaatgcatt

SEQ ID NO: 8306499 - DNA, 22 bp, Homo sapiens
ctgcagtgaaatcaggaagcaa

SEQ ID NO: 8306500 - DNA, 22 bp, Homo sapiens
ctgcagtgcaagcccagatgga

SEQ ID NO: 8306501 - DNA, 23 bp, Homo sapiens
ctgcagtcgccggcctgggtgcc

SEQ ID NO: 8306502 - DNA, 22 bp, Homo sapiens
ctgcagtatgagctacccaggt

SEQ ID NO: 8306503 - DNA, 22 bp, Homo sapiens
ctgagatggagttttgctcttg

SEQ ID NO: 8306504 - DNA, 22 bp, Homo sapiens
ctgagatggagtttcgctcttc

SEQ ID NO: 8306505 - DNA, 22 bp, Homo sapiens
ctgagagtcagcttctcctcct

SEQ ID NO: 8306506 - DNA, 22 bp, Homo sapiens
ctgagatggccactgggtctca

SEQ ID NO: 8306507 - DNA, 20 bp, Homo sapiens
ctgagcgtctaagaggtgag

SEQ ID NO: 8306508 - DNA, 22 bp, Homo sapiens
ctgagccttattcaccagccct

SEQ ID NO: 8306509 - DNA, 22 bp, Homo sapiens
ctgagctgggagtggatagtgg

SEQ ID NO: 8306510 - DNA, 22 bp, Homo sapiens
ctgagctgggagtagagactct

SEQ ID NO: 8306511 - DNA, 19 bp, Homo sapiens
ctgagagatgcttcacaca

SEQ ID NO: 8306512 - DNA, 22 bp, Homo sapiens
ctgagaggtgacagcgtgctgg

SEQ ID NO: 8306513 - DNA, 18 bp, Homo sapiens
ctgaggctggcaggagcc

SEQ ID NO: 8306514 - DNA, 18 bp, Homo sapiens
ctgagggcagcccctggg

SEQ ID NO: 8306515 - DNA, 22 bp, Homo sapiens
ctgagggccctgaagcttggca

SEQ ID NO: 8306516 - DNA, 22 bp, Homo sapiens
ctgagggcatgaacattccata

SEQ ID NO: 8306517 - DNA, 22 bp, Homo sapiens
ctgagcttggccaggaatgaat

SEQ ID NO: 8306518 - DNA, 22 bp, Homo sapiens
ctgagcttccagttcctccagg

SEQ ID NO: 8306519 - DNA, 22 bp, Homo sapiens
ctgagctggtggaagcatgcag

SEQ ID NO: 8306520 - DNA, 22 bp, Homo sapiens
ctgagctggtctatggacttgg

SEQ ID NO: 8306521 - DNA, 22 bp, Homo sapiens
ctgagctgggctctcttgaggg

SEQ ID NO: 8306522 - DNA, 20 bp, Homo sapiens
tttttctgggcttccatagc

SEQ ID NO: 8306523 - DNA, 22 bp, Homo sapiens
ctgaaggatttagttctttgct

SEQ ID NO: 8306524 - DNA, 19 bp, Homo sapiens
ctgaagtcttttcagctgg

SEQ ID NO: 8306525 - DNA, 22 bp, Homo sapiens
ctgaaggacacgtgaggagcca

SEQ ID NO: 8306526 - DNA, 22 bp, Homo sapiens
ctgaagcaaaggatcgagctaa

SEQ ID NO: 8306527 - DNA, 22 bp, Homo sapiens
ctgaaggatgtgtggtgggagt

SEQ ID NO: 8306528 - DNA, 18 bp, Homo sapiens
ctgaaggatccaggtgta

SEQ ID NO: 8306529 - DNA, 22 bp, Homo sapiens
ctgaaggattcaaaatggcagg

SEQ ID NO: 8306530 - DNA, 22 bp, Homo sapiens
ctgaaggattagagagcactta

SEQ ID NO: 8306531 - DNA, 22 bp, Homo sapiens
ctgaaggaggtagagtgacata

SEQ ID NO: 8306532 - DNA, 22 bp, Homo sapiens
ctgaaggaggtagagtgacata

SEQ ID NO: 8306533 - DNA, 22 bp, Homo sapiens
ctgaaggagcatagtcagtttt

SEQ ID NO: 8306534 - DNA, 22 bp, Homo sapiens
ctgaaggagaaggccactgttc

SEQ ID NO: 8306535 - DNA, 22 bp, Homo sapiens
ctgaaggacttggtgatagttg

SEQ ID NO: 8306536 - DNA, 22 bp, Homo sapiens
ctctggagtgcagcctggtggc

SEQ ID NO: 8306537 - DNA, 22 bp, Homo sapiens
ttttcctctgttattagtgtga

SEQ ID NO: 8306538 - DNA, 22 bp, Homo sapiens
ttttcctctgtatttgaaatgc

SEQ ID NO: 8306539 - DNA, 22 bp, Homo sapiens
ttttctctacaaaataaccagc

SEQ ID NO: 8306540 - DNA, 22 bp, Homo sapiens
tttttctctaagtagtcccaaa

SEQ ID NO: 8306541 - DNA, 20 bp, Homo sapiens
tgttgattggtgtcatctca

SEQ ID NO: 8306542 - DNA, 22 bp, Homo sapiens
tgttccatgtctttgtaggact

SEQ ID NO: 8306543 - DNA, 20 bp, Homo sapiens
tgttccatgactatttggat

SEQ ID NO: 8306544 - DNA, 17 bp, Homo sapiens
tgttccatttgaccacc

SEQ ID NO: 8306545 - DNA, 22 bp, Homo sapiens
cctgctcccgggacgcgttcac

SEQ ID NO: 8306546 - DNA, 22 bp, Homo sapiens
tgttgcccaggttctctcctgc

SEQ ID NO: 8306547 - DNA, 22 bp, Homo sapiens
cctggggctcaagatggcgccg

SEQ ID NO: 8306548 - DNA, 23 bp, Homo sapiens
cctggggcacttgagtcctcatc

SEQ ID NO: 8306549 - DNA, 22 bp, Homo sapiens
cctggggagaagagcttccccc

SEQ ID NO: 8306550 - DNA, 22 bp, Homo sapiens
ttacaaagcgttgagacaagta

SEQ ID NO: 8306551 - DNA, 22 bp, Homo sapiens
cctgtggctctctttggaggtc

SEQ ID NO: 8306552 - DNA, 22 bp, Homo sapiens
cctgtggctgccacttgggtga

SEQ ID NO: 8306553 - DNA, 22 bp, Homo sapiens
cctgtggctctctttggaggtc

SEQ ID NO: 8306554 - DNA, 22 bp, Homo sapiens
cctgtggcgggggccagtgcct

SEQ ID NO: 8306555 - DNA, 22 bp, Homo sapiens
ttaatgcagaaatcaaactgac

SEQ ID NO: 8306556 - DNA, 22 bp, Homo sapiens
cctgtggcacatgcagggattc

SEQ ID NO: 8306557 - DNA, 22 bp, Homo sapiens
cctgtggcacatgcagggattc

SEQ ID NO: 8306558 - DNA, 22 bp, Homo sapiens
cctgtggccgcgtcgggcggcg

SEQ ID NO: 8306559 - DNA, 22 bp, Homo sapiens
ccttctgctggtcatcccagtg

SEQ ID NO: 8306560 - DNA, 22 bp, Homo sapiens
ccttctgctccctggccagggc

SEQ ID NO: 8306561 - DNA, 21 bp, Homo sapiens
ccttctcttgcttcagcttca

SEQ ID NO: 8306562 - DNA, 21 bp, Homo sapiens
ccttctcttgcttcagcttca

SEQ ID NO: 8306563 - DNA, 22 bp, Homo sapiens
ttatcgtacgcttcagaaattt

SEQ ID NO: 8306564 - DNA, 22 bp, Homo sapiens
cctttgggtgaattcctctctt

SEQ ID NO: 8306565 - DNA, 22 bp, Homo sapiens
cgagggtgtgctgacccagctc

SEQ ID NO: 8306566 - DNA, 17 bp, Homo sapiens
cgagggcttgctggctc

SEQ ID NO: 8306567 - DNA, 22 bp, Homo sapiens
cgatggttctggctgcttgtat

SEQ ID NO: 8306568 - DNA, 22 bp, Homo sapiens
cgcaccactgaattccagcctg

SEQ ID NO: 8306569 - DNA, 22 bp, Homo sapiens
ttatgtatggatggctgaaagt

SEQ ID NO: 8306570 - DNA, 19 bp, Homo sapiens
cctttgaatcaggacactt

SEQ ID NO: 8306571 - DNA, 22 bp, Homo sapiens
ttatgtactctgcaatgtttga

SEQ ID NO: 8306572 - DNA, 22 bp, Homo sapiens
ttatgtacaatgttaatgtaaa

SEQ ID NO: 8306573 - DNA, 22 bp, Homo sapiens
ttatgtacctgaattagtaaag

SEQ ID NO: 8306574 - DNA, 22 bp, Homo sapiens
ttatgggagcaattggggaggt

SEQ ID NO: 8306575 - DNA, 22 bp, Homo sapiens
ttatgtaatttgtttgctcttc

SEQ ID NO: 8306576 - DNA, 22 bp, Homo sapiens
ttatttttaaaagttcacacag

SEQ ID NO: 8306577 - DNA, 22 bp, Homo sapiens
ttcaaaacagctagatattgga

SEQ ID NO: 8306578 - DNA, 22 bp, Homo sapiens
cgcagaagaggttgtctagtcc

SEQ ID NO: 8306579 - DNA, 22 bp, Homo sapiens
ttattattttgtgtacagcaaa

SEQ ID NO: 8306580 - DNA, 22 bp, Homo sapiens
ttattattgtgacctgagaatg

SEQ ID NO: 8306581 - DNA, 22 bp, Homo sapiens
ttatttttaaaagttcacacag

SEQ ID NO: 8306582 - DNA, 22 bp, Homo sapiens
cggctgggttcggctgcaggcc

SEQ ID NO: 8306583 - DNA, 22 bp, Homo sapiens
cgcagcagccccgtggtaggtg

SEQ ID NO: 8306584 - DNA, 22 bp, Homo sapiens
ttcagtttcagtcttgcaaaaa

SEQ ID NO: 8306585 - DNA, 22 bp, Homo sapiens
cgtcccagttccagccgcgctg

SEQ ID NO: 8306586 - DNA, 22 bp, Homo sapiens
ttccagaaatctttcagctcaa

SEQ ID NO: 8306587 - DNA, 22 bp, Homo sapiens
ttcctctcctcacatgagtcac

SEQ ID NO: 8306588 - DNA, 17 bp, Homo sapiens
ttcctctcacatttttt

SEQ ID NO: 8306589 - DNA, 22 bp, Homo sapiens
ttcctctcctcccaccaggtga

SEQ ID NO: 8306590 - DNA, 22 bp, Homo sapiens
ttcctctcaacatgcctgccgg

SEQ ID NO: 8306591 - DNA, 22 bp, Homo sapiens
ttcctctcaacatgcctgccgg

SEQ ID NO: 8306592 - DNA, 22 bp, Homo sapiens
ttcctctctcttgccagaatgt

SEQ ID NO: 8306593 - DNA, 22 bp, Homo sapiens
ttcctctcgctctccggggccc

SEQ ID NO: 8306594 - DNA, 22 bp, Homo sapiens
ttcctctgaaatggcttggaaa

SEQ ID NO: 8306595 - DNA, 22 bp, Homo sapiens
ttctcattctgactcagtgtag

SEQ ID NO: 8306596 - DNA, 22 bp, Homo sapiens
ctaaatgcctttcctacctaac

SEQ ID NO: 8306597 - DNA, 22 bp, Homo sapiens
ctaaatgccctacaatgactgg

SEQ ID NO: 8306598 - DNA, 22 bp, Homo sapiens
ttctacactgagttttttccct

SEQ ID NO: 8306599 - DNA, 22 bp, Homo sapiens
ctacattaaattggcttactta

SEQ ID NO: 8306600 - DNA, 22 bp, Homo sapiens
ctacatggagaagaaaattctt

SEQ ID NO: 8306601 - DNA, 22 bp, Homo sapiens
ttgaagttctaagccccagtac

SEQ ID NO: 8306602 - DNA, 23 bp, Homo sapiens
ttgaaggagaaagctttcttggt

SEQ ID NO: 8306603 - DNA, 21 bp, Homo sapiens
ttgaaggatcacttctgtacc

SEQ ID NO: 8306604 - DNA, 22 bp, Homo sapiens
ttgaaggaggctcctttttaaa

SEQ ID NO: 8306605 - DNA, 22 bp, Homo sapiens
ttgaaggacatcttgtttctag

SEQ ID NO: 8306606 - DNA, 22 bp, Homo sapiens
ttgaatcattacaatagataag

SEQ ID NO: 8306607 - DNA, 22 bp, Homo sapiens
ctcactgtctgtactagctgat

SEQ ID NO: 8306608 - DNA, 22 bp, Homo sapiens
ctcactggcaagactacaggtg

SEQ ID NO: 8306609 - DNA, 22 bp, Homo sapiens
ctcactgccctgaagttgggtt

SEQ ID NO: 8306610 - DNA, 22 bp, Homo sapiens
ctcactggcaagactacaggtg

SEQ ID NO: 8306611 - DNA, 22 bp, Homo sapiens
ctcactgcaagttccacctacc

SEQ ID NO: 8306612 - DNA, 22 bp, Homo sapiens
ttcttaaagaggcaaaacacag

SEQ ID NO: 8306613 - DNA, 22 bp, Homo sapiens
ttgcactccagcccgagcaaca

SEQ ID NO: 8306614 - DNA, 22 bp, Homo sapiens
ttgcaccatttcacttccatta

SEQ ID NO: 8306615 - DNA, 21 bp, Homo sapiens
ttgcaccatgataaattcaga

SEQ ID NO: 8306616 - DNA, 22 bp, Homo sapiens
ttgcaccaaatgagttaaaatt

SEQ ID NO: 8306617 - DNA, 22 bp, Homo sapiens
ttgcacagatgagggtgatgct

SEQ ID NO: 8306618 - DNA, 22 bp, Homo sapiens
ttgcaaaagccgaggcactcca

SEQ ID NO: 8306619 - DNA, 22 bp, Homo sapiens
ctcagcagtgacaagagagtat

SEQ ID NO: 8306620 - DNA, 22 bp, Homo sapiens
ctcaggccattcttccagctgc

SEQ ID NO: 8306621 - DNA, 22 bp, Homo sapiens
ctcaggcccacagcagacccac

SEQ ID NO: 8306622 - DNA, 22 bp, Homo sapiens
ctcagcccagcccaggaccagg

SEQ ID NO: 8306623 - DNA, 22 bp, Homo sapiens
gtagcttattagggataatagt

SEQ ID NO: 8306624 - DNA, 22 bp, Homo sapiens
gtaggaagctctgaggctagtt

SEQ ID NO: 8306625 - DNA, 22 bp, Homo sapiens
gtcaagttaagataaggtcatg

SEQ ID NO: 8306626 - DNA, 22 bp, Homo sapiens
gtcaagtttatccgctcattca

SEQ ID NO: 8306627 - DNA, 22 bp, Homo sapiens
gtagcccacctggggagggcga

SEQ ID NO: 8306628 - DNA, 22 bp, Homo sapiens
gtaagggatttgaacataggtt

SEQ ID NO: 8306629 - DNA, 19 bp, Homo sapiens
gtaagggctaatggactat

SEQ ID NO: 8306630 - DNA, 22 bp, Homo sapiens
gtaacagagggtttgcagatat

SEQ ID NO: 8306631 - DNA, 22 bp, Homo sapiens
gtaacagaaagtcatgctcatt

SEQ ID NO: 8306632 - DNA, 22 bp, Homo sapiens
gtaacaaagtttctaggtgctg

SEQ ID NO: 8306633 - DNA, 22 bp, Homo sapiens
gtaacacagaaatgaaattcca

SEQ ID NO: 8306634 - DNA, 22 bp, Homo sapiens
gtaacaaacggttccaagatgc

SEQ ID NO: 8306635 - DNA, 22 bp, Homo sapiens
ggtgggcagctcttggcaggca

SEQ ID NO: 8306636 - DNA, 22 bp, Homo sapiens
ggtgggcagctcttggcaggca

SEQ ID NO: 8306637 - DNA, 22 bp, Homo sapiens
ggtgggcacattcagtctctgt

SEQ ID NO: 8306638 - DNA, 22 bp, Homo sapiens
ggtgggcacccgagactggatc

SEQ ID NO: 8306639 - DNA, 22 bp, Homo sapiens
ggtgggcacccgagactggatc

SEQ ID NO: 8306640 - DNA, 22 bp, Homo sapiens
gtaaatgtgcttcttttaactt

SEQ ID NO: 8306641 - DNA, 22 bp, Homo sapiens
gtaaatcccatcctttctctgg

SEQ ID NO: 8306642 - DNA, 22 bp, Homo sapiens
gtcctcagagtgggcaggtcct

SEQ ID NO: 8306643 - DNA, 22 bp, Homo sapiens
gtcctcagtaagagggcctctg

SEQ ID NO: 8306644 - DNA, 22 bp, Homo sapiens
gtcctcagggaatgtggcgggt

SEQ ID NO: 8306645 - DNA, 22 bp, Homo sapiens
gtcctcaggaaagcagataaca

SEQ ID NO: 8306646 - DNA, 22 bp, Homo sapiens
gtcatttctgtttcttcagtgc

SEQ ID NO: 8306647 - DNA, 22 bp, Homo sapiens
gtcattgtgtggacatggagaa

SEQ ID NO: 8306648 - DNA, 22 bp, Homo sapiens
gtcattgcagtggcaaatcaca

SEQ ID NO: 8306649 - DNA, 18 bp, Homo sapiens
gtcattgcaacatactgt

SEQ ID NO: 8306650 - DNA, 22 bp, Homo sapiens
gtccctggatctgggacagctg

SEQ ID NO: 8306651 - DNA, 22 bp, Homo sapiens
gtcctctgcccaggtcaaggtt

SEQ ID NO: 8306652 - DNA, 22 bp, Homo sapiens
gtctcccactttctggcctctt

SEQ ID NO: 8306653 - DNA, 22 bp, Homo sapiens
gtctcccatcgtttgtgaggaa

SEQ ID NO: 8306654 - DNA, 22 bp, Homo sapiens
gtcctcagtcagtttggtgggg

SEQ ID NO: 8306655 - DNA, 22 bp, Homo sapiens
gtcctctgaagttgtgcaatgc

SEQ ID NO: 8306656 - DNA, 22 bp, Homo sapiens
gtcctctgcccaggtcaaggtt

SEQ ID NO: 8306657 - DNA, 22 bp, Homo sapiens
gtcctctgactcagccttggga

SEQ ID NO: 8306658 - DNA, 22 bp, Homo sapiens
gtcaccagtcccagctcctgaa

SEQ ID NO: 8306659 - DNA, 22 bp, Homo sapiens
gtcaccagtgctaagaggtgga

SEQ ID NO: 8306660 - DNA, 22 bp, Homo sapiens
gtcaccaggtctgatgcagcca

SEQ ID NO: 8306661 - DNA, 19 bp, Homo sapiens
gtcacatttgtctcccagg

SEQ ID NO: 8306662 - DNA, 23 bp, Homo sapiens
gtcagggctggggtcagagtgac

SEQ ID NO: 8306663 - DNA, 22 bp, Homo sapiens
gtcaggggccatgggccaagga

SEQ ID NO: 8306664 - DNA, 20 bp, Homo sapiens
gtcagtgtcttcagtagtga

SEQ ID NO: 8306665 - DNA, 22 bp, Homo sapiens
gtcagtgtcttaacagagatta

SEQ ID NO: 8306666 - DNA, 22 bp, Homo sapiens
gtctctctcccaagattggcta

SEQ ID NO: 8306667 - DNA, 22 bp, Homo sapiens
gtctctctgactggtccacacc

SEQ ID NO: 8306668 - DNA, 22 bp, Homo sapiens
gtctctctgctaggcctccagt

SEQ ID NO: 8306669 - DNA, 22 bp, Homo sapiens
gtgatctgccagcctcagcctc

SEQ ID NO: 8306670 - DNA, 22 bp, Homo sapiens
gtgaggtggtacaatattaact

SEQ ID NO: 8306671 - DNA, 22 bp, Homo sapiens
gtgaggtgggctggccagagac

SEQ ID NO: 8306672 - DNA, 22 bp, Homo sapiens
gtcttcttttcagtctgcttgt

SEQ ID NO: 8306673 - DNA, 22 bp, Homo sapiens
gtgcctcagcaccgcctgcagc

SEQ ID NO: 8306674 - DNA, 22 bp, Homo sapiens
gtgccctggtccccagcatata

SEQ ID NO: 8306675 - DNA, 22 bp, Homo sapiens
gtgctgtcaattgctttcagta

SEQ ID NO: 8306676 - DNA, 22 bp, Homo sapiens
gtgctgtcgtggaactgggctg

SEQ ID NO: 8306677 - DNA, 22 bp, Homo sapiens
gtgccctgagtgggtaggagag

SEQ ID NO: 8306678 - DNA, 19 bp, Homo sapiens
gtgatttctttccacaagc

SEQ ID NO: 8306679 - DNA, 22 bp, Homo sapiens
gtgattgcccagcaccattgtt

SEQ ID NO: 8306680 - DNA, 23 bp, Homo sapiens
gtgatttcagggaacagaatcag

SEQ ID NO: 8306681 - DNA, 22 bp, Homo sapiens
gtgatttcaaatatagagtgag

SEQ ID NO: 8306682 - DNA, 22 bp, Homo sapiens
gtgatttcaggtttttcatact

SEQ ID NO: 8306683 - DNA, 22 bp, Homo sapiens
gtgatttctaatcatctgaatg

SEQ ID NO: 8306684 - DNA, 22 bp, Homo sapiens
gtgattcctattagtacatgca

SEQ ID NO: 8306685 - DNA, 22 bp, Homo sapiens
ggggcagaaagcccacagagtg

SEQ ID NO: 8306686 - DNA, 22 bp, Homo sapiens
ggggatggtgggaaggcaatct

SEQ ID NO: 8306687 - DNA, 22 bp, Homo sapiens
ggggatggtgggaaggcaatct

SEQ ID NO: 8306688 - DNA, 22 bp, Homo sapiens
ggggcacacttttggtagatat

SEQ ID NO: 8306689 - DNA, 22 bp, Homo sapiens
ggggatggattccgggtccctg

SEQ ID NO: 8306690 - DNA, 22 bp, Homo sapiens
ggggatggattccgggtccctg

SEQ ID NO: 8306691 - DNA, 22 bp, Homo sapiens
ggggatggtggcatttgtaaaa

SEQ ID NO: 8306692 - DNA, 22 bp, Homo sapiens
ggggatggtagaccggtgacgt

SEQ ID NO: 8306693 - DNA, 22 bp, Homo sapiens
ggggatggaggcgtgtggtcct

SEQ ID NO: 8306694 - DNA, 22 bp, Homo sapiens
ggggatggaatgtagtagtgat

SEQ ID NO: 8306695 - DNA, 22 bp, Homo sapiens
ggggatggaatgtagtagtgat

SEQ ID NO: 8306696 - DNA, 22 bp, Homo sapiens
gggctgggatggcttgaagatt

SEQ ID NO: 8306697 - DNA, 22 bp, Homo sapiens
gggctggctctgtctagaaagg

SEQ ID NO: 8306698 - DNA, 22 bp, Homo sapiens
gggctgggaatggctaagtatg

SEQ ID NO: 8306699 - DNA, 22 bp, Homo sapiens
gggctgggattgcttgctgtga

SEQ ID NO: 8306700 - DNA, 22 bp, Homo sapiens
gggctgggcatggtgttccctc

SEQ ID NO: 8306701 - DNA, 22 bp, Homo sapiens
gggctggggctcaataatttgt

SEQ ID NO: 8306702 - DNA, 22 bp, Homo sapiens
ggggctgtttttggaatggctg

SEQ ID NO: 8306703 - DNA, 22 bp, Homo sapiens
ggggcagctcccgagggcagga

SEQ ID NO: 8306704 - DNA, 22 bp, Homo sapiens
gggtcagctgctgggggctgac

SEQ ID NO: 8306705 - DNA, 22 bp, Homo sapiens
gggcatgagagggcagctggca

SEQ ID NO: 8306706 - DNA, 18 bp, Homo sapiens
gggcatcattcacaaagt

SEQ ID NO: 8306707 - DNA, 22 bp, Homo sapiens
gggcctctcccttctcacgcat

SEQ ID NO: 8306708 - DNA, 22 bp, Homo sapiens
gggcctctgtgcagaggggcct

SEQ ID NO: 8306709 - DNA, 22 bp, Homo sapiens
gggcctccggggtgagctgtgg

SEQ ID NO: 8306710 - DNA, 22 bp, Homo sapiens
gggcctgactgagagctcctca

SEQ ID NO: 8306711 - DNA, 22 bp, Homo sapiens
gggcctggcatgcagccccgtt

SEQ ID NO: 8306712 - DNA, 22 bp, Homo sapiens
gggcctgggaacttgcatttag

SEQ ID NO: 8306713 - DNA, 21 bp, Homo sapiens
gggcctggctgcgcaggacgg

SEQ ID NO: 8306714 - DNA, 21 bp, Homo sapiens
gggcctggctgcgcaggacgg

SEQ ID NO: 8306715 - DNA, 22 bp, Homo sapiens
gggcctggggacaccaccatga

SEQ ID NO: 8306716 - DNA, 22 bp, Homo sapiens
gggcctggggtgacgtacccct

SEQ ID NO: 8306717 - DNA, 22 bp, Homo sapiens
gggcctggtgcttctgactcct

SEQ ID NO: 8306718 - DNA, 22 bp, Homo sapiens
gggctggcatcggttgctgaga

SEQ ID NO: 8306719 - DNA, 20 bp, Homo sapiens
gggctggcgcatggggaaag

SEQ ID NO: 8306720 - DNA, 22 bp, Homo sapiens
gggctggcgggaaaggcaattc

SEQ ID NO: 8306721 - DNA, 22 bp, Homo sapiens
gggctggctcccaggtgttgaa

SEQ ID NO: 8306722 - DNA, 22 bp, Homo sapiens
gggctggctcccaggtgttgaa

SEQ ID NO: 8306723 - DNA, 22 bp, Homo sapiens
gggctctcatgagtgtgtggta

SEQ ID NO: 8306724 - DNA, 19 bp, Homo sapiens
gggctccttgggcctctct

SEQ ID NO: 8306725 - DNA, 22 bp, Homo sapiens
gggctccagcccgggaccaggt

SEQ ID NO: 8306726 - DNA, 22 bp, Homo sapiens
ggtcagggttccaggtatcttc

SEQ ID NO: 8306727 - DNA, 22 bp, Homo sapiens
ggtcagggggatctgtgaggta

SEQ ID NO: 8306728 - DNA, 22 bp, Homo sapiens
ggtcagggtataatcaagtgag

SEQ ID NO: 8306729 - DNA, 21 bp, Homo sapiens
ggtcagggggtgcctccaggt

SEQ ID NO: 8306730 - DNA, 22 bp, Homo sapiens
ggtcagggctcttccagtggct

SEQ ID NO: 8306731 - DNA, 22 bp, Homo sapiens
ggtcaggggctgctctacagag

SEQ ID NO: 8306732 - DNA, 22 bp, Homo sapiens
ggtagcacattgcattaggaga

SEQ ID NO: 8306733 - DNA, 20 bp, Homo sapiens
ggtagcagctgctgtcatcc

SEQ ID NO: 8306734 - DNA, 22 bp, Homo sapiens
ggtagcagggctgtgagtcaga

SEQ ID NO: 8306735 - DNA, 22 bp, Homo sapiens
ggtcagccttggatttggtagc

SEQ ID NO: 8306736 - DNA, 22 bp, Homo sapiens
ggtaacagtatgtagagtaaga

SEQ ID NO: 8306737 - DNA, 19 bp, Homo sapiens
ggtaaaagtgagcttcagg

SEQ ID NO: 8306738 - DNA, 22 bp, Homo sapiens
gggtccagcgacagcaggctca

SEQ ID NO: 8306739 - DNA, 22 bp, Homo sapiens
ggtacaaggagtgaaggtttgg

SEQ ID NO: 8306740 - DNA, 22 bp, Homo sapiens
gggtccagagttgaagaggtta

SEQ ID NO: 8306741 - DNA, 23 bp, Homo sapiens
gggtccagagacaggcatgggtg

SEQ ID NO: 8306742 - DNA, 22 bp, Homo sapiens
gggtccagacactccagaggaa

SEQ ID NO: 8306743 - DNA, 22 bp, Homo sapiens
ggtgcagtggtgtggcaaaggg

SEQ ID NO: 8306744 - DNA, 22 bp, Homo sapiens
ggtgaagggccttaggagacag

SEQ ID NO: 8306745 - DNA, 22 bp, Homo sapiens
ggtgaaggcacaagagggcaag

SEQ ID NO: 8306746 - DNA, 22 bp, Homo sapiens
ggtgaaggaggaagctgatgga

SEQ ID NO: 8306747 - DNA, 22 bp, Homo sapiens
ggtgaaggtctactgtgtgcca

SEQ ID NO: 8306748 - DNA, 22 bp, Homo sapiens
ggtgaagggtgtcatggcattt

SEQ ID NO: 8306749 - DNA, 22 bp, Homo sapiens
ggtcttccgagaggcctgtgct

SEQ ID NO: 8306750 - DNA, 21 bp, Homo sapiens
ggtcttccaaataaggagaaa

SEQ ID NO: 8306751 - DNA, 22 bp, Homo sapiens
ggtcttttcacagtggtttgag

SEQ ID NO: 8306752 - DNA, 22 bp, Homo sapiens
ggtcccagaattggttagcaca

SEQ ID NO: 8306753 - DNA, 22 bp, Homo sapiens
ggtgggaggcaggctgctccca

SEQ ID NO: 8306754 - DNA, 22 bp, Homo sapiens
ggtgggcaacatttggcctgag

SEQ ID NO: 8306755 - DNA, 21 bp, Homo sapiens
ggtgggcacaggagagcagag

SEQ ID NO: 8306756 - DNA, 22 bp, Homo sapiens
ggtgccagcctagtgcagtggt

SEQ ID NO: 8306757 - DNA, 22 bp, Homo sapiens
ggtgccagcctagtgcagtggt

SEQ ID NO: 8306758 - DNA, 22 bp, Homo sapiens
ggtgccaggctgtagtcagggt

SEQ ID NO: 8306759 - DNA, 22 bp, Homo sapiens
ggtgccaggctcccagctcagg

SEQ ID NO: 8306760 - DNA, 22 bp, Homo sapiens
ggtgcccacctgtcttcctgga

SEQ ID NO: 8306761 - DNA, 22 bp, Homo sapiens
ggtgctcaagagggcatcctct

SEQ ID NO: 8306762 - DNA, 22 bp, Homo sapiens
ggatggagatgaccatggtgac

SEQ ID NO: 8306763 - DNA, 22 bp, Homo sapiens
ggatggaggttctcagatgctc

SEQ ID NO: 8306764 - DNA, 22 bp, Homo sapiens
ggatgctgggagacagcaggca

SEQ ID NO: 8306765 - DNA, 22 bp, Homo sapiens
ggatgctgactttggagcatgg

SEQ ID NO: 8306766 - DNA, 22 bp, Homo sapiens
ggatgctgctatcaggcttcga

SEQ ID NO: 8306767 - DNA, 22 bp, Homo sapiens
ggatgctggggaccaatctctg

SEQ ID NO: 8306768 - DNA, 19 bp, Homo sapiens
ggatgagggtcaggcatag

SEQ ID NO: 8306769 - DNA, 22 bp, Homo sapiens
ggatgcaggacggcatggatgt

SEQ ID NO: 8306770 - DNA, 22 bp, Homo sapiens
ggatgcaggacggcatggatgt

SEQ ID NO: 8306771 - DNA, 22 bp, Homo sapiens
ggatgcaggggcagcagagcct

SEQ ID NO: 8306772 - DNA, 22 bp, Homo sapiens
ggatgcaggagttgaagaagga

SEQ ID NO: 8306773 - DNA, 22 bp, Homo sapiens
ggagatggctctgcaaggtcta

SEQ ID NO: 8306774 - DNA, 21 bp, Homo sapiens
ggagatgggtatcgcctgggc

SEQ ID NO: 8306775 - DNA, 22 bp, Homo sapiens
ggagatggtggaagctggtgca

SEQ ID NO: 8306776 - DNA, 22 bp, Homo sapiens
ggagatttatagcacacttcag

SEQ ID NO: 8306777 - DNA, 22 bp, Homo sapiens
ggatctttaagttcttttccat

SEQ ID NO: 8306778 - DNA, 23 bp, Homo sapiens
ggagttggattgtacttgctgct

SEQ ID NO: 8306779 - DNA, 22 bp, Homo sapiens
ggagttggtgagcaccaggctt

SEQ ID NO: 8306780 - DNA, 22 bp, Homo sapiens
ggagcagagctgggcttggctg

SEQ ID NO: 8306781 - DNA, 22 bp, Homo sapiens
ggagcagagctcttcatctgca

SEQ ID NO: 8306782 - DNA, 22 bp, Homo sapiens
ggagcagacataaccttacaga

SEQ ID NO: 8306783 - DNA, 22 bp, Homo sapiens
ggagcagagcatttcacagcct

SEQ ID NO: 8306784 - DNA, 22 bp, Homo sapiens
ggcagctgtggacgtcgtcatt

SEQ ID NO: 8306785 - DNA, 22 bp, Homo sapiens
ggcagctgtgaagtgcctcaca

SEQ ID NO: 8306786 - DNA, 22 bp, Homo sapiens
ggcagccatgcacgctgcctgg

SEQ ID NO: 8306787 - DNA, 22 bp, Homo sapiens
ggcagccatactcagacctggg

SEQ ID NO: 8306788 - DNA, 22 bp, Homo sapiens
ggcagccatggacactggctag

SEQ ID NO: 8306789 - DNA, 22 bp, Homo sapiens
ggcagcagtccatggcccaagg

SEQ ID NO: 8306790 - DNA, 22 bp, Homo sapiens
ggcagcagggctgtctccctac

SEQ ID NO: 8306791 - DNA, 20 bp, Homo sapiens
ggcagcaggagtttcctctt

SEQ ID NO: 8306792 - DNA, 22 bp, Homo sapiens
ggcagcaggcgacttccctatt

SEQ ID NO: 8306793 - DNA, 22 bp, Homo sapiens
ggcagcagggtctagattgatg

SEQ ID NO: 8306794 - DNA, 22 bp, Homo sapiens
ggcagcagtaggagctaatctt

SEQ ID NO: 8306795 - DNA, 22 bp, Homo sapiens
ggcagcagcaaggttggagctg

SEQ ID NO: 8306796 - DNA, 22 bp, Homo sapiens
ggcagcaggagccatctggtag

SEQ ID NO: 8306797 - DNA, 21 bp, Homo sapiens
ggcagaagtagcatggacggg

SEQ ID NO: 8306798 - DNA, 22 bp, Homo sapiens
ggcagaaggcctcccagctcct

SEQ ID NO: 8306799 - DNA, 19 bp, Homo sapiens
ggcagaaggtgtaggggga

SEQ ID NO: 8306800 - DNA, 22 bp, Homo sapiens
ggcagaagaaaggctaagtctc

SEQ ID NO: 8306801 - DNA, 22 bp, Homo sapiens
ggcagtggtgggaggctcgctc

SEQ ID NO: 8306802 - DNA, 22 bp, Homo sapiens
ggcagtggttagaaacatgagc

SEQ ID NO: 8306803 - DNA, 22 bp, Homo sapiens
ggcatctgtccatctctccagc

SEQ ID NO: 8306804 - DNA, 22 bp, Homo sapiens
ggcagggtggccctccagtgag

SEQ ID NO: 8306805 - DNA, 22 bp, Homo sapiens
ggcagtgggttccccaaggcac

SEQ ID NO: 8306806 - DNA, 22 bp, Homo sapiens
ggcagggtctggactgaaagct

SEQ ID NO: 8306807 - DNA, 22 bp, Homo sapiens
ggcagggtgcctggctcctgtt

SEQ ID NO: 8306808 - DNA, 22 bp, Homo sapiens
ggcagggtctggactgaaagct

SEQ ID NO: 8306809 - DNA, 22 bp, Homo sapiens
ggcaggaggaagagttagcacc

SEQ ID NO: 8306810 - DNA, 22 bp, Homo sapiens
ggcaggagctctccagtttgcc

SEQ ID NO: 8306811 - DNA, 22 bp, Homo sapiens
ggcaggagaatggcgtgaactc

SEQ ID NO: 8306812 - DNA, 22 bp, Homo sapiens
ggcaggagataaaatattagtt

SEQ ID NO: 8306813 - DNA, 22 bp, Homo sapiens
ggcctcacccatcggtgccttt

SEQ ID NO: 8306814 - DNA, 22 bp, Homo sapiens
ggcctagggagtggccatgcct

SEQ ID NO: 8306815 - DNA, 21 bp, Homo sapiens
ggccctggttacgcctcctct

SEQ ID NO: 8306816 - DNA, 22 bp, Homo sapiens
ggccctgggatgctcagcagtg

SEQ ID NO: 8306817 - DNA, 22 bp, Homo sapiens
ggccctgggcagaggagtgggc

SEQ ID NO: 8306818 - DNA, 22 bp, Homo sapiens
ggccaggaagggaagatcagca

SEQ ID NO: 8306819 - DNA, 22 bp, Homo sapiens
ggccaggagcaagccaggctct

SEQ ID NO: 8306820 - DNA, 22 bp, Homo sapiens
ggcctggctcttgcccagcctg

SEQ ID NO: 8306821 - DNA, 19 bp, Homo sapiens
ggcctggatttagggctcc

SEQ ID NO: 8306822 - DNA, 22 bp, Homo sapiens
ggcctggcctccagatgtgggc

SEQ ID NO: 8306823 - DNA, 22 bp, Homo sapiens
ggcctggcagagcgcgcggctg

SEQ ID NO: 8306824 - DNA, 19 bp, Homo sapiens
ggcctggatttagggctcc

SEQ ID NO: 8306825 - DNA, 22 bp, Homo sapiens
ggcctggcatggggactaaggg

SEQ ID NO: 8306826 - DNA, 22 bp, Homo sapiens
ggcctgcttctcagtgagcttg

SEQ ID NO: 8306827 - DNA, 22 bp, Homo sapiens
ggcctggaagaggacagagaaa

SEQ ID NO: 8306828 - DNA, 22 bp, Homo sapiens
ggcctgctttccgagcctgcag

SEQ ID NO: 8306829 - DNA, 22 bp, Homo sapiens
ggcctggaatgctttcctacca

SEQ ID NO: 8306830 - DNA, 22 bp, Homo sapiens
ggcctgcctcacagtcagcacc

SEQ ID NO: 8306831 - DNA, 22 bp, Homo sapiens
ggcctgctattggtgggcagac

SEQ ID NO: 8306832 - DNA, 22 bp, Homo sapiens
ggcctgctgacccaagtcctgt

SEQ ID NO: 8306833 - DNA, 22 bp, Homo sapiens
ggcctgctgctatgacttcctg

SEQ ID NO: 8306834 - DNA, 22 bp, Homo sapiens
ggcctgctctgcagcctctaca

SEQ ID NO: 8306835 - DNA, 22 bp, Homo sapiens
ggcctgctccgggggctgagct

SEQ ID NO: 8306836 - DNA, 22 bp, Homo sapiens
gggagctgagggacctctgtgg

SEQ ID NO: 8306837 - DNA, 22 bp, Homo sapiens
gggagctgagggacctctgtgg

SEQ ID NO: 8306838 - DNA, 22 bp, Homo sapiens
gggagctgagctggaagagaat

SEQ ID NO: 8306839 - DNA, 22 bp, Homo sapiens
ggctgtgcgggcagccgtggga

SEQ ID NO: 8306840 - DNA, 22 bp, Homo sapiens
ggctgtgcctcaaggctactca

SEQ ID NO: 8306841 - DNA, 20 bp, Homo sapiens
ggctgtgcccttccgtggcc

SEQ ID NO: 8306842 - DNA, 22 bp, Homo sapiens
ggctttctagatctagctctgt

SEQ ID NO: 8306843 - DNA, 22 bp, Homo sapiens
gggaaggctgcctgagggatgg

SEQ ID NO: 8306844 - DNA, 22 bp, Homo sapiens
gggaagggagggacctcagtct

SEQ ID NO: 8306845 - DNA, 22 bp, Homo sapiens
gggcactggaaggctctcaggc

SEQ ID NO: 8306846 - DNA, 22 bp, Homo sapiens
gggcactgctttgctctgtcac

SEQ ID NO: 8306847 - DNA, 21 bp, Homo sapiens
gggcacccttagcctcctctg

SEQ ID NO: 8306848 - DNA, 22 bp, Homo sapiens
gggcactgaatgccaagctagg

SEQ ID NO: 8306849 - DNA, 22 bp, Homo sapiens
gggcactgctggaggctccctg

SEQ ID NO: 8306850 - DNA, 18 bp, Homo sapiens
gggcactggggactggag

SEQ ID NO: 8306851 - DNA, 22 bp, Homo sapiens
gggaggttgaggctgcagtgag

SEQ ID NO: 8306852 - DNA, 22 bp, Homo sapiens
gggaggttctgttcgcacttga

SEQ ID NO: 8306853 - DNA, 22 bp, Homo sapiens
gggagggccaggctcacccagg

SEQ ID NO: 8306854 - DNA, 22 bp, Homo sapiens
gggaggtgatggcaagcagcgg

SEQ ID NO: 8306855 - DNA, 22 bp, Homo sapiens
gggagggattagttctgcctgg

SEQ ID NO: 8306856 - DNA, 22 bp, Homo sapiens
gggagggaggtgctggttcacg

SEQ ID NO: 8306857 - DNA, 16 bp, Homo sapiens
gggagggagttggtgg

SEQ ID NO: 8306858 - DNA, 22 bp, Homo sapiens
gggagggatctgctaggcaatg

SEQ ID NO: 8306859 - DNA, 22 bp, Homo sapiens
gggagggaggtgatgcttggct

SEQ ID NO: 8306860 - DNA, 22 bp, Homo sapiens
gggagctggagctggaagactc

SEQ ID NO: 8306861 - DNA, 22 bp, Homo sapiens
gggagctggagctggaagactc

SEQ ID NO: 8306862 - DNA, 22 bp, Homo sapiens
gggagggacacaaagagttccc

SEQ ID NO: 8306863 - DNA, 22 bp, Homo sapiens
ggctgggttatttatggccaag

SEQ ID NO: 8306864 - DNA, 22 bp, Homo sapiens
ggctggtcacaccactgcaggg

SEQ ID NO: 8306865 - DNA, 19 bp, Homo sapiens
ggctgggtctggcaggttc

SEQ ID NO: 8306866 - DNA, 22 bp, Homo sapiens
ggctgctggggacgtgggagag

SEQ ID NO: 8306867 - DNA, 22 bp, Homo sapiens
ggctgctgtttcagagactgtt

SEQ ID NO: 8306868 - DNA, 22 bp, Homo sapiens
ggctgcttctcactcatttgca

SEQ ID NO: 8306869 - DNA, 20 bp, Homo sapiens
ggctgctgtgggcagagagg

SEQ ID NO: 8306870 - DNA, 22 bp, Homo sapiens
ggctggaaaagacaaagctatt

SEQ ID NO: 8306871 - DNA, 22 bp, Homo sapiens
ggctgcttgctgtttcttggat

SEQ ID NO: 8306872 - DNA, 22 bp, Homo sapiens
ggctgctttatcggctgctgaa

SEQ ID NO: 8306873 - DNA, 22 bp, Homo sapiens
ggctggaagtccaagatcaagg

SEQ ID NO: 8306874 - DNA, 22 bp, Homo sapiens
ggctggaagtccaagatcaaga

SEQ ID NO: 8306875 - DNA, 18 bp, Homo sapiens
ggctgaggttgactagaa

SEQ ID NO: 8306876 - DNA, 22 bp, Homo sapiens
ggctgagggccagggctagtct

SEQ ID NO: 8306877 - DNA, 22 bp, Homo sapiens
ggctccagggagtggagagaag

SEQ ID NO: 8306878 - DNA, 22 bp, Homo sapiens
ggctccctgcctgtcctcagtc

SEQ ID NO: 8306879 - DNA, 22 bp, Homo sapiens
ggctagaataattgacttcatt

SEQ ID NO: 8306880 - DNA, 22 bp, Homo sapiens
ggctagaactttacactttgca

SEQ ID NO: 8306881 - DNA, 22 bp, Homo sapiens
ggcgtggggccttctgcccgct

SEQ ID NO: 8306882 - DNA, 22 bp, Homo sapiens
ggcgtgggaagtggggcttctg

SEQ ID NO: 8306883 - DNA, 22 bp, Homo sapiens
ggctctggttgaccatgatggc

SEQ ID NO: 8306884 - DNA, 23 bp, Homo sapiens
ggctctgtgctgggcctgcagga

SEQ ID NO: 8306885 - DNA, 22 bp, Homo sapiens
ggctctgggtctgtggggagcg

SEQ ID NO: 8306886 - DNA, 22 bp, Homo sapiens
ggctctggtgtgaagcagcctc

SEQ ID NO: 8306887 - DNA, 22 bp, Homo sapiens
ggctctggtgtgaagcagcctc

SEQ ID NO: 8306888 - DNA, 22 bp, Homo sapiens
ggctctggttgaccatgatggc

SEQ ID NO: 8306889 - DNA, 22 bp, Homo sapiens
ggctcctctctggccgctcccg

SEQ ID NO: 8306890 - DNA, 22 bp, Homo sapiens
ggctcctgaaagactatgggaa

SEQ ID NO: 8306891 - DNA, 22 bp, Homo sapiens
ggctcctgataggagaatgcgg

SEQ ID NO: 8306892 - DNA, 22 bp, Homo sapiens
gcactgggctccaggaaggagg

SEQ ID NO: 8306893 - DNA, 22 bp, Homo sapiens
gcactgggagtctgtgggggtt

SEQ ID NO: 8306894 - DNA, 22 bp, Homo sapiens
gcactgggaatgtgagcagctg

SEQ ID NO: 8306895 - DNA, 23 bp, Homo sapiens
gcactgggctctcagcaaggtgt

SEQ ID NO: 8306896 - DNA, 22 bp, Homo sapiens
gcagagctctgttcttatctcc

SEQ ID NO: 8306897 - DNA, 22 bp, Homo sapiens
gcactgcaggtgggtggagagg

SEQ ID NO: 8306898 - DNA, 22 bp, Homo sapiens
gcactgcatctactggcaagta

SEQ ID NO: 8306899 - DNA, 22 bp, Homo sapiens
gcactgcagcctcagatggtgg

SEQ ID NO: 8306900 - DNA, 22 bp, Homo sapiens
gcactgggaatgagggcagctt

SEQ ID NO: 8306901 - DNA, 22 bp, Homo sapiens
gcactgaaattatatgcatttg

SEQ ID NO: 8306902 - DNA, 22 bp, Homo sapiens
gcactgaaaatgttggattcca

SEQ ID NO: 8306903 - DNA, 22 bp, Homo sapiens
gcacctgggacccagaggcacc

SEQ ID NO: 8306904 - DNA, 22 bp, Homo sapiens
gcactgaatgccaaagtgtagg

SEQ ID NO: 8306905 - DNA, 22 bp, Homo sapiens
gcactgaatgcttttactgtaa

SEQ ID NO: 8306906 - DNA, 20 bp, Homo sapiens
gcactgaaattcaatgtttg

SEQ ID NO: 8306907 - DNA, 17 bp, Homo sapiens
gcactgaacaatcctgt

SEQ ID NO: 8306908 - DNA, 20 bp, Homo sapiens
gcactgaaggttccagggga

SEQ ID NO: 8306909 - DNA, 19 bp, Homo sapiens
gcactgaagagttggtcac

SEQ ID NO: 8306910 - DNA, 22 bp, Homo sapiens
gcactgaactttaatcatttct

SEQ ID NO: 8306911 - DNA, 22 bp, Homo sapiens
gcacagccagcatctgagggat

SEQ ID NO: 8306912 - DNA, 21 bp, Homo sapiens
gcacagcatgagtgttggcat

SEQ ID NO: 8306913 - DNA, 22 bp, Homo sapiens
gcacagccactgagtgagaacc

SEQ ID NO: 8306914 - DNA, 22 bp, Homo sapiens
gcaagcagttgtggcttctgag

SEQ ID NO: 8306915 - DNA, 22 bp, Homo sapiens
gcaagctggctgttagaggatg

SEQ ID NO: 8306916 - DNA, 22 bp, Homo sapiens
gcaagctgcttaagctcattgt

SEQ ID NO: 8306917 - DNA, 22 bp, Homo sapiens
gcaaatgctaaagtgtagagac

SEQ ID NO: 8306918 - DNA, 22 bp, Homo sapiens
gcaaatgagttgtaacataaaa

SEQ ID NO: 8306919 - DNA, 22 bp, Homo sapiens
gagggtcccgagccctgtcaga

SEQ ID NO: 8306920 - DNA, 22 bp, Homo sapiens
gagggtccccatgcagagctca

SEQ ID NO: 8306921 - DNA, 22 bp, Homo sapiens
gcaagatgttaacatagggaga

SEQ ID NO: 8306922 - DNA, 22 bp, Homo sapiens
gcaagcaagcaggtagagctga

SEQ ID NO: 8306923 - DNA, 22 bp, Homo sapiens
gagggggagatgtgcacacact

SEQ ID NO: 8306924 - DNA, 22 bp, Homo sapiens
gaggggtgtggagccatcagtt

SEQ ID NO: 8306925 - DNA, 22 bp, Homo sapiens
gaggggcttgaggccctgatgg

SEQ ID NO: 8306926 - DNA, 22 bp, Homo sapiens
gaggggctgggtagggcaaccc

SEQ ID NO: 8306927 - DNA, 22 bp, Homo sapiens
gaggggctggggttgactccaa

SEQ ID NO: 8306928 - DNA, 22 bp, Homo sapiens
gaggggctgggcagtccctgga

SEQ ID NO: 8306929 - DNA, 22 bp, Homo sapiens
gcaggctgatgactggagttgg

SEQ ID NO: 8306930 - DNA, 22 bp, Homo sapiens
gcaggctgatagaggattccat

SEQ ID NO: 8306931 - DNA, 22 bp, Homo sapiens
gcagggccttagcagcggctgc

SEQ ID NO: 8306932 - DNA, 22 bp, Homo sapiens
gcagggctaatggggcaagtag

SEQ ID NO: 8306933 - DNA, 22 bp, Homo sapiens
gcagggctattggaaggagatg

SEQ ID NO: 8306934 - DNA, 22 bp, Homo sapiens
gcaggctcttctttctgcccag

SEQ ID NO: 8306935 - DNA, 22 bp, Homo sapiens
gcaggctccaggccggcccctt

SEQ ID NO: 8306936 - DNA, 22 bp, Homo sapiens
gcaggagttaggcgtcgtggat

SEQ ID NO: 8306937 - DNA, 22 bp, Homo sapiens
gcaggcctctgttgagggcctt

SEQ ID NO: 8306938 - DNA, 22 bp, Homo sapiens
gcaggagtgacatggatgtgga

SEQ ID NO: 8306939 - DNA, 22 bp, Homo sapiens
gcaggagtgtatttgcatgtaa

SEQ ID NO: 8306940 - DNA, 22 bp, Homo sapiens
gcaggagtgtggtgggacatcc

SEQ ID NO: 8306941 - DNA, 22 bp, Homo sapiens
gcaggagtcactgacttggtcc

SEQ ID NO: 8306942 - DNA, 22 bp, Homo sapiens
gcagctggagccagccagacac

SEQ ID NO: 8306943 - DNA, 22 bp, Homo sapiens
gcagctggagccagccagacac

SEQ ID NO: 8306944 - DNA, 22 bp, Homo sapiens
gcagctggagccagccagacac

SEQ ID NO: 8306945 - DNA, 22 bp, Homo sapiens
gcagctggacccacacggctta

SEQ ID NO: 8306946 - DNA, 22 bp, Homo sapiens
gcagctggagcatcttctcatc

SEQ ID NO: 8306947 - DNA, 22 bp, Homo sapiens
gcagctggacccacacggctta

SEQ ID NO: 8306948 - DNA, 22 bp, Homo sapiens
gcagctggacccacacggctta

SEQ ID NO: 8306949 - DNA, 22 bp, Homo sapiens
gcagctgcctattcagggcttg

SEQ ID NO: 8306950 - DNA, 22 bp, Homo sapiens
gcaggagctggaaagtgatgtt

SEQ ID NO: 8306951 - DNA, 22 bp, Homo sapiens
gcagctggccctgacacgcaga

SEQ ID NO: 8306952 - DNA, 22 bp, Homo sapiens
gcagccacactgttacagaatg

SEQ ID NO: 8306953 - DNA, 22 bp, Homo sapiens
gcagctgcaggcaggcttgctg

SEQ ID NO: 8306954 - DNA, 22 bp, Homo sapiens
gcagctgcaggtggtcccatgc

SEQ ID NO: 8306955 - DNA, 18 bp, Homo sapiens
gcagctgcagttgtagct

SEQ ID NO: 8306956 - DNA, 20 bp, Homo sapiens
gcagctgcccccagtccctg

SEQ ID NO: 8306957 - DNA, 22 bp, Homo sapiens
gcagctgccgtgagctcacgcc

SEQ ID NO: 8306958 - DNA, 22 bp, Homo sapiens
gcagctgccccgactgtgagtc

SEQ ID NO: 8306959 - DNA, 22 bp, Homo sapiens
gcagcatgagctatacaaagta

SEQ ID NO: 8306960 - DNA, 21 bp, Homo sapiens
gcagcagtgttctagaatact

SEQ ID NO: 8306961 - DNA, 23 bp, Homo sapiens
gcagaggagcaagctggacacca

SEQ ID NO: 8306962 - DNA, 22 bp, Homo sapiens
gcagcaggcacggtctcgacat

SEQ ID NO: 8306963 - DNA, 22 bp, Homo sapiens
gcagcaggagagtttgtcctgc

SEQ ID NO: 8306964 - DNA, 22 bp, Homo sapiens
gcagtcctctcattggcctcct

SEQ ID NO: 8306965 - DNA, 22 bp, Homo sapiens
gcagtgaaacaataggatcaaa

SEQ ID NO: 8306966 - DNA, 17 bp, Homo sapiens
gcagtgaaaagagatca

SEQ ID NO: 8306967 - DNA, 22 bp, Homo sapiens
gcagggctcattctagtacaat

SEQ ID NO: 8306968 - DNA, 22 bp, Homo sapiens
gcagggctcaacaggacacccc

SEQ ID NO: 8306969 - DNA, 22 bp, Homo sapiens
gcataatatacatgcttgatcc

SEQ ID NO: 8306970 - DNA, 22 bp, Homo sapiens
gcatccagtcttggctcctgga

SEQ ID NO: 8306971 - DNA, 22 bp, Homo sapiens
gcatccagaggtagccactgtg

SEQ ID NO: 8306972 - DNA, 22 bp, Homo sapiens
gcatttctgtgcatacacatga

SEQ ID NO: 8306973 - DNA, 22 bp, Homo sapiens
gcatttcttcctggtgtgagcc

SEQ ID NO: 8306974 - DNA, 19 bp, Homo sapiens
gcatttctctttacagcca

SEQ ID NO: 8306975 - DNA, 22 bp, Homo sapiens
gcatctttctgtccattcagca

SEQ ID NO: 8306976 - DNA, 22 bp, Homo sapiens
gcatcttcacacaaagccagtg

SEQ ID NO: 8306977 - DNA, 22 bp, Homo sapiens
gcatttgtgttcttcctagagc

SEQ ID NO: 8306978 - DNA, 21 bp, Homo sapiens
gccagagcagtacaatgaggt

SEQ ID NO: 8306979 - DNA, 22 bp, Homo sapiens
gccagagcagaatagagtggcc

SEQ ID NO: 8306980 - DNA, 22 bp, Homo sapiens
gccagagcagaatagagtggcc

SEQ ID NO: 8306981 - DNA, 22 bp, Homo sapiens
gccagagccggcttcacaggat

SEQ ID NO: 8306982 - DNA, 22 bp, Homo sapiens
gccagagccacttttgggtgat

SEQ ID NO: 8306983 - DNA, 22 bp, Homo sapiens
gccagagcatgcactgcctgca

SEQ ID NO: 8306984 - DNA, 22 bp, Homo sapiens
gccagagcacaggctggtagta

SEQ ID NO: 8306985 - DNA, 22 bp, Homo sapiens
gccagagctgagacacgagtcc

SEQ ID NO: 8306986 - DNA, 22 bp, Homo sapiens
gccagagctgagtgaggttctt

SEQ ID NO: 8306987 - DNA, 22 bp, Homo sapiens
gccagcaggtggagagatcaag

SEQ ID NO: 8306988 - DNA, 22 bp, Homo sapiens
gccagcaggttgtcaaggagct

SEQ ID NO: 8306989 - DNA, 22 bp, Homo sapiens
gccagcaggttgtcaaggagct

SEQ ID NO: 8306990 - DNA, 22 bp, Homo sapiens
gccagcagtatgtcctggcagt

SEQ ID NO: 8306991 - DNA, 22 bp, Homo sapiens
gccagccccttagggctctccc

SEQ ID NO: 8306992 - DNA, 22 bp, Homo sapiens
gccagcccagctccaggggaaa

SEQ ID NO: 8306993 - DNA, 22 bp, Homo sapiens
gccagcccagctccaggggaaa

SEQ ID NO: 8306994 - DNA, 22 bp, Homo sapiens
gccagcagtcctgctgtgtgcc

SEQ ID NO: 8306995 - DNA, 22 bp, Homo sapiens
gcctaataactagctgtgtaac

SEQ ID NO: 8306996 - DNA, 22 bp, Homo sapiens
gcctaatatgcaaaattgatac

SEQ ID NO: 8306997 - DNA, 22 bp, Homo sapiens
gccctgaggggtggtgtctgta

SEQ ID NO: 8306998 - DNA, 23 bp, Homo sapiens
gcctcagagaaacagctgcacac

SEQ ID NO: 8306999 - DNA, 22 bp, Homo sapiens
gcctcaggactggcatactcat

SEQ ID NO: 8307000 - DNA, 22 bp, Homo sapiens
gccctgagactgagcatgggtt

SEQ ID NO: 8307001 - DNA, 22 bp, Homo sapiens
gcccagagttcaaggctgcagt

SEQ ID NO: 8307002 - DNA, 22 bp, Homo sapiens
gcccaggctggagtgcagtggt

SEQ ID NO: 8307003 - DNA, 22 bp, Homo sapiens
gccctctggcagccttggctgg

SEQ ID NO: 8307004 - DNA, 22 bp, Homo sapiens
gcccatgcactttctgtgatgg

SEQ ID NO: 8307005 - DNA, 22 bp, Homo sapiens
gcccatgctctcaggcgggcct

SEQ ID NO: 8307006 - DNA, 22 bp, Homo sapiens
gcccatggacacccaagtgcca

SEQ ID NO: 8307007 - DNA, 23 bp, Homo sapiens
gcccatgctgttgggcccgagca

SEQ ID NO: 8307008 - DNA, 22 bp, Homo sapiens
gcccatcatcactgtggaggct

SEQ ID NO: 8307009 - DNA, 22 bp, Homo sapiens
gcccagagagatgctgtagacc

SEQ ID NO: 8307010 - DNA, 22 bp, Homo sapiens
gcccagaagttgaggctgcagt

SEQ ID NO: 8307011 - DNA, 18 bp, Homo sapiens
gcccagaggtctgggccc

SEQ ID NO: 8307012 - DNA, 22 bp, Homo sapiens
gccaggtggctgagcagctgca

SEQ ID NO: 8307013 - DNA, 22 bp, Homo sapiens
gccaggtggctgagtgactgag

SEQ ID NO: 8307014 - DNA, 22 bp, Homo sapiens
gccaggtgggagacagacagca

SEQ ID NO: 8307015 - DNA, 22 bp, Homo sapiens
gccaggtggtctggctccagag

SEQ ID NO: 8307016 - DNA, 22 bp, Homo sapiens
gccaggcacagttctaggtgct

SEQ ID NO: 8307017 - DNA, 22 bp, Homo sapiens
gccaggagttcagatgcatgtt

SEQ ID NO: 8307018 - DNA, 22 bp, Homo sapiens
gccaggcaaattaaggaatgca

SEQ ID NO: 8307019 - DNA, 20 bp, Homo sapiens
gctgggggtgtgctgagtga

SEQ ID NO: 8307020 - DNA, 22 bp, Homo sapiens
gctgggagtcgcgtctgtggcc

SEQ ID NO: 8307021 - DNA, 22 bp, Homo sapiens
gctggggtctgtgaggagggct

SEQ ID NO: 8307022 - DNA, 22 bp, Homo sapiens
gctgtcttcacttcctggtttc

SEQ ID NO: 8307023 - DNA, 22 bp, Homo sapiens
gctgtcttccttgctccaaggg

SEQ ID NO: 8307024 - DNA, 22 bp, Homo sapiens
gctgtcttcacttcctggtttc

SEQ ID NO: 8307025 - DNA, 22 bp, Homo sapiens
gctgtctgttcgagcgtgtgtt

SEQ ID NO: 8307026 - DNA, 22 bp, Homo sapiens
gctggtcactctgggagctgct

SEQ ID NO: 8307027 - DNA, 22 bp, Homo sapiens
gctgggtggatcggaggctctg

SEQ ID NO: 8307028 - DNA, 22 bp, Homo sapiens
gctgtgcactacctatacatcc

SEQ ID NO: 8307029 - DNA, 22 bp, Homo sapiens
gctgtcttgctcactcttgcag

SEQ ID NO: 8307030 - DNA, 22 bp, Homo sapiens
gctgtgcagtctttggtgtgcc

SEQ ID NO: 8307031 - DNA, 22 bp, Homo sapiens
gctgtgcaggtccccactgcct

SEQ ID NO: 8307032 - DNA, 22 bp, Homo sapiens
gctgtgcagccaagtgcctctg

SEQ ID NO: 8307033 - DNA, 22 bp, Homo sapiens
gctgccatggtccaggctccag

SEQ ID NO: 8307034 - DNA, 22 bp, Homo sapiens
gctgccatggtccaggctccag

SEQ ID NO: 8307035 - DNA, 22 bp, Homo sapiens
gctgccatgccacagcactcac

SEQ ID NO: 8307036 - DNA, 22 bp, Homo sapiens
gctggcacctgcaccaagcagg

SEQ ID NO: 8307037 - DNA, 22 bp, Homo sapiens
gctggcagacttcctctggaac

SEQ ID NO: 8307038 - DNA, 22 bp, Homo sapiens
gctggcagaatttcttcttgct

SEQ ID NO: 8307039 - DNA, 22 bp, Homo sapiens
gctggcagaagagctggttcaa

SEQ ID NO: 8307040 - DNA, 22 bp, Homo sapiens
gctggcagaagagctggttcaa

SEQ ID NO: 8307041 - DNA, 22 bp, Homo sapiens
gctggctcagggactagagttt

SEQ ID NO: 8307042 - DNA, 22 bp, Homo sapiens
gctggctcccattggtccttcc

SEQ ID NO: 8307043 - DNA, 22 bp, Homo sapiens
gctggcagggacagctgcgtgt

SEQ ID NO: 8307044 - DNA, 22 bp, Homo sapiens
gctggcagagacaagaagacta

SEQ ID NO: 8307045 - DNA, 18 bp, Homo sapiens
gctggctgcacttctgct

SEQ ID NO: 8307046 - DNA, 22 bp, Homo sapiens
gctggctcctctgtcctcacgg

SEQ ID NO: 8307047 - DNA, 22 bp, Homo sapiens
gctgggagaggccctgaagtga

SEQ ID NO: 8307048 - DNA, 22 bp, Homo sapiens
gctgggaggatctctccctgtc

SEQ ID NO: 8307049 - DNA, 19 bp, Homo sapiens
gcttcccaccagccagccc

SEQ ID NO: 8307050 - DNA, 22 bp, Homo sapiens
gcttcccacagctggactgggg

SEQ ID NO: 8307051 - DNA, 22 bp, Homo sapiens
gcttcctagatctgtggtactc

SEQ ID NO: 8307052 - DNA, 22 bp, Homo sapiens
gcttcctaaatgcacagggcag

SEQ ID NO: 8307053 - DNA, 22 bp, Homo sapiens
gcttccgcgatgtcctaggtgg

SEQ ID NO: 8307054 - DNA, 22 bp, Homo sapiens
gcttcctgagaaacaatctgat

SEQ ID NO: 8307055 - DNA, 22 bp, Homo sapiens
gcttcctcgctgggcagaggca

SEQ ID NO: 8307056 - DNA, 22 bp, Homo sapiens
gcttcctcgctgggcagaggca

SEQ ID NO: 8307057 - DNA, 17 bp, Homo sapiens
gcttcctcatgcagttc

SEQ ID NO: 8307058 - DNA, 22 bp, Homo sapiens
gcttcctgatattcatactgtt

SEQ ID NO: 8307059 - DNA, 22 bp, Homo sapiens
ggaaagtggtggtggaaagagg

SEQ ID NO: 8307060 - DNA, 22 bp, Homo sapiens
ggaaccaggagttacacgagtt

SEQ ID NO: 8307061 - DNA, 22 bp, Homo sapiens
ggaaccagtggaatgatatgct

SEQ ID NO: 8307062 - DNA, 22 bp, Homo sapiens
ggagagagatgccgccttgctc

SEQ ID NO: 8307063 - DNA, 22 bp, Homo sapiens
ggagagctggtagctggctcca

SEQ ID NO: 8307064 - DNA, 22 bp, Homo sapiens
ggactctgttttcctgatcact

SEQ ID NO: 8307065 - DNA, 22 bp, Homo sapiens
ggactcagcagccaggagtggc

SEQ ID NO: 8307066 - DNA, 22 bp, Homo sapiens
ggacctgccagaactcaggcta

SEQ ID NO: 8307067 - DNA, 22 bp, Homo sapiens
ggaccctgggcttgctcctggg

SEQ ID NO: 8307068 - DNA, 22 bp, Homo sapiens
ggacagagccctggtggcctaa

SEQ ID NO: 8307069 - DNA, 22 bp, Homo sapiens
gcctgggtccactgatcatgct

SEQ ID NO: 8307070 - DNA, 22 bp, Homo sapiens
gcctgggtgaatttgatcctaa

SEQ ID NO: 8307071 - DNA, 22 bp, Homo sapiens
gcctgggtgtcgatcactagtg

SEQ ID NO: 8307072 - DNA, 22 bp, Homo sapiens
gcctgggttccatgatctccag

SEQ ID NO: 8307073 - DNA, 22 bp, Homo sapiens
gcctgggtggagaggggtgaca

SEQ ID NO: 8307074 - DNA, 22 bp, Homo sapiens
gcctggtgaaaggcagagagcg

SEQ ID NO: 8307075 - DNA, 22 bp, Homo sapiens
gcctggtgaaaggcagagagcg

SEQ ID NO: 8307076 - DNA, 22 bp, Homo sapiens
gcctggtctctttcatgtcagt

SEQ ID NO: 8307077 - DNA, 22 bp, Homo sapiens
gccttcagccctgactggccag

SEQ ID NO: 8307078 - DNA, 22 bp, Homo sapiens
gcctggtgtccagaggcgagtg

SEQ ID NO: 8307079 - DNA, 22 bp, Homo sapiens
gcctggtggtatcctggcaaga

SEQ ID NO: 8307080 - DNA, 22 bp, Homo sapiens
gcctggtggtgtgctcaagtgg

SEQ ID NO: 8307081 - DNA, 22 bp, Homo sapiens
gcctggtggacactgggcatca

SEQ ID NO: 8307082 - DNA, 22 bp, Homo sapiens
gcctggtgctatgagggccagc

SEQ ID NO: 8307083 - DNA, 22 bp, Homo sapiens
gccttcagtagtgtcagctgta

SEQ ID NO: 8307084 - DNA, 22 bp, Homo sapiens
gccttcagtagtatcctcatga

SEQ ID NO: 8307085 - DNA, 22 bp, Homo sapiens
gccttcaggagggttccagaca

SEQ ID NO: 8307086 - DNA, 22 bp, Homo sapiens
gccttcaggaaatcagtccttg

SEQ ID NO: 8307087 - DNA, 23 bp, Homo sapiens
gccttcagctcgggaaggctccc

SEQ ID NO: 8307088 - DNA, 22 bp, Homo sapiens
gccttcagcggccgctcgctgc

SEQ ID NO: 8307089 - DNA, 22 bp, Homo sapiens
gcctggggaacttgatcctgtc

SEQ ID NO: 8307090 - DNA, 22 bp, Homo sapiens
gcctggctgaggtggggaggca

SEQ ID NO: 8307091 - DNA, 22 bp, Homo sapiens
gccttctgatatctcttggcat

SEQ ID NO: 8307092 - DNA, 22 bp, Homo sapiens
gccttctgattgctggactgac

SEQ ID NO: 8307093 - DNA, 22 bp, Homo sapiens
gccttctgatcgctggactgac

SEQ ID NO: 8307094 - DNA, 22 bp, Homo sapiens
gccttctgcgctcgtgtctccg

SEQ ID NO: 8307095 - DNA, 22 bp, Homo sapiens
gccttctgtgctcctggccttt

SEQ ID NO: 8307096 - DNA, 22 bp, Homo sapiens
gccttctgtgctcctggccttt

SEQ ID NO: 8307097 - DNA, 22 bp, Homo sapiens
gccttttttgttgctctgtcac

SEQ ID NO: 8307098 - DNA, 22 bp, Homo sapiens
gcgaaaaatgtgtaaatatgtt

SEQ ID NO: 8307099 - DNA, 22 bp, Homo sapiens
gccttttttaaactccaagtct

SEQ ID NO: 8307100 - DNA, 22 bp, Homo sapiens
gccttttttgttgctctgtcac

SEQ ID NO: 8307101 - DNA, 22 bp, Homo sapiens
gctcaaggcaggcagacatgag

SEQ ID NO: 8307102 - DNA, 22 bp, Homo sapiens
gctcaagccttctgcccacctc

SEQ ID NO: 8307103 - DNA, 22 bp, Homo sapiens
gctcaagggatgggagtgggtg

SEQ ID NO: 8307104 - DNA, 22 bp, Homo sapiens
gctcaagagagatgcagttctt

SEQ ID NO: 8307105 - DNA, 22 bp, Homo sapiens
gctcacagccggctggcagggg

SEQ ID NO: 8307106 - DNA, 22 bp, Homo sapiens
gctcactgcaacctccacctcc

SEQ ID NO: 8307107 - DNA, 21 bp, Homo sapiens
gctcctggtgctgcgtggcgc

SEQ ID NO: 8307108 - DNA, 22 bp, Homo sapiens
gctcctgtcttggggcactggc

SEQ ID NO: 8307109 - DNA, 22 bp, Homo sapiens
gctcctggtctggagcttcaag

SEQ ID NO: 8307110 - DNA, 22 bp, Homo sapiens
gctcagggaactttttgcaggc

SEQ ID NO: 8307111 - DNA, 22 bp, Homo sapiens
gctctgctggagggaaagagaa

SEQ ID NO: 8307112 - DNA, 22 bp, Homo sapiens
gctctgctggaagttctctgga

SEQ ID NO: 8307113 - DNA, 22 bp, Homo sapiens
gctctgctgagatatctgggag

SEQ ID NO: 8307114 - DNA, 22 bp, Homo sapiens
gctctgctgatccgcagccatc

SEQ ID NO: 8307115 - DNA, 22 bp, Homo sapiens
gctctgctgcttactagatggt

SEQ ID NO: 8307116 - DNA, 22 bp, Homo sapiens
gctctgctcttgacttaccagg

SEQ ID NO: 8307117 - DNA, 22 bp, Homo sapiens
gctctgctgaagccccttgcat

SEQ ID NO: 8307118 - DNA, 22 bp, Homo sapiens
gctctgctgaagccccttgcat

SEQ ID NO: 8307119 - DNA, 22 bp, Homo sapiens
gctctgctcttgacttaccagg

SEQ ID NO: 8307120 - DNA, 22 bp, Homo sapiens
gctctggctactgtggctaccg

SEQ ID NO: 8307121 - DNA, 22 bp, Homo sapiens
gctgaagagagatgcgtccagc

SEQ ID NO: 8307122 - DNA, 22 bp, Homo sapiens
gctctccactgaccacggggca

SEQ ID NO: 8307123 - DNA, 22 bp, Homo sapiens
gctctccaaaccctgtggcttt

SEQ ID NO: 8307124 - DNA, 22 bp, Homo sapiens
gctctcaggtacaaagctgtgt

SEQ ID NO: 8307125 - DNA, 18 bp, Homo sapiens
gctctgcccaggctgccc

SEQ ID NO: 8307126 - DNA, 22 bp, Homo sapiens
gctctgctctaacattcctgac

SEQ ID NO: 8307127 - DNA, 22 bp, Homo sapiens
gctctgctctaacattcctgac

SEQ ID NO: 8307128 - DNA, 19 bp, Homo sapiens
gctctgctactattaccac

SEQ ID NO: 8307129 - DNA, 22 bp, Homo sapiens
gctgaagggagtgctgagtctg

SEQ ID NO: 8307130 - DNA, 22 bp, Homo sapiens
gctgaagcccacgtggcttgta

SEQ ID NO: 8307131 - DNA, 22 bp, Homo sapiens
gctgaaggaggctctggtacta

SEQ ID NO: 8307132 - DNA, 22 bp, Homo sapiens
gctgaagctgcagcaggaggaa

SEQ ID NO: 8307133 - DNA, 22 bp, Homo sapiens
gctgattattacatgtctgtgg

SEQ ID NO: 8307134 - DNA, 22 bp, Homo sapiens
gctgatccttttatgtctagct

SEQ ID NO: 8307135 - DNA, 22 bp, Homo sapiens
gctgccagctcactctcctgag

SEQ ID NO: 8307136 - DNA, 22 bp, Homo sapiens
gctgccagtgtggcatgatgca

SEQ ID NO: 8307137 - DNA, 20 bp, Homo sapiens
gctgccagtgcctgatgctt

SEQ ID NO: 8307138 - DNA, 22 bp, Homo sapiens
gctgccagtagttggagctcca

SEQ ID NO: 8307139 - DNA, 22 bp, Homo sapiens
gctgccacttggtcatgtcatg

SEQ ID NO: 8307140 - DNA, 22 bp, Homo sapiens
gctgccactctgagcttgcttc

SEQ ID NO: 8307141 - DNA, 22 bp, Homo sapiens
gctgcaggggggtctggacttg

SEQ ID NO: 8307142 - DNA, 23 bp, Homo sapiens
gctgcagctgtggatgttctcag

SEQ ID NO: 8307143 - DNA, 22 bp, Homo sapiens
gctgcagctcgccttccggcct

SEQ ID NO: 8307144 - DNA, 22 bp, Homo sapiens
gctgcagctgtaggacacaatt

SEQ ID NO: 8307145 - DNA, 22 bp, Homo sapiens
gctgcagctttaggatccagtg

SEQ ID NO: 8307146 - DNA, 22 bp, Homo sapiens
gctgcagctttaggatccagtg

SEQ ID NO: 8307147 - DNA, 22 bp, Homo sapiens
gctgcaggagctggagctgtgg

SEQ ID NO: 8307148 - DNA, 22 bp, Homo sapiens
tattgagttacagaaaatactt

SEQ ID NO: 8307149 - DNA, 22 bp, Homo sapiens
tattgagttacagaaaatactt

SEQ ID NO: 8307150 - DNA, 22 bp, Homo sapiens
tattcacattctcaggcctggt

SEQ ID NO: 8307151 - DNA, 22 bp, Homo sapiens
tattcacagttgatttacagtt

SEQ ID NO: 8307152 - DNA, 22 bp, Homo sapiens
tattcacaggctggagtgatgt

SEQ ID NO: 8307153 - DNA, 22 bp, Homo sapiens
tattcacatgtacatatgctca

SEQ ID NO: 8307154 - DNA, 22 bp, Homo sapiens
tattcacagctgccgcactcag

SEQ ID NO: 8307155 - DNA, 22 bp, Homo sapiens
tattcacaaaatgaggtcctca

SEQ ID NO: 8307156 - DNA, 22 bp, Homo sapiens
tatgttaaatgtttgatgttta

SEQ ID NO: 8307157 - DNA, 22 bp, Homo sapiens
tattggtgggggcagagagaga

SEQ ID NO: 8307158 - DNA, 22 bp, Homo sapiens
tatttcctgcatggtgatgtaa

SEQ ID NO: 8307159 - DNA, 22 bp, Homo sapiens
tatttgtatttcatgcagtaaa

SEQ ID NO: 8307160 - DNA, 22 bp, Homo sapiens
tatctttgcaaatatctctaag

SEQ ID NO: 8307161 - DNA, 22 bp, Homo sapiens
tatgcacattggtttcctcatt

SEQ ID NO: 8307162 - DNA, 22 bp, Homo sapiens
tatgcacgtctatttatgaaga

SEQ ID NO: 8307163 - DNA, 22 bp, Homo sapiens
tatgcacattcacacaaaaatg

SEQ ID NO: 8307164 - DNA, 22 bp, Homo sapiens
tatgcacattatctaatccatt

SEQ ID NO: 8307165 - DNA, 22 bp, Homo sapiens
tatgcacatataacctgcactg

SEQ ID NO: 8307166 - DNA, 22 bp, Homo sapiens
tatgcatatgaccccaagcttg

SEQ ID NO: 8307167 - DNA, 22 bp, Homo sapiens
tatgcatatagatgcacacaca

SEQ ID NO: 8307168 - DNA, 22 bp, Homo sapiens
tatgcataattggataagtaga

SEQ ID NO: 8307169 - DNA, 22 bp, Homo sapiens
tatgcataggtatctatactca

SEQ ID NO: 8307170 - DNA, 22 bp, Homo sapiens
tatctttagaggaagagaatct

SEQ ID NO: 8307171 - DNA, 22 bp, Homo sapiens
tatctttaacttgcagtattta

SEQ ID NO: 8307172 - DNA, 22 bp, Homo sapiens
tatcttgagagacaacacagca

SEQ ID NO: 8307173 - DNA, 22 bp, Homo sapiens
tatctgttccaggcactcagct

SEQ ID NO: 8307174 - DNA, 20 bp, Homo sapiens
tatcaatcagaaagaagact

SEQ ID NO: 8307175 - DNA, 22 bp, Homo sapiens
tatactttcctgcaactttgat

SEQ ID NO: 8307176 - DNA, 22 bp, Homo sapiens
tatagaagagacatgtgcatag

SEQ ID NO: 8307177 - DNA, 22 bp, Homo sapiens
tatagaagtaagcattgtgatg

SEQ ID NO: 8307178 - DNA, 22 bp, Homo sapiens
tatacagaaccgcctgaagtct

SEQ ID NO: 8307179 - DNA, 22 bp, Homo sapiens
tatattaacacccacttgcctc

SEQ ID NO: 8307180 - DNA, 22 bp, Homo sapiens
tatatgtaagctatgtaagagt

SEQ ID NO: 8307181 - DNA, 22 bp, Homo sapiens
tatagaggtggaaactgaggtt

SEQ ID NO: 8307182 - DNA, 22 bp, Homo sapiens
tagccaggcgaggtcagtgtcg

SEQ ID NO: 8307183 - DNA, 22 bp, Homo sapiens
tagcatttatggtcatgtgtcc

SEQ ID NO: 8307184 - DNA, 22 bp, Homo sapiens
tagcagtggaatcttttgtcca

SEQ ID NO: 8307185 - DNA, 21 bp, Homo sapiens
tagcacttcgctgtaattggg

SEQ ID NO: 8307186 - DNA, 22 bp, Homo sapiens
tagcagtgccaggattttgctg

SEQ ID NO: 8307187 - DNA, 22 bp, Homo sapiens
tagcagaaccagcagtcaattt

SEQ ID NO: 8307188 - DNA, 22 bp, Homo sapiens
tagcacatctggcgcttatagg

SEQ ID NO: 8307189 - DNA, 22 bp, Homo sapiens
tagcacataacttagaatagtt

SEQ ID NO: 8307190 - DNA, 22 bp, Homo sapiens
tactttctagctctccccagtt

SEQ ID NO: 8307191 - DNA, 22 bp, Homo sapiens
tagaagttaaaggaatacagaa

SEQ ID NO: 8307192 - DNA, 22 bp, Homo sapiens
tagagcagttggcagctgtatt

SEQ ID NO: 8307193 - DNA, 22 bp, Homo sapiens
tagagctgataatgaggccaag

SEQ ID NO: 8307194 - DNA, 22 bp, Homo sapiens
tagagctgataatgaggccaag

SEQ ID NO: 8307195 - DNA, 22 bp, Homo sapiens
tagagctatttagagcatttta

SEQ ID NO: 8307196 - DNA, 22 bp, Homo sapiens
tagagctagcttcaaaatgcga

SEQ ID NO: 8307197 - DNA, 22 bp, Homo sapiens
tagagcatttagaggggcagga

SEQ ID NO: 8307198 - DNA, 23 bp, Homo sapiens
tagagcagggaaatctgtcagag

SEQ ID NO: 8307199 - DNA, 22 bp, Homo sapiens
tagagctgctggactgtaacag

SEQ ID NO: 8307200 - DNA, 22 bp, Homo sapiens
tagcccagagtcccaattccag

SEQ ID NO: 8307201 - DNA, 22 bp, Homo sapiens
taggacaggtgaggggctgtgg

SEQ ID NO: 8307202 - DNA, 22 bp, Homo sapiens
tagtacttatctctgtcattgt

SEQ ID NO: 8307203 - DNA, 22 bp, Homo sapiens
tagtacttatctctgtcattgt

SEQ ID NO: 8307204 - DNA, 22 bp, Homo sapiens
tagtaaaagtttagttgaaagt

SEQ ID NO: 8307205 - DNA, 22 bp, Homo sapiens
tagtcaaacctcagaatacccc

SEQ ID NO: 8307206 - DNA, 22 bp, Homo sapiens
tagtatctattagtaacaagag

SEQ ID NO: 8307207 - DNA, 22 bp, Homo sapiens
tagtatctttctatatttccca

SEQ ID NO: 8307208 - DNA, 22 bp, Homo sapiens
tagtccagtaaaacagctaacg

SEQ ID NO: 8307209 - DNA, 22 bp, Homo sapiens
tagtccagccttgggtgtagcc

SEQ ID NO: 8307210 - DNA, 22 bp, Homo sapiens
tagtccattttcacactgctga

SEQ ID NO: 8307211 - DNA, 22 bp, Homo sapiens
tagtcccattttgaggtatttg

SEQ ID NO: 8307212 - DNA, 22 bp, Homo sapiens
gtgctttctgcatggttcctac

SEQ ID NO: 8307213 - DNA, 22 bp, Homo sapiens
gtgctttccatcctccctgctg

SEQ ID NO: 8307214 - DNA, 22 bp, Homo sapiens
gttagaaagtgtctgcttgggt

SEQ ID NO: 8307215 - DNA, 22 bp, Homo sapiens
gttagaaacacattcttattga

SEQ ID NO: 8307216 - DNA, 22 bp, Homo sapiens
gttataaaggtgataatggtca

SEQ ID NO: 8307217 - DNA, 22 bp, Homo sapiens
gttcattttactgtaaatagca

SEQ ID NO: 8307218 - DNA, 22 bp, Homo sapiens
gtttagaattctaactttaagg

SEQ ID NO: 8307219 - DNA, 22 bp, Homo sapiens
gtttacaaatattttaaatggt

SEQ ID NO: 8307220 - DNA, 22 bp, Homo sapiens
gttccaggcaagtgggatagga

SEQ ID NO: 8307221 - DNA, 22 bp, Homo sapiens
gttccacaaaatgtacccagtt

SEQ ID NO: 8307222 - DNA, 22 bp, Homo sapiens
gttccatatcacagcagacgaa

SEQ ID NO: 8307223 - DNA, 22 bp, Homo sapiens
taacacactgaaggtgagatgg

SEQ ID NO: 8307224 - DNA, 22 bp, Homo sapiens
taagatatggtaggaagtttgg

SEQ ID NO: 8307225 - DNA, 22 bp, Homo sapiens
gttttataggtgaaatattact

SEQ ID NO: 8307226 - DNA, 22 bp, Homo sapiens
taaacatgtgagtgtgcatata

SEQ ID NO: 8307227 - DNA, 22 bp, Homo sapiens
taaacatggattctgatcacag

SEQ ID NO: 8307228 - DNA, 22 bp, Homo sapiens
taaagaacacagggaatagcac

SEQ ID NO: 8307229 - DNA, 21 bp, Homo sapiens
taaagaagatgaatgtgatca

SEQ ID NO: 8307230 - DNA, 22 bp, Homo sapiens
taaagttcagtgcatgaatgtg

SEQ ID NO: 8307231 - DNA, 22 bp, Homo sapiens
taaagttctggtgagaggtaag

SEQ ID NO: 8307232 - DNA, 22 bp, Homo sapiens
taaagtttggcagacaataaca

SEQ ID NO: 8307233 - DNA, 21 bp, Homo sapiens
taaataataagttgctgagat

SEQ ID NO: 8307234 - DNA, 22 bp, Homo sapiens
tacagtttgttacattgttagt

SEQ ID NO: 8307235 - DNA, 22 bp, Homo sapiens
tacattatcttgttatctttca

SEQ ID NO: 8307236 - DNA, 20 bp, Homo sapiens
tacattcaaaacaaactctg

SEQ ID NO: 8307237 - DNA, 22 bp, Homo sapiens
tacattcaacatgtcactatgt

SEQ ID NO: 8307238 - DNA, 22 bp, Homo sapiens
tacatgtattgatttctcttct

SEQ ID NO: 8307239 - DNA, 22 bp, Homo sapiens
tacattaacttacgtccacatg

SEQ ID NO: 8307240 - DNA, 22 bp, Homo sapiens
tacatacacaaatatactgttt

SEQ ID NO: 8307241 - DNA, 22 bp, Homo sapiens
tacttccagcaatctgcatatt

SEQ ID NO: 8307242 - DNA, 20 bp, Homo sapiens
tacttgaatgttgcagcagt

SEQ ID NO: 8307243 - DNA, 22 bp, Homo sapiens
tacttagagcgataatttatac

SEQ ID NO: 8307244 - DNA, 20 bp, Homo sapiens
tactgggcaagcccacagac

SEQ ID NO: 8307245 - DNA, 22 bp, Homo sapiens
tacattccatgtgtgtgtattc

SEQ ID NO: 8307246 - DNA, 22 bp, Homo sapiens
tacattccactagtgactggcg

SEQ ID NO: 8307247 - DNA, 22 bp, Homo sapiens
tacccagcttcaagtcaggact

SEQ ID NO: 8307248 - DNA, 22 bp, Homo sapiens
tacctgagcccagtgcagcata

SEQ ID NO: 8307249 - DNA, 22 bp, Homo sapiens
taccttttgcttattatgacac

SEQ ID NO: 8307250 - DNA, 22 bp, Homo sapiens
tacacatgtttggcaagtatgt

SEQ ID NO: 8307251 - DNA, 22 bp, Homo sapiens
taatgcacatgactgaactatt

SEQ ID NO: 8307252 - DNA, 22 bp, Homo sapiens
taatgcacatagaagtacttag

SEQ ID NO: 8307253 - DNA, 22 bp, Homo sapiens
taatgcacagaattgacatggg

SEQ ID NO: 8307254 - DNA, 22 bp, Homo sapiens
taatgcagtactgatataaaca

SEQ ID NO: 8307255 - DNA, 22 bp, Homo sapiens
taatgaataaacttgagagtca

SEQ ID NO: 8307256 - DNA, 22 bp, Homo sapiens
taagtttaaatgtacatgaagc

SEQ ID NO: 8307257 - DNA, 22 bp, Homo sapiens
taataaatgaaagtgctggcat

SEQ ID NO: 8307258 - DNA, 22 bp, Homo sapiens
taagttcagagttctcatttgt

SEQ ID NO: 8307259 - DNA, 22 bp, Homo sapiens
taagttcagttggtcgaagtag

SEQ ID NO: 8307260 - DNA, 22 bp, Homo sapiens
taagttcattagactacagata

SEQ ID NO: 8307261 - DNA, 22 bp, Homo sapiens
taagttcataagcttattctta

SEQ ID NO: 8307262 - DNA, 22 bp, Homo sapiens
taagttcaatgaactcagttct

SEQ ID NO: 8307263 - DNA, 22 bp, Homo sapiens
taagcataactaaaaatgattt

SEQ ID NO: 8307264 - DNA, 22 bp, Homo sapiens
tcaatgattagagtttagtgtg

SEQ ID NO: 8307265 - DNA, 22 bp, Homo sapiens
tcaatgatatcagcaggatgtg

SEQ ID NO: 8307266 - DNA, 22 bp, Homo sapiens
tcaatgatagacaagatctaag

SEQ ID NO: 8307267 - DNA, 22 bp, Homo sapiens
tcaatgatagtacaatcagcct

SEQ ID NO: 8307268 - DNA, 19 bp, Homo sapiens
tcaatgcatgaaatcagcc

SEQ ID NO: 8307269 - DNA, 22 bp, Homo sapiens
tcaatgatgctgaaggtagcgt

SEQ ID NO: 8307270 - DNA, 22 bp, Homo sapiens
tcaaaccaccttgttactgggg

SEQ ID NO: 8307271 - DNA, 22 bp, Homo sapiens
tcaaactagcctgactggtatt

SEQ ID NO: 8307272 - DNA, 22 bp, Homo sapiens
tcaaaagtttcacatagagata

SEQ ID NO: 8307273 - DNA, 22 bp, Homo sapiens
tcaaaagtctgcattcttcaca

SEQ ID NO: 8307274 - DNA, 23 bp, Homo sapiens
tcacacagctggtcaggtacaga

SEQ ID NO: 8307275 - DNA, 22 bp, Homo sapiens
tcaattatgccattgcaatatt

SEQ ID NO: 8307276 - DNA, 22 bp, Homo sapiens
tcacagaatagcactgtaagcg

SEQ ID NO: 8307277 - DNA, 22 bp, Homo sapiens
tcacagacaattgttttggtgt

SEQ ID NO: 8307278 - DNA, 22 bp, Homo sapiens
tcacagcaaaagtgtgcagagc

SEQ ID NO: 8307279 - DNA, 20 bp, Homo sapiens
tcacatcctctcccaacatg

SEQ ID NO: 8307280 - DNA, 22 bp, Homo sapiens
tcagaggacgcactagggttgt

SEQ ID NO: 8307281 - DNA, 22 bp, Homo sapiens
tcagaggagaagttgggaaaat

SEQ ID NO: 8307282 - DNA, 22 bp, Homo sapiens
tcagaggattgcctcagcgagc

SEQ ID NO: 8307283 - DNA, 19 bp, Homo sapiens
tcagaggatttggctatga

SEQ ID NO: 8307284 - DNA, 20 bp, Homo sapiens
tcagaggctgccagctgggg

SEQ ID NO: 8307285 - DNA, 22 bp, Homo sapiens
tcagaggaataatgctgcattt

SEQ ID NO: 8307286 - DNA, 22 bp, Homo sapiens
tcagaggaccttactgagaacc

SEQ ID NO: 8307287 - DNA, 22 bp, Homo sapiens
tcagaggacaagctccctggtg

SEQ ID NO: 8307288 - DNA, 22 bp, Homo sapiens
tcagagagcctcaggcactgcc

SEQ ID NO: 8307289 - DNA, 22 bp, Homo sapiens
tcagaacattgacattcttatt

SEQ ID NO: 8307290 - DNA, 22 bp, Homo sapiens
tcagaacatttaaaaagtggtt

SEQ ID NO: 8307291 - DNA, 22 bp, Homo sapiens
tcagaagaagagactccacagc

SEQ ID NO: 8307292 - DNA, 22 bp, Homo sapiens
tcagaagactactaggacacat

SEQ ID NO: 8307293 - DNA, 22 bp, Homo sapiens
tcagaagagctggtgctgcctg

SEQ ID NO: 8307294 - DNA, 22 bp, Homo sapiens
tcagaagcaaacatcactctag

SEQ ID NO: 8307295 - DNA, 22 bp, Homo sapiens
tcagaagcatgtggggagcctg

SEQ ID NO: 8307296 - DNA, 22 bp, Homo sapiens
tcagaagcaggagtgtgcacaa

SEQ ID NO: 8307297 - DNA, 23 bp, Homo sapiens
tcagagaagttgtaggctgggga

SEQ ID NO: 8307298 - DNA, 22 bp, Homo sapiens
tcagagaagtaaggtggggtgc

SEQ ID NO: 8307299 - DNA, 22 bp, Homo sapiens
tcactgtatttgctgatgcata

SEQ ID NO: 8307300 - DNA, 22 bp, Homo sapiens
tcactggggcctttggtcagga

SEQ ID NO: 8307301 - DNA, 22 bp, Homo sapiens
tcactggggcctttggtcagga

SEQ ID NO: 8307302 - DNA, 22 bp, Homo sapiens
tcactgtatcatgttgcactta

SEQ ID NO: 8307303 - DNA, 22 bp, Homo sapiens
tcacgttttactgagtgagata

SEQ ID NO: 8307304 - DNA, 22 bp, Homo sapiens
tcactgggagatgtgggaaggg

SEQ ID NO: 8307305 - DNA, 21 bp, Homo sapiens
tcacatgcccattactggagc

SEQ ID NO: 8307306 - DNA, 22 bp, Homo sapiens
tcacatgccctgtatttaccag

SEQ ID NO: 8307307 - DNA, 22 bp, Homo sapiens
tcacatcttattagagtatctc

SEQ ID NO: 8307308 - DNA, 20 bp, Homo sapiens
tcacatctggcagctgatga

SEQ ID NO: 8307309 - DNA, 22 bp, Homo sapiens
tcacgagaggcacagaatagag

SEQ ID NO: 8307310 - DNA, 22 bp, Homo sapiens
tcaccttgaatgcagcagcgtg

SEQ ID NO: 8307311 - DNA, 22 bp, Homo sapiens
tcaccttagctagaggaagaga

SEQ ID NO: 8307312 - DNA, 22 bp, Homo sapiens
tcacctgggagggctgtggtag

SEQ ID NO: 8307313 - DNA, 22 bp, Homo sapiens
tcaccctgtgattgcaaagaaa

SEQ ID NO: 8307314 - DNA, 22 bp, Homo sapiens
tcaccgaggctggagtgcagtg

SEQ ID NO: 8307315 - DNA, 22 bp, Homo sapiens
tcaccgaggctggagtgcagtg

SEQ ID NO: 8307316 - DNA, 22 bp, Homo sapiens
tcagcctgcgtcatggtgacac

SEQ ID NO: 8307317 - DNA, 22 bp, Homo sapiens
tcagcttggacagcttggttga

SEQ ID NO: 8307318 - DNA, 22 bp, Homo sapiens
tcagcctctctgagtccagacc

SEQ ID NO: 8307319 - DNA, 22 bp, Homo sapiens
tcagaggtccctagcaggagtg

SEQ ID NO: 8307320 - DNA, 22 bp, Homo sapiens
tcagaggtggtaaaggacagca

SEQ ID NO: 8307321 - DNA, 18 bp, Homo sapiens
tcagaggtacagaaaagt

SEQ ID NO: 8307322 - DNA, 22 bp, Homo sapiens
tcagaggtaagggctgagagga

SEQ ID NO: 8307323 - DNA, 22 bp, Homo sapiens
tcagagggtggctgggagcatc

SEQ ID NO: 8307324 - DNA, 22 bp, Homo sapiens
tcagaggtcacacagcaagttt

SEQ ID NO: 8307325 - DNA, 17 bp, Homo sapiens
tcagagggatgagcagg

SEQ ID NO: 8307326 - DNA, 22 bp, Homo sapiens
tcagaggtggtaaaggacagca

SEQ ID NO: 8307327 - DNA, 22 bp, Homo sapiens
tcagagtcattgcaagtagaag

SEQ ID NO: 8307328 - DNA, 20 bp, Homo sapiens
tcagagtcatcaaagatggt

SEQ ID NO: 8307329 - DNA, 22 bp, Homo sapiens
tcagagtctcccccagtttggg

SEQ ID NO: 8307330 - DNA, 22 bp, Homo sapiens
tcagagtgaggcgtcaacatga

SEQ ID NO: 8307331 - DNA, 22 bp, Homo sapiens
tcagagtgaggcccagcaatct

SEQ ID NO: 8307332 - DNA, 22 bp, Homo sapiens
tcagagtgaccttacatggtct

SEQ ID NO: 8307333 - DNA, 22 bp, Homo sapiens
tcagagtgcagggagtagcagc

SEQ ID NO: 8307334 - DNA, 22 bp, Homo sapiens
tcagagtgcagcgggaggctgg

SEQ ID NO: 8307335 - DNA, 22 bp, Homo sapiens
tcagccagtgccttgatcttgc

SEQ ID NO: 8307336 - DNA, 22 bp, Homo sapiens
tcagccaggtaatgtggagatg

SEQ ID NO: 8307337 - DNA, 21 bp, Homo sapiens
tcaggcaggcgcagagggaag

SEQ ID NO: 8307338 - DNA, 22 bp, Homo sapiens
tcaggcaggcagagggcaaatg

SEQ ID NO: 8307339 - DNA, 22 bp, Homo sapiens
tcaggcagtagaattgcttgaa

SEQ ID NO: 8307340 - DNA, 22 bp, Homo sapiens
tcaggcagctccaggaatggta

SEQ ID NO: 8307341 - DNA, 22 bp, Homo sapiens
tcaggcactgctttctgatatg

SEQ ID NO: 8307342 - DNA, 22 bp, Homo sapiens
tcaggcagatgcagggatggat

SEQ ID NO: 8307343 - DNA, 22 bp, Homo sapiens
tcaggcaccttcctcttatctg

SEQ ID NO: 8307344 - DNA, 22 bp, Homo sapiens
tcaggagcagcatgggtgagag

SEQ ID NO: 8307345 - DNA, 22 bp, Homo sapiens
tcaggagatggtctttataggc

SEQ ID NO: 8307346 - DNA, 22 bp, Homo sapiens
tcataaaacacaccaggtagtt

SEQ ID NO: 8307347 - DNA, 22 bp, Homo sapiens
tcatcaaagcgcttggagtagg

SEQ ID NO: 8307348 - DNA, 22 bp, Homo sapiens
tcatccagtaccatggaaggca

SEQ ID NO: 8307349 - DNA, 20 bp, Homo sapiens
tcatccaggacaggagtggc

SEQ ID NO: 8307350 - DNA, 22 bp, Homo sapiens
tcatccagttcacatggtgagt

SEQ ID NO: 8307351 - DNA, 22 bp, Homo sapiens
tcatccagttgtggagagggaa

SEQ ID NO: 8307352 - DNA, 22 bp, Homo sapiens
tcatctaagagtcttacattta

SEQ ID NO: 8307353 - DNA, 22 bp, Homo sapiens
tcatccttttgcatgggaaggc

SEQ ID NO: 8307354 - DNA, 22 bp, Homo sapiens
tcagttttaaggtttgagaatt

SEQ ID NO: 8307355 - DNA, 19 bp, Homo sapiens
tcagttttagtcatcagtt

SEQ ID NO: 8307356 - DNA, 22 bp, Homo sapiens
tcagttttcatttcatgagcag

SEQ ID NO: 8307357 - DNA, 22 bp, Homo sapiens
tcagttttcaatttcatcagag

SEQ ID NO: 8307358 - DNA, 22 bp, Homo sapiens
tcagtttttctatactttgtag

SEQ ID NO: 8307359 - DNA, 22 bp, Homo sapiens
tcagtttttgtttgccagatag

SEQ ID NO: 8307360 - DNA, 22 bp, Homo sapiens
tcagttttctcatctgtaattt

SEQ ID NO: 8307361 - DNA, 22 bp, Homo sapiens
tcagttttctcatctgtgaaat

SEQ ID NO: 8307362 - DNA, 22 bp, Homo sapiens
tcagttttctcatttatgagat

SEQ ID NO: 8307363 - DNA, 22 bp, Homo sapiens
tcagttttgattcctggttctc

SEQ ID NO: 8307364 - DNA, 22 bp, Homo sapiens
tcagttttgaaaacattgaatg

SEQ ID NO: 8307365 - DNA, 22 bp, Homo sapiens
tcagtttttaagagttatgcga

SEQ ID NO: 8307366 - DNA, 22 bp, Homo sapiens
tcagtttttacggtcacaggga

SEQ ID NO: 8307367 - DNA, 22 bp, Homo sapiens
tcagttttgtatgttgtaagtc

SEQ ID NO: 8307368 - DNA, 23 bp, Homo sapiens
tcagttttggctgttcagtgttg

SEQ ID NO: 8307369 - DNA, 22 bp, Homo sapiens
tcagtttttaaatgatataatt

SEQ ID NO: 8307370 - DNA, 22 bp, Homo sapiens
tcagtgcttcggcgagcaccta

SEQ ID NO: 8307371 - DNA, 22 bp, Homo sapiens
tcagtggagctaagcatgagat

SEQ ID NO: 8307372 - DNA, 22 bp, Homo sapiens
tcagtggatatttctgtggctg

SEQ ID NO: 8307373 - DNA, 22 bp, Homo sapiens
tcagggcaaaagggaaaccatt

SEQ ID NO: 8307374 - DNA, 22 bp, Homo sapiens
tcagggacttacaaaccagaag

SEQ ID NO: 8307375 - DNA, 22 bp, Homo sapiens
tcagggactaggtgctgcctga

SEQ ID NO: 8307376 - DNA, 22 bp, Homo sapiens
tcagggactgcagagggaagct

SEQ ID NO: 8307377 - DNA, 22 bp, Homo sapiens
tcaggctgagaaaatctggacc

SEQ ID NO: 8307378 - DNA, 22 bp, Homo sapiens
tcaggctgaggtcatctgcatc

SEQ ID NO: 8307379 - DNA, 22 bp, Homo sapiens
tcagggcaatgtccctcagaag

SEQ ID NO: 8307380 - DNA, 22 bp, Homo sapiens
tcagggcacaggcctgtgggtt

SEQ ID NO: 8307381 - DNA, 22 bp, Homo sapiens
tcagggcacattctgcagtggc

SEQ ID NO: 8307382 - DNA, 22 bp, Homo sapiens
tcagggcaccaaaaaagatgcc

SEQ ID NO: 8307383 - DNA, 22 bp, Homo sapiens
tcagggcaaagggcagagtttg

SEQ ID NO: 8307384 - DNA, 22 bp, Homo sapiens
tcagggcaagattggttaataa

SEQ ID NO: 8307385 - DNA, 22 bp, Homo sapiens
tcagggcaagtctcagaaggtt

SEQ ID NO: 8307386 - DNA, 21 bp, Homo sapiens
tcaggggctgtgttttccatc

SEQ ID NO: 8307387 - DNA, 22 bp, Homo sapiens
tcaggggctgtgcatttcccag

SEQ ID NO: 8307388 - DNA, 22 bp, Homo sapiens
tcaggggcccttccctcagcag

SEQ ID NO: 8307389 - DNA, 22 bp, Homo sapiens
tcaggggcccttccctcagcag

SEQ ID NO: 8307390 - DNA, 22 bp, Homo sapiens
tcaggggcttgaggtgcatgtc

SEQ ID NO: 8307391 - DNA, 22 bp, Homo sapiens
tcaggggaaatctctcagcgaa

SEQ ID NO: 8307392 - DNA, 22 bp, Homo sapiens
tcaggggacagccagctggagg

SEQ ID NO: 8307393 - DNA, 22 bp, Homo sapiens
tcaggggacttaggagagaagt

SEQ ID NO: 8307394 - DNA, 22 bp, Homo sapiens
tcaggggaggttgaatcgtctc

SEQ ID NO: 8307395 - DNA, 22 bp, Homo sapiens
tcagggcagcctaaggcacctc

SEQ ID NO: 8307396 - DNA, 21 bp, Homo sapiens
tcagggcagctgctcttcaga

SEQ ID NO: 8307397 - DNA, 22 bp, Homo sapiens
tcagggcagaatccaaagaatt

SEQ ID NO: 8307398 - DNA, 22 bp, Homo sapiens
tccgccaggactgagggcccat

SEQ ID NO: 8307399 - DNA, 22 bp, Homo sapiens
tcctcatgccgggtctcacgct

SEQ ID NO: 8307400 - DNA, 22 bp, Homo sapiens
tcctccaggtctagggtggctt

SEQ ID NO: 8307401 - DNA, 22 bp, Homo sapiens
tcctccagtgtctggggccttg

SEQ ID NO: 8307402 - DNA, 22 bp, Homo sapiens
tcccttaaaactcatgtgttgt

SEQ ID NO: 8307403 - DNA, 22 bp, Homo sapiens
tccctgtgtcttcctcttgccc

SEQ ID NO: 8307404 - DNA, 23 bp, Homo sapiens
tccctgtgtacagcctgcatgag

SEQ ID NO: 8307405 - DNA, 19 bp, Homo sapiens
tcccttcctgtcgggctcc

SEQ ID NO: 8307406 - DNA, 22 bp, Homo sapiens
tccctggggatgttggcctgcc

SEQ ID NO: 8307407 - DNA, 22 bp, Homo sapiens
tccctgggcctcctgctatgca

SEQ ID NO: 8307408 - DNA, 22 bp, Homo sapiens
tccctgtcctgggcaatcccag

SEQ ID NO: 8307409 - DNA, 22 bp, Homo sapiens
tccctgtgcctatatgtgctga

SEQ ID NO: 8307410 - DNA, 21 bp, Homo sapiens
tccctgtgagcagctcttcct

SEQ ID NO: 8307411 - DNA, 22 bp, Homo sapiens
tccctgcagctgtaggccggcg

SEQ ID NO: 8307412 - DNA, 22 bp, Homo sapiens
tccctgggccacagctgtgagc

SEQ ID NO: 8307413 - DNA, 22 bp, Homo sapiens
tccctgggcatcacgttgcttc

SEQ ID NO: 8307414 - DNA, 22 bp, Homo sapiens
tcccagcgcggggggaggatcc

SEQ ID NO: 8307415 - DNA, 22 bp, Homo sapiens
tcccaggatgttggcggcaggt

SEQ ID NO: 8307416 - DNA, 22 bp, Homo sapiens
tcccaggatctgagggcagaga

SEQ ID NO: 8307417 - DNA, 22 bp, Homo sapiens
tcccagcctttcttttctgctg

SEQ ID NO: 8307418 - DNA, 22 bp, Homo sapiens
tcccagcagtcagagctatgtg

SEQ ID NO: 8307419 - DNA, 22 bp, Homo sapiens
tcccagcagcatagctcagaat

SEQ ID NO: 8307420 - DNA, 22 bp, Homo sapiens
tcccagcagggccgaccagcct

SEQ ID NO: 8307421 - DNA, 22 bp, Homo sapiens
tcccagagttcaatgggaaggt

SEQ ID NO: 8307422 - DNA, 22 bp, Homo sapiens
tcccagagtttcctgtgtccca

SEQ ID NO: 8307423 - DNA, 22 bp, Homo sapiens
tcccagattgttgatggcttaa

SEQ ID NO: 8307424 - DNA, 22 bp, Homo sapiens
tcccagcagagccagcaagccg

SEQ ID NO: 8307425 - DNA, 22 bp, Homo sapiens
tcccagacaatcattggccacc

SEQ ID NO: 8307426 - DNA, 21 bp, Homo sapiens
tcccagagtgcttgggactgc

SEQ ID NO: 8307427 - DNA, 22 bp, Homo sapiens
tcccagagtgagccaggggcag

SEQ ID NO: 8307428 - DNA, 22 bp, Homo sapiens
tcccagagtgtgggcatcaagg

SEQ ID NO: 8307429 - DNA, 22 bp, Homo sapiens
tcccagagtattagcaattgct

SEQ ID NO: 8307430 - DNA, 22 bp, Homo sapiens
tcccagagaaagtcaaggtctt

SEQ ID NO: 8307431 - DNA, 22 bp, Homo sapiens
tcccagagtcagaggtggggcc

SEQ ID NO: 8307432 - DNA, 22 bp, Homo sapiens
tcccagagtcttctcctgtaat

SEQ ID NO: 8307433 - DNA, 19 bp, Homo sapiens
tcccagagtctagaggttg

SEQ ID NO: 8307434 - DNA, 22 bp, Homo sapiens
tcccagaaaaaggaggctatga

SEQ ID NO: 8307435 - DNA, 22 bp, Homo sapiens
tcccactgtgaatccaaggcct

SEQ ID NO: 8307436 - DNA, 22 bp, Homo sapiens
tcccactgctttgctctgctca

SEQ ID NO: 8307437 - DNA, 22 bp, Homo sapiens
tccagttctaggtcactctctg

SEQ ID NO: 8307438 - DNA, 22 bp, Homo sapiens
tccagggagatggcagaggctg

SEQ ID NO: 8307439 - DNA, 22 bp, Homo sapiens
tccagggagatactggctgcca

SEQ ID NO: 8307440 - DNA, 22 bp, Homo sapiens
tccagggagagccgctgctcca

SEQ ID NO: 8307441 - DNA, 22 bp, Homo sapiens
tccagggacagcgctggagcta

SEQ ID NO: 8307442 - DNA, 22 bp, Homo sapiens
tccagggacctccctgagagct

SEQ ID NO: 8307443 - DNA, 22 bp, Homo sapiens
tccagtggagtgtgggggtgaa

SEQ ID NO: 8307444 - DNA, 22 bp, Homo sapiens
tccagtggcactggagactaga

SEQ ID NO: 8307445 - DNA, 22 bp, Homo sapiens
tccagtgggttgctgagggagg

SEQ ID NO: 8307446 - DNA, 22 bp, Homo sapiens
tccagtggtggtttgaagggca

SEQ ID NO: 8307447 - DNA, 22 bp, Homo sapiens
tccagtggtttgaaaggggtgt

SEQ ID NO: 8307448 - DNA, 22 bp, Homo sapiens
tccagtggtacatggagacact

SEQ ID NO: 8307449 - DNA, 22 bp, Homo sapiens
tccagtggtagtaaagaggtct

SEQ ID NO: 8307450 - DNA, 22 bp, Homo sapiens
tccagggatctttagagtcttt

SEQ ID NO: 8307451 - DNA, 22 bp, Homo sapiens
tccagggatgtcctgtagcact

SEQ ID NO: 8307452 - DNA, 23 bp, Homo sapiens
tccagggattaatgaagtcagtc

SEQ ID NO: 8307453 - DNA, 22 bp, Homo sapiens
tccagggatgccagccatgttg

SEQ ID NO: 8307454 - DNA, 22 bp, Homo sapiens
tccagggatggtaatgagcagt

SEQ ID NO: 8307455 - DNA, 22 bp, Homo sapiens
tccagtcatttccattgttccc

SEQ ID NO: 8307456 - DNA, 22 bp, Homo sapiens
tccagtcaggctgaattcaagg

SEQ ID NO: 8307457 - DNA, 22 bp, Homo sapiens
tccagtcatctcccttcacatt

SEQ ID NO: 8307458 - DNA, 20 bp, Homo sapiens
tccaggagaactgggagccg

SEQ ID NO: 8307459 - DNA, 22 bp, Homo sapiens
tccaggaggaggaaggctgcca

SEQ ID NO: 8307460 - DNA, 22 bp, Homo sapiens
tccaggactagcatttctgata

SEQ ID NO: 8307461 - DNA, 20 bp, Homo sapiens
tccagccacttccgctggtc

SEQ ID NO: 8307462 - DNA, 22 bp, Homo sapiens
tccagccactcagcagggattg

SEQ ID NO: 8307463 - DNA, 22 bp, Homo sapiens
tccagccaccaccttgattgcc

SEQ ID NO: 8307464 - DNA, 22 bp, Homo sapiens
tccacagaatgtaagatccaca

SEQ ID NO: 8307465 - DNA, 22 bp, Homo sapiens
tccactttagcaatgattgaat

SEQ ID NO: 8307466 - DNA, 22 bp, Homo sapiens
tccactgcagcttctgatggaa

SEQ ID NO: 8307467 - DNA, 20 bp, Homo sapiens
tttgagaccagtctgcccaa

SEQ ID NO: 8307468 - DNA, 22 bp, Homo sapiens
tttgcattatatttatagaaga

SEQ ID NO: 8307469 - DNA, 22 bp, Homo sapiens
tttgcattatctcacttatata

SEQ ID NO: 8307470 - DNA, 22 bp, Homo sapiens
tttgcattcctgcctgcattca

SEQ ID NO: 8307471 - DNA, 22 bp, Homo sapiens
tttgcattacttgactttagtt

SEQ ID NO: 8307472 - DNA, 22 bp, Homo sapiens
tttgcattagtttagatttcaa

SEQ ID NO: 8307473 - DNA, 22 bp, Homo sapiens
tttgcatttctcgtaaggaaac

SEQ ID NO: 8307474 - DNA, 22 bp, Homo sapiens
tttgcatttgcaaataatgaaa

SEQ ID NO: 8307475 - DNA, 22 bp, Homo sapiens
tttgcatttctaatgagctccg

SEQ ID NO: 8307476 - DNA, 22 bp, Homo sapiens
tttgcatttataagttggtgga

SEQ ID NO: 8307477 - DNA, 22 bp, Homo sapiens
tttgcatttccagagtagcaga

SEQ ID NO: 8307478 - DNA, 22 bp, Homo sapiens
tttgcatttgtttagaacctga

SEQ ID NO: 8307479 - DNA, 21 bp, Homo sapiens
tttgcattttacatgtgggga

SEQ ID NO: 8307480 - DNA, 22 bp, Homo sapiens
tttgcatttgttcaagtattga

SEQ ID NO: 8307481 - DNA, 22 bp, Homo sapiens
tttgcattgcattaagtattct

SEQ ID NO: 8307482 - DNA, 22 bp, Homo sapiens
tttgcattctagaaaaatttct

SEQ ID NO: 8307483 - DNA, 22 bp, Homo sapiens
tttgcattgcatacaaggaact

SEQ ID NO: 8307484 - DNA, 22 bp, Homo sapiens
tttgcattgcagtggtttacag

SEQ ID NO: 8307485 - DNA, 22 bp, Homo sapiens
tttgcattgtttcaaaagtgaa

SEQ ID NO: 8307486 - DNA, 22 bp, Homo sapiens
tttgcattgtaatatttagttc

SEQ ID NO: 8307487 - DNA, 22 bp, Homo sapiens
tttgcattgcctctgacttatg

SEQ ID NO: 8307488 - DNA, 22 bp, Homo sapiens
tttgggcagtagatgtatcact

SEQ ID NO: 8307489 - DNA, 22 bp, Homo sapiens
tttgggaaacttaggggtcaga

SEQ ID NO: 8307490 - DNA, 22 bp, Homo sapiens
tttgacagtaataaagcacaag

SEQ ID NO: 8307491 - DNA, 22 bp, Homo sapiens
tttgacaggactaacatatggc

SEQ ID NO: 8307492 - DNA, 22 bp, Homo sapiens
tttgacagcttgttacaaagtt

SEQ ID NO: 8307493 - DNA, 22 bp, Homo sapiens
tttgaacaagagcttcacatta

SEQ ID NO: 8307494 - DNA, 22 bp, Homo sapiens
tttgaacatgctgcatgataat

SEQ ID NO: 8307495 - DNA, 22 bp, Homo sapiens
tttctagaggctccaggggagt

SEQ ID NO: 8307496 - DNA, 22 bp, Homo sapiens
tttttgtggtatattgcaacaa

SEQ ID NO: 8307497 - DNA, 22 bp, Homo sapiens
tttttgtcatctatttctggtg

SEQ ID NO: 8307498 - DNA, 22 bp, Homo sapiens
tttttgtctagcgtctctagtt

SEQ ID NO: 8307499 - DNA, 22 bp, Homo sapiens
tttttgttcccagagaatttgt

SEQ ID NO: 8307500 - DNA, 22 bp, Homo sapiens
ttttttacagaatcattaatca

SEQ ID NO: 8307501 - DNA, 22 bp, Homo sapiens
ttttttccaacttaagacttca

SEQ ID NO: 8307502 - DNA, 22 bp, Homo sapiens
ttttttcagcctgtctgtgcca

SEQ ID NO: 8307503 - DNA, 22 bp, Homo sapiens
ttttgtctaagaactttgcaaa

SEQ ID NO: 8307504 - DNA, 22 bp, Homo sapiens
ttttgtctaagaactttgcaaa

SEQ ID NO: 8307505 - DNA, 22 bp, Homo sapiens
ttttcctatatgcaaagaatgc

SEQ ID NO: 8307506 - DNA, 22 bp, Homo sapiens
ttttcctcaggaatgctaagct

SEQ ID NO: 8307507 - DNA, 22 bp, Homo sapiens
ttttcctactgataaacagtta

SEQ ID NO: 8307508 - DNA, 22 bp, Homo sapiens
ttttcctagtaggcctattaga

SEQ ID NO: 8307509 - DNA, 22 bp, Homo sapiens
ttttcctctgcaataaaagcag

SEQ ID NO: 8307510 - DNA, 22 bp, Homo sapiens
ttttcctctgcagagcagttag

SEQ ID NO: 8307511 - DNA, 22 bp, Homo sapiens
ttttcctctgagctttgaataa

SEQ ID NO: 8307512 - DNA, 22 bp, Homo sapiens
ttttcctcaggaatgctaagct

SEQ ID NO: 8307513 - DNA, 22 bp, Homo sapiens
ttttggtcaggttggtctcgaa

SEQ ID NO: 8307514 - DNA, 23 bp, Homo sapiens
ttttaatttggacataagaagat

SEQ ID NO: 8307515 - DNA, 22 bp, Homo sapiens
ttttagaaatactgatttagtg

SEQ ID NO: 8307516 - DNA, 21 bp, Homo sapiens
ttttttcttgcgtgaggcctg

SEQ ID NO: 8307517 - DNA, 22 bp, Homo sapiens
ttgaccatacctccaggcagtt

SEQ ID NO: 8307518 - DNA, 22 bp, Homo sapiens
ttctttttggatagctgatgaa

SEQ ID NO: 8307519 - DNA, 22 bp, Homo sapiens
ttctttttatcttcccataaga

SEQ ID NO: 8307520 - DNA, 22 bp, Homo sapiens
ttgagggtctggatctgctgct

SEQ ID NO: 8307521 - DNA, 22 bp, Homo sapiens
ttgagggtctggatctgctgct

SEQ ID NO: 8307522 - DNA, 19 bp, Homo sapiens
ttgaggggccaggggagat

SEQ ID NO: 8307523 - DNA, 18 bp, Homo sapiens
ttgagggaggggcagagt

SEQ ID NO: 8307524 - DNA, 22 bp, Homo sapiens
ttcttcctcagcagggctgcct

SEQ ID NO: 8307525 - DNA, 22 bp, Homo sapiens
ttctgggacatctggacagttt

SEQ ID NO: 8307526 - DNA, 22 bp, Homo sapiens
ttctggagtattcctggcacct

SEQ ID NO: 8307527 - DNA, 22 bp, Homo sapiens
ttctttctttgtagtcctgaac

SEQ ID NO: 8307528 - DNA, 22 bp, Homo sapiens
ttctttggggaatattctggtt

SEQ ID NO: 8307529 - DNA, 22 bp, Homo sapiens
ttctctttatgtatttagtggg

SEQ ID NO: 8307530 - DNA, 22 bp, Homo sapiens
ttctgaggcactggctctccca

SEQ ID NO: 8307531 - DNA, 20 bp, Homo sapiens
ttctctttgggtccagagaa

SEQ ID NO: 8307532 - DNA, 22 bp, Homo sapiens
ttctggaggccccttccttctc

SEQ ID NO: 8307533 - DNA, 20 bp, Homo sapiens
ttctggaggctacaagtctg

SEQ ID NO: 8307534 - DNA, 22 bp, Homo sapiens
ttctcttattctggatatgcag

SEQ ID NO: 8307535 - DNA, 22 bp, Homo sapiens
ttctcttagctgtaaagtcaat

SEQ ID NO: 8307536 - DNA, 22 bp, Homo sapiens
ttctcttctgttcagtgcccaa

SEQ ID NO: 8307537 - DNA, 17 bp, Homo sapiens
ttctcttcctggatagt

SEQ ID NO: 8307538 - DNA, 17 bp, Homo sapiens
ttctcctctgtgtcctt

SEQ ID NO: 8307539 - DNA, 21 bp, Homo sapiens
ttctcctccaagttgctcctg

SEQ ID NO: 8307540 - DNA, 22 bp, Homo sapiens
ttctccgctaagttctctgcag

SEQ ID NO: 8307541 - DNA, 22 bp, Homo sapiens
ttctcctcactgcagcctttca

SEQ ID NO: 8307542 - DNA, 22 bp, Homo sapiens
ttccttgtttgtagctctggga

SEQ ID NO: 8307543 - DNA, 22 bp, Homo sapiens
ttccctcccccagcctggcagg

SEQ ID NO: 8307544 - DNA, 22 bp, Homo sapiens
ttctaactctgttatgtgtttc

SEQ ID NO: 8307545 - DNA, 22 bp, Homo sapiens
ttcaagtcaaggaaagaggtct

SEQ ID NO: 8307546 - DNA, 22 bp, Homo sapiens
ttcaaggtatggtagctggtca

SEQ ID NO: 8307547 - DNA, 22 bp, Homo sapiens
ttcaatcatttttacatagtcc

SEQ ID NO: 8307548 - DNA, 21 bp, Homo sapiens
ttcaatgaaaacaaagtgagg

SEQ ID NO: 8307549 - DNA, 22 bp, Homo sapiens
ttcaatgagcccaagaacgtga

SEQ ID NO: 8307550 - DNA, 17 bp, Homo sapiens
ttcaatgattaatgcat

SEQ ID NO: 8307551 - DNA, 22 bp, Homo sapiens
ttcaatgatttttagggatcat

SEQ ID NO: 8307552 - DNA, 22 bp, Homo sapiens
ttcaatgaggatagaactggat

SEQ ID NO: 8307553 - DNA, 22 bp, Homo sapiens
ttcaatgagcccggggccatag

SEQ ID NO: 8307554 - DNA, 22 bp, Homo sapiens
ttcaatcattagaatctcaggc

SEQ ID NO: 8307555 - DNA, 22 bp, Homo sapiens
ttcatatatatgcactacgtac

SEQ ID NO: 8307556 - DNA, 22 bp, Homo sapiens
ttcccaggctgtgctaccagag

SEQ ID NO: 8307557 - DNA, 22 bp, Homo sapiens
ttcccagtattaccttcaggaa

SEQ ID NO: 8307558 - DNA, 22 bp, Homo sapiens
ttcccatcgtctccttcacctt

SEQ ID NO: 8307559 - DNA, 17 bp, Homo sapiens
ttcccctgaccaagcct

SEQ ID NO: 8307560 - DNA, 22 bp, Homo sapiens
ttccatgtgagtacactgtgat

SEQ ID NO: 8307561 - DNA, 22 bp, Homo sapiens
ttccattgtttctgtcttcact

SEQ ID NO: 8307562 - DNA, 22 bp, Homo sapiens
ttccatttattcttgtccagat

SEQ ID NO: 8307563 - DNA, 22 bp, Homo sapiens
ttccatatttgtgtggcaaaag

SEQ ID NO: 8307564 - DNA, 22 bp, Homo sapiens
ttccataaaggtgatagtatac

SEQ ID NO: 8307565 - DNA, 22 bp, Homo sapiens
ttccataattaagtggagagaa

SEQ ID NO: 8307566 - DNA, 22 bp, Homo sapiens
ttccatatgtatatagctgtta

SEQ ID NO: 8307567 - DNA, 22 bp, Homo sapiens
ttccataactgaccgaatgcat

SEQ ID NO: 8307568 - DNA, 22 bp, Homo sapiens
ttccataatcaccttattcttt

SEQ ID NO: 8307569 - DNA, 22 bp, Homo sapiens
ttccataataggcttaagtgaa

SEQ ID NO: 8307570 - DNA, 22 bp, Homo sapiens
ttccataataacctgagagaaa

SEQ ID NO: 8307571 - DNA, 18 bp, Homo sapiens
ttccataatgtatgtaac

SEQ ID NO: 8307572 - DNA, 22 bp, Homo sapiens
ttccataatgagattcccagcc

SEQ ID NO: 8307573 - DNA, 22 bp, Homo sapiens
ttatgctagtatagtccttaga

SEQ ID NO: 8307574 - DNA, 22 bp, Homo sapiens
ttatgctaagtgcaacaagcca

SEQ ID NO: 8307575 - DNA, 22 bp, Homo sapiens
ttatgctaaatgaatcaagtca

SEQ ID NO: 8307576 - DNA, 22 bp, Homo sapiens
tcctctgctccatctttactgt

SEQ ID NO: 8307577 - DNA, 21 bp, Homo sapiens
tcctctgctctcataccacaa

SEQ ID NO: 8307578 - DNA, 22 bp, Homo sapiens
tcctctgctgttctggttcttt

SEQ ID NO: 8307579 - DNA, 22 bp, Homo sapiens
tcctctgctggaagggcaagag

SEQ ID NO: 8307580 - DNA, 22 bp, Homo sapiens
tcctctggcccagctgcctctg

SEQ ID NO: 8307581 - DNA, 22 bp, Homo sapiens
tcctctggatataagcctcacc

SEQ ID NO: 8307582 - DNA, 22 bp, Homo sapiens
tcctctggctctttccctagga

SEQ ID NO: 8307583 - DNA, 22 bp, Homo sapiens
ttagtgtcttcttcatcctctg

SEQ ID NO: 8307584 - DNA, 22 bp, Homo sapiens
tcctctcagtgtggttgtggga

SEQ ID NO: 8307585 - DNA, 22 bp, Homo sapiens
tcctctgctcagcattcctcac

SEQ ID NO: 8307586 - DNA, 22 bp, Homo sapiens
tcctctgccccagatgaaattt

SEQ ID NO: 8307587 - DNA, 22 bp, Homo sapiens
tcctctgctccaggctggactt

SEQ ID NO: 8307588 - DNA, 22 bp, Homo sapiens
tcctctgctcagcattcctcac

SEQ ID NO: 8307589 - DNA, 18 bp, Homo sapiens
tcctcctttggccttttc

SEQ ID NO: 8307590 - DNA, 23 bp, Homo sapiens
tcctccttttgcttgtgcttccc

SEQ ID NO: 8307591 - DNA, 22 bp, Homo sapiens
tcctccttcgggactgcttgac

SEQ ID NO: 8307592 - DNA, 21 bp, Homo sapiens
tcctccttcaagtcctggcct

SEQ ID NO: 8307593 - DNA, 19 bp, Homo sapiens
tcctccttacttcctcttg

SEQ ID NO: 8307594 - DNA, 22 bp, Homo sapiens
ttatttatggcactgttggtgg

SEQ ID NO: 8307595 - DNA, 22 bp, Homo sapiens
ttatttaattttctcactcaga

SEQ ID NO: 8307596 - DNA, 22 bp, Homo sapiens
ttattttggtaaatgtttgcct

SEQ ID NO: 8307597 - DNA, 22 bp, Homo sapiens
ttattttcagctaggaaagcca

SEQ ID NO: 8307598 - DNA, 22 bp, Homo sapiens
ttattttctcctcagaaagtgg

SEQ ID NO: 8307599 - DNA, 22 bp, Homo sapiens
ttcaagataataggaatgaaaa

SEQ ID NO: 8307600 - DNA, 17 bp, Homo sapiens
ttcaagatattgaaatg

SEQ ID NO: 8307601 - DNA, 23 bp, Homo sapiens
ttcaagatacggtttccaggctg

SEQ ID NO: 8307602 - DNA, 21 bp, Homo sapiens
ttcaagatatttaaaaggtgg

SEQ ID NO: 8307603 - DNA, 22 bp, Homo sapiens
ttcaagatccagcacaacagtg

SEQ ID NO: 8307604 - DNA, 22 bp, Homo sapiens
ttcaagatcttccaaaggatac

SEQ ID NO: 8307605 - DNA, 22 bp, Homo sapiens
ttcaagatgacccagtcacacg

SEQ ID NO: 8307606 - DNA, 22 bp, Homo sapiens
ttcaagatctgggttttcagct

SEQ ID NO: 8307607 - DNA, 22 bp, Homo sapiens
ttcaagatcgagtttaaagtga

SEQ ID NO: 8307608 - DNA, 22 bp, Homo sapiens
ttcaagatggcaccagtgagtg

SEQ ID NO: 8307609 - DNA, 22 bp, Homo sapiens
ttcaagatgccagggacgcggc

SEQ ID NO: 8307610 - DNA, 22 bp, Homo sapiens
ttcaagatgcacagtggcattc

SEQ ID NO: 8307611 - DNA, 22 bp, Homo sapiens
ttcaagatggccccagtgagcc

SEQ ID NO: 8307612 - DNA, 22 bp, Homo sapiens
ttcaagatggctgcaaatactt

SEQ ID NO: 8307613 - DNA, 22 bp, Homo sapiens
ttcaagatgtcttcacaatagt

SEQ ID NO: 8307614 - DNA, 22 bp, Homo sapiens
tttcatctatttgctttgtgaa

SEQ ID NO: 8307615 - DNA, 22 bp, Homo sapiens
tttcataatgtcacagtcaaaa

SEQ ID NO: 8307616 - DNA, 22 bp, Homo sapiens
tttcatatgggcattggcaata

SEQ ID NO: 8307617 - DNA, 23 bp, Homo sapiens
tttcatatggtgtggatgaagaa

SEQ ID NO: 8307618 - DNA, 22 bp, Homo sapiens
tttctaaatggtggctgcattg

SEQ ID NO: 8307619 - DNA, 22 bp, Homo sapiens
tttccatatttggtctttggga

SEQ ID NO: 8307620 - DNA, 22 bp, Homo sapiens
tttccatattctgcgtctgcca

SEQ ID NO: 8307621 - DNA, 20 bp, Homo sapiens
tttcagtggtttgtgcctag

SEQ ID NO: 8307622 - DNA, 22 bp, Homo sapiens
tttcagtgggtttatttcatgt

SEQ ID NO: 8307623 - DNA, 22 bp, Homo sapiens
tttcagtgtaaggtttccagga

SEQ ID NO: 8307624 - DNA, 22 bp, Homo sapiens
tttcacatcagaggtagattag

SEQ ID NO: 8307625 - DNA, 22 bp, Homo sapiens
tttcacatgtggaatgccaggt

SEQ ID NO: 8307626 - DNA, 18 bp, Homo sapiens
tttcacaacctccagagg

SEQ ID NO: 8307627 - DNA, 19 bp, Homo sapiens
tttcaatggcttagagaaa

SEQ ID NO: 8307628 - DNA, 22 bp, Homo sapiens
tttcacaagtttcaggattctg

SEQ ID NO: 8307629 - DNA, 22 bp, Homo sapiens
tttcacaagtaaagtcctaagt

SEQ ID NO: 8307630 - DNA, 22 bp, Homo sapiens
tttcaatgacacaaaagagaaa

SEQ ID NO: 8307631 - DNA, 22 bp, Homo sapiens
tttcaagcataactgggaagag

SEQ ID NO: 8307632 - DNA, 22 bp, Homo sapiens
tttattgcatacacaaatgtca

SEQ ID NO: 8307633 - DNA, 22 bp, Homo sapiens
tttatgtagttacggactatca

SEQ ID NO: 8307634 - DNA, 21 bp, Homo sapiens
tttatgtacttcatagagtag

SEQ ID NO: 8307635 - DNA, 22 bp, Homo sapiens
tttatctttggatcttcagaaa

SEQ ID NO: 8307636 - DNA, 22 bp, Homo sapiens
tttatgtacatatccacaagga

SEQ ID NO: 8307637 - DNA, 22 bp, Homo sapiens
tttatgtaatttcataggtgtg

SEQ ID NO: 8307638 - DNA, 22 bp, Homo sapiens
tttatctttaggactttgcaga

SEQ ID NO: 8307639 - DNA, 22 bp, Homo sapiens
ttgctcaggcttagagctacta

SEQ ID NO: 8307640 - DNA, 22 bp, Homo sapiens
ttgctattttgagagtcatagt

SEQ ID NO: 8307641 - DNA, 22 bp, Homo sapiens
ttgctcagcactggagccagct

SEQ ID NO: 8307642 - DNA, 22 bp, Homo sapiens
ttgcttcctcgaggccagcgtg

SEQ ID NO: 8307643 - DNA, 22 bp, Homo sapiens
ttgcttccagtccaagtctgtt

SEQ ID NO: 8307644 - DNA, 22 bp, Homo sapiens
ttgccttgattcttctcatgtg

SEQ ID NO: 8307645 - DNA, 22 bp, Homo sapiens
ttgcctgctacggtcttcactg

SEQ ID NO: 8307646 - DNA, 22 bp, Homo sapiens
ttgagtcagtaattccatttct

SEQ ID NO: 8307647 - DNA, 22 bp, Homo sapiens
ttgccaggagctcatctgaggg

SEQ ID NO: 8307648 - DNA, 22 bp, Homo sapiens
ttggaggcaatgggaaggaggc

SEQ ID NO: 8307649 - DNA, 23 bp, Homo sapiens
ttgcttctgtgcaattcagtact

SEQ ID NO: 8307650 - DNA, 22 bp, Homo sapiens
ttggctcaggacccctgtgact

SEQ ID NO: 8307651 - DNA, 22 bp, Homo sapiens
ttggccttaacctctctgtgcc

SEQ ID NO: 8307652 - DNA, 22 bp, Homo sapiens
ttggccttccctacctgggcca

SEQ ID NO: 8307653 - DNA, 22 bp, Homo sapiens
ttggccttgttaaggaggccct

SEQ ID NO: 8307654 - DNA, 22 bp, Homo sapiens
ttggcttctggcagtctggacg

SEQ ID NO: 8307655 - DNA, 22 bp, Homo sapiens
ttggcttccaggatctcagcag

SEQ ID NO: 8307656 - DNA, 22 bp, Homo sapiens
ttggcttctcttaaccctaaag

SEQ ID NO: 8307657 - DNA, 22 bp, Homo sapiens
ttgggctggcagaggtggtctt

SEQ ID NO: 8307658 - DNA, 22 bp, Homo sapiens
ttgggctgaagtagagggcaga

SEQ ID NO: 8307659 - DNA, 22 bp, Homo sapiens
ttgggctgaaccctgcagctga

SEQ ID NO: 8307660 - DNA, 22 bp, Homo sapiens
ttgggctcaggagtttgagacc

SEQ ID NO: 8307661 - DNA, 22 bp, Homo sapiens
ttgtgcatttctctgagtgtgt

SEQ ID NO: 8307662 - DNA, 22 bp, Homo sapiens
ttgtggaaatacagactccaag

SEQ ID NO: 8307663 - DNA, 22 bp, Homo sapiens
ttgtattagctgtaaattttct

SEQ ID NO: 8307664 - DNA, 22 bp, Homo sapiens
aagtttcatgtggaggtagact

SEQ ID NO: 8307665 - DNA, 22 bp, Homo sapiens
aagtttaaggtggaagtggtgg

SEQ ID NO: 8307666 - DNA, 22 bp, Homo sapiens
aagttgtatataccgctttaag

SEQ ID NO: 8307667 - DNA, 22 bp, Homo sapiens
aagttctactgtgggtaaaatg

SEQ ID NO: 8307668 - DNA, 22 bp, Homo sapiens
aagttctaattttgcattcagg

SEQ ID NO: 8307669 - DNA, 22 bp, Homo sapiens
actgccttatatgctgtgtgtg

SEQ ID NO: 8307670 - DNA, 22 bp, Homo sapiens
actgccttgaaagattgttgag

SEQ ID NO: 8307671 - DNA, 22 bp, Homo sapiens
actgccttgtctcttgcctgtt

SEQ ID NO: 8307672 - DNA, 20 bp, Homo sapiens
actgccttggttcagtaggt

SEQ ID NO: 8307673 - DNA, 22 bp, Homo sapiens
aataatttccagccaactggaa

SEQ ID NO: 8307674 - DNA, 22 bp, Homo sapiens
aataattttgagagcctggaaa

SEQ ID NO: 8307675 - DNA, 22 bp, Homo sapiens
aataattttagctcagagttgt

SEQ ID NO: 8307676 - DNA, 22 bp, Homo sapiens
aataatgttgacgatagtctta

SEQ ID NO: 8307677 - DNA, 22 bp, Homo sapiens
aagtcacagctaaatagctaag

SEQ ID NO: 8307678 - DNA, 22 bp, Homo sapiens
aagtcagagcaactgagacatt

SEQ ID NO: 8307679 - DNA, 22 bp, Homo sapiens
aagttatatcatctcattgacg

SEQ ID NO: 8307680 - DNA, 22 bp, Homo sapiens
aagttatgaaatttggacagct

SEQ ID NO: 8307681 - DNA, 22 bp, Homo sapiens
aagttattgcagcaatccaagt

SEQ ID NO: 8307682 - DNA, 22 bp, Homo sapiens
aagttactggcaagggctgcag

SEQ ID NO: 8307683 - DNA, 22 bp, Homo sapiens
actaaggaatatgacaaactca

SEQ ID NO: 8307684 - DNA, 22 bp, Homo sapiens
aagttcaagagtgacatattag

SEQ ID NO: 8307685 - DNA, 22 bp, Homo sapiens
aagttcaagctctgcctaaaat

SEQ ID NO: 8307686 - DNA, 22 bp, Homo sapiens
aagttcaaggaagcctccagtt

SEQ ID NO: 8307687 - DNA, 22 bp, Homo sapiens
aagttcaagatcaaggttccag

SEQ ID NO: 8307688 - DNA, 22 bp, Homo sapiens
aagttatttcctcgtgactgaa

SEQ ID NO: 8307689 - DNA, 22 bp, Homo sapiens
aagttcaaggaagcctccagtt

SEQ ID NO: 8307690 - DNA, 22 bp, Homo sapiens
actcccaggttgcctggcaggc

SEQ ID NO: 8307691 - DNA, 22 bp, Homo sapiens
actcccactccagagtagaagc

SEQ ID NO: 8307692 - DNA, 22 bp, Homo sapiens
actcccaggttgcctggcaggc

SEQ ID NO: 8307693 - DNA, 22 bp, Homo sapiens
aatccaggtggcggaggttgtg

SEQ ID NO: 8307694 - DNA, 22 bp, Homo sapiens
acttgtgtaacacagaaagaac

SEQ ID NO: 8307695 - DNA, 22 bp, Homo sapiens
aatacaatcaaattcactagca

SEQ ID NO: 8307696 - DNA, 22 bp, Homo sapiens
acttcctgctatgagcttctgt

SEQ ID NO: 8307697 - DNA, 22 bp, Homo sapiens
acttcctggcgtagctgacatt

SEQ ID NO: 8307698 - DNA, 18 bp, Homo sapiens
agaaggagctatgggcag

SEQ ID NO: 8307699 - DNA, 18 bp, Homo sapiens
agaaggagctatgggcag

SEQ ID NO: 8307700 - DNA, 22 bp, Homo sapiens
aatgagctagacctgcttcctc

SEQ ID NO: 8307701 - DNA, 22 bp, Homo sapiens
aatgagctagacctgcttcctc

SEQ ID NO: 8307702 - DNA, 22 bp, Homo sapiens
aatgagctgctgctgttccacc

SEQ ID NO: 8307703 - DNA, 22 bp, Homo sapiens
agaaaaatcttggcgcttgtct

SEQ ID NO: 8307704 - DNA, 22 bp, Homo sapiens
aatgaacacagccctctacttt

SEQ ID NO: 8307705 - DNA, 22 bp, Homo sapiens
aatgaacacagccctctacttt

SEQ ID NO: 8307706 - DNA, 22 bp, Homo sapiens
agaaaacattacataggtgtgt

SEQ ID NO: 8307707 - DNA, 22 bp, Homo sapiens
aatgaacatcaaatgcctacca

SEQ ID NO: 8307708 - DNA, 22 bp, Homo sapiens
aatgaacaggtgaatgtcagat

SEQ ID NO: 8307709 - DNA, 22 bp, Homo sapiens
aagggctgaaagaccttgggca

SEQ ID NO: 8307710 - DNA, 22 bp, Homo sapiens
aagggctgaatgaagggttgaa

SEQ ID NO: 8307711 - DNA, 23 bp, Homo sapiens
aagtaacagggataatagcagtt

SEQ ID NO: 8307712 - DNA, 22 bp, Homo sapiens
accatgggtcagccacctcagc

SEQ ID NO: 8307713 - DNA, 22 bp, Homo sapiens
aaggtgggtggatcacgaggtc

SEQ ID NO: 8307714 - DNA, 22 bp, Homo sapiens
accatcagtcattgtcagtggg

SEQ ID NO: 8307715 - DNA, 22 bp, Homo sapiens
aagtcacactagacaactgagg

SEQ ID NO: 8307716 - DNA, 22 bp, Homo sapiens
acatgtgtatagcctgtataga

SEQ ID NO: 8307717 - DNA, 18 bp, Homo sapiens
aaggcttcaaagagtaga

SEQ ID NO: 8307718 - DNA, 22 bp, Homo sapiens
aaggctgcctctgccagaggag

SEQ ID NO: 8307719 - DNA, 22 bp, Homo sapiens
aaggctgattagactgatagct

SEQ ID NO: 8307720 - DNA, 22 bp, Homo sapiens
aaggctgagtaaaacagagaac

SEQ ID NO: 8307721 - DNA, 22 bp, Homo sapiens
aaggctgagggctgtacctggc

SEQ ID NO: 8307722 - DNA, 22 bp, Homo sapiens
aaggctcttggagtgaatgcag

SEQ ID NO: 8307723 - DNA, 22 bp, Homo sapiens
aaggctgaggagggcctgcagg

SEQ ID NO: 8307724 - DNA, 22 bp, Homo sapiens
aagggaaatcatatggtgcagt

SEQ ID NO: 8307725 - DNA, 22 bp, Homo sapiens
aagggactttgtcagctttcca

SEQ ID NO: 8307726 - DNA, 22 bp, Homo sapiens
aagggccataacttgcagtgtt

SEQ ID NO: 8307727 - DNA, 22 bp, Homo sapiens
aagggcctcctggggagcctgg

SEQ ID NO: 8307728 - DNA, 22 bp, Homo sapiens
acagtacctgctctcaagcaaa

SEQ ID NO: 8307729 - DNA, 22 bp, Homo sapiens
aaggaaagacatataaatgact

SEQ ID NO: 8307730 - DNA, 22 bp, Homo sapiens
aagctgcagaccccctgtctca

SEQ ID NO: 8307731 - DNA, 22 bp, Homo sapiens
aagctgccacacggtgagtact

SEQ ID NO: 8307732 - DNA, 22 bp, Homo sapiens
aagctgccaccagcccagggca

SEQ ID NO: 8307733 - DNA, 22 bp, Homo sapiens
aagctgccaatggtaagctgct

SEQ ID NO: 8307734 - DNA, 22 bp, Homo sapiens
aagctgccagattcagtctgct

SEQ ID NO: 8307735 - DNA, 22 bp, Homo sapiens
aagctgccagctgagctgaggc

SEQ ID NO: 8307736 - DNA, 23 bp, Homo sapiens
aagctgccagtctgaagcctggg

SEQ ID NO: 8307737 - DNA, 22 bp, Homo sapiens
aagctgccatagaacgagaggt

SEQ ID NO: 8307738 - DNA, 22 bp, Homo sapiens
aagctgcccaagactgaagcat

SEQ ID NO: 8307739 - DNA, 22 bp, Homo sapiens
aagccaggtgtttaggccagcg

SEQ ID NO: 8307740 - DNA, 22 bp, Homo sapiens
aagccaggtgttgtggtaagag

SEQ ID NO: 8307741 - DNA, 22 bp, Homo sapiens
aagccaggcatgcttggacagt

SEQ ID NO: 8307742 - DNA, 22 bp, Homo sapiens
aagccagggattcctgagggag

SEQ ID NO: 8307743 - DNA, 22 bp, Homo sapiens
aagccaggctgcacttgctggg

SEQ ID NO: 8307744 - DNA, 22 bp, Homo sapiens
aagccagggtcaggggcctcct

SEQ ID NO: 8307745 - DNA, 22 bp, Homo sapiens
aagccaggggctgcttaggaga

SEQ ID NO: 8307746 - DNA, 22 bp, Homo sapiens
aaggcacttttcctgagatgat

SEQ ID NO: 8307747 - DNA, 22 bp, Homo sapiens
aaggcacttttctaaagacctt

SEQ ID NO: 8307748 - DNA, 21 bp, Homo sapiens
aaggcagaagcatggaatgag

SEQ ID NO: 8307749 - DNA, 22 bp, Homo sapiens
aaggcacttgcccagagctgca

SEQ ID NO: 8307750 - DNA, 22 bp, Homo sapiens
aaggcactacgctgctggggcg

SEQ ID NO: 8307751 - DNA, 22 bp, Homo sapiens
aaggcagcctctgccagccggg

SEQ ID NO: 8307752 - DNA, 22 bp, Homo sapiens
aaggcagccgtgtgactgcatg

SEQ ID NO: 8307753 - DNA, 22 bp, Homo sapiens
aaggcaggatgggaaaagattt

SEQ ID NO: 8307754 - DNA, 22 bp, Homo sapiens
aaggcaggatgcggacccatct

SEQ ID NO: 8307755 - DNA, 20 bp, Homo sapiens
aatttactcacagaatgaat

SEQ ID NO: 8307756 - DNA, 22 bp, Homo sapiens
aatttagaattcgctagctaat

SEQ ID NO: 8307757 - DNA, 22 bp, Homo sapiens
agagctgggacttggactcaat

SEQ ID NO: 8307758 - DNA, 22 bp, Homo sapiens
aatttagattgataaacatgga

SEQ ID NO: 8307759 - DNA, 22 bp, Homo sapiens
aattagtattgcgattcattag

SEQ ID NO: 8307760 - DNA, 22 bp, Homo sapiens
aatgttgtttttctgcatgtct

SEQ ID NO: 8307761 - DNA, 22 bp, Homo sapiens
agacagagatactatgttgtca

SEQ ID NO: 8307762 - DNA, 19 bp, Homo sapiens
agacagagctcagtgggtt

SEQ ID NO: 8307763 - DNA, 23 bp, Homo sapiens
agacagaggctgaggctggccgc

SEQ ID NO: 8307764 - DNA, 21 bp, Homo sapiens
agacagagtgcagtctacata

SEQ ID NO: 8307765 - DNA, 22 bp, Homo sapiens
agaagtaggcagggctgtatca

SEQ ID NO: 8307766 - DNA, 22 bp, Homo sapiens
aatgtctgcctgaactttatat

SEQ ID NO: 8307767 - DNA, 22 bp, Homo sapiens
aatgtctgagtctctgtatccc

SEQ ID NO: 8307768 - DNA, 22 bp, Homo sapiens
agacagggtcttgatcagagct

SEQ ID NO: 8307769 - DNA, 22 bp, Homo sapiens
acaaatgcaagttttatgtcaa

SEQ ID NO: 8307770 - DNA, 20 bp, Homo sapiens
acaaatgcattctgtgacat

SEQ ID NO: 8307771 - DNA, 22 bp, Homo sapiens
acaaatgcagcataaagtgaac

SEQ ID NO: 8307772 - DNA, 22 bp, Homo sapiens
acaaatgccatatataaattct

SEQ ID NO: 8307773 - DNA, 22 bp, Homo sapiens
acaaatgcttagttcaccaaaa

SEQ ID NO: 8307774 - DNA, 23 bp, Homo sapiens
acaaatgcccatacatctagttc

SEQ ID NO: 8307775 - DNA, 22 bp, Homo sapiens
acaaactacctacagatgttca

SEQ ID NO: 8307776 - DNA, 22 bp, Homo sapiens
acaaaattacctagttattttc

SEQ ID NO: 8307777 - DNA, 22 bp, Homo sapiens
agagctgggtggacttgtagtt

SEQ ID NO: 8307778 - DNA, 22 bp, Homo sapiens
agagctgggtgaagtgccatca

SEQ ID NO: 8307779 - DNA, 22 bp, Homo sapiens
agagctggggccagagtcaagg

SEQ ID NO: 8307780 - DNA, 22 bp, Homo sapiens
agaggccaggtccagagtttgt

SEQ ID NO: 8307781 - DNA, 22 bp, Homo sapiens
agaggccagtggctgtgctgtc

SEQ ID NO: 8307782 - DNA, 22 bp, Homo sapiens
agaggccatctgctctgtgggg

SEQ ID NO: 8307783 - DNA, 22 bp, Homo sapiens
acaattctctcatatcttatta

SEQ ID NO: 8307784 - DNA, 22 bp, Homo sapiens
agatggggctcagtgtggaggc

SEQ ID NO: 8307785 - DNA, 22 bp, Homo sapiens
agatggggtttcatcatgttgg

SEQ ID NO: 8307786 - DNA, 22 bp, Homo sapiens
agatgggtaactggagtctgct

SEQ ID NO: 8307787 - DNA, 22 bp, Homo sapiens
agcaccatcagatgcaatatct

SEQ ID NO: 8307788 - DNA, 22 bp, Homo sapiens
agcacaggtacggagatgctac

SEQ ID NO: 8307789 - DNA, 22 bp, Homo sapiens
agcaagctacctagatagtcta

SEQ ID NO: 8307790 - DNA, 22 bp, Homo sapiens
acaaatgtggacatggataatg

SEQ ID NO: 8307791 - DNA, 18 bp, Homo sapiens
acaaatgtagtgtcttaa

SEQ ID NO: 8307792 - DNA, 19 bp, Homo sapiens
acaagggcaggcaaggtga

SEQ ID NO: 8307793 - DNA, 22 bp, Homo sapiens
agatggggcagaatggagccat

SEQ ID NO: 8307794 - DNA, 19 bp, Homo sapiens
agatggggaagagtgtgag

SEQ ID NO: 8307795 - DNA, 22 bp, Homo sapiens
agccattgaatttagtgccttt

SEQ ID NO: 8307796 - DNA, 22 bp, Homo sapiens
agccattgagttttatgtgcta

SEQ ID NO: 8307797 - DNA, 22 bp, Homo sapiens
agccatggcgccactagaggga

SEQ ID NO: 8307798 - DNA, 22 bp, Homo sapiens
agccatgcaccttactcttgct

SEQ ID NO: 8307799 - DNA, 22 bp, Homo sapiens
agccacagtctgatgcctgaga

SEQ ID NO: 8307800 - DNA, 22 bp, Homo sapiens
agccacagtcaacctgtccata

SEQ ID NO: 8307801 - DNA, 22 bp, Homo sapiens
acagagcactgccctgtgccgc

SEQ ID NO: 8307802 - DNA, 23 bp, Homo sapiens
acagaggtccaaacagtataagc

SEQ ID NO: 8307803 - DNA, 22 bp, Homo sapiens
agcccctctgtggctctgcctc

SEQ ID NO: 8307804 - DNA, 22 bp, Homo sapiens
agcccctgggagtagctgctgc

SEQ ID NO: 8307805 - DNA, 22 bp, Homo sapiens
acagagcatataaagtgctttg

SEQ ID NO: 8307806 - DNA, 22 bp, Homo sapiens
acagagcatgctcagtgtgtga

SEQ ID NO: 8307807 - DNA, 22 bp, Homo sapiens
acagagcagttctggagctggc

SEQ ID NO: 8307808 - DNA, 22 bp, Homo sapiens
acagagcatttgggacagagag

SEQ ID NO: 8307809 - DNA, 17 bp, Homo sapiens
agcccctcagcgtcacc

SEQ ID NO: 8307810 - DNA, 22 bp, Homo sapiens
agctctccacacataggactag

SEQ ID NO: 8307811 - DNA, 22 bp, Homo sapiens
agctctccacacataggactag

SEQ ID NO: 8307812 - DNA, 22 bp, Homo sapiens
agctctcaagataagaaagaac

SEQ ID NO: 8307813 - DNA, 22 bp, Homo sapiens
acagcaggatttggcgatgttg

SEQ ID NO: 8307814 - DNA, 22 bp, Homo sapiens
acagcagctaaaggtgtctcct

SEQ ID NO: 8307815 - DNA, 22 bp, Homo sapiens
acagcaagccagcttgtcactg

SEQ ID NO: 8307816 - DNA, 23 bp, Homo sapiens
acagcaagaggaccagatgtgag

SEQ ID NO: 8307817 - DNA, 21 bp, Homo sapiens
acagcaagccttcctttcagg

SEQ ID NO: 8307818 - DNA, 22 bp, Homo sapiens
agcctgccttgggctgcttgag

SEQ ID NO: 8307819 - DNA, 22 bp, Homo sapiens
acagattgatcttgagaattat

SEQ ID NO: 8307820 - DNA, 22 bp, Homo sapiens
agcctgagtgcttaggactgtt

SEQ ID NO: 8307821 - DNA, 22 bp, Homo sapiens
agcctgcaggatgggcagcacc

SEQ ID NO: 8307822 - DNA, 20 bp, Homo sapiens
agcctgccagctggcccaga

SEQ ID NO: 8307823 - DNA, 22 bp, Homo sapiens
agccacagggggtgagggacaa

SEQ ID NO: 8307824 - DNA, 22 bp, Homo sapiens
acagaaattgggcaaatggaag

SEQ ID NO: 8307825 - DNA, 22 bp, Homo sapiens
acagaaattagcagtgagttta

SEQ ID NO: 8307826 - DNA, 19 bp, Homo sapiens
acagaaattagttattttc

SEQ ID NO: 8307827 - DNA, 19 bp, Homo sapiens
acagaaatgtaagtgagac

SEQ ID NO: 8307828 - DNA, 22 bp, Homo sapiens
agcagtggctggatggtgtgct

SEQ ID NO: 8307829 - DNA, 22 bp, Homo sapiens
agcagtgggggagtgttagttt

SEQ ID NO: 8307830 - DNA, 22 bp, Homo sapiens
agcagtgggtgacagagctgag

SEQ ID NO: 8307831 - DNA, 22 bp, Homo sapiens
agcaggaaagaaaaatctgtgt

SEQ ID NO: 8307832 - DNA, 23 bp, Homo sapiens
agcagggccagaatacttgctgt

SEQ ID NO: 8307833 - DNA, 22 bp, Homo sapiens
agcagggccaacagtaaacacc

SEQ ID NO: 8307834 - DNA, 22 bp, Homo sapiens
acaattctgggtatttatatag

SEQ ID NO: 8307835 - DNA, 22 bp, Homo sapiens
agcacctgctatgtgtcaggga

SEQ ID NO: 8307836 - DNA, 22 bp, Homo sapiens
agcacctgcacagtggaggaaa

SEQ ID NO: 8307837 - DNA, 22 bp, Homo sapiens
acacaggaagtcagcactgatg

SEQ ID NO: 8307838 - DNA, 22 bp, Homo sapiens
acacaggagatatgtaatggct

SEQ ID NO: 8307839 - DNA, 22 bp, Homo sapiens
aagatttagggccagtttacat

SEQ ID NO: 8307840 - DNA, 22 bp, Homo sapiens
aagatttactagcataatagct

SEQ ID NO: 8307841 - DNA, 17 bp, Homo sapiens
aagatttcattagctga

SEQ ID NO: 8307842 - DNA, 22 bp, Homo sapiens
aagatttcagagtttgggggaa

SEQ ID NO: 8307843 - DNA, 22 bp, Homo sapiens
aagatttcctggatgtaattcc

SEQ ID NO: 8307844 - DNA, 22 bp, Homo sapiens
aagatttccatttctagctcat

SEQ ID NO: 8307845 - DNA, 22 bp, Homo sapiens
aagatttccttcagtagagcta

SEQ ID NO: 8307846 - DNA, 22 bp, Homo sapiens
aagatttctctcctggaaagca

SEQ ID NO: 8307847 - DNA, 22 bp, Homo sapiens
aagatttctgcttttggaggca

SEQ ID NO: 8307848 - DNA, 22 bp, Homo sapiens
aagatttctgctcctgagagaa

SEQ ID NO: 8307849 - DNA, 22 bp, Homo sapiens
aagatttcttacttattgatgc

SEQ ID NO: 8307850 - DNA, 22 bp, Homo sapiens
acactgctcacttcttcccttg

SEQ ID NO: 8307851 - DNA, 22 bp, Homo sapiens
aagcacagaaaaggagcatgga

SEQ ID NO: 8307852 - DNA, 22 bp, Homo sapiens
acacagtaccccaaggctgggc

SEQ ID NO: 8307853 - DNA, 22 bp, Homo sapiens
acacagggtctagagttaggcc

SEQ ID NO: 8307854 - DNA, 22 bp, Homo sapiens
acacagggggcattctaggagt

SEQ ID NO: 8307855 - DNA, 22 bp, Homo sapiens
acacaggggctcggctgggtgc

SEQ ID NO: 8307856 - DNA, 22 bp, Homo sapiens
acacagggctgcgcctgacccc

SEQ ID NO: 8307857 - DNA, 22 bp, Homo sapiens
acacaggggaaagtggagctga

SEQ ID NO: 8307858 - DNA, 22 bp, Homo sapiens
aagatttaccactttattcaag

SEQ ID NO: 8307859 - DNA, 22 bp, Homo sapiens
acagaattgaaagtataatctg

SEQ ID NO: 8307860 - DNA, 22 bp, Homo sapiens
acagaattatcaggaaatgtta

SEQ ID NO: 8307861 - DNA, 22 bp, Homo sapiens
acagaattctctctgcagaggc

SEQ ID NO: 8307862 - DNA, 22 bp, Homo sapiens
acagaattctagtatgtggctt

SEQ ID NO: 8307863 - DNA, 22 bp, Homo sapiens
acagaattgatggaaatctcag

SEQ ID NO: 8307864 - DNA, 18 bp, Homo sapiens
acagacaaaatggaaatg

SEQ ID NO: 8307865 - DNA, 22 bp, Homo sapiens
acagaggtgttccagacctagg

SEQ ID NO: 8307866 - DNA, 22 bp, Homo sapiens
acagaggtgtgtgtaggacagt

SEQ ID NO: 8307867 - DNA, 22 bp, Homo sapiens
aagcagctgatttcacagctca

SEQ ID NO: 8307868 - DNA, 22 bp, Homo sapiens
aagcagccacctcatctccact

SEQ ID NO: 8307869 - DNA, 22 bp, Homo sapiens
aagcagccactggccagttata

SEQ ID NO: 8307870 - DNA, 22 bp, Homo sapiens
aagcagccagccatcatgcccg

SEQ ID NO: 8307871 - DNA, 22 bp, Homo sapiens
aagcagcctggacttgggctgg

SEQ ID NO: 8307872 - DNA, 22 bp, Homo sapiens
aagcagcctggcatgatgcttt

SEQ ID NO: 8307873 - DNA, 19 bp, Homo sapiens
aagcagccctggcaagagc

SEQ ID NO: 8307874 - DNA, 22 bp, Homo sapiens
aagcagcctcatttgtggtaag

SEQ ID NO: 8307875 - DNA, 17 bp, Homo sapiens
acagaggttatacagac

SEQ ID NO: 8307876 - DNA, 22 bp, Homo sapiens
acagagtacattcagagactat

SEQ ID NO: 8307877 - DNA, 22 bp, Homo sapiens
acagagtagctcaagaagattg

SEQ ID NO: 8307878 - DNA, 22 bp, Homo sapiens
acagagtattggaaaggcagtg

SEQ ID NO: 8307879 - DNA, 22 bp, Homo sapiens
acagagtatctatcaggagtat

SEQ ID NO: 8307880 - DNA, 22 bp, Homo sapiens
acagagtaggtgctgtcgactg

SEQ ID NO: 8307881 - DNA, 21 bp, Homo sapiens
acagagtagttgaaacagaga

SEQ ID NO: 8307882 - DNA, 22 bp, Homo sapiens
acagcagctaacccctgggcca

SEQ ID NO: 8307883 - DNA, 22 bp, Homo sapiens
aagccaggaagagagccttcac

SEQ ID NO: 8307884 - DNA, 22 bp, Homo sapiens
acagcagctgggttcccaccat

SEQ ID NO: 8307885 - DNA, 22 bp, Homo sapiens
acaaggaggtctggggggccct

SEQ ID NO: 8307886 - DNA, 22 bp, Homo sapiens
aagacattactggaatctgact

SEQ ID NO: 8307887 - DNA, 22 bp, Homo sapiens
aagagagaactcccttcgccag

SEQ ID NO: 8307888 - DNA, 22 bp, Homo sapiens
acaaagctagagaagagaattg

SEQ ID NO: 8307889 - DNA, 22 bp, Homo sapiens
aagagctggatggaatctggga

SEQ ID NO: 8307890 - DNA, 21 bp, Homo sapiens
aagagctggatcaaggataag

SEQ ID NO: 8307891 - DNA, 21 bp, Homo sapiens
aagagctggatcaaggataag

SEQ ID NO: 8307892 - DNA, 22 bp, Homo sapiens
aagagctggatgaagaaatcaa

SEQ ID NO: 8307893 - DNA, 22 bp, Homo sapiens
aagagctggattgtgctgcaga

SEQ ID NO: 8307894 - DNA, 22 bp, Homo sapiens
aagagctggcccaatctgagca

SEQ ID NO: 8307895 - DNA, 22 bp, Homo sapiens
aagagctggagctgctacagga

SEQ ID NO: 8307896 - DNA, 22 bp, Homo sapiens
aagagctggaagtgaagataac

SEQ ID NO: 8307897 - DNA, 22 bp, Homo sapiens
aagagctgcccaaggtgaacag

SEQ ID NO: 8307898 - DNA, 22 bp, Homo sapiens
aagagctggaagtgaagataac

SEQ ID NO: 8307899 - DNA, 22 bp, Homo sapiens
aagagctggagtttgcagccct

SEQ ID NO: 8307900 - DNA, 22 bp, Homo sapiens
aagaggaaatgattgactatat

SEQ ID NO: 8307901 - DNA, 22 bp, Homo sapiens
aagaggaactgggggctgagtc

SEQ ID NO: 8307902 - DNA, 21 bp, Homo sapiens
aagagctgtcaggaaggctgc

SEQ ID NO: 8307903 - DNA, 22 bp, Homo sapiens
aagagctgtatgccatatgatt

SEQ ID NO: 8307904 - DNA, 22 bp, Homo sapiens
aagagctggtcacaggtccatt

SEQ ID NO: 8307905 - DNA, 22 bp, Homo sapiens
aagagctggctcttgcagcagc

SEQ ID NO: 8307906 - DNA, 22 bp, Homo sapiens
aagagctggctcttgcagcagc

SEQ ID NO: 8307907 - DNA, 22 bp, Homo sapiens
aagagctggcccaatctgagca

SEQ ID NO: 8307908 - DNA, 22 bp, Homo sapiens
acaaggctgaacagtgaagccg

SEQ ID NO: 8307909 - DNA, 22 bp, Homo sapiens
aagagctgcccaaggtgaacag

SEQ ID NO: 8307910 - DNA, 22 bp, Homo sapiens
aagagctgcatctaagccatga

SEQ ID NO: 8307911 - DNA, 22 bp, Homo sapiens
aagagctgcatctaagccatga

SEQ ID NO: 8307912 - DNA, 22 bp, Homo sapiens
aagagctgattaagtcatgagg

SEQ ID NO: 8307913 - DNA, 20 bp, Homo sapiens
aagagctgactcacagtggt

SEQ ID NO: 8307914 - DNA, 22 bp, Homo sapiens
aagaaatgcagaaatgtgctgg

SEQ ID NO: 8307915 - DNA, 22 bp, Homo sapiens
aagaaatattgggccttataaa

SEQ ID NO: 8307916 - DNA, 22 bp, Homo sapiens
aagaaatcagaaaagcattcgt

SEQ ID NO: 8307917 - DNA, 23 bp, Homo sapiens
aagaataaatgacattaaaggtg

SEQ ID NO: 8307918 - DNA, 22 bp, Homo sapiens
aattgtgctatgattatgaaag

SEQ ID NO: 8307919 - DNA, 22 bp, Homo sapiens
aaatgtgtcatattcaaagtca

SEQ ID NO: 8307920 - DNA, 22 bp, Homo sapiens
aaatgtgtgcacaaagacagct

SEQ ID NO: 8307921 - DNA, 22 bp, Homo sapiens
aaatgtgtgtatgtacatatat

SEQ ID NO: 8307922 - DNA, 21 bp, Homo sapiens
aaatgtgttccataatgcttt

SEQ ID NO: 8307923 - DNA, 22 bp, Homo sapiens
aaatgtgtcagtttcattctct

SEQ ID NO: 8307924 - DNA, 22 bp, Homo sapiens
aaatgtgtatatgaaacatgat

SEQ ID NO: 8307925 - DNA, 22 bp, Homo sapiens
aaatgtgcttgtgatcagctgt

SEQ ID NO: 8307926 - DNA, 22 bp, Homo sapiens
aaatgtctatctggcatattcc

SEQ ID NO: 8307927 - DNA, 22 bp, Homo sapiens
aagctgaggcccatggcaaggt

SEQ ID NO: 8307928 - DNA, 22 bp, Homo sapiens
aaatgtgtttcgaaaactggtg

SEQ ID NO: 8307929 - DNA, 22 bp, Homo sapiens
aaatgtgtttagatggtttatt

SEQ ID NO: 8307930 - DNA, 22 bp, Homo sapiens
aaatgtgttcctttgctacaga

SEQ ID NO: 8307931 - DNA, 22 bp, Homo sapiens
aaatgtgtttgataggaatatt

SEQ ID NO: 8307932 - DNA, 22 bp, Homo sapiens
aaatgtgtttctttgtgaatgg

SEQ ID NO: 8307933 - DNA, 22 bp, Homo sapiens
aaattcccatagtctgcttcta

SEQ ID NO: 8307934 - DNA, 22 bp, Homo sapiens
aaattgcaaaagtacttttagg

SEQ ID NO: 8307935 - DNA, 22 bp, Homo sapiens
aaattctttcatggctaataag

SEQ ID NO: 8307936 - DNA, 21 bp, Homo sapiens
aacaaagggatgctcatcttt

SEQ ID NO: 8307937 - DNA, 21 bp, Homo sapiens
aacaaagggatgctcatcttt

SEQ ID NO: 8307938 - DNA, 22 bp, Homo sapiens
aagtcattggtagcttgatagg

SEQ ID NO: 8307939 - DNA, 22 bp, Homo sapiens
aacagcatgctgggtaacattg

SEQ ID NO: 8307940 - DNA, 22 bp, Homo sapiens
aagtcattatctcttctaatct

SEQ ID NO: 8307941 - DNA, 22 bp, Homo sapiens
aacagcagggggacctgctggt

SEQ ID NO: 8307942 - DNA, 23 bp, Homo sapiens
aaggtcacagaacttagcaagcc

SEQ ID NO: 8307943 - DNA, 22 bp, Homo sapiens
aaggtcattgttgcatgttctc

SEQ ID NO: 8307944 - DNA, 22 bp, Homo sapiens
aaggtcatttaacaatttatga

SEQ ID NO: 8307945 - DNA, 22 bp, Homo sapiens
aaggtcattggttctgaattct

SEQ ID NO: 8307946 - DNA, 22 bp, Homo sapiens
aaggtcatggcaaattactttt

SEQ ID NO: 8307947 - DNA, 22 bp, Homo sapiens
aaggtcattttttcctctgttg

SEQ ID NO: 8307948 - DNA, 22 bp, Homo sapiens
aacaaatgacctgatttcttcc

SEQ ID NO: 8307949 - DNA, 22 bp, Homo sapiens
aacaaatggaacacaaatcttt

SEQ ID NO: 8307950 - DNA, 22 bp, Homo sapiens
aacaaatggggccttgtatgaa

SEQ ID NO: 8307951 - DNA, 22 bp, Homo sapiens
aacaaatgattgttggttggag

SEQ ID NO: 8307952 - DNA, 22 bp, Homo sapiens
aacaaatgataccagttctcaa

SEQ ID NO: 8307953 - DNA, 22 bp, Homo sapiens
aacaaatgtaaaatgcagatgc

SEQ ID NO: 8307954 - DNA, 22 bp, Homo sapiens
aacaggagagtaaatatatgat

SEQ ID NO: 8307955 - DNA, 20 bp, Homo sapiens
aacagggggctgcagagggc

SEQ ID NO: 8307956 - DNA, 22 bp, Homo sapiens
aaccaccattctctcctcttcc

SEQ ID NO: 8307957 - DNA, 22 bp, Homo sapiens
aatagtgttgttcactcaggag

SEQ ID NO: 8307958 - DNA, 21 bp, Homo sapiens
aacatttcaggatccaaattg

SEQ ID NO: 8307959 - DNA, 21 bp, Homo sapiens
aactgctggtcttttctgtct

SEQ ID NO: 8307960 - DNA, 22 bp, Homo sapiens
aactgcatttgcataagtccat

SEQ ID NO: 8307961 - DNA, 22 bp, Homo sapiens
aactgcattcagaaagctcact

SEQ ID NO: 8307962 - DNA, 22 bp, Homo sapiens
aaaggtttgcatggaatttacc

SEQ ID NO: 8307963 - DNA, 22 bp, Homo sapiens
aaaggttagttcttagaagtgc

SEQ ID NO: 8307964 - DNA, 22 bp, Homo sapiens
aaagtgtagagactttggaacc

SEQ ID NO: 8307965 - DNA, 22 bp, Homo sapiens
aaagtgtactatgtcatgaaca

SEQ ID NO: 8307966 - DNA, 22 bp, Homo sapiens
aaagtgtaaggaatttaagtaa

SEQ ID NO: 8307967 - DNA, 20 bp, Homo sapiens
aaagtgtaagcatataatta

SEQ ID NO: 8307968 - DNA, 22 bp, Homo sapiens
aaagtgtaaaagcatgttaggg

SEQ ID NO: 8307969 - DNA, 22 bp, Homo sapiens
aaagtggtcaccttctcatttc

SEQ ID NO: 8307970 - DNA, 21 bp, Homo sapiens
aaagtggtaaggattattttg

SEQ ID NO: 8307971 - DNA, 22 bp, Homo sapiens
aaattgtgagctatagatctag

SEQ ID NO: 8307972 - DNA, 22 bp, Homo sapiens
aaattgtgctcacactgatatt

SEQ ID NO: 8307973 - DNA, 22 bp, Homo sapiens
aacagcaatagcactattcatt

SEQ ID NO: 8307974 - DNA, 22 bp, Homo sapiens
aaagctgctgccaatcaggctt

SEQ ID NO: 8307975 - DNA, 22 bp, Homo sapiens
aaataattgagttggtcaatat

SEQ ID NO: 8307976 - DNA, 22 bp, Homo sapiens
aaataattatagcgagtctatc

SEQ ID NO: 8307977 - DNA, 22 bp, Homo sapiens
aaatcagtaaatgttcattaac

SEQ ID NO: 8307978 - DNA, 22 bp, Homo sapiens
aaagtgttgggattacaggtgt

SEQ ID NO: 8307979 - DNA, 22 bp, Homo sapiens
aaagtgtggagattgaactaaa

SEQ ID NO: 8307980 - DNA, 23 bp, Homo sapiens
aaagtgtagccaggttaagaacc

SEQ ID NO: 8307981 - DNA, 22 bp, Homo sapiens
aaagtgttgggaagaaagtgca

SEQ ID NO: 8307982 - DNA, 22 bp, Homo sapiens
aaagtgttgatatgtgacatcc

SEQ ID NO: 8307983 - DNA, 22 bp, Homo sapiens
aaataatgttaggcctttgctc

SEQ ID NO: 8307984 - DNA, 22 bp, Homo sapiens
aaatctaggctcatcctggtcc

SEQ ID NO: 8307985 - DNA, 22 bp, Homo sapiens
aaatgcatatcaaagacttgaa

SEQ ID NO: 8307986 - DNA, 22 bp, Homo sapiens
aaatgcatcagctcataagaga

SEQ ID NO: 8307987 - DNA, 23 bp, Homo sapiens
aaatgcagggtcgcaggttacag

SEQ ID NO: 8307988 - DNA, 22 bp, Homo sapiens
aaatgcaggtagtatttatttt

SEQ ID NO: 8307989 - DNA, 22 bp, Homo sapiens
aaatgcaggttcttgagccaag

SEQ ID NO: 8307990 - DNA, 22 bp, Homo sapiens
aaatgcaggaaattatgctttt

SEQ ID NO: 8307991 - DNA, 22 bp, Homo sapiens
aaatgcacaggttttaaatcct

SEQ ID NO: 8307992 - DNA, 22 bp, Homo sapiens
aaatgtagacctatagggacct

SEQ ID NO: 8307993 - DNA, 18 bp, Homo sapiens
aaatgtactgtccatggc

SEQ ID NO: 8307994 - DNA, 22 bp, Homo sapiens
aaatgtagtatgttgcatgtat

SEQ ID NO: 8307995 - DNA, 22 bp, Homo sapiens
aaatgtattgcataggatattt

SEQ ID NO: 8307996 - DNA, 22 bp, Homo sapiens
aaatgtatcctacttcctgagt

SEQ ID NO: 8307997 - DNA, 22 bp, Homo sapiens
aagcatctctatgtggagagtg

SEQ ID NO: 8307998 - DNA, 22 bp, Homo sapiens
aaaggtgacactctgccagctg

SEQ ID NO: 8307999 - DNA, 22 bp, Homo sapiens
aaaggtgactgcagcagctatt

SEQ ID NO: 8308000 - DNA, 21 bp, Homo sapiens
aaagttcatgctttaatattc

SEQ ID NO: 8308001 - DNA, 22 bp, Homo sapiens
aaagttcatggtgttatagaaa

SEQ ID NO: 8308002 - DNA, 22 bp, Homo sapiens
aaagttcagtgccttctataca

SEQ ID NO: 8308003 - DNA, 22 bp, Homo sapiens
aaagttcagattagactcaaga

SEQ ID NO: 8308004 - DNA, 22 bp, Homo sapiens
aaagttagaatgatatcaacga

SEQ ID NO: 8308005 - DNA, 22 bp, Homo sapiens
aaagttactatcacaatgaaat

SEQ ID NO: 8308006 - DNA, 22 bp, Homo sapiens
aaaggtagtacttctagaaggg

SEQ ID NO: 8308007 - DNA, 22 bp, Homo sapiens
aaaggtcaaaatcgtgacattg

SEQ ID NO: 8308008 - DNA, 22 bp, Homo sapiens
aaaggtcagacttaggctgggc

SEQ ID NO: 8308009 - DNA, 22 bp, Homo sapiens
aaaggtcaagctggactcaggt

SEQ ID NO: 8308010 - DNA, 22 bp, Homo sapiens
aaaggtcattgaaaaggaggaa

SEQ ID NO: 8308011 - DNA, 22 bp, Homo sapiens
aaaggtcagctgccatcgttct

SEQ ID NO: 8308012 - DNA, 22 bp, Homo sapiens
aaatgcactctgcttctgtgac

SEQ ID NO: 8308013 - DNA, 22 bp, Homo sapiens
aaatgcaccttgctgtgagact

SEQ ID NO: 8308014 - DNA, 22 bp, Homo sapiens
aaatgcactgaacacatgttgt

SEQ ID NO: 8308015 - DNA, 22 bp, Homo sapiens
aaatgcagatccctgaatctca

SEQ ID NO: 8308016 - DNA, 22 bp, Homo sapiens
aaatgcagatccctgaatctca

SEQ ID NO: 8308017 - DNA, 22 bp, Homo sapiens
aaatgcagattttgatgcagca

SEQ ID NO: 8308018 - DNA, 22 bp, Homo sapiens
aaatgcagattgtcattcagga

SEQ ID NO: 8308019 - DNA, 22 bp, Homo sapiens
aaatgcagattgtcattcagga

SEQ ID NO: 8308020 - DNA, 22 bp, Homo sapiens
aaatgcagcagctaattgaaaa

SEQ ID NO: 8308021 - DNA, 22 bp, Homo sapiens
aaagaggaaccaagagcacgtg

SEQ ID NO: 8308022 - DNA, 21 bp, Homo sapiens
aaagaggttaatattgtaagt

SEQ ID NO: 8308023 - DNA, 21 bp, Homo sapiens
aaagaacaggcagatgttctt

SEQ ID NO: 8308024 - DNA, 22 bp, Homo sapiens
aaagaacatcggagtgggcggg

SEQ ID NO: 8308025 - DNA, 22 bp, Homo sapiens
aaagaatcacatccttcagcaa

SEQ ID NO: 8308026 - DNA, 22 bp, Homo sapiens
aaagaatttgtacaccctacta

SEQ ID NO: 8308027 - DNA, 22 bp, Homo sapiens
aaagaatctatatatcaccacc

SEQ ID NO: 8308028 - DNA, 21 bp, Homo sapiens
aaactgaccttgcctgagaca

SEQ ID NO: 8308029 - DNA, 22 bp, Homo sapiens
aaactgaattcccaagggcatg

SEQ ID NO: 8308030 - DNA, 22 bp, Homo sapiens
aaactctggagatgtttatgca

SEQ ID NO: 8308031 - DNA, 22 bp, Homo sapiens
aaaatctggtaatttgaatgtg

SEQ ID NO: 8308032 - DNA, 20 bp, Homo sapiens
aaaaacagtaatgctgaaga

SEQ ID NO: 8308033 - DNA, 22 bp, Homo sapiens
aaaaaatcagatctttggttaa

SEQ ID NO: 8308034 - DNA, 22 bp, Homo sapiens
aaacagaaatttcctcatgctc

SEQ ID NO: 8308035 - DNA, 22 bp, Homo sapiens
aaacagaaatttcctcatgctc

SEQ ID NO: 8308036 - DNA, 22 bp, Homo sapiens
aaacagaagggtaggtaaacat

SEQ ID NO: 8308037 - DNA, 22 bp, Homo sapiens
aaaagacatctatttcaggcag

SEQ ID NO: 8308038 - DNA, 22 bp, Homo sapiens
aaaagacatatgtgggcattct

SEQ ID NO: 8308039 - DNA, 22 bp, Homo sapiens
aaaaatagcttctcttgtccct

SEQ ID NO: 8308040 - DNA, 22 bp, Homo sapiens
aaaaatcacttttataggcagc

SEQ ID NO: 8308041 - DNA, 22 bp, Homo sapiens
aaaaataggtcaaccgtgtatg

SEQ ID NO: 8308042 - DNA, 22 bp, Homo sapiens
aaaaatcacttttataggcagc

SEQ ID NO: 8308043 - DNA, 22 bp, Homo sapiens
aaaatctgcttccttttacaga

SEQ ID NO: 8308044 - DNA, 22 bp, Homo sapiens
aaacaagtgtaaactagtctgt

SEQ ID NO: 8308045 - DNA, 22 bp, Homo sapiens
aaaatcagtacactttattttg

SEQ ID NO: 8308046 - DNA, 22 bp, Homo sapiens
aaaagtattggccaccatttct

SEQ ID NO: 8308047 - DNA, 22 bp, Homo sapiens
atgtgtacaaccaagcactaaa

SEQ ID NO: 8308048 - DNA, 22 bp, Homo sapiens
atgtgtaaaaagtgcttaatat

SEQ ID NO: 8308049 - DNA, 22 bp, Homo sapiens
agagcctgtgattgtcatcacc

SEQ ID NO: 8308050 - DNA, 22 bp, Homo sapiens
agagcctgtgggagatgcagct

SEQ ID NO: 8308051 - DNA, 22 bp, Homo sapiens
agagcctggtctgagataggac

SEQ ID NO: 8308052 - DNA, 22 bp, Homo sapiens
agagcctgtctgcctttctacc

SEQ ID NO: 8308053 - DNA, 22 bp, Homo sapiens
agagcctggggattggcaaggg

SEQ ID NO: 8308054 - DNA, 22 bp, Homo sapiens
agagcctgggaatttgcatgtt

SEQ ID NO: 8308055 - DNA, 22 bp, Homo sapiens
agagccagcaactctagccctg

SEQ ID NO: 8308056 - DNA, 22 bp, Homo sapiens
agagccagcaagtgaatagtga

SEQ ID NO: 8308057 - DNA, 22 bp, Homo sapiens
agagccactgggagacagagca

SEQ ID NO: 8308058 - DNA, 22 bp, Homo sapiens
agagccagagacctgggttcac

SEQ ID NO: 8308059 - DNA, 22 bp, Homo sapiens
agagcagtgctgaagagtaggg

SEQ ID NO: 8308060 - DNA, 22 bp, Homo sapiens
agagcagcctgtgatgatgcac

SEQ ID NO: 8308061 - DNA, 22 bp, Homo sapiens
atggggtggagtccgggcagcg

SEQ ID NO: 8308062 - DNA, 22 bp, Homo sapiens
atggggctgttctctgccctgc

SEQ ID NO: 8308063 - DNA, 22 bp, Homo sapiens
atgggggcctgaacaggcaaaa

SEQ ID NO: 8308064 - DNA, 22 bp, Homo sapiens
atggggtgaccatgagcattta

SEQ ID NO: 8308065 - DNA, 20 bp, Homo sapiens
atggggtgagtgacgccctc

SEQ ID NO: 8308066 - DNA, 22 bp, Homo sapiens
atggggtgagactaggattaaa

SEQ ID NO: 8308067 - DNA, 22 bp, Homo sapiens
agagacagggttttgtcgtgtt

SEQ ID NO: 8308068 - DNA, 22 bp, Homo sapiens
agagatgaaaagtggagactgg

SEQ ID NO: 8308069 - DNA, 22 bp, Homo sapiens
atggcctggccagagctctgct

SEQ ID NO: 8308070 - DNA, 22 bp, Homo sapiens
atggcctggccagagctctgct

SEQ ID NO: 8308071 - DNA, 22 bp, Homo sapiens
atggcctgggcccgcttcagat

SEQ ID NO: 8308072 - DNA, 22 bp, Homo sapiens
atggcctgggcccgcttcagat

SEQ ID NO: 8308073 - DNA, 22 bp, Homo sapiens
atggcctggggagcatgggaag

SEQ ID NO: 8308074 - DNA, 22 bp, Homo sapiens
agacccagaaagcagctgcatt

SEQ ID NO: 8308075 - DNA, 22 bp, Homo sapiens
agaccagctgcctcccagggcc

SEQ ID NO: 8308076 - DNA, 22 bp, Homo sapiens
agaccacagtcaggctcctggt

SEQ ID NO: 8308077 - DNA, 22 bp, Homo sapiens
agagaagagcaatgataaattt

SEQ ID NO: 8308078 - DNA, 21 bp, Homo sapiens
agagaagaggactttctcaca

SEQ ID NO: 8308079 - DNA, 22 bp, Homo sapiens
atggcagcctgtggacagtcaa

SEQ ID NO: 8308080 - DNA, 23 bp, Homo sapiens
agacccagagactggctctgctc

SEQ ID NO: 8308081 - DNA, 22 bp, Homo sapiens
agaagtgccatactgtggtcca

SEQ ID NO: 8308082 - DNA, 22 bp, Homo sapiens
atctcagacatgttgtccatga

SEQ ID NO: 8308083 - DNA, 22 bp, Homo sapiens
agaagttaccacatacttctct

SEQ ID NO: 8308084 - DNA, 22 bp, Homo sapiens
agaattcttggtggttagaata

SEQ ID NO: 8308085 - DNA, 22 bp, Homo sapiens
agacaaagaaaccgtagaagca

SEQ ID NO: 8308086 - DNA, 22 bp, Homo sapiens
agacaaagacagcatctcaggt

SEQ ID NO: 8308087 - DNA, 22 bp, Homo sapiens
agacaaaggattaatgatgatg

SEQ ID NO: 8308088 - DNA, 22 bp, Homo sapiens
atgcacccagtgtctggactat

SEQ ID NO: 8308089 - DNA, 22 bp, Homo sapiens
atgcacgccccacactggtgtg

SEQ ID NO: 8308090 - DNA, 22 bp, Homo sapiens
agacagctgctcgcagagctat

SEQ ID NO: 8308091 - DNA, 22 bp, Homo sapiens
agacaggacacaagctgcataa

SEQ ID NO: 8308092 - DNA, 22 bp, Homo sapiens
agacagcaggggagtctggttt

SEQ ID NO: 8308093 - DNA, 22 bp, Homo sapiens
agacagcatggagctgataaca

SEQ ID NO: 8308094 - DNA, 22 bp, Homo sapiens
agacagcatgatacatgatgct

SEQ ID NO: 8308095 - DNA, 22 bp, Homo sapiens
agaggtgacataggagaggctc

SEQ ID NO: 8308096 - DNA, 22 bp, Homo sapiens
agagtgggtgatctctgttgtc

SEQ ID NO: 8308097 - DNA, 22 bp, Homo sapiens
agagtgggtgatctctgttgtc

SEQ ID NO: 8308098 - DNA, 22 bp, Homo sapiens
agaggtcagaacaggaaagtgt

SEQ ID NO: 8308099 - DNA, 22 bp, Homo sapiens
agaggtcatatctcagaagaga

SEQ ID NO: 8308100 - DNA, 22 bp, Homo sapiens
atttcactcttaattgcttcct

SEQ ID NO: 8308101 - DNA, 22 bp, Homo sapiens
atttcactctccctgccactta

SEQ ID NO: 8308102 - DNA, 22 bp, Homo sapiens
agatacatagctgtgagcacac

SEQ ID NO: 8308103 - DNA, 22 bp, Homo sapiens
agatacatatagaaaacatcaa

SEQ ID NO: 8308104 - DNA, 17 bp, Homo sapiens
atttcacttagcatgag

SEQ ID NO: 8308105 - DNA, 22 bp, Homo sapiens
agatacatcttgaacttctaga

SEQ ID NO: 8308106 - DNA, 22 bp, Homo sapiens
agatacatcatttataccttca

SEQ ID NO: 8308107 - DNA, 22 bp, Homo sapiens
agatacatgtcaagagacttat

SEQ ID NO: 8308108 - DNA, 22 bp, Homo sapiens
agatacattagtagttacttgt

SEQ ID NO: 8308109 - DNA, 22 bp, Homo sapiens
agatacattgagtttcctcctg

SEQ ID NO: 8308110 - DNA, 22 bp, Homo sapiens
caaaagcagttctatctgagtt

SEQ ID NO: 8308111 - DNA, 22 bp, Homo sapiens
attttttgttaactcaggatag

SEQ ID NO: 8308112 - DNA, 22 bp, Homo sapiens
caaaagtaattgcagtttttgc

SEQ ID NO: 8308113 - DNA, 17 bp, Homo sapiens
atttcctcagggctgag

SEQ ID NO: 8308114 - DNA, 22 bp, Homo sapiens
atttcctcatgatcataatgca

SEQ ID NO: 8308115 - DNA, 22 bp, Homo sapiens
agatacattgttctaagcattg

SEQ ID NO: 8308116 - DNA, 22 bp, Homo sapiens
agaggctcctagccactggctt

SEQ ID NO: 8308117 - DNA, 22 bp, Homo sapiens
agaggctccaccttctctgtcc

SEQ ID NO: 8308118 - DNA, 21 bp, Homo sapiens
agaggccttacaggatagacc

SEQ ID NO: 8308119 - DNA, 22 bp, Homo sapiens
agaggcctttctgttgagtgaa

SEQ ID NO: 8308120 - DNA, 16 bp, Homo sapiens
agaggccttgaggaag

SEQ ID NO: 8308121 - DNA, 22 bp, Homo sapiens
attcattctgacctcaagagaa

SEQ ID NO: 8308122 - DNA, 22 bp, Homo sapiens
attcagtaggtctagaataaga

SEQ ID NO: 8308123 - DNA, 22 bp, Homo sapiens
agaggcaggaagagctgatttt

SEQ ID NO: 8308124 - DNA, 22 bp, Homo sapiens
agaggcaggaagagctgatttt

SEQ ID NO: 8308125 - DNA, 22 bp, Homo sapiens
agaggcaggaggttgacttgag

SEQ ID NO: 8308126 - DNA, 22 bp, Homo sapiens
agaggcaggaggttgacttgag

SEQ ID NO: 8308127 - DNA, 22 bp, Homo sapiens
agaggcagcagtcatactacag

SEQ ID NO: 8308128 - DNA, 17 bp, Homo sapiens
agaggcagatacttgga

SEQ ID NO: 8308129 - DNA, 22 bp, Homo sapiens
attgcagctggtcagggtaatt

SEQ ID NO: 8308130 - DNA, 22 bp, Homo sapiens
attccagttctcctctctaaag

SEQ ID NO: 8308131 - DNA, 20 bp, Homo sapiens
attccatagttggcactttt

SEQ ID NO: 8308132 - DNA, 22 bp, Homo sapiens
attataggcttgagccaccgtg

SEQ ID NO: 8308133 - DNA, 21 bp, Homo sapiens
attattatttctgtgtccagc

SEQ ID NO: 8308134 - DNA, 22 bp, Homo sapiens
agaggagctgggaggccctcgt

SEQ ID NO: 8308135 - DNA, 22 bp, Homo sapiens
atgtgtagaactgtaatgccca

SEQ ID NO: 8308136 - DNA, 22 bp, Homo sapiens
atgtgtaggtgaatcgaggctg

SEQ ID NO: 8308137 - DNA, 22 bp, Homo sapiens
atgtgtatacttgtgcttactc

SEQ ID NO: 8308138 - DNA, 22 bp, Homo sapiens
agagctgtggatagtcctggat

SEQ ID NO: 8308139 - DNA, 22 bp, Homo sapiens
agagctgtgctttgcaccacgt

SEQ ID NO: 8308140 - DNA, 22 bp, Homo sapiens
agagctgtgaaaatgaggtttg

SEQ ID NO: 8308141 - DNA, 22 bp, Homo sapiens
agagctgtagcttcctagagcc

SEQ ID NO: 8308142 - DNA, 22 bp, Homo sapiens
agagctgtggatagtcctggat

SEQ ID NO: 8308143 - DNA, 22 bp, Homo sapiens
agagctgttcaacgtagcaatg

SEQ ID NO: 8308144 - DNA, 22 bp, Homo sapiens
agagctgttcagcagccaggtt

SEQ ID NO: 8308145 - DNA, 22 bp, Homo sapiens
agagctgtttggacatctgagt

SEQ ID NO: 8308146 - DNA, 22 bp, Homo sapiens
agcaggagtttgatgcttttat

SEQ ID NO: 8308147 - DNA, 21 bp, Homo sapiens
agcagctgcagtttctatctg

SEQ ID NO: 8308148 - DNA, 22 bp, Homo sapiens
agcagctgccagagagagttcc

SEQ ID NO: 8308149 - DNA, 22 bp, Homo sapiens
agcagctgcagagggctccccc

SEQ ID NO: 8308150 - DNA, 22 bp, Homo sapiens
agcagctgcagggagggtctgc

SEQ ID NO: 8308151 - DNA, 22 bp, Homo sapiens
agcagctgatcaaagcacttat

SEQ ID NO: 8308152 - DNA, 22 bp, Homo sapiens
agcaggctccttccttctctgg

SEQ ID NO: 8308153 - DNA, 22 bp, Homo sapiens
cacccaggctggagagcagtgg

SEQ ID NO: 8308154 - DNA, 22 bp, Homo sapiens
agcagggtttggggattggcac

SEQ ID NO: 8308155 - DNA, 22 bp, Homo sapiens
cacccaggctggagtgcagggg

SEQ ID NO: 8308156 - DNA, 22 bp, Homo sapiens
cacccaggctggagtgcagtga

SEQ ID NO: 8308157 - DNA, 22 bp, Homo sapiens
agcagggtatgttagagctgta

SEQ ID NO: 8308158 - DNA, 22 bp, Homo sapiens
agcagggttccaggagttgcag

SEQ ID NO: 8308159 - DNA, 22 bp, Homo sapiens
agcagggttccaggagttgcag

SEQ ID NO: 8308160 - DNA, 22 bp, Homo sapiens
agcagggggccacagtcacagc

SEQ ID NO: 8308161 - DNA, 22 bp, Homo sapiens
agcaggggtaacagaaggaaag

SEQ ID NO: 8308162 - DNA, 22 bp, Homo sapiens
agcaggggtaacagaaggaaag

SEQ ID NO: 8308163 - DNA, 22 bp, Homo sapiens
agcagggggagttagactagat

SEQ ID NO: 8308164 - DNA, 22 bp, Homo sapiens
cactgctcgctgcagcatggcc

SEQ ID NO: 8308165 - DNA, 22 bp, Homo sapiens
cactgcttagttggtaaatgtg

SEQ ID NO: 8308166 - DNA, 22 bp, Homo sapiens
cactgcttataaattctaggca

SEQ ID NO: 8308167 - DNA, 22 bp, Homo sapiens
cactgcttctggaggaatttgg

SEQ ID NO: 8308168 - DNA, 22 bp, Homo sapiens
cactgctttaaggctgagtaac

SEQ ID NO: 8308169 - DNA, 22 bp, Homo sapiens
cactgcctgtgagctgtgtgcc

SEQ ID NO: 8308170 - DNA, 22 bp, Homo sapiens
cactgcagatcagaggctgaga

SEQ ID NO: 8308171 - DNA, 22 bp, Homo sapiens
caccctttgctgctcttcctcc

SEQ ID NO: 8308172 - DNA, 22 bp, Homo sapiens
cacccaggctggagtgcagtgg

SEQ ID NO: 8308173 - DNA, 22 bp, Homo sapiens
caagcagagactagatagctgt

SEQ ID NO: 8308174 - DNA, 22 bp, Homo sapiens
agcagcaggagccgtggggtga

SEQ ID NO: 8308175 - DNA, 22 bp, Homo sapiens
agcagcaggctgtgtggactga

SEQ ID NO: 8308176 - DNA, 22 bp, Homo sapiens
caagagcatttagttagctggt

SEQ ID NO: 8308177 - DNA, 22 bp, Homo sapiens
caagagctaccctgtgccatat

SEQ ID NO: 8308178 - DNA, 22 bp, Homo sapiens
caagagctagaaattggttaga

SEQ ID NO: 8308179 - DNA, 22 bp, Homo sapiens
caagagctagactttgtcagga

SEQ ID NO: 8308180 - DNA, 22 bp, Homo sapiens
caagcagacagtaggcctagaa

SEQ ID NO: 8308181 - DNA, 22 bp, Homo sapiens
cacaagagagtgcgcgttgcaa

SEQ ID NO: 8308182 - DNA, 20 bp, Homo sapiens
cacaagagaatacacactgg

SEQ ID NO: 8308183 - DNA, 22 bp, Homo sapiens
cacaagacttatttgtgtagaa

SEQ ID NO: 8308184 - DNA, 22 bp, Homo sapiens
agcagccaaggtaacctgtgct

SEQ ID NO: 8308185 - DNA, 22 bp, Homo sapiens
agcagccaaccttacattcatc

SEQ ID NO: 8308186 - DNA, 22 bp, Homo sapiens
agcagccaaatgaagattttac

SEQ ID NO: 8308187 - DNA, 22 bp, Homo sapiens
agcagccacccagctgctcatt

SEQ ID NO: 8308188 - DNA, 22 bp, Homo sapiens
agcagccacagtctgggacagg

SEQ ID NO: 8308189 - DNA, 22 bp, Homo sapiens
agcagccaattggaggatgaag

SEQ ID NO: 8308190 - DNA, 22 bp, Homo sapiens
agcagccacacgcctccttctc

SEQ ID NO: 8308191 - DNA, 22 bp, Homo sapiens
agcagccacagcagatctgagt

SEQ ID NO: 8308192 - DNA, 22 bp, Homo sapiens
agcagccagaaatccagaggtg

SEQ ID NO: 8308193 - DNA, 22 bp, Homo sapiens
agcagccagaaatccagaggtg

SEQ ID NO: 8308194 - DNA, 22 bp, Homo sapiens
agcagccagaaagggcagtcga

SEQ ID NO: 8308195 - DNA, 22 bp, Homo sapiens
caacagaaggtgtactactgaa

SEQ ID NO: 8308196 - DNA, 22 bp, Homo sapiens
caaatatctttggcaaagagaa

SEQ ID NO: 8308197 - DNA, 22 bp, Homo sapiens
caacagaaggaagcagggtcag

SEQ ID NO: 8308198 - DNA, 23 bp, Homo sapiens
agcctcttttctcctgccctgca

SEQ ID NO: 8308199 - DNA, 22 bp, Homo sapiens
agcctgagagccaagctgtgca

SEQ ID NO: 8308200 - DNA, 22 bp, Homo sapiens
agcctgagccccatccagctga

SEQ ID NO: 8308201 - DNA, 22 bp, Homo sapiens
cagcagctcccatccgctgagc

SEQ ID NO: 8308202 - DNA, 22 bp, Homo sapiens
agcctggaggtaatgaggaaac

SEQ ID NO: 8308203 - DNA, 22 bp, Homo sapiens
agcctggatccatgtggctacc

SEQ ID NO: 8308204 - DNA, 22 bp, Homo sapiens
agcctggagttcccaggagaag

SEQ ID NO: 8308205 - DNA, 22 bp, Homo sapiens
agcctggattcgtgcatccaca

SEQ ID NO: 8308206 - DNA, 22 bp, Homo sapiens
agcctggatcctaggctcagct

SEQ ID NO: 8308207 - DNA, 22 bp, Homo sapiens
agcctggcactgaggcagggcg

SEQ ID NO: 8308208 - DNA, 22 bp, Homo sapiens
agcctggcactgaggcagggcg

SEQ ID NO: 8308209 - DNA, 22 bp, Homo sapiens
cagcagggcccccgggtgcgcc

SEQ ID NO: 8308210 - DNA, 22 bp, Homo sapiens
agcctctgtcaagcttttcaaa

SEQ ID NO: 8308211 - DNA, 22 bp, Homo sapiens
agcctctgtgactcacaggtca

SEQ ID NO: 8308212 - DNA, 22 bp, Homo sapiens
agcctctgtagaaagcagtgtg

SEQ ID NO: 8308213 - DNA, 22 bp, Homo sapiens
agcctctggccctagactgctt

SEQ ID NO: 8308214 - DNA, 22 bp, Homo sapiens
agcctctggccctagactgctt

SEQ ID NO: 8308215 - DNA, 22 bp, Homo sapiens
agcctctggtcctccctcagct

SEQ ID NO: 8308216 - DNA, 22 bp, Homo sapiens
agcctctgcttatgcaaaggta

SEQ ID NO: 8308217 - DNA, 22 bp, Homo sapiens
agcctctgctggccctggcact

SEQ ID NO: 8308218 - DNA, 22 bp, Homo sapiens
agcctctgatggctcccaagga

SEQ ID NO: 8308219 - DNA, 22 bp, Homo sapiens
agcctctgcacgggcacgggtg

SEQ ID NO: 8308220 - DNA, 22 bp, Homo sapiens
cagaggtattgcaaaagcctag

SEQ ID NO: 8308221 - DNA, 22 bp, Homo sapiens
cagaggtgcatacaggtcatta

SEQ ID NO: 8308222 - DNA, 22 bp, Homo sapiens
agcctcctggagtttctgggat

SEQ ID NO: 8308223 - DNA, 22 bp, Homo sapiens
cagccctgcacgctgcctccgc

SEQ ID NO: 8308224 - DNA, 22 bp, Homo sapiens
cagccctgagaaggaggatctc

SEQ ID NO: 8308225 - DNA, 22 bp, Homo sapiens
cagccctgagagaaccatctat

SEQ ID NO: 8308226 - DNA, 22 bp, Homo sapiens
cagcagggtaggttgtatcagt

SEQ ID NO: 8308227 - DNA, 22 bp, Homo sapiens
cagcagggtaggttgtatcagt

SEQ ID NO: 8308228 - DNA, 22 bp, Homo sapiens
cagcagggggcagcgcagatca

SEQ ID NO: 8308229 - DNA, 22 bp, Homo sapiens
cagcaggggaactgtgggccag

SEQ ID NO: 8308230 - DNA, 22 bp, Homo sapiens
cagcagggtatacagggaattt

SEQ ID NO: 8308231 - DNA, 22 bp, Homo sapiens
cagcagtgtgcaggtgtgctgg

SEQ ID NO: 8308232 - DNA, 22 bp, Homo sapiens
cagcagtgtctccagcatcaca

SEQ ID NO: 8308233 - DNA, 22 bp, Homo sapiens
cagcagtgtggaagctgagggg

SEQ ID NO: 8308234 - DNA, 19 bp, Homo sapiens
cagctcagtttgattctct

SEQ ID NO: 8308235 - DNA, 22 bp, Homo sapiens
agctcctgaaaagcgcttgctt

SEQ ID NO: 8308236 - DNA, 21 bp, Homo sapiens
agctcagccgggcacagtggc

SEQ ID NO: 8308237 - DNA, 22 bp, Homo sapiens
agctcagcttcctctccatgct

SEQ ID NO: 8308238 - DNA, 22 bp, Homo sapiens
cagacatgatgtaagcagaggc

SEQ ID NO: 8308239 - DNA, 20 bp, Homo sapiens
agccagaagaaggctggaga

SEQ ID NO: 8308240 - DNA, 22 bp, Homo sapiens
agccagacatggctcctgctcc

SEQ ID NO: 8308241 - DNA, 22 bp, Homo sapiens
agccagagagccccaggttcta

SEQ ID NO: 8308242 - DNA, 22 bp, Homo sapiens
cagaatgcaaattttataatat

SEQ ID NO: 8308243 - DNA, 22 bp, Homo sapiens
cagaatgagataacccagattg

SEQ ID NO: 8308244 - DNA, 22 bp, Homo sapiens
cagaatatgacaagattttcct

SEQ ID NO: 8308245 - DNA, 23 bp, Homo sapiens
agccacttctatcttgctcctgg

SEQ ID NO: 8308246 - DNA, 22 bp, Homo sapiens
agccacaggaaacagagacagc

SEQ ID NO: 8308247 - DNA, 22 bp, Homo sapiens
agccacgtccctgtcagggtca

SEQ ID NO: 8308248 - DNA, 22 bp, Homo sapiens
agccacagtgcaagagagaaaa

SEQ ID NO: 8308249 - DNA, 22 bp, Homo sapiens
agccacagtgcaagagagaaaa

SEQ ID NO: 8308250 - DNA, 18 bp, Homo sapiens
cagaaatcacaccagcac

SEQ ID NO: 8308251 - DNA, 21 bp, Homo sapiens
cagaggcaggtcctgggacgg

SEQ ID NO: 8308252 - DNA, 22 bp, Homo sapiens
agcccagccggattcccagttc

SEQ ID NO: 8308253 - DNA, 22 bp, Homo sapiens
agcccaggctggagtgcagtgg

SEQ ID NO: 8308254 - DNA, 22 bp, Homo sapiens
agcccaggctggagtgcagtgg

SEQ ID NO: 8308255 - DNA, 20 bp, Homo sapiens
agcccaggcctgtgtgagtc

SEQ ID NO: 8308256 - DNA, 22 bp, Homo sapiens
cagagggagccctccaggagca

SEQ ID NO: 8308257 - DNA, 22 bp, Homo sapiens
cagaggctcttcctcactgccc

SEQ ID NO: 8308258 - DNA, 22 bp, Homo sapiens
agccatcatttctgtcactggc

SEQ ID NO: 8308259 - DNA, 22 bp, Homo sapiens
agcccaagctatgaggtgacct

SEQ ID NO: 8308260 - DNA, 22 bp, Homo sapiens
agcccaagctatgaggtgacct

SEQ ID NO: 8308261 - DNA, 22 bp, Homo sapiens
agcccaagcataggagggaggc

SEQ ID NO: 8308262 - DNA, 22 bp, Homo sapiens
cagactttcaaggagtgaaggc

SEQ ID NO: 8308263 - DNA, 22 bp, Homo sapiens
cagagaaactcagatagctgat

SEQ ID NO: 8308264 - DNA, 22 bp, Homo sapiens
agcccaaggcttccctgctggc

SEQ ID NO: 8308265 - DNA, 22 bp, Homo sapiens
agcccagaggctgggcgtgcat

SEQ ID NO: 8308266 - DNA, 22 bp, Homo sapiens
agcccagcagaaagtccagcct

SEQ ID NO: 8308267 - DNA, 22 bp, Homo sapiens
agcccagcaaagggaggttcag

SEQ ID NO: 8308268 - DNA, 23 bp, Homo sapiens
agcccagcagagaacctaggtcc

SEQ ID NO: 8308269 - DNA, 22 bp, Homo sapiens
acttcttgggaccctggcaccg

SEQ ID NO: 8308270 - DNA, 22 bp, Homo sapiens
atacatctatgcctttctgaca

SEQ ID NO: 8308271 - DNA, 22 bp, Homo sapiens
atacatgttcgtgtacatgttc

SEQ ID NO: 8308272 - DNA, 22 bp, Homo sapiens
acttctggtgtcatactgcatt

SEQ ID NO: 8308273 - DNA, 22 bp, Homo sapiens
atacattagctcatatgattaa

SEQ ID NO: 8308274 - DNA, 22 bp, Homo sapiens
atacatgttgtaccatatgttt

SEQ ID NO: 8308275 - DNA, 22 bp, Homo sapiens
atacattagaatctggtactca

SEQ ID NO: 8308276 - DNA, 22 bp, Homo sapiens
acttagaacaggcagaattcca

SEQ ID NO: 8308277 - DNA, 23 bp, Homo sapiens
acttaaatggttctttatctcag

SEQ ID NO: 8308278 - DNA, 22 bp, Homo sapiens
actgtcaccatcagagcgggaa

SEQ ID NO: 8308279 - DNA, 22 bp, Homo sapiens
actgtcactccaactgagtcgt

SEQ ID NO: 8308280 - DNA, 22 bp, Homo sapiens
ataaaaactgacccatcctttg

SEQ ID NO: 8308281 - DNA, 22 bp, Homo sapiens
actgtactgtgtattgtagaat

SEQ ID NO: 8308282 - DNA, 22 bp, Homo sapiens
actgtgcatgaaccgaaacaaa

SEQ ID NO: 8308283 - DNA, 22 bp, Homo sapiens
ataaacagctccatttagtgcc

SEQ ID NO: 8308284 - DNA, 22 bp, Homo sapiens
ataaacagtagagaaaggtggt

SEQ ID NO: 8308285 - DNA, 22 bp, Homo sapiens
ataaacacttctagggcacaca

SEQ ID NO: 8308286 - DNA, 22 bp, Homo sapiens
actgtgcaatgagtaataaact

SEQ ID NO: 8308287 - DNA, 22 bp, Homo sapiens
actgtgcacaattctaagtcct

SEQ ID NO: 8308288 - DNA, 22 bp, Homo sapiens
atctaagatgtattgagcactt

SEQ ID NO: 8308289 - DNA, 22 bp, Homo sapiens
atctaagagttaacatcaagaa

SEQ ID NO: 8308290 - DNA, 22 bp, Homo sapiens
agaaagttcactggtatatttt

SEQ ID NO: 8308291 - DNA, 22 bp, Homo sapiens
agaaagttctgtgagttgttca

SEQ ID NO: 8308292 - DNA, 22 bp, Homo sapiens
agaacagaagggaggaaggcct

SEQ ID NO: 8308293 - DNA, 22 bp, Homo sapiens
agaacagaggccttatgtttca

SEQ ID NO: 8308294 - DNA, 22 bp, Homo sapiens
agaacagatgtgggcagacctg

SEQ ID NO: 8308295 - DNA, 22 bp, Homo sapiens
agaacagcagcacgtcaagctg

SEQ ID NO: 8308296 - DNA, 22 bp, Homo sapiens
agaacagcagttatggttcatt

SEQ ID NO: 8308297 - DNA, 22 bp, Homo sapiens
actttctcaaatcagactttaa

SEQ ID NO: 8308298 - DNA, 22 bp, Homo sapiens
actttctaggtctcagtccttt

SEQ ID NO: 8308299 - DNA, 20 bp, Homo sapiens
actttctcggtttctcacct

SEQ ID NO: 8308300 - DNA, 22 bp, Homo sapiens
actttctcccacccacccgtct

SEQ ID NO: 8308301 - DNA, 19 bp, Homo sapiens
actttctccaggacctgtt

SEQ ID NO: 8308302 - DNA, 22 bp, Homo sapiens
actttctccagaaaaccaagga

SEQ ID NO: 8308303 - DNA, 22 bp, Homo sapiens
actttctcaggaattcacagac

SEQ ID NO: 8308304 - DNA, 22 bp, Homo sapiens
agaaaaggttgaaagtaggatt

SEQ ID NO: 8308305 - DNA, 21 bp, Homo sapiens
agaaaagtagagttttcagag

SEQ ID NO: 8308306 - DNA, 22 bp, Homo sapiens
atattcgtggtcaagtaaggcc

SEQ ID NO: 8308307 - DNA, 22 bp, Homo sapiens
atattcttccaaaacatcattt

SEQ ID NO: 8308308 - DNA, 22 bp, Homo sapiens
actggaagccagttgacaatca

SEQ ID NO: 8308309 - DNA, 22 bp, Homo sapiens
actgcttttagaaatctataga

SEQ ID NO: 8308310 - DNA, 22 bp, Homo sapiens
actgcttttctaagattctgtg

SEQ ID NO: 8308311 - DNA, 22 bp, Homo sapiens
actgcttttcagagtctgcctg

SEQ ID NO: 8308312 - DNA, 22 bp, Homo sapiens
agtgttgtcaaacggctcagca

SEQ ID NO: 8308313 - DNA, 22 bp, Homo sapiens
agtgttgtatgggatgactgct

SEQ ID NO: 8308314 - DNA, 22 bp, Homo sapiens
agtggcagtagatgagctggtt

SEQ ID NO: 8308315 - DNA, 22 bp, Homo sapiens
agtgtacatgtttacagcatct

SEQ ID NO: 8308316 - DNA, 22 bp, Homo sapiens
actgcagcaaagcccgtgtctt

SEQ ID NO: 8308317 - DNA, 22 bp, Homo sapiens
actctgtgtgagtagagcctgt

SEQ ID NO: 8308318 - DNA, 22 bp, Homo sapiens
agtgcagtggttaggagccagg

SEQ ID NO: 8308319 - DNA, 22 bp, Homo sapiens
agtgcatatatgaagagtatga

SEQ ID NO: 8308320 - DNA, 20 bp, Homo sapiens
actgagctgcatggagagga

SEQ ID NO: 8308321 - DNA, 22 bp, Homo sapiens
actgagctcttgactgggagtt

SEQ ID NO: 8308322 - DNA, 22 bp, Homo sapiens
actgagctgcaagtcagggagg

SEQ ID NO: 8308323 - DNA, 22 bp, Homo sapiens
actgagctgtgacaatgcttaa

SEQ ID NO: 8308324 - DNA, 22 bp, Homo sapiens
actgagctgcttgaagtgaact

SEQ ID NO: 8308325 - DNA, 22 bp, Homo sapiens
actcctggtttgtgtcctggct

SEQ ID NO: 8308326 - DNA, 22 bp, Homo sapiens
actcctgggttgcagtcctcaa

SEQ ID NO: 8308327 - DNA, 19 bp, Homo sapiens
agtcccaggcccgaaagag

SEQ ID NO: 8308328 - DNA, 21 bp, Homo sapiens
agtcccaggggtgagtgatgt

SEQ ID NO: 8308329 - DNA, 22 bp, Homo sapiens
agtcccagtgacttggccagaa

SEQ ID NO: 8308330 - DNA, 22 bp, Homo sapiens
agtcccagtgacttggccagaa

SEQ ID NO: 8308331 - DNA, 22 bp, Homo sapiens
agtcccagcttcccccatgcag

SEQ ID NO: 8308332 - DNA, 22 bp, Homo sapiens
agtcccagcttcccccatgcag

SEQ ID NO: 8308333 - DNA, 22 bp, Homo sapiens
agtcccaggcagccgagccggt

SEQ ID NO: 8308334 - DNA, 22 bp, Homo sapiens
agtcccaggcagccgagccggt

SEQ ID NO: 8308335 - DNA, 22 bp, Homo sapiens
agtcccagttcggttcttcctc

SEQ ID NO: 8308336 - DNA, 22 bp, Homo sapiens
agtcccagttcggttcttcctc

SEQ ID NO: 8308337 - DNA, 22 bp, Homo sapiens
agtcccagtgagatgagccacg

SEQ ID NO: 8308338 - DNA, 22 bp, Homo sapiens
agtcccagtgagatgaaccagg

SEQ ID NO: 8308339 - DNA, 22 bp, Homo sapiens
agtcccagtgagatgaaccagg

SEQ ID NO: 8308340 - DNA, 22 bp, Homo sapiens
agtcccagtgagatgagccacg

SEQ ID NO: 8308341 - DNA, 22 bp, Homo sapiens
agtcccagctctgccacttact

SEQ ID NO: 8308342 - DNA, 22 bp, Homo sapiens
agtcccagctctgccacttact

SEQ ID NO: 8308343 - DNA, 22 bp, Homo sapiens
agtcccagctcagaaccactag

SEQ ID NO: 8308344 - DNA, 22 bp, Homo sapiens
agtcccagctcagaaccactag

SEQ ID NO: 8308345 - DNA, 22 bp, Homo sapiens
agtatacatatattagccttcg

SEQ ID NO: 8308346 - DNA, 22 bp, Homo sapiens
agtaaaatcttaagcacagtgg

SEQ ID NO: 8308347 - DNA, 22 bp, Homo sapiens
agtaaacagaaagcaagatgat

SEQ ID NO: 8308348 - DNA, 22 bp, Homo sapiens
agtaaaaattgaggtgcaaaat

SEQ ID NO: 8308349 - DNA, 22 bp, Homo sapiens
acgcctgtaatcccagcacttt

SEQ ID NO: 8308350 - DNA, 22 bp, Homo sapiens
aggtggctcctcccatggctgg

SEQ ID NO: 8308351 - DNA, 22 bp, Homo sapiens
acgcagaagggcctggcgtgcc

SEQ ID NO: 8308352 - DNA, 20 bp, Homo sapiens
aggtggctcctgctgggggt

SEQ ID NO: 8308353 - DNA, 22 bp, Homo sapiens
acctggagtcatttgaggagta

SEQ ID NO: 8308354 - DNA, 22 bp, Homo sapiens
aggtggccggtgccagccgggc

SEQ ID NO: 8308355 - DNA, 22 bp, Homo sapiens
acctggccatccagctggcatc

SEQ ID NO: 8308356 - DNA, 22 bp, Homo sapiens
acctggcactacaggcacctgt

SEQ ID NO: 8308357 - DNA, 22 bp, Homo sapiens
acctggcatgaagcatgcctta

SEQ ID NO: 8308358 - DNA, 22 bp, Homo sapiens
accctcccatttccatgtagca

SEQ ID NO: 8308359 - DNA, 22 bp, Homo sapiens
accctcccatttccatgtagca

SEQ ID NO: 8308360 - DNA, 22 bp, Homo sapiens
accctccccaagaggtcgtgcc

SEQ ID NO: 8308361 - DNA, 19 bp, Homo sapiens
accctctcagtgcctgagg

SEQ ID NO: 8308362 - DNA, 22 bp, Homo sapiens
acctctggccttcaggcatcat

SEQ ID NO: 8308363 - DNA, 22 bp, Homo sapiens
acctgagaatgggggcatgtgt

SEQ ID NO: 8308364 - DNA, 22 bp, Homo sapiens
acctgagcctagggaggttgag

SEQ ID NO: 8308365 - DNA, 22 bp, Homo sapiens
acctgaggcctccccagcagac

SEQ ID NO: 8308366 - DNA, 22 bp, Homo sapiens
acctgagcatgccaggagagtg

SEQ ID NO: 8308367 - DNA, 22 bp, Homo sapiens
acctgaggctgttagtctaggt

SEQ ID NO: 8308368 - DNA, 22 bp, Homo sapiens
acctgagggcccaaacttggta

SEQ ID NO: 8308369 - DNA, 22 bp, Homo sapiens
acatttcttttcatctctatat

SEQ ID NO: 8308370 - DNA, 22 bp, Homo sapiens
acatttgagatgccttttaggt

SEQ ID NO: 8308371 - DNA, 22 bp, Homo sapiens
acatttgaggatgttaagaatg

SEQ ID NO: 8308372 - DNA, 18 bp, Homo sapiens
acatttctatgcttctgg

SEQ ID NO: 8308373 - DNA, 22 bp, Homo sapiens
acatttcttgatgcctctgtga

SEQ ID NO: 8308374 - DNA, 22 bp, Homo sapiens
acatttcttcctaattatccct

SEQ ID NO: 8308375 - DNA, 22 bp, Homo sapiens
acatttctcttagagttggact

SEQ ID NO: 8308376 - DNA, 22 bp, Homo sapiens
acatttctttctattcagtagc

SEQ ID NO: 8308377 - DNA, 22 bp, Homo sapiens
acatttctttgctagacagcag

SEQ ID NO: 8308378 - DNA, 22 bp, Homo sapiens
aggcctgaggaccttctggagg

SEQ ID NO: 8308379 - DNA, 22 bp, Homo sapiens
aggcctgaggttcctgtgctca

SEQ ID NO: 8308380 - DNA, 22 bp, Homo sapiens
aggcctgcagcaggagcaaacc

SEQ ID NO: 8308381 - DNA, 22 bp, Homo sapiens
aggctctgttattctagagggc

SEQ ID NO: 8308382 - DNA, 20 bp, Homo sapiens
acattgattatgtttgtaga

SEQ ID NO: 8308383 - DNA, 22 bp, Homo sapiens
acattgatgaaaaggtatcatt

SEQ ID NO: 8308384 - DNA, 22 bp, Homo sapiens
acattgatcagcctcccatgca

SEQ ID NO: 8308385 - DNA, 22 bp, Homo sapiens
acattgatcagcctcccatgca

SEQ ID NO: 8308386 - DNA, 18 bp, Homo sapiens
acatttctaggtgaaagc

SEQ ID NO: 8308387 - DNA, 22 bp, Homo sapiens
acatttctaatttaatgtaaca

SEQ ID NO: 8308388 - DNA, 22 bp, Homo sapiens
acatttctagttgttcatctcc

SEQ ID NO: 8308389 - DNA, 22 bp, Homo sapiens
acatttctatcatcctgtaatg

SEQ ID NO: 8308390 - DNA, 22 bp, Homo sapiens
acatttctatagtgcatctgtt

SEQ ID NO: 8308391 - DNA, 22 bp, Homo sapiens
acattgtagacttttcatatgt

SEQ ID NO: 8308392 - DNA, 22 bp, Homo sapiens
acattgtataatgattatcaca

SEQ ID NO: 8308393 - DNA, 22 bp, Homo sapiens
acatgttagaaatgcagaatct

SEQ ID NO: 8308394 - DNA, 22 bp, Homo sapiens
aggccagggtcccacactcgca

SEQ ID NO: 8308395 - DNA, 22 bp, Homo sapiens
aggccagggtcccacactcgca

SEQ ID NO: 8308396 - DNA, 22 bp, Homo sapiens
aggcctcttcagggagcatgga

SEQ ID NO: 8308397 - DNA, 21 bp, Homo sapiens
aggcctcttcatggccatgat

SEQ ID NO: 8308398 - DNA, 22 bp, Homo sapiens
aggcctgagccccaggtttgtt

SEQ ID NO: 8308399 - DNA, 22 bp, Homo sapiens
aggcctgaggaccagataaatg

SEQ ID NO: 8308400 - DNA, 22 bp, Homo sapiens
aggcctgagcagaggagtggac

SEQ ID NO: 8308401 - DNA, 22 bp, Homo sapiens
aggcctgaaggaagatgagctg

SEQ ID NO: 8308402 - DNA, 22 bp, Homo sapiens
aggcctgaagtgtggagtgggg

SEQ ID NO: 8308403 - DNA, 22 bp, Homo sapiens
aggcctgacttgaatttagggc

SEQ ID NO: 8308404 - DNA, 22 bp, Homo sapiens
acatgcatacaagcacatgtag

SEQ ID NO: 8308405 - DNA, 22 bp, Homo sapiens
acatgcatacaagcacatgtag

SEQ ID NO: 8308406 - DNA, 22 bp, Homo sapiens
acatgctttctaggtccttctg

SEQ ID NO: 8308407 - DNA, 21 bp, Homo sapiens
agggcagattagctgtaagag

SEQ ID NO: 8308408 - DNA, 22 bp, Homo sapiens
agggcagcacaaggcatggact

SEQ ID NO: 8308409 - DNA, 22 bp, Homo sapiens
agggcagcagcggcccaggcct

SEQ ID NO: 8308410 - DNA, 22 bp, Homo sapiens
agggcagcagcccatggctctg

SEQ ID NO: 8308411 - DNA, 22 bp, Homo sapiens
agggcagcacagctgtgctcct

SEQ ID NO: 8308412 - DNA, 17 bp, Homo sapiens
accagcctctcctgggg

SEQ ID NO: 8308413 - DNA, 22 bp, Homo sapiens
accagcctgtctgagtcgtggg

SEQ ID NO: 8308414 - DNA, 22 bp, Homo sapiens
accagctcagaagccagaaaga

SEQ ID NO: 8308415 - DNA, 22 bp, Homo sapiens
agggagacacatgaggaagtca

SEQ ID NO: 8308416 - DNA, 19 bp, Homo sapiens
agggagaattccaagagga

SEQ ID NO: 8308417 - DNA, 22 bp, Homo sapiens
accagcagagttgaggaggaca

SEQ ID NO: 8308418 - DNA, 21 bp, Homo sapiens
accagcaggagatcagaagga

SEQ ID NO: 8308419 - DNA, 22 bp, Homo sapiens
accagagctggcagagtatcaa

SEQ ID NO: 8308420 - DNA, 22 bp, Homo sapiens
acatttgtatgcgtttttactg

SEQ ID NO: 8308421 - DNA, 22 bp, Homo sapiens
agggggcccttgcaggtgagcg

SEQ ID NO: 8308422 - DNA, 22 bp, Homo sapiens
agggggcaggagagacctgctg

SEQ ID NO: 8308423 - DNA, 22 bp, Homo sapiens
agggggcatcaggtcctggctc

SEQ ID NO: 8308424 - DNA, 22 bp, Homo sapiens
agggggaggctgtgctgcgtct

SEQ ID NO: 8308425 - DNA, 22 bp, Homo sapiens
aggggcctggacatggacgcgc

SEQ ID NO: 8308426 - DNA, 22 bp, Homo sapiens
agggctgcctgactccagagcc

SEQ ID NO: 8308427 - DNA, 22 bp, Homo sapiens
agggctgcctgctctgcattga

SEQ ID NO: 8308428 - DNA, 22 bp, Homo sapiens
agggctgctatgttgattcaga

SEQ ID NO: 8308429 - DNA, 22 bp, Homo sapiens
agggctgctcctccttcaggcc

SEQ ID NO: 8308430 - DNA, 19 bp, Homo sapiens
agggctgctctggcctggg

SEQ ID NO: 8308431 - DNA, 22 bp, Homo sapiens
acccagctggatgcatggaggc

SEQ ID NO: 8308432 - DNA, 22 bp, Homo sapiens
acccagctggatgcatggaggc

SEQ ID NO: 8308433 - DNA, 22 bp, Homo sapiens
acccagctctttgatggtcttg

SEQ ID NO: 8308434 - DNA, 20 bp, Homo sapiens
acccagctctgtgccctggg

SEQ ID NO: 8308435 - DNA, 22 bp, Homo sapiens
agggctgcccagtgtgagagct

SEQ ID NO: 8308436 - DNA, 22 bp, Homo sapiens
agggctgccatttctggcccaa

SEQ ID NO: 8308437 - DNA, 22 bp, Homo sapiens
accaggctgtgaagtgagacta

SEQ ID NO: 8308438 - DNA, 22 bp, Homo sapiens
acccagagccagggtcaggagc

SEQ ID NO: 8308439 - DNA, 22 bp, Homo sapiens
accaggctggagtgcagtggcg

SEQ ID NO: 8308440 - DNA, 22 bp, Homo sapiens
acaggggaatttactgtcatta

SEQ ID NO: 8308441 - DNA, 22 bp, Homo sapiens
acaggggattgattggaagtct

SEQ ID NO: 8308442 - DNA, 22 bp, Homo sapiens
acaggcagcgtcattgctgctc

SEQ ID NO: 8308443 - DNA, 22 bp, Homo sapiens
acaggcagcactaatctctggt

SEQ ID NO: 8308444 - DNA, 22 bp, Homo sapiens
acaggcagggaccttggctaag

SEQ ID NO: 8308445 - DNA, 22 bp, Homo sapiens
agctggtggattatgctgtaca

SEQ ID NO: 8308446 - DNA, 22 bp, Homo sapiens
agctggtgtcctcctggagctg

SEQ ID NO: 8308447 - DNA, 21 bp, Homo sapiens
agctggtgtcagagctctggg

SEQ ID NO: 8308448 - DNA, 22 bp, Homo sapiens
acaggagtgaatctggcactta

SEQ ID NO: 8308449 - DNA, 21 bp, Homo sapiens
agctggcagatatggtgtctg

SEQ ID NO: 8308450 - DNA, 22 bp, Homo sapiens
agctgaaggctagaacagctgg

SEQ ID NO: 8308451 - DNA, 22 bp, Homo sapiens
agctgagaggtggcaagctgta

SEQ ID NO: 8308452 - DNA, 22 bp, Homo sapiens
acagctggcaggggggcatgaa

SEQ ID NO: 8308453 - DNA, 22 bp, Homo sapiens
acagctgggtgctgctcagagc

SEQ ID NO: 8308454 - DNA, 22 bp, Homo sapiens
acagctgtatccccagagctca

SEQ ID NO: 8308455 - DNA, 22 bp, Homo sapiens
agctggaggggccagcaggtgt

SEQ ID NO: 8308456 - DNA, 22 bp, Homo sapiens
aggagcagaactgttgtggagg

SEQ ID NO: 8308457 - DNA, 22 bp, Homo sapiens
acagtgtctcctggtacccagt

SEQ ID NO: 8308458 - DNA, 22 bp, Homo sapiens
acagtgtctgacacattgtagc

SEQ ID NO: 8308459 - DNA, 17 bp, Homo sapiens
aggcagctcagaacatc

SEQ ID NO: 8308460 - DNA, 22 bp, Homo sapiens
acatagcttaaatgagaagata

SEQ ID NO: 8308461 - DNA, 22 bp, Homo sapiens
acatatttccatgcagcatgtc

SEQ ID NO: 8308462 - DNA, 21 bp, Homo sapiens
aggcagctcaggcccagagag

SEQ ID NO: 8308463 - DNA, 22 bp, Homo sapiens
acagtttctccatttacacctt

SEQ ID NO: 8308464 - DNA, 22 bp, Homo sapiens
aggcactgcttctaagtaggaa

SEQ ID NO: 8308465 - DNA, 18 bp, Homo sapiens
aggcactggaattaaggg

SEQ ID NO: 8308466 - DNA, 22 bp, Homo sapiens
aggcactgggaatatgctgagg

SEQ ID NO: 8308467 - DNA, 20 bp, Homo sapiens
aggcactggatttcttatat

SEQ ID NO: 8308468 - DNA, 22 bp, Homo sapiens
aggcactgggggatgagcaagg

SEQ ID NO: 8308469 - DNA, 20 bp, Homo sapiens
aggcactggggataggtaag

SEQ ID NO: 8308470 - DNA, 22 bp, Homo sapiens
aggcactgggtaattagtagct

SEQ ID NO: 8308471 - DNA, 21 bp, Homo sapiens
acagttcatgataactccatc

SEQ ID NO: 8308472 - DNA, 22 bp, Homo sapiens
atacagaagaactatagccact

SEQ ID NO: 8308473 - DNA, 22 bp, Homo sapiens
atacatatatggtacttcctgg

SEQ ID NO: 8308474 - DNA, 22 bp, Homo sapiens
ctggagctgctgtccttgggtg

SEQ ID NO: 8308475 - DNA, 22 bp, Homo sapiens
ctggagctggcttccttccact

SEQ ID NO: 8308476 - DNA, 22 bp, Homo sapiens
ctggagctgtcttcacaggcct

SEQ ID NO: 8308477 - DNA, 22 bp, Homo sapiens
atacatcttgtcagattcatgt

SEQ ID NO: 8308478 - DNA, 22 bp, Homo sapiens
atacatctcatgtaagagataa

SEQ ID NO: 8308479 - DNA, 22 bp, Homo sapiens
atacatcttccttttaaaatgc

SEQ ID NO: 8308480 - DNA, 22 bp, Homo sapiens
ataatttaaattagtatgtgat

SEQ ID NO: 8308481 - DNA, 22 bp, Homo sapiens
ataattaatttcagtaatctcc

SEQ ID NO: 8308482 - DNA, 22 bp, Homo sapiens
ataatgtaggtatgtgtattta

SEQ ID NO: 8308483 - DNA, 22 bp, Homo sapiens
ataatttaattttcacagtggt

SEQ ID NO: 8308484 - DNA, 20 bp, Homo sapiens
ataatttaccctgcaccact

SEQ ID NO: 8308485 - DNA, 22 bp, Homo sapiens
ataatttacaactgcttttaat

SEQ ID NO: 8308486 - DNA, 22 bp, Homo sapiens
atacagaaaatgatgcagagtt

SEQ ID NO: 8308487 - DNA, 22 bp, Homo sapiens
atagtaactggcatgtttatga

SEQ ID NO: 8308488 - DNA, 22 bp, Homo sapiens
atagtacacatcctacaatgtt

SEQ ID NO: 8308489 - DNA, 19 bp, Homo sapiens
atagaaagggttaaagaca

SEQ ID NO: 8308490 - DNA, 22 bp, Homo sapiens
atagaaatggcagctggtgcta

SEQ ID NO: 8308491 - DNA, 21 bp, Homo sapiens
atactttgaattacagccttg

SEQ ID NO: 8308492 - DNA, 21 bp, Homo sapiens
atactttgaattacagccttg

SEQ ID NO: 8308493 - DNA, 22 bp, Homo sapiens
atactttgggggttagtgtaga

SEQ ID NO: 8308494 - DNA, 22 bp, Homo sapiens
atagaaaacagatgtccttaaa

SEQ ID NO: 8308495 - DNA, 22 bp, Homo sapiens
ctggccaggcttgggacagaca

SEQ ID NO: 8308496 - DNA, 22 bp, Homo sapiens
agtttatgtaaaattagtaatg

SEQ ID NO: 8308497 - DNA, 22 bp, Homo sapiens
agtttatgtagaattggcaata

SEQ ID NO: 8308498 - DNA, 22 bp, Homo sapiens
agtgttccttgctttcccagag

SEQ ID NO: 8308499 - DNA, 20 bp, Homo sapiens
agtgttccggaagactggca

SEQ ID NO: 8308500 - DNA, 22 bp, Homo sapiens
agtgttcctgctctcaggaagc

SEQ ID NO: 8308501 - DNA, 22 bp, Homo sapiens
agtgttccacacatctggggaa

SEQ ID NO: 8308502 - DNA, 23 bp, Homo sapiens
agtgttccagttggttgagagtg

SEQ ID NO: 8308503 - DNA, 22 bp, Homo sapiens
agttttattccaatgtgcagca

SEQ ID NO: 8308504 - DNA, 22 bp, Homo sapiens
ctgagtctcccggcagtggagg

SEQ ID NO: 8308505 - DNA, 22 bp, Homo sapiens
agtttcatattaccatgtcacc

SEQ ID NO: 8308506 - DNA, 22 bp, Homo sapiens
ctgccctggtcccatggctgat

SEQ ID NO: 8308507 - DNA, 22 bp, Homo sapiens
ctgccctgactgaccttttgaa

SEQ ID NO: 8308508 - DNA, 22 bp, Homo sapiens
ctgccctgacctgcctcagagt

SEQ ID NO: 8308509 - DNA, 22 bp, Homo sapiens
ctgccctgtctttttctgatga

SEQ ID NO: 8308510 - DNA, 22 bp, Homo sapiens
ctgccctgtgagggtccttggg

SEQ ID NO: 8308511 - DNA, 22 bp, Homo sapiens
ctgccctgtgagggtccttggg

SEQ ID NO: 8308512 - DNA, 22 bp, Homo sapiens
ctgccctgtggctctgagtcat

SEQ ID NO: 8308513 - DNA, 22 bp, Homo sapiens
ctgccctgtggctctgagtcat

SEQ ID NO: 8308514 - DNA, 22 bp, Homo sapiens
ctgccctgtctgcagcctggct

SEQ ID NO: 8308515 - DNA, 22 bp, Homo sapiens
ctgccctgtatcttctcccaat

SEQ ID NO: 8308516 - DNA, 22 bp, Homo sapiens
ctgccctgtttggacagcccgg

SEQ ID NO: 8308517 - DNA, 22 bp, Homo sapiens
ataagttcaggtaaagaaatca

SEQ ID NO: 8308518 - DNA, 22 bp, Homo sapiens
ataataacacctgaataggaaa

SEQ ID NO: 8308519 - DNA, 23 bp, Homo sapiens
ataataacgtctgtcttgtctct

SEQ ID NO: 8308520 - DNA, 22 bp, Homo sapiens
ataataaaccaggatgggtctg

SEQ ID NO: 8308521 - DNA, 22 bp, Homo sapiens
ctgcctgctgcctgtggagggt

SEQ ID NO: 8308522 - DNA, 22 bp, Homo sapiens
ctgcctgctgcctgtggagggt

SEQ ID NO: 8308523 - DNA, 22 bp, Homo sapiens
ctgcctgcttttctgggagccg

SEQ ID NO: 8308524 - DNA, 22 bp, Homo sapiens
ctgcctgcttctgagccagagg

SEQ ID NO: 8308525 - DNA, 22 bp, Homo sapiens
atatcacaaacaagtctgtact

SEQ ID NO: 8308526 - DNA, 22 bp, Homo sapiens
atagtcttagtctatagttttg

SEQ ID NO: 8308527 - DNA, 22 bp, Homo sapiens
atagtcttagatcagataaagt

SEQ ID NO: 8308528 - DNA, 22 bp, Homo sapiens
atagtatttaatagttagctca

SEQ ID NO: 8308529 - DNA, 19 bp, Homo sapiens
atagtctttccaattatac

SEQ ID NO: 8308530 - DNA, 22 bp, Homo sapiens
ctgggccatcagaggggctgga

SEQ ID NO: 8308531 - DNA, 22 bp, Homo sapiens
ctgggccagggaggtgtctgta

SEQ ID NO: 8308532 - DNA, 22 bp, Homo sapiens
ctgggccagtctcggccgctct

SEQ ID NO: 8308533 - DNA, 22 bp, Homo sapiens
ctgggccagggaggtgtctgta

SEQ ID NO: 8308534 - DNA, 22 bp, Homo sapiens
ctgggccatggaagtctctgcc

SEQ ID NO: 8308535 - DNA, 22 bp, Homo sapiens
ctgggctgtaatgtggcactga

SEQ ID NO: 8308536 - DNA, 22 bp, Homo sapiens
ctgggcctgggaggccaggtct

SEQ ID NO: 8308537 - DNA, 22 bp, Homo sapiens
ctgggcctgggaggccaggtct

SEQ ID NO: 8308538 - DNA, 22 bp, Homo sapiens
ctgggcctggcgttccaggctg

SEQ ID NO: 8308539 - DNA, 22 bp, Homo sapiens
ctgtatttagttaaaatgctaa

SEQ ID NO: 8308540 - DNA, 20 bp, Homo sapiens
ctgtatcaggttacaaagta

SEQ ID NO: 8308541 - DNA, 22 bp, Homo sapiens
ctgtaattcactagggtcagcg

SEQ ID NO: 8308542 - DNA, 22 bp, Homo sapiens
ctgggctgtcccaaccccatcc

SEQ ID NO: 8308543 - DNA, 22 bp, Homo sapiens
ctgggctgtcaatggccctctg

SEQ ID NO: 8308544 - DNA, 22 bp, Homo sapiens
ctgggctgtcaatggccctctg

SEQ ID NO: 8308545 - DNA, 22 bp, Homo sapiens
ctgggctgtggtgtggcccaaa

SEQ ID NO: 8308546 - DNA, 22 bp, Homo sapiens
ctgggctgtggtgtggcccaaa

SEQ ID NO: 8308547 - DNA, 22 bp, Homo sapiens
ctggggaggcagggctgcccct

SEQ ID NO: 8308548 - DNA, 22 bp, Homo sapiens
ctgggctgttctgcccctgggt

SEQ ID NO: 8308549 - DNA, 22 bp, Homo sapiens
ctggtgggagcagcaggcagct

SEQ ID NO: 8308550 - DNA, 22 bp, Homo sapiens
ctggtgggaggcaaggtggaag

SEQ ID NO: 8308551 - DNA, 17 bp, Homo sapiens
ctggggatgtgggactc

SEQ ID NO: 8308552 - DNA, 22 bp, Homo sapiens
ctggtcctccttgccttcagat

SEQ ID NO: 8308553 - DNA, 19 bp, Homo sapiens
ctggtcctgactgaggggt

SEQ ID NO: 8308554 - DNA, 19 bp, Homo sapiens
ctggtgcttgagtgagtca

SEQ ID NO: 8308555 - DNA, 22 bp, Homo sapiens
ctggtccttgacgcgtgggagg

SEQ ID NO: 8308556 - DNA, 22 bp, Homo sapiens
ctgtgtccccctcagccaggtg

SEQ ID NO: 8308557 - DNA, 22 bp, Homo sapiens
ctgtgtcccttgtcccagagcc

SEQ ID NO: 8308558 - DNA, 22 bp, Homo sapiens
ctgtgtcccagtaccttgggta

SEQ ID NO: 8308559 - DNA, 22 bp, Homo sapiens
atcattccacatgtaccactag

SEQ ID NO: 8308560 - DNA, 22 bp, Homo sapiens
ctgtttatccctttggtcagca

SEQ ID NO: 8308561 - DNA, 22 bp, Homo sapiens
ctgtttatctaggagttgcagg

SEQ ID NO: 8308562 - DNA, 22 bp, Homo sapiens
ctgtttattacactggatagca

SEQ ID NO: 8308563 - DNA, 22 bp, Homo sapiens
ctgtgcctaagatgcatgtctc

SEQ ID NO: 8308564 - DNA, 20 bp, Homo sapiens
ctgtgcctaaacctccgggt

SEQ ID NO: 8308565 - DNA, 22 bp, Homo sapiens
ctgtgcctaagatgcatgtctc

SEQ ID NO: 8308566 - DNA, 19 bp, Homo sapiens
ctgtgcaggccgggctgag

SEQ ID NO: 8308567 - DNA, 22 bp, Homo sapiens
ctgtgcctggggggcagagctg

SEQ ID NO: 8308568 - DNA, 22 bp, Homo sapiens
ctgtgcctggggggcagagctg

SEQ ID NO: 8308569 - DNA, 22 bp, Homo sapiens
ctgtgcctttgtagctgtgcct

SEQ ID NO: 8308570 - DNA, 22 bp, Homo sapiens
ctgtgcctttgtagctgtgcct

SEQ ID NO: 8308571 - DNA, 22 bp, Homo sapiens
atccttcaaggggctgacagct

SEQ ID NO: 8308572 - DNA, 22 bp, Homo sapiens
atctattatgctgagaaactgt

SEQ ID NO: 8308573 - DNA, 18 bp, Homo sapiens
atccttgatgagaggtct

SEQ ID NO: 8308574 - DNA, 21 bp, Homo sapiens
atccttgatcagaagagtgct

SEQ ID NO: 8308575 - DNA, 22 bp, Homo sapiens
atccttgagccaatgactgatt

SEQ ID NO: 8308576 - DNA, 22 bp, Homo sapiens
atccttgagccttatcttttgt

SEQ ID NO: 8308577 - DNA, 22 bp, Homo sapiens
atccttgagaaaataaatgacc

SEQ ID NO: 8308578 - DNA, 22 bp, Homo sapiens
atccttgaacttagacactagg

SEQ ID NO: 8308579 - DNA, 22 bp, Homo sapiens
atccttgaatgactctgccctc

SEQ ID NO: 8308580 - DNA, 22 bp, Homo sapiens
atccttgacacactccagtact

SEQ ID NO: 8308581 - DNA, 22 bp, Homo sapiens
cttcagaggggactcaaagtca

SEQ ID NO: 8308582 - DNA, 22 bp, Homo sapiens
ctgtttccccatgccctgactc

SEQ ID NO: 8308583 - DNA, 22 bp, Homo sapiens
cttcatcaactctaacaaatgt

SEQ ID NO: 8308584 - DNA, 22 bp, Homo sapiens
atctcccagccacagcattctt

SEQ ID NO: 8308585 - DNA, 22 bp, Homo sapiens
agtaataatttatattagggag

SEQ ID NO: 8308586 - DNA, 22 bp, Homo sapiens
agtaatgtcccttaaatgtggt

SEQ ID NO: 8308587 - DNA, 22 bp, Homo sapiens
agtaatgtgcctgaaatacttg

SEQ ID NO: 8308588 - DNA, 22 bp, Homo sapiens
aggttatatgtcatactgaagt

SEQ ID NO: 8308589 - DNA, 22 bp, Homo sapiens
aggtggggttcagtctcagccg

SEQ ID NO: 8308590 - DNA, 22 bp, Homo sapiens
cctggtgccactagagaatgtc

SEQ ID NO: 8308591 - DNA, 22 bp, Homo sapiens
cgtggcctttgagtgagctccc

SEQ ID NO: 8308592 - DNA, 22 bp, Homo sapiens
cgcctgggagtccacacctgct

SEQ ID NO: 8308593 - DNA, 22 bp, Homo sapiens
cgcctgggagtccacacctgct

SEQ ID NO: 8308594 - DNA, 22 bp, Homo sapiens
agtcagtgttctccggagaggc

SEQ ID NO: 8308595 - DNA, 22 bp, Homo sapiens
agtcataattataaacatcagt

SEQ ID NO: 8308596 - DNA, 22 bp, Homo sapiens
ctacacagttctgcctaatggc

SEQ ID NO: 8308597 - DNA, 22 bp, Homo sapiens
aggtgcttggctcgtgcacaca

SEQ ID NO: 8308598 - DNA, 22 bp, Homo sapiens
aggtgcagaaaaaagtccttta

SEQ ID NO: 8308599 - DNA, 22 bp, Homo sapiens
aggtgcagaaaaaagtccttta

SEQ ID NO: 8308600 - DNA, 22 bp, Homo sapiens
cctgggcaggatgggcccggtg

SEQ ID NO: 8308601 - DNA, 19 bp, Homo sapiens
aggtgatgtgactctagaa

SEQ ID NO: 8308602 - DNA, 22 bp, Homo sapiens
aggtgagttggtaggaagtttg

SEQ ID NO: 8308603 - DNA, 22 bp, Homo sapiens
aggtgagttacaggaggaggtc

SEQ ID NO: 8308604 - DNA, 22 bp, Homo sapiens
aggtgagttacaggaggaggtc

SEQ ID NO: 8308605 - DNA, 22 bp, Homo sapiens
aggtgatgtccacagcttgcag

SEQ ID NO: 8308606 - DNA, 22 bp, Homo sapiens
aggtgaggtttgggaggtgtca

SEQ ID NO: 8308607 - DNA, 22 bp, Homo sapiens
aggtgagtgtgactgcaagaga

SEQ ID NO: 8308608 - DNA, 22 bp, Homo sapiens
cctgggcaggtgtggcttcccc

SEQ ID NO: 8308609 - DNA, 22 bp, Homo sapiens
cctgggcagggctggactctca

SEQ ID NO: 8308610 - DNA, 22 bp, Homo sapiens
aggtctggtgttgggcctgaaa

SEQ ID NO: 8308611 - DNA, 22 bp, Homo sapiens
cctggcctttgaacgctagact

SEQ ID NO: 8308612 - DNA, 22 bp, Homo sapiens
cctggccttaagggcagggagc

SEQ ID NO: 8308613 - DNA, 22 bp, Homo sapiens
aggtatagaattgaaagggttt

SEQ ID NO: 8308614 - DNA, 22 bp, Homo sapiens
cctggccttaagggcagggagc

SEQ ID NO: 8308615 - DNA, 22 bp, Homo sapiens
agggtggccatgagggagagat

SEQ ID NO: 8308616 - DNA, 22 bp, Homo sapiens
cctggagctcactgggagccgg

SEQ ID NO: 8308617 - DNA, 22 bp, Homo sapiens
cctggagcccctctggccagcc

SEQ ID NO: 8308618 - DNA, 22 bp, Homo sapiens
cctggagcccctctggccagcc

SEQ ID NO: 8308619 - DNA, 20 bp, Homo sapiens
cctggagcctggaaggagtc

SEQ ID NO: 8308620 - DNA, 22 bp, Homo sapiens
cctggagcgcgggtcaagctgg

SEQ ID NO: 8308621 - DNA, 19 bp, Homo sapiens
agggtggcaaaggagggtg

SEQ ID NO: 8308622 - DNA, 22 bp, Homo sapiens
agggtggcagttactggagcaa

SEQ ID NO: 8308623 - DNA, 22 bp, Homo sapiens
cctgcctgcgtcctctgagggc

SEQ ID NO: 8308624 - DNA, 22 bp, Homo sapiens
agggtggcagttactggagcaa

SEQ ID NO: 8308625 - DNA, 22 bp, Homo sapiens
cctgcctgcggcccgcggggag

SEQ ID NO: 8308626 - DNA, 22 bp, Homo sapiens
cctgcctgcggcccgcggggag

SEQ ID NO: 8308627 - DNA, 22 bp, Homo sapiens
agggtggagggagtccctgagc

SEQ ID NO: 8308628 - DNA, 22 bp, Homo sapiens
aggggctgtggaaaccaactct

SEQ ID NO: 8308629 - DNA, 22 bp, Homo sapiens
cctggagcaggagctgcagagg

SEQ ID NO: 8308630 - DNA, 18 bp, Homo sapiens
cctggacctgtctccttt

SEQ ID NO: 8308631 - DNA, 22 bp, Homo sapiens
cctggagcccaaggcagtgaga

SEQ ID NO: 8308632 - DNA, 22 bp, Homo sapiens
cctggagcaggagctgcagagg

SEQ ID NO: 8308633 - DNA, 22 bp, Homo sapiens
cctgcctgctttctgctttgca

SEQ ID NO: 8308634 - DNA, 22 bp, Homo sapiens
cctgcctgctttctgctttgca

SEQ ID NO: 8308635 - DNA, 22 bp, Homo sapiens
cctgcctgcgtcctctgagggc

SEQ ID NO: 8308636 - DNA, 22 bp, Homo sapiens
cctgcctggagctgagtgtgga

SEQ ID NO: 8308637 - DNA, 22 bp, Homo sapiens
cctgcctggagctgagtgtgga

SEQ ID NO: 8308638 - DNA, 22 bp, Homo sapiens
cctgcctggatcagccatcctg

SEQ ID NO: 8308639 - DNA, 22 bp, Homo sapiens
cctgcctggatcagccatcctg

SEQ ID NO: 8308640 - DNA, 22 bp, Homo sapiens
cctgcctggatcagccatcctg

SEQ ID NO: 8308641 - DNA, 22 bp, Homo sapiens
cctgcctggctgtcagcagagc

SEQ ID NO: 8308642 - DNA, 22 bp, Homo sapiens
cctgcctggctgtcagcagagc

SEQ ID NO: 8308643 - DNA, 22 bp, Homo sapiens
agtggggacttatgccagcatt

SEQ ID NO: 8308644 - DNA, 22 bp, Homo sapiens
agtggggaagagcatgggccct

SEQ ID NO: 8308645 - DNA, 22 bp, Homo sapiens
agtggggaggtccaggccaccc

SEQ ID NO: 8308646 - DNA, 22 bp, Homo sapiens
agtgtctgccaactgcatggtc

SEQ ID NO: 8308647 - DNA, 22 bp, Homo sapiens
agtgtctgccagctgccaggtg

SEQ ID NO: 8308648 - DNA, 22 bp, Homo sapiens
agtgtgtgtttgggcggtttat

SEQ ID NO: 8308649 - DNA, 22 bp, Homo sapiens
ctgaagcacagcatataaataa

SEQ ID NO: 8308650 - DNA, 22 bp, Homo sapiens
ctgaagcaaatgaaacagctct

SEQ ID NO: 8308651 - DNA, 22 bp, Homo sapiens
agtgtgtgcatgcattcgtgca

SEQ ID NO: 8308652 - DNA, 18 bp, Homo sapiens
agtgtgtgccctttcagg

SEQ ID NO: 8308653 - DNA, 22 bp, Homo sapiens
ctgaagccatgtgctcactggt

SEQ ID NO: 8308654 - DNA, 22 bp, Homo sapiens
ctgaagccacgatagcttccta

SEQ ID NO: 8308655 - DNA, 22 bp, Homo sapiens
ctgagagcagggacttgagcca

SEQ ID NO: 8308656 - DNA, 22 bp, Homo sapiens
ctgagagcctcctgttggctag

SEQ ID NO: 8308657 - DNA, 22 bp, Homo sapiens
ctgagaggatgctgcagtggag

SEQ ID NO: 8308658 - DNA, 22 bp, Homo sapiens
ctgagaggcacaaggcatttcg

SEQ ID NO: 8308659 - DNA, 22 bp, Homo sapiens
ctctgagaggtgagaagcagca

SEQ ID NO: 8308660 - DNA, 22 bp, Homo sapiens
ctctgagagagctggtgagcac

SEQ ID NO: 8308661 - DNA, 22 bp, Homo sapiens
ctctgagagcggtctgtggctt

SEQ ID NO: 8308662 - DNA, 22 bp, Homo sapiens
ctctgagaaagctgtgagctaa

SEQ ID NO: 8308663 - DNA, 22 bp, Homo sapiens
ctctgagcagaggccgtggcta

SEQ ID NO: 8308664 - DNA, 22 bp, Homo sapiens
agtgggcagcccaggaggtctt

SEQ ID NO: 8308665 - DNA, 22 bp, Homo sapiens
agtgggcagtgcgctcggatgc

SEQ ID NO: 8308666 - DNA, 22 bp, Homo sapiens
agtgggcatgatctggtgtctg

SEQ ID NO: 8308667 - DNA, 18 bp, Homo sapiens
ctctctgggtgaggacaa

SEQ ID NO: 8308668 - DNA, 22 bp, Homo sapiens
ctctctgggcccagttggcacc

SEQ ID NO: 8308669 - DNA, 22 bp, Homo sapiens
ctctctggcttggcacggagat

SEQ ID NO: 8308670 - DNA, 22 bp, Homo sapiens
ctctctgggggccatgccaaga

SEQ ID NO: 8308671 - DNA, 23 bp, Homo sapiens
ctctctctaccatgtgaggacac

SEQ ID NO: 8308672 - DNA, 22 bp, Homo sapiens
ctctctggcttggcacggagat

SEQ ID NO: 8308673 - DNA, 17 bp, Homo sapiens
agtggcaggcagatggg

SEQ ID NO: 8308674 - DNA, 22 bp, Homo sapiens
agtggcaggaaagtggaagaga

SEQ ID NO: 8308675 - DNA, 22 bp, Homo sapiens
agtggcagccgagcaggagatg

SEQ ID NO: 8308676 - DNA, 22 bp, Homo sapiens
ctctctggtacatagagtttgg

SEQ ID NO: 8308677 - DNA, 22 bp, Homo sapiens
agtctgcactcaggtggaggtc

SEQ ID NO: 8308678 - DNA, 22 bp, Homo sapiens
agtcatatgtggcattttctaa

SEQ ID NO: 8308679 - DNA, 22 bp, Homo sapiens
ctcaggatattgggctggagca

SEQ ID NO: 8308680 - DNA, 22 bp, Homo sapiens
ctcaggatagctgcgcagcctg

SEQ ID NO: 8308681 - DNA, 22 bp, Homo sapiens
ctcaggatagattgtcctctca

SEQ ID NO: 8308682 - DNA, 20 bp, Homo sapiens
ctcaggatactgcaaagttg

SEQ ID NO: 8308683 - DNA, 22 bp, Homo sapiens
ctcaggatgcaattccatcaag

SEQ ID NO: 8308684 - DNA, 22 bp, Homo sapiens
ctcaggatgaaagtcatggtga

SEQ ID NO: 8308685 - DNA, 21 bp, Homo sapiens
ctcaggatcttatatattagt

SEQ ID NO: 8308686 - DNA, 22 bp, Homo sapiens
ctcaggatcgcttgccctaggg

SEQ ID NO: 8308687 - DNA, 22 bp, Homo sapiens
ctcaggatccatctcctgccct

SEQ ID NO: 8308688 - DNA, 22 bp, Homo sapiens
ctcaggatgtcggtgactattg

SEQ ID NO: 8308689 - DNA, 22 bp, Homo sapiens
ctcaggattaaggaatctaaat

SEQ ID NO: 8308690 - DNA, 22 bp, Homo sapiens
ctcaggattgtgcctagggaga

SEQ ID NO: 8308691 - DNA, 20 bp, Homo sapiens
ctcaggattgtctagcccct

SEQ ID NO: 8308692 - DNA, 22 bp, Homo sapiens
ctcaggattctcgacactcaca

SEQ ID NO: 8308693 - DNA, 22 bp, Homo sapiens
ctcaggatgtactacagaaggc

SEQ ID NO: 8308694 - DNA, 21 bp, Homo sapiens
ctcaggatggcggcctggtgg

SEQ ID NO: 8308695 - DNA, 22 bp, Homo sapiens
ctcaggatggaagcctacagga

SEQ ID NO: 8308696 - DNA, 22 bp, Homo sapiens
ctcaggatgcaggtcacaggac

SEQ ID NO: 8308697 - DNA, 22 bp, Homo sapiens
ctcaggatttactaatttcaag

SEQ ID NO: 8308698 - DNA, 22 bp, Homo sapiens
ctcaggatttaaaggggcactc

SEQ ID NO: 8308699 - DNA, 22 bp, Homo sapiens
agtgcacagcgtgatgtattgg

SEQ ID NO: 8308700 - DNA, 22 bp, Homo sapiens
agtgcacaccttagtacaaagt

SEQ ID NO: 8308701 - DNA, 22 bp, Homo sapiens
agtgaccaacaatgctgagaag

SEQ ID NO: 8308702 - DNA, 22 bp, Homo sapiens
agtgaccaatcatggttagatt

SEQ ID NO: 8308703 - DNA, 22 bp, Homo sapiens
agtgaccattttcagctagagg

SEQ ID NO: 8308704 - DNA, 22 bp, Homo sapiens
agtgactgggcagggcagggcc

SEQ ID NO: 8308705 - DNA, 22 bp, Homo sapiens
agtgactgacacctgtaatccc

SEQ ID NO: 8308706 - DNA, 22 bp, Homo sapiens
agtgactcactagctctcagtg

SEQ ID NO: 8308707 - DNA, 22 bp, Homo sapiens
ctccagggagctgcgggagcca

SEQ ID NO: 8308708 - DNA, 22 bp, Homo sapiens
ctcccagggtagggagagacta

SEQ ID NO: 8308709 - DNA, 22 bp, Homo sapiens
agtgcagccgagatcaggtgct

SEQ ID NO: 8308710 - DNA, 22 bp, Homo sapiens
ctcctccctgcgattgctctgc

SEQ ID NO: 8308711 - DNA, 22 bp, Homo sapiens
ctcctcctcaaattagcttttg

SEQ ID NO: 8308712 - DNA, 22 bp, Homo sapiens
ctcctccctgcgattgctctgc

SEQ ID NO: 8308713 - DNA, 22 bp, Homo sapiens
ctcctccctctttgccacacat

SEQ ID NO: 8308714 - DNA, 22 bp, Homo sapiens
ctcctccctctttgccacacat

SEQ ID NO: 8308715 - DNA, 22 bp, Homo sapiens
ctcctcccacggtctcaggaag

SEQ ID NO: 8308716 - DNA, 22 bp, Homo sapiens
ctcctctcaggctggatggcgc

SEQ ID NO: 8308717 - DNA, 23 bp, Homo sapiens
ctcctcgtaactctgtggtgggt

SEQ ID NO: 8308718 - DNA, 22 bp, Homo sapiens
caggtgggagccacagcgtaca

SEQ ID NO: 8308719 - DNA, 22 bp, Homo sapiens
caggtgggaccatgatagggca

SEQ ID NO: 8308720 - DNA, 22 bp, Homo sapiens
caggtggcttctccctaggcca

SEQ ID NO: 8308721 - DNA, 22 bp, Homo sapiens
aggacaggattgagctgaactg

SEQ ID NO: 8308722 - DNA, 22 bp, Homo sapiens
aggaccaacatagcagcagtgg

SEQ ID NO: 8308723 - DNA, 22 bp, Homo sapiens
caggtgggagcgaggagctact

SEQ ID NO: 8308724 - DNA, 22 bp, Homo sapiens
caggtgggagcggagactgatt

SEQ ID NO: 8308725 - DNA, 22 bp, Homo sapiens
aggaccagtatgagagcatctg

SEQ ID NO: 8308726 - DNA, 22 bp, Homo sapiens
aggaccagaggccagagtcagc

SEQ ID NO: 8308727 - DNA, 22 bp, Homo sapiens
aggaccagcctccaggtctctt

SEQ ID NO: 8308728 - DNA, 22 bp, Homo sapiens
aggacctgactggctcctgctt

SEQ ID NO: 8308729 - DNA, 22 bp, Homo sapiens
aggacctgtagggcctgcatcc

SEQ ID NO: 8308730 - DNA, 22 bp, Homo sapiens
aggacctgtacctcagcatcta

SEQ ID NO: 8308731 - DNA, 22 bp, Homo sapiens
aggacccagaggcagaggacgt

SEQ ID NO: 8308732 - DNA, 22 bp, Homo sapiens
aggaccctgagcgggcatgccg

SEQ ID NO: 8308733 - DNA, 22 bp, Homo sapiens
cagtgcctcttaagtgtcaccc

SEQ ID NO: 8308734 - DNA, 21 bp, Homo sapiens
cagtgctcaatctgacagtgg

SEQ ID NO: 8308735 - DNA, 22 bp, Homo sapiens
cagtgctcctgatgtacccttg

SEQ ID NO: 8308736 - DNA, 19 bp, Homo sapiens
aggactctggaggcatgag

SEQ ID NO: 8308737 - DNA, 22 bp, Homo sapiens
aggactccatgtgtcctggaga

SEQ ID NO: 8308738 - DNA, 22 bp, Homo sapiens
aggactcatccctgcttgtcag

SEQ ID NO: 8308739 - DNA, 22 bp, Homo sapiens
cagtggccatggtggcaggggt

SEQ ID NO: 8308740 - DNA, 22 bp, Homo sapiens
cagtggccatggtggcaggggt

SEQ ID NO: 8308741 - DNA, 22 bp, Homo sapiens
cagtggcctgagccaggcttcc

SEQ ID NO: 8308742 - DNA, 19 bp, Homo sapiens
cagtggcctggaggtctct

SEQ ID NO: 8308743 - DNA, 22 bp, Homo sapiens
cagtggcatggttgactgcagt

SEQ ID NO: 8308744 - DNA, 22 bp, Homo sapiens
aggagaagtaaggctagatgat

SEQ ID NO: 8308745 - DNA, 22 bp, Homo sapiens
aggagaaggaagtgcatcacta

SEQ ID NO: 8308746 - DNA, 22 bp, Homo sapiens
aggagaagtaaggctagatgat

SEQ ID NO: 8308747 - DNA, 22 bp, Homo sapiens
catagcaacagcatcaagtcaa

SEQ ID NO: 8308748 - DNA, 22 bp, Homo sapiens
cagtgggtggctaagtggctga

SEQ ID NO: 8308749 - DNA, 22 bp, Homo sapiens
cagtggcgtgatctctgctcac

SEQ ID NO: 8308750 - DNA, 22 bp, Homo sapiens
cagtggtggaatgaggaattgt

SEQ ID NO: 8308751 - DNA, 22 bp, Homo sapiens
cagtggtgaagagcaggggctc

SEQ ID NO: 8308752 - DNA, 22 bp, Homo sapiens
cagtggtctgtgcttctgtaca

SEQ ID NO: 8308753 - DNA, 22 bp, Homo sapiens
cagtttctctcaataagcatcg

SEQ ID NO: 8308754 - DNA, 22 bp, Homo sapiens
cagtttctacgacttaagcaca

SEQ ID NO: 8308755 - DNA, 22 bp, Homo sapiens
aggcactgtggaagacatggtt

SEQ ID NO: 8308756 - DNA, 22 bp, Homo sapiens
aggcactggtctaccccttagt

SEQ ID NO: 8308757 - DNA, 22 bp, Homo sapiens
aggcactgtactaggtacaggg

SEQ ID NO: 8308758 - DNA, 22 bp, Homo sapiens
aggcactgtgcagtcccaagca

SEQ ID NO: 8308759 - DNA, 22 bp, Homo sapiens
aggcactgtgctgatgtcttat

SEQ ID NO: 8308760 - DNA, 22 bp, Homo sapiens
aggcactgtgctgatgtcttat

SEQ ID NO: 8308761 - DNA, 15 bp, Homo sapiens
aggcactgtgggacc

SEQ ID NO: 8308762 - DNA, 22 bp, Homo sapiens
aggcactgtgcttcttatatgt

SEQ ID NO: 8308763 - DNA, 22 bp, Homo sapiens
aggcactgtggaagacatggtt

SEQ ID NO: 8308764 - DNA, 22 bp, Homo sapiens
ccaaggagaaatgctgtgcttt

SEQ ID NO: 8308765 - DNA, 22 bp, Homo sapiens
ccaagggctctgacttgcctgc

SEQ ID NO: 8308766 - DNA, 22 bp, Homo sapiens
ccaaggagaatgacaccatgga

SEQ ID NO: 8308767 - DNA, 22 bp, Homo sapiens
ccaagggctgctgaggtgtcca

SEQ ID NO: 8308768 - DNA, 22 bp, Homo sapiens
aggcagcagggccactggctga

SEQ ID NO: 8308769 - DNA, 22 bp, Homo sapiens
catggactctggtttggggagc

SEQ ID NO: 8308770 - DNA, 22 bp, Homo sapiens
catggcagaaacctgagctgct

SEQ ID NO: 8308771 - DNA, 21 bp, Homo sapiens
aggagggcacaaggccaggaa

SEQ ID NO: 8308772 - DNA, 22 bp, Homo sapiens
catgtacattctgtagatggag

SEQ ID NO: 8308773 - DNA, 18 bp, Homo sapiens
catgggtgacaggtggat

SEQ ID NO: 8308774 - DNA, 22 bp, Homo sapiens
aggcactgcagattacaggcgc

SEQ ID NO: 8308775 - DNA, 22 bp, Homo sapiens
catggggagacacctagggaaa

SEQ ID NO: 8308776 - DNA, 22 bp, Homo sapiens
catgggctttggaggctggagg

SEQ ID NO: 8308777 - DNA, 22 bp, Homo sapiens
agctgcagattctatctagaag

SEQ ID NO: 8308778 - DNA, 22 bp, Homo sapiens
caggaagagaacatggaggctg

SEQ ID NO: 8308779 - DNA, 18 bp, Homo sapiens
agctgcagaccaggaggt

SEQ ID NO: 8308780 - DNA, 22 bp, Homo sapiens
agctgcagaggtttgtgcaaca

SEQ ID NO: 8308781 - DNA, 22 bp, Homo sapiens
agctgccaagtttctcagttta

SEQ ID NO: 8308782 - DNA, 22 bp, Homo sapiens
agctgccacagagcctggccag

SEQ ID NO: 8308783 - DNA, 22 bp, Homo sapiens
agctgccacatgcccaagggca

SEQ ID NO: 8308784 - DNA, 22 bp, Homo sapiens
agctgccaagttggagtagcaa

SEQ ID NO: 8308785 - DNA, 22 bp, Homo sapiens
agctgccaagttggagtagcaa

SEQ ID NO: 8308786 - DNA, 22 bp, Homo sapiens
caggaaggcccacctgtcctgt

SEQ ID NO: 8308787 - DNA, 22 bp, Homo sapiens
agctgattccactttttcccca

SEQ ID NO: 8308788 - DNA, 22 bp, Homo sapiens
cagctgagaccagaatgcaggt

SEQ ID NO: 8308789 - DNA, 22 bp, Homo sapiens
cagctgagaccagaatgcaggt

SEQ ID NO: 8308790 - DNA, 22 bp, Homo sapiens
cagctctgggtgacaggagggc

SEQ ID NO: 8308791 - DNA, 22 bp, Homo sapiens
cagctctgtaaattccttcatc

SEQ ID NO: 8308792 - DNA, 22 bp, Homo sapiens
cagctgaattcttcagactcca

SEQ ID NO: 8308793 - DNA, 22 bp, Homo sapiens
caggcactggggatgctgggat

SEQ ID NO: 8308794 - DNA, 22 bp, Homo sapiens
caggcactgtgcaagggtctcg

SEQ ID NO: 8308795 - DNA, 22 bp, Homo sapiens
caggcactgtgctagatccttg

SEQ ID NO: 8308796 - DNA, 22 bp, Homo sapiens
caggcactgtgctagatccttg

SEQ ID NO: 8308797 - DNA, 22 bp, Homo sapiens
caggcactcattcagagaggtg

SEQ ID NO: 8308798 - DNA, 22 bp, Homo sapiens
caggcactggccagtcagcaca

SEQ ID NO: 8308799 - DNA, 22 bp, Homo sapiens
agctgctgcgcctcaccctggc

SEQ ID NO: 8308800 - DNA, 22 bp, Homo sapiens
agctgctgcggaaagatgccac

SEQ ID NO: 8308801 - DNA, 22 bp, Homo sapiens
caggaggaggtgaggtagaact

SEQ ID NO: 8308802 - DNA, 22 bp, Homo sapiens
agctgctgagccaggctgatgt

SEQ ID NO: 8308803 - DNA, 22 bp, Homo sapiens
caggaggattgcttgaggccag

SEQ ID NO: 8308804 - DNA, 22 bp, Homo sapiens
caggagccccaggctgacaata

SEQ ID NO: 8308805 - DNA, 22 bp, Homo sapiens
agctgccactgagggtgcacag

SEQ ID NO: 8308806 - DNA, 22 bp, Homo sapiens
agctgccacctctgcctttggg

SEQ ID NO: 8308807 - DNA, 21 bp, Homo sapiens
agctgccaccctagcttctga

SEQ ID NO: 8308808 - DNA, 22 bp, Homo sapiens
agctgccacatggtgtcactgt

SEQ ID NO: 8308809 - DNA, 22 bp, Homo sapiens
caggccaggctgcatttgcccc

SEQ ID NO: 8308810 - DNA, 20 bp, Homo sapiens
caggccagaggtttgatggc

SEQ ID NO: 8308811 - DNA, 22 bp, Homo sapiens
agctggccctcgagagccaatt

SEQ ID NO: 8308812 - DNA, 18 bp, Homo sapiens
agctggccctggctgccg

SEQ ID NO: 8308813 - DNA, 22 bp, Homo sapiens
caggcactgtgctgagctctgc

SEQ ID NO: 8308814 - DNA, 22 bp, Homo sapiens
caggcactgtgttaggcactgt

SEQ ID NO: 8308815 - DNA, 22 bp, Homo sapiens
caggcacttctgctgcttgtct

SEQ ID NO: 8308816 - DNA, 22 bp, Homo sapiens
caggtgacctttgtcctaagtt

SEQ ID NO: 8308817 - DNA, 22 bp, Homo sapiens
cagggtgcgccactcagatgta

SEQ ID NO: 8308818 - DNA, 22 bp, Homo sapiens
cagggtgcctcccgctcgccgg

SEQ ID NO: 8308819 - DNA, 22 bp, Homo sapiens
cagggtgccaaagaacaaatat

SEQ ID NO: 8308820 - DNA, 22 bp, Homo sapiens
cagggtgcctgtcctcagcaaa

SEQ ID NO: 8308821 - DNA, 22 bp, Homo sapiens
caggggctgtgggcggagcctc

SEQ ID NO: 8308822 - DNA, 22 bp, Homo sapiens
cagggtgactgccctggccact

SEQ ID NO: 8308823 - DNA, 22 bp, Homo sapiens
cagggtgcagtgtcgctgctag

SEQ ID NO: 8308824 - DNA, 22 bp, Homo sapiens
caggggctctgggtgatgtgag

SEQ ID NO: 8308825 - DNA, 22 bp, Homo sapiens
caggggctctaatgcatgatca

SEQ ID NO: 8308826 - DNA, 22 bp, Homo sapiens
caggggctctgagattgtctaa

SEQ ID NO: 8308827 - DNA, 22 bp, Homo sapiens
caggggctccctgggtgccagt

SEQ ID NO: 8308828 - DNA, 22 bp, Homo sapiens
caggggctctaatgcatgatca

SEQ ID NO: 8308829 - DNA, 22 bp, Homo sapiens
caggggctgtggcacatggtgt

SEQ ID NO: 8308830 - DNA, 22 bp, Homo sapiens
caggggctgagaaggaacgtcc

SEQ ID NO: 8308831 - DNA, 22 bp, Homo sapiens
caggggctgtggcacatggtgt

SEQ ID NO: 8308832 - DNA, 22 bp, Homo sapiens
caggggctagcacttaatgttt

SEQ ID NO: 8308833 - DNA, 22 bp, Homo sapiens
caggggctccctgggtgccagt

SEQ ID NO: 8308834 - DNA, 22 bp, Homo sapiens
caggggctccctgggtgccagt

SEQ ID NO: 8308835 - DNA, 22 bp, Homo sapiens
cagggctccccgcaccgcagcc

SEQ ID NO: 8308836 - DNA, 22 bp, Homo sapiens
cagggcctctcctccaggaact

SEQ ID NO: 8308837 - DNA, 22 bp, Homo sapiens
cagggcctgagggctgctctgc

SEQ ID NO: 8308838 - DNA, 22 bp, Homo sapiens
cagggcctccccggcagtcttt

SEQ ID NO: 8308839 - DNA, 23 bp, Homo sapiens
cagggccaggcagcagctgtcac

SEQ ID NO: 8308840 - DNA, 22 bp, Homo sapiens
cagggcctcctaaggcatctaa

SEQ ID NO: 8308841 - DNA, 22 bp, Homo sapiens
cagggagctggctggcgtgagt

SEQ ID NO: 8308842 - DNA, 22 bp, Homo sapiens
caggctggagttacctttaggg

SEQ ID NO: 8308843 - DNA, 22 bp, Homo sapiens
caggctggagtgcagttgtgca

SEQ ID NO: 8308844 - DNA, 22 bp, Homo sapiens
caggctggagtgcagtggtgcc

SEQ ID NO: 8308845 - DNA, 18 bp, Homo sapiens
agctggggcctctggtcc

SEQ ID NO: 8308846 - DNA, 22 bp, Homo sapiens
caggctgagctctggcctgggc

SEQ ID NO: 8308847 - DNA, 22 bp, Homo sapiens
caggctgaggcagtagggtttg

SEQ ID NO: 8308848 - DNA, 22 bp, Homo sapiens
caggctgcggtcggctctggtc

SEQ ID NO: 8308849 - DNA, 22 bp, Homo sapiens
aggctctgtgacaatcaagctg

SEQ ID NO: 8308850 - DNA, 22 bp, Homo sapiens
ccagggtgctctgtggcgtcgc

SEQ ID NO: 8308851 - DNA, 22 bp, Homo sapiens
ccagggtggaggctggatggag

SEQ ID NO: 8308852 - DNA, 22 bp, Homo sapiens
ccagggtggaggctggatggag

SEQ ID NO: 8308853 - DNA, 22 bp, Homo sapiens
aggctgcctcgtgagctcgctg

SEQ ID NO: 8308854 - DNA, 22 bp, Homo sapiens
aggctgcctgttccaatctcct

SEQ ID NO: 8308855 - DNA, 23 bp, Homo sapiens
cccagagcacagcctccagatgc

SEQ ID NO: 8308856 - DNA, 19 bp, Homo sapiens
cccagagcatcctgaactt

SEQ ID NO: 8308857 - DNA, 19 bp, Homo sapiens
cccagagcatcctgaactt

SEQ ID NO: 8308858 - DNA, 17 bp, Homo sapiens
aggctggctcacaggga

SEQ ID NO: 8308859 - DNA, 22 bp, Homo sapiens
aggctccttgctcacaggctca

SEQ ID NO: 8308860 - DNA, 22 bp, Homo sapiens
ccagggtcttggagaggagtgc

SEQ ID NO: 8308861 - DNA, 22 bp, Homo sapiens
ccagggtgagaaaaggctggat

SEQ ID NO: 8308862 - DNA, 22 bp, Homo sapiens
ccagggtgagaaaaggctggat

SEQ ID NO: 8308863 - DNA, 22 bp, Homo sapiens
ccagggtgagaaaaggctggat

SEQ ID NO: 8308864 - DNA, 22 bp, Homo sapiens
ccagggtgaccctcccggtggc

SEQ ID NO: 8308865 - DNA, 22 bp, Homo sapiens
ccagggtgaccagctggcctag

SEQ ID NO: 8308866 - DNA, 22 bp, Homo sapiens
ccagggtgaccagctggcctag

SEQ ID NO: 8308867 - DNA, 22 bp, Homo sapiens
ccagggtgaggaggctcccacg

SEQ ID NO: 8308868 - DNA, 22 bp, Homo sapiens
ccagggtgagtgtcatgggtta

SEQ ID NO: 8308869 - DNA, 22 bp, Homo sapiens
ccagggtgctctgtggcgtcgc

SEQ ID NO: 8308870 - DNA, 22 bp, Homo sapiens
aggctcctatcgctttcagcaa

SEQ ID NO: 8308871 - DNA, 22 bp, Homo sapiens
ccagggagcctggtgtgtcagc

SEQ ID NO: 8308872 - DNA, 22 bp, Homo sapiens
ccaggagctggagggtgcagtg

SEQ ID NO: 8308873 - DNA, 22 bp, Homo sapiens
aggctcattcttgcctctgagc

SEQ ID NO: 8308874 - DNA, 22 bp, Homo sapiens
aggctcagtttggtttccattg

SEQ ID NO: 8308875 - DNA, 22 bp, Homo sapiens
ccagcctccatgtagatagctg

SEQ ID NO: 8308876 - DNA, 22 bp, Homo sapiens
ccagcctgaaatgcctcatcct

SEQ ID NO: 8308877 - DNA, 23 bp, Homo sapiens
ccagcctctgggtcttcatccag

SEQ ID NO: 8308878 - DNA, 22 bp, Homo sapiens
ccagcctgaaatgcctcatcct

SEQ ID NO: 8308879 - DNA, 22 bp, Homo sapiens
ccagccctgccagagagagctg

SEQ ID NO: 8308880 - DNA, 22 bp, Homo sapiens
ccagcttgaagatgtgctggtt

SEQ ID NO: 8308881 - DNA, 22 bp, Homo sapiens
ccagcttgtttgaagctcgtca

SEQ ID NO: 8308882 - DNA, 22 bp, Homo sapiens
ccagcttctctctgatgcagct

SEQ ID NO: 8308883 - DNA, 22 bp, Homo sapiens
ccagcctggactgggtcttgtg

SEQ ID NO: 8308884 - DNA, 22 bp, Homo sapiens
ccagcctggactgggtcttgtg

SEQ ID NO: 8308885 - DNA, 22 bp, Homo sapiens
aggccctggcactgcctgggag

SEQ ID NO: 8308886 - DNA, 18 bp, Homo sapiens
aggccctggcctcgaaca

SEQ ID NO: 8308887 - DNA, 18 bp, Homo sapiens
aggccctggcctcgaaca

SEQ ID NO: 8308888 - DNA, 22 bp, Homo sapiens
aggccctgggcagttctgtagc

SEQ ID NO: 8308889 - DNA, 22 bp, Homo sapiens
ccaggagcaaagatcactggga

SEQ ID NO: 8308890 - DNA, 22 bp, Homo sapiens
ccagcagaagctcccgctgggt

SEQ ID NO: 8308891 - DNA, 22 bp, Homo sapiens
ccagcagacacacaggcgtggg

SEQ ID NO: 8308892 - DNA, 19 bp, Homo sapiens
ccagcagacacagctgccc

SEQ ID NO: 8308893 - DNA, 22 bp, Homo sapiens
ccagcagagcatggggaggaag

SEQ ID NO: 8308894 - DNA, 22 bp, Homo sapiens
aggccagagaggggaccagcct

SEQ ID NO: 8308895 - DNA, 22 bp, Homo sapiens
ccagcagaggggcggagtgcag

SEQ ID NO: 8308896 - DNA, 22 bp, Homo sapiens
ccagagcaattctcacagaact

SEQ ID NO: 8308897 - DNA, 22 bp, Homo sapiens
ccagagtctttatattcctgaa

SEQ ID NO: 8308898 - DNA, 22 bp, Homo sapiens
ccagagtgacgtgaagtgtgaa

SEQ ID NO: 8308899 - DNA, 22 bp, Homo sapiens
aggcaggggagctggaagggta

SEQ ID NO: 8308900 - DNA, 22 bp, Homo sapiens
aggcagggtcttgctatgttgc

SEQ ID NO: 8308901 - DNA, 22 bp, Homo sapiens
ccacaggaccagaggagatcac

SEQ ID NO: 8308902 - DNA, 20 bp, Homo sapiens
ccacaggagtccagtcgacc

SEQ ID NO: 8308903 - DNA, 22 bp, Homo sapiens
cctccccatgacccggtgctgg

SEQ ID NO: 8308904 - DNA, 22 bp, Homo sapiens
agggctctgtccccagaggccc

SEQ ID NO: 8308905 - DNA, 22 bp, Homo sapiens
agggctctggggtggcagagat

SEQ ID NO: 8308906 - DNA, 22 bp, Homo sapiens
agggctctgagtgggaaagagg

SEQ ID NO: 8308907 - DNA, 22 bp, Homo sapiens
agggccctccccgctcagggca

SEQ ID NO: 8308908 - DNA, 22 bp, Homo sapiens
agggccctctggcaggccaggc

SEQ ID NO: 8308909 - DNA, 22 bp, Homo sapiens
cccttttttatgtcaagcattg

SEQ ID NO: 8308910 - DNA, 22 bp, Homo sapiens
ccctttcccttctggctcaggg

SEQ ID NO: 8308911 - DNA, 22 bp, Homo sapiens
ccctttctccagaactgtctga

SEQ ID NO: 8308912 - DNA, 22 bp, Homo sapiens
ccctttctgggacccctgtctc

SEQ ID NO: 8308913 - DNA, 22 bp, Homo sapiens
ccctttttcactctaccaaggt

SEQ ID NO: 8308914 - DNA, 22 bp, Homo sapiens
agggccagaatccctcagtcta

SEQ ID NO: 8308915 - DNA, 22 bp, Homo sapiens
agggccagaggcaccttgcagc

SEQ ID NO: 8308916 - DNA, 22 bp, Homo sapiens
ccctggaggcaaaggttgcagt

SEQ ID NO: 8308917 - DNA, 22 bp, Homo sapiens
ccctggaggcggagcttgcagt

SEQ ID NO: 8308918 - DNA, 22 bp, Homo sapiens
ccctggaggcggatgttgcagt

SEQ ID NO: 8308919 - DNA, 22 bp, Homo sapiens
ccctggagggacagctgctcta

SEQ ID NO: 8308920 - DNA, 22 bp, Homo sapiens
ccctggagggacagctgctcta

SEQ ID NO: 8308921 - DNA, 23 bp, Homo sapiens
agggctgatgccattgcagctct

SEQ ID NO: 8308922 - DNA, 22 bp, Homo sapiens
cctcctggccctgggcctggaa

SEQ ID NO: 8308923 - DNA, 22 bp, Homo sapiens
cctctgggagactgctactgag

SEQ ID NO: 8308924 - DNA, 21 bp, Homo sapiens
cctctggcttgtgctgtgccc

SEQ ID NO: 8308925 - DNA, 22 bp, Homo sapiens
agggctgcaggcaagatatggc

SEQ ID NO: 8308926 - DNA, 22 bp, Homo sapiens
agggctgcaccggggcttcgcg

SEQ ID NO: 8308927 - DNA, 22 bp, Homo sapiens
agggctgcaggcaagatatggc

SEQ ID NO: 8308928 - DNA, 22 bp, Homo sapiens
cctgaggacacacgctgcagga

SEQ ID NO: 8308929 - DNA, 22 bp, Homo sapiens
aggggacacggcttctccaggg

SEQ ID NO: 8308930 - DNA, 21 bp, Homo sapiens
aggggacagagtagctccagg

SEQ ID NO: 8308931 - DNA, 22 bp, Homo sapiens
aggggctgcctggcttggcact

SEQ ID NO: 8308932 - DNA, 22 bp, Homo sapiens
aggggctggagttcgaggttac

SEQ ID NO: 8308933 - DNA, 22 bp, Homo sapiens
aggggctggagttcgaggttac

SEQ ID NO: 8308934 - DNA, 22 bp, Homo sapiens
aggggctgctgggtccgcccct

SEQ ID NO: 8308935 - DNA, 22 bp, Homo sapiens
aggggctgcctggcttggcact

SEQ ID NO: 8308936 - DNA, 22 bp, Homo sapiens
aggggctggcttatctgagagt

SEQ ID NO: 8308937 - DNA, 22 bp, Homo sapiens
aggggctgggacagagccaagc

SEQ ID NO: 8308938 - DNA, 22 bp, Homo sapiens
aggggctgggacagagccaagc

SEQ ID NO: 8308939 - DNA, 22 bp, Homo sapiens
ccctctggctcttctcaggccg

SEQ ID NO: 8308940 - DNA, 22 bp, Homo sapiens
ccctctggctcttctcaggccg

SEQ ID NO: 8308941 - DNA, 22 bp, Homo sapiens
ccctctgctgcctggctgggtc

SEQ ID NO: 8308942 - DNA, 22 bp, Homo sapiens
ccctctgctcaggtgcataggc

SEQ ID NO: 8308943 - DNA, 20 bp, Homo sapiens
ccctctgctacactgggagc

SEQ ID NO: 8308944 - DNA, 22 bp, Homo sapiens
ccctctgcctgcgccctggtgt

SEQ ID NO: 8308945 - DNA, 22 bp, Homo sapiens
ccctctgcctgggaccaagtcc

SEQ ID NO: 8308946 - DNA, 22 bp, Homo sapiens
ccctctgcatacaggcgaggag

SEQ ID NO: 8308947 - DNA, 22 bp, Homo sapiens
ccctctgcctctgagtaggaca

SEQ ID NO: 8308948 - DNA, 20 bp, Homo sapiens
ccctctgcacatggctgtgg

SEQ ID NO: 8308949 - DNA, 22 bp, Homo sapiens
ccctctgcaggctggacctgcc

SEQ ID NO: 8308950 - DNA, 22 bp, Homo sapiens
ccctctgacctcctgccacagt

SEQ ID NO: 8308951 - DNA, 22 bp, Homo sapiens
agggcagaggcggacacggaag

SEQ ID NO: 8308952 - DNA, 22 bp, Homo sapiens
agggcagagctgtctaaatggc

SEQ ID NO: 8308953 - DNA, 20 bp, Homo sapiens
agggcagagggattacaggc

SEQ ID NO: 8308954 - DNA, 22 bp, Homo sapiens
ccctggaaggttctctggctca

SEQ ID NO: 8308955 - DNA, 22 bp, Homo sapiens
ccctggaggagcttagagcttg

SEQ ID NO: 8308956 - DNA, 22 bp, Homo sapiens
agggcagagatctgagtgggca

SEQ ID NO: 8308957 - DNA, 22 bp, Homo sapiens
agggcagagattaattaagaca

SEQ ID NO: 8308958 - DNA, 22 bp, Homo sapiens
agggcagagcactgaattggga

SEQ ID NO: 8308959 - DNA, 22 bp, Homo sapiens
agggcagagagatgaatgggat

SEQ ID NO: 8308960 - DNA, 22 bp, Homo sapiens
agggcagagacatgcttcctga

SEQ ID NO: 8308961 - DNA, 22 bp, Homo sapiens
agggagaacagttgcagcagac

SEQ ID NO: 8308962 - DNA, 22 bp, Homo sapiens
agggagaaaattggatgcacaa

SEQ ID NO: 8308963 - DNA, 22 bp, Homo sapiens
agggactggctctctgagcagg

SEQ ID NO: 8308964 - DNA, 22 bp, Homo sapiens
agggactgagctaggatctagt

SEQ ID NO: 8308965 - DNA, 22 bp, Homo sapiens
agggagtgtaaatggtgctcag

SEQ ID NO: 8308966 - DNA, 22 bp, Homo sapiens
agggatcaaaaaatgtacatgc

SEQ ID NO: 8308967 - DNA, 18 bp, Homo sapiens
agggatcatcactgcagc

SEQ ID NO: 8308968 - DNA, 22 bp, Homo sapiens
agggatggaagctcgtctgcaa

SEQ ID NO: 8308969 - DNA, 22 bp, Homo sapiens
agggaagaagctggtagtaggt

SEQ ID NO: 8308970 - DNA, 22 bp, Homo sapiens
agggaagaaaatccatcgctgc

SEQ ID NO: 8308971 - DNA, 22 bp, Homo sapiens
cccagggccctggacagctaca

SEQ ID NO: 8308972 - DNA, 22 bp, Homo sapiens
cccagggcttttctcactagac

SEQ ID NO: 8308973 - DNA, 22 bp, Homo sapiens
agggaaattaatgtgagcaatg

SEQ ID NO: 8308974 - DNA, 22 bp, Homo sapiens
cccaggagtttgagttcagcat

SEQ ID NO: 8308975 - DNA, 22 bp, Homo sapiens
cccaggagttggaggctgcagt

SEQ ID NO: 8308976 - DNA, 22 bp, Homo sapiens
aggcttcttagattggctggag

SEQ ID NO: 8308977 - DNA, 18 bp, Homo sapiens
aggcttcttggctcagtc

SEQ ID NO: 8308978 - DNA, 22 bp, Homo sapiens
aggcttctagggttggcagcgg

SEQ ID NO: 8308979 - DNA, 22 bp, Homo sapiens
aggcttctacgtggtcccaggg

SEQ ID NO: 8308980 - DNA, 22 bp, Homo sapiens
aggcttcctggaggaagaggta

SEQ ID NO: 8308981 - DNA, 22 bp, Homo sapiens
aggcttcctcgtgccttagata

SEQ ID NO: 8308982 - DNA, 22 bp, Homo sapiens
gccttcccaccctgcgaggctg

SEQ ID NO: 8308983 - DNA, 22 bp, Homo sapiens
gccttccttacacctgctcagc

SEQ ID NO: 8308984 - DNA, 22 bp, Homo sapiens
gccttcctgcagctctgagcgt

SEQ ID NO: 8308985 - DNA, 22 bp, Homo sapiens
gccttccttacacctgctcagc

SEQ ID NO: 8308986 - DNA, 22 bp, Homo sapiens
gccttcctgcagctctgagcgt

SEQ ID NO: 8308987 - DNA, 22 bp, Homo sapiens
gccttcctgcagctctgagcgt

SEQ ID NO: 8308988 - DNA, 22 bp, Homo sapiens
gcctgtgcttaactgacgtgag

SEQ ID NO: 8308989 - DNA, 22 bp, Homo sapiens
atttgtctagtggtattcacgt

SEQ ID NO: 8308990 - DNA, 22 bp, Homo sapiens
atttgtctctgcactttactca

SEQ ID NO: 8308991 - DNA, 22 bp, Homo sapiens
atttgtagtgaagtgaaaataa

SEQ ID NO: 8308992 - DNA, 22 bp, Homo sapiens
atttgtaatttcttatctgtgt

SEQ ID NO: 8308993 - DNA, 22 bp, Homo sapiens
atttgtacaaatttatgttagt

SEQ ID NO: 8308994 - DNA, 22 bp, Homo sapiens
gctctgctgtgtttgttcagca

SEQ ID NO: 8308995 - DNA, 22 bp, Homo sapiens
gctctgctgtcttcttgcaggc

SEQ ID NO: 8308996 - DNA, 22 bp, Homo sapiens
gctctgagagtgggtgattctg

SEQ ID NO: 8308997 - DNA, 22 bp, Homo sapiens
gctctgctgggtgggcagttat

SEQ ID NO: 8308998 - DNA, 22 bp, Homo sapiens
gctcccagggcagcgcagaaga

SEQ ID NO: 8308999 - DNA, 22 bp, Homo sapiens
gctcccagttcccaaagtgacc

SEQ ID NO: 8309000 - DNA, 22 bp, Homo sapiens
gctcccagggaccgcagggcag

SEQ ID NO: 8309001 - DNA, 22 bp, Homo sapiens
gccttccttttaccaccagcca

SEQ ID NO: 8309002 - DNA, 17 bp, Homo sapiens
gccttccttcctccaca

SEQ ID NO: 8309003 - DNA, 22 bp, Homo sapiens
caaaagatacttgcatctaact

SEQ ID NO: 8309004 - DNA, 22 bp, Homo sapiens
gctcagagaatcagcagacacc

SEQ ID NO: 8309005 - DNA, 22 bp, Homo sapiens
atttatcaccagttagctgact

SEQ ID NO: 8309006 - DNA, 22 bp, Homo sapiens
atttatgactggtgaatagaac

SEQ ID NO: 8309007 - DNA, 22 bp, Homo sapiens
gccagctggagactggcagggg

SEQ ID NO: 8309008 - DNA, 22 bp, Homo sapiens
gccagctggagtgagagtgggc

SEQ ID NO: 8309009 - DNA, 22 bp, Homo sapiens
gccatcatatcccctgtgacct

SEQ ID NO: 8309010 - DNA, 22 bp, Homo sapiens
atttattatgggatttggcaca

SEQ ID NO: 8309011 - DNA, 22 bp, Homo sapiens
atttatgtatctgtgtagatca

SEQ ID NO: 8309012 - DNA, 22 bp, Homo sapiens
attgtacatgcagtgagtcatc

SEQ ID NO: 8309013 - DNA, 22 bp, Homo sapiens
gccatcctctgagcactaggca

SEQ ID NO: 8309014 - DNA, 22 bp, Homo sapiens
gccatgcctgtgtctccaggcc

SEQ ID NO: 8309015 - DNA, 22 bp, Homo sapiens
atttcttcaggtcagaaataga

SEQ ID NO: 8309016 - DNA, 18 bp, Homo sapiens
gccctggtggagctggtg

SEQ ID NO: 8309017 - DNA, 22 bp, Homo sapiens
gccctgtcggaactgcgacctc

SEQ ID NO: 8309018 - DNA, 22 bp, Homo sapiens
gccctgtcccttggcttctagg

SEQ ID NO: 8309019 - DNA, 23 bp, Homo sapiens
atttcctactataaaagaggtaa

SEQ ID NO: 8309020 - DNA, 22 bp, Homo sapiens
attatgtatttggtatagtttg

SEQ ID NO: 8309021 - DNA, 22 bp, Homo sapiens
attatgtagctaaaaattgtgt

SEQ ID NO: 8309022 - DNA, 22 bp, Homo sapiens
attatgtaggttaggtggttgt

SEQ ID NO: 8309023 - DNA, 22 bp, Homo sapiens
attatgtaactgtggttcagca

SEQ ID NO: 8309024 - DNA, 22 bp, Homo sapiens
gcacccagaataaggacaggac

SEQ ID NO: 8309025 - DNA, 22 bp, Homo sapiens
gcagagactccactgtcttgtg

SEQ ID NO: 8309026 - DNA, 22 bp, Homo sapiens
gcacacaggcagtttccagcca

SEQ ID NO: 8309027 - DNA, 22 bp, Homo sapiens
gcacacagccagctgagggcta

SEQ ID NO: 8309028 - DNA, 22 bp, Homo sapiens
gcacacagattaggaaacagaa

SEQ ID NO: 8309029 - DNA, 22 bp, Homo sapiens
gcacagggcctggcacataaga

SEQ ID NO: 8309030 - DNA, 22 bp, Homo sapiens
gcaccaggcttagagccccagg

SEQ ID NO: 8309031 - DNA, 22 bp, Homo sapiens
attatattgagtataaccagag

SEQ ID NO: 8309032 - DNA, 22 bp, Homo sapiens
gagtggggcgaagtcggcgagt

SEQ ID NO: 8309033 - DNA, 22 bp, Homo sapiens
gagtggggcgtggatccagcgt

SEQ ID NO: 8309034 - DNA, 22 bp, Homo sapiens
gagtggggcccactgctgggtg

SEQ ID NO: 8309035 - DNA, 22 bp, Homo sapiens
gagtggggcccactgctgggtg

SEQ ID NO: 8309036 - DNA, 22 bp, Homo sapiens
gatggcacacagacatccccgc

SEQ ID NO: 8309037 - DNA, 22 bp, Homo sapiens
gatggcagtcaaccaggtgagg

SEQ ID NO: 8309038 - DNA, 22 bp, Homo sapiens
gatggcaggtagtggtctcatc

SEQ ID NO: 8309039 - DNA, 22 bp, Homo sapiens
gattctgagctggtgttttacg

SEQ ID NO: 8309040 - DNA, 22 bp, Homo sapiens
gatgtgagtggtagctgggatt

SEQ ID NO: 8309041 - DNA, 22 bp, Homo sapiens
gatgtggggttgagggaccagc

SEQ ID NO: 8309042 - DNA, 22 bp, Homo sapiens
gcaggcaggagcccaactgcct

SEQ ID NO: 8309043 - DNA, 22 bp, Homo sapiens
gcaggcaggcttccttgaactg

SEQ ID NO: 8309044 - DNA, 22 bp, Homo sapiens
gcaggcaggcttccttgaactg

SEQ ID NO: 8309045 - DNA, 22 bp, Homo sapiens
gcagctgtgtaatgagcccaca

SEQ ID NO: 8309046 - DNA, 22 bp, Homo sapiens
gcagcttggatttctgtagttt

SEQ ID NO: 8309047 - DNA, 22 bp, Homo sapiens
gcagcttggtgaaaggtgatgg

SEQ ID NO: 8309048 - DNA, 22 bp, Homo sapiens
attctccacacatccagacctt

SEQ ID NO: 8309049 - DNA, 22 bp, Homo sapiens
gcagctgtgggttccaagtcta

SEQ ID NO: 8309050 - DNA, 19 bp, Homo sapiens
gcagctgtgggaagagcca

SEQ ID NO: 8309051 - DNA, 20 bp, Homo sapiens
gcaggcagggaatgggggtg

SEQ ID NO: 8309052 - DNA, 19 bp, Homo sapiens
gcatgcttggtggcttctg

SEQ ID NO: 8309053 - DNA, 22 bp, Homo sapiens
attgcacaaacacagtcagact

SEQ ID NO: 8309054 - DNA, 22 bp, Homo sapiens
attgcaccttgggttttgaaag

SEQ ID NO: 8309055 - DNA, 22 bp, Homo sapiens
gcatggcagtgaggatggtgct

SEQ ID NO: 8309056 - DNA, 22 bp, Homo sapiens
gcagtaaaaaaggatatgtgca

SEQ ID NO: 8309057 - DNA, 22 bp, Homo sapiens
gcaggtgtggagtggggtgagc

SEQ ID NO: 8309058 - DNA, 22 bp, Homo sapiens
gaagctctcaaactctcccctt

SEQ ID NO: 8309059 - DNA, 22 bp, Homo sapiens
gaagcagcaaatctgcagtatc

SEQ ID NO: 8309060 - DNA, 22 bp, Homo sapiens
gaagcagcaagtataggacagg

SEQ ID NO: 8309061 - DNA, 22 bp, Homo sapiens
gaagcagcagctggggacagtt

SEQ ID NO: 8309062 - DNA, 22 bp, Homo sapiens
gaaggagggtgcggatctgagc

SEQ ID NO: 8309063 - DNA, 22 bp, Homo sapiens
atgcagtaaatgttaagaaaaa

SEQ ID NO: 8309064 - DNA, 22 bp, Homo sapiens
atgcagtaaatgttaagaaaaa

SEQ ID NO: 8309065 - DNA, 22 bp, Homo sapiens
atgcagtaaaataggaggtaat

SEQ ID NO: 8309066 - DNA, 22 bp, Homo sapiens
atgcagtaaatgttctagtttg

SEQ ID NO: 8309067 - DNA, 22 bp, Homo sapiens
atgcagtacatacaaacactga

SEQ ID NO: 8309068 - DNA, 22 bp, Homo sapiens
atgcagtacagataattctaca

SEQ ID NO: 8309069 - DNA, 23 bp, Homo sapiens
atgcagtatatgtcagtagttta

SEQ ID NO: 8309070 - DNA, 22 bp, Homo sapiens
atgcagtactgatacatgccac

SEQ ID NO: 8309071 - DNA, 22 bp, Homo sapiens
atgcagtataaatcatttctgg

SEQ ID NO: 8309072 - DNA, 22 bp, Homo sapiens
atgcagtagataggcactttta

SEQ ID NO: 8309073 - DNA, 22 bp, Homo sapiens
atgcagtggcagctcctggtgt

SEQ ID NO: 8309074 - DNA, 22 bp, Homo sapiens
atgatgtgtgctgatcaagctt

SEQ ID NO: 8309075 - DNA, 22 bp, Homo sapiens
atgatggtaaattcagtatccg

SEQ ID NO: 8309076 - DNA, 22 bp, Homo sapiens
atgatggttgtcctaggtgcat

SEQ ID NO: 8309077 - DNA, 22 bp, Homo sapiens
atgatggtgggtaatgtgtaaa

SEQ ID NO: 8309078 - DNA, 22 bp, Homo sapiens
atgatggtgaggttgagcacag

SEQ ID NO: 8309079 - DNA, 22 bp, Homo sapiens
atgatggtgggagatgacccag

SEQ ID NO: 8309080 - DNA, 19 bp, Homo sapiens
atgatggtcccattcacct

SEQ ID NO: 8309081 - DNA, 22 bp, Homo sapiens
atgagctgtaaggtggcttcct

SEQ ID NO: 8309082 - DNA, 22 bp, Homo sapiens
atgagctgtgggattccagagg

SEQ ID NO: 8309083 - DNA, 22 bp, Homo sapiens
atgagctgggccatccagtgat

SEQ ID NO: 8309084 - DNA, 19 bp, Homo sapiens
atgagctggcatttcaggt

SEQ ID NO: 8309085 - DNA, 22 bp, Homo sapiens
atgctatactcaaagaaattca

SEQ ID NO: 8309086 - DNA, 23 bp, Homo sapiens
atgctctgggctgtgggacctgc

SEQ ID NO: 8309087 - DNA, 22 bp, Homo sapiens
atgctctgggcaggagccctgg

SEQ ID NO: 8309088 - DNA, 22 bp, Homo sapiens
atgccactgcactccagcctag

SEQ ID NO: 8309089 - DNA, 22 bp, Homo sapiens
atgccactgcactccagcctgg

SEQ ID NO: 8309090 - DNA, 22 bp, Homo sapiens
atgagactacctgtaatgtggc

SEQ ID NO: 8309091 - DNA, 22 bp, Homo sapiens
atgacagaggagtgcaggtgat

SEQ ID NO: 8309092 - DNA, 22 bp, Homo sapiens
ctttttcaagtcaaagagggta

SEQ ID NO: 8309093 - DNA, 22 bp, Homo sapiens
ctttttcattggctttaggaca

SEQ ID NO: 8309094 - DNA, 19 bp, Homo sapiens
ctttttcaccttctagaag

SEQ ID NO: 8309095 - DNA, 22 bp, Homo sapiens
atgacacaattttagagctgaa

SEQ ID NO: 8309096 - DNA, 22 bp, Homo sapiens
atgacagaaggcctccctgaca

SEQ ID NO: 8309097 - DNA, 20 bp, Homo sapiens
ctttgcctattctctgcctg

SEQ ID NO: 8309098 - DNA, 22 bp, Homo sapiens
atctttgaagaggacttgaagt

SEQ ID NO: 8309099 - DNA, 22 bp, Homo sapiens
ctttatgttggggtgtcttagt

SEQ ID NO: 8309100 - DNA, 22 bp, Homo sapiens
ctttatgttcagtacaatgctt

SEQ ID NO: 8309101 - DNA, 22 bp, Homo sapiens
cttctcctctgagtcctgggag

SEQ ID NO: 8309102 - DNA, 22 bp, Homo sapiens
cttctccctggcttctgcacac

SEQ ID NO: 8309103 - DNA, 18 bp, Homo sapiens
atctttccatagcatgtt

SEQ ID NO: 8309104 - DNA, 22 bp, Homo sapiens
atctttcagtttcataccaatt

SEQ ID NO: 8309105 - DNA, 22 bp, Homo sapiens
atctttcagagctccatcaggg

SEQ ID NO: 8309106 - DNA, 22 bp, Homo sapiens
atggataatggtgatagttgca

SEQ ID NO: 8309107 - DNA, 22 bp, Homo sapiens
gagacagcagggccagggcctg

SEQ ID NO: 8309108 - DNA, 21 bp, Homo sapiens
gagacagcccagtgccagggc

SEQ ID NO: 8309109 - DNA, 22 bp, Homo sapiens
gagaaggtggacctgaaggagc

SEQ ID NO: 8309110 - DNA, 22 bp, Homo sapiens
gagaaggggtgatgtgggtaat

SEQ ID NO: 8309111 - DNA, 22 bp, Homo sapiens
gagaaggggtgatgtgggtaat

SEQ ID NO: 8309112 - DNA, 22 bp, Homo sapiens
gagaagtttctggtttgcatag

SEQ ID NO: 8309113 - DNA, 22 bp, Homo sapiens
atgctgtagatcttagcctcta

SEQ ID NO: 8309114 - DNA, 22 bp, Homo sapiens
gagccctccatggagccaggca

SEQ ID NO: 8309115 - DNA, 19 bp, Homo sapiens
gagccctctccatggccac

SEQ ID NO: 8309116 - DNA, 22 bp, Homo sapiens
gagccctctctgtaggcaagta

SEQ ID NO: 8309117 - DNA, 22 bp, Homo sapiens
atgggatgaacttgatctgctt

SEQ ID NO: 8309118 - DNA, 22 bp, Homo sapiens
atgggatgcatggctgtggcca

SEQ ID NO: 8309119 - DNA, 22 bp, Homo sapiens
atgggatgaacttgatctgctt

SEQ ID NO: 8309120 - DNA, 22 bp, Homo sapiens
gagctgagttacctccagatca

SEQ ID NO: 8309121 - DNA, 22 bp, Homo sapiens
gagctgccagtgtatgaattct

SEQ ID NO: 8309122 - DNA, 22 bp, Homo sapiens
gagctgccaagattacaatcag

SEQ ID NO: 8309123 - DNA, 22 bp, Homo sapiens
gagctgccagacatgggaatga

SEQ ID NO: 8309124 - DNA, 18 bp, Homo sapiens
gagctgccatatttagtt

SEQ ID NO: 8309125 - DNA, 22 bp, Homo sapiens
gagctgccctgagctttgcatg

SEQ ID NO: 8309126 - DNA, 22 bp, Homo sapiens
gagctgccggcccacagtacta

SEQ ID NO: 8309127 - DNA, 22 bp, Homo sapiens
atgggagggtggaaaggctctg

SEQ ID NO: 8309128 - DNA, 22 bp, Homo sapiens
atgggagtgacagggccactgg

SEQ ID NO: 8309129 - DNA, 22 bp, Homo sapiens
atgggagttttctctgatgctc

SEQ ID NO: 8309130 - DNA, 22 bp, Homo sapiens
atgggaggaagagaagatgtct

SEQ ID NO: 8309131 - DNA, 22 bp, Homo sapiens
gagcacaggctttggtggacac

SEQ ID NO: 8309132 - DNA, 22 bp, Homo sapiens
gagcacagctggaggtagcatt

SEQ ID NO: 8309133 - DNA, 22 bp, Homo sapiens
gagcacagccaaagtaagaagg

SEQ ID NO: 8309134 - DNA, 19 bp, Homo sapiens
gagcacagcggcatttggt

SEQ ID NO: 8309135 - DNA, 22 bp, Homo sapiens
atggctcatttatcttgcagcc

SEQ ID NO: 8309136 - DNA, 22 bp, Homo sapiens
atgtatcaattatctgtctgca

SEQ ID NO: 8309137 - DNA, 22 bp, Homo sapiens
atgtatcagaaatagcattggc

SEQ ID NO: 8309138 - DNA, 22 bp, Homo sapiens
atgtatcatgcagggtccatga

SEQ ID NO: 8309139 - DNA, 22 bp, Homo sapiens
atgtatcagataaagcatgtgg

SEQ ID NO: 8309140 - DNA, 22 bp, Homo sapiens
atgtatgttagtgtattatcta

SEQ ID NO: 8309141 - DNA, 20 bp, Homo sapiens
gaggctctgggcatggcgcc

SEQ ID NO: 8309142 - DNA, 22 bp, Homo sapiens
gaggctctgtgatgtgccaggc

SEQ ID NO: 8309143 - DNA, 22 bp, Homo sapiens
atgtatcaacaaattgtacagt

SEQ ID NO: 8309144 - DNA, 22 bp, Homo sapiens
atgggcagcagctgccattcat

SEQ ID NO: 8309145 - DNA, 22 bp, Homo sapiens
gaggttcacaggctatcacagt

SEQ ID NO: 8309146 - DNA, 22 bp, Homo sapiens
gaggttagaggtcagtgcagtc

SEQ ID NO: 8309147 - DNA, 22 bp, Homo sapiens
gaggttgggatgagggatacag

SEQ ID NO: 8309148 - DNA, 22 bp, Homo sapiens
atgttacatagtccttatttgt

SEQ ID NO: 8309149 - DNA, 21 bp, Homo sapiens
gggagctggaaactgggtgac

SEQ ID NO: 8309150 - DNA, 21 bp, Homo sapiens
gggagctggaaactgggtgac

SEQ ID NO: 8309151 - DNA, 22 bp, Homo sapiens
cagacacagcaattctgtgttg

SEQ ID NO: 8309152 - DNA, 22 bp, Homo sapiens
cagacacagcaattctgtgttg

SEQ ID NO: 8309153 - DNA, 22 bp, Homo sapiens
cagacacagatatgcatatggc

SEQ ID NO: 8309154 - DNA, 22 bp, Homo sapiens
cagacacaccaggcccattctg

SEQ ID NO: 8309155 - DNA, 22 bp, Homo sapiens
gggagccaaggagagaggcctt

SEQ ID NO: 8309156 - DNA, 22 bp, Homo sapiens
cagaatttagcacaatgtatgg

SEQ ID NO: 8309157 - DNA, 22 bp, Homo sapiens
cagaatttgaagtaatattcca

SEQ ID NO: 8309158 - DNA, 22 bp, Homo sapiens
cagaatttttcgaatgtactgt

SEQ ID NO: 8309159 - DNA, 22 bp, Homo sapiens
ggctggcactctgtccagtgtc

SEQ ID NO: 8309160 - DNA, 19 bp, Homo sapiens
ggctggcaagtgacagtgt

SEQ ID NO: 8309161 - DNA, 22 bp, Homo sapiens
ggctggcaagtgtctgctcatg

SEQ ID NO: 8309162 - DNA, 22 bp, Homo sapiens
ggctggcactgaggagagctct

SEQ ID NO: 8309163 - DNA, 22 bp, Homo sapiens
cagacttgacggcagctgcttt

SEQ ID NO: 8309164 - DNA, 22 bp, Homo sapiens
cagagacagaaaatggatctag

SEQ ID NO: 8309165 - DNA, 22 bp, Homo sapiens
cagagcagaaacctgggtgatt

SEQ ID NO: 8309166 - DNA, 22 bp, Homo sapiens
cagagcagaaacctgggtgatt

SEQ ID NO: 8309167 - DNA, 22 bp, Homo sapiens
cagagcagaagcggtcctcaca

SEQ ID NO: 8309168 - DNA, 22 bp, Homo sapiens
cagagccaacgccacctgccca

SEQ ID NO: 8309169 - DNA, 20 bp, Homo sapiens
cagagccaagagcagcatct

SEQ ID NO: 8309170 - DNA, 20 bp, Homo sapiens
cagagccaagagcagcatct

SEQ ID NO: 8309171 - DNA, 22 bp, Homo sapiens
cagagccaaatgctgtggttat

SEQ ID NO: 8309172 - DNA, 22 bp, Homo sapiens
cagagccaaacctcagggcccg

SEQ ID NO: 8309173 - DNA, 19 bp, Homo sapiens
cagagcagtggttcctgaa

SEQ ID NO: 8309174 - DNA, 22 bp, Homo sapiens
gggcaggggtagcattccaagt

SEQ ID NO: 8309175 - DNA, 18 bp, Homo sapiens
cagagcagaggtggagcg

SEQ ID NO: 8309176 - DNA, 22 bp, Homo sapiens
cagagcaggcccactgccctcc

SEQ ID NO: 8309177 - DNA, 22 bp, Homo sapiens
cagagcagtgaggagttgtgta

SEQ ID NO: 8309178 - DNA, 22 bp, Homo sapiens
gggtcccaggaaggagcagtgt

SEQ ID NO: 8309179 - DNA, 22 bp, Homo sapiens
gggtccaggtcttcaggcagag

SEQ ID NO: 8309180 - DNA, 22 bp, Homo sapiens
gggtgggatctgtggagcctca

SEQ ID NO: 8309181 - DNA, 22 bp, Homo sapiens
gggtgtgttcctaaggaaacca

SEQ ID NO: 8309182 - DNA, 22 bp, Homo sapiens
ggtcctggaaattgacggaaag

SEQ ID NO: 8309183 - DNA, 18 bp, Homo sapiens
cagatgagatgcaatctc

SEQ ID NO: 8309184 - DNA, 22 bp, Homo sapiens
ggggttggtttaaatgcttgag

SEQ ID NO: 8309185 - DNA, 22 bp, Homo sapiens
gggtaaatctcttttcatggct

SEQ ID NO: 8309186 - DNA, 20 bp, Homo sapiens
ggggttggctggcacaggga

SEQ ID NO: 8309187 - DNA, 22 bp, Homo sapiens
gggtacaaagatttcataagat

SEQ ID NO: 8309188 - DNA, 22 bp, Homo sapiens
gggtaattggggccttgcagtg

SEQ ID NO: 8309189 - DNA, 22 bp, Homo sapiens
ggggcctgtagagcttcaggga

SEQ ID NO: 8309190 - DNA, 22 bp, Homo sapiens
ggggcctgcgaggttcaacttc

SEQ ID NO: 8309191 - DNA, 22 bp, Homo sapiens
ggggcctgtagagcttcaggga

SEQ ID NO: 8309192 - DNA, 22 bp, Homo sapiens
ggggcagaagtagtgcccctga

SEQ ID NO: 8309193 - DNA, 22 bp, Homo sapiens
ggggcagagaataaaaacctaa

SEQ ID NO: 8309194 - DNA, 22 bp, Homo sapiens
ggggcagagagaaggaagcttg

SEQ ID NO: 8309195 - DNA, 21 bp, Homo sapiens
ggggcagagctaggccctgca

SEQ ID NO: 8309196 - DNA, 22 bp, Homo sapiens
ggggcagagcatagctccaatt

SEQ ID NO: 8309197 - DNA, 22 bp, Homo sapiens
ggggcagagtagctggggtgtg

SEQ ID NO: 8309198 - DNA, 22 bp, Homo sapiens
ggggcagatggaacagagcaca

SEQ ID NO: 8309199 - DNA, 22 bp, Homo sapiens
ggggcagagtctggactgttgt

SEQ ID NO: 8309200 - DNA, 23 bp, Homo sapiens
ggggcctgcaccggtctgcgcgg

SEQ ID NO: 8309201 - DNA, 22 bp, Homo sapiens
cagagccactgtctgccaggca

SEQ ID NO: 8309202 - DNA, 22 bp, Homo sapiens
cagagccagaactagaccttgt

SEQ ID NO: 8309203 - DNA, 22 bp, Homo sapiens
cagagccagcagtggggacagg

SEQ ID NO: 8309204 - DNA, 22 bp, Homo sapiens
cagagccagcccactgttcccg

SEQ ID NO: 8309205 - DNA, 22 bp, Homo sapiens
gggctggaggaccggcctcgga

SEQ ID NO: 8309206 - DNA, 22 bp, Homo sapiens
gggctggaggagatccagaggc

SEQ ID NO: 8309207 - DNA, 22 bp, Homo sapiens
gggctggaggtgagcaggacag

SEQ ID NO: 8309208 - DNA, 22 bp, Homo sapiens
gggctgtggagccgcgagggct

SEQ ID NO: 8309209 - DNA, 22 bp, Homo sapiens
gggctgtgggacccggcacttt

SEQ ID NO: 8309210 - DNA, 22 bp, Homo sapiens
gggctgtgctgagtaggaggtg

SEQ ID NO: 8309211 - DNA, 22 bp, Homo sapiens
gggctgtgagagtggggctgct

SEQ ID NO: 8309212 - DNA, 22 bp, Homo sapiens
gggctgtcatgtgtcagtgacc

SEQ ID NO: 8309213 - DNA, 22 bp, Homo sapiens
gtgagcagaacaggtggcttct

SEQ ID NO: 8309214 - DNA, 18 bp, Homo sapiens
gtgagcagagagcatcac

SEQ ID NO: 8309215 - DNA, 23 bp, Homo sapiens
gtgagcagcccactaggaatgcc

SEQ ID NO: 8309216 - DNA, 20 bp, Homo sapiens
cagccctccagtggaggcag

SEQ ID NO: 8309217 - DNA, 22 bp, Homo sapiens
gtcctgtcccccaaggctgtgg

SEQ ID NO: 8309218 - DNA, 22 bp, Homo sapiens
cagccaggcccccgagtcgttg

SEQ ID NO: 8309219 - DNA, 22 bp, Homo sapiens
cagccctggtgccaaggttccc

SEQ ID NO: 8309220 - DNA, 22 bp, Homo sapiens
cagccctgtccctgagggacct

SEQ ID NO: 8309221 - DNA, 22 bp, Homo sapiens
cagccctgtccagcagagggtg

SEQ ID NO: 8309222 - DNA, 22 bp, Homo sapiens
gtcacactagggccaagtggag

SEQ ID NO: 8309223 - DNA, 22 bp, Homo sapiens
gtcacactcagaatgactagag

SEQ ID NO: 8309224 - DNA, 22 bp, Homo sapiens
gtcacaggcctggatgaggggc

SEQ ID NO: 8309225 - DNA, 22 bp, Homo sapiens
gtcagcagtgtcagctctgggg

SEQ ID NO: 8309226 - DNA, 22 bp, Homo sapiens
gtcagcagggtccccttgagtg

SEQ ID NO: 8309227 - DNA, 21 bp, Homo sapiens
gtcagcagatccagcacttgt

SEQ ID NO: 8309228 - DNA, 22 bp, Homo sapiens
cagcatctaatcttcatgccgg

SEQ ID NO: 8309229 - DNA, 22 bp, Homo sapiens
cagccagcttcagatccaagcc

SEQ ID NO: 8309230 - DNA, 22 bp, Homo sapiens
cagccaggacagggaaactagt

SEQ ID NO: 8309231 - DNA, 22 bp, Homo sapiens
cagccagaacctaggatgagct

SEQ ID NO: 8309232 - DNA, 22 bp, Homo sapiens
cagccaggagcctctgcaacta

SEQ ID NO: 8309233 - DNA, 22 bp, Homo sapiens
cagccaggagctccccctgctc

SEQ ID NO: 8309234 - DNA, 22 bp, Homo sapiens
gtactctcttgaaggcctttct

SEQ ID NO: 8309235 - DNA, 22 bp, Homo sapiens
gtacttccgtggactaattgtt

SEQ ID NO: 8309236 - DNA, 22 bp, Homo sapiens
gtacttccctgggaggcaagca

SEQ ID NO: 8309237 - DNA, 22 bp, Homo sapiens
gtacttccagccaagtgagaca

SEQ ID NO: 8309238 - DNA, 22 bp, Homo sapiens
gtaggcagtctctcaggtgatc

SEQ ID NO: 8309239 - DNA, 22 bp, Homo sapiens
cagcaaaagccagcataagctc

SEQ ID NO: 8309240 - DNA, 22 bp, Homo sapiens
cagcagcccacgcgtgctgtcc

SEQ ID NO: 8309241 - DNA, 22 bp, Homo sapiens
cagcagcctacaatgcacagaa

SEQ ID NO: 8309242 - DNA, 22 bp, Homo sapiens
cagcagcctacaatgcacagaa

SEQ ID NO: 8309243 - DNA, 22 bp, Homo sapiens
cagcaaaatttgaggattgcct

SEQ ID NO: 8309244 - DNA, 22 bp, Homo sapiens
gctctggagatggagccttgag

SEQ ID NO: 8309245 - DNA, 22 bp, Homo sapiens
gctctggactggggcctgagaa

SEQ ID NO: 8309246 - DNA, 22 bp, Homo sapiens
gctctggaccctggagtggctg

SEQ ID NO: 8309247 - DNA, 22 bp, Homo sapiens
gctctggactggggcctgagaa

SEQ ID NO: 8309248 - DNA, 22 bp, Homo sapiens
gctctggaagcatctgagagga

SEQ ID NO: 8309249 - DNA, 22 bp, Homo sapiens
gctctgctgtgtttgttcagca

SEQ ID NO: 8309250 - DNA, 22 bp, Homo sapiens
gctctgcttgcatcatgactgc

SEQ ID NO: 8309251 - DNA, 22 bp, Homo sapiens
caaagtccatagtttacaatag

SEQ ID NO: 8309252 - DNA, 22 bp, Homo sapiens
caaagtcccagctgcttagaga

SEQ ID NO: 8309253 - DNA, 22 bp, Homo sapiens
caaagtcctagaacagtgcttg

SEQ ID NO: 8309254 - DNA, 22 bp, Homo sapiens
gctgccctcccagggcaagctt

SEQ ID NO: 8309255 - DNA, 22 bp, Homo sapiens
gctgccacgatctctgctgtag

SEQ ID NO: 8309256 - DNA, 17 bp, Homo sapiens
gctgccacctttggagc

SEQ ID NO: 8309257 - DNA, 22 bp, Homo sapiens
caaagtgctaggattacaggcc

SEQ ID NO: 8309258 - DNA, 22 bp, Homo sapiens
caaagtgctaggattacaggcg

SEQ ID NO: 8309259 - DNA, 22 bp, Homo sapiens
caagaacattgtgatcacttca

SEQ ID NO: 8309260 - DNA, 22 bp, Homo sapiens
caagaacagtttgccaaattgg

SEQ ID NO: 8309261 - DNA, 22 bp, Homo sapiens
caagaaatttcttaagaactaa

SEQ ID NO: 8309262 - DNA, 22 bp, Homo sapiens
gctgcctgatgtccagcaggac

SEQ ID NO: 8309263 - DNA, 22 bp, Homo sapiens
gctgcctgatttacatagtgaa

SEQ ID NO: 8309264 - DNA, 17 bp, Homo sapiens
gctgcctgcaactgact

SEQ ID NO: 8309265 - DNA, 22 bp, Homo sapiens
caagaaatgtttactgagcatc

SEQ ID NO: 8309266 - DNA, 22 bp, Homo sapiens
caagaaatgggatttgactgcc

SEQ ID NO: 8309267 - DNA, 22 bp, Homo sapiens
gctgccctgtctgcagcaggac

SEQ ID NO: 8309268 - DNA, 22 bp, Homo sapiens
caacaatatgctgagtttttca

SEQ ID NO: 8309269 - DNA, 22 bp, Homo sapiens
caagcctcagaatcttctccat

SEQ ID NO: 8309270 - DNA, 20 bp, Homo sapiens
caagccctctttagcctgcc

SEQ ID NO: 8309271 - DNA, 22 bp, Homo sapiens
caagcccaggattccccagtta

SEQ ID NO: 8309272 - DNA, 22 bp, Homo sapiens
gctggctgaggtctagctcttt

SEQ ID NO: 8309273 - DNA, 17 bp, Homo sapiens
gctggctgacccatgcc

SEQ ID NO: 8309274 - DNA, 22 bp, Homo sapiens
gctggctcttcagtggagatag

SEQ ID NO: 8309275 - DNA, 22 bp, Homo sapiens
gctggcccagggtcacctagga

SEQ ID NO: 8309276 - DNA, 22 bp, Homo sapiens
caagctccttacatccacaggg

SEQ ID NO: 8309277 - DNA, 22 bp, Homo sapiens
caagcctgtctcaccagtgcta

SEQ ID NO: 8309278 - DNA, 22 bp, Homo sapiens
gctgcctgcacagagctgcttt

SEQ ID NO: 8309279 - DNA, 22 bp, Homo sapiens
gctgcctgcacagagctgcttt

SEQ ID NO: 8309280 - DNA, 22 bp, Homo sapiens
gctgcctgcacagagctgcttt

SEQ ID NO: 8309281 - DNA, 22 bp, Homo sapiens
gctgcctgcagtgttttcccag

SEQ ID NO: 8309282 - DNA, 18 bp, Homo sapiens
gctgcctgcattcctcac

SEQ ID NO: 8309283 - DNA, 21 bp, Homo sapiens
gctgcctgcccctcgggggct

SEQ ID NO: 8309284 - DNA, 18 bp, Homo sapiens
gctgcctgcattcctcac

SEQ ID NO: 8309285 - DNA, 22 bp, Homo sapiens
gctgcctgcctagttccacagt

SEQ ID NO: 8309286 - DNA, 22 bp, Homo sapiens
gctgcctgcctagttccacagt

SEQ ID NO: 8309287 - DNA, 22 bp, Homo sapiens
gctggaaggctaggctcagttg

SEQ ID NO: 8309288 - DNA, 22 bp, Homo sapiens
caagaattgtacaaactgggtg

SEQ ID NO: 8309289 - DNA, 22 bp, Homo sapiens
caagacaagatctaagcatgct

SEQ ID NO: 8309290 - DNA, 22 bp, Homo sapiens
gctggaccaggtgtgcacaggc

SEQ ID NO: 8309291 - DNA, 22 bp, Homo sapiens
cacacaggatgaagcagcagaa

SEQ ID NO: 8309292 - DNA, 22 bp, Homo sapiens
ggaccagagaagtgagcacctg

SEQ ID NO: 8309293 - DNA, 22 bp, Homo sapiens
ggaccagagctcgggcttctca

SEQ ID NO: 8309294 - DNA, 22 bp, Homo sapiens
ggagaaggtgctggtcactgtg

SEQ ID NO: 8309295 - DNA, 22 bp, Homo sapiens
ggagaagggacagactcagctt

SEQ ID NO: 8309296 - DNA, 20 bp, Homo sapiens
ggagagcagggaagacagta

SEQ ID NO: 8309297 - DNA, 22 bp, Homo sapiens
ggagagcagggaggctgctctg

SEQ ID NO: 8309298 - DNA, 22 bp, Homo sapiens
ggagagcagggtcctgagatac

SEQ ID NO: 8309299 - DNA, 22 bp, Homo sapiens
caatatgcaagctattaagtat

SEQ ID NO: 8309300 - DNA, 22 bp, Homo sapiens
caatattcagtggaaaagccat

SEQ ID NO: 8309301 - DNA, 22 bp, Homo sapiens
ggaagagcctggggtgtcaggc

SEQ ID NO: 8309302 - DNA, 22 bp, Homo sapiens
caatagcagcttctgaatgcaa

SEQ ID NO: 8309303 - DNA, 22 bp, Homo sapiens
caaggctgctgcgggtcgcacc

SEQ ID NO: 8309304 - DNA, 22 bp, Homo sapiens
gctggggagctagacctcagca

SEQ ID NO: 8309305 - DNA, 22 bp, Homo sapiens
ggccaggctggtctcagacttc

SEQ ID NO: 8309306 - DNA, 22 bp, Homo sapiens
cacctggctggaagtgctccgg

SEQ ID NO: 8309307 - DNA, 22 bp, Homo sapiens
caccaggctggagtgcagaggt

SEQ ID NO: 8309308 - DNA, 22 bp, Homo sapiens
caccaggctgaaccagagggga

SEQ ID NO: 8309309 - DNA, 20 bp, Homo sapiens
caccaggcgctctgagaaca

SEQ ID NO: 8309310 - DNA, 22 bp, Homo sapiens
cacgcctggacggcggagggtg

SEQ ID NO: 8309311 - DNA, 21 bp, Homo sapiens
cactcagggtatgtgccaggc

SEQ ID NO: 8309312 - DNA, 22 bp, Homo sapiens
cactcaggctgtgtcaggagga

SEQ ID NO: 8309313 - DNA, 22 bp, Homo sapiens
cactcccttcaggagcctagga

SEQ ID NO: 8309314 - DNA, 22 bp, Homo sapiens
cactgcactccagcctgggaga

SEQ ID NO: 8309315 - DNA, 22 bp, Homo sapiens
cactgcaacctccacctcctgg

SEQ ID NO: 8309316 - DNA, 22 bp, Homo sapiens
cactctctcaggctttccttgt

SEQ ID NO: 8309317 - DNA, 22 bp, Homo sapiens
cactctgactggccctgcagga

SEQ ID NO: 8309318 - DNA, 22 bp, Homo sapiens
cacttaagcagttaatttatct

SEQ ID NO: 8309319 - DNA, 22 bp, Homo sapiens
cacttcaattaacttcagcatt

SEQ ID NO: 8309320 - DNA, 20 bp, Homo sapiens
ggctctggaatctggtgggc

SEQ ID NO: 8309321 - DNA, 20 bp, Homo sapiens
ggctctgcttgtgagcagcc

SEQ ID NO: 8309322 - DNA, 22 bp, Homo sapiens
ggctctggaaagtgtccttgat

SEQ ID NO: 8309323 - DNA, 17 bp, Homo sapiens
ggctgctgtgctggtgc

SEQ ID NO: 8309324 - DNA, 22 bp, Homo sapiens
cactgtatcttttccaaagtct

SEQ ID NO: 8309325 - DNA, 22 bp, Homo sapiens
ggctctgctggattgaggccag

SEQ ID NO: 8309326 - DNA, 22 bp, Homo sapiens
ggctctgctggtaagatgcctc

SEQ ID NO: 8309327 - DNA, 22 bp, Homo sapiens
ggctctgcttcagaaggctcat

SEQ ID NO: 8309328 - DNA, 22 bp, Homo sapiens
cactgggcaattctgagcctaa

SEQ ID NO: 8309329 - DNA, 22 bp, Homo sapiens
cactgcactccagcctgggtca

SEQ ID NO: 8309330 - DNA, 22 bp, Homo sapiens
cactgcactccagcctgggtga

SEQ ID NO: 8309331 - DNA, 22 bp, Homo sapiens
cactgcactccagcttgggtga

SEQ ID NO: 8309332 - DNA, 22 bp, Homo sapiens
cacaggtgctcctcggggagct

SEQ ID NO: 8309333 - DNA, 22 bp, Homo sapiens
cacagggttgttctgaggattc

SEQ ID NO: 8309334 - DNA, 22 bp, Homo sapiens
cacaggggcaaactgtagggga

SEQ ID NO: 8309335 - DNA, 22 bp, Homo sapiens
cacagggcaggtactctcagag

SEQ ID NO: 8309336 - DNA, 20 bp, Homo sapiens
cacaggccttgtgagcagac

SEQ ID NO: 8309337 - DNA, 22 bp, Homo sapiens
cacaggaggttaggaagtggtc

SEQ ID NO: 8309338 - DNA, 22 bp, Homo sapiens
cacaggtgttcttgcagtgaaa

SEQ ID NO: 8309339 - DNA, 21 bp, Homo sapiens
cacaggtgggtcagtgaggcc

SEQ ID NO: 8309340 - DNA, 22 bp, Homo sapiens
cacaggtggctccaagttagag

SEQ ID NO: 8309341 - DNA, 17 bp, Homo sapiens
cacaggtgtggtttgag

SEQ ID NO: 8309342 - DNA, 22 bp, Homo sapiens
cacaggtgtatgaatatgtcca

SEQ ID NO: 8309343 - DNA, 22 bp, Homo sapiens
cacagtgcatgatgggcagaag

SEQ ID NO: 8309344 - DNA, 22 bp, Homo sapiens
cacagtgcatgatgggcagaag

SEQ ID NO: 8309345 - DNA, 22 bp, Homo sapiens
ggcagagtggagtgcggcctcc

SEQ ID NO: 8309346 - DNA, 22 bp, Homo sapiens
cacatgtttggcatgtcaccaa

SEQ ID NO: 8309347 - DNA, 22 bp, Homo sapiens
caccagctttgcccactgccca

SEQ ID NO: 8309348 - DNA, 22 bp, Homo sapiens
cagtgtcttatttgtagctcag

SEQ ID NO: 8309349 - DNA, 22 bp, Homo sapiens
cagtgtctccagatgctccaat

SEQ ID NO: 8309350 - DNA, 22 bp, Homo sapiens
tcagagaacacagaggtgatgt

SEQ ID NO: 8309351 - DNA, 22 bp, Homo sapiens
tcagagaaatgaagtagggatt

SEQ ID NO: 8309352 - DNA, 22 bp, Homo sapiens
cagtgggaagggcagaggcttt

SEQ ID NO: 8309353 - DNA, 22 bp, Homo sapiens
cagtgggctgtgatggattcac

SEQ ID NO: 8309354 - DNA, 22 bp, Homo sapiens
cagtgggtaggaaaggctcttc

SEQ ID NO: 8309355 - DNA, 22 bp, Homo sapiens
cagtgggtcctaagtacagttc

SEQ ID NO: 8309356 - DNA, 22 bp, Homo sapiens
cagtggggaggccaggatagaa

SEQ ID NO: 8309357 - DNA, 22 bp, Homo sapiens
cagtggctgtttctggaaggca

SEQ ID NO: 8309358 - DNA, 22 bp, Homo sapiens
cagtggctgtgaccagggacct

SEQ ID NO: 8309359 - DNA, 22 bp, Homo sapiens
cagtgccatgtctgagccccta

SEQ ID NO: 8309360 - DNA, 22 bp, Homo sapiens
cagttaaaggcccaatatctgg

SEQ ID NO: 8309361 - DNA, 22 bp, Homo sapiens
tcagcagcagctcagcatgttt

SEQ ID NO: 8309362 - DNA, 21 bp, Homo sapiens
tcagcagcatctgcctagagt

SEQ ID NO: 8309363 - DNA, 22 bp, Homo sapiens
tcagcagatgggttgtgttggc

SEQ ID NO: 8309364 - DNA, 22 bp, Homo sapiens
tcagcagaggggaaggcatctg

SEQ ID NO: 8309365 - DNA, 22 bp, Homo sapiens
tcaggaaagaagatgctcagtg

SEQ ID NO: 8309366 - DNA, 22 bp, Homo sapiens
tcagctgccccagtggccccag

SEQ ID NO: 8309367 - DNA, 22 bp, Homo sapiens
tatttcatgtgcaccataattc

SEQ ID NO: 8309368 - DNA, 22 bp, Homo sapiens
cagggtgggcacccagcctcca

SEQ ID NO: 8309369 - DNA, 22 bp, Homo sapiens
cagggtggccctgtggtctcat

SEQ ID NO: 8309370 - DNA, 22 bp, Homo sapiens
cagggtggccctgtggtctcat

SEQ ID NO: 8309371 - DNA, 22 bp, Homo sapiens
cagggtggggaaatagcgccct

SEQ ID NO: 8309372 - DNA, 22 bp, Homo sapiens
cagtagccactagacacatgta

SEQ ID NO: 8309373 - DNA, 22 bp, Homo sapiens
cagtagcatgtaataaagacag

SEQ ID NO: 8309374 - DNA, 22 bp, Homo sapiens
cagtcccagacccagaaggtgg

SEQ ID NO: 8309375 - DNA, 22 bp, Homo sapiens
cagtcccagacatagtaaggga

SEQ ID NO: 8309376 - DNA, 22 bp, Homo sapiens
cagtcccagacatagtaaggga

SEQ ID NO: 8309377 - DNA, 22 bp, Homo sapiens
cagtcccagaagagcctgggag

SEQ ID NO: 8309378 - DNA, 21 bp, Homo sapiens
tatttctttgactctctccct

SEQ ID NO: 8309379 - DNA, 22 bp, Homo sapiens
tatttctttcaggtatgtgttg

SEQ ID NO: 8309380 - DNA, 19 bp, Homo sapiens
cagtcccaaattcttgtca

SEQ ID NO: 8309381 - DNA, 22 bp, Homo sapiens
cagtcccaaggaggaagcagtc

SEQ ID NO: 8309382 - DNA, 22 bp, Homo sapiens
cagtcccaaggaggaagcagtc

SEQ ID NO: 8309383 - DNA, 18 bp, Homo sapiens
cagtcccaaaccttagga

SEQ ID NO: 8309384 - DNA, 20 bp, Homo sapiens
cagtcccaatccagggccag

SEQ ID NO: 8309385 - DNA, 20 bp, Homo sapiens
cagtcccaatccagggccag

SEQ ID NO: 8309386 - DNA, 22 bp, Homo sapiens
cagtcccacaagatctccacaa

SEQ ID NO: 8309387 - DNA, 22 bp, Homo sapiens
cagtcccactagtgccaatacc

SEQ ID NO: 8309388 - DNA, 22 bp, Homo sapiens
cagtcccaccaggatcgctctt

SEQ ID NO: 8309389 - DNA, 22 bp, Homo sapiens
tcacaggaccctgagggtggcg

SEQ ID NO: 8309390 - DNA, 22 bp, Homo sapiens
tcacaggaccctgagggtggcg

SEQ ID NO: 8309391 - DNA, 22 bp, Homo sapiens
tcacaggaaccatcagagaaat

SEQ ID NO: 8309392 - DNA, 22 bp, Homo sapiens
cagtgcatgaaacaatatgcag

SEQ ID NO: 8309393 - DNA, 22 bp, Homo sapiens
tcacaggagggagagacaccca

SEQ ID NO: 8309394 - DNA, 22 bp, Homo sapiens
tcacaacttgaagctgatttaa

SEQ ID NO: 8309395 - DNA, 22 bp, Homo sapiens
tcacaactctttccatttaata

SEQ ID NO: 8309396 - DNA, 22 bp, Homo sapiens
tatttgaaagtgtacaaaaact

SEQ ID NO: 8309397 - DNA, 22 bp, Homo sapiens
cagggccttttagcatcttctc

SEQ ID NO: 8309398 - DNA, 22 bp, Homo sapiens
cagggccttcgtaagtgtccgg

SEQ ID NO: 8309399 - DNA, 22 bp, Homo sapiens
cagggccttatcctgccattga

SEQ ID NO: 8309400 - DNA, 22 bp, Homo sapiens
taggagctaaaatattttatat

SEQ ID NO: 8309401 - DNA, 22 bp, Homo sapiens
cagggcctgcctggttcctgga

SEQ ID NO: 8309402 - DNA, 22 bp, Homo sapiens
cagggcctgcttccttcttgtt

SEQ ID NO: 8309403 - DNA, 22 bp, Homo sapiens
taggagaggtgaatggcacact

SEQ ID NO: 8309404 - DNA, 19 bp, Homo sapiens
taggaccctggtggccccc

SEQ ID NO: 8309405 - DNA, 22 bp, Homo sapiens
cagggcagagggaaactccttt

SEQ ID NO: 8309406 - DNA, 22 bp, Homo sapiens
cagggcagagggaaactccttt

SEQ ID NO: 8309407 - DNA, 22 bp, Homo sapiens
cagggcagagccaggatttcaa

SEQ ID NO: 8309408 - DNA, 22 bp, Homo sapiens
cagggcagcttcctttgttagg

SEQ ID NO: 8309409 - DNA, 22 bp, Homo sapiens
cagggcagccaggccccgtggg

SEQ ID NO: 8309410 - DNA, 22 bp, Homo sapiens
cagggcaggaatttgacattgc

SEQ ID NO: 8309411 - DNA, 22 bp, Homo sapiens
caggggcaagaatgctgtcagc

SEQ ID NO: 8309412 - DNA, 22 bp, Homo sapiens
tagtgaaacagttatcaatctg

SEQ ID NO: 8309413 - DNA, 22 bp, Homo sapiens
tagtctttttaataaataatgc

SEQ ID NO: 8309414 - DNA, 22 bp, Homo sapiens
tagtcttttgagaagtatatct

SEQ ID NO: 8309415 - DNA, 19 bp, Homo sapiens
tagtctttattcttaattt

SEQ ID NO: 8309416 - DNA, 22 bp, Homo sapiens
tagtgattaaaggcagaatgtt

SEQ ID NO: 8309417 - DNA, 22 bp, Homo sapiens
tagtgaaatttatgcacagcta

SEQ ID NO: 8309418 - DNA, 22 bp, Homo sapiens
cagggtggcactcagcgcatct

SEQ ID NO: 8309419 - DNA, 22 bp, Homo sapiens
cagggtggcaggcaccatggcc

SEQ ID NO: 8309420 - DNA, 22 bp, Homo sapiens
cagggtggcaggcaccatggcc

SEQ ID NO: 8309421 - DNA, 22 bp, Homo sapiens
tagggtggagactggaagcagg

SEQ ID NO: 8309422 - DNA, 22 bp, Homo sapiens
tagggtggttagaaggagtatg

SEQ ID NO: 8309423 - DNA, 22 bp, Homo sapiens
caggggacagtatggtggatga

SEQ ID NO: 8309424 - DNA, 22 bp, Homo sapiens
caggggacattaaagctccata

SEQ ID NO: 8309425 - DNA, 22 bp, Homo sapiens
caggggaagatgccaagggaga

SEQ ID NO: 8309426 - DNA, 22 bp, Homo sapiens
tagggctataagagaataagac

SEQ ID NO: 8309427 - DNA, 22 bp, Homo sapiens
tagggctattctgagtaataat

SEQ ID NO: 8309428 - DNA, 22 bp, Homo sapiens
tagggcagtttcatgttatctt

SEQ ID NO: 8309429 - DNA, 22 bp, Homo sapiens
tagggcagttataacattagtg

SEQ ID NO: 8309430 - DNA, 22 bp, Homo sapiens
tagggcaggggaggaatctgaa

SEQ ID NO: 8309431 - DNA, 22 bp, Homo sapiens
tagggcaggtgaagaaaagcta

SEQ ID NO: 8309432 - DNA, 22 bp, Homo sapiens
cagggctcatctgtgtgaccag

SEQ ID NO: 8309433 - DNA, 21 bp, Homo sapiens
tagggcaggcattggaagaga

SEQ ID NO: 8309434 - DNA, 22 bp, Homo sapiens
tagataaattagaaagtttact

SEQ ID NO: 8309435 - DNA, 22 bp, Homo sapiens
cagggcagaacatatagatagt

SEQ ID NO: 8309436 - DNA, 22 bp, Homo sapiens
cagggcagaaggcactctactc

SEQ ID NO: 8309437 - DNA, 21 bp, Homo sapiens
cagggcacacagaggatggta

SEQ ID NO: 8309438 - DNA, 22 bp, Homo sapiens
cagggcacagttatggaggtgg

SEQ ID NO: 8309439 - DNA, 22 bp, Homo sapiens
cagggcacagttatggaggtgg

SEQ ID NO: 8309440 - DNA, 22 bp, Homo sapiens
cagggcacagatcggggcgcac

SEQ ID NO: 8309441 - DNA, 22 bp, Homo sapiens
tagaatatgtggtaggatctgg

SEQ ID NO: 8309442 - DNA, 22 bp, Homo sapiens
caggctgggcagcctccccggc

SEQ ID NO: 8309443 - DNA, 22 bp, Homo sapiens
tagagctgtatcaaagagcctt

SEQ ID NO: 8309444 - DNA, 17 bp, Homo sapiens
tagagctggttcaggag

SEQ ID NO: 8309445 - DNA, 22 bp, Homo sapiens
tagagctggaaaactgcaggta

SEQ ID NO: 8309446 - DNA, 22 bp, Homo sapiens
tagagctggccgggacagctgg

SEQ ID NO: 8309447 - DNA, 22 bp, Homo sapiens
tagagctggaatttgcagcaag

SEQ ID NO: 8309448 - DNA, 22 bp, Homo sapiens
tagagctggaatttgcagcaag

SEQ ID NO: 8309449 - DNA, 22 bp, Homo sapiens
tagagtgtcctatctcccacgg

SEQ ID NO: 8309450 - DNA, 22 bp, Homo sapiens
caggctggagtgagtgtagtgg

SEQ ID NO: 8309451 - DNA, 22 bp, Homo sapiens
tactgtatttgataagtgaagt

SEQ ID NO: 8309452 - DNA, 22 bp, Homo sapiens
gtgaggggagtaaagccatgtt

SEQ ID NO: 8309453 - DNA, 22 bp, Homo sapiens
tcatgcacatgtgtcaccatca

SEQ ID NO: 8309454 - DNA, 22 bp, Homo sapiens
tcatgacatctgtttatctcaa

SEQ ID NO: 8309455 - DNA, 22 bp, Homo sapiens
tcatgacaactatattattcca

SEQ ID NO: 8309456 - DNA, 22 bp, Homo sapiens
tcatgcaaggctgaaacatggt

SEQ ID NO: 8309457 - DNA, 20 bp, Homo sapiens
tccaagccctccttccattc

SEQ ID NO: 8309458 - DNA, 22 bp, Homo sapiens
tcattctcctctggaaaaggca

SEQ ID NO: 8309459 - DNA, 22 bp, Homo sapiens
tccagcctaatgttcttcccac

SEQ ID NO: 8309460 - DNA, 22 bp, Homo sapiens
cattgacatcaggcttggccaa

SEQ ID NO: 8309461 - DNA, 22 bp, Homo sapiens
cattgcacaccagcctgggcaa

SEQ ID NO: 8309462 - DNA, 22 bp, Homo sapiens
cattgcaccacattgcatccct

SEQ ID NO: 8309463 - DNA, 22 bp, Homo sapiens
cattgcacatctgagaagagat

SEQ ID NO: 8309464 - DNA, 22 bp, Homo sapiens
cattgcacagccctgtggtgat

SEQ ID NO: 8309465 - DNA, 22 bp, Homo sapiens
cattgcacgggcgtctgtctgt

SEQ ID NO: 8309466 - DNA, 22 bp, Homo sapiens
tcccagggtcctcttctggaat

SEQ ID NO: 8309467 - DNA, 22 bp, Homo sapiens
cattgacagttctttaagttgc

SEQ ID NO: 8309468 - DNA, 22 bp, Homo sapiens
cattgaaatatggaaactgatg

SEQ ID NO: 8309469 - DNA, 22 bp, Homo sapiens
cattgaaacctaacataggctg

SEQ ID NO: 8309470 - DNA, 22 bp, Homo sapiens
cattgaaaaacgttgactgagt

SEQ ID NO: 8309471 - DNA, 22 bp, Homo sapiens
tccccactctgggccaccacaa

SEQ ID NO: 8309472 - DNA, 19 bp, Homo sapiens
tccccagcacctctgagtc

SEQ ID NO: 8309473 - DNA, 22 bp, Homo sapiens
tccccagcttgctacttctgct

SEQ ID NO: 8309474 - DNA, 22 bp, Homo sapiens
tccccagctctgtgcttccact

SEQ ID NO: 8309475 - DNA, 22 bp, Homo sapiens
tccccagccgtgaaggagagga

SEQ ID NO: 8309476 - DNA, 22 bp, Homo sapiens
tcctcaggagagctcctatgcc

SEQ ID NO: 8309477 - DNA, 22 bp, Homo sapiens
tcctcaggatctaggagtgctt

SEQ ID NO: 8309478 - DNA, 22 bp, Homo sapiens
tcctcaggatgtggagtagaat

SEQ ID NO: 8309479 - DNA, 22 bp, Homo sapiens
tcctcaggatgtggggtagaat

SEQ ID NO: 8309480 - DNA, 22 bp, Homo sapiens
tcctcaggcggtgaggaggggc

SEQ ID NO: 8309481 - DNA, 22 bp, Homo sapiens
tcctcaggctgcctggaagact

SEQ ID NO: 8309482 - DNA, 22 bp, Homo sapiens
tcctcagggaagatgagcctca

SEQ ID NO: 8309483 - DNA, 22 bp, Homo sapiens
catttgtatgttcctccttagg

SEQ ID NO: 8309484 - DNA, 22 bp, Homo sapiens
cattcatttactttcaacagct

SEQ ID NO: 8309485 - DNA, 21 bp, Homo sapiens
tcccactctaaatggactgaa

SEQ ID NO: 8309486 - DNA, 22 bp, Homo sapiens
cattcatttatgaaatatctat

SEQ ID NO: 8309487 - DNA, 22 bp, Homo sapiens
tcccagagcccaagttggagag

SEQ ID NO: 8309488 - DNA, 22 bp, Homo sapiens
tcccagaggaaatggcagctga

SEQ ID NO: 8309489 - DNA, 22 bp, Homo sapiens
tcccagccacaggtgtagccct

SEQ ID NO: 8309490 - DNA, 22 bp, Homo sapiens
tcccagagctgataagccttta

SEQ ID NO: 8309491 - DNA, 22 bp, Homo sapiens
tcccagagcctctgccactctg

SEQ ID NO: 8309492 - DNA, 22 bp, Homo sapiens
tcccagagctctgacaccagct

SEQ ID NO: 8309493 - DNA, 22 bp, Homo sapiens
tcccagagctctggaggttgga

SEQ ID NO: 8309494 - DNA, 22 bp, Homo sapiens
tcccagccacagtttccacctg

SEQ ID NO: 8309495 - DNA, 22 bp, Homo sapiens
tcccagccaggctctaccactt

SEQ ID NO: 8309496 - DNA, 22 bp, Homo sapiens
tcccagcccagatttgtgtgac

SEQ ID NO: 8309497 - DNA, 22 bp, Homo sapiens
tcccagccattcctttaggtgt

SEQ ID NO: 8309498 - DNA, 22 bp, Homo sapiens
tcccaggacaggccacatggaa

SEQ ID NO: 8309499 - DNA, 22 bp, Homo sapiens
cattcactcagcgatgccagta

SEQ ID NO: 8309500 - DNA, 22 bp, Homo sapiens
cattcattagaatagatatgta

SEQ ID NO: 8309501 - DNA, 18 bp, Homo sapiens
ccagcatgccagaggctg

SEQ ID NO: 8309502 - DNA, 22 bp, Homo sapiens
ccagcatgagacgatgatgaag

SEQ ID NO: 8309503 - DNA, 19 bp, Homo sapiens
ccagccctgtcacttcttg

SEQ ID NO: 8309504 - DNA, 22 bp, Homo sapiens
ccagccctgtcaccaactggag

SEQ ID NO: 8309505 - DNA, 22 bp, Homo sapiens
ccagccctgtaaggatgaggca

SEQ ID NO: 8309506 - DNA, 22 bp, Homo sapiens
ccagcccttcccaactggccag

SEQ ID NO: 8309507 - DNA, 22 bp, Homo sapiens
ccagccctgcctctcagggccc

SEQ ID NO: 8309508 - DNA, 22 bp, Homo sapiens
ccagcatggcacctgagatgag

SEQ ID NO: 8309509 - DNA, 20 bp, Homo sapiens
ccagcatgtacacatgtgga

SEQ ID NO: 8309510 - DNA, 22 bp, Homo sapiens
tctgagaggcagaccttcctaa

SEQ ID NO: 8309511 - DNA, 22 bp, Homo sapiens
tctgagagcctctagcctaagt

SEQ ID NO: 8309512 - DNA, 22 bp, Homo sapiens
tctgagagctgtagaagcctat

SEQ ID NO: 8309513 - DNA, 22 bp, Homo sapiens
tctgagaggattcctgtcccga

SEQ ID NO: 8309514 - DNA, 22 bp, Homo sapiens
tctgcagaagtggctgggccac

SEQ ID NO: 8309515 - DNA, 22 bp, Homo sapiens
tctgagagtccatctccaagcc

SEQ ID NO: 8309516 - DNA, 22 bp, Homo sapiens
tctgagagtacgggctgcgcgc

SEQ ID NO: 8309517 - DNA, 22 bp, Homo sapiens
tctgagagtagagctgcctctt

SEQ ID NO: 8309518 - DNA, 22 bp, Homo sapiens
tctgagaggttaagcaatttga

SEQ ID NO: 8309519 - DNA, 22 bp, Homo sapiens
tctctcttgtcaccccatctgc

SEQ ID NO: 8309520 - DNA, 22 bp, Homo sapiens
tctctgatgtatatcagagaac

SEQ ID NO: 8309521 - DNA, 20 bp, Homo sapiens
tctctgcagcagaggctggg

SEQ ID NO: 8309522 - DNA, 19 bp, Homo sapiens
tctctgcagcgcgcccggc

SEQ ID NO: 8309523 - DNA, 22 bp, Homo sapiens
tctctgcagtcttgggcaggca

SEQ ID NO: 8309524 - DNA, 22 bp, Homo sapiens
tctctgggaatgggcctgggta

SEQ ID NO: 8309525 - DNA, 21 bp, Homo sapiens
tctctgggaggacttgtgaga

SEQ ID NO: 8309526 - DNA, 22 bp, Homo sapiens
ccagcagctttattggctctcc

SEQ ID NO: 8309527 - DNA, 22 bp, Homo sapiens
ccagcagctgtggctttgcctc

SEQ ID NO: 8309528 - DNA, 21 bp, Homo sapiens
ccagcagctcaaggatctctt

SEQ ID NO: 8309529 - DNA, 22 bp, Homo sapiens
ccagcagctccctcagggtccg

SEQ ID NO: 8309530 - DNA, 22 bp, Homo sapiens
ccagcagccaccttctcgaaat

SEQ ID NO: 8309531 - DNA, 22 bp, Homo sapiens
ccagcagcccacaggcgtccct

SEQ ID NO: 8309532 - DNA, 22 bp, Homo sapiens
ccagcagcgatagggtgagtgc

SEQ ID NO: 8309533 - DNA, 22 bp, Homo sapiens
ccagcagccctcttccaagact

SEQ ID NO: 8309534 - DNA, 22 bp, Homo sapiens
ccagcagcagcgtccaaggaga

SEQ ID NO: 8309535 - DNA, 22 bp, Homo sapiens
ccagcagcagcgtccaaggaga

SEQ ID NO: 8309536 - DNA, 22 bp, Homo sapiens
ccagcagagtctaggaaggagg

SEQ ID NO: 8309537 - DNA, 22 bp, Homo sapiens
ccagcagagggtcttggccatt

SEQ ID NO: 8309538 - DNA, 22 bp, Homo sapiens
ccagcactgctctcagactgag

SEQ ID NO: 8309539 - DNA, 22 bp, Homo sapiens
ccacttgtgaaataatcaaata

SEQ ID NO: 8309540 - DNA, 22 bp, Homo sapiens
ccacctccacctattgccagcc

SEQ ID NO: 8309541 - DNA, 22 bp, Homo sapiens
ccacctgagataagagagctca

SEQ ID NO: 8309542 - DNA, 16 bp, Homo sapiens
ccacctgcagctctca

SEQ ID NO: 8309543 - DNA, 22 bp, Homo sapiens
tctcaagcttgttggtatgttt

SEQ ID NO: 8309544 - DNA, 22 bp, Homo sapiens
tctcaagagggaggcaatcatg

SEQ ID NO: 8309545 - DNA, 22 bp, Homo sapiens
tctcccacagtctcccatggct

SEQ ID NO: 8309546 - DNA, 22 bp, Homo sapiens
tctcccacggtacaggataaac

SEQ ID NO: 8309547 - DNA, 22 bp, Homo sapiens
tctccctctcagatttattcac

SEQ ID NO: 8309548 - DNA, 22 bp, Homo sapiens
tctccctctttgtctgctttgg

SEQ ID NO: 8309549 - DNA, 21 bp, Homo sapiens
tcctctgcagtgaggtggcct

SEQ ID NO: 8309550 - DNA, 22 bp, Homo sapiens
tcctctgccaaagggagttgcc

SEQ ID NO: 8309551 - DNA, 18 bp, Homo sapiens
tcctctctttccccaggg

SEQ ID NO: 8309552 - DNA, 22 bp, Homo sapiens
tcctctctgcactggccctgcc

SEQ ID NO: 8309553 - DNA, 18 bp, Homo sapiens
tcctctctttccccaggg

SEQ ID NO: 8309554 - DNA, 22 bp, Homo sapiens
tcggagctgtagatgaaaccct

SEQ ID NO: 8309555 - DNA, 22 bp, Homo sapiens
ccacccttgggttcggaggccg

SEQ ID NO: 8309556 - DNA, 22 bp, Homo sapiens
ccaccctggacaggcctctgag

SEQ ID NO: 8309557 - DNA, 20 bp, Homo sapiens
ccaccctgtccggggcggag

SEQ ID NO: 8309558 - DNA, 22 bp, Homo sapiens
ccaccctgtgcaggcgtgggta

SEQ ID NO: 8309559 - DNA, 22 bp, Homo sapiens
ccaccagctttgccaccctgct

SEQ ID NO: 8309560 - DNA, 22 bp, Homo sapiens
ccaccaggacagccctgagggg

SEQ ID NO: 8309561 - DNA, 22 bp, Homo sapiens
tcctttccagcctcacctcagc

SEQ ID NO: 8309562 - DNA, 22 bp, Homo sapiens
ccaccagcttcagcagccgcgg

SEQ ID NO: 8309563 - DNA, 22 bp, Homo sapiens
ccaccagcagtgtgcaaggatt

SEQ ID NO: 8309564 - DNA, 22 bp, Homo sapiens
cccaggaggcggaggttgcagt

SEQ ID NO: 8309565 - DNA, 20 bp, Homo sapiens
cccaggagtgagcagcttta

SEQ ID NO: 8309566 - DNA, 22 bp, Homo sapiens
tgcctcagtctaaagtctctca

SEQ ID NO: 8309567 - DNA, 22 bp, Homo sapiens
tgcatattatgtgtatctgtct

SEQ ID NO: 8309568 - DNA, 22 bp, Homo sapiens
tgcatatttgtatgatgtttag

SEQ ID NO: 8309569 - DNA, 22 bp, Homo sapiens
tgcatattgtgaaaatgtagat

SEQ ID NO: 8309570 - DNA, 22 bp, Homo sapiens
tgcatattttataaagatggaa

SEQ ID NO: 8309571 - DNA, 22 bp, Homo sapiens
cccaggaggcagaagttgcagt

SEQ ID NO: 8309572 - DNA, 22 bp, Homo sapiens
cccaggaggcagagcttgcagt

SEQ ID NO: 8309573 - DNA, 22 bp, Homo sapiens
cccaggaggccaaggttgcagt

SEQ ID NO: 8309574 - DNA, 22 bp, Homo sapiens
cccaggaggcagaggttgcagt

SEQ ID NO: 8309575 - DNA, 18 bp, Homo sapiens
cccagctccacttccctc

SEQ ID NO: 8309576 - DNA, 22 bp, Homo sapiens
cccagctccagagccagaaaca

SEQ ID NO: 8309577 - DNA, 22 bp, Homo sapiens
cccagctccgagctccgagccg

SEQ ID NO: 8309578 - DNA, 22 bp, Homo sapiens
tgcagtggaaagactcagactt

SEQ ID NO: 8309579 - DNA, 22 bp, Homo sapiens
tgcagtgcctcggcagtgcagc

SEQ ID NO: 8309580 - DNA, 22 bp, Homo sapiens
tgcagtctggatgtcctcagat

SEQ ID NO: 8309581 - DNA, 22 bp, Homo sapiens
tgcagtcttccagctgcacaaa

SEQ ID NO: 8309582 - DNA, 22 bp, Homo sapiens
tgcagtggaagaggtggagatc

SEQ ID NO: 8309583 - DNA, 22 bp, Homo sapiens
tgcagtggaatctggagagcag

SEQ ID NO: 8309584 - DNA, 22 bp, Homo sapiens
tgcagtggaggccgtgagacag

SEQ ID NO: 8309585 - DNA, 22 bp, Homo sapiens
cccagctccaagggacagcgaa

SEQ ID NO: 8309586 - DNA, 22 bp, Homo sapiens
cccagctcatcaggagccgccc

SEQ ID NO: 8309587 - DNA, 22 bp, Homo sapiens
cccagctcatcaggagccgccc

SEQ ID NO: 8309588 - DNA, 22 bp, Homo sapiens
cccagctcaagcagagagctaa

SEQ ID NO: 8309589 - DNA, 22 bp, Homo sapiens
tgcagcattcttggccactact

SEQ ID NO: 8309590 - DNA, 22 bp, Homo sapiens
tgcagcattattcacagtagcc

SEQ ID NO: 8309591 - DNA, 22 bp, Homo sapiens
tgcagcattgcaaagcagtctt

SEQ ID NO: 8309592 - DNA, 22 bp, Homo sapiens
cccagcatttctgggctgcact

SEQ ID NO: 8309593 - DNA, 22 bp, Homo sapiens
cccagccaaggtgctggtgttg

SEQ ID NO: 8309594 - DNA, 22 bp, Homo sapiens
cccagccagcctcttcccatat

SEQ ID NO: 8309595 - DNA, 22 bp, Homo sapiens
cccagcatctccaggcatggcc

SEQ ID NO: 8309596 - DNA, 22 bp, Homo sapiens
cccagcatggagtgaggactca

SEQ ID NO: 8309597 - DNA, 22 bp, Homo sapiens
cccagcccagcgttcgaggggt

SEQ ID NO: 8309598 - DNA, 18 bp, Homo sapiens
cccagcccaccatttctc

SEQ ID NO: 8309599 - DNA, 18 bp, Homo sapiens
cccagcccaccatttctc

SEQ ID NO: 8309600 - DNA, 22 bp, Homo sapiens
cccagccctgacctattggaaa

SEQ ID NO: 8309601 - DNA, 20 bp, Homo sapiens
cccagcccctacctgttgcc

SEQ ID NO: 8309602 - DNA, 22 bp, Homo sapiens
cccagcccatctcaaaggtcta

SEQ ID NO: 8309603 - DNA, 22 bp, Homo sapiens
cccagcccccgagtgtctggaa

SEQ ID NO: 8309604 - DNA, 22 bp, Homo sapiens
tgatacagtcagctcacaattg

SEQ ID NO: 8309605 - DNA, 22 bp, Homo sapiens
cccaagcagggtgcagaggcat

SEQ ID NO: 8309606 - DNA, 22 bp, Homo sapiens
cccaagatctttcgtgcactaa

SEQ ID NO: 8309607 - DNA, 22 bp, Homo sapiens
ccattgtagtatctgttttagt

SEQ ID NO: 8309608 - DNA, 22 bp, Homo sapiens
ccatggccgccgctgctcagga

SEQ ID NO: 8309609 - DNA, 22 bp, Homo sapiens
ccatggcattttatgtgtctta

SEQ ID NO: 8309610 - DNA, 22 bp, Homo sapiens
ccatggagttcctctggtctat

SEQ ID NO: 8309611 - DNA, 19 bp, Homo sapiens
ccatggcaatgatctgatg

SEQ ID NO: 8309612 - DNA, 22 bp, Homo sapiens
tgcagcaggttccaaagggtta

SEQ ID NO: 8309613 - DNA, 23 bp, Homo sapiens
cccagcagattgtaaagtgtcca

SEQ ID NO: 8309614 - DNA, 22 bp, Homo sapiens
cccagcagccagaatgaggagc

SEQ ID NO: 8309615 - DNA, 22 bp, Homo sapiens
cccagcagccagaatgaggagc

SEQ ID NO: 8309616 - DNA, 22 bp, Homo sapiens
cccagcagaatctgatgagggc

SEQ ID NO: 8309617 - DNA, 22 bp, Homo sapiens
cccagcactttgaatatgtcac

SEQ ID NO: 8309618 - DNA, 22 bp, Homo sapiens
cccagcagaccgctgtgatggc

SEQ ID NO: 8309619 - DNA, 23 bp, Homo sapiens
cccagcagagatgaggaggggtc

SEQ ID NO: 8309620 - DNA, 22 bp, Homo sapiens
tgcagagtaaaagcagatgcta

SEQ ID NO: 8309621 - DNA, 22 bp, Homo sapiens
cccagactgcagagcgggcaga

SEQ ID NO: 8309622 - DNA, 17 bp, Homo sapiens
cccagagatgctgcctt

SEQ ID NO: 8309623 - DNA, 22 bp, Homo sapiens
tgcagaggtgttgctgagataa

SEQ ID NO: 8309624 - DNA, 22 bp, Homo sapiens
cccaccagtacagatggtagat

SEQ ID NO: 8309625 - DNA, 22 bp, Homo sapiens
cccacaggctaggggtagggca

SEQ ID NO: 8309626 - DNA, 22 bp, Homo sapiens
cccacaggtccccatgaactcg

SEQ ID NO: 8309627 - DNA, 22 bp, Homo sapiens
tgaacagatggcccagcagagg

SEQ ID NO: 8309628 - DNA, 18 bp, Homo sapiens
tgaacagatgagttgaag

SEQ ID NO: 8309629 - DNA, 22 bp, Homo sapiens
tgaacagatggcccagcagagg

SEQ ID NO: 8309630 - DNA, 22 bp, Homo sapiens
tgaacagatcaatagaactgac

SEQ ID NO: 8309631 - DNA, 22 bp, Homo sapiens
tgaacagatcaatagaactgac

SEQ ID NO: 8309632 - DNA, 22 bp, Homo sapiens
tgaaggaaagagggaacatccc

SEQ ID NO: 8309633 - DNA, 22 bp, Homo sapiens
tgaaggaaatgacggcagaaga

SEQ ID NO: 8309634 - DNA, 22 bp, Homo sapiens
tgaagatgtcagcaggggtggt

SEQ ID NO: 8309635 - DNA, 22 bp, Homo sapiens
tgaaggaatgagggagtgggtc

SEQ ID NO: 8309636 - DNA, 17 bp, Homo sapiens
tgaaggaaggatgatgt

SEQ ID NO: 8309637 - DNA, 22 bp, Homo sapiens
tgaaggaagaataggcagtgtt

SEQ ID NO: 8309638 - DNA, 22 bp, Homo sapiens
tgaaggaatgagtatactgttt

SEQ ID NO: 8309639 - DNA, 22 bp, Homo sapiens
tgaaggaatggaggatcagagc

SEQ ID NO: 8309640 - DNA, 22 bp, Homo sapiens
ccaggctgctcacaagctgccc

SEQ ID NO: 8309641 - DNA, 22 bp, Homo sapiens
ccaggctgctcacaagctgccc

SEQ ID NO: 8309642 - DNA, 22 bp, Homo sapiens
ccaggctgagcatgattggagc

SEQ ID NO: 8309643 - DNA, 22 bp, Homo sapiens
ccaggctgccgaggaaagaaag

SEQ ID NO: 8309644 - DNA, 22 bp, Homo sapiens
tgaaagctgtccactaggctgt

SEQ ID NO: 8309645 - DNA, 22 bp, Homo sapiens
tgaaagctctgtcatcattcct

SEQ ID NO: 8309646 - DNA, 22 bp, Homo sapiens
tctttatttaagtctgttgtaa

SEQ ID NO: 8309647 - DNA, 22 bp, Homo sapiens
ccaggctcaggtgcgagagaca

SEQ ID NO: 8309648 - DNA, 22 bp, Homo sapiens
ccagcctcactggcatcaccta

SEQ ID NO: 8309649 - DNA, 22 bp, Homo sapiens
ccagcccttgctgaagggtggc

SEQ ID NO: 8309650 - DNA, 22 bp, Homo sapiens
ccagcccttgagatggaaggga

SEQ ID NO: 8309651 - DNA, 22 bp, Homo sapiens
ccagcccttgagatggaaggga

SEQ ID NO: 8309652 - DNA, 21 bp, Homo sapiens
tcttgtccttgctctcccact

SEQ ID NO: 8309653 - DNA, 22 bp, Homo sapiens
tcttgtcctaagagctggattc

SEQ ID NO: 8309654 - DNA, 22 bp, Homo sapiens
tcttgcctcttcccctttccat

SEQ ID NO: 8309655 - DNA, 21 bp, Homo sapiens
ccagcctcagatcagggagct

SEQ ID NO: 8309656 - DNA, 22 bp, Homo sapiens
ccagggcatgggaagaactgaa

SEQ ID NO: 8309657 - DNA, 22 bp, Homo sapiens
ccagggccaagagacctcgagg

SEQ ID NO: 8309658 - DNA, 22 bp, Homo sapiens
ccagggcatgtccaagacttag

SEQ ID NO: 8309659 - DNA, 22 bp, Homo sapiens
ccagggcatgtaactaatggtg

SEQ ID NO: 8309660 - DNA, 22 bp, Homo sapiens
tgacatgcttgttttccttgaa

SEQ ID NO: 8309661 - DNA, 22 bp, Homo sapiens
ccagggccagtaagattggcat

SEQ ID NO: 8309662 - DNA, 22 bp, Homo sapiens
tgaccaaaggtggtttatttgg

SEQ ID NO: 8309663 - DNA, 22 bp, Homo sapiens
tgaccaaagagttgcttgtatt

SEQ ID NO: 8309664 - DNA, 22 bp, Homo sapiens
tgaccctgcttcttggtgcagg

SEQ ID NO: 8309665 - DNA, 22 bp, Homo sapiens
ccagggtctctgctgcctgaga

SEQ ID NO: 8309666 - DNA, 22 bp, Homo sapiens
tgagcccaggagttggaggctg

SEQ ID NO: 8309667 - DNA, 22 bp, Homo sapiens
tgagctgggctgggctgagctg

SEQ ID NO: 8309668 - DNA, 22 bp, Homo sapiens
tgagctgggctgggctgagctg

SEQ ID NO: 8309669 - DNA, 23 bp, Homo sapiens
tgagctggtattgtccatctcca

SEQ ID NO: 8309670 - DNA, 22 bp, Homo sapiens
tgagagtgaaatgtcacatgtc

SEQ ID NO: 8309671 - DNA, 19 bp, Homo sapiens
tgagagtgaggaaggcttc

SEQ ID NO: 8309672 - DNA, 22 bp, Homo sapiens
tgagagtgattggttcgaatgt

SEQ ID NO: 8309673 - DNA, 18 bp, Homo sapiens
tgagagtgtgtgctcttg

SEQ ID NO: 8309674 - DNA, 22 bp, Homo sapiens
tgagagtggttcagctcagaag

SEQ ID NO: 8309675 - DNA, 22 bp, Homo sapiens
tgagagtctcagacctcctggt

SEQ ID NO: 8309676 - DNA, 22 bp, Homo sapiens
tgagagtattttggcattatca

SEQ ID NO: 8309677 - DNA, 22 bp, Homo sapiens
ccagggtggggtccaggaacca

SEQ ID NO: 8309678 - DNA, 22 bp, Homo sapiens
ccagggtgtgagaaggaagtag

SEQ ID NO: 8309679 - DNA, 22 bp, Homo sapiens
ccagggtgtagggattccagat

SEQ ID NO: 8309680 - DNA, 22 bp, Homo sapiens
ccagggtgtgggcgtcggcacg

SEQ ID NO: 8309681 - DNA, 22 bp, Homo sapiens
ccagggtgggaggctgaaggcg

SEQ ID NO: 8309682 - DNA, 22 bp, Homo sapiens
ccagggtggcgtagatgctggg

SEQ ID NO: 8309683 - DNA, 22 bp, Homo sapiens
ccagggtgggaggctgaaggcg

SEQ ID NO: 8309684 - DNA, 22 bp, Homo sapiens
ccagggtgggaggctgaaggcg

SEQ ID NO: 8309685 - DNA, 22 bp, Homo sapiens
ccagggtggggcaggcccactg

SEQ ID NO: 8309686 - DNA, 22 bp, Homo sapiens
ccagggtggggcaggcccactg

SEQ ID NO: 8309687 - DNA, 22 bp, Homo sapiens
ccagggtgtgggcgtcggcacg

SEQ ID NO: 8309688 - DNA, 22 bp, Homo sapiens
ccagggtgtgggcgtcggcacg

SEQ ID NO: 8309689 - DNA, 22 bp, Homo sapiens
ccagggtgtgggcgtcggcacg

SEQ ID NO: 8309690 - DNA, 22 bp, Homo sapiens
tgcctgctccagtcctgtccac

SEQ ID NO: 8309691 - DNA, 22 bp, Homo sapiens
tgctttatttataaaatagcaa

SEQ ID NO: 8309692 - DNA, 22 bp, Homo sapiens
tgcctgctaggccctgctgggt

SEQ ID NO: 8309693 - DNA, 22 bp, Homo sapiens
tgcctgctaggccctgctgggt

SEQ ID NO: 8309694 - DNA, 22 bp, Homo sapiens
tggaaggcatgggaactgttct

SEQ ID NO: 8309695 - DNA, 22 bp, Homo sapiens
ccctactctgccactttttctg

SEQ ID NO: 8309696 - DNA, 22 bp, Homo sapiens
tggaaagacattcagccgctgg

SEQ ID NO: 8309697 - DNA, 22 bp, Homo sapiens
cccgtcccttttgcccgctggt

SEQ ID NO: 8309698 - DNA, 22 bp, Homo sapiens
tggaggtgagtgtggtacagca

SEQ ID NO: 8309699 - DNA, 22 bp, Homo sapiens
tggaggtgagtgtggtacagca

SEQ ID NO: 8309700 - DNA, 23 bp, Homo sapiens
ccctggagctagtctgagcagag

SEQ ID NO: 8309701 - DNA, 22 bp, Homo sapiens
ccctgctgaatcccatggagtc

SEQ ID NO: 8309702 - DNA, 22 bp, Homo sapiens
tggaggccagaggtactgggac

SEQ ID NO: 8309703 - DNA, 23 bp, Homo sapiens
ccctgctcaggggtctgattctc

SEQ ID NO: 8309704 - DNA, 22 bp, Homo sapiens
ccctgccttgtctgggctaggt

SEQ ID NO: 8309705 - DNA, 22 bp, Homo sapiens
ccctgccttgtctgggctaggt

SEQ ID NO: 8309706 - DNA, 22 bp, Homo sapiens
ccctgccttgttggagcctatg

SEQ ID NO: 8309707 - DNA, 22 bp, Homo sapiens
ccctgccttgttggagcctatg

SEQ ID NO: 8309708 - DNA, 22 bp, Homo sapiens
ccctgccttcttggcctttaaa

SEQ ID NO: 8309709 - DNA, 22 bp, Homo sapiens
ccctgccttcttggcctttaaa

SEQ ID NO: 8309710 - DNA, 22 bp, Homo sapiens
ccctgccttggggtccacaccg

SEQ ID NO: 8309711 - DNA, 22 bp, Homo sapiens
ccctgccttggggtccacaccg

SEQ ID NO: 8309712 - DNA, 22 bp, Homo sapiens
tggacaggtttgggtgcctgtt

SEQ ID NO: 8309713 - DNA, 22 bp, Homo sapiens
tggacaggttgagtaggaggag

SEQ ID NO: 8309714 - DNA, 22 bp, Homo sapiens
ccctgcctacagggttttcttt

SEQ ID NO: 8309715 - DNA, 22 bp, Homo sapiens
ccctgcctacagggttttcttt

SEQ ID NO: 8309716 - DNA, 22 bp, Homo sapiens
ccctgcctctgaagctgctcag

SEQ ID NO: 8309717 - DNA, 22 bp, Homo sapiens
ccctgcagtgtgacctcaccta

SEQ ID NO: 8309718 - DNA, 22 bp, Homo sapiens
ccctgcctctgaagctgctcag

SEQ ID NO: 8309719 - DNA, 22 bp, Homo sapiens
ccctgcctgtgggcatcaacat

SEQ ID NO: 8309720 - DNA, 22 bp, Homo sapiens
ccctgcctgtgggcatcaacat

SEQ ID NO: 8309721 - DNA, 22 bp, Homo sapiens
ccctgcagaaccacagacaaac

SEQ ID NO: 8309722 - DNA, 22 bp, Homo sapiens
ccctgcagaccaatgccataga

SEQ ID NO: 8309723 - DNA, 20 bp, Homo sapiens
ccctgcagccatgggagtgg

SEQ ID NO: 8309724 - DNA, 22 bp, Homo sapiens
ccctgcagccggccagctcatt

SEQ ID NO: 8309725 - DNA, 22 bp, Homo sapiens
tggctagcccttgtggggagag

SEQ ID NO: 8309726 - DNA, 22 bp, Homo sapiens
tggctaggctccaagagctgga

SEQ ID NO: 8309727 - DNA, 22 bp, Homo sapiens
tggctcagccattcgtgttgcc

SEQ ID NO: 8309728 - DNA, 22 bp, Homo sapiens
tggctcagcctggccctttcat

SEQ ID NO: 8309729 - DNA, 22 bp, Homo sapiens
tggctcagcgcggcctggtctt

SEQ ID NO: 8309730 - DNA, 22 bp, Homo sapiens
tggctcagctgactcggcttct

SEQ ID NO: 8309731 - DNA, 23 bp, Homo sapiens
tggctcagctagttttccatttc

SEQ ID NO: 8309732 - DNA, 22 bp, Homo sapiens
tggctcagcggtggcagcagac

SEQ ID NO: 8309733 - DNA, 22 bp, Homo sapiens
cctccctctgttagagctgtct

SEQ ID NO: 8309734 - DNA, 22 bp, Homo sapiens
cctccctctttcagtcccacag

SEQ ID NO: 8309735 - DNA, 22 bp, Homo sapiens
tggctaacaaggtgaaaccccg

SEQ ID NO: 8309736 - DNA, 22 bp, Homo sapiens
tggcctggggacctgtgagacc

SEQ ID NO: 8309737 - DNA, 22 bp, Homo sapiens
cctcagctgcttccctggagcc

SEQ ID NO: 8309738 - DNA, 22 bp, Homo sapiens
cctcagctcttccctgtgcaca

SEQ ID NO: 8309739 - DNA, 23 bp, Homo sapiens
tggcctctccccacctggcagaa

SEQ ID NO: 8309740 - DNA, 23 bp, Homo sapiens
cctcagcatggcaggagcccagc

SEQ ID NO: 8309741 - DNA, 22 bp, Homo sapiens
cctcagccttggccccaggcag

SEQ ID NO: 8309742 - DNA, 22 bp, Homo sapiens
cctcactctgcaccctgcagca

SEQ ID NO: 8309743 - DNA, 22 bp, Homo sapiens
cctcactggccagccaggggtg

SEQ ID NO: 8309744 - DNA, 22 bp, Homo sapiens
cctcactttcctttctcctggg

SEQ ID NO: 8309745 - DNA, 22 bp, Homo sapiens
tggcctcaagtctgagggcctt

SEQ ID NO: 8309746 - DNA, 22 bp, Homo sapiens
tggcctcccctaacagcctctt

SEQ ID NO: 8309747 - DNA, 21 bp, Homo sapiens
tggcctcccacacttccatgg

SEQ ID NO: 8309748 - DNA, 23 bp, Homo sapiens
ccctgtagcccaggacaggcttt

SEQ ID NO: 8309749 - DNA, 22 bp, Homo sapiens
ccctgtcctggatgggagcact

SEQ ID NO: 8309750 - DNA, 22 bp, Homo sapiens
ccctgtccttggctgtgaggct

SEQ ID NO: 8309751 - DNA, 22 bp, Homo sapiens
ccctggtggtacggcactggca

SEQ ID NO: 8309752 - DNA, 22 bp, Homo sapiens
ccctggagctgcttgcatgttg

SEQ ID NO: 8309753 - DNA, 22 bp, Homo sapiens
ccctggaggaaaatctgaggct

SEQ ID NO: 8309754 - DNA, 22 bp, Homo sapiens
ccctgtgctgtcatgctgggcg

SEQ ID NO: 8309755 - DNA, 22 bp, Homo sapiens
ccctgtgcattggagggtgttt

SEQ ID NO: 8309756 - DNA, 22 bp, Homo sapiens
ccctgtgccagagaggcaggag

SEQ ID NO: 8309757 - DNA, 22 bp, Homo sapiens
ccctgtgcagatggcagctggg

SEQ ID NO: 8309758 - DNA, 22 bp, Homo sapiens
ccgggcgggggctctcgtcacc

SEQ ID NO: 8309759 - DNA, 22 bp, Homo sapiens
ccgggcctcgggacaccgggta

SEQ ID NO: 8309760 - DNA, 22 bp, Homo sapiens
ccggctactcgggaggctgacg

SEQ ID NO: 8309761 - DNA, 22 bp, Homo sapiens
ccggggacttaaagtgaaggaa

SEQ ID NO: 8309762 - DNA, 18 bp, Homo sapiens
ccgggctttggtgacaca

SEQ ID NO: 8309763 - DNA, 22 bp, Homo sapiens
cctcacagggccaggcccctca

SEQ ID NO: 8309764 - DNA, 17 bp, Homo sapiens
cctcacagggaccagac

SEQ ID NO: 8309765 - DNA, 22 bp, Homo sapiens
cctcacccagtcacctaggtgg

SEQ ID NO: 8309766 - DNA, 22 bp, Homo sapiens
cctcacccactacactcaaggg

SEQ ID NO: 8309767 - DNA, 22 bp, Homo sapiens
cctattgacaattctcttctcc

SEQ ID NO: 8309768 - DNA, 21 bp, Homo sapiens
cctattgaatataggaagatt

SEQ ID NO: 8309769 - DNA, 18 bp, Homo sapiens
tgtacagttatgagcatt

SEQ ID NO: 8309770 - DNA, 22 bp, Homo sapiens
tgtacagtgtagtcatgaggtt

SEQ ID NO: 8309771 - DNA, 22 bp, Homo sapiens
tgtacattgtcactcatcaagt

SEQ ID NO: 8309772 - DNA, 22 bp, Homo sapiens
tgtacatgtgtctgtatatctt

SEQ ID NO: 8309773 - DNA, 22 bp, Homo sapiens
tgtacatttagagctcaataga

SEQ ID NO: 8309774 - DNA, 22 bp, Homo sapiens
cctggagcactctccctggctg

SEQ ID NO: 8309775 - DNA, 22 bp, Homo sapiens
tgtaatggaagtgggattgcat

SEQ ID NO: 8309776 - DNA, 22 bp, Homo sapiens
tgtaatcattacagtacatgga

SEQ ID NO: 8309777 - DNA, 22 bp, Homo sapiens
cctgcttcagggatgatggcac

SEQ ID NO: 8309778 - DNA, 19 bp, Homo sapiens
cctggaggtgaaggttctc

SEQ ID NO: 8309779 - DNA, 22 bp, Homo sapiens
cctggagggcgccgcacagtcc

SEQ ID NO: 8309780 - DNA, 22 bp, Homo sapiens
cctggaggcggaggttgcagtg

SEQ ID NO: 8309781 - DNA, 18 bp, Homo sapiens
cctggagctccacagcaa

SEQ ID NO: 8309782 - DNA, 22 bp, Homo sapiens
cctggagcttggtcacgctgcg

SEQ ID NO: 8309783 - DNA, 22 bp, Homo sapiens
cctggaggagcgctgaccagct

SEQ ID NO: 8309784 - DNA, 22 bp, Homo sapiens
cctggagcttttccatcctgga

SEQ ID NO: 8309785 - DNA, 22 bp, Homo sapiens
cctggagcttttccatcctgga

SEQ ID NO: 8309786 - DNA, 22 bp, Homo sapiens
cctgccagggccttggaagaaa

SEQ ID NO: 8309787 - DNA, 22 bp, Homo sapiens
cctgccagtcactatgtcacct

SEQ ID NO: 8309788 - DNA, 18 bp, Homo sapiens
cctgccagtctggagcag

SEQ ID NO: 8309789 - DNA, 18 bp, Homo sapiens
cctgccagtctggagcag

SEQ ID NO: 8309790 - DNA, 22 bp, Homo sapiens
cctgccaggctttgggcttctg

SEQ ID NO: 8309791 - DNA, 22 bp, Homo sapiens
cctgcctggtgtaagtctaagg

SEQ ID NO: 8309792 - DNA, 22 bp, Homo sapiens
cctgcctggggacaaaggaggg

SEQ ID NO: 8309793 - DNA, 22 bp, Homo sapiens
cctgcctgggctcacttgccag

SEQ ID NO: 8309794 - DNA, 22 bp, Homo sapiens
cctgcctgggctcacttgccag

SEQ ID NO: 8309795 - DNA, 20 bp, Homo sapiens
cctgcctgcctcggctcatt

SEQ ID NO: 8309796 - DNA, 20 bp, Homo sapiens
cctgcctgcctcggctcatt

SEQ ID NO: 8309797 - DNA, 22 bp, Homo sapiens
cctgcctgcctgctggccggga

SEQ ID NO: 8309798 - DNA, 22 bp, Homo sapiens
cctgcctgtcatcgcctgcgcc

SEQ ID NO: 8309799 - DNA, 22 bp, Homo sapiens
cctgcctgtactagagacccag

SEQ ID NO: 8309800 - DNA, 22 bp, Homo sapiens
cctgcctgtaagatgggtacaa

SEQ ID NO: 8309801 - DNA, 22 bp, Homo sapiens
cctgcctgtaagatgggtacaa

SEQ ID NO: 8309802 - DNA, 22 bp, Homo sapiens
cctgcctggtgtaagtctaagg

SEQ ID NO: 8309803 - DNA, 20 bp, Homo sapiens
cctgcctgtgtttgtgatga

SEQ ID NO: 8309804 - DNA, 22 bp, Homo sapiens
cctgcctgtccctcagtccaca

SEQ ID NO: 8309805 - DNA, 22 bp, Homo sapiens
cctgctggccagtggagggctg

SEQ ID NO: 8309806 - DNA, 22 bp, Homo sapiens
cctgctgggcctgagcaatgag

SEQ ID NO: 8309807 - DNA, 22 bp, Homo sapiens
cctgctgtgaaactggcatatg

SEQ ID NO: 8309808 - DNA, 22 bp, Homo sapiens
cctgctgcttaggccatatttc

SEQ ID NO: 8309809 - DNA, 22 bp, Homo sapiens
tggtctcttcttccaagatggc

SEQ ID NO: 8309810 - DNA, 22 bp, Homo sapiens
tggtctcttcttccaagatggc

SEQ ID NO: 8309811 - DNA, 23 bp, Homo sapiens
cctgaagggtcagggtcctcagc

SEQ ID NO: 8309812 - DNA, 22 bp, Homo sapiens
cctctttgtgcctgcaggctgc

SEQ ID NO: 8309813 - DNA, 22 bp, Homo sapiens
cctgaagcaagggtaggcaggt

SEQ ID NO: 8309814 - DNA, 22 bp, Homo sapiens
cctcttgccaatcagctacaga

SEQ ID NO: 8309815 - DNA, 22 bp, Homo sapiens
tgggccacttgaaagtggatgt

SEQ ID NO: 8309816 - DNA, 22 bp, Homo sapiens
tggctctgaccaggtagaggag

SEQ ID NO: 8309817 - DNA, 21 bp, Homo sapiens
tggctctgaaagagtgctgca

SEQ ID NO: 8309818 - DNA, 22 bp, Homo sapiens
tggctctcagctcccagcagcc

SEQ ID NO: 8309819 - DNA, 22 bp, Homo sapiens
tggctctcagctcccagcagcc

SEQ ID NO: 8309820 - DNA, 22 bp, Homo sapiens
tggctctcaggcctgctgcgtt

SEQ ID NO: 8309821 - DNA, 23 bp, Homo sapiens
tggctctctcagtgctgcagagg

SEQ ID NO: 8309822 - DNA, 22 bp, Homo sapiens
cctctggcaacttcacagccca

SEQ ID NO: 8309823 - DNA, 22 bp, Homo sapiens
tgggagctcagaaagggaggtc

SEQ ID NO: 8309824 - DNA, 22 bp, Homo sapiens
tgggggtgtgccagggacctcc

SEQ ID NO: 8309825 - DNA, 22 bp, Homo sapiens
tgggggtgtcctggtgcacaca

SEQ ID NO: 8309826 - DNA, 21 bp, Homo sapiens
cctgagggtggttgtgaagat

SEQ ID NO: 8309827 - DNA, 20 bp, Homo sapiens
cctgagggtttgtgttcttt

SEQ ID NO: 8309828 - DNA, 22 bp, Homo sapiens
cctgccaggccagtgagcttcc

SEQ ID NO: 8309829 - DNA, 22 bp, Homo sapiens
cctgccaggagctggtgctgca

SEQ ID NO: 8309830 - DNA, 22 bp, Homo sapiens
cctgccagagcagcttgtcctc

SEQ ID NO: 8309831 - DNA, 22 bp, Homo sapiens
cctgcagacacttgtccagcaa

SEQ ID NO: 8309832 - DNA, 22 bp, Homo sapiens
cctgcactacctggggctgctg

SEQ ID NO: 8309833 - DNA, 22 bp, Homo sapiens
cctgcagaaagggtccccagga

SEQ ID NO: 8309834 - DNA, 22 bp, Homo sapiens
cctgagacatgaaccaggctcc

SEQ ID NO: 8309835 - DNA, 22 bp, Homo sapiens
cctgactctggccaggccagct

SEQ ID NO: 8309836 - DNA, 22 bp, Homo sapiens
cctgacgaaaggcgtgctggag

SEQ ID NO: 8309837 - DNA, 22 bp, Homo sapiens
cctgaggccctggctgtgctga

SEQ ID NO: 8309838 - DNA, 22 bp, Homo sapiens
cctgagggcgccgagctcccag

SEQ ID NO: 8309839 - DNA, 22 bp, Homo sapiens
cctgagggagggtataggctgt

SEQ ID NO: 8309840 - DNA, 22 bp, Homo sapiens
cctgaggggctgcaggccagct

SEQ ID NO: 8309841 - DNA, 22 bp, Homo sapiens
cctgagggaaggatgctaccca

SEQ ID NO: 8309842 - DNA, 22 bp, Homo sapiens
cctgaggcttaatctgtcccaa

SEQ ID NO: 8309843 - DNA, 17 bp, Homo sapiens
ttttctctcttggattc

SEQ ID NO: 8309844 - DNA, 22 bp, Homo sapiens
ctctgtgggggagaggcagctg

SEQ ID NO: 8309845 - DNA, 22 bp, Homo sapiens
ctctgtgcctcagttttcttct

SEQ ID NO: 8309846 - DNA, 22 bp, Homo sapiens
ctctgtgattttgtgagccaga

SEQ ID NO: 8309847 - DNA, 22 bp, Homo sapiens
ctctgtgccagtctgcactcgg

SEQ ID NO: 8309848 - DNA, 22 bp, Homo sapiens
ctctgtgccctactgctcagct

SEQ ID NO: 8309849 - DNA, 22 bp, Homo sapiens
ctctgcagaatttgagctgctc

SEQ ID NO: 8309850 - DNA, 22 bp, Homo sapiens
ctctgcagaggcccaaggctga

SEQ ID NO: 8309851 - DNA, 22 bp, Homo sapiens
ctctgaactcttgggcagcatg

SEQ ID NO: 8309852 - DNA, 22 bp, Homo sapiens
ctctgaagggagggccaagccc

SEQ ID NO: 8309853 - DNA, 22 bp, Homo sapiens
tttgaaaatttaagtgctacac

SEQ ID NO: 8309854 - DNA, 22 bp, Homo sapiens
ctctggccagagcctgcgggaa

SEQ ID NO: 8309855 - DNA, 19 bp, Homo sapiens
ctctggcctctggatgctg

SEQ ID NO: 8309856 - DNA, 22 bp, Homo sapiens
ctctggccgcagctcagctctg

SEQ ID NO: 8309857 - DNA, 22 bp, Homo sapiens
ctctggcctgcttcctcaggta

SEQ ID NO: 8309858 - DNA, 22 bp, Homo sapiens
tttatgtaagtggaatgatgcc

SEQ ID NO: 8309859 - DNA, 22 bp, Homo sapiens
ctccaggagctgtgtctttctt

SEQ ID NO: 8309860 - DNA, 22 bp, Homo sapiens
ctccaggccatggctgcggagg

SEQ ID NO: 8309861 - DNA, 22 bp, Homo sapiens
ctccaggccagggaagtggaca

SEQ ID NO: 8309862 - DNA, 22 bp, Homo sapiens
tttattcatcatctgttcatat

SEQ ID NO: 8309863 - DNA, 22 bp, Homo sapiens
ctccttcccctactcagcatcc

SEQ ID NO: 8309864 - DNA, 22 bp, Homo sapiens
ctccttcccttcaagtgttcct

SEQ ID NO: 8309865 - DNA, 22 bp, Homo sapiens
ctccttcctggttagcacctta

SEQ ID NO: 8309866 - DNA, 22 bp, Homo sapiens
ctccttcctgccccagtgataa

SEQ ID NO: 8309867 - DNA, 22 bp, Homo sapiens
tttcattacgtgtttgacttgt

SEQ ID NO: 8309868 - DNA, 22 bp, Homo sapiens
tttcatgttttcttaaatggca

SEQ ID NO: 8309869 - DNA, 22 bp, Homo sapiens
tttcatgtttatggaaaatgag

SEQ ID NO: 8309870 - DNA, 22 bp, Homo sapiens
tttccaataaagtgtcattgtt

SEQ ID NO: 8309871 - DNA, 22 bp, Homo sapiens
ctctcttcccgtgagtgttgca

SEQ ID NO: 8309872 - DNA, 22 bp, Homo sapiens
ctctctgttatgctttcatgaa

SEQ ID NO: 8309873 - DNA, 22 bp, Homo sapiens
ctctctggtttcagcgaagggg

SEQ ID NO: 8309874 - DNA, 22 bp, Homo sapiens
ctctctggtttcagcgaagggg

SEQ ID NO: 8309875 - DNA, 22 bp, Homo sapiens
ctctctgtggtggctgtcccat

SEQ ID NO: 8309876 - DNA, 18 bp, Homo sapiens
ctctctttccactctttg

SEQ ID NO: 8309877 - DNA, 18 bp, Homo sapiens
ctctctggtctggatccc

SEQ ID NO: 8309878 - DNA, 22 bp, Homo sapiens
ctggaaggctctgctgcctgtc

SEQ ID NO: 8309879 - DNA, 22 bp, Homo sapiens
ctggaaggttcctcccagctcc

SEQ ID NO: 8309880 - DNA, 22 bp, Homo sapiens
ctggaagggtctacttagcaga

SEQ ID NO: 8309881 - DNA, 22 bp, Homo sapiens
ctggaaggtctgtccccactgc

SEQ ID NO: 8309882 - DNA, 22 bp, Homo sapiens
ctgctgtctttatttcactgct

SEQ ID NO: 8309883 - DNA, 22 bp, Homo sapiens
ctggaagaggaagccagctgga

SEQ ID NO: 8309884 - DNA, 22 bp, Homo sapiens
ctggagagaccgaaagaggctg

SEQ ID NO: 8309885 - DNA, 22 bp, Homo sapiens
ctggagagatcctcctgaaaaa

SEQ ID NO: 8309886 - DNA, 22 bp, Homo sapiens
ctggagaggccccaagatattt

SEQ ID NO: 8309887 - DNA, 22 bp, Homo sapiens
ctggagaggctgggaacaggtt

SEQ ID NO: 8309888 - DNA, 22 bp, Homo sapiens
ctggagaggctgggaacaggtt

SEQ ID NO: 8309889 - DNA, 22 bp, Homo sapiens
ctggagagggagccctggcagt

SEQ ID NO: 8309890 - DNA, 22 bp, Homo sapiens
ctggagccggcgagccccagcc

SEQ ID NO: 8309891 - DNA, 22 bp, Homo sapiens
ctggagcctaggttgacctggg

SEQ ID NO: 8309892 - DNA, 22 bp, Homo sapiens
ctggagcctaggttgacctggg

SEQ ID NO: 8309893 - DNA, 22 bp, Homo sapiens
ctggagcctgcagttttcactt

SEQ ID NO: 8309894 - DNA, 17 bp, Homo sapiens
ctggagcctccaactcc

SEQ ID NO: 8309895 - DNA, 22 bp, Homo sapiens
ctggagccgcatggagcaggga

SEQ ID NO: 8309896 - DNA, 22 bp, Homo sapiens
ctggagccggaccagggacggt

SEQ ID NO: 8309897 - DNA, 22 bp, Homo sapiens
ctggagccggaccagggacggt

SEQ ID NO: 8309898 - DNA, 22 bp, Homo sapiens
ctggagccctgaatgggcagga

SEQ ID NO: 8309899 - DNA, 22 bp, Homo sapiens
ctggagccccaggctgtgcaga

SEQ ID NO: 8309900 - DNA, 22 bp, Homo sapiens
ctggagccccaggctgtgcaga

SEQ ID NO: 8309901 - DNA, 22 bp, Homo sapiens
ctggagcatccatgcccagggt

SEQ ID NO: 8309902 - DNA, 22 bp, Homo sapiens
ctggagcaggtttaggagtccc

SEQ ID NO: 8309903 - DNA, 22 bp, Homo sapiens
ctggagcaggcttgtcccagct

SEQ ID NO: 8309904 - DNA, 22 bp, Homo sapiens
ctgcctggggaatgtgaggatt

SEQ ID NO: 8309905 - DNA, 22 bp, Homo sapiens
ctgcctggggaatgtgaggatt

SEQ ID NO: 8309906 - DNA, 22 bp, Homo sapiens
ctgcctgtgtgtgcctgcagaa

SEQ ID NO: 8309907 - DNA, 19 bp, Homo sapiens
ctgcctgttatggagagaa

SEQ ID NO: 8309908 - DNA, 22 bp, Homo sapiens
ctgcctgttagtctagcagtta

SEQ ID NO: 8309909 - DNA, 18 bp, Homo sapiens
ctgcctgttgctgagagg

SEQ ID NO: 8309910 - DNA, 22 bp, Homo sapiens
ctgcctgttttctgatagattt

SEQ ID NO: 8309911 - DNA, 22 bp, Homo sapiens
ctgccttccaaccccagactcc

SEQ ID NO: 8309912 - DNA, 22 bp, Homo sapiens
ctgccttgaggaggttgtggga

SEQ ID NO: 8309913 - DNA, 21 bp, Homo sapiens
ctgccttgaatggtactggga

SEQ ID NO: 8309914 - DNA, 22 bp, Homo sapiens
ctgccttgaaaatgaagcttta

SEQ ID NO: 8309915 - DNA, 22 bp, Homo sapiens
ctgccttggaaaatgtggtaat

SEQ ID NO: 8309916 - DNA, 22 bp, Homo sapiens
ctgccttggccctagttcatgg

SEQ ID NO: 8309917 - DNA, 22 bp, Homo sapiens
ctgcctttgcccttgacactgt

SEQ ID NO: 8309918 - DNA, 21 bp, Homo sapiens
ctgctctgacagtgaggccag

SEQ ID NO: 8309919 - DNA, 22 bp, Homo sapiens
ctgctctgtggtccatgagaca

SEQ ID NO: 8309920 - DNA, 22 bp, Homo sapiens
ctgctctgaccctttcaccttc

SEQ ID NO: 8309921 - DNA, 22 bp, Homo sapiens
ctgctctgttcccccatcatct

SEQ ID NO: 8309922 - DNA, 22 bp, Homo sapiens
ctgctctgttaattaaactttg

SEQ ID NO: 8309923 - DNA, 22 bp, Homo sapiens
ctgctctgtttcttagctgggt

SEQ ID NO: 8309924 - DNA, 22 bp, Homo sapiens
ctgctctgtttcttagctgggt

SEQ ID NO: 8309925 - DNA, 22 bp, Homo sapiens
ctgctcttcccactcactccca

SEQ ID NO: 8309926 - DNA, 22 bp, Homo sapiens
ctgctgagcatcagggctgccc

SEQ ID NO: 8309927 - DNA, 22 bp, Homo sapiens
ctgctgggaaggtctgctcagt

SEQ ID NO: 8309928 - DNA, 22 bp, Homo sapiens
ctgctgggaaggtctgctcagt

SEQ ID NO: 8309929 - DNA, 19 bp, Homo sapiens
ctgctgggtgctgagggag

SEQ ID NO: 8309930 - DNA, 22 bp, Homo sapiens
ctgctgggtctatgcaagtgga

SEQ ID NO: 8309931 - DNA, 22 bp, Homo sapiens
ctgctgtccaacctgcactcgc

SEQ ID NO: 8309932 - DNA, 22 bp, Homo sapiens
ctgctgtcgccgagctgcatgc

SEQ ID NO: 8309933 - DNA, 22 bp, Homo sapiens
ctgccccatggtccctggtggg

SEQ ID NO: 8309934 - DNA, 22 bp, Homo sapiens
ctgcccaggaaccagaggggca

SEQ ID NO: 8309935 - DNA, 22 bp, Homo sapiens
ctgcaggattctcccagttgga

SEQ ID NO: 8309936 - DNA, 20 bp, Homo sapiens
ctgcccagccactgagggat

SEQ ID NO: 8309937 - DNA, 22 bp, Homo sapiens
ctgaggtctctttccatagtga

SEQ ID NO: 8309938 - DNA, 22 bp, Homo sapiens
ctgaggtgagcttccctgggct

SEQ ID NO: 8309939 - DNA, 19 bp, Homo sapiens
ctgaggtgcagtaagaggc

SEQ ID NO: 8309940 - DNA, 22 bp, Homo sapiens
ctgaggtggaacagaggtgaag

SEQ ID NO: 8309941 - DNA, 22 bp, Homo sapiens
ctgaggtgctagggtccctgct

SEQ ID NO: 8309942 - DNA, 22 bp, Homo sapiens
ctgaggtgctatggaggatacg

SEQ ID NO: 8309943 - DNA, 22 bp, Homo sapiens
ctgaggtgtttagtaggggcgg

SEQ ID NO: 8309944 - DNA, 22 bp, Homo sapiens
ctgaggtgttgatgacctatgc

SEQ ID NO: 8309945 - DNA, 22 bp, Homo sapiens
ctgaggtgtgaaatggtggcaa

SEQ ID NO: 8309946 - DNA, 22 bp, Homo sapiens
ctgaggtggaacagaggtgaag

SEQ ID NO: 8309947 - DNA, 22 bp, Homo sapiens
ctgcagcctaggtgcagctggg

SEQ ID NO: 8309948 - DNA, 22 bp, Homo sapiens
ctgcagcctcaacctcctgagc

SEQ ID NO: 8309949 - DNA, 22 bp, Homo sapiens
ctgcagctgtagaggacagtgg

SEQ ID NO: 8309950 - DNA, 22 bp, Homo sapiens
ctgcagctgtctctactgggca

SEQ ID NO: 8309951 - DNA, 22 bp, Homo sapiens
ctgcaggaattcaaagtgagct

SEQ ID NO: 8309952 - DNA, 22 bp, Homo sapiens
ctgcagctttggaaacctgttt

SEQ ID NO: 8309953 - DNA, 22 bp, Homo sapiens
ctgagccaaaaagcagagcttg

SEQ ID NO: 8309954 - DNA, 22 bp, Homo sapiens
ctgagccaaaaagcagagcttg

SEQ ID NO: 8309955 - DNA, 17 bp, Homo sapiens
ctgagcatccgtgctct

SEQ ID NO: 8309956 - DNA, 22 bp, Homo sapiens
ctgagcatggccggtccatggt

SEQ ID NO: 8309957 - DNA, 22 bp, Homo sapiens
ctgaggctcaagggcaggtggg

SEQ ID NO: 8309958 - DNA, 22 bp, Homo sapiens
ctgaggtctagacaccccaggg

SEQ ID NO: 8309959 - DNA, 22 bp, Homo sapiens
ctgaggctggagtgcagtggtg

SEQ ID NO: 8309960 - DNA, 22 bp, Homo sapiens
ctgaggctccctcgggtctgct

SEQ ID NO: 8309961 - DNA, 22 bp, Homo sapiens
ctgaggctgcccagggccaggt

SEQ ID NO: 8309962 - DNA, 19 bp, Homo sapiens
ctgagcagcggcagcactt

SEQ ID NO: 8309963 - DNA, 22 bp, Homo sapiens
ctcttcctacagtctgctatgc

SEQ ID NO: 8309964 - DNA, 22 bp, Homo sapiens
ctcttcctctcatgcggtcata

SEQ ID NO: 8309965 - DNA, 23 bp, Homo sapiens
cgttttttcctcagatgttctgg

SEQ ID NO: 8309966 - DNA, 18 bp, Homo sapiens
cgtttttccgggattgca

SEQ ID NO: 8309967 - DNA, 22 bp, Homo sapiens
cgttggagacacttgaggactt

SEQ ID NO: 8309968 - DNA, 22 bp, Homo sapiens
cgtgtacagtctatcttttttc

SEQ ID NO: 8309969 - DNA, 22 bp, Homo sapiens
cgtgtcatctgagccttgggcg

SEQ ID NO: 8309970 - DNA, 22 bp, Homo sapiens
cgtgtggtcccggcaaggcaag

SEQ ID NO: 8309971 - DNA, 22 bp, Homo sapiens
ctagaaatacaggcacgtgcca

SEQ ID NO: 8309972 - DNA, 22 bp, Homo sapiens
ctagagggatgttaggatagca

SEQ ID NO: 8309973 - DNA, 22 bp, Homo sapiens
ctagagaggcagatgtcctgtg

SEQ ID NO: 8309974 - DNA, 22 bp, Homo sapiens
ctcactgcaagctcagcctccc

SEQ ID NO: 8309975 - DNA, 18 bp, Homo sapiens
ctcaccattctgcccaat

SEQ ID NO: 8309976 - DNA, 22 bp, Homo sapiens
ctcagagaagtctttgctaaac

SEQ ID NO: 8309977 - DNA, 22 bp, Homo sapiens
ctcactgcaagctccacctctt

SEQ ID NO: 8309978 - DNA, 22 bp, Homo sapiens
ctcagagcaatgaacatgcaaa

SEQ ID NO: 8309979 - DNA, 22 bp, Homo sapiens
ctcagagcccagggtacacccg

SEQ ID NO: 8309980 - DNA, 22 bp, Homo sapiens
ctcagggcagtatggctgagag

SEQ ID NO: 8309981 - DNA, 18 bp, Homo sapiens
ctcagggcatcagtctgg

SEQ ID NO: 8309982 - DNA, 22 bp, Homo sapiens
ctcagggccaaggatgctgttg

SEQ ID NO: 8309983 - DNA, 22 bp, Homo sapiens
ctcagggtaatgaaagacgaat

SEQ ID NO: 8309984 - DNA, 22 bp, Homo sapiens
ctcagggtctggtccttagatt

SEQ ID NO: 8309985 - DNA, 22 bp, Homo sapiens
ctcagggggaatcaggtcacag

SEQ ID NO: 8309986 - DNA, 22 bp, Homo sapiens
ctcaggggacctggctccgagt

SEQ ID NO: 8309987 - DNA, 22 bp, Homo sapiens
ctcagggcttgagtgtccagga

SEQ ID NO: 8309988 - DNA, 22 bp, Homo sapiens
ttgcataaagattttattgcat

SEQ ID NO: 8309989 - DNA, 22 bp, Homo sapiens
ttgcataaaagagtatatctta

SEQ ID NO: 8309990 - DNA, 22 bp, Homo sapiens
ttgcataaatgcttaaaatttg

SEQ ID NO: 8309991 - DNA, 22 bp, Homo sapiens
ctcaggaggtggtagaggccct

SEQ ID NO: 8309992 - DNA, 22 bp, Homo sapiens
ctcaggaggaggaagttcattg

SEQ ID NO: 8309993 - DNA, 22 bp, Homo sapiens
ctcaggacccggtccaggtggg

SEQ ID NO: 8309994 - DNA, 22 bp, Homo sapiens
ctcaggagacagtgtccacatg

SEQ ID NO: 8309995 - DNA, 22 bp, Homo sapiens
ctcaggagatgacagaaggtat

SEQ ID NO: 8309996 - DNA, 19 bp, Homo sapiens
ctcagctgtagctcatgtg

SEQ ID NO: 8309997 - DNA, 22 bp, Homo sapiens
ctcagctggcaattctggctcc

SEQ ID NO: 8309998 - DNA, 22 bp, Homo sapiens
ttggaaggagtcaaccagctga

SEQ ID NO: 8309999 - DNA, 19 bp, Homo sapiens
ttggaaggagccagagtgg

SEQ ID NO: 8310000 - DNA, 22 bp, Homo sapiens
ttggaaggtgagtccctgggtt

SEQ ID NO: 8310001 - DNA, 22 bp, Homo sapiens
ttggaaggccctgcctagcagg

SEQ ID NO: 8310002 - DNA, 22 bp, Homo sapiens
ttggctgaaggttaagtgctgg

SEQ ID NO: 8310003 - DNA, 22 bp, Homo sapiens
ttggctgagagaggaaaagggc

SEQ ID NO: 8310004 - DNA, 21 bp, Homo sapiens
ttagcaaagcaaacacatgct

SEQ ID NO: 8310005 - DNA, 22 bp, Homo sapiens
ccttcagacctagacaggaatc

SEQ ID NO: 8310006 - DNA, 23 bp, Homo sapiens
ccttcagaagaagtaacaggggc

SEQ ID NO: 8310007 - DNA, 22 bp, Homo sapiens
ccttgcaggggaacaggcagtg

SEQ ID NO: 8310008 - DNA, 22 bp, Homo sapiens
ttatcattgtcgcagtctaatt

SEQ ID NO: 8310009 - DNA, 22 bp, Homo sapiens
ttatccaaactggtgaatcatt

SEQ ID NO: 8310010 - DNA, 18 bp, Homo sapiens
ttaagagctgaaagggga

SEQ ID NO: 8310011 - DNA, 21 bp, Homo sapiens
ttaagagcttagcagtaggcc

SEQ ID NO: 8310012 - DNA, 22 bp, Homo sapiens
ttacaaagagtgttcttttcca

SEQ ID NO: 8310013 - DNA, 22 bp, Homo sapiens
ccttagagagtactgggctgcc

SEQ ID NO: 8310014 - DNA, 22 bp, Homo sapiens
ttacaaagagtgccagagtgtg

SEQ ID NO: 8310015 - DNA, 22 bp, Homo sapiens
cctgtgtgtctgtcactgcaca

SEQ ID NO: 8310016 - DNA, 22 bp, Homo sapiens
ccttaaaagaactatctcttct

SEQ ID NO: 8310017 - DNA, 22 bp, Homo sapiens
cggggctgctcgtcctcctgtg

SEQ ID NO: 8310018 - DNA, 22 bp, Homo sapiens
cgtggggacccacgtgcagcac

SEQ ID NO: 8310019 - DNA, 22 bp, Homo sapiens
cggggctgctcgtcctcctgtg

SEQ ID NO: 8310020 - DNA, 22 bp, Homo sapiens
cggggctgcgctcttcctgccg

SEQ ID NO: 8310021 - DNA, 22 bp, Homo sapiens
cggggctgcgctcttcctgccg

SEQ ID NO: 8310022 - DNA, 22 bp, Homo sapiens
cggggagggcagaggctccctc

SEQ ID NO: 8310023 - DNA, 22 bp, Homo sapiens
cggggaggcttcggattaaagc

SEQ ID NO: 8310024 - DNA, 22 bp, Homo sapiens
cggggacacactggcagctcct

SEQ ID NO: 8310025 - DNA, 22 bp, Homo sapiens
cgggctggctgcagctgctgga

SEQ ID NO: 8310026 - DNA, 21 bp, Homo sapiens
ttcaaagtttgcctaaagatt

SEQ ID NO: 8310027 - DNA, 22 bp, Homo sapiens
ttcaaagtgcatgttcctcaga

SEQ ID NO: 8310028 - DNA, 22 bp, Homo sapiens
cggaggttgaggctgcagtgag

SEQ ID NO: 8310029 - DNA, 22 bp, Homo sapiens
cggcagcaaaggaagccaggtc

SEQ ID NO: 8310030 - DNA, 18 bp, Homo sapiens
cggcagagtgcttctagc

SEQ ID NO: 8310031 - DNA, 22 bp, Homo sapiens
cggcagctccgcgccgtaggac

SEQ ID NO: 8310032 - DNA, 22 bp, Homo sapiens
cggcagagacggcgctttgaac

SEQ ID NO: 8310033 - DNA, 22 bp, Homo sapiens
cggcagagcttcctgctcagcg

SEQ ID NO: 8310034 - DNA, 22 bp, Homo sapiens
ttattgcctgattgaggtcatt

SEQ ID NO: 8310035 - DNA, 22 bp, Homo sapiens
ttatttattgtgtacctactgt

SEQ ID NO: 8310036 - DNA, 22 bp, Homo sapiens
cgctgctccgccttgtccatat

SEQ ID NO: 8310037 - DNA, 22 bp, Homo sapiens
cgctggccatagcctcctgtgt

SEQ ID NO: 8310038 - DNA, 22 bp, Homo sapiens
cgctgccaggatcccctgccgg

SEQ ID NO: 8310039 - DNA, 22 bp, Homo sapiens
cgctgccaggtcaccaggggta

SEQ ID NO: 8310040 - DNA, 22 bp, Homo sapiens
cctttgggttcaatctcggtct

SEQ ID NO: 8310041 - DNA, 22 bp, Homo sapiens
cctttttcaatatagaattgca

SEQ ID NO: 8310042 - DNA, 22 bp, Homo sapiens
cctttttccctggagggacagc

SEQ ID NO: 8310043 - DNA, 22 bp, Homo sapiens
ccttttgctctcccatccagaa

SEQ ID NO: 8310044 - DNA, 19 bp, Homo sapiens
ccttttttaacttcagcaa

SEQ ID NO: 8310045 - DNA, 22 bp, Homo sapiens
ccttttttctatgccaactctg

SEQ ID NO: 8310046 - DNA, 22 bp, Homo sapiens
cctttttctgagttgtagcttc

SEQ ID NO: 8310047 - DNA, 22 bp, Homo sapiens
cgagagtggacagggcgcagct

SEQ ID NO: 8310048 - DNA, 22 bp, Homo sapiens
gaagaacaagcagtgctttcct

SEQ ID NO: 8310049 - DNA, 22 bp, Homo sapiens
gaagaacacctgctgcccagtg

SEQ ID NO: 8310050 - DNA, 22 bp, Homo sapiens
gaagaacacttcatgattcatt

SEQ ID NO: 8310051 - DNA, 19 bp, Homo sapiens
gaagaagcttgagaagtag

SEQ ID NO: 8310052 - DNA, 22 bp, Homo sapiens
gaagaagcaggagtgtgtagca

SEQ ID NO: 8310053 - DNA, 22 bp, Homo sapiens
gaaatgtgttgttcatttctaa

SEQ ID NO: 8310054 - DNA, 22 bp, Homo sapiens
gaaatgtgggtcatgacccatt

SEQ ID NO: 8310055 - DNA, 22 bp, Homo sapiens
gaaatgtgtgacaagtttcaat

SEQ ID NO: 8310056 - DNA, 22 bp, Homo sapiens
gaaatgtgcagaatgtgttaga

SEQ ID NO: 8310057 - DNA, 20 bp, Homo sapiens
gaaatgtgacctcttctgtg

SEQ ID NO: 8310058 - DNA, 18 bp, Homo sapiens
gaaatgtgattctagggc

SEQ ID NO: 8310059 - DNA, 22 bp, Homo sapiens
gaaatgtgacctacttccttgt

SEQ ID NO: 8310060 - DNA, 22 bp, Homo sapiens
gaaagagaacctgggcctagat

SEQ ID NO: 8310061 - DNA, 22 bp, Homo sapiens
gaaagagaacctgggcctagat

SEQ ID NO: 8310062 - DNA, 22 bp, Homo sapiens
gaaaaatgagctgatgtcaggg

SEQ ID NO: 8310063 - DNA, 22 bp, Homo sapiens
gaaaaatgctccaaatctgtgg

SEQ ID NO: 8310064 - DNA, 22 bp, Homo sapiens
ctttttgttgtataagcccttt

SEQ ID NO: 8310065 - DNA, 22 bp, Homo sapiens
cttttttcctaaggcaacatga

SEQ ID NO: 8310066 - DNA, 22 bp, Homo sapiens
gaaactgtatgtagtttttggg

SEQ ID NO: 8310067 - DNA, 22 bp, Homo sapiens
gaaacccaaactaagacagtag

SEQ ID NO: 8310068 - DNA, 22 bp, Homo sapiens
gaaacctcttagcctctctttg

SEQ ID NO: 8310069 - DNA, 22 bp, Homo sapiens
gaaagaagctttagatggctat

SEQ ID NO: 8310070 - DNA, 20 bp, Homo sapiens
ctttggcaatgagaacaggg

SEQ ID NO: 8310071 - DNA, 20 bp, Homo sapiens
ctttttctccagctctgagc

SEQ ID NO: 8310072 - DNA, 22 bp, Homo sapiens
ctttttctaatcataattgtct

SEQ ID NO: 8310073 - DNA, 22 bp, Homo sapiens
ctttttgtctctgtcctgatga

SEQ ID NO: 8310074 - DNA, 22 bp, Homo sapiens
ctttggaagtgaccacaatcct

SEQ ID NO: 8310075 - DNA, 22 bp, Homo sapiens
ctttggcaatgaaacacaagaa

SEQ ID NO: 8310076 - DNA, 22 bp, Homo sapiens
cttcccagacggggtggcagcc

SEQ ID NO: 8310077 - DNA, 22 bp, Homo sapiens
cttcccagaccttagagtgcag

SEQ ID NO: 8310078 - DNA, 22 bp, Homo sapiens
cttccctgataagagcctcaga

SEQ ID NO: 8310079 - DNA, 22 bp, Homo sapiens
cttccctgataagagcctcaga

SEQ ID NO: 8310080 - DNA, 18 bp, Homo sapiens
cttccctcttcctttgtc

SEQ ID NO: 8310081 - DNA, 22 bp, Homo sapiens
cttcccttggtgaacagagcat

SEQ ID NO: 8310082 - DNA, 22 bp, Homo sapiens
cttcacatgttggagtcctttg

SEQ ID NO: 8310083 - DNA, 22 bp, Homo sapiens
ctttgcatacaatttttagaaa

SEQ ID NO: 8310084 - DNA, 22 bp, Homo sapiens
ctttctctgtgtttcacatgct

SEQ ID NO: 8310085 - DNA, 22 bp, Homo sapiens
ctttctctgtgtggtaaagggc

SEQ ID NO: 8310086 - DNA, 23 bp, Homo sapiens
ctttcctttctttgacacccagc

SEQ ID NO: 8310087 - DNA, 22 bp, Homo sapiens
cttgctggggtaagtctgtgct

SEQ ID NO: 8310088 - DNA, 22 bp, Homo sapiens
cttcttcctgaaagctggctct

SEQ ID NO: 8310089 - DNA, 22 bp, Homo sapiens
cttcttcctgctgcagcctcca

SEQ ID NO: 8310090 - DNA, 22 bp, Homo sapiens
cttcttcccagcttccctcacc

SEQ ID NO: 8310091 - DNA, 22 bp, Homo sapiens
cttgctttgtccagaaattcag

SEQ ID NO: 8310092 - DNA, 22 bp, Homo sapiens
ctgggggtgagcagcagcgacg

SEQ ID NO: 8310093 - DNA, 22 bp, Homo sapiens
ctggggtgagcagaaacagggg

SEQ ID NO: 8310094 - DNA, 22 bp, Homo sapiens
ctgggggtcttgaaagggagag

SEQ ID NO: 8310095 - DNA, 22 bp, Homo sapiens
ctggggtggatgggtccaagtt

SEQ ID NO: 8310096 - DNA, 22 bp, Homo sapiens
ctggggtggaggagctcccctg

SEQ ID NO: 8310097 - DNA, 22 bp, Homo sapiens
ctggggtgtctcgtctgccatt

SEQ ID NO: 8310098 - DNA, 22 bp, Homo sapiens
ctggggtggtgcaggcctcatg

SEQ ID NO: 8310099 - DNA, 22 bp, Homo sapiens
ctggggctggtgaggcaggctc

SEQ ID NO: 8310100 - DNA, 22 bp, Homo sapiens
ctggggggagctgcgtccagca

SEQ ID NO: 8310101 - DNA, 22 bp, Homo sapiens
ctgggctcctaaccatccaggt

SEQ ID NO: 8310102 - DNA, 21 bp, Homo sapiens
ctggtgtagcactcaggtgct

SEQ ID NO: 8310103 - DNA, 22 bp, Homo sapiens
ctggtggttcaggagaatggct

SEQ ID NO: 8310104 - DNA, 22 bp, Homo sapiens
ctggtgtgattgagcccaggtg

SEQ ID NO: 8310105 - DNA, 22 bp, Homo sapiens
ctggtgtctgctccctcacagc

SEQ ID NO: 8310106 - DNA, 22 bp, Homo sapiens
ctggtgctggagcctagtccct

SEQ ID NO: 8310107 - DNA, 22 bp, Homo sapiens
ctggtgcctcctccctgtgctt

SEQ ID NO: 8310108 - DNA, 22 bp, Homo sapiens
ctgggtggttctaactgttgat

SEQ ID NO: 8310109 - DNA, 22 bp, Homo sapiens
ctgggtggttttgatgtgaatt

SEQ ID NO: 8310110 - DNA, 22 bp, Homo sapiens
ctgggtggaaagtgctgagaat

SEQ ID NO: 8310111 - DNA, 22 bp, Homo sapiens
ctgggtggaaagtgctgagaat

SEQ ID NO: 8310112 - DNA, 22 bp, Homo sapiens
ctgggcctagaggaagctgaca

SEQ ID NO: 8310113 - DNA, 22 bp, Homo sapiens
ctgggcctagcaacagaggagt

SEQ ID NO: 8310114 - DNA, 22 bp, Homo sapiens
ctgggcctagcaacagaggagt

SEQ ID NO: 8310115 - DNA, 22 bp, Homo sapiens
ctgggcctcaatctcagagttt

SEQ ID NO: 8310116 - DNA, 22 bp, Homo sapiens
ctgggcctcatcctcagagttt

SEQ ID NO: 8310117 - DNA, 22 bp, Homo sapiens
ctgggctcagcccatgctgtcc

SEQ ID NO: 8310118 - DNA, 22 bp, Homo sapiens
ctgggccagcaactgcaatgga

SEQ ID NO: 8310119 - DNA, 22 bp, Homo sapiens
ctgggatgtctatagaacactt

SEQ ID NO: 8310120 - DNA, 22 bp, Homo sapiens
ctgggagtgttctaggtcacat

SEQ ID NO: 8310121 - DNA, 22 bp, Homo sapiens
ctgggagttgacgaggcttgta

SEQ ID NO: 8310122 - DNA, 22 bp, Homo sapiens
ctgggatgctccggcctggatg

SEQ ID NO: 8310123 - DNA, 22 bp, Homo sapiens
ctggagctccagggtctcctct

SEQ ID NO: 8310124 - DNA, 22 bp, Homo sapiens
ctggagccttcaccaggggaaa

SEQ ID NO: 8310125 - DNA, 22 bp, Homo sapiens
ctggagctaggaagtccaagat

SEQ ID NO: 8310126 - DNA, 22 bp, Homo sapiens
ctggagctaataatccatctga

SEQ ID NO: 8310127 - DNA, 22 bp, Homo sapiens
ctgggaggcggaggttgcagtg

SEQ ID NO: 8310128 - DNA, 22 bp, Homo sapiens
ctgggagtcaccaggagcaagg

SEQ ID NO: 8310129 - DNA, 22 bp, Homo sapiens
ctgggagtctggcctctggtcc

SEQ ID NO: 8310130 - DNA, 22 bp, Homo sapiens
ctgtgagctgggtggccaggac

SEQ ID NO: 8310131 - DNA, 22 bp, Homo sapiens
ctgtgaggccctgggtgctgga

SEQ ID NO: 8310132 - DNA, 22 bp, Homo sapiens
ctgtccctcatcacctctgggt

SEQ ID NO: 8310133 - DNA, 22 bp, Homo sapiens
ctgtccctcatcacctctgggt

SEQ ID NO: 8310134 - DNA, 21 bp, Homo sapiens
ctgtccctctttgcttccctc

SEQ ID NO: 8310135 - DNA, 22 bp, Homo sapiens
ctgtctgttcagattcattact

SEQ ID NO: 8310136 - DNA, 22 bp, Homo sapiens
ctggtttagctgtaaggttccc

SEQ ID NO: 8310137 - DNA, 22 bp, Homo sapiens
ctggttcatccccttccaggaa

SEQ ID NO: 8310138 - DNA, 22 bp, Homo sapiens
ctgtcagtaggctcccatcatt

SEQ ID NO: 8310139 - DNA, 22 bp, Homo sapiens
ctgtcagttcttccagatagag

SEQ ID NO: 8310140 - DNA, 22 bp, Homo sapiens
ctgtcatcacagttgagcagcc

SEQ ID NO: 8310141 - DNA, 22 bp, Homo sapiens
ctgtccccacccaaatctcatc

SEQ ID NO: 8310142 - DNA, 22 bp, Homo sapiens
ctgtccccgcgagtccagagct

SEQ ID NO: 8310143 - DNA, 20 bp, Homo sapiens
ctgtccccgaggtcaccagg

SEQ ID NO: 8310144 - DNA, 20 bp, Homo sapiens
ctgtccccgaggtcaccagg

SEQ ID NO: 8310145 - DNA, 22 bp, Homo sapiens
ctgtcccagatgttctcagcac

SEQ ID NO: 8310146 - DNA, 22 bp, Homo sapiens
ctgtcccaggagctgtaagaca

SEQ ID NO: 8310147 - DNA, 22 bp, Homo sapiens
ctgtccattttcgtgcctcctt

SEQ ID NO: 8310148 - DNA, 22 bp, Homo sapiens
ctgtggcacatgtggcaaggcc

SEQ ID NO: 8310149 - DNA, 22 bp, Homo sapiens
ctgtggcattgtgaggactgca

SEQ ID NO: 8310150 - DNA, 22 bp, Homo sapiens
ctgtggcattgccgaggctggc

SEQ ID NO: 8310151 - DNA, 22 bp, Homo sapiens
ctgtggctttctctgcctcctt

SEQ ID NO: 8310152 - DNA, 22 bp, Homo sapiens
ctgtggtgagcaactgactgaa

SEQ ID NO: 8310153 - DNA, 19 bp, Homo sapiens
ctgtgggtgtgcaagggtg

SEQ ID NO: 8310154 - DNA, 22 bp, Homo sapiens
ctgtgggtgaagacaagggaga

SEQ ID NO: 8310155 - DNA, 22 bp, Homo sapiens
ctgtgggctgaaagtgctcccg

SEQ ID NO: 8310156 - DNA, 22 bp, Homo sapiens
ctgtgtgtgtctgcagcatact

SEQ ID NO: 8310157 - DNA, 22 bp, Homo sapiens
gaatgcagatggctggtgtatg

SEQ ID NO: 8310158 - DNA, 22 bp, Homo sapiens
gaatgcactcacccatcactca

SEQ ID NO: 8310159 - DNA, 22 bp, Homo sapiens
gaatgcacttccaacatctatt

SEQ ID NO: 8310160 - DNA, 22 bp, Homo sapiens
gaatgcacacgtgtgtgcatgc

SEQ ID NO: 8310161 - DNA, 22 bp, Homo sapiens
gacagcaggagatcatgataga

SEQ ID NO: 8310162 - DNA, 22 bp, Homo sapiens
gacaaaggatcagaggttggga

SEQ ID NO: 8310163 - DNA, 22 bp, Homo sapiens
gacctggggtggaaggaaggca

SEQ ID NO: 8310164 - DNA, 22 bp, Homo sapiens
gacctgcctgagctgcctctgc

SEQ ID NO: 8310165 - DNA, 22 bp, Homo sapiens
gacatgcaacaatttggcattt

SEQ ID NO: 8310166 - DNA, 22 bp, Homo sapiens
gacatcatagggtgggaggaaa

SEQ ID NO: 8310167 - DNA, 20 bp, Homo sapiens
gacatcatgtacacattgcc

SEQ ID NO: 8310168 - DNA, 22 bp, Homo sapiens
gacagcagggacatgtaggaag

SEQ ID NO: 8310169 - DNA, 22 bp, Homo sapiens
gacagcatggtgtctgttcagg

SEQ ID NO: 8310170 - DNA, 22 bp, Homo sapiens
gacagccatgcacttctgctgt

SEQ ID NO: 8310171 - DNA, 22 bp, Homo sapiens
gacagcctcatgaggagcaaaa

SEQ ID NO: 8310172 - DNA, 22 bp, Homo sapiens
gactcagtgatttgacatgcct

SEQ ID NO: 8310173 - DNA, 22 bp, Homo sapiens
gagaacctctccacaagtctgg

SEQ ID NO: 8310174 - DNA, 22 bp, Homo sapiens
gagagaagaaagccatggtcct

SEQ ID NO: 8310175 - DNA, 22 bp, Homo sapiens
gagagaagggggatatgagcct

SEQ ID NO: 8310176 - DNA, 22 bp, Homo sapiens
gagagaagaatgttccgaggcc

SEQ ID NO: 8310177 - DNA, 22 bp, Homo sapiens
gagagaagaatgttccgaggcc

SEQ ID NO: 8310178 - DNA, 22 bp, Homo sapiens
gagaagcaatcagtggccaccc

SEQ ID NO: 8310179 - DNA, 22 bp, Homo sapiens
gagaagccgagtcagctgagcc

SEQ ID NO: 8310180 - DNA, 22 bp, Homo sapiens
gagaagcaatttccaactgtgc

SEQ ID NO: 8310181 - DNA, 22 bp, Homo sapiens
gagaggagtaggctgatggtgc

SEQ ID NO: 8310182 - DNA, 22 bp, Homo sapiens
gagaggagtccctatcacagtt

SEQ ID NO: 8310183 - DNA, 22 bp, Homo sapiens
gagagccctgctcctatcccag

SEQ ID NO: 8310184 - DNA, 22 bp, Homo sapiens
gagagctgtaatagtcatgtct

SEQ ID NO: 8310185 - DNA, 22 bp, Homo sapiens
gagagctgtcagcgtagcaccg

SEQ ID NO: 8310186 - DNA, 22 bp, Homo sapiens
gagcagagacagtacaactggc

SEQ ID NO: 8310187 - DNA, 22 bp, Homo sapiens
gagcagagacagtacaactggc

SEQ ID NO: 8310188 - DNA, 22 bp, Homo sapiens
gagcagaacaggccgggtggga

SEQ ID NO: 8310189 - DNA, 22 bp, Homo sapiens
gagcagaactactcacatatcg

SEQ ID NO: 8310190 - DNA, 20 bp, Homo sapiens
gagatttccaatcatgccca

SEQ ID NO: 8310191 - DNA, 22 bp, Homo sapiens
gagatttcttttgatgcctgtc

SEQ ID NO: 8310192 - DNA, 22 bp, Homo sapiens
gagcaacagtttatggtttttc

SEQ ID NO: 8310193 - DNA, 22 bp, Homo sapiens
gagcacagaatcttcccatgca

SEQ ID NO: 8310194 - DNA, 22 bp, Homo sapiens
gagctcatccccatggtccgtc

SEQ ID NO: 8310195 - DNA, 22 bp, Homo sapiens
gagctcattcattcattgcctg

SEQ ID NO: 8310196 - DNA, 22 bp, Homo sapiens
gagctcagcactaaaatcatgt

SEQ ID NO: 8310197 - DNA, 22 bp, Homo sapiens
gagctcagcccaaagagcagtg

SEQ ID NO: 8310198 - DNA, 22 bp, Homo sapiens
gagctcagattctggtgtcaga

SEQ ID NO: 8310199 - DNA, 22 bp, Homo sapiens
gagctcaggagcatcagaagaa

SEQ ID NO: 8310200 - DNA, 22 bp, Homo sapiens
gagctcaggagcatcagaagaa

SEQ ID NO: 8310201 - DNA, 22 bp, Homo sapiens
gagcaggcattctagtggctga

SEQ ID NO: 8310202 - DNA, 22 bp, Homo sapiens
gagcaggccagcaatggaaggg

SEQ ID NO: 8310203 - DNA, 22 bp, Homo sapiens
gagcaggctctgcctgtgtgtc

SEQ ID NO: 8310204 - DNA, 22 bp, Homo sapiens
gagctgggcacacgccacttga

SEQ ID NO: 8310205 - DNA, 22 bp, Homo sapiens
gagctccctggaggttcagata

SEQ ID NO: 8310206 - DNA, 22 bp, Homo sapiens
gagctcccaggccccagcaagg

SEQ ID NO: 8310207 - DNA, 22 bp, Homo sapiens
gagctggtgtgtgcccgagcac

SEQ ID NO: 8310208 - DNA, 22 bp, Homo sapiens
gagctggtgatcagctggagga

SEQ ID NO: 8310209 - DNA, 22 bp, Homo sapiens
gagctgtgagggacacattgct

SEQ ID NO: 8310210 - DNA, 22 bp, Homo sapiens
gagctgtctggggactctgggt

SEQ ID NO: 8310211 - DNA, 22 bp, Homo sapiens
gagctgtccgcccctgggccga

SEQ ID NO: 8310212 - DNA, 22 bp, Homo sapiens
gagctgtcctaccaggagtcct

SEQ ID NO: 8310213 - DNA, 22 bp, Homo sapiens
gagctgtctctatatgaatgct

SEQ ID NO: 8310214 - DNA, 22 bp, Homo sapiens
gaggaggttccgggtggagaag

SEQ ID NO: 8310215 - DNA, 22 bp, Homo sapiens
gaggagagagggactgtctgca

SEQ ID NO: 8310216 - DNA, 22 bp, Homo sapiens
gaggagtgtattccacaccact

SEQ ID NO: 8310217 - DNA, 22 bp, Homo sapiens
gaggagtggagttgctgggttg

SEQ ID NO: 8310218 - DNA, 18 bp, Homo sapiens
gaggatggaaggagatgc

SEQ ID NO: 8310219 - DNA, 22 bp, Homo sapiens
gaggactgcagatgggtgcatc

SEQ ID NO: 8310220 - DNA, 22 bp, Homo sapiens
gaggacagtgtgatctgccagc

SEQ ID NO: 8310221 - DNA, 22 bp, Homo sapiens
gaggaccacagatgagcctgca

SEQ ID NO: 8310222 - DNA, 22 bp, Homo sapiens
gaggccacggttttccttgggg

SEQ ID NO: 8310223 - DNA, 21 bp, Homo sapiens
gaggccactaataggggcaga

SEQ ID NO: 8310224 - DNA, 22 bp, Homo sapiens
gaggatggtatgaggcaagcaa

SEQ ID NO: 8310225 - DNA, 22 bp, Homo sapiens
gaggatgtgtctggtctgggca

SEQ ID NO: 8310226 - DNA, 22 bp, Homo sapiens
gaggcctggaattccagcctgg

SEQ ID NO: 8310227 - DNA, 22 bp, Homo sapiens
gaggccagaatgagctgaatgc

SEQ ID NO: 8310228 - DNA, 22 bp, Homo sapiens
gagggtggcctttagagcccat

SEQ ID NO: 8310229 - DNA, 22 bp, Homo sapiens
gagggctgataacaggaataca

SEQ ID NO: 8310230 - DNA, 22 bp, Homo sapiens
gagggctgatgcttacttattt

SEQ ID NO: 8310231 - DNA, 22 bp, Homo sapiens
gagggtggtggcttaaggtgct

SEQ ID NO: 8310232 - DNA, 18 bp, Homo sapiens
gaggtcctgctctagccc

SEQ ID NO: 8310233 - DNA, 22 bp, Homo sapiens
gagggtgggctttgttcctcca

SEQ ID NO: 8310234 - DNA, 22 bp, Homo sapiens
gaggtgagaagggggtcagatg

SEQ ID NO: 8310235 - DNA, 22 bp, Homo sapiens
gaggtgagtggatcacgaggtc

SEQ ID NO: 8310236 - DNA, 22 bp, Homo sapiens
gaggtgctgctgtacttcttgc

SEQ ID NO: 8310237 - DNA, 22 bp, Homo sapiens
gagtaagagctggctttggtgt

SEQ ID NO: 8310238 - DNA, 22 bp, Homo sapiens
gaggtgggagggcagtccctaa

SEQ ID NO: 8310239 - DNA, 22 bp, Homo sapiens
gaggtgggagggcagtccctaa

SEQ ID NO: 8310240 - DNA, 22 bp, Homo sapiens
gaggctggtaggaaaggaaaca

SEQ ID NO: 8310241 - DNA, 22 bp, Homo sapiens
gaggctggtggttagttccatt

SEQ ID NO: 8310242 - DNA, 22 bp, Homo sapiens
gaggcctgtagtcatggatgta

SEQ ID NO: 8310243 - DNA, 22 bp, Homo sapiens
gaggcctgtcgctaggcctctg

SEQ ID NO: 8310244 - DNA, 22 bp, Homo sapiens
gaggcctggtagccgagcccca

SEQ ID NO: 8310245 - DNA, 22 bp, Homo sapiens
gaggcctggtctatgagatgtt

SEQ ID NO: 8310246 - DNA, 22 bp, Homo sapiens
gaggcctggaccagccacagag

SEQ ID NO: 8310247 - DNA, 22 bp, Homo sapiens
gaggcctgggttggaggtgcat

SEQ ID NO: 8310248 - DNA, 22 bp, Homo sapiens
gaggcctggtctatgagatgtt

SEQ ID NO: 8310249 - DNA, 22 bp, Homo sapiens
gaggcctggtttgcatgagaat

SEQ ID NO: 8310250 - DNA, 22 bp, Homo sapiens
gaggcctggtttgcatgagaat

SEQ ID NO: 8310251 - DNA, 22 bp, Homo sapiens
gaggcctggtttccagcatcct

SEQ ID NO: 8310252 - DNA, 22 bp, Homo sapiens
gaggcctggtgtgtctcccgct

SEQ ID NO: 8310253 - DNA, 22 bp, Homo sapiens
gaggcctggtttccagcatcct

SEQ ID NO: 8310254 - DNA, 22 bp, Homo sapiens
gagggacagctaaagagaaatt

SEQ ID NO: 8310255 - DNA, 22 bp, Homo sapiens
gagggacagctaaagagaaatt

SEQ ID NO: 8310256 - DNA, 22 bp, Homo sapiens
gagggctgataaatgcgcatgg

SEQ ID NO: 8310257 - DNA, 22 bp, Homo sapiens
gtgttccatgtttgaggtagtt

SEQ ID NO: 8310258 - DNA, 22 bp, Homo sapiens
gttataaatacctaataggatt

SEQ ID NO: 8310259 - DNA, 22 bp, Homo sapiens
gtgtttccagttcagaaagcaa

SEQ ID NO: 8310260 - DNA, 22 bp, Homo sapiens
gtgtttcctctagaagccatgg

SEQ ID NO: 8310261 - DNA, 21 bp, Homo sapiens
gtgtttcctgtttatggcttg

SEQ ID NO: 8310262 - DNA, 22 bp, Homo sapiens
gtgtttcctcacttctctgact

SEQ ID NO: 8310263 - DNA, 22 bp, Homo sapiens
gtgtttcctagtttaatgaatg

SEQ ID NO: 8310264 - DNA, 22 bp, Homo sapiens
gttatgtaatctaacactcagt

SEQ ID NO: 8310265 - DNA, 22 bp, Homo sapiens
gttattgcagtatagaggtcta

SEQ ID NO: 8310266 - DNA, 22 bp, Homo sapiens
gttatgtatgagggaatgatta

SEQ ID NO: 8310267 - DNA, 22 bp, Homo sapiens
gttatgtatcttgattgggtgg

SEQ ID NO: 8310268 - DNA, 22 bp, Homo sapiens
gttatgtactttttaaatcttg

SEQ ID NO: 8310269 - DNA, 22 bp, Homo sapiens
gttataaatgactgcaaaagtt

SEQ ID NO: 8310270 - DNA, 19 bp, Homo sapiens
gttcttttcacctctgtgc

SEQ ID NO: 8310271 - DNA, 22 bp, Homo sapiens
gtttgaaaaaagcagtatgtaa

SEQ ID NO: 8310272 - DNA, 22 bp, Homo sapiens
gtttgcatatttgcacaggaat

SEQ ID NO: 8310273 - DNA, 22 bp, Homo sapiens
gtttgcatggaagacagtgagt

SEQ ID NO: 8310274 - DNA, 21 bp, Homo sapiens
gtttgcatgaacaagtcagcc

SEQ ID NO: 8310275 - DNA, 22 bp, Homo sapiens
gtttgcatatctgtgaaatgga

SEQ ID NO: 8310276 - DNA, 22 bp, Homo sapiens
gtttgcataaagtggatgcagg

SEQ ID NO: 8310277 - DNA, 22 bp, Homo sapiens
gtttgattcaagaacaaagagt

SEQ ID NO: 8310278 - DNA, 22 bp, Homo sapiens
gtttgtcttaattaggcatcga

SEQ ID NO: 8310279 - DNA, 22 bp, Homo sapiens
gtttgcattccaatttagggga

SEQ ID NO: 8310280 - DNA, 22 bp, Homo sapiens
gtttgcatgtgtacttaattgg

SEQ ID NO: 8310281 - DNA, 17 bp, Homo sapiens
gtttgcatggtgttaac

SEQ ID NO: 8310282 - DNA, 22 bp, Homo sapiens
gtttgcatgtattaagtcaata

SEQ ID NO: 8310283 - DNA, 21 bp, Homo sapiens
gttttaagggagaaaacctag

SEQ ID NO: 8310284 - DNA, 22 bp, Homo sapiens
gtttgtttatacaaaagatcct

SEQ ID NO: 8310285 - DNA, 22 bp, Homo sapiens
taaatgcaagtgctcctgggag

SEQ ID NO: 8310286 - DNA, 22 bp, Homo sapiens
taaatgcagttagtacttgcca

SEQ ID NO: 8310287 - DNA, 22 bp, Homo sapiens
taaatgcagattcctgagccta

SEQ ID NO: 8310288 - DNA, 22 bp, Homo sapiens
taaatgcaatgtgctttaccag

SEQ ID NO: 8310289 - DNA, 22 bp, Homo sapiens
taaatgcagcagtttctgttct

SEQ ID NO: 8310290 - DNA, 22 bp, Homo sapiens
taaatgcagtacaaattgttct

SEQ ID NO: 8310291 - DNA, 22 bp, Homo sapiens
taaaagtggataagctgtagga

SEQ ID NO: 8310292 - DNA, 22 bp, Homo sapiens
taacatctttagcagctcgaac

SEQ ID NO: 8310293 - DNA, 22 bp, Homo sapiens
taaatgtgttgtggatgaagtt

SEQ ID NO: 8310294 - DNA, 22 bp, Homo sapiens
taaatgtgggggccacgggctt

SEQ ID NO: 8310295 - DNA, 22 bp, Homo sapiens
taaatgtgtaaacctccattac

SEQ ID NO: 8310296 - DNA, 22 bp, Homo sapiens
taaatgtgtctttttaaggcct

SEQ ID NO: 8310297 - DNA, 22 bp, Homo sapiens
taaatgtgtctatggacccgcc

SEQ ID NO: 8310298 - DNA, 22 bp, Homo sapiens
taaatgtgtgtagccatctgtg

SEQ ID NO: 8310299 - DNA, 22 bp, Homo sapiens
taaatgtgttagtcatggtttt

SEQ ID NO: 8310300 - DNA, 22 bp, Homo sapiens
taaatgtgcacaggttagaagg

SEQ ID NO: 8310301 - DNA, 22 bp, Homo sapiens
taaatgtggagactcaggagtc

SEQ ID NO: 8310302 - DNA, 22 bp, Homo sapiens
taaatgtgcactttacttttca

SEQ ID NO: 8310303 - DNA, 18 bp, Homo sapiens
taaatgcatgttaataac

SEQ ID NO: 8310304 - DNA, 22 bp, Homo sapiens
taagacaattcttcagtcacaa

SEQ ID NO: 8310305 - DNA, 22 bp, Homo sapiens
taagacatggttgatctagtgt

SEQ ID NO: 8310306 - DNA, 22 bp, Homo sapiens
taagacatttgaaatgtgatcc

SEQ ID NO: 8310307 - DNA, 22 bp, Homo sapiens
taagcattcaatgcttagcact

SEQ ID NO: 8310308 - DNA, 22 bp, Homo sapiens
taagctattcctgaagaaggtt

SEQ ID NO: 8310309 - DNA, 22 bp, Homo sapiens
taatttacttgcaaataacaat

SEQ ID NO: 8310310 - DNA, 22 bp, Homo sapiens
tacaagaggtatatagaaacag

SEQ ID NO: 8310311 - DNA, 22 bp, Homo sapiens
taatttatttcaactgccaagg

SEQ ID NO: 8310312 - DNA, 22 bp, Homo sapiens
tacagtattatgagtgattgaa

SEQ ID NO: 8310313 - DNA, 22 bp, Homo sapiens
tacagtatcttctggcaagcat

SEQ ID NO: 8310314 - DNA, 22 bp, Homo sapiens
tacagtctttggaaagagatag

SEQ ID NO: 8310315 - DNA, 18 bp, Homo sapiens
tacatgcataaatgaagc

SEQ ID NO: 8310316 - DNA, 22 bp, Homo sapiens
tacatgaacaaaatagcagaaa

SEQ ID NO: 8310317 - DNA, 22 bp, Homo sapiens
tacatgcatgtcacagaatgaa

SEQ ID NO: 8310318 - DNA, 22 bp, Homo sapiens
tacatgctccactttctcctgt

SEQ ID NO: 8310319 - DNA, 22 bp, Homo sapiens
tacatgctcagtaactttcagt

SEQ ID NO: 8310320 - DNA, 22 bp, Homo sapiens
tacatgtaagacatgagactct

SEQ ID NO: 8310321 - DNA, 22 bp, Homo sapiens
tacatgggtaggttaagtcata

SEQ ID NO: 8310322 - DNA, 22 bp, Homo sapiens
tacatggtggtggcacttgact

SEQ ID NO: 8310323 - DNA, 22 bp, Homo sapiens
tacatgtaggtgacattttaat

SEQ ID NO: 8310324 - DNA, 22 bp, Homo sapiens
tacatgtaattttcatagtaag

SEQ ID NO: 8310325 - DNA, 22 bp, Homo sapiens
tactacattaataaaacattca

SEQ ID NO: 8310326 - DNA, 22 bp, Homo sapiens
taccaggcagctgcacagaggc

SEQ ID NO: 8310327 - DNA, 22 bp, Homo sapiens
tactctctaggacattttctag

SEQ ID NO: 8310328 - DNA, 22 bp, Homo sapiens
tactgtgtgcccagccgagctg

SEQ ID NO: 8310329 - DNA, 22 bp, Homo sapiens
tacttacagagcttataagtta

SEQ ID NO: 8310330 - DNA, 22 bp, Homo sapiens
tcaaatatgtgatagaagctaa

SEQ ID NO: 8310331 - DNA, 22 bp, Homo sapiens
tcaaagtttgtggcaatttatt

SEQ ID NO: 8310332 - DNA, 22 bp, Homo sapiens
tcaaagtttttgagaattacat

SEQ ID NO: 8310333 - DNA, 18 bp, Homo sapiens
tcaaagtctggctccact

SEQ ID NO: 8310334 - DNA, 22 bp, Homo sapiens
tcaaagtcatggcaggctcaga

SEQ ID NO: 8310335 - DNA, 22 bp, Homo sapiens
tcaaagtcatggcaggctcaga

SEQ ID NO: 8310336 - DNA, 22 bp, Homo sapiens
tcaaagtcacaactctctaatt

SEQ ID NO: 8310337 - DNA, 22 bp, Homo sapiens
tcaaagtcatggctagtaatga

SEQ ID NO: 8310338 - DNA, 22 bp, Homo sapiens
tcaaagtccttgctttttctgt

SEQ ID NO: 8310339 - DNA, 22 bp, Homo sapiens
tcaaagtctatctgtaattact

SEQ ID NO: 8310340 - DNA, 22 bp, Homo sapiens
tcaaagtctctgcttctgtaac

SEQ ID NO: 8310341 - DNA, 19 bp, Homo sapiens
tcaaagtctgagtcacttt

SEQ ID NO: 8310342 - DNA, 22 bp, Homo sapiens
tcaaagtaggggtaagccaggc

SEQ ID NO: 8310343 - DNA, 22 bp, Homo sapiens
tcaaagtaaaagtatagagttt

SEQ ID NO: 8310344 - DNA, 22 bp, Homo sapiens
tattttgtcttctgctcatcac

SEQ ID NO: 8310345 - DNA, 22 bp, Homo sapiens
tattttgttaataatccagtcc

SEQ ID NO: 8310346 - DNA, 22 bp, Homo sapiens
tattttgactattaaaccaaca

SEQ ID NO: 8310347 - DNA, 22 bp, Homo sapiens
tattttgactattaaaccaaca

SEQ ID NO: 8310348 - DNA, 22 bp, Homo sapiens
tattttgaggtatttttgagct

SEQ ID NO: 8310349 - DNA, 22 bp, Homo sapiens
tcaaactgtttacagtgagata

SEQ ID NO: 8310350 - DNA, 22 bp, Homo sapiens
tattgtctgtccgggtcaaagc

SEQ ID NO: 8310351 - DNA, 22 bp, Homo sapiens
tatttcttgttattctcgttga

SEQ ID NO: 8310352 - DNA, 22 bp, Homo sapiens
tatgtagaagctgctcaaagaa

SEQ ID NO: 8310353 - DNA, 17 bp, Homo sapiens
tatgtagtacttataaa

SEQ ID NO: 8310354 - DNA, 22 bp, Homo sapiens
tataaagtttcgaaagatgtat

SEQ ID NO: 8310355 - DNA, 20 bp, Homo sapiens
tatgaagatatgtgaacagc

SEQ ID NO: 8310356 - DNA, 22 bp, Homo sapiens
tagttttttcaacaaatggtgc

SEQ ID NO: 8310357 - DNA, 23 bp, Homo sapiens
tagttattttctctgtaatttgc

SEQ ID NO: 8310358 - DNA, 22 bp, Homo sapiens
tagttattattgttactatcag

SEQ ID NO: 8310359 - DNA, 22 bp, Homo sapiens
tagttacagcaggcaggatata

SEQ ID NO: 8310360 - DNA, 22 bp, Homo sapiens
tagtgcacacgcatgtagcagt

SEQ ID NO: 8310361 - DNA, 22 bp, Homo sapiens
tagtctctggagactctagggg

SEQ ID NO: 8310362 - DNA, 22 bp, Homo sapiens
tagggcagctgcatcaggcact

SEQ ID NO: 8310363 - DNA, 22 bp, Homo sapiens
tagggcagccttatagctccca

SEQ ID NO: 8310364 - DNA, 23 bp, Homo sapiens
tagggcagctgggagggacatgc

SEQ ID NO: 8310365 - DNA, 22 bp, Homo sapiens
tagggcagagtccaggatgggc

SEQ ID NO: 8310366 - DNA, 22 bp, Homo sapiens
tagggcagattcggtggagttt

SEQ ID NO: 8310367 - DNA, 22 bp, Homo sapiens
tagggcagccacccaggctgct

SEQ ID NO: 8310368 - DNA, 20 bp, Homo sapiens
taggcagagctgtgcagcct

SEQ ID NO: 8310369 - DNA, 22 bp, Homo sapiens
tagctgtcaccagaaatggcca

SEQ ID NO: 8310370 - DNA, 22 bp, Homo sapiens
tagctgtcagcaatcaagtggt

SEQ ID NO: 8310371 - DNA, 22 bp, Homo sapiens
tagctgtgagcacccaggctgt

SEQ ID NO: 8310372 - DNA, 22 bp, Homo sapiens
taggcagctgcaaacttcggtc

SEQ ID NO: 8310373 - DNA, 22 bp, Homo sapiens
taggccagcccttagtcctgtc

SEQ ID NO: 8310374 - DNA, 22 bp, Homo sapiens
taggccagcccttagtcctgtc

SEQ ID NO: 8310375 - DNA, 22 bp, Homo sapiens
taggccagtggcaggttgtgtg

SEQ ID NO: 8310376 - DNA, 22 bp, Homo sapiens
taggccaggacagagcttccag

SEQ ID NO: 8310377 - DNA, 22 bp, Homo sapiens
tagagtggttaacagtttagaa

SEQ ID NO: 8310378 - DNA, 22 bp, Homo sapiens
tagagaaataagctttgccttg

SEQ ID NO: 8310379 - DNA, 22 bp, Homo sapiens
tagagaaaagcagggatcagga

SEQ ID NO: 8310380 - DNA, 21 bp, Homo sapiens
tagagaaaagaagctgttcct

SEQ ID NO: 8310381 - DNA, 22 bp, Homo sapiens
tagacagatttcttgttagaca

SEQ ID NO: 8310382 - DNA, 22 bp, Homo sapiens
tagcagggaaggtgtgctgagc

SEQ ID NO: 8310383 - DNA, 22 bp, Homo sapiens
tagcagggaagatgatcagaat

SEQ ID NO: 8310384 - DNA, 22 bp, Homo sapiens
tagcagggccaggctgggaacc

SEQ ID NO: 8310385 - DNA, 22 bp, Homo sapiens
tagcagcttccagagagggcag

SEQ ID NO: 8310386 - DNA, 22 bp, Homo sapiens
tagcagcttaagtaattagaat

SEQ ID NO: 8310387 - DNA, 19 bp, Homo sapiens
tagcagctgccaaaggaga

SEQ ID NO: 8310388 - DNA, 22 bp, Homo sapiens
tagcagctgtgagtaaaagcca

SEQ ID NO: 8310389 - DNA, 22 bp, Homo sapiens
tagctgcctttgggctcctgct

SEQ ID NO: 8310390 - DNA, 22 bp, Homo sapiens
tagctgcctatgtgataagaga

SEQ ID NO: 8310391 - DNA, 19 bp, Homo sapiens
tagctgcctgttacctcca

SEQ ID NO: 8310392 - DNA, 17 bp, Homo sapiens
tagctgccccgaatgct

SEQ ID NO: 8310393 - DNA, 22 bp, Homo sapiens
tagctgcccatctttcctttag

SEQ ID NO: 8310394 - DNA, 22 bp, Homo sapiens
tagctgcctagacagctatagc

SEQ ID NO: 8310395 - DNA, 22 bp, Homo sapiens
tagctgccattgctccaggaag

SEQ ID NO: 8310396 - DNA, 22 bp, Homo sapiens
tagctgccagaccattcttact

SEQ ID NO: 8310397 - DNA, 22 bp, Homo sapiens
tagcagggtctcaggagtcagg

SEQ ID NO: 8310398 - DNA, 22 bp, Homo sapiens
tagcagggtctcaggagtcagg

SEQ ID NO: 8310399 - DNA, 22 bp, Homo sapiens
tagctgccaaaagggtgggcta

SEQ ID NO: 8310400 - DNA, 22 bp, Homo sapiens
tagcagggtccaatgtgaggca

SEQ ID NO: 8310401 - DNA, 22 bp, Homo sapiens
tagcagggtccaatgtgaggca

SEQ ID NO: 8310402 - DNA, 22 bp, Homo sapiens
tagcagggtaaatgtagatgga

SEQ ID NO: 8310403 - DNA, 22 bp, Homo sapiens
tagcaggggtagatagagtgtg

SEQ ID NO: 8310404 - DNA, 22 bp, Homo sapiens
tagcagctctgattctgggccc

SEQ ID NO: 8310405 - DNA, 22 bp, Homo sapiens
tagatctgatacaattcatctg

SEQ ID NO: 8310406 - DNA, 22 bp, Homo sapiens
tcaacagaagtgatagctatta

SEQ ID NO: 8310407 - DNA, 22 bp, Homo sapiens
tcaacactctttggcacagtta

SEQ ID NO: 8310408 - DNA, 22 bp, Homo sapiens
tcaacactatccaggcaatctt

SEQ ID NO: 8310409 - DNA, 22 bp, Homo sapiens
tcaaatgcaggtctggtcttgg

SEQ ID NO: 8310410 - DNA, 22 bp, Homo sapiens
tcaaatgcacgtagagaaaata

SEQ ID NO: 8310411 - DNA, 22 bp, Homo sapiens
tcaagaaagggcttcaccagga

SEQ ID NO: 8310412 - DNA, 22 bp, Homo sapiens
tcacatgctcacctaagccaca

SEQ ID NO: 8310413 - DNA, 22 bp, Homo sapiens
tcacatgctactgagccagacc

SEQ ID NO: 8310414 - DNA, 18 bp, Homo sapiens
tcacagtgctcttgccta

SEQ ID NO: 8310415 - DNA, 22 bp, Homo sapiens
tcacagtgatgacgtgggagca

SEQ ID NO: 8310416 - DNA, 22 bp, Homo sapiens
tcacagtgagccatgtcagaga

SEQ ID NO: 8310417 - DNA, 22 bp, Homo sapiens
tcacatacactaggatattttt

SEQ ID NO: 8310418 - DNA, 22 bp, Homo sapiens
tcactgcaacctccacctcccg

SEQ ID NO: 8310419 - DNA, 22 bp, Homo sapiens
tcactgcaacctccacctcccg

SEQ ID NO: 8310420 - DNA, 22 bp, Homo sapiens
tcacattttatctattttaagt

SEQ ID NO: 8310421 - DNA, 22 bp, Homo sapiens
tcacatttgttcctctgcactt

SEQ ID NO: 8310422 - DNA, 22 bp, Homo sapiens
tcactgcaacctccacctcctg

SEQ ID NO: 8310423 - DNA, 22 bp, Homo sapiens
tcactgcaacctccacctcctg

SEQ ID NO: 8310424 - DNA, 22 bp, Homo sapiens
tcactgctctctaagcatcgcc

SEQ ID NO: 8310425 - DNA, 23 bp, Homo sapiens
tcagaatgcactgaatttaccct

SEQ ID NO: 8310426 - DNA, 22 bp, Homo sapiens
tcagaagccggaagtgctcctc

SEQ ID NO: 8310427 - DNA, 22 bp, Homo sapiens
tcagaacagaagaaggaacacg

SEQ ID NO: 8310428 - DNA, 22 bp, Homo sapiens
tcagaacagaagaaggaacacg

SEQ ID NO: 8310429 - DNA, 22 bp, Homo sapiens
tcagaacagaagctggctataa

SEQ ID NO: 8310430 - DNA, 22 bp, Homo sapiens
tcagaacaattgggaaccatta

SEQ ID NO: 8310431 - DNA, 22 bp, Homo sapiens
tcagcagttttatatgcagctt

SEQ ID NO: 8310432 - DNA, 22 bp, Homo sapiens
tcagccactacccaccttaaca

SEQ ID NO: 8310433 - DNA, 20 bp, Homo sapiens
tcagccagctaacatgggga

SEQ ID NO: 8310434 - DNA, 23 bp, Homo sapiens
tcagctgcttcctcctgcctgcc

SEQ ID NO: 8310435 - DNA, 22 bp, Homo sapiens
tcagctgctctgttgagctgaa

SEQ ID NO: 8310436 - DNA, 22 bp, Homo sapiens
tcagctgcctttcccatgctag

SEQ ID NO: 8310437 - DNA, 22 bp, Homo sapiens
tcagctgcctctccctggaaga

SEQ ID NO: 8310438 - DNA, 22 bp, Homo sapiens
tcaggacagccagggtgcagac

SEQ ID NO: 8310439 - DNA, 19 bp, Homo sapiens
tcaggactgacttgaagtc

SEQ ID NO: 8310440 - DNA, 22 bp, Homo sapiens
tcaggagaatcagggctgtcct

SEQ ID NO: 8310441 - DNA, 18 bp, Homo sapiens
tcagctggggctgcagcc

SEQ ID NO: 8310442 - DNA, 22 bp, Homo sapiens
tcagctggcagttcagaggctg

SEQ ID NO: 8310443 - DNA, 22 bp, Homo sapiens
tcagctggagatgagaaccgaa

SEQ ID NO: 8310444 - DNA, 17 bp, Homo sapiens
tcagcaaagacaaagga

SEQ ID NO: 8310445 - DNA, 22 bp, Homo sapiens
tcagcaggcggttccttgtggg

SEQ ID NO: 8310446 - DNA, 22 bp, Homo sapiens
tcagcagggctgtggtgtggct

SEQ ID NO: 8310447 - DNA, 22 bp, Homo sapiens
tcagcagtgtagtttatcattc

SEQ ID NO: 8310448 - DNA, 17 bp, Homo sapiens
tcagcaggggccaagct

SEQ ID NO: 8310449 - DNA, 22 bp, Homo sapiens
tcagcagggaggctctgtgccc

SEQ ID NO: 8310450 - DNA, 22 bp, Homo sapiens
tcagcagggagaggagaatgca

SEQ ID NO: 8310451 - DNA, 22 bp, Homo sapiens
tcagcagggagaggagaatgca

SEQ ID NO: 8310452 - DNA, 22 bp, Homo sapiens
tcagcagggcctccttgtgcag

SEQ ID NO: 8310453 - DNA, 21 bp, Homo sapiens
tcagagtggaagacagtttga

SEQ ID NO: 8310454 - DNA, 22 bp, Homo sapiens
tcagagtgggagaatgtgccaa

SEQ ID NO: 8310455 - DNA, 22 bp, Homo sapiens
tcagagtggtggttttgccttc

SEQ ID NO: 8310456 - DNA, 22 bp, Homo sapiens
tcagagtgtgacttggtcatga

SEQ ID NO: 8310457 - DNA, 22 bp, Homo sapiens
tcagagtggtagcctattttct

SEQ ID NO: 8310458 - DNA, 21 bp, Homo sapiens
tcagagtgtgttacagcaagc

SEQ ID NO: 8310459 - DNA, 22 bp, Homo sapiens
tcagagtgttttactaaacaag

SEQ ID NO: 8310460 - DNA, 22 bp, Homo sapiens
tcagagtgtgagacatattgga

SEQ ID NO: 8310461 - DNA, 22 bp, Homo sapiens
tcagagtgtggtgagatgtgca

SEQ ID NO: 8310462 - DNA, 22 bp, Homo sapiens
tcagggctcaccagcctctgcc

SEQ ID NO: 8310463 - DNA, 22 bp, Homo sapiens
tcagggcatactcttcaaggtc

SEQ ID NO: 8310464 - DNA, 22 bp, Homo sapiens
tcagggcatcatcatgaatata

SEQ ID NO: 8310465 - DNA, 22 bp, Homo sapiens
tcagggcatccattgcctgttg

SEQ ID NO: 8310466 - DNA, 22 bp, Homo sapiens
tcagtaacttacttattcacct

SEQ ID NO: 8310467 - DNA, 22 bp, Homo sapiens
tcaggagagaaagaatacaatt

SEQ ID NO: 8310468 - DNA, 17 bp, Homo sapiens
tcaggctgggtgcagtg

SEQ ID NO: 8310469 - DNA, 17 bp, Homo sapiens
tcaggctgggtgcagtg

SEQ ID NO: 8310470 - DNA, 22 bp, Homo sapiens
tcaggctggtggtcagatggct

SEQ ID NO: 8310471 - DNA, 21 bp, Homo sapiens
tcagggcagtgggaggttcct

SEQ ID NO: 8310472 - DNA, 22 bp, Homo sapiens
tcagggcaggcgagcagctgct

SEQ ID NO: 8310473 - DNA, 22 bp, Homo sapiens
tcagggcaggttaacttgggtg

SEQ ID NO: 8310474 - DNA, 22 bp, Homo sapiens
tcagggcaggacagtgtaggcc

SEQ ID NO: 8310475 - DNA, 22 bp, Homo sapiens
tcatacatcttgtatatctatc

SEQ ID NO: 8310476 - DNA, 22 bp, Homo sapiens
tcatcttctattaatagggaga

SEQ ID NO: 8310477 - DNA, 22 bp, Homo sapiens
tcagtatccacaaatgctcaaa

SEQ ID NO: 8310478 - DNA, 22 bp, Homo sapiens
tcattgtcttgatatgattgtc

SEQ ID NO: 8310479 - DNA, 22 bp, Homo sapiens
tcatttctccgacctgctgtcc

SEQ ID NO: 8310480 - DNA, 22 bp, Homo sapiens
tcatttcctcaaattcaaggtt

SEQ ID NO: 8310481 - DNA, 22 bp, Homo sapiens
tcatttttagcgcgcaaaagtt

SEQ ID NO: 8310482 - DNA, 21 bp, Homo sapiens
tcatttttattgctaccttgc

SEQ ID NO: 8310483 - DNA, 22 bp, Homo sapiens
tccaaacaccctccatgctgca

SEQ ID NO: 8310484 - DNA, 19 bp, Homo sapiens
tccaaaggacccacctcca

SEQ ID NO: 8310485 - DNA, 20 bp, Homo sapiens
tccaagggcagcagaatcag

SEQ ID NO: 8310486 - DNA, 22 bp, Homo sapiens
tccaagggcagccatagaactt

SEQ ID NO: 8310487 - DNA, 23 bp, Homo sapiens
tccaagggctacaaacacagacc

SEQ ID NO: 8310488 - DNA, 22 bp, Homo sapiens
tcctgcagacctcagtcaggtc

SEQ ID NO: 8310489 - DNA, 22 bp, Homo sapiens
tcctgcagagacagaggcctca

SEQ ID NO: 8310490 - DNA, 22 bp, Homo sapiens
tcctgcagccactgcaggcaga

SEQ ID NO: 8310491 - DNA, 22 bp, Homo sapiens
tcctgcagagccgccctcaggt

SEQ ID NO: 8310492 - DNA, 22 bp, Homo sapiens
tcctgcaggcctgttcccagta

SEQ ID NO: 8310493 - DNA, 22 bp, Homo sapiens
tcctgcctctccatgctaacta

SEQ ID NO: 8310494 - DNA, 22 bp, Homo sapiens
tcctgcctcttgccttcttcac

SEQ ID NO: 8310495 - DNA, 22 bp, Homo sapiens
tcctgcctcttgccttcttcac

SEQ ID NO: 8310496 - DNA, 22 bp, Homo sapiens
tcctgcctcttttcttattcca

SEQ ID NO: 8310497 - DNA, 22 bp, Homo sapiens
tcctgcctcttttcttattcca

SEQ ID NO: 8310498 - DNA, 22 bp, Homo sapiens
tcctgcctgagcgtggaggagg

SEQ ID NO: 8310499 - DNA, 22 bp, Homo sapiens
tcctgcctgagcgtggaggagg

SEQ ID NO: 8310500 - DNA, 22 bp, Homo sapiens
tcctgcctgcaatcccagcact

SEQ ID NO: 8310501 - DNA, 22 bp, Homo sapiens
tcctgcctgcaatcccagcact

SEQ ID NO: 8310502 - DNA, 22 bp, Homo sapiens
tcctgcctagcaggtgacctat

SEQ ID NO: 8310503 - DNA, 22 bp, Homo sapiens
tcctgcctagcaggtgacctat

SEQ ID NO: 8310504 - DNA, 22 bp, Homo sapiens
tcctgcctaccttgcggaggtg

SEQ ID NO: 8310505 - DNA, 22 bp, Homo sapiens
tcctgcctaccttgcggaggtg

SEQ ID NO: 8310506 - DNA, 22 bp, Homo sapiens
tcctgcctcaggctctggagta

SEQ ID NO: 8310507 - DNA, 22 bp, Homo sapiens
tcctgcctcacagttgaagttt

SEQ ID NO: 8310508 - DNA, 22 bp, Homo sapiens
tcctgcctcacagttgaagttt

SEQ ID NO: 8310509 - DNA, 22 bp, Homo sapiens
tcctgcctcaggctctggagta

SEQ ID NO: 8310510 - DNA, 22 bp, Homo sapiens
tcctgcctctccatgctaacta

SEQ ID NO: 8310511 - DNA, 22 bp, Homo sapiens
tcctgagatgagacagtgctgc

SEQ ID NO: 8310512 - DNA, 23 bp, Homo sapiens
tcctgagatgagacagtgctgcc

SEQ ID NO: 8310513 - DNA, 22 bp, Homo sapiens
tcctgagataaatctcatgtga

SEQ ID NO: 8310514 - DNA, 22 bp, Homo sapiens
tcctgagatgtggagctccatg

SEQ ID NO: 8310515 - DNA, 22 bp, Homo sapiens
tcctgagattctgcatttctaa

SEQ ID NO: 8310516 - DNA, 20 bp, Homo sapiens
tcctgagatttaaggggttc

SEQ ID NO: 8310517 - DNA, 22 bp, Homo sapiens
tcctgaggaaagttcatgaatg

SEQ ID NO: 8310518 - DNA, 22 bp, Homo sapiens
tcctcaggtgactaggtatctt

SEQ ID NO: 8310519 - DNA, 22 bp, Homo sapiens
tcctctggggtcagggcactac

SEQ ID NO: 8310520 - DNA, 22 bp, Homo sapiens
tcctctggggcgtggtcctgga

SEQ ID NO: 8310521 - DNA, 22 bp, Homo sapiens
tcctcttctgcccatcagaggc

SEQ ID NO: 8310522 - DNA, 22 bp, Homo sapiens
tcctgagagcagagtccaggtg

SEQ ID NO: 8310523 - DNA, 22 bp, Homo sapiens
tccgtatttgactattgcaccg

SEQ ID NO: 8310524 - DNA, 22 bp, Homo sapiens
tccctggccattcctctaggcc

SEQ ID NO: 8310525 - DNA, 19 bp, Homo sapiens
tccctggcgcctctcgggc

SEQ ID NO: 8310526 - DNA, 22 bp, Homo sapiens
tccctggctgggggctgccttg

SEQ ID NO: 8310527 - DNA, 22 bp, Homo sapiens
tccctggctgtgttcaggtgcg

SEQ ID NO: 8310528 - DNA, 22 bp, Homo sapiens
tccctggcagctaagggtggtc

SEQ ID NO: 8310529 - DNA, 20 bp, Homo sapiens
tccctggaggtggtggcatc

SEQ ID NO: 8310530 - DNA, 23 bp, Homo sapiens
tccctggaggcaggtccagggcc

SEQ ID NO: 8310531 - DNA, 22 bp, Homo sapiens
tccctggagataacttctggga

SEQ ID NO: 8310532 - DNA, 22 bp, Homo sapiens
tccctggacagccttgcctggg

SEQ ID NO: 8310533 - DNA, 22 bp, Homo sapiens
tccctggacaacagacttcact

SEQ ID NO: 8310534 - DNA, 22 bp, Homo sapiens
tcctattggtagacatttctgt

SEQ ID NO: 8310535 - DNA, 22 bp, Homo sapiens
tcctcacaagcaagcacaggta

SEQ ID NO: 8310536 - DNA, 20 bp, Homo sapiens
tcctcagaagacatttgggg

SEQ ID NO: 8310537 - DNA, 22 bp, Homo sapiens
tcctcagaaacccctgtgaggt

SEQ ID NO: 8310538 - DNA, 22 bp, Homo sapiens
tcctcacagtcaacactttgag

SEQ ID NO: 8310539 - DNA, 22 bp, Homo sapiens
tcctcacatggtgagccacaca

SEQ ID NO: 8310540 - DNA, 22 bp, Homo sapiens
tcctcagatgctcttggacgcc

SEQ ID NO: 8310541 - DNA, 22 bp, Homo sapiens
tcctcagacttccctttgtgta

SEQ ID NO: 8310542 - DNA, 22 bp, Homo sapiens
tcctcagacaccctgctggctt

SEQ ID NO: 8310543 - DNA, 22 bp, Homo sapiens
tcctcagggcggcctccgtctt

SEQ ID NO: 8310544 - DNA, 19 bp, Homo sapiens
tcctcaggggctcacagac

SEQ ID NO: 8310545 - DNA, 21 bp, Homo sapiens
tcctcagggccccagagcact

SEQ ID NO: 8310546 - DNA, 22 bp, Homo sapiens
tcctcaggtcaaagcaggagaa

SEQ ID NO: 8310547 - DNA, 22 bp, Homo sapiens
tcctcagggggccaacccagcc

SEQ ID NO: 8310548 - DNA, 22 bp, Homo sapiens
tccctccccacttctgagcttt

SEQ ID NO: 8310549 - DNA, 22 bp, Homo sapiens
tccctcagcttgtctccatgca

SEQ ID NO: 8310550 - DNA, 23 bp, Homo sapiens
tccctcaggccttatctccatct

SEQ ID NO: 8310551 - DNA, 20 bp, Homo sapiens
tccctccctccagctctggg

SEQ ID NO: 8310552 - DNA, 18 bp, Homo sapiens
tccctccctgctgtggcc

SEQ ID NO: 8310553 - DNA, 19 bp, Homo sapiens
tccctccctgtaatctcac

SEQ ID NO: 8310554 - DNA, 22 bp, Homo sapiens
tccctctgtgttgggcatgcct

SEQ ID NO: 8310555 - DNA, 22 bp, Homo sapiens
tcccagggacaccaagctgttt

SEQ ID NO: 8310556 - DNA, 23 bp, Homo sapiens
tcccagggaaggtgagcgaggct

SEQ ID NO: 8310557 - DNA, 22 bp, Homo sapiens
tcccaggctaggcctctgcgtt

SEQ ID NO: 8310558 - DNA, 22 bp, Homo sapiens
tcccagggactctctgccttcc

SEQ ID NO: 8310559 - DNA, 19 bp, Homo sapiens
tcccgcccactgagcgtgc

SEQ ID NO: 8310560 - DNA, 22 bp, Homo sapiens
tccctcagatgagctcctagca

SEQ ID NO: 8310561 - DNA, 20 bp, Homo sapiens
tccctcagcacttctacctc

SEQ ID NO: 8310562 - DNA, 22 bp, Homo sapiens
tcccagcctggaccctgccagt

SEQ ID NO: 8310563 - DNA, 22 bp, Homo sapiens
tcccagcctgacagtgcatcaa

SEQ ID NO: 8310564 - DNA, 22 bp, Homo sapiens
tcccagccttccagtctggttt

SEQ ID NO: 8310565 - DNA, 22 bp, Homo sapiens
tcccagccttccttgtggtgaa

SEQ ID NO: 8310566 - DNA, 23 bp, Homo sapiens
tcccagcctcttctcttgcatac

SEQ ID NO: 8310567 - DNA, 22 bp, Homo sapiens
tcccagccggtgcctgggtccc

SEQ ID NO: 8310568 - DNA, 22 bp, Homo sapiens
tcccagcattaatgcctgtcag

SEQ ID NO: 8310569 - DNA, 22 bp, Homo sapiens
tcccagagccaagctatggatg

SEQ ID NO: 8310570 - DNA, 22 bp, Homo sapiens
tcccagaggactgttggtgcta

SEQ ID NO: 8310571 - DNA, 22 bp, Homo sapiens
tcccagaggcagttggtaactt

SEQ ID NO: 8310572 - DNA, 22 bp, Homo sapiens
tcccagaggctccagtctctat

SEQ ID NO: 8310573 - DNA, 22 bp, Homo sapiens
tcccagaggtctctgctggttc

SEQ ID NO: 8310574 - DNA, 22 bp, Homo sapiens
tcccagaggttgagtcacttat

SEQ ID NO: 8310575 - DNA, 22 bp, Homo sapiens
tcccagcataacaaactgcccg

SEQ ID NO: 8310576 - DNA, 22 bp, Homo sapiens
tccatgtggccagacactggca

SEQ ID NO: 8310577 - DNA, 22 bp, Homo sapiens
tccatgtgccaaggggcagagg

SEQ ID NO: 8310578 - DNA, 22 bp, Homo sapiens
tccatgggtagccctggttgag

SEQ ID NO: 8310579 - DNA, 22 bp, Homo sapiens
tccatggggcccaggatgagag

SEQ ID NO: 8310580 - DNA, 22 bp, Homo sapiens
tcccaaagctactcttctgact

SEQ ID NO: 8310581 - DNA, 22 bp, Homo sapiens
tccatttactattctcatatcg

SEQ ID NO: 8310582 - DNA, 21 bp, Homo sapiens
tccattgttttcccagggttt

SEQ ID NO: 8310583 - DNA, 18 bp, Homo sapiens
tccattgttctactgtga

SEQ ID NO: 8310584 - DNA, 22 bp, Homo sapiens
tccattgtctttggtcctagcc

SEQ ID NO: 8310585 - DNA, 22 bp, Homo sapiens
tccattggtctctgtgcccagg

SEQ ID NO: 8310586 - DNA, 22 bp, Homo sapiens
tcccagagcagtactccaggag

SEQ ID NO: 8310587 - DNA, 22 bp, Homo sapiens
tcccagagcagatgtgctaaag

SEQ ID NO: 8310588 - DNA, 22 bp, Homo sapiens
tcccagagacatcatttctccg

SEQ ID NO: 8310589 - DNA, 22 bp, Homo sapiens
tcccagagacagagcctcctcc

SEQ ID NO: 8310590 - DNA, 22 bp, Homo sapiens
tcccagagatttcctctccttc

SEQ ID NO: 8310591 - DNA, 22 bp, Homo sapiens
tcccagagaagagctggatgga

SEQ ID NO: 8310592 - DNA, 22 bp, Homo sapiens
tccaggctaggtttacaggaca

SEQ ID NO: 8310593 - DNA, 22 bp, Homo sapiens
tccaggctggacatgaggcggg

SEQ ID NO: 8310594 - DNA, 21 bp, Homo sapiens
tccacaagttagaaggaaatt

SEQ ID NO: 8310595 - DNA, 22 bp, Homo sapiens
tccacaaggcagctcctccagg

SEQ ID NO: 8310596 - DNA, 22 bp, Homo sapiens
tccagggaaggtgtgaggctgg

SEQ ID NO: 8310597 - DNA, 22 bp, Homo sapiens
tccagggaagagcagaggctac

SEQ ID NO: 8310598 - DNA, 21 bp, Homo sapiens
tccagggaacttctcaggaat

SEQ ID NO: 8310599 - DNA, 22 bp, Homo sapiens
tccaggctgggctgaagggtgc

SEQ ID NO: 8310600 - DNA, 22 bp, Homo sapiens
tccagggctgacttgggagagg

SEQ ID NO: 8310601 - DNA, 22 bp, Homo sapiens
tccagggacacagagtccttct

SEQ ID NO: 8310602 - DNA, 22 bp, Homo sapiens
tccagggctgggttggctcagc

SEQ ID NO: 8310603 - DNA, 22 bp, Homo sapiens
tccagggcttggctgggacggt

SEQ ID NO: 8310604 - DNA, 22 bp, Homo sapiens
tccagtcaagcttgagaatttc

SEQ ID NO: 8310605 - DNA, 18 bp, Homo sapiens
gcagagtgcgtctctgtg

SEQ ID NO: 8310606 - DNA, 18 bp, Homo sapiens
gcagagtgcgtctctgtg

SEQ ID NO: 8310607 - DNA, 22 bp, Homo sapiens
gcagagtgatggaatgtgggtg

SEQ ID NO: 8310608 - DNA, 22 bp, Homo sapiens
gcagagtgaggaagagcttcca

SEQ ID NO: 8310609 - DNA, 22 bp, Homo sapiens
gcagagtgagccgaggctgctc

SEQ ID NO: 8310610 - DNA, 22 bp, Homo sapiens
gcagagtgagccgaggctgctc

SEQ ID NO: 8310611 - DNA, 22 bp, Homo sapiens
gcagagtgggagcccagggctg

SEQ ID NO: 8310612 - DNA, 22 bp, Homo sapiens
gcagagtgggagcccagggctg

SEQ ID NO: 8310613 - DNA, 22 bp, Homo sapiens
gcagagtgggagcccagggctg

SEQ ID NO: 8310614 - DNA, 22 bp, Homo sapiens
gcagaggtggcatctgggctct

SEQ ID NO: 8310615 - DNA, 22 bp, Homo sapiens
gcaccacatcaatgaggggagc

SEQ ID NO: 8310616 - DNA, 22 bp, Homo sapiens
gcacccagaggtcagcagtgct

SEQ ID NO: 8310617 - DNA, 22 bp, Homo sapiens
gcacccagccagcatctcagag

SEQ ID NO: 8310618 - DNA, 22 bp, Homo sapiens
gcacccagcccagggcgtgatg

SEQ ID NO: 8310619 - DNA, 23 bp, Homo sapiens
gcagacagagcagactaagacaa

SEQ ID NO: 8310620 - DNA, 22 bp, Homo sapiens
gcagacagactgcagtgatttt

SEQ ID NO: 8310621 - DNA, 22 bp, Homo sapiens
gcagacagcatgttgggctatt

SEQ ID NO: 8310622 - DNA, 22 bp, Homo sapiens
gcagacagccagactgcactgg

SEQ ID NO: 8310623 - DNA, 22 bp, Homo sapiens
gcagacaggcccagtggaggga

SEQ ID NO: 8310624 - DNA, 22 bp, Homo sapiens
gcacagagggcagtgagcctct

SEQ ID NO: 8310625 - DNA, 22 bp, Homo sapiens
gcacagaagagctttggaatga

SEQ ID NO: 8310626 - DNA, 22 bp, Homo sapiens
gcacagaacttctcttagtagg

SEQ ID NO: 8310627 - DNA, 22 bp, Homo sapiens
gcacagaagtaaaatacaagtc

SEQ ID NO: 8310628 - DNA, 22 bp, Homo sapiens
gcacagcaatttctataagctc

SEQ ID NO: 8310629 - DNA, 22 bp, Homo sapiens
gcaaggcagcgcggagtagcta

SEQ ID NO: 8310630 - DNA, 20 bp, Homo sapiens
gcaaggcacagtgaggaggg

SEQ ID NO: 8310631 - DNA, 22 bp, Homo sapiens
gcaaggacctttgagcgtgcca

SEQ ID NO: 8310632 - DNA, 22 bp, Homo sapiens
gcaaggagactgtagggccaag

SEQ ID NO: 8310633 - DNA, 22 bp, Homo sapiens
gcaaggaggctggtggaggaag

SEQ ID NO: 8310634 - DNA, 19 bp, Homo sapiens
gcagggtgttgactgtccc

SEQ ID NO: 8310635 - DNA, 22 bp, Homo sapiens
gcagggccagggctcaggctgt

SEQ ID NO: 8310636 - DNA, 22 bp, Homo sapiens
gcagggccagggctcaggctgt

SEQ ID NO: 8310637 - DNA, 22 bp, Homo sapiens
gcagggcatgggccctgtctgc

SEQ ID NO: 8310638 - DNA, 22 bp, Homo sapiens
gcagggccagtgcagagaggaa

SEQ ID NO: 8310639 - DNA, 22 bp, Homo sapiens
gcagggccaggtacaagaagca

SEQ ID NO: 8310640 - DNA, 22 bp, Homo sapiens
gcagggtgtgtctcatacagtt

SEQ ID NO: 8310641 - DNA, 22 bp, Homo sapiens
gcaggcagttgcagttttctag

SEQ ID NO: 8310642 - DNA, 22 bp, Homo sapiens
gcaggcagttgcagttttctag

SEQ ID NO: 8310643 - DNA, 22 bp, Homo sapiens
gcaggcagtttgcttttccctc

SEQ ID NO: 8310644 - DNA, 22 bp, Homo sapiens
gcaggccagctgtgcagatggg

SEQ ID NO: 8310645 - DNA, 22 bp, Homo sapiens
gcagggcagcttagtccctgtc

SEQ ID NO: 8310646 - DNA, 22 bp, Homo sapiens
gcagggcagccacaggccccct

SEQ ID NO: 8310647 - DNA, 22 bp, Homo sapiens
gcaggcctcccctgctggagct

SEQ ID NO: 8310648 - DNA, 22 bp, Homo sapiens
gcagctggtctggcctagagta

SEQ ID NO: 8310649 - DNA, 22 bp, Homo sapiens
gcagctggtgcaaatgtcactc

SEQ ID NO: 8310650 - DNA, 22 bp, Homo sapiens
gcagctggttaatgggagaatt

SEQ ID NO: 8310651 - DNA, 22 bp, Homo sapiens
gcagctggggccacacttaggc

SEQ ID NO: 8310652 - DNA, 21 bp, Homo sapiens
gcagctggtctcagagcttgc

SEQ ID NO: 8310653 - DNA, 22 bp, Homo sapiens
gcagctgggccccagcctctcc

SEQ ID NO: 8310654 - DNA, 22 bp, Homo sapiens
gcagctggggaggtcgtgggga

SEQ ID NO: 8310655 - DNA, 22 bp, Homo sapiens
gcagctgggacactgaggccag

SEQ ID NO: 8310656 - DNA, 22 bp, Homo sapiens
gcagctggctcagagaggtggg

SEQ ID NO: 8310657 - DNA, 22 bp, Homo sapiens
gcagcccaatggactgagacag

SEQ ID NO: 8310658 - DNA, 22 bp, Homo sapiens
gcagcccaatggactgagacag

SEQ ID NO: 8310659 - DNA, 17 bp, Homo sapiens
gcagccagtgcagcagg

SEQ ID NO: 8310660 - DNA, 22 bp, Homo sapiens
gcagcccaaaaaagaggtagat

SEQ ID NO: 8310661 - DNA, 22 bp, Homo sapiens
gcagcacatataaacaaagaga

SEQ ID NO: 8310662 - DNA, 22 bp, Homo sapiens
gcagcaatcttcacagtgtcat

SEQ ID NO: 8310663 - DNA, 22 bp, Homo sapiens
gcagcagcccagggctctcaga

SEQ ID NO: 8310664 - DNA, 22 bp, Homo sapiens
gcagccacagaggagggatgca

SEQ ID NO: 8310665 - DNA, 21 bp, Homo sapiens
gcagccacagccaccaagcta

SEQ ID NO: 8310666 - DNA, 21 bp, Homo sapiens
gcagccacagccaccaagcta

SEQ ID NO: 8310667 - DNA, 22 bp, Homo sapiens
gcagccaccctcaaggctgaat

SEQ ID NO: 8310668 - DNA, 19 bp, Homo sapiens
gcagccaccgcggcggccg

SEQ ID NO: 8310669 - DNA, 22 bp, Homo sapiens
gcagccactagttttcctgttt

SEQ ID NO: 8310670 - DNA, 22 bp, Homo sapiens
gcagccactagttttcctgttt

SEQ ID NO: 8310671 - DNA, 22 bp, Homo sapiens
gcagccacctcccatggcgggg

SEQ ID NO: 8310672 - DNA, 22 bp, Homo sapiens
gcagccactttgcaaccaagag

SEQ ID NO: 8310673 - DNA, 22 bp, Homo sapiens
gcagccagaagactcagaacaa

SEQ ID NO: 8310674 - DNA, 22 bp, Homo sapiens
gcagccactctcattccacgtg

SEQ ID NO: 8310675 - DNA, 21 bp, Homo sapiens
gcagccactgccttcaacaat

SEQ ID NO: 8310676 - DNA, 22 bp, Homo sapiens
gcagccactgggagtgcttata

SEQ ID NO: 8310677 - DNA, 22 bp, Homo sapiens
gcagccagcccctctgacctct

SEQ ID NO: 8310678 - DNA, 21 bp, Homo sapiens
gcagccagacgggattcagtt

SEQ ID NO: 8310679 - DNA, 22 bp, Homo sapiens
gcagccaggaaagctggaccct

SEQ ID NO: 8310680 - DNA, 21 bp, Homo sapiens
gcagccagccgagaccatgcc

SEQ ID NO: 8310681 - DNA, 18 bp, Homo sapiens
gcaggtgccactgctgtt

SEQ ID NO: 8310682 - DNA, 20 bp, Homo sapiens
gcattgagtatagacagatg

SEQ ID NO: 8310683 - DNA, 19 bp, Homo sapiens
gcataaaatgtcaatgtgt

SEQ ID NO: 8310684 - DNA, 22 bp, Homo sapiens
gcatttaaatttgaacttcaga

SEQ ID NO: 8310685 - DNA, 23 bp, Homo sapiens
gcattgtctccccacttctgggc

SEQ ID NO: 8310686 - DNA, 22 bp, Homo sapiens
gcattgtcctgcttctgagtgt

SEQ ID NO: 8310687 - DNA, 22 bp, Homo sapiens
gcattgtcaaaagtggtatgac

SEQ ID NO: 8310688 - DNA, 22 bp, Homo sapiens
gcatttatttctttactgcatc

SEQ ID NO: 8310689 - DNA, 22 bp, Homo sapiens
gcatttagctttaaaatatttc

SEQ ID NO: 8310690 - DNA, 22 bp, Homo sapiens
gccacctctttgtctctgccgc

SEQ ID NO: 8310691 - DNA, 22 bp, Homo sapiens
gccacctcggctttctctgctc

SEQ ID NO: 8310692 - DNA, 21 bp, Homo sapiens
gccacctcgtctcggagcagc

SEQ ID NO: 8310693 - DNA, 22 bp, Homo sapiens
gccaggctctcagtgactgccc

SEQ ID NO: 8310694 - DNA, 23 bp, Homo sapiens
gccaggctccggtctgtggccac

SEQ ID NO: 8310695 - DNA, 22 bp, Homo sapiens
gccaggctccccggatccctgg

SEQ ID NO: 8310696 - DNA, 22 bp, Homo sapiens
gccaggctccaggccctcctga

SEQ ID NO: 8310697 - DNA, 22 bp, Homo sapiens
gccaggctcagcagtcaacctg

SEQ ID NO: 8310698 - DNA, 22 bp, Homo sapiens
gccagacactcccctgggcagg

SEQ ID NO: 8310699 - DNA, 22 bp, Homo sapiens
gccagaaacatacacatcactt

SEQ ID NO: 8310700 - DNA, 22 bp, Homo sapiens
gccagctggtaggcacctagcc

SEQ ID NO: 8310701 - DNA, 22 bp, Homo sapiens
gccctgctgtcttcagagtata

SEQ ID NO: 8310702 - DNA, 22 bp, Homo sapiens
gccctggaatctctccatggga

SEQ ID NO: 8310703 - DNA, 22 bp, Homo sapiens
gccctcagaggacagctgactt

SEQ ID NO: 8310704 - DNA, 22 bp, Homo sapiens
gcccctgggagcagagccacca

SEQ ID NO: 8310705 - DNA, 22 bp, Homo sapiens
gcccctggctggccagctcctc

SEQ ID NO: 8310706 - DNA, 22 bp, Homo sapiens
gcccctccatccatcaccgggg

SEQ ID NO: 8310707 - DNA, 22 bp, Homo sapiens
gcccctcccagtcaggagcact

SEQ ID NO: 8310708 - DNA, 22 bp, Homo sapiens
gcccacagctcgttcctctcct

SEQ ID NO: 8310709 - DNA, 22 bp, Homo sapiens
gcccacagctcgttcctctcct

SEQ ID NO: 8310710 - DNA, 22 bp, Homo sapiens
gcccacacaccagctcaggagg

SEQ ID NO: 8310711 - DNA, 22 bp, Homo sapiens
gcccacacaccagctcaggagg

SEQ ID NO: 8310712 - DNA, 22 bp, Homo sapiens
gcctgaggaattgagggggtaa

SEQ ID NO: 8310713 - DNA, 22 bp, Homo sapiens
gcctgaggaatgctcctgactt

SEQ ID NO: 8310714 - DNA, 22 bp, Homo sapiens
gcctccctgttcttccacaata

SEQ ID NO: 8310715 - DNA, 22 bp, Homo sapiens
gcctcccctgcaattgtccttg

SEQ ID NO: 8310716 - DNA, 22 bp, Homo sapiens
gcctccctggcccacagcagcg

SEQ ID NO: 8310717 - DNA, 18 bp, Homo sapiens
gcctgcaggcacgggggt

SEQ ID NO: 8310718 - DNA, 22 bp, Homo sapiens
gcctgcagcctcaagggctgag

SEQ ID NO: 8310719 - DNA, 22 bp, Homo sapiens
gcctgcagatatataggatggt

SEQ ID NO: 8310720 - DNA, 20 bp, Homo sapiens
gcctgcagagaaggtcagag

SEQ ID NO: 8310721 - DNA, 22 bp, Homo sapiens
gcctgcagaggtgctgctagct

SEQ ID NO: 8310722 - DNA, 22 bp, Homo sapiens
gcctgcagaactgtgaggcaat

SEQ ID NO: 8310723 - DNA, 21 bp, Homo sapiens
gcctgcagaccccaccaggct

SEQ ID NO: 8310724 - DNA, 22 bp, Homo sapiens
gcctgatgagcttccagctgag

SEQ ID NO: 8310725 - DNA, 19 bp, Homo sapiens
gcctgcagaaaaggcaggg

SEQ ID NO: 8310726 - DNA, 22 bp, Homo sapiens
gcctgcagggtgatgggctgcc

SEQ ID NO: 8310727 - DNA, 22 bp, Homo sapiens
gcctgcagggtgatgggctgcc

SEQ ID NO: 8310728 - DNA, 22 bp, Homo sapiens
gcctgcagggtgatgggctgcc

SEQ ID NO: 8310729 - DNA, 22 bp, Homo sapiens
gcctgcagtgagtgcagaaggt

SEQ ID NO: 8310730 - DNA, 20 bp, Homo sapiens
gcctgcaggttggatgggat

SEQ ID NO: 8310731 - DNA, 22 bp, Homo sapiens
gcctgcagttctgtgctaggca

SEQ ID NO: 8310732 - DNA, 23 bp, Homo sapiens
gcctggagaaaagctgcagttca

SEQ ID NO: 8310733 - DNA, 22 bp, Homo sapiens
gcctggagaaaggaaggtggga

SEQ ID NO: 8310734 - DNA, 22 bp, Homo sapiens
gcctggagaaaggaaggtggga

SEQ ID NO: 8310735 - DNA, 22 bp, Homo sapiens
gcctggagaagatggaactagc

SEQ ID NO: 8310736 - DNA, 22 bp, Homo sapiens
gcctggagaattaaaaggaagg

SEQ ID NO: 8310737 - DNA, 22 bp, Homo sapiens
gcctggagacaaggacaaaggg

SEQ ID NO: 8310738 - DNA, 22 bp, Homo sapiens
gcctggagacagcagaggcggc

SEQ ID NO: 8310739 - DNA, 22 bp, Homo sapiens
gcctggagacagcagaggcggc

SEQ ID NO: 8310740 - DNA, 22 bp, Homo sapiens
gcctggagcccagtgtggggct

SEQ ID NO: 8310741 - DNA, 16 bp, Homo sapiens
gcctggagtggcaggg

SEQ ID NO: 8310742 - DNA, 22 bp, Homo sapiens
gcctggagtgcagtggcgtgat

SEQ ID NO: 8310743 - DNA, 22 bp, Homo sapiens
gcctggagtgcagtggcgtgat

SEQ ID NO: 8310744 - DNA, 22 bp, Homo sapiens
gcctggagtggacttggcccct

SEQ ID NO: 8310745 - DNA, 22 bp, Homo sapiens
gcctggagagcactgtgcgctt

SEQ ID NO: 8310746 - DNA, 22 bp, Homo sapiens
gcctggagacctgctcctctac

SEQ ID NO: 8310747 - DNA, 22 bp, Homo sapiens
gcctggagagcactgtgcgctt

SEQ ID NO: 8310748 - DNA, 22 bp, Homo sapiens
gcctggagaggaagccggtgga

SEQ ID NO: 8310749 - DNA, 22 bp, Homo sapiens
gcctggagcagacgtgtcccgg

SEQ ID NO: 8310750 - DNA, 22 bp, Homo sapiens
gcctggagcagacgtgtcccgg

SEQ ID NO: 8310751 - DNA, 22 bp, Homo sapiens
ggacagagggttgacagagtat

SEQ ID NO: 8310752 - DNA, 22 bp, Homo sapiens
ggaaggaggggcaaagcagttc

SEQ ID NO: 8310753 - DNA, 22 bp, Homo sapiens
ggaaggagggcggcaatgatga

SEQ ID NO: 8310754 - DNA, 22 bp, Homo sapiens
ggaaggagggcggcaatgatga

SEQ ID NO: 8310755 - DNA, 22 bp, Homo sapiens
ggaaggaggatgctctggcctt

SEQ ID NO: 8310756 - DNA, 23 bp, Homo sapiens
ggacagggccctgccctatggcc

SEQ ID NO: 8310757 - DNA, 21 bp, Homo sapiens
ggacttacataggtaaggggt

SEQ ID NO: 8310758 - DNA, 22 bp, Homo sapiens
ggactgggaatcagggagatgc

SEQ ID NO: 8310759 - DNA, 22 bp, Homo sapiens
ggactggccggcgctgaggccc

SEQ ID NO: 8310760 - DNA, 22 bp, Homo sapiens
ggactggactctcaggctcaca

SEQ ID NO: 8310761 - DNA, 22 bp, Homo sapiens
ggagccagtatttagtggtctt

SEQ ID NO: 8310762 - DNA, 22 bp, Homo sapiens
ggagccaggggaccttcacaga

SEQ ID NO: 8310763 - DNA, 22 bp, Homo sapiens
ggagccagggaagctgcttcct

SEQ ID NO: 8310764 - DNA, 22 bp, Homo sapiens
ggagccaggcaatctgtacttt

SEQ ID NO: 8310765 - DNA, 22 bp, Homo sapiens
ggagccagtgccctctggtgga

SEQ ID NO: 8310766 - DNA, 22 bp, Homo sapiens
ggagccagtttagacctcagtt

SEQ ID NO: 8310767 - DNA, 18 bp, Homo sapiens
ggagccagtctgtctctg

SEQ ID NO: 8310768 - DNA, 23 bp, Homo sapiens
ggagcctggcatatgagacgcat

SEQ ID NO: 8310769 - DNA, 22 bp, Homo sapiens
ggagcctggcaatgctgcgtcc

SEQ ID NO: 8310770 - DNA, 22 bp, Homo sapiens
ggagcctggcaatgctgcgtcc

SEQ ID NO: 8310771 - DNA, 22 bp, Homo sapiens
ggagcctggcaatgctgcgtcc

SEQ ID NO: 8310772 - DNA, 22 bp, Homo sapiens
ggagctgttgcgcatgcgctcg

SEQ ID NO: 8310773 - DNA, 22 bp, Homo sapiens
ggagctgtctgtagggcacagg

SEQ ID NO: 8310774 - DNA, 22 bp, Homo sapiens
ggagctgtaacgagccattgct

SEQ ID NO: 8310775 - DNA, 22 bp, Homo sapiens
ggagctggtcagccttgagcat

SEQ ID NO: 8310776 - DNA, 22 bp, Homo sapiens
ggagctggggttggcatcttcc

SEQ ID NO: 8310777 - DNA, 22 bp, Homo sapiens
ggagctgcatttagggagcctt

SEQ ID NO: 8310778 - DNA, 22 bp, Homo sapiens
ggagctggctacagagaactcc

SEQ ID NO: 8310779 - DNA, 21 bp, Homo sapiens
ggagctgcaggagccgaaggc

SEQ ID NO: 8310780 - DNA, 22 bp, Homo sapiens
ggagcctgggcattagtaattt

SEQ ID NO: 8310781 - DNA, 22 bp, Homo sapiens
ggagcctggcctggctctgtgt

SEQ ID NO: 8310782 - DNA, 22 bp, Homo sapiens
ggagctgggaccctgtcatctg

SEQ ID NO: 8310783 - DNA, 22 bp, Homo sapiens
ggagctgggaccctgtcatctg

SEQ ID NO: 8310784 - DNA, 22 bp, Homo sapiens
ggagctgggaattggatcatct

SEQ ID NO: 8310785 - DNA, 19 bp, Homo sapiens
gctttttgttgtcaaaggt

SEQ ID NO: 8310786 - DNA, 22 bp, Homo sapiens
gcttttttaggtaagacccagg

SEQ ID NO: 8310787 - DNA, 22 bp, Homo sapiens
gcttttttgctattgaagtggt

SEQ ID NO: 8310788 - DNA, 22 bp, Homo sapiens
gcttttttgggatgcctgcctt

SEQ ID NO: 8310789 - DNA, 22 bp, Homo sapiens
gctttttcaaatgaaagctggt

SEQ ID NO: 8310790 - DNA, 20 bp, Homo sapiens
gctttttctaatagcagtcc

SEQ ID NO: 8310791 - DNA, 22 bp, Homo sapiens
gctttgtgtagaaggaggatgg

SEQ ID NO: 8310792 - DNA, 19 bp, Homo sapiens
gctgtattaaagatacatg

SEQ ID NO: 8310793 - DNA, 22 bp, Homo sapiens
gctgtattcctgcactgtatag

SEQ ID NO: 8310794 - DNA, 22 bp, Homo sapiens
gctgtatttaacaactggctca

SEQ ID NO: 8310795 - DNA, 22 bp, Homo sapiens
gctgtcacaaatatttctcagc

SEQ ID NO: 8310796 - DNA, 22 bp, Homo sapiens
gctgtatttattttctagggtt

SEQ ID NO: 8310797 - DNA, 22 bp, Homo sapiens
gctgtagtgaatggccgcgttc

SEQ ID NO: 8310798 - DNA, 22 bp, Homo sapiens
gctgtcaccaaagcaggcactg

SEQ ID NO: 8310799 - DNA, 22 bp, Homo sapiens
gctgtcacatcaaggcactaaa

SEQ ID NO: 8310800 - DNA, 22 bp, Homo sapiens
gctgtcacatttggagcactgg

SEQ ID NO: 8310801 - DNA, 22 bp, Homo sapiens
gctgtcacacatgggatctcag

SEQ ID NO: 8310802 - DNA, 22 bp, Homo sapiens
gctgtcacacatggccccagct

SEQ ID NO: 8310803 - DNA, 22 bp, Homo sapiens
gctgtcacaagcatctggggca

SEQ ID NO: 8310804 - DNA, 22 bp, Homo sapiens
gctgtcactcaccaggcctgca

SEQ ID NO: 8310805 - DNA, 22 bp, Homo sapiens
gctgtcactctccggccttccc

SEQ ID NO: 8310806 - DNA, 22 bp, Homo sapiens
gctgtcagcgcccaaggagctc

SEQ ID NO: 8310807 - DNA, 22 bp, Homo sapiens
gctgtcagaaggtgaagggtaa

SEQ ID NO: 8310808 - DNA, 22 bp, Homo sapiens
gctgtcaggccatgtgggcctt

SEQ ID NO: 8310809 - DNA, 22 bp, Homo sapiens
gctgtcaggaacatgccttggt

SEQ ID NO: 8310810 - DNA, 23 bp, Homo sapiens
gctgtcagttgtttttgtctcta

SEQ ID NO: 8310811 - DNA, 22 bp, Homo sapiens
gctgtcagtgaggtgagacatg

SEQ ID NO: 8310812 - DNA, 22 bp, Homo sapiens
gctggtccactccctggaggct

SEQ ID NO: 8310813 - DNA, 22 bp, Homo sapiens
gctggccacactgctgatggag

SEQ ID NO: 8310814 - DNA, 22 bp, Homo sapiens
gctggccacattgtgccgtcct

SEQ ID NO: 8310815 - DNA, 22 bp, Homo sapiens
gctgtgtgctcacgtagtggaa

SEQ ID NO: 8310816 - DNA, 22 bp, Homo sapiens
gctgtgtgactgagagcctggc

SEQ ID NO: 8310817 - DNA, 19 bp, Homo sapiens
gctgtgtgaccttgggcaa

SEQ ID NO: 8310818 - DNA, 23 bp, Homo sapiens
gctgtctgtcatctctgcgggag

SEQ ID NO: 8310819 - DNA, 22 bp, Homo sapiens
gctgtctgggttgagggccctg

SEQ ID NO: 8310820 - DNA, 22 bp, Homo sapiens
gctgtctgtctctgtcccacca

SEQ ID NO: 8310821 - DNA, 22 bp, Homo sapiens
gctgtctgtggtgtcagctgac

SEQ ID NO: 8310822 - DNA, 22 bp, Homo sapiens
gctgtctgtcttcacatctcgc

SEQ ID NO: 8310823 - DNA, 22 bp, Homo sapiens
gctgtctgtctctgtgacttaa

SEQ ID NO: 8310824 - DNA, 22 bp, Homo sapiens
gctgtctggaggctctgaggga

SEQ ID NO: 8310825 - DNA, 22 bp, Homo sapiens
gctgtctgggaggcctccactt

SEQ ID NO: 8310826 - DNA, 22 bp, Homo sapiens
gctgtctgggatgtcactgctg

SEQ ID NO: 8310827 - DNA, 20 bp, Homo sapiens
gctgtctggattagaagcct

SEQ ID NO: 8310828 - DNA, 22 bp, Homo sapiens
gctgtccatgtctggcctcagt

SEQ ID NO: 8310829 - DNA, 22 bp, Homo sapiens
gctgtcccatggttgcaagatg

SEQ ID NO: 8310830 - DNA, 22 bp, Homo sapiens
gctgtcccgaacccctggtaat

SEQ ID NO: 8310831 - DNA, 22 bp, Homo sapiens
gctgtcagttttacccacagac

SEQ ID NO: 8310832 - DNA, 22 bp, Homo sapiens
gctgtcagttttacccacagac

SEQ ID NO: 8310833 - DNA, 22 bp, Homo sapiens
gctgtccagagcatgggagcaa

SEQ ID NO: 8310834 - DNA, 22 bp, Homo sapiens
gctgtcctgggaacaggcacta

SEQ ID NO: 8310835 - DNA, 22 bp, Homo sapiens
gctgtctcatacaaggccctgc

SEQ ID NO: 8310836 - DNA, 22 bp, Homo sapiens
gctgtctgctgggtcgctcagg

SEQ ID NO: 8310837 - DNA, 22 bp, Homo sapiens
gctgtctcatacaaggccctgc

SEQ ID NO: 8310838 - DNA, 22 bp, Homo sapiens
gctgtctgctgtgcactgagca

SEQ ID NO: 8310839 - DNA, 22 bp, Homo sapiens
gctgtcctcttggactcagggc

SEQ ID NO: 8310840 - DNA, 22 bp, Homo sapiens
gctgtcctctgatctctggagg

SEQ ID NO: 8310841 - DNA, 22 bp, Homo sapiens
gctgtcctctgatctctggagg

SEQ ID NO: 8310842 - DNA, 22 bp, Homo sapiens
gctgagtgaggtccagagcttg

SEQ ID NO: 8310843 - DNA, 22 bp, Homo sapiens
gctgagtgattgatattttagt

SEQ ID NO: 8310844 - DNA, 17 bp, Homo sapiens
gctgagtgcagggagtc

SEQ ID NO: 8310845 - DNA, 22 bp, Homo sapiens
gctgagtgtaatgatggcagag

SEQ ID NO: 8310846 - DNA, 22 bp, Homo sapiens
gctgcaggcattttcctgggca

SEQ ID NO: 8310847 - DNA, 22 bp, Homo sapiens
gctctgtgggtgagtagaatct

SEQ ID NO: 8310848 - DNA, 23 bp, Homo sapiens
gctgaggtacatttacaggaaga

SEQ ID NO: 8310849 - DNA, 18 bp, Homo sapiens
gctgaggtggtgtcagag

SEQ ID NO: 8310850 - DNA, 22 bp, Homo sapiens
gctgaggtggctgccttagtaa

SEQ ID NO: 8310851 - DNA, 22 bp, Homo sapiens
gctgagtcttgagcactgagca

SEQ ID NO: 8310852 - DNA, 22 bp, Homo sapiens
gctgcctcccccatggctggaa

SEQ ID NO: 8310853 - DNA, 22 bp, Homo sapiens
gctgcctctgcgactctgggcg

SEQ ID NO: 8310854 - DNA, 22 bp, Homo sapiens
gctgcctctgcgactctgggcg

SEQ ID NO: 8310855 - DNA, 22 bp, Homo sapiens
gctgcctcctgaaagcgctctg

SEQ ID NO: 8310856 - DNA, 22 bp, Homo sapiens
gctgcaggcgcctgcggtctct

SEQ ID NO: 8310857 - DNA, 22 bp, Homo sapiens
gctggcatcactggcttcggtg

SEQ ID NO: 8310858 - DNA, 22 bp, Homo sapiens
gctggcattacaggagagaacc

SEQ ID NO: 8310859 - DNA, 22 bp, Homo sapiens
gctggcagtcccatcagctggg

SEQ ID NO: 8310860 - DNA, 22 bp, Homo sapiens
gctggcagtcccatcagctggg

SEQ ID NO: 8310861 - DNA, 22 bp, Homo sapiens
gctggcagggttctcactgaaa

SEQ ID NO: 8310862 - DNA, 22 bp, Homo sapiens
gctggcaggtccaagatagagc

SEQ ID NO: 8310863 - DNA, 22 bp, Homo sapiens
gctggaggtttcacctgagttt

SEQ ID NO: 8310864 - DNA, 19 bp, Homo sapiens
gctgctggctctggctgga

SEQ ID NO: 8310865 - DNA, 22 bp, Homo sapiens
gctgcctctgtagctttggacc

SEQ ID NO: 8310866 - DNA, 22 bp, Homo sapiens
gctgcctgaagtgtctacactg

SEQ ID NO: 8310867 - DNA, 22 bp, Homo sapiens
gctgcctgaagtgtctacactg

SEQ ID NO: 8310868 - DNA, 22 bp, Homo sapiens
gctggagcttgagaggacaggg

SEQ ID NO: 8310869 - DNA, 22 bp, Homo sapiens
gctggagcttgagaggacaggg

SEQ ID NO: 8310870 - DNA, 22 bp, Homo sapiens
gctgctggtcctcagagctcat

SEQ ID NO: 8310871 - DNA, 22 bp, Homo sapiens
gctcccaggatgaggagccagg

SEQ ID NO: 8310872 - DNA, 22 bp, Homo sapiens
gctccctccatgaggcagaccg

SEQ ID NO: 8310873 - DNA, 20 bp, Homo sapiens
gctcccagcctgcagtcccc

SEQ ID NO: 8310874 - DNA, 22 bp, Homo sapiens
gctcccagctggagcctcaaca

SEQ ID NO: 8310875 - DNA, 22 bp, Homo sapiens
gctcccaggaagagaagggcca

SEQ ID NO: 8310876 - DNA, 22 bp, Homo sapiens
gctcccagcattgcttcccagg

SEQ ID NO: 8310877 - DNA, 22 bp, Homo sapiens
gctcccagcattgctgctgaat

SEQ ID NO: 8310878 - DNA, 22 bp, Homo sapiens
gctccctctgctcaggcacttg

SEQ ID NO: 8310879 - DNA, 22 bp, Homo sapiens
gctccctctgctcaggcacttg

SEQ ID NO: 8310880 - DNA, 22 bp, Homo sapiens
gctctctcgtgaacaggtggtt

SEQ ID NO: 8310881 - DNA, 22 bp, Homo sapiens
gctctctccctaggcaagtgag

SEQ ID NO: 8310882 - DNA, 22 bp, Homo sapiens
gctctctgaggtgctggcagag

SEQ ID NO: 8310883 - DNA, 22 bp, Homo sapiens
gctctctgaggtgctggcagag

SEQ ID NO: 8310884 - DNA, 22 bp, Homo sapiens
gctctctgaggtgctggcagag

SEQ ID NO: 8310885 - DNA, 21 bp, Homo sapiens
gctctctgcatggtggctcag

SEQ ID NO: 8310886 - DNA, 22 bp, Homo sapiens
gctctgtgccacatgcagtgtt

SEQ ID NO: 8310887 - DNA, 22 bp, Homo sapiens
gctctgtgcagttcagggacac

SEQ ID NO: 8310888 - DNA, 19 bp, Homo sapiens
gctctgtgatgctgagggg

SEQ ID NO: 8310889 - DNA, 22 bp, Homo sapiens
gctctgtcttcagcacacagta

SEQ ID NO: 8310890 - DNA, 22 bp, Homo sapiens
gctctgtccagcgtgcacagaa

SEQ ID NO: 8310891 - DNA, 22 bp, Homo sapiens
gctctgtcattttgcagacact

SEQ ID NO: 8310892 - DNA, 22 bp, Homo sapiens
gctctgtcaacagctagctgtg

SEQ ID NO: 8310893 - DNA, 22 bp, Homo sapiens
gctctgggtagccactgcctgg

SEQ ID NO: 8310894 - DNA, 22 bp, Homo sapiens
gctctgtacgcaggatgagggg

SEQ ID NO: 8310895 - DNA, 22 bp, Homo sapiens
gctctcttgacagcttgctgtt

SEQ ID NO: 8310896 - DNA, 22 bp, Homo sapiens
gctctctgtcgttatgcttcat

SEQ ID NO: 8310897 - DNA, 22 bp, Homo sapiens
gctctctgttattaagatcttt

SEQ ID NO: 8310898 - DNA, 22 bp, Homo sapiens
gctctctgccatatgaggatac

SEQ ID NO: 8310899 - DNA, 22 bp, Homo sapiens
gctctctgcctttctcaatgac

SEQ ID NO: 8310900 - DNA, 22 bp, Homo sapiens
gctctctgcctttctcaatgac

SEQ ID NO: 8310901 - DNA, 22 bp, Homo sapiens
gctctctggaggccatggacag

SEQ ID NO: 8310902 - DNA, 22 bp, Homo sapiens
gctctctggaggccatggacag

SEQ ID NO: 8310903 - DNA, 22 bp, Homo sapiens
gctctctggttccagtcaggaa

SEQ ID NO: 8310904 - DNA, 22 bp, Homo sapiens
gctctctgggtgtgtctagata

SEQ ID NO: 8310905 - DNA, 22 bp, Homo sapiens
gctctctggaggccatggacag

SEQ ID NO: 8310906 - DNA, 22 bp, Homo sapiens
gctctctgggtggtgggcaaca

SEQ ID NO: 8310907 - DNA, 22 bp, Homo sapiens
gctcccagcaattgaggcagcc

SEQ ID NO: 8310908 - DNA, 22 bp, Homo sapiens
gctcccagatttcagccttgtg

SEQ ID NO: 8310909 - DNA, 22 bp, Homo sapiens
gctcccagatttcagccttgtg

SEQ ID NO: 8310910 - DNA, 22 bp, Homo sapiens
gctcccagactgaccagaggtg

SEQ ID NO: 8310911 - DNA, 20 bp, Homo sapiens
gcctggcacccggggctggc

SEQ ID NO: 8310912 - DNA, 20 bp, Homo sapiens
gcctggcacccggggctggc

SEQ ID NO: 8310913 - DNA, 22 bp, Homo sapiens
gcctggagttcagccaagtccc

SEQ ID NO: 8310914 - DNA, 22 bp, Homo sapiens
gcctggagtggtcctgctgccc

SEQ ID NO: 8310915 - DNA, 22 bp, Homo sapiens
gcctggagtggtcctgctgccc

SEQ ID NO: 8310916 - DNA, 22 bp, Homo sapiens
gcctggcactcactgaagaggc

SEQ ID NO: 8310917 - DNA, 22 bp, Homo sapiens
gcctggcaggcctcatgagggg

SEQ ID NO: 8310918 - DNA, 22 bp, Homo sapiens
gcctggcaggcctcatgagggg

SEQ ID NO: 8310919 - DNA, 22 bp, Homo sapiens
gctaggagattgagctctgaag

SEQ ID NO: 8310920 - DNA, 16 bp, Homo sapiens
gggctgggggattctg

SEQ ID NO: 8310921 - DNA, 22 bp, Homo sapiens
gggctggtgaggctgccctgca

SEQ ID NO: 8310922 - DNA, 22 bp, Homo sapiens
gggctggtctggcttagtcagg

SEQ ID NO: 8310923 - DNA, 18 bp, Homo sapiens
gggctgtgttcatgccca

SEQ ID NO: 8310924 - DNA, 22 bp, Homo sapiens
gggctctgggatgctcttagag

SEQ ID NO: 8310925 - DNA, 22 bp, Homo sapiens
gggctctgggattcagagcaag

SEQ ID NO: 8310926 - DNA, 22 bp, Homo sapiens
gggctctgggattcagagcaag

SEQ ID NO: 8310927 - DNA, 19 bp, Homo sapiens
gggctctggcctcagtggg

SEQ ID NO: 8310928 - DNA, 22 bp, Homo sapiens
gggcttctccctaaggactctg

SEQ ID NO: 8310929 - DNA, 22 bp, Homo sapiens
gggcttctcttatgctaactgg

SEQ ID NO: 8310930 - DNA, 19 bp, Homo sapiens
gggcttctgggatcaagag

SEQ ID NO: 8310931 - DNA, 22 bp, Homo sapiens
gggcttctctttagtgagctga

SEQ ID NO: 8310932 - DNA, 22 bp, Homo sapiens
gggcttctagaccagcagtgag

SEQ ID NO: 8310933 - DNA, 22 bp, Homo sapiens
ggggaggctgatgtgggcaaag

SEQ ID NO: 8310934 - DNA, 22 bp, Homo sapiens
ggggaggctgatgtgggcaaag

SEQ ID NO: 8310935 - DNA, 22 bp, Homo sapiens
ggggcattgtgtctgggttcct

SEQ ID NO: 8310936 - DNA, 22 bp, Homo sapiens
ggggagtgttttcatgggcttg

SEQ ID NO: 8310937 - DNA, 22 bp, Homo sapiens
ggggagtgacgcagggccatag

SEQ ID NO: 8310938 - DNA, 22 bp, Homo sapiens
ggggagtgacgcagggccatag

SEQ ID NO: 8310939 - DNA, 21 bp, Homo sapiens
gggtggggttccagccttttc

SEQ ID NO: 8310940 - DNA, 22 bp, Homo sapiens
gggtgcaggcagcccaggcagg

SEQ ID NO: 8310941 - DNA, 21 bp, Homo sapiens
gggtgctgtggtcatgcagga

SEQ ID NO: 8310942 - DNA, 22 bp, Homo sapiens
ggggcccagcacccctcctcgc

SEQ ID NO: 8310943 - DNA, 20 bp, Homo sapiens
ggggcccaagccctcttgcc

SEQ ID NO: 8310944 - DNA, 22 bp, Homo sapiens
ggggtgggagtgccatccttga

SEQ ID NO: 8310945 - DNA, 22 bp, Homo sapiens
ggggtggattcctacaggtcca

SEQ ID NO: 8310946 - DNA, 22 bp, Homo sapiens
ggtggagctgtggacaggaagg

SEQ ID NO: 8310947 - DNA, 22 bp, Homo sapiens
ggtggagctggaccaggagagg

SEQ ID NO: 8310948 - DNA, 22 bp, Homo sapiens
ggtgggcaggcgaggcccaggt

SEQ ID NO: 8310949 - DNA, 22 bp, Homo sapiens
ggtggggccctggcactggtat

SEQ ID NO: 8310950 - DNA, 22 bp, Homo sapiens
ggtgggcaggtcactctgcctc

SEQ ID NO: 8310951 - DNA, 22 bp, Homo sapiens
ggtgggcaggtcactctgcctc

SEQ ID NO: 8310952 - DNA, 22 bp, Homo sapiens
ggtgggtgagccctgggagctg

SEQ ID NO: 8310953 - DNA, 19 bp, Homo sapiens
ggtgggtgacctccccacc

SEQ ID NO: 8310954 - DNA, 22 bp, Homo sapiens
ggtggggcctgctccagcggcc

SEQ ID NO: 8310955 - DNA, 22 bp, Homo sapiens
gtaattgactcagctctgttca

SEQ ID NO: 8310956 - DNA, 22 bp, Homo sapiens
ggttggaggtgggaatagctag

SEQ ID NO: 8310957 - DNA, 22 bp, Homo sapiens
ggttggggcgagctggaggccc

SEQ ID NO: 8310958 - DNA, 22 bp, Homo sapiens
ggttcacatattgagagtattc

SEQ ID NO: 8310959 - DNA, 22 bp, Homo sapiens
ggttcacactttcatgatttca

SEQ ID NO: 8310960 - DNA, 22 bp, Homo sapiens
ggttcacactaagcttaagtgg

SEQ ID NO: 8310961 - DNA, 22 bp, Homo sapiens
ggtgggtttggaagagcaggct

SEQ ID NO: 8310962 - DNA, 22 bp, Homo sapiens
ggtggtggagccagctgggagt

SEQ ID NO: 8310963 - DNA, 22 bp, Homo sapiens
ggtccctgctgaagccttggtg

SEQ ID NO: 8310964 - DNA, 22 bp, Homo sapiens
ggtgaggcccagtgatctgtgt

SEQ ID NO: 8310965 - DNA, 22 bp, Homo sapiens
ggtgaggcaggtggctgctgag

SEQ ID NO: 8310966 - DNA, 22 bp, Homo sapiens
ggtgaggctaagtgacacaggg

SEQ ID NO: 8310967 - DNA, 18 bp, Homo sapiens
ggtgagggagctggaagc

SEQ ID NO: 8310968 - DNA, 22 bp, Homo sapiens
ggtccctgaagaggcctggggt

SEQ ID NO: 8310969 - DNA, 20 bp, Homo sapiens
ggtccctgccctctgtcatc

SEQ ID NO: 8310970 - DNA, 22 bp, Homo sapiens
ggtccccagcagtggctgcttc

SEQ ID NO: 8310971 - DNA, 23 bp, Homo sapiens
ggtcccagtggagaggcctcacc

SEQ ID NO: 8310972 - DNA, 22 bp, Homo sapiens
ggtcccagttgcccaggtcagg

SEQ ID NO: 8310973 - DNA, 22 bp, Homo sapiens
ggtcccaggctgcgggctggtg

SEQ ID NO: 8310974 - DNA, 22 bp, Homo sapiens
ggtcccaggttgacagggagac

SEQ ID NO: 8310975 - DNA, 22 bp, Homo sapiens
ggtcccagtcctctccctgcta

SEQ ID NO: 8310976 - DNA, 18 bp, Homo sapiens
gggtggtgtgctcttcgc

SEQ ID NO: 8310977 - DNA, 22 bp, Homo sapiens
gggtgtcctgtgccaagctggg

SEQ ID NO: 8310978 - DNA, 22 bp, Homo sapiens
gggttggggcccagcagtctgc

SEQ ID NO: 8310979 - DNA, 22 bp, Homo sapiens
ggtcccagctggtcactgtcag

SEQ ID NO: 8310980 - DNA, 22 bp, Homo sapiens
ggtcccagctggtcactgtcag

SEQ ID NO: 8310981 - DNA, 22 bp, Homo sapiens
ggtcccaggattggttgcgcag

SEQ ID NO: 8310982 - DNA, 22 bp, Homo sapiens
ggtcccaggctccctcttgtcc

SEQ ID NO: 8310983 - DNA, 22 bp, Homo sapiens
ggtcccaggagaataggtgcaa

SEQ ID NO: 8310984 - DNA, 22 bp, Homo sapiens
ggtcccaggaagtgcggcggcg

SEQ ID NO: 8310985 - DNA, 22 bp, Homo sapiens
ggtcccaggaatctgtgttcta

SEQ ID NO: 8310986 - DNA, 22 bp, Homo sapiens
ggtcccagctgctcaagaggct

SEQ ID NO: 8310987 - DNA, 22 bp, Homo sapiens
gtacaaagtggacctgatagta

SEQ ID NO: 8310988 - DNA, 22 bp, Homo sapiens
gtaggcagataggagtgcagcc

SEQ ID NO: 8310989 - DNA, 22 bp, Homo sapiens
gtagtcccagctaccccggagg

SEQ ID NO: 8310990 - DNA, 22 bp, Homo sapiens
gtcaaacaaattaacatatcca

SEQ ID NO: 8310991 - DNA, 22 bp, Homo sapiens
gtattttcaagagcagtagtat

SEQ ID NO: 8310992 - DNA, 22 bp, Homo sapiens
gtatacatagatgatgaacaag

SEQ ID NO: 8310993 - DNA, 22 bp, Homo sapiens
gtcctggcttagttcgctgtaa

SEQ ID NO: 8310994 - DNA, 22 bp, Homo sapiens
gtcctggcccactggcaggctg

SEQ ID NO: 8310995 - DNA, 22 bp, Homo sapiens
gtcctctgtagggctgggccac

SEQ ID NO: 8310996 - DNA, 22 bp, Homo sapiens
gtcctctggtgaaagcattccc

SEQ ID NO: 8310997 - DNA, 22 bp, Homo sapiens
gtcctctgggctttgagcagtc

SEQ ID NO: 8310998 - DNA, 22 bp, Homo sapiens
gtcctctggcctttcccaggac

SEQ ID NO: 8310999 - DNA, 22 bp, Homo sapiens
gtcctctgggcagctgccccac

SEQ ID NO: 8311000 - DNA, 22 bp, Homo sapiens
gtcctctgggagccttgagcct

SEQ ID NO: 8311001 - DNA, 22 bp, Homo sapiens
gtcctctggaagatgagttctt

SEQ ID NO: 8311002 - DNA, 22 bp, Homo sapiens
gtcctctgcttcatgccctgat

SEQ ID NO: 8311003 - DNA, 22 bp, Homo sapiens
gtcactggggccacatgcagaa

SEQ ID NO: 8311004 - DNA, 18 bp, Homo sapiens
gtcacctggatcagatta

SEQ ID NO: 8311005 - DNA, 22 bp, Homo sapiens
gtcagaggaatggatgagtgat

SEQ ID NO: 8311006 - DNA, 20 bp, Homo sapiens
gtcagaggaccctagagcga

SEQ ID NO: 8311007 - DNA, 22 bp, Homo sapiens
gtgccagcagttatggtgattt

SEQ ID NO: 8311008 - DNA, 22 bp, Homo sapiens
gtgcaggggatcaggttgcagc

SEQ ID NO: 8311009 - DNA, 22 bp, Homo sapiens
gtgcagggctggcaccggaggc

SEQ ID NO: 8311010 - DNA, 17 bp, Homo sapiens
gtgcagggatgaaggat

SEQ ID NO: 8311011 - DNA, 22 bp, Homo sapiens
gtgcagggagcccagaaggtcc

SEQ ID NO: 8311012 - DNA, 19 bp, Homo sapiens
gtgaggatactgctcagag

SEQ ID NO: 8311013 - DNA, 22 bp, Homo sapiens
gtgctgacaggagcctggcggt

SEQ ID NO: 8311014 - DNA, 22 bp, Homo sapiens
gtgcccaggcccaaggcaccac

SEQ ID NO: 8311015 - DNA, 22 bp, Homo sapiens
gtgctgcagagtctcgtgccgc

SEQ ID NO: 8311016 - DNA, 22 bp, Homo sapiens
gtgctgcctgccagcttctggg

SEQ ID NO: 8311017 - DNA, 22 bp, Homo sapiens
gtgctgctcacatctggaggta

SEQ ID NO: 8311018 - DNA, 22 bp, Homo sapiens
gtgccagggggcactgaacaga

SEQ ID NO: 8311019 - DNA, 22 bp, Homo sapiens
gtgccaggtgctaagctgtgct

SEQ ID NO: 8311020 - DNA, 22 bp, Homo sapiens
gtgccagctctccccacatctg

SEQ ID NO: 8311021 - DNA, 22 bp, Homo sapiens
gtcttgtttgggatgtggatgg

SEQ ID NO: 8311022 - DNA, 22 bp, Homo sapiens
gtctcccaacccctgtgcccag

SEQ ID NO: 8311023 - DNA, 22 bp, Homo sapiens
gtcttgatctcctgaccttgtg

SEQ ID NO: 8311024 - DNA, 22 bp, Homo sapiens
gtctttatttgagattgtcatt

SEQ ID NO: 8311025 - DNA, 21 bp, Homo sapiens
gtctttctacctctatgtggc

SEQ ID NO: 8311026 - DNA, 21 bp, Homo sapiens
gtctttttaattgcgatttcc

SEQ ID NO: 8311027 - DNA, 18 bp, Homo sapiens
gtcttttctcccttcctc

SEQ ID NO: 8311028 - DNA, 22 bp, Homo sapiens
gtctttttctacgatagcgcct

SEQ ID NO: 8311029 - DNA, 22 bp, Homo sapiens
gtctttttattatagagtggag

SEQ ID NO: 8311030 - DNA, 22 bp, Homo sapiens
gtcttttttacaccttacatca

SEQ ID NO: 8311031 - DNA, 22 bp, Homo sapiens
gtctttttgtctggcagaggtc

SEQ ID NO: 8311032 - DNA, 22 bp, Homo sapiens
ggcactgacactagcatggcac

SEQ ID NO: 8311033 - DNA, 22 bp, Homo sapiens
ggcactgaatttcttggcatct

SEQ ID NO: 8311034 - DNA, 22 bp, Homo sapiens
ggcactgactgtgcagcgcacc

SEQ ID NO: 8311035 - DNA, 22 bp, Homo sapiens
ggcactgacactagcatggcac

SEQ ID NO: 8311036 - DNA, 22 bp, Homo sapiens
ggcactgagctgccttggggca

SEQ ID NO: 8311037 - DNA, 22 bp, Homo sapiens
ggcactgagcgggctctgagcg

SEQ ID NO: 8311038 - DNA, 21 bp, Homo sapiens
ggcactgagccagatggactc

SEQ ID NO: 8311039 - DNA, 22 bp, Homo sapiens
ggcactgagaggctcttcctaa

SEQ ID NO: 8311040 - DNA, 22 bp, Homo sapiens
ggcactgagaacaggctgactt

SEQ ID NO: 8311041 - DNA, 22 bp, Homo sapiens
ggcactgaagtgggtgttgggt

SEQ ID NO: 8311042 - DNA, 23 bp, Homo sapiens
ggcactgaagctacaatggtgag

SEQ ID NO: 8311043 - DNA, 22 bp, Homo sapiens
ggcactgaatttcttggcatct

SEQ ID NO: 8311044 - DNA, 23 bp, Homo sapiens
ggcactgaagctacaatggtgag

SEQ ID NO: 8311045 - DNA, 22 bp, Homo sapiens
ggcactcagagattcaggctgt

SEQ ID NO: 8311046 - DNA, 22 bp, Homo sapiens
ggcactgaaccaggacacaagc

SEQ ID NO: 8311047 - DNA, 22 bp, Homo sapiens
ggcactgattccattcatgaag

SEQ ID NO: 8311048 - DNA, 22 bp, Homo sapiens
ggcactgataatgtcctctctc

SEQ ID NO: 8311049 - DNA, 22 bp, Homo sapiens
ggcactgatctgatttccctcc

SEQ ID NO: 8311050 - DNA, 22 bp, Homo sapiens
ggcagatggagaagcagcaggt

SEQ ID NO: 8311051 - DNA, 22 bp, Homo sapiens
ggcagcagaactggccctgtat

SEQ ID NO: 8311052 - DNA, 22 bp, Homo sapiens
ggcagcagaactggccctgtat

SEQ ID NO: 8311053 - DNA, 22 bp, Homo sapiens
ggcagcactgcagcttgttggg

SEQ ID NO: 8311054 - DNA, 22 bp, Homo sapiens
ggaggatgagctacgaggagct

SEQ ID NO: 8311055 - DNA, 22 bp, Homo sapiens
ggaggatgagctacgaggagct

SEQ ID NO: 8311056 - DNA, 22 bp, Homo sapiens
ggaggatgccaagctgtgcaca

SEQ ID NO: 8311057 - DNA, 22 bp, Homo sapiens
ggcacctggatgtagcagtgaa

SEQ ID NO: 8311058 - DNA, 22 bp, Homo sapiens
ggcacctggaggtttactggat

SEQ ID NO: 8311059 - DNA, 22 bp, Homo sapiens
ggcacctgctcatctggactca

SEQ ID NO: 8311060 - DNA, 22 bp, Homo sapiens
ggcagtggaggaccctgtgtct

SEQ ID NO: 8311061 - DNA, 22 bp, Homo sapiens
ggcagtgactgttcagacgtcc

SEQ ID NO: 8311062 - DNA, 22 bp, Homo sapiens
ggcagggaaacagctgatccca

SEQ ID NO: 8311063 - DNA, 22 bp, Homo sapiens
ggcagggaaacagctgatccca

SEQ ID NO: 8311064 - DNA, 22 bp, Homo sapiens
ggcagggagagcatgctgataa

SEQ ID NO: 8311065 - DNA, 22 bp, Homo sapiens
ggcagggcttgtctctgtgatg

SEQ ID NO: 8311066 - DNA, 22 bp, Homo sapiens
ggcaggggtcctggtgttgact

SEQ ID NO: 8311067 - DNA, 22 bp, Homo sapiens
ggcagggagagcatgctgataa

SEQ ID NO: 8311068 - DNA, 22 bp, Homo sapiens
ggcagccatgtcccagggcttc

SEQ ID NO: 8311069 - DNA, 21 bp, Homo sapiens
ggcagcccgccctctcctggc

SEQ ID NO: 8311070 - DNA, 22 bp, Homo sapiens
ggcagcctccagggcactggtg

SEQ ID NO: 8311071 - DNA, 21 bp, Homo sapiens
ggcagcctgacccccagagag

SEQ ID NO: 8311072 - DNA, 22 bp, Homo sapiens
ggcagctcactgattagcaatt

SEQ ID NO: 8311073 - DNA, 20 bp, Homo sapiens
ggcagctcactactttctgt

SEQ ID NO: 8311074 - DNA, 22 bp, Homo sapiens
ggcagctccaaaaggaaacact

SEQ ID NO: 8311075 - DNA, 22 bp, Homo sapiens
ggcagctcctcctagtctgccc

SEQ ID NO: 8311076 - DNA, 22 bp, Homo sapiens
ggcagctcctcaaaaaattaaa

SEQ ID NO: 8311077 - DNA, 22 bp, Homo sapiens
ggcagctcctctcagcaaaaga

SEQ ID NO: 8311078 - DNA, 22 bp, Homo sapiens
ggcagctcacctctggtccagg

SEQ ID NO: 8311079 - DNA, 22 bp, Homo sapiens
ggcagtggctcctctctactcc

SEQ ID NO: 8311080 - DNA, 22 bp, Homo sapiens
ggcagtgggtggatctcaggga

SEQ ID NO: 8311081 - DNA, 22 bp, Homo sapiens
ggcccagctgtgcttccagccc

SEQ ID NO: 8311082 - DNA, 22 bp, Homo sapiens
ggcccatctcttgctctgggtt

SEQ ID NO: 8311083 - DNA, 19 bp, Homo sapiens
ggctctcttaaagctgttt

SEQ ID NO: 8311084 - DNA, 22 bp, Homo sapiens
ggctcagaaactaaaggcgctg

SEQ ID NO: 8311085 - DNA, 22 bp, Homo sapiens
ggctctgcccaggtggacagca

SEQ ID NO: 8311086 - DNA, 22 bp, Homo sapiens
ggctctgcccagatgaagagga

SEQ ID NO: 8311087 - DNA, 22 bp, Homo sapiens
ggctctgcctgcccagcagcac

SEQ ID NO: 8311088 - DNA, 22 bp, Homo sapiens
ggctctgcagtgacttgagggg

SEQ ID NO: 8311089 - DNA, 22 bp, Homo sapiens
ggctctgcatgtgagtgggtgg

SEQ ID NO: 8311090 - DNA, 22 bp, Homo sapiens
ggcctctgcaactggctgtggc

SEQ ID NO: 8311091 - DNA, 22 bp, Homo sapiens
ggcctctgccccagccacacct

SEQ ID NO: 8311092 - DNA, 22 bp, Homo sapiens
ggcctctgccctcactcctgtc

SEQ ID NO: 8311093 - DNA, 21 bp, Homo sapiens
ggcctctgccttgccccactc

SEQ ID NO: 8311094 - DNA, 22 bp, Homo sapiens
ggcctctgcctcatctgggcac

SEQ ID NO: 8311095 - DNA, 22 bp, Homo sapiens
ggcctctgcctcatctgggcac

SEQ ID NO: 8311096 - DNA, 22 bp, Homo sapiens
ggcctctctggcatggctgccc

SEQ ID NO: 8311097 - DNA, 22 bp, Homo sapiens
ggcctctgaggacagccttggc

SEQ ID NO: 8311098 - DNA, 22 bp, Homo sapiens
ggctcacgcaattatcccggcc

SEQ ID NO: 8311099 - DNA, 22 bp, Homo sapiens
ggctcactgcaacttccgcctc

SEQ ID NO: 8311100 - DNA, 22 bp, Homo sapiens
ggcctctggggtcctgagccca

SEQ ID NO: 8311101 - DNA, 22 bp, Homo sapiens
ggcctctggtcaagacaagcat

SEQ ID NO: 8311102 - DNA, 22 bp, Homo sapiens
ggcctctggcaggcaggccctc

SEQ ID NO: 8311103 - DNA, 22 bp, Homo sapiens
ggcctctggcaggcaggccctc

SEQ ID NO: 8311104 - DNA, 22 bp, Homo sapiens
gggctccaacggtgagcatgga

SEQ ID NO: 8311105 - DNA, 22 bp, Homo sapiens
gggctctggaaggtgcaccatg

SEQ ID NO: 8311106 - DNA, 22 bp, Homo sapiens
gggctctggatggagcctgcag

SEQ ID NO: 8311107 - DNA, 22 bp, Homo sapiens
gggctcagccccattgaaccag

SEQ ID NO: 8311108 - DNA, 22 bp, Homo sapiens
gggccctggggcctgatttgca

SEQ ID NO: 8311109 - DNA, 22 bp, Homo sapiens
gggccccttgtatctctggctc

SEQ ID NO: 8311110 - DNA, 22 bp, Homo sapiens
gggccccaaaatgccaggctct

SEQ ID NO: 8311111 - DNA, 22 bp, Homo sapiens
gggcactgtacactgtgcatgg

SEQ ID NO: 8311112 - DNA, 18 bp, Homo sapiens
gggatcaggctgcctagg

SEQ ID NO: 8311113 - DNA, 22 bp, Homo sapiens
gggcagagactcagaaacagaa

SEQ ID NO: 8311114 - DNA, 22 bp, Homo sapiens
gggcagagagctggaactcctt

SEQ ID NO: 8311115 - DNA, 22 bp, Homo sapiens
gggcagagagctggaactcctt

SEQ ID NO: 8311116 - DNA, 20 bp, Homo sapiens
gggcagagccagccagtccc

SEQ ID NO: 8311117 - DNA, 22 bp, Homo sapiens
gggcagaggctctggcccatcc

SEQ ID NO: 8311118 - DNA, 21 bp, Homo sapiens
gggcagaggggcctcctgggt

SEQ ID NO: 8311119 - DNA, 17 bp, Homo sapiens
gggcagggactcctggg

SEQ ID NO: 8311120 - DNA, 22 bp, Homo sapiens
gggagccttgggagtgccagcc

SEQ ID NO: 8311121 - DNA, 22 bp, Homo sapiens
gggagtggattatgtggaccca

SEQ ID NO: 8311122 - DNA, 22 bp, Homo sapiens
gggagtggagagcaatggatga

SEQ ID NO: 8311123 - DNA, 22 bp, Homo sapiens
gggatcagcaagccactgcacc

SEQ ID NO: 8311124 - DNA, 22 bp, Homo sapiens
gggatcagaaacatagccctga

SEQ ID NO: 8311125 - DNA, 23 bp, Homo sapiens
gggatatggaccttggaggagtc

SEQ ID NO: 8311126 - DNA, 22 bp, Homo sapiens
gggagtgttgagcgccctgcca

SEQ ID NO: 8311127 - DNA, 20 bp, Homo sapiens
gggagtggtggtagcctgtg

SEQ ID NO: 8311128 - DNA, 22 bp, Homo sapiens
gggagtgggtttggcctaggcc

SEQ ID NO: 8311129 - DNA, 22 bp, Homo sapiens
gggaaggcagtgtctggttgaa

SEQ ID NO: 8311130 - DNA, 23 bp, Homo sapiens
gggagccaggacctcgcgcccca

SEQ ID NO: 8311131 - DNA, 22 bp, Homo sapiens
gggagccatgctggtcttcttt

SEQ ID NO: 8311132 - DNA, 23 bp, Homo sapiens
gggagccatgggtggtcatggag

SEQ ID NO: 8311133 - DNA, 18 bp, Homo sapiens
ggctgtgcgtggaggctg

SEQ ID NO: 8311134 - DNA, 22 bp, Homo sapiens
ggctgcctgcctccaagccggg

SEQ ID NO: 8311135 - DNA, 22 bp, Homo sapiens
ggctgcctgctcaggtgcggcg

SEQ ID NO: 8311136 - DNA, 22 bp, Homo sapiens
ggctgcctgaggctgaggcccg

SEQ ID NO: 8311137 - DNA, 22 bp, Homo sapiens
ggctgcctgaggctgaggcccg

SEQ ID NO: 8311138 - DNA, 22 bp, Homo sapiens
ggctgcctctggaagctggaga

SEQ ID NO: 8311139 - DNA, 22 bp, Homo sapiens
ggctgcctctgatgtgcagacg

SEQ ID NO: 8311140 - DNA, 22 bp, Homo sapiens
ggctgcctctgatgtgcagacg

SEQ ID NO: 8311141 - DNA, 22 bp, Homo sapiens
ggctgcctgaggcagtgagaga

SEQ ID NO: 8311142 - DNA, 22 bp, Homo sapiens
ggctgcctgaactttggggaaa

SEQ ID NO: 8311143 - DNA, 22 bp, Homo sapiens
ggctgcctgaggcagtgagaga

SEQ ID NO: 8311144 - DNA, 22 bp, Homo sapiens
ggctggagatatgtctggaaca

SEQ ID NO: 8311145 - DNA, 22 bp, Homo sapiens
ggctgcctgctcctcctgcacg

SEQ ID NO: 8311146 - DNA, 22 bp, Homo sapiens
ggctgcctggacctcctctttc

SEQ ID NO: 8311147 - DNA, 22 bp, Homo sapiens
ggctggcatccagggaaatcca

SEQ ID NO: 8311148 - DNA, 22 bp, Homo sapiens
ggctggagtgggctccagagtt

SEQ ID NO: 8311149 - DNA, 22 bp, Homo sapiens
ggctgcaggttggttggcagct

SEQ ID NO: 8311150 - DNA, 22 bp, Homo sapiens
ggctgcagggcagctggtgtgg

SEQ ID NO: 8311151 - DNA, 22 bp, Homo sapiens
ggctgcaggttggttggcagct

SEQ ID NO: 8311152 - DNA, 22 bp, Homo sapiens
ggctgcaggttggttggcagct

SEQ ID NO: 8311153 - DNA, 22 bp, Homo sapiens
ggctgcaggcagggtatccact

SEQ ID NO: 8311154 - DNA, 22 bp, Homo sapiens
ggctctgcgcggtaaagtgact

SEQ ID NO: 8311155 - DNA, 22 bp, Homo sapiens
ggctgccaggagggaggccagt

SEQ ID NO: 8311156 - DNA, 22 bp, Homo sapiens
ggctgccagtgagtgcagaccg

SEQ ID NO: 8311157 - DNA, 22 bp, Homo sapiens
ggctgcctcctcgagacaggat

SEQ ID NO: 8311158 - DNA, 22 bp, Homo sapiens
ggctgcctcctgctgggctgga

SEQ ID NO: 8311159 - DNA, 20 bp, Homo sapiens
ggctgcctccttcctttcct

SEQ ID NO: 8311160 - DNA, 22 bp, Homo sapiens
ggctgccaggagaagctcagtg

SEQ ID NO: 8311161 - DNA, 22 bp, Homo sapiens
ggctgccacgtcgagggtccaa

SEQ ID NO: 8311162 - DNA, 22 bp, Homo sapiens
ggctgcagtttgtcttttgctt

SEQ ID NO: 8311163 - DNA, 22 bp, Homo sapiens
ggctgcagtttgtcttttgctt

SEQ ID NO: 8311164 - DNA, 22 bp, Homo sapiens
ttatacatgtgttttgagatga

SEQ ID NO: 8311165 - DNA, 22 bp, Homo sapiens
ttagctgcattatcaaagttat

SEQ ID NO: 8311166 - DNA, 22 bp, Homo sapiens
ttagctaaactgtaactagaat

SEQ ID NO: 8311167 - DNA, 22 bp, Homo sapiens
ttagctcagaaaatttaaactt

SEQ ID NO: 8311168 - DNA, 22 bp, Homo sapiens
tcctgctgagcgtctgtcattt

SEQ ID NO: 8311169 - DNA, 22 bp, Homo sapiens
tcctgccttagagcaaggaaaa

SEQ ID NO: 8311170 - DNA, 19 bp, Homo sapiens
tcctgcctggggccgcctg

SEQ ID NO: 8311171 - DNA, 19 bp, Homo sapiens
tcctgcctggggccgcctg

SEQ ID NO: 8311172 - DNA, 18 bp, Homo sapiens
tcctgcctgcgggctccc

SEQ ID NO: 8311173 - DNA, 18 bp, Homo sapiens
tcctgcctgcgggctccc

SEQ ID NO: 8311174 - DNA, 22 bp, Homo sapiens
tcctgcctgtttacctgtactt

SEQ ID NO: 8311175 - DNA, 22 bp, Homo sapiens
tcctgcctgtttacctgtactt

SEQ ID NO: 8311176 - DNA, 18 bp, Homo sapiens
tcctgcctgtgccccagg

SEQ ID NO: 8311177 - DNA, 18 bp, Homo sapiens
tcctgcctgtgccccagg

SEQ ID NO: 8311178 - DNA, 22 bp, Homo sapiens
ttattaatgagtacaagttatt

SEQ ID NO: 8311179 - DNA, 22 bp, Homo sapiens
ttattataatgagggataaaaa

SEQ ID NO: 8311180 - DNA, 22 bp, Homo sapiens
ttcagtgtgtgatacctgctgt

SEQ ID NO: 8311181 - DNA, 22 bp, Homo sapiens
ttccaggaattcagctctcagt

SEQ ID NO: 8311182 - DNA, 22 bp, Homo sapiens
ttccagttaaggaagctattct

SEQ ID NO: 8311183 - DNA, 22 bp, Homo sapiens
ttccagttcccatgaggattaa

SEQ ID NO: 8311184 - DNA, 22 bp, Homo sapiens
ttccagggctaattcctgtgga

SEQ ID NO: 8311185 - DNA, 22 bp, Homo sapiens
ttccaggggcagcagtgatggt

SEQ ID NO: 8311186 - DNA, 18 bp, Homo sapiens
ttcagcagcagacacact

SEQ ID NO: 8311187 - DNA, 22 bp, Homo sapiens
ttcacagggcagcagctgagcc

SEQ ID NO: 8311188 - DNA, 22 bp, Homo sapiens
ttcacagggccactggcaggag

SEQ ID NO: 8311189 - DNA, 22 bp, Homo sapiens
ttcacaggtgactggggataac

SEQ ID NO: 8311190 - DNA, 22 bp, Homo sapiens
ttcacaggcttggaggtggggg

SEQ ID NO: 8311191 - DNA, 22 bp, Homo sapiens
ttcacaggagggtggatgcatg

SEQ ID NO: 8311192 - DNA, 22 bp, Homo sapiens
ttcacaggatatatgtgcaggg

SEQ ID NO: 8311193 - DNA, 22 bp, Homo sapiens
ttcagagcatctctaaagccag

SEQ ID NO: 8311194 - DNA, 22 bp, Homo sapiens
ttcagagccacttcaagtctaa

SEQ ID NO: 8311195 - DNA, 22 bp, Homo sapiens
ttcagagatgacacctggtgtt

SEQ ID NO: 8311196 - DNA, 18 bp, Homo sapiens
ttcacaggaaatgtcttt

SEQ ID NO: 8311197 - DNA, 22 bp, Homo sapiens
ttcacaggaatgtaggggtctt

SEQ ID NO: 8311198 - DNA, 21 bp, Homo sapiens
ttcaaagagtgggcattgtca

SEQ ID NO: 8311199 - DNA, 22 bp, Homo sapiens
ttctctggaactgaaacaagat

SEQ ID NO: 8311200 - DNA, 22 bp, Homo sapiens
ttctctgctataggcagggagg

SEQ ID NO: 8311201 - DNA, 22 bp, Homo sapiens
ttctctgctctcacatacagaa

SEQ ID NO: 8311202 - DNA, 22 bp, Homo sapiens
ttctctgctacatactagggct

SEQ ID NO: 8311203 - DNA, 22 bp, Homo sapiens
ttctctgcctcacaggtctaag

SEQ ID NO: 8311204 - DNA, 22 bp, Homo sapiens
ttctctgcctctagctatattc

SEQ ID NO: 8311205 - DNA, 22 bp, Homo sapiens
ttctctgcagctcctggctggg

SEQ ID NO: 8311206 - DNA, 22 bp, Homo sapiens
ttctctgcattgtaaagagcca

SEQ ID NO: 8311207 - DNA, 22 bp, Homo sapiens
ttctctgcagcttaggcccagt

SEQ ID NO: 8311208 - DNA, 22 bp, Homo sapiens
ttctctctgtgtcattatggac

SEQ ID NO: 8311209 - DNA, 22 bp, Homo sapiens
ttctctctgtggtcccattttg

SEQ ID NO: 8311210 - DNA, 22 bp, Homo sapiens
ttctctctggacctgggatgcg

SEQ ID NO: 8311211 - DNA, 22 bp, Homo sapiens
ttctctcttactgccatgctgt

SEQ ID NO: 8311212 - DNA, 22 bp, Homo sapiens
ttctctctgttatggattttac

SEQ ID NO: 8311213 - DNA, 22 bp, Homo sapiens
ttctctcttccagttcccactt

SEQ ID NO: 8311214 - DNA, 22 bp, Homo sapiens
ttctctcttttgggtaggaggt

SEQ ID NO: 8311215 - DNA, 22 bp, Homo sapiens
ttctctctgagagcatctggaa

SEQ ID NO: 8311216 - DNA, 22 bp, Homo sapiens
ttctctcattcaaattaaagtg

SEQ ID NO: 8311217 - DNA, 21 bp, Homo sapiens
ttctctccatatgcccagccc

SEQ ID NO: 8311218 - DNA, 22 bp, Homo sapiens
ttctctaggttttagatgaaga

SEQ ID NO: 8311219 - DNA, 22 bp, Homo sapiens
ttctccacccactcttttgttg

SEQ ID NO: 8311220 - DNA, 17 bp, Homo sapiens
ttccagtttagtattgt

SEQ ID NO: 8311221 - DNA, 22 bp, Homo sapiens
ttccagttggtagaatgtaagg

SEQ ID NO: 8311222 - DNA, 22 bp, Homo sapiens
ttcctgatgcacacagtcattt

SEQ ID NO: 8311223 - DNA, 22 bp, Homo sapiens
ttcctgagggacttttgagatt

SEQ ID NO: 8311224 - DNA, 22 bp, Homo sapiens
ttcctgcttcctggcctcacaa

SEQ ID NO: 8311225 - DNA, 17 bp, Homo sapiens
ttcctggaagtcattcc

SEQ ID NO: 8311226 - DNA, 20 bp, Homo sapiens
ttcctgtatacaaagagttc

SEQ ID NO: 8311227 - DNA, 22 bp, Homo sapiens
ttcctgtagttgtgcaatgtac

SEQ ID NO: 8311228 - DNA, 22 bp, Homo sapiens
ttcctggtggtggtgacagcac

SEQ ID NO: 8311229 - DNA, 19 bp, Homo sapiens
ttctctgctacattctcag

SEQ ID NO: 8311230 - DNA, 22 bp, Homo sapiens
ttctggagagaaaccttacaaa

SEQ ID NO: 8311231 - DNA, 22 bp, Homo sapiens
ttctggagatctgcctatggga

SEQ ID NO: 8311232 - DNA, 22 bp, Homo sapiens
ttctggagctaaagtccactct

SEQ ID NO: 8311233 - DNA, 22 bp, Homo sapiens
ttcttactagtatgtttcagca

SEQ ID NO: 8311234 - DNA, 22 bp, Homo sapiens
ttctgtgtgggtagctcctgtt

SEQ ID NO: 8311235 - DNA, 22 bp, Homo sapiens
ttcttcaattattggaaagaaa

SEQ ID NO: 8311236 - DNA, 22 bp, Homo sapiens
ttcttcaaaatccagcatgatt

SEQ ID NO: 8311237 - DNA, 22 bp, Homo sapiens
ttgaacattaacttcagtctat

SEQ ID NO: 8311238 - DNA, 22 bp, Homo sapiens
ttgaacagttttgtcaggttca

SEQ ID NO: 8311239 - DNA, 22 bp, Homo sapiens
ttgaacagctgttacattgtta

SEQ ID NO: 8311240 - DNA, 22 bp, Homo sapiens
ttgaattcatttctcattgagt

SEQ ID NO: 8311241 - DNA, 22 bp, Homo sapiens
ttctttttaaagtgtgtatgca

SEQ ID NO: 8311242 - DNA, 22 bp, Homo sapiens
ttgaaaggaatacagaggccta

SEQ ID NO: 8311243 - DNA, 22 bp, Homo sapiens
ttgaaagggatatatctttctg

SEQ ID NO: 8311244 - DNA, 22 bp, Homo sapiens
ttgaaaggcacaggcacctggg

SEQ ID NO: 8311245 - DNA, 22 bp, Homo sapiens
ttgaaaggcctgtttatccagc

SEQ ID NO: 8311246 - DNA, 22 bp, Homo sapiens
tttagagttgagtattcattgg

SEQ ID NO: 8311247 - DNA, 22 bp, Homo sapiens
tttaccaagctttaattacata

SEQ ID NO: 8311248 - DNA, 22 bp, Homo sapiens
tttaagatggtattttataaag

SEQ ID NO: 8311249 - DNA, 22 bp, Homo sapiens
tttaaataggactcctgggggt

SEQ ID NO: 8311250 - DNA, 22 bp, Homo sapiens
ttgtgtggtagcttcattgaac

SEQ ID NO: 8311251 - DNA, 22 bp, Homo sapiens
tttattcttgagagtgagaaga

SEQ ID NO: 8311252 - DNA, 22 bp, Homo sapiens
tttcaaaggtggaagagtgaat

SEQ ID NO: 8311253 - DNA, 22 bp, Homo sapiens
tttcacaatgcaatcctacttc

SEQ ID NO: 8311254 - DNA, 22 bp, Homo sapiens
tttcatgtgcaattagcaatat

SEQ ID NO: 8311255 - DNA, 22 bp, Homo sapiens
tttcacattttatacttaagcc

SEQ ID NO: 8311256 - DNA, 22 bp, Homo sapiens
ttgcatgtgtaatttttctaaa

SEQ ID NO: 8311257 - DNA, 22 bp, Homo sapiens
ttgcatgttatttaatctgtat

SEQ ID NO: 8311258 - DNA, 22 bp, Homo sapiens
ttgcattgcttggtcttcaaga

SEQ ID NO: 8311259 - DNA, 22 bp, Homo sapiens
ttgcattgatgttccttcttgc

SEQ ID NO: 8311260 - DNA, 22 bp, Homo sapiens
ttgcattgatgtctatacgctg

SEQ ID NO: 8311261 - DNA, 22 bp, Homo sapiens
ttgcattgatcccagcttgggc

SEQ ID NO: 8311262 - DNA, 22 bp, Homo sapiens
ttgcattgaatgcacattttta

SEQ ID NO: 8311263 - DNA, 22 bp, Homo sapiens
ttgcattgaaaatatattttaa

SEQ ID NO: 8311264 - DNA, 22 bp, Homo sapiens
ttgcattgtgattacagaggtg

SEQ ID NO: 8311265 - DNA, 22 bp, Homo sapiens
ttgcattgttgcaatgaagtat

SEQ ID NO: 8311266 - DNA, 22 bp, Homo sapiens
ttgcattgggagtgaggagacc

SEQ ID NO: 8311267 - DNA, 20 bp, Homo sapiens
ttgcattggatgtgcaggtg

SEQ ID NO: 8311268 - DNA, 22 bp, Homo sapiens
ttgcattgtaggatgttagaag

SEQ ID NO: 8311269 - DNA, 19 bp, Homo sapiens
ttgcattgtagttggactg

SEQ ID NO: 8311270 - DNA, 22 bp, Homo sapiens
ttgctctgtaataatctggggt

SEQ ID NO: 8311271 - DNA, 22 bp, Homo sapiens
ttgctctgactggagtgcagtg

SEQ ID NO: 8311272 - DNA, 22 bp, Homo sapiens
ttgcagggacctgcagaaagct

SEQ ID NO: 8311273 - DNA, 20 bp, Homo sapiens
ttgcagcagtgaggtgaagg

SEQ ID NO: 8311274 - DNA, 22 bp, Homo sapiens
ttgcagcagggtgaattcactc

SEQ ID NO: 8311275 - DNA, 23 bp, Homo sapiens
ttgcatgtagcccatgagtaact

SEQ ID NO: 8311276 - DNA, 22 bp, Homo sapiens
ttgcaggggaaggagcagagct

SEQ ID NO: 8311277 - DNA, 22 bp, Homo sapiens
ttgcagggcaggaccatggaca

SEQ ID NO: 8311278 - DNA, 22 bp, Homo sapiens
ttgacaattgggagatataaag

SEQ ID NO: 8311279 - DNA, 22 bp, Homo sapiens
ttgacaatgtcctttgaatttc

SEQ ID NO: 8311280 - DNA, 22 bp, Homo sapiens
ttgacaagaatcgttgccttgg

SEQ ID NO: 8311281 - DNA, 22 bp, Homo sapiens
ttgcagagatcagcaggtttga

SEQ ID NO: 8311282 - DNA, 22 bp, Homo sapiens
ttgacagctattttgctttgat

SEQ ID NO: 8311283 - DNA, 22 bp, Homo sapiens
ttgacagcaaagattgtgccta

SEQ ID NO: 8311284 - DNA, 22 bp, Homo sapiens
ttgtggctcgtgagatgttagg

SEQ ID NO: 8311285 - DNA, 22 bp, Homo sapiens
ttgtgtccccctttgagagcca

SEQ ID NO: 8311286 - DNA, 22 bp, Homo sapiens
ttgtgtctgggggagtgacatc

SEQ ID NO: 8311287 - DNA, 22 bp, Homo sapiens
ttgtgtcctgatttgacacaat

SEQ ID NO: 8311288 - DNA, 22 bp, Homo sapiens
ttgtcccaggacttgcatagat

SEQ ID NO: 8311289 - DNA, 22 bp, Homo sapiens
ttgtaacagctgcttaatagag

SEQ ID NO: 8311290 - DNA, 22 bp, Homo sapiens
ttgtaacagctgtttatatagt

SEQ ID NO: 8311291 - DNA, 22 bp, Homo sapiens
ttgtaacacttttctattaata

SEQ ID NO: 8311292 - DNA, 22 bp, Homo sapiens
ttgtaacaatctgtcataaatg

SEQ ID NO: 8311293 - DNA, 22 bp, Homo sapiens
ttgtaacaggtactaaataact

SEQ ID NO: 8311294 - DNA, 22 bp, Homo sapiens
ttgtaacaggcactctgtgcca

SEQ ID NO: 8311295 - DNA, 22 bp, Homo sapiens
ttggagccctgaggatctggat

SEQ ID NO: 8311296 - DNA, 22 bp, Homo sapiens
ttggcagggccaggctctctct

SEQ ID NO: 8311297 - DNA, 22 bp, Homo sapiens
ttgggaaggcgtggaagcagaa

SEQ ID NO: 8311298 - DNA, 17 bp, Homo sapiens
ttgggagagaaaggtat

SEQ ID NO: 8311299 - DNA, 22 bp, Homo sapiens
tttgtaaaaggaggaagcatgg

SEQ ID NO: 8311300 - DNA, 22 bp, Homo sapiens
tttgtaaagtctgttctgagtt

SEQ ID NO: 8311301 - DNA, 22 bp, Homo sapiens
tttgtaaatagcagtactcatg

SEQ ID NO: 8311302 - DNA, 22 bp, Homo sapiens
ttttaatcatgcttctatgtcc

SEQ ID NO: 8311303 - DNA, 22 bp, Homo sapiens
ttttattggagtgataccaagc

SEQ ID NO: 8311304 - DNA, 22 bp, Homo sapiens
ttttcattgtaaatcaggaaac

SEQ ID NO: 8311305 - DNA, 22 bp, Homo sapiens
ttttcacacaaggtgataagtt

SEQ ID NO: 8311306 - DNA, 22 bp, Homo sapiens
ttttcatttacattagggaaga

SEQ ID NO: 8311307 - DNA, 22 bp, Homo sapiens
ttttcatttttgtagatgcaag

SEQ ID NO: 8311308 - DNA, 22 bp, Homo sapiens
ttttccaaattagaagtagaga

SEQ ID NO: 8311309 - DNA, 22 bp, Homo sapiens
ttttcttatggtgaagcacaaa

SEQ ID NO: 8311310 - DNA, 22 bp, Homo sapiens
ttttcttactgtctgtgatcct

SEQ ID NO: 8311311 - DNA, 22 bp, Homo sapiens
tttgagttgcttatttaatagg

SEQ ID NO: 8311312 - DNA, 22 bp, Homo sapiens
tttggaaagttgtcactttaga

SEQ ID NO: 8311313 - DNA, 22 bp, Homo sapiens
tttggaaagtgtacaaatttga

SEQ ID NO: 8311314 - DNA, 22 bp, Homo sapiens
tttgacagatccttaactcagc

SEQ ID NO: 8311315 - DNA, 22 bp, Homo sapiens
tttgacagacatttactacatt

SEQ ID NO: 8311316 - DNA, 22 bp, Homo sapiens
tttcttttgaatagtgtgtggt

SEQ ID NO: 8311317 - DNA, 22 bp, Homo sapiens
tttcttttgccctgtgggttag

SEQ ID NO: 8311318 - DNA, 21 bp, Homo sapiens
tttctttctggctctcacagt

SEQ ID NO: 8311319 - DNA, 22 bp, Homo sapiens
tttcctctccaccaggaggtct

SEQ ID NO: 8311320 - DNA, 22 bp, Homo sapiens
tttcctctccggggcctccagg

SEQ ID NO: 8311321 - DNA, 22 bp, Homo sapiens
tttcctctgactgctcccctgc

SEQ ID NO: 8311322 - DNA, 22 bp, Homo sapiens
tttcctctgatgctgacttgga

SEQ ID NO: 8311323 - DNA, 22 bp, Homo sapiens
tttcctctgagtgagctgggag

SEQ ID NO: 8311324 - DNA, 22 bp, Homo sapiens
tttcctctaaacgcatttgctt

SEQ ID NO: 8311325 - DNA, 22 bp, Homo sapiens
tttcccctcagtactaaacata

SEQ ID NO: 8311326 - DNA, 22 bp, Homo sapiens
tttccctgtgaatatttaaaga

SEQ ID NO: 8311327 - DNA, 22 bp, Homo sapiens
tttccctttgcactctacaatt

SEQ ID NO: 8311328 - DNA, 22 bp, Homo sapiens
tttttagccaagccataggtct

SEQ ID NO: 8311329 - DNA, 22 bp, Homo sapiens
tttttacctggaggataaatgt

SEQ ID NO: 8311330 - DNA, 22 bp, Homo sapiens
tttttacagtcatggtcactca

SEQ ID NO: 8311331 - DNA, 22 bp, Homo sapiens
ttttcttcctggattttggcat

SEQ ID NO: 8311332 - DNA, 22 bp, Homo sapiens
tttttcaagacaacctgcatgt

SEQ ID NO: 8311333 - DNA, 22 bp, Homo sapiens
tttttcatattcccctctctgg

SEQ ID NO: 8311334 - DNA, 22 bp, Homo sapiens
accagagcttacatgctagaaa

SEQ ID NO: 8311335 - DNA, 22 bp, Homo sapiens
accagagctggctctgagcacc

SEQ ID NO: 8311336 - DNA, 22 bp, Homo sapiens
aaggtacagttttaagaataag

SEQ ID NO: 8311337 - DNA, 22 bp, Homo sapiens
aaggtacagaaattaacaagga

SEQ ID NO: 8311338 - DNA, 22 bp, Homo sapiens
aaggtacaccaaagttcaagtt

SEQ ID NO: 8311339 - DNA, 22 bp, Homo sapiens
aaggtacaaagtattatttaaa

SEQ ID NO: 8311340 - DNA, 22 bp, Homo sapiens
aagggtggatttctgagctcta

SEQ ID NO: 8311341 - DNA, 22 bp, Homo sapiens
aagggtgggccctggcagccat

SEQ ID NO: 8311342 - DNA, 22 bp, Homo sapiens
aagggtggtgtaggagatcaaa

SEQ ID NO: 8311343 - DNA, 22 bp, Homo sapiens
aagggcagaaagggacgctttg

SEQ ID NO: 8311344 - DNA, 22 bp, Homo sapiens
aagggcagaaagggacgctttg

SEQ ID NO: 8311345 - DNA, 22 bp, Homo sapiens
aagggaggtaaagctatttaaa

SEQ ID NO: 8311346 - DNA, 22 bp, Homo sapiens
aagggcagagggaatcccacat

SEQ ID NO: 8311347 - DNA, 20 bp, Homo sapiens
aagggcagagggaacagact

SEQ ID NO: 8311348 - DNA, 22 bp, Homo sapiens
aagggcagaatagagaagatgg

SEQ ID NO: 8311349 - DNA, 22 bp, Homo sapiens
aagggcagaatagagaagatgg

SEQ ID NO: 8311350 - DNA, 22 bp, Homo sapiens
aagggctggccacattctgggt

SEQ ID NO: 8311351 - DNA, 22 bp, Homo sapiens
aagggctggccctgggaagagt

SEQ ID NO: 8311352 - DNA, 19 bp, Homo sapiens
aagggctgggcacctcact

SEQ ID NO: 8311353 - DNA, 22 bp, Homo sapiens
aagggctggatctctctgagca

SEQ ID NO: 8311354 - DNA, 22 bp, Homo sapiens
aagtccatctctgccccacaca

SEQ ID NO: 8311355 - DNA, 22 bp, Homo sapiens
aagtatattttttgaagcatat

SEQ ID NO: 8311356 - DNA, 22 bp, Homo sapiens
acctgcctatggagccacatgg

SEQ ID NO: 8311357 - DNA, 22 bp, Homo sapiens
acctgcctatcagctgcctgct

SEQ ID NO: 8311358 - DNA, 22 bp, Homo sapiens
acctgcctagttggttctgccc

SEQ ID NO: 8311359 - DNA, 22 bp, Homo sapiens
acctgcctatcagctgcctgct

SEQ ID NO: 8311360 - DNA, 22 bp, Homo sapiens
acctgcctagttggttctgccc

SEQ ID NO: 8311361 - DNA, 22 bp, Homo sapiens
acctctgcaaccctggaatggg

SEQ ID NO: 8311362 - DNA, 22 bp, Homo sapiens
acctctgcttcccgggttcaag

SEQ ID NO: 8311363 - DNA, 19 bp, Homo sapiens
acctctgcagagatgttta

SEQ ID NO: 8311364 - DNA, 20 bp, Homo sapiens
acctctgcatcaatcctttg

SEQ ID NO: 8311365 - DNA, 22 bp, Homo sapiens
acctctgcagtagggctgtgcc

SEQ ID NO: 8311366 - DNA, 22 bp, Homo sapiens
acctctgcaatgcaatgtcatg

SEQ ID NO: 8311367 - DNA, 22 bp, Homo sapiens
acctctgccaagatgtgctccc

SEQ ID NO: 8311368 - DNA, 22 bp, Homo sapiens
acctctgccactttctaactct

SEQ ID NO: 8311369 - DNA, 22 bp, Homo sapiens
acctctgctcaagacccctccg

SEQ ID NO: 8311370 - DNA, 22 bp, Homo sapiens
aagcttcctgaatgctcattta

SEQ ID NO: 8311371 - DNA, 21 bp, Homo sapiens
aagcttccctgctctccaggg

SEQ ID NO: 8311372 - DNA, 23 bp, Homo sapiens
aagcttccttcacgtctcctggg

SEQ ID NO: 8311373 - DNA, 22 bp, Homo sapiens
acagctggaggtctgtgagcac

SEQ ID NO: 8311374 - DNA, 22 bp, Homo sapiens
acagctggaggccccattgtcc

SEQ ID NO: 8311375 - DNA, 22 bp, Homo sapiens
aaggaagggaaatagtgatgtc

SEQ ID NO: 8311376 - DNA, 22 bp, Homo sapiens
aaggacagaaacagattgctgg

SEQ ID NO: 8311377 - DNA, 21 bp, Homo sapiens
acatgcatagagagatttctg

SEQ ID NO: 8311378 - DNA, 22 bp, Homo sapiens
acatgcatgtctatgggcaggt

SEQ ID NO: 8311379 - DNA, 22 bp, Homo sapiens
agaagccactggaggttgagat

SEQ ID NO: 8311380 - DNA, 22 bp, Homo sapiens
agaacttaggaacaacagctta

SEQ ID NO: 8311381 - DNA, 22 bp, Homo sapiens
agaagaaactgtcggggatatt

SEQ ID NO: 8311382 - DNA, 22 bp, Homo sapiens
agaactgtccttggaggagagt

SEQ ID NO: 8311383 - DNA, 22 bp, Homo sapiens
aatgcacaaaaattgtatgtaa

SEQ ID NO: 8311384 - DNA, 22 bp, Homo sapiens
aatgccagtgtgttgattccag

SEQ ID NO: 8311385 - DNA, 22 bp, Homo sapiens
agaagccagcttcagctgcccg

SEQ ID NO: 8311386 - DNA, 22 bp, Homo sapiens
agaaactgaattatttctgagg

SEQ ID NO: 8311387 - DNA, 22 bp, Homo sapiens
aatcacaattacttttgcacca

SEQ ID NO: 8311388 - DNA, 22 bp, Homo sapiens
aatcggttgaacccaggaagtg

SEQ ID NO: 8311389 - DNA, 22 bp, Homo sapiens
aataggtagccagatatataaa

SEQ ID NO: 8311390 - DNA, 17 bp, Homo sapiens
aatagctgctcagagag

SEQ ID NO: 8311391 - DNA, 22 bp, Homo sapiens
actttgaaggggaacattttaa

SEQ ID NO: 8311392 - DNA, 22 bp, Homo sapiens
actgggagttctccatgtccct

SEQ ID NO: 8311393 - DNA, 20 bp, Homo sapiens
aataaaagaagccttcaccc

SEQ ID NO: 8311394 - DNA, 21 bp, Homo sapiens
aataaaacagttggtgtcaat

SEQ ID NO: 8311395 - DNA, 22 bp, Homo sapiens
actgggaggcaaagagcaagga

SEQ ID NO: 8311396 - DNA, 22 bp, Homo sapiens
actgggaggcatctggagctga

SEQ ID NO: 8311397 - DNA, 22 bp, Homo sapiens
actgtctctctagcagttcagg

SEQ ID NO: 8311398 - DNA, 22 bp, Homo sapiens
actgtctcctcatcatgcctgg

SEQ ID NO: 8311399 - DNA, 22 bp, Homo sapiens
actgtacacgtgtcatttacag

SEQ ID NO: 8311400 - DNA, 22 bp, Homo sapiens
aagtgttaaaagattaaatgct

SEQ ID NO: 8311401 - DNA, 22 bp, Homo sapiens
actcttgtctcaacttttgtat

SEQ ID NO: 8311402 - DNA, 22 bp, Homo sapiens
aagtgtgtattgtttatgctgc

SEQ ID NO: 8311403 - DNA, 22 bp, Homo sapiens
aagtgtgttgactgaattgggg

SEQ ID NO: 8311404 - DNA, 22 bp, Homo sapiens
acctgcctcagtgcagctggat

SEQ ID NO: 8311405 - DNA, 22 bp, Homo sapiens
acctgcctctaagcagcaggtg

SEQ ID NO: 8311406 - DNA, 22 bp, Homo sapiens
acctgcctctaagcagcaggtg

SEQ ID NO: 8311407 - DNA, 22 bp, Homo sapiens
acctgcctatggagccacatgg

SEQ ID NO: 8311408 - DNA, 22 bp, Homo sapiens
acctgcctcagtgcagctggat

SEQ ID NO: 8311409 - DNA, 22 bp, Homo sapiens
aagttcaagtagtgttacatgg

SEQ ID NO: 8311410 - DNA, 23 bp, Homo sapiens
aagttcaagtcacagcctgtctt

SEQ ID NO: 8311411 - DNA, 22 bp, Homo sapiens
aagttcaagtctcctgagtata

SEQ ID NO: 8311412 - DNA, 22 bp, Homo sapiens
aagttcaagtctgcatcttttt

SEQ ID NO: 8311413 - DNA, 22 bp, Homo sapiens
aagttcaagtgtaatctttatt

SEQ ID NO: 8311414 - DNA, 22 bp, Homo sapiens
aagttcaatcagatgaaaaagc

SEQ ID NO: 8311415 - DNA, 22 bp, Homo sapiens
aagttcaatggaaaagctttag

SEQ ID NO: 8311416 - DNA, 22 bp, Homo sapiens
aagttcaaggtgatagtggcag

SEQ ID NO: 8311417 - DNA, 22 bp, Homo sapiens
aagttcaaggctctagagttcc

SEQ ID NO: 8311418 - DNA, 22 bp, Homo sapiens
aagttcaaggcaggtcctgagg

SEQ ID NO: 8311419 - DNA, 22 bp, Homo sapiens
actgcaggagacacagctgctg

SEQ ID NO: 8311420 - DNA, 22 bp, Homo sapiens
actgcagcctttgggctcataa

SEQ ID NO: 8311421 - DNA, 22 bp, Homo sapiens
actgcagccttgaactctgggc

SEQ ID NO: 8311422 - DNA, 22 bp, Homo sapiens
actgcagggcatcctggccaag

SEQ ID NO: 8311423 - DNA, 22 bp, Homo sapiens
actgcatctgaaacatgggtca

SEQ ID NO: 8311424 - DNA, 22 bp, Homo sapiens
acaccagggcctagccagggcg

SEQ ID NO: 8311425 - DNA, 22 bp, Homo sapiens
acacccagagcgccagtgccga

SEQ ID NO: 8311426 - DNA, 22 bp, Homo sapiens
agcatttaattacagtttaatt

SEQ ID NO: 8311427 - DNA, 22 bp, Homo sapiens
agccaaggacacggagcctcct

SEQ ID NO: 8311428 - DNA, 22 bp, Homo sapiens
agccaaggagtgcaggtggctt

SEQ ID NO: 8311429 - DNA, 22 bp, Homo sapiens
agccaaggcagctagagctctg

SEQ ID NO: 8311430 - DNA, 22 bp, Homo sapiens
agccagctgcctttcacatctg

SEQ ID NO: 8311431 - DNA, 22 bp, Homo sapiens
agccagctggagaccactgttt

SEQ ID NO: 8311432 - DNA, 22 bp, Homo sapiens
agccagctggtgggtcagctgg

SEQ ID NO: 8311433 - DNA, 22 bp, Homo sapiens
agccagaggccagcctgcctca

SEQ ID NO: 8311434 - DNA, 22 bp, Homo sapiens
agccaggaaccagctacagtct

SEQ ID NO: 8311435 - DNA, 22 bp, Homo sapiens
agccagagctgatgtcattctc

SEQ ID NO: 8311436 - DNA, 23 bp, Homo sapiens
acacaagggtaactgccagccat

SEQ ID NO: 8311437 - DNA, 23 bp, Homo sapiens
acacaatagagtactattcagcc

SEQ ID NO: 8311438 - DNA, 22 bp, Homo sapiens
acacacaactcattgtgtaata

SEQ ID NO: 8311439 - DNA, 22 bp, Homo sapiens
acacagtattacaataggtgct

SEQ ID NO: 8311440 - DNA, 22 bp, Homo sapiens
acacagtatgaaaagtctagtt

SEQ ID NO: 8311441 - DNA, 19 bp, Homo sapiens
acacagggctagagttaca

SEQ ID NO: 8311442 - DNA, 22 bp, Homo sapiens
agcaggctttcaagagtcttct

SEQ ID NO: 8311443 - DNA, 22 bp, Homo sapiens
agcaggcttgttatgtctgaga

SEQ ID NO: 8311444 - DNA, 22 bp, Homo sapiens
agctgagttaattcatcactta

SEQ ID NO: 8311445 - DNA, 22 bp, Homo sapiens
acagcagcgtcaacttaaaatt

SEQ ID NO: 8311446 - DNA, 22 bp, Homo sapiens
agctgagcacattcaaacaggt

SEQ ID NO: 8311447 - DNA, 21 bp, Homo sapiens
acagcagggctggcatgacag

SEQ ID NO: 8311448 - DNA, 22 bp, Homo sapiens
acagatataaactatagtagtg

SEQ ID NO: 8311449 - DNA, 22 bp, Homo sapiens
acagatatatgattgtgtaaat

SEQ ID NO: 8311450 - DNA, 22 bp, Homo sapiens
acagcagagtgtgagatagcca

SEQ ID NO: 8311451 - DNA, 22 bp, Homo sapiens
acagcagccttgttggtttcga

SEQ ID NO: 8311452 - DNA, 22 bp, Homo sapiens
acagcagcctgcagccctgtgt

SEQ ID NO: 8311453 - DNA, 22 bp, Homo sapiens
acagcagcataaactgactaag

SEQ ID NO: 8311454 - DNA, 22 bp, Homo sapiens
acagcagcaatagcagtgacat

SEQ ID NO: 8311455 - DNA, 22 bp, Homo sapiens
acagcagcaatagcagtgacat

SEQ ID NO: 8311456 - DNA, 22 bp, Homo sapiens
acagcagcactattgacatttt

SEQ ID NO: 8311457 - DNA, 22 bp, Homo sapiens
acagaggtaggacatgagatat

SEQ ID NO: 8311458 - DNA, 22 bp, Homo sapiens
acagaggccccgtgggagagcc

SEQ ID NO: 8311459 - DNA, 22 bp, Homo sapiens
acagaggtcatggagagttctc

SEQ ID NO: 8311460 - DNA, 22 bp, Homo sapiens
agccttcactgggaccttggat

SEQ ID NO: 8311461 - DNA, 22 bp, Homo sapiens
agccttcaacctagctagagca

SEQ ID NO: 8311462 - DNA, 20 bp, Homo sapiens
agcggctggcggaggacacg

SEQ ID NO: 8311463 - DNA, 22 bp, Homo sapiens
agcgggtgctgtgtcagccctc

SEQ ID NO: 8311464 - DNA, 20 bp, Homo sapiens
acagaatatgctggttgtgg

SEQ ID NO: 8311465 - DNA, 22 bp, Homo sapiens
acagaatattggttactgttgc

SEQ ID NO: 8311466 - DNA, 22 bp, Homo sapiens
acagaatgcgtagtgcatgttg

SEQ ID NO: 8311467 - DNA, 22 bp, Homo sapiens
acagaattaaagtgtttgtgga

SEQ ID NO: 8311468 - DNA, 22 bp, Homo sapiens
acagagctgtacatgtgccatg

SEQ ID NO: 8311469 - DNA, 22 bp, Homo sapiens
acagaacttcctgctggagtgg

SEQ ID NO: 8311470 - DNA, 19 bp, Homo sapiens
acagaagcatagaaaagga

SEQ ID NO: 8311471 - DNA, 22 bp, Homo sapiens
acagaaggcggggacaaggcgg

SEQ ID NO: 8311472 - DNA, 22 bp, Homo sapiens
acagaatactacagactggtta

SEQ ID NO: 8311473 - DNA, 22 bp, Homo sapiens
acaacagggtaaggcaggccat

SEQ ID NO: 8311474 - DNA, 22 bp, Homo sapiens
agatgctgcctctcctcacaag

SEQ ID NO: 8311475 - DNA, 22 bp, Homo sapiens
agatgctgctccacaggccagg

SEQ ID NO: 8311476 - DNA, 22 bp, Homo sapiens
acaaagttaacagttggatagt

SEQ ID NO: 8311477 - DNA, 22 bp, Homo sapiens
acaaagttattctttcagagga

SEQ ID NO: 8311478 - DNA, 22 bp, Homo sapiens
acaaagtttgtggtattccaag

SEQ ID NO: 8311479 - DNA, 22 bp, Homo sapiens
acaaagtctctaataatcttct

SEQ ID NO: 8311480 - DNA, 22 bp, Homo sapiens
acaaagtcctggtgtatggcca

SEQ ID NO: 8311481 - DNA, 22 bp, Homo sapiens
acaaagtcttttacaacagtca

SEQ ID NO: 8311482 - DNA, 22 bp, Homo sapiens
acaaagtctgaaacctgaggca

SEQ ID NO: 8311483 - DNA, 22 bp, Homo sapiens
acaaagtgaattgcatcgagtt

SEQ ID NO: 8311484 - DNA, 22 bp, Homo sapiens
acaaagtgcacaagatgagaac

SEQ ID NO: 8311485 - DNA, 22 bp, Homo sapiens
acaaagtcacaataattaacct

SEQ ID NO: 8311486 - DNA, 22 bp, Homo sapiens
acaaagtcaaattgcagccgcc

SEQ ID NO: 8311487 - DNA, 22 bp, Homo sapiens
aatttgcatgatgagaacaata

SEQ ID NO: 8311488 - DNA, 22 bp, Homo sapiens
agagtgaagttcatcgtgcagc

SEQ ID NO: 8311489 - DNA, 22 bp, Homo sapiens
agagtgaagtaattgttaggat

SEQ ID NO: 8311490 - DNA, 22 bp, Homo sapiens
aatttggcagtgtcttgaagta

SEQ ID NO: 8311491 - DNA, 22 bp, Homo sapiens
agagtgaagtttttgaaagtga

SEQ ID NO: 8311492 - DNA, 22 bp, Homo sapiens
agagtgtaataagggcaagggc

SEQ ID NO: 8311493 - DNA, 22 bp, Homo sapiens
agagtgtttttctgtcaaggac

SEQ ID NO: 8311494 - DNA, 22 bp, Homo sapiens
agagtgttatttgctctgtatt

SEQ ID NO: 8311495 - DNA, 22 bp, Homo sapiens
agagtgtttttctgtcaaggac

SEQ ID NO: 8311496 - DNA, 18 bp, Homo sapiens
agagtgttctcagtgaaa

SEQ ID NO: 8311497 - DNA, 22 bp, Homo sapiens
agagtgtttcagtcttcctaga

SEQ ID NO: 8311498 - DNA, 19 bp, Homo sapiens
agcaaatataatagtgttc

SEQ ID NO: 8311499 - DNA, 22 bp, Homo sapiens
agcaaggcagtcagctggctgg

SEQ ID NO: 8311500 - DNA, 22 bp, Homo sapiens
agcaaagtcagtggaaccatcc

SEQ ID NO: 8311501 - DNA, 22 bp, Homo sapiens
agcacaggaccaaggaagctgt

SEQ ID NO: 8311502 - DNA, 22 bp, Homo sapiens
agagcctggctcccagctaccg

SEQ ID NO: 8311503 - DNA, 22 bp, Homo sapiens
agagctgcacctatgcagacct

SEQ ID NO: 8311504 - DNA, 22 bp, Homo sapiens
agagctgcaatttcatgtggtg

SEQ ID NO: 8311505 - DNA, 22 bp, Homo sapiens
agagctgcagggtggacccagg

SEQ ID NO: 8311506 - DNA, 22 bp, Homo sapiens
agagctgcccacacagcagatt

SEQ ID NO: 8311507 - DNA, 22 bp, Homo sapiens
agagctgaggatccagctgagc

SEQ ID NO: 8311508 - DNA, 22 bp, Homo sapiens
agagctgaatttgggtggtgga

SEQ ID NO: 8311509 - DNA, 22 bp, Homo sapiens
agagctgagaatgtggcttcct

SEQ ID NO: 8311510 - DNA, 22 bp, Homo sapiens
aattcatccatgaacaattcca

SEQ ID NO: 8311511 - DNA, 22 bp, Homo sapiens
agaggatgattttaaggacact

SEQ ID NO: 8311512 - DNA, 22 bp, Homo sapiens
agaggaggtggtgatgctttaa

SEQ ID NO: 8311513 - DNA, 22 bp, Homo sapiens
aatttcaattacttttgcacca

SEQ ID NO: 8311514 - DNA, 22 bp, Homo sapiens
agaggatggttgaggaagacct

SEQ ID NO: 8311515 - DNA, 22 bp, Homo sapiens
agacatcagcttgtgtgcaggg

SEQ ID NO: 8311516 - DNA, 22 bp, Homo sapiens
aatgctgcaagaggtgaaaaga

SEQ ID NO: 8311517 - DNA, 22 bp, Homo sapiens
aatgctgctctcataattatag

SEQ ID NO: 8311518 - DNA, 22 bp, Homo sapiens
aatgctagtgtgatatgtaagg

SEQ ID NO: 8311519 - DNA, 20 bp, Homo sapiens
aatgtatattttatgccagg

SEQ ID NO: 8311520 - DNA, 22 bp, Homo sapiens
aatgtgtagggtgcctgttttt

SEQ ID NO: 8311521 - DNA, 22 bp, Homo sapiens
aatgtgtagcatttaatgcagt

SEQ ID NO: 8311522 - DNA, 22 bp, Homo sapiens
aatgtgtagatgttgcattcct

SEQ ID NO: 8311523 - DNA, 22 bp, Homo sapiens
aatgtgtagcatttaatgcagt

SEQ ID NO: 8311524 - DNA, 22 bp, Homo sapiens
aatgtgtactttttcatgctca

SEQ ID NO: 8311525 - DNA, 21 bp, Homo sapiens
agagaagggactcttccagtc

SEQ ID NO: 8311526 - DNA, 22 bp, Homo sapiens
aatgtgtatatgaacatacagg

SEQ ID NO: 8311527 - DNA, 22 bp, Homo sapiens
aatgtgtatactggcaattaag

SEQ ID NO: 8311528 - DNA, 22 bp, Homo sapiens
aatgtgtatactggcaattaag

SEQ ID NO: 8311529 - DNA, 21 bp, Homo sapiens
aatgtgtgctatttatctttt

SEQ ID NO: 8311530 - DNA, 22 bp, Homo sapiens
aatgtgtgtatttctaggcgag

SEQ ID NO: 8311531 - DNA, 22 bp, Homo sapiens
aatgtgtgttcggggcccagag

SEQ ID NO: 8311532 - DNA, 22 bp, Homo sapiens
aagatacataaaggtagagtct

SEQ ID NO: 8311533 - DNA, 22 bp, Homo sapiens
acagagatgcaagtgtgtattt

SEQ ID NO: 8311534 - DNA, 22 bp, Homo sapiens
acagagatggcacagagaaggt

SEQ ID NO: 8311535 - DNA, 22 bp, Homo sapiens
acagagatgtggatgagggatt

SEQ ID NO: 8311536 - DNA, 22 bp, Homo sapiens
acagagcaataacagggagagg

SEQ ID NO: 8311537 - DNA, 23 bp, Homo sapiens
acagagatcttgacttgtatgga

SEQ ID NO: 8311538 - DNA, 22 bp, Homo sapiens
acagacattttctgtattgcct

SEQ ID NO: 8311539 - DNA, 22 bp, Homo sapiens
acagaccaagtttccagcaggt

SEQ ID NO: 8311540 - DNA, 22 bp, Homo sapiens
acagaccaaaaaaggatattgg

SEQ ID NO: 8311541 - DNA, 22 bp, Homo sapiens
acagaaatattcgtggtgcttg

SEQ ID NO: 8311542 - DNA, 22 bp, Homo sapiens
acagaaatatagaaggtaggaa

SEQ ID NO: 8311543 - DNA, 18 bp, Homo sapiens
acagaaatagctgtgcct

SEQ ID NO: 8311544 - DNA, 22 bp, Homo sapiens
acagaaataactttttatgttt

SEQ ID NO: 8311545 - DNA, 22 bp, Homo sapiens
aagcccagctgaaagcattttt

SEQ ID NO: 8311546 - DNA, 22 bp, Homo sapiens
aagcccagcatccctgcaccag

SEQ ID NO: 8311547 - DNA, 22 bp, Homo sapiens
aagcccagtttcacactgagac

SEQ ID NO: 8311548 - DNA, 22 bp, Homo sapiens
acagccaggagccatgggcagg

SEQ ID NO: 8311549 - DNA, 22 bp, Homo sapiens
aagccaggttccatggaggagc

SEQ ID NO: 8311550 - DNA, 22 bp, Homo sapiens
aagcccagatgtgagaactgag

SEQ ID NO: 8311551 - DNA, 22 bp, Homo sapiens
aagcccagatgtgagaactgag

SEQ ID NO: 8311552 - DNA, 22 bp, Homo sapiens
acagccaggaattctggagaag

SEQ ID NO: 8311553 - DNA, 21 bp, Homo sapiens
aagcaggacatatgatgccct

SEQ ID NO: 8311554 - DNA, 22 bp, Homo sapiens
acagagcaattcttgggtgttt

SEQ ID NO: 8311555 - DNA, 22 bp, Homo sapiens
aagcagggtgtcttgacccatg

SEQ ID NO: 8311556 - DNA, 22 bp, Homo sapiens
aagcagtgcgctcatctaaggg

SEQ ID NO: 8311557 - DNA, 22 bp, Homo sapiens
aagaacaggttctagaaccatt

SEQ ID NO: 8311558 - DNA, 22 bp, Homo sapiens
aagaacatgttaaaagattcac

SEQ ID NO: 8311559 - DNA, 22 bp, Homo sapiens
aatgtacaagggttccagtttt

SEQ ID NO: 8311560 - DNA, 22 bp, Homo sapiens
aagaacattttgtagaatgaca

SEQ ID NO: 8311561 - DNA, 22 bp, Homo sapiens
aagaactgtgctccaggctcca

SEQ ID NO: 8311562 - DNA, 22 bp, Homo sapiens
aagaagagaaatgtgctgctgg

SEQ ID NO: 8311563 - DNA, 22 bp, Homo sapiens
acaaaaattagctgggcatggt

SEQ ID NO: 8311564 - DNA, 19 bp, Homo sapiens
aagaagcaataagctgtga

SEQ ID NO: 8311565 - DNA, 22 bp, Homo sapiens
aagaagatggttaactttcagt

SEQ ID NO: 8311566 - DNA, 21 bp, Homo sapiens
aagaagcaatttattggaagg

SEQ ID NO: 8311567 - DNA, 22 bp, Homo sapiens
aagaatcatcctgcaagagtct

SEQ ID NO: 8311568 - DNA, 22 bp, Homo sapiens
aagaatcatagagccactgata

SEQ ID NO: 8311569 - DNA, 22 bp, Homo sapiens
acaaaagtgtaggaattcctta

SEQ ID NO: 8311570 - DNA, 22 bp, Homo sapiens
acaaaagaataagatgagtcat

SEQ ID NO: 8311571 - DNA, 22 bp, Homo sapiens
acacagccgtgaatctgcttct

SEQ ID NO: 8311572 - DNA, 22 bp, Homo sapiens
acacagccagggtagtaaggct

SEQ ID NO: 8311573 - DNA, 17 bp, Homo sapiens
acacagccaggttctcc

SEQ ID NO: 8311574 - DNA, 20 bp, Homo sapiens
acaatagatttgagcaaagt

SEQ ID NO: 8311575 - DNA, 22 bp, Homo sapiens
acaatgtaggatatgtacttgt

SEQ ID NO: 8311576 - DNA, 22 bp, Homo sapiens
aatgtacaaaagtcagccaact

SEQ ID NO: 8311577 - DNA, 22 bp, Homo sapiens
aactttaaggctataaattatg

SEQ ID NO: 8311578 - DNA, 22 bp, Homo sapiens
aatgcagtttcatttgtagaat

SEQ ID NO: 8311579 - DNA, 22 bp, Homo sapiens
aatgctgtatatcttagctaat

SEQ ID NO: 8311580 - DNA, 22 bp, Homo sapiens
aatgcagtgagccattaaatgg

SEQ ID NO: 8311581 - DNA, 22 bp, Homo sapiens
aatgaacaaaatatgctttgca

SEQ ID NO: 8311582 - DNA, 18 bp, Homo sapiens
aatgcacacatttactcc

SEQ ID NO: 8311583 - DNA, 22 bp, Homo sapiens
aatgcacacatttggtactgaa

SEQ ID NO: 8311584 - DNA, 22 bp, Homo sapiens
aatgcacagcgttccatgcttg

SEQ ID NO: 8311585 - DNA, 22 bp, Homo sapiens
aatgcacagctaaagtggttcc

SEQ ID NO: 8311586 - DNA, 22 bp, Homo sapiens
aatgcacataaatatggtctta

SEQ ID NO: 8311587 - DNA, 22 bp, Homo sapiens
aatgcacatatatgtgtataca

SEQ ID NO: 8311588 - DNA, 22 bp, Homo sapiens
aatgcacatgccacatgtggta

SEQ ID NO: 8311589 - DNA, 22 bp, Homo sapiens
aatgcacatgtcttggcctcac

SEQ ID NO: 8311590 - DNA, 22 bp, Homo sapiens
aatgcacatgttgtaataaata

SEQ ID NO: 8311591 - DNA, 23 bp, Homo sapiens
aatctggctgatgttttttctct

SEQ ID NO: 8311592 - DNA, 22 bp, Homo sapiens
aatctggctcagaagaagatga

SEQ ID NO: 8311593 - DNA, 15 bp, Homo sapiens
aatctggcggcaagt

SEQ ID NO: 8311594 - DNA, 22 bp, Homo sapiens
aatctggcatgtaagcttagag

SEQ ID NO: 8311595 - DNA, 22 bp, Homo sapiens
aatctggcatttgagagtagga

SEQ ID NO: 8311596 - DNA, 22 bp, Homo sapiens
aagttacaggagaaagagatca

SEQ ID NO: 8311597 - DNA, 22 bp, Homo sapiens
aatatttctccttcgttatagc

SEQ ID NO: 8311598 - DNA, 22 bp, Homo sapiens
aagtgaaacatgtatctcttta

SEQ ID NO: 8311599 - DNA, 22 bp, Homo sapiens
aagtgaaacatgtatctcttta

SEQ ID NO: 8311600 - DNA, 22 bp, Homo sapiens
aagggctgccagggggtgccag

SEQ ID NO: 8311601 - DNA, 22 bp, Homo sapiens
aagggcagggagtttgtgtcta

SEQ ID NO: 8311602 - DNA, 22 bp, Homo sapiens
aagggcagggagtttgtgtcta

SEQ ID NO: 8311603 - DNA, 22 bp, Homo sapiens
aagggcaggtgggcatttctgg

SEQ ID NO: 8311604 - DNA, 22 bp, Homo sapiens
aagggctgctgtagaagcagag

SEQ ID NO: 8311605 - DNA, 22 bp, Homo sapiens
aaggagtctcagctgggcctga

SEQ ID NO: 8311606 - DNA, 22 bp, Homo sapiens
aaggagtgcatgactcagagta

SEQ ID NO: 8311607 - DNA, 22 bp, Homo sapiens
aaggcactgaacttaaattctg

SEQ ID NO: 8311608 - DNA, 22 bp, Homo sapiens
aaggcactgaaaaattgtgtgt

SEQ ID NO: 8311609 - DNA, 22 bp, Homo sapiens
aaggcactgagccagccgtctc

SEQ ID NO: 8311610 - DNA, 22 bp, Homo sapiens
aaggcactgactgtgcagggga

SEQ ID NO: 8311611 - DNA, 22 bp, Homo sapiens
aaggcactcagccttgggacag

SEQ ID NO: 8311612 - DNA, 22 bp, Homo sapiens
aaggcactcattcaaggagata

SEQ ID NO: 8311613 - DNA, 22 bp, Homo sapiens
aaggcactagcagaattagtga

SEQ ID NO: 8311614 - DNA, 20 bp, Homo sapiens
aaggcactatgtctgctagc

SEQ ID NO: 8311615 - DNA, 22 bp, Homo sapiens
aaggcactagcaagctgcctgg

SEQ ID NO: 8311616 - DNA, 22 bp, Homo sapiens
aaggccatgcacatcctaggca

SEQ ID NO: 8311617 - DNA, 22 bp, Homo sapiens
aaggccatgaccacttgctgtg

SEQ ID NO: 8311618 - DNA, 22 bp, Homo sapiens
aaggccattattctgatatatt

SEQ ID NO: 8311619 - DNA, 22 bp, Homo sapiens
aaggcactgtactagttagtta

SEQ ID NO: 8311620 - DNA, 22 bp, Homo sapiens
aaggcactgctttgctgcgccc

SEQ ID NO: 8311621 - DNA, 22 bp, Homo sapiens
aaggccctggcaggaagcagga

SEQ ID NO: 8311622 - DNA, 22 bp, Homo sapiens
aaggccctggccccagcttctt

SEQ ID NO: 8311623 - DNA, 22 bp, Homo sapiens
aaggccctaatagagcacatat

SEQ ID NO: 8311624 - DNA, 22 bp, Homo sapiens
aagggcaggagaagacggatat

SEQ ID NO: 8311625 - DNA, 22 bp, Homo sapiens
aagggcaggagaagacggatat

SEQ ID NO: 8311626 - DNA, 22 bp, Homo sapiens
aagggcaggaaaagatggatgt

SEQ ID NO: 8311627 - DNA, 22 bp, Homo sapiens
aagggcaggaaaagatggatgt

SEQ ID NO: 8311628 - DNA, 22 bp, Homo sapiens
aagggaggggatgtaagcctgg

SEQ ID NO: 8311629 - DNA, 22 bp, Homo sapiens
aagggcaggcacccaccctcac

SEQ ID NO: 8311630 - DNA, 22 bp, Homo sapiens
aagggcaggcagagatcatata

SEQ ID NO: 8311631 - DNA, 22 bp, Homo sapiens
aaggctgagagtcacagtccta

SEQ ID NO: 8311632 - DNA, 22 bp, Homo sapiens
aagggaggccagaggttttgca

SEQ ID NO: 8311633 - DNA, 22 bp, Homo sapiens
aaggctgagacagcacaggtcc

SEQ ID NO: 8311634 - DNA, 22 bp, Homo sapiens
aaaggttaaggtgttcaagaaa

SEQ ID NO: 8311635 - DNA, 22 bp, Homo sapiens
aaagctcacagtaatacaaggc

SEQ ID NO: 8311636 - DNA, 22 bp, Homo sapiens
aaagtcatgtaatgatatgatt

SEQ ID NO: 8311637 - DNA, 22 bp, Homo sapiens
aaatacagagttgcttaaaagc

SEQ ID NO: 8311638 - DNA, 22 bp, Homo sapiens
aaatgaactcttcctgcatccc

SEQ ID NO: 8311639 - DNA, 22 bp, Homo sapiens
aaatgtctgttagtcatatcat

SEQ ID NO: 8311640 - DNA, 22 bp, Homo sapiens
aaatgtctttatctcatgtaac

SEQ ID NO: 8311641 - DNA, 22 bp, Homo sapiens
aaatgtctttatctcatgtaac

SEQ ID NO: 8311642 - DNA, 22 bp, Homo sapiens
aaatggtgtttctaatgctaga

SEQ ID NO: 8311643 - DNA, 22 bp, Homo sapiens
aaatgtctgagacttctgaact

SEQ ID NO: 8311644 - DNA, 22 bp, Homo sapiens
aaatgtctttcaatagagaaat

SEQ ID NO: 8311645 - DNA, 22 bp, Homo sapiens
aaatgtctttcttctgctacgt

SEQ ID NO: 8311646 - DNA, 22 bp, Homo sapiens
aaatgtctttgagtatttctgc

SEQ ID NO: 8311647 - DNA, 22 bp, Homo sapiens
aaaatacacatactaggggaaa

SEQ ID NO: 8311648 - DNA, 22 bp, Homo sapiens
aaaagttacctctgtaatataa

SEQ ID NO: 8311649 - DNA, 22 bp, Homo sapiens
aaaagttccctggttagaaaag

SEQ ID NO: 8311650 - DNA, 22 bp, Homo sapiens
aaaagtttaagactcattctag

SEQ ID NO: 8311651 - DNA, 22 bp, Homo sapiens
aaaagtttaagactcattctag

SEQ ID NO: 8311652 - DNA, 22 bp, Homo sapiens
aaaagctctttctgctgtagat

SEQ ID NO: 8311653 - DNA, 22 bp, Homo sapiens
aaaatgaggtcaatatcctttt

SEQ ID NO: 8311654 - DNA, 18 bp, Homo sapiens
aaaatgcaggcgacatgg

SEQ ID NO: 8311655 - DNA, 22 bp, Homo sapiens
aaaatgcatgagaatgtgctcg

SEQ ID NO: 8311656 - DNA, 22 bp, Homo sapiens
aaaatggtctcagctggcacca

SEQ ID NO: 8311657 - DNA, 22 bp, Homo sapiens
aaaatgtaaagcttgagtgtag

SEQ ID NO: 8311658 - DNA, 22 bp, Homo sapiens
aaaagaggagtggtttatgaca

SEQ ID NO: 8311659 - DNA, 22 bp, Homo sapiens
aaaagaggttaaccaggtgtgt

SEQ ID NO: 8311660 - DNA, 22 bp, Homo sapiens
aaaagagtcttaggcagtcata

SEQ ID NO: 8311661 - DNA, 22 bp, Homo sapiens
aaaaccaggcgtttcctattat

SEQ ID NO: 8311662 - DNA, 22 bp, Homo sapiens
aaaaatgttatctactgtccga

SEQ ID NO: 8311663 - DNA, 22 bp, Homo sapiens
aaaaatgtgaccacagggtgtt

SEQ ID NO: 8311664 - DNA, 22 bp, Homo sapiens
aaaaatgaaacggctggttggc

SEQ ID NO: 8311665 - DNA, 22 bp, Homo sapiens
aacatgaagttttctatagtga

SEQ ID NO: 8311666 - DNA, 22 bp, Homo sapiens
aaaggctatgagatagaagata

SEQ ID NO: 8311667 - DNA, 22 bp, Homo sapiens
aaaggctccttctcccatgacc

SEQ ID NO: 8311668 - DNA, 22 bp, Homo sapiens
aaagttctgggggagaagaacg

SEQ ID NO: 8311669 - DNA, 22 bp, Homo sapiens
aacttcttggtcctgagctgtt

SEQ ID NO: 8311670 - DNA, 20 bp, Homo sapiens
aaagtcttatggttaatttt

SEQ ID NO: 8311671 - DNA, 22 bp, Homo sapiens
aacatgaaggtaggatggtttt

SEQ ID NO: 8311672 - DNA, 22 bp, Homo sapiens
aacatgaaagttgctaagtgca

SEQ ID NO: 8311673 - DNA, 22 bp, Homo sapiens
aaagcagtatattggtagttgt

SEQ ID NO: 8311674 - DNA, 23 bp, Homo sapiens
aaagttgatttgcagtttaagag

SEQ ID NO: 8311675 - DNA, 22 bp, Homo sapiens
aagagttttctataatcttggc

SEQ ID NO: 8311676 - DNA, 22 bp, Homo sapiens
aagagagagcattcttctgtta

SEQ ID NO: 8311677 - DNA, 22 bp, Homo sapiens
aaatgcaacgggctttccttat

SEQ ID NO: 8311678 - DNA, 22 bp, Homo sapiens
aaatgcacaaagtaagtgtaat

SEQ ID NO: 8311679 - DNA, 22 bp, Homo sapiens
aaatgcaattgtatgtactcca

SEQ ID NO: 8311680 - DNA, 22 bp, Homo sapiens
aaatgcacagaaaggatgtgga

SEQ ID NO: 8311681 - DNA, 22 bp, Homo sapiens
aaatgcacagagccttagagat

SEQ ID NO: 8311682 - DNA, 22 bp, Homo sapiens
aaatgcacacaccaggaaacta

SEQ ID NO: 8311683 - DNA, 22 bp, Homo sapiens
aaatgcacaataaagtaaaggc

SEQ ID NO: 8311684 - DNA, 22 bp, Homo sapiens
aaatgcatttttaattagaccc

SEQ ID NO: 8311685 - DNA, 22 bp, Homo sapiens
aaatgcacagaggccagagagg

SEQ ID NO: 8311686 - DNA, 22 bp, Homo sapiens
aaatgcacaggagaaccaattc

SEQ ID NO: 8311687 - DNA, 22 bp, Homo sapiens
aaatgctgtgttttaacataga

SEQ ID NO: 8311688 - DNA, 22 bp, Homo sapiens
aaatgctgtaactgatattctg

SEQ ID NO: 8311689 - DNA, 22 bp, Homo sapiens
aaatgcttgctcttgattattt

SEQ ID NO: 8311690 - DNA, 22 bp, Homo sapiens
aaatgaccagaatacaggcttc

SEQ ID NO: 8311691 - DNA, 22 bp, Homo sapiens
aaatgaacagttgcattctctg

SEQ ID NO: 8311692 - DNA, 22 bp, Homo sapiens
aaatcactaagttatagtgtgg

SEQ ID NO: 8311693 - DNA, 22 bp, Homo sapiens
aaatcaaaagacatgtgtttta

SEQ ID NO: 8311694 - DNA, 22 bp, Homo sapiens
attctctcatttatctgtccta

SEQ ID NO: 8311695 - DNA, 22 bp, Homo sapiens
attctctctagaagctgagatg

SEQ ID NO: 8311696 - DNA, 22 bp, Homo sapiens
attctctctctatgaaaactga

SEQ ID NO: 8311697 - DNA, 22 bp, Homo sapiens
attctctcttctgctgcccgtg

SEQ ID NO: 8311698 - DNA, 22 bp, Homo sapiens
attctccatcaccactggcact

SEQ ID NO: 8311699 - DNA, 22 bp, Homo sapiens
attctccagctcactgtccata

SEQ ID NO: 8311700 - DNA, 22 bp, Homo sapiens
attcccatcgtcaacttcactg

SEQ ID NO: 8311701 - DNA, 22 bp, Homo sapiens
agagcttagaatttcagatgat

SEQ ID NO: 8311702 - DNA, 23 bp, Homo sapiens
agagcttagggaattcacatgag

SEQ ID NO: 8311703 - DNA, 22 bp, Homo sapiens
agagcttatatcttggccatcc

SEQ ID NO: 8311704 - DNA, 23 bp, Homo sapiens
agagctttctaaaatgtaaatct

SEQ ID NO: 8311705 - DNA, 22 bp, Homo sapiens
agaggccagggacactgctcaa

SEQ ID NO: 8311706 - DNA, 22 bp, Homo sapiens
agaggcctccgaaaggtgggct

SEQ ID NO: 8311707 - DNA, 22 bp, Homo sapiens
agaggcctaattgctacccttt

SEQ ID NO: 8311708 - DNA, 22 bp, Homo sapiens
agaggcctaaccaagatgtcct

SEQ ID NO: 8311709 - DNA, 19 bp, Homo sapiens
agaggcctcagcagctggc

SEQ ID NO: 8311710 - DNA, 22 bp, Homo sapiens
attgtatcttgtcattatgcat

SEQ ID NO: 8311711 - DNA, 22 bp, Homo sapiens
attgagaatccatttgagatga

SEQ ID NO: 8311712 - DNA, 22 bp, Homo sapiens
attgaaagtcctatctaaggga

SEQ ID NO: 8311713 - DNA, 22 bp, Homo sapiens
attgaaaggcaaagtaggaagc

SEQ ID NO: 8311714 - DNA, 21 bp, Homo sapiens
attgaaagtcaacaatcagtt

SEQ ID NO: 8311715 - DNA, 22 bp, Homo sapiens
attgaaaggttttgagcagata

SEQ ID NO: 8311716 - DNA, 22 bp, Homo sapiens
attgaaagatatactgttctca

SEQ ID NO: 8311717 - DNA, 22 bp, Homo sapiens
attgaaagattttgggctcatg

SEQ ID NO: 8311718 - DNA, 22 bp, Homo sapiens
attgaaagcacaaagaacaagt

SEQ ID NO: 8311719 - DNA, 22 bp, Homo sapiens
attgaaagcatggatttggatt

SEQ ID NO: 8311720 - DNA, 22 bp, Homo sapiens
attgaaagagaatgtagctctt

SEQ ID NO: 8311721 - DNA, 22 bp, Homo sapiens
attgaaagagttttctgctgca

SEQ ID NO: 8311722 - DNA, 22 bp, Homo sapiens
attgaaagataggctactgtgg

SEQ ID NO: 8311723 - DNA, 22 bp, Homo sapiens
agataatttgagtaaattaatt

SEQ ID NO: 8311724 - DNA, 22 bp, Homo sapiens
attgtatttccagcttgaatgt

SEQ ID NO: 8311725 - DNA, 22 bp, Homo sapiens
attgtattagcacaatacaatt

SEQ ID NO: 8311726 - DNA, 22 bp, Homo sapiens
attgtggtgtcagttataggca

SEQ ID NO: 8311727 - DNA, 22 bp, Homo sapiens
attgtggctagacagtcacaat

SEQ ID NO: 8311728 - DNA, 22 bp, Homo sapiens
attgtgtaattttcagctcata

SEQ ID NO: 8311729 - DNA, 22 bp, Homo sapiens
attttttcagattgagtgttaa

SEQ ID NO: 8311730 - DNA, 23 bp, Homo sapiens
agcaataagaagggatacatgtg

SEQ ID NO: 8311731 - DNA, 23 bp, Homo sapiens
attttttgtctttgtaactagat

SEQ ID NO: 8311732 - DNA, 22 bp, Homo sapiens
attttttctgtaaactggcctt

SEQ ID NO: 8311733 - DNA, 22 bp, Homo sapiens
attttttcccagttagccagga

SEQ ID NO: 8311734 - DNA, 22 bp, Homo sapiens
agcaatatttcagctagcaggt

SEQ ID NO: 8311735 - DNA, 22 bp, Homo sapiens
agcaatatgacattgctacatc

SEQ ID NO: 8311736 - DNA, 22 bp, Homo sapiens
agcaatataaatgttgggtaga

SEQ ID NO: 8311737 - DNA, 22 bp, Homo sapiens
agcaatatttaaaggtttgcaa

SEQ ID NO: 8311738 - DNA, 22 bp, Homo sapiens
caaaggtaaagatctgctgtgg

SEQ ID NO: 8311739 - DNA, 22 bp, Homo sapiens
caaagggctctagactcagcag

SEQ ID NO: 8311740 - DNA, 22 bp, Homo sapiens
caaaggtataagttaatataca

SEQ ID NO: 8311741 - DNA, 22 bp, Homo sapiens
caaaggtagtatatatattgtt

SEQ ID NO: 8311742 - DNA, 22 bp, Homo sapiens
caaagtgctgggattacaggct

SEQ ID NO: 8311743 - DNA, 22 bp, Homo sapiens
caaagtgctgggattacaggtg

SEQ ID NO: 8311744 - DNA, 22 bp, Homo sapiens
caaagtttaaagtagatttcag

SEQ ID NO: 8311745 - DNA, 22 bp, Homo sapiens
caaagttatgaatgataagatt

SEQ ID NO: 8311746 - DNA, 22 bp, Homo sapiens
caaagttatcaactgcaacatt

SEQ ID NO: 8311747 - DNA, 22 bp, Homo sapiens
caaagtttggctctcatgacat

SEQ ID NO: 8311748 - DNA, 22 bp, Homo sapiens
agatgatggccatgtcctctcc

SEQ ID NO: 8311749 - DNA, 22 bp, Homo sapiens
agattgtagaaactgtagcatt

SEQ ID NO: 8311750 - DNA, 21 bp, Homo sapiens
agattgtatggaggtgagagg

SEQ ID NO: 8311751 - DNA, 22 bp, Homo sapiens
agatttagtggtggaattttgg

SEQ ID NO: 8311752 - DNA, 22 bp, Homo sapiens
agatttagactgccttaatcat

SEQ ID NO: 8311753 - DNA, 22 bp, Homo sapiens
agatttcaatgtgagcattagt

SEQ ID NO: 8311754 - DNA, 22 bp, Homo sapiens
agatttcaatggatattgcaag

SEQ ID NO: 8311755 - DNA, 22 bp, Homo sapiens
atttacagatgatgctatttga

SEQ ID NO: 8311756 - DNA, 22 bp, Homo sapiens
atttcttttcaagagggtgctt

SEQ ID NO: 8311757 - DNA, 19 bp, Homo sapiens
atttgaaagctgtgcttgc

SEQ ID NO: 8311758 - DNA, 21 bp, Homo sapiens
agatgaggatactgaggccta

SEQ ID NO: 8311759 - DNA, 23 bp, Homo sapiens
agatgaggcttctccatgttggt

SEQ ID NO: 8311760 - DNA, 23 bp, Homo sapiens
agatgaggcttctccatgttggt

SEQ ID NO: 8311761 - DNA, 22 bp, Homo sapiens
agatgaggggtagaaaggactt

SEQ ID NO: 8311762 - DNA, 22 bp, Homo sapiens
agagaagacttacagccacagt

SEQ ID NO: 8311763 - DNA, 18 bp, Homo sapiens
atgggaggggccaagaga

SEQ ID NO: 8311764 - DNA, 18 bp, Homo sapiens
atgggaggggccaagaga

SEQ ID NO: 8311765 - DNA, 22 bp, Homo sapiens
atggacaggctgagcttcctca

SEQ ID NO: 8311766 - DNA, 22 bp, Homo sapiens
atggacaggaactcccttggca

SEQ ID NO: 8311767 - DNA, 22 bp, Homo sapiens
atgtagtgtagagattagtctc

SEQ ID NO: 8311768 - DNA, 22 bp, Homo sapiens
atgtagtatttggaaatgtaaa

SEQ ID NO: 8311769 - DNA, 22 bp, Homo sapiens
agagctcaagacgctcacagta

SEQ ID NO: 8311770 - DNA, 20 bp, Homo sapiens
agagccttgaggaagatgat

SEQ ID NO: 8311771 - DNA, 22 bp, Homo sapiens
agagcctgttttgtgggagatg

SEQ ID NO: 8311772 - DNA, 22 bp, Homo sapiens
agagccttgaagatctggaaaa

SEQ ID NO: 8311773 - DNA, 22 bp, Homo sapiens
atgttcaaactttttacacacc

SEQ ID NO: 8311774 - DNA, 22 bp, Homo sapiens
agagattcatgtttactgtagg

SEQ ID NO: 8311775 - DNA, 18 bp, Homo sapiens
agagatggtgtagagttt

SEQ ID NO: 8311776 - DNA, 22 bp, Homo sapiens
agagatgttcattcagcatgtt

SEQ ID NO: 8311777 - DNA, 22 bp, Homo sapiens
agagatgtcgccttgcccaggg

SEQ ID NO: 8311778 - DNA, 22 bp, Homo sapiens
agagccaggatgtcttctgggg

SEQ ID NO: 8311779 - DNA, 22 bp, Homo sapiens
atgttattttggaaaatacaaa

SEQ ID NO: 8311780 - DNA, 22 bp, Homo sapiens
atgttacagaaagcaaagatga

SEQ ID NO: 8311781 - DNA, 22 bp, Homo sapiens
agagccaggatctgttttgggg

SEQ ID NO: 8311782 - DNA, 22 bp, Homo sapiens
agagccaggactgtgtctcact

SEQ ID NO: 8311783 - DNA, 22 bp, Homo sapiens
agagccagccttctcagcttac

SEQ ID NO: 8311784 - DNA, 22 bp, Homo sapiens
agagccagcatttgggccctgc

SEQ ID NO: 8311785 - DNA, 22 bp, Homo sapiens
agagccagcatttgacactggc

SEQ ID NO: 8311786 - DNA, 22 bp, Homo sapiens
atgtgcatgcacttacatgtgt

SEQ ID NO: 8311787 - DNA, 22 bp, Homo sapiens
atgtgcattaaatgtcaatgtt

SEQ ID NO: 8311788 - DNA, 22 bp, Homo sapiens
atgattgaccatctgctgggct

SEQ ID NO: 8311789 - DNA, 22 bp, Homo sapiens
atgatttccagttgttgctaag

SEQ ID NO: 8311790 - DNA, 22 bp, Homo sapiens
atgacccctaaaatttactgtc

SEQ ID NO: 8311791 - DNA, 19 bp, Homo sapiens
atcttacagagcagagtac

SEQ ID NO: 8311792 - DNA, 22 bp, Homo sapiens
atctgggttcaccatgctcctg

SEQ ID NO: 8311793 - DNA, 22 bp, Homo sapiens
atctggcttttactgaattgct

SEQ ID NO: 8311794 - DNA, 22 bp, Homo sapiens
atctggcttttaccccacggcc

SEQ ID NO: 8311795 - DNA, 22 bp, Homo sapiens
atctggctttcttaatgactta

SEQ ID NO: 8311796 - DNA, 22 bp, Homo sapiens
atctggcttgactttgcgactt

SEQ ID NO: 8311797 - DNA, 22 bp, Homo sapiens
atctggcttgggtgtgggtagc

SEQ ID NO: 8311798 - DNA, 22 bp, Homo sapiens
atctggcttacgaagcactggt

SEQ ID NO: 8311799 - DNA, 22 bp, Homo sapiens
atctggctgactttgtgggaca

SEQ ID NO: 8311800 - DNA, 22 bp, Homo sapiens
atctggctgagcgaggcccaca

SEQ ID NO: 8311801 - DNA, 22 bp, Homo sapiens
atctggcttacctagggtgcct

SEQ ID NO: 8311802 - DNA, 22 bp, Homo sapiens
atctggctggattcttagcgtt

SEQ ID NO: 8311803 - DNA, 22 bp, Homo sapiens
atctggctgctgtgcttaagct

SEQ ID NO: 8311804 - DNA, 17 bp, Homo sapiens
atctggctgcttctaga

SEQ ID NO: 8311805 - DNA, 22 bp, Homo sapiens
atgctgcacaagccacatgtag

SEQ ID NO: 8311806 - DNA, 22 bp, Homo sapiens
atgctgagactggagcagctgg

SEQ ID NO: 8311807 - DNA, 22 bp, Homo sapiens
atgctgaggacaaagagatcaa

SEQ ID NO: 8311808 - DNA, 22 bp, Homo sapiens
agagaacacgtgcatctgcaat

SEQ ID NO: 8311809 - DNA, 22 bp, Homo sapiens
agagaacacgtgcatctgcaat

SEQ ID NO: 8311810 - DNA, 22 bp, Homo sapiens
agagaacaaattaaaggtggtt

SEQ ID NO: 8311811 - DNA, 22 bp, Homo sapiens
atgccaggccccacgctgggca

SEQ ID NO: 8311812 - DNA, 22 bp, Homo sapiens
atgccactgacatggacaattt

SEQ ID NO: 8311813 - DNA, 22 bp, Homo sapiens
atgccagtcaaagaagatgaca

SEQ ID NO: 8311814 - DNA, 22 bp, Homo sapiens
cagccttctgaatgaacgtact

SEQ ID NO: 8311815 - DNA, 22 bp, Homo sapiens
agctctggaataatgatgtgat

SEQ ID NO: 8311816 - DNA, 22 bp, Homo sapiens
cagctgccccataaatcacagt

SEQ ID NO: 8311817 - DNA, 22 bp, Homo sapiens
cagctgccccataaatcacagt

SEQ ID NO: 8311818 - DNA, 22 bp, Homo sapiens
cagctgcccatcctgggaaatg

SEQ ID NO: 8311819 - DNA, 22 bp, Homo sapiens
cagctgcccaggccacctggag

SEQ ID NO: 8311820 - DNA, 22 bp, Homo sapiens
cagctgccccgctggctgacca

SEQ ID NO: 8311821 - DNA, 22 bp, Homo sapiens
cagctgccccgctggctgacca

SEQ ID NO: 8311822 - DNA, 22 bp, Homo sapiens
cagctgccatgacatgtcctgc

SEQ ID NO: 8311823 - DNA, 22 bp, Homo sapiens
cagctgcccaggccacctggag

SEQ ID NO: 8311824 - DNA, 22 bp, Homo sapiens
cagctgcccaagccccagatgt

SEQ ID NO: 8311825 - DNA, 22 bp, Homo sapiens
cagctgagcatcactagtctgg

SEQ ID NO: 8311826 - DNA, 18 bp, Homo sapiens
cagctgccagctcatgga

SEQ ID NO: 8311827 - DNA, 22 bp, Homo sapiens
cagctgccagcttctctccatc

SEQ ID NO: 8311828 - DNA, 18 bp, Homo sapiens
cagctgccagctcatgga

SEQ ID NO: 8311829 - DNA, 22 bp, Homo sapiens
cagctggcagaacctgcatcca

SEQ ID NO: 8311830 - DNA, 22 bp, Homo sapiens
cagctggcaagtggagcagggt

SEQ ID NO: 8311831 - DNA, 22 bp, Homo sapiens
cagctggatgggagaccatgtt

SEQ ID NO: 8311832 - DNA, 22 bp, Homo sapiens
cagctggatgggagaccatgtt

SEQ ID NO: 8311833 - DNA, 22 bp, Homo sapiens
cagctggcaagtggagcagggt

SEQ ID NO: 8311834 - DNA, 22 bp, Homo sapiens
cagctggcatacctgggcccgg

SEQ ID NO: 8311835 - DNA, 22 bp, Homo sapiens
cagctggcagccctggccctgc

SEQ ID NO: 8311836 - DNA, 22 bp, Homo sapiens
cagctggcagaacctgcatcca

SEQ ID NO: 8311837 - DNA, 22 bp, Homo sapiens
cagctggatccctgcagaactt

SEQ ID NO: 8311838 - DNA, 20 bp, Homo sapiens
agctgaggcacctgaggtta

SEQ ID NO: 8311839 - DNA, 17 bp, Homo sapiens
agctgagctggccaggg

SEQ ID NO: 8311840 - DNA, 22 bp, Homo sapiens
agctgagctgcagatgactgta

SEQ ID NO: 8311841 - DNA, 22 bp, Homo sapiens
agctgagctgcagatgactgta

SEQ ID NO: 8311842 - DNA, 21 bp, Homo sapiens
agctgagcccagaagactggt

SEQ ID NO: 8311843 - DNA, 22 bp, Homo sapiens
agctgagctcaggctgatgtaa

SEQ ID NO: 8311844 - DNA, 22 bp, Homo sapiens
agctgagctagtagttccagtg

SEQ ID NO: 8311845 - DNA, 22 bp, Homo sapiens
agctgagctcaggctgatgtaa

SEQ ID NO: 8311846 - DNA, 22 bp, Homo sapiens
agctgagccagcagcaacagga

SEQ ID NO: 8311847 - DNA, 22 bp, Homo sapiens
agctgagccagcagcaacagga

SEQ ID NO: 8311848 - DNA, 22 bp, Homo sapiens
agctgagcatttgatccacctc

SEQ ID NO: 8311849 - DNA, 22 bp, Homo sapiens
cagcatggtggagctgctcttt

SEQ ID NO: 8311850 - DNA, 22 bp, Homo sapiens
cagcatggtgccagtgagtcca

SEQ ID NO: 8311851 - DNA, 22 bp, Homo sapiens
cagcatggtgccagtgagtcca

SEQ ID NO: 8311852 - DNA, 22 bp, Homo sapiens
cagcatggggcttggagtcagc

SEQ ID NO: 8311853 - DNA, 22 bp, Homo sapiens
cagcatggggcttggagtcagc

SEQ ID NO: 8311854 - DNA, 22 bp, Homo sapiens
cagcatcaccgccatttctgat

SEQ ID NO: 8311855 - DNA, 22 bp, Homo sapiens
cagcatggagacaaagtgggca

SEQ ID NO: 8311856 - DNA, 22 bp, Homo sapiens
cagcatggggatcactgtaggc

SEQ ID NO: 8311857 - DNA, 22 bp, Homo sapiens
cagcatggggatcactgtaggc

SEQ ID NO: 8311858 - DNA, 22 bp, Homo sapiens
cagcatggcttgagtgtttcct

SEQ ID NO: 8311859 - DNA, 22 bp, Homo sapiens
cagcactgcttcgcagccaggg

SEQ ID NO: 8311860 - DNA, 22 bp, Homo sapiens
cagcactggggggattcggagc

SEQ ID NO: 8311861 - DNA, 22 bp, Homo sapiens
cagcctctctgtatctcaggat

SEQ ID NO: 8311862 - DNA, 22 bp, Homo sapiens
cagcctctaagcacagcctctc

SEQ ID NO: 8311863 - DNA, 22 bp, Homo sapiens
cagcctcctgggacactcaccg

SEQ ID NO: 8311864 - DNA, 22 bp, Homo sapiens
cagccccacacggtctagctct

SEQ ID NO: 8311865 - DNA, 22 bp, Homo sapiens
cagccagctggcactgtgagta

SEQ ID NO: 8311866 - DNA, 22 bp, Homo sapiens
cagcccaaagccccaggctaga

SEQ ID NO: 8311867 - DNA, 22 bp, Homo sapiens
cagccatcagtaaagacagctt

SEQ ID NO: 8311868 - DNA, 22 bp, Homo sapiens
cagccatcccagcctgtggttc

SEQ ID NO: 8311869 - DNA, 22 bp, Homo sapiens
agccagggacgctgcaggctac

SEQ ID NO: 8311870 - DNA, 22 bp, Homo sapiens
agccagggacgctgcaggctac

SEQ ID NO: 8311871 - DNA, 22 bp, Homo sapiens
agccaggctgcagttggctggc

SEQ ID NO: 8311872 - DNA, 22 bp, Homo sapiens
agccaagcaccactggcactcg

SEQ ID NO: 8311873 - DNA, 22 bp, Homo sapiens
agccaagcactcaactcctgga

SEQ ID NO: 8311874 - DNA, 22 bp, Homo sapiens
agccaactaggagattaaggta

SEQ ID NO: 8311875 - DNA, 22 bp, Homo sapiens
cagagcagggtgcaccttgggc

SEQ ID NO: 8311876 - DNA, 22 bp, Homo sapiens
agccagggaggtggaggttgca

SEQ ID NO: 8311877 - DNA, 22 bp, Homo sapiens
agccagggatggcagtgcccag

SEQ ID NO: 8311878 - DNA, 23 bp, Homo sapiens
agccagggcactggtggagattg

SEQ ID NO: 8311879 - DNA, 22 bp, Homo sapiens
cagagccatccaggtgcctgtt

SEQ ID NO: 8311880 - DNA, 22 bp, Homo sapiens
cagagccatggtatgggcttgt

SEQ ID NO: 8311881 - DNA, 22 bp, Homo sapiens
cagagccattatggagacttgc

SEQ ID NO: 8311882 - DNA, 21 bp, Homo sapiens
cagagctgtccaaaccctgac

SEQ ID NO: 8311883 - DNA, 22 bp, Homo sapiens
cagagctgttgcggggcttggc

SEQ ID NO: 8311884 - DNA, 20 bp, Homo sapiens
cagagctgttatggatgatg

SEQ ID NO: 8311885 - DNA, 22 bp, Homo sapiens
cagagctgttactattcatgaa

SEQ ID NO: 8311886 - DNA, 22 bp, Homo sapiens
cagagctgtgataaatagatat

SEQ ID NO: 8311887 - DNA, 22 bp, Homo sapiens
cagagctgtccaaaccctgaca

SEQ ID NO: 8311888 - DNA, 22 bp, Homo sapiens
cagagccaggcctgccctcttt

SEQ ID NO: 8311889 - DNA, 22 bp, Homo sapiens
cagagccaggtctaggagtctc

SEQ ID NO: 8311890 - DNA, 22 bp, Homo sapiens
cagagccagggttgcacccctg

SEQ ID NO: 8311891 - DNA, 22 bp, Homo sapiens
cagagcagtaaatctggggcac

SEQ ID NO: 8311892 - DNA, 22 bp, Homo sapiens
cagagcagtaaatctggggcac

SEQ ID NO: 8311893 - DNA, 22 bp, Homo sapiens
cagagcaggtatctttggtgaa

SEQ ID NO: 8311894 - DNA, 22 bp, Homo sapiens
cagagcagtccttgtcaatcag

SEQ ID NO: 8311895 - DNA, 18 bp, Homo sapiens
agcctggagggttgaagt

SEQ ID NO: 8311896 - DNA, 19 bp, Homo sapiens
agcctggagggctggtcac

SEQ ID NO: 8311897 - DNA, 22 bp, Homo sapiens
agcctggaggccaggagacagt

SEQ ID NO: 8311898 - DNA, 22 bp, Homo sapiens
agcctggaggaggagttgagca

SEQ ID NO: 8311899 - DNA, 22 bp, Homo sapiens
agcctggagcttgagttatgag

SEQ ID NO: 8311900 - DNA, 22 bp, Homo sapiens
agcctggagaggcgccatacac

SEQ ID NO: 8311901 - DNA, 22 bp, Homo sapiens
agcctggacagctacggagaac

SEQ ID NO: 8311902 - DNA, 22 bp, Homo sapiens
agcctggaattaaggaaatgca

SEQ ID NO: 8311903 - DNA, 22 bp, Homo sapiens
agcctggagaagatgtgtattg

SEQ ID NO: 8311904 - DNA, 22 bp, Homo sapiens
agcctggaccaggggcctcaga

SEQ ID NO: 8311905 - DNA, 22 bp, Homo sapiens
agcctggaagaacctgaagtct

SEQ ID NO: 8311906 - DNA, 22 bp, Homo sapiens
agcctgagtgcttaggactgtt

SEQ ID NO: 8311907 - DNA, 18 bp, Homo sapiens
cagatccaggcagctatt

SEQ ID NO: 8311908 - DNA, 22 bp, Homo sapiens
agcccttcaacctgcctactcc

SEQ ID NO: 8311909 - DNA, 22 bp, Homo sapiens
cagagtggcagtcccaggccca

SEQ ID NO: 8311910 - DNA, 21 bp, Homo sapiens
cagaggtggcctgacctctga

SEQ ID NO: 8311911 - DNA, 22 bp, Homo sapiens
cagagtgagggcctgcacctgc

SEQ ID NO: 8311912 - DNA, 22 bp, Homo sapiens
cagagtgaaataggggatcaag

SEQ ID NO: 8311913 - DNA, 22 bp, Homo sapiens
cagaggaggccaccgcataggc

SEQ ID NO: 8311914 - DNA, 19 bp, Homo sapiens
caagtgaagcctgggatgg

SEQ ID NO: 8311915 - DNA, 22 bp, Homo sapiens
caatgatggctaggcagctgct

SEQ ID NO: 8311916 - DNA, 22 bp, Homo sapiens
caatgatgtttagataaaatcc

SEQ ID NO: 8311917 - DNA, 22 bp, Homo sapiens
caatgattctgcaactgtgtgc

SEQ ID NO: 8311918 - DNA, 22 bp, Homo sapiens
caagggcttcaagtggccaaga

SEQ ID NO: 8311919 - DNA, 22 bp, Homo sapiens
caagggctcttttgaggaatgt

SEQ ID NO: 8311920 - DNA, 22 bp, Homo sapiens
caagggctcacggtctgctggg

SEQ ID NO: 8311921 - DNA, 22 bp, Homo sapiens
caagggcctccaccttgctcgt

SEQ ID NO: 8311922 - DNA, 22 bp, Homo sapiens
caagggacctgagatggtctct

SEQ ID NO: 8311923 - DNA, 22 bp, Homo sapiens
caagggagttactgagggcggg

SEQ ID NO: 8311924 - DNA, 22 bp, Homo sapiens
agcagagaagacacaggcttca

SEQ ID NO: 8311925 - DNA, 22 bp, Homo sapiens
caaggaaaaagcgagctcgggg

SEQ ID NO: 8311926 - DNA, 22 bp, Homo sapiens
caaggaaaacagatgatcaaca

SEQ ID NO: 8311927 - DNA, 22 bp, Homo sapiens
caaggaaacatgaaatgcattg

SEQ ID NO: 8311928 - DNA, 22 bp, Homo sapiens
cacagctgccctactccatgtg

SEQ ID NO: 8311929 - DNA, 22 bp, Homo sapiens
cacagctgccctactccatgtg

SEQ ID NO: 8311930 - DNA, 22 bp, Homo sapiens
cacagctgccctactccatgtg

SEQ ID NO: 8311931 - DNA, 22 bp, Homo sapiens
cacagctgccatggctgcactt

SEQ ID NO: 8311932 - DNA, 22 bp, Homo sapiens
cacacatgtctctccatgctct

SEQ ID NO: 8311933 - DNA, 22 bp, Homo sapiens
cacacatgtctctccatgctct

SEQ ID NO: 8311934 - DNA, 22 bp, Homo sapiens
cacacatgaatccctagtacct

SEQ ID NO: 8311935 - DNA, 22 bp, Homo sapiens
cacacatgagtctccccattgg

SEQ ID NO: 8311936 - DNA, 22 bp, Homo sapiens
cacagaaaaaggcttgaaaatc

SEQ ID NO: 8311937 - DNA, 22 bp, Homo sapiens
cactacttgaaagaattacaga

SEQ ID NO: 8311938 - DNA, 22 bp, Homo sapiens
cactaggctggagtgcagtggc

SEQ ID NO: 8311939 - DNA, 20 bp, Homo sapiens
cacgtttttccactagcaaa

SEQ ID NO: 8311940 - DNA, 22 bp, Homo sapiens
cacgttttatgacagaagaagc

SEQ ID NO: 8311941 - DNA, 22 bp, Homo sapiens
cacctgagtgtcagtattctca

SEQ ID NO: 8311942 - DNA, 22 bp, Homo sapiens
cacatttaaaggttgaagctga

SEQ ID NO: 8311943 - DNA, 22 bp, Homo sapiens
cacattgaaatgacccaataat

SEQ ID NO: 8311944 - DNA, 22 bp, Homo sapiens
cacaggctcttctcacttgatt

SEQ ID NO: 8311945 - DNA, 22 bp, Homo sapiens
cacaggctgcccgcagctggga

SEQ ID NO: 8311946 - DNA, 22 bp, Homo sapiens
cacatgggcgtaatgtccatgg

SEQ ID NO: 8311947 - DNA, 22 bp, Homo sapiens
cacatggggcgctgcattggcc

SEQ ID NO: 8311948 - DNA, 22 bp, Homo sapiens
cacatgggtgtgcctggaggaa

SEQ ID NO: 8311949 - DNA, 22 bp, Homo sapiens
cacatgtacagaagcaggctgg

SEQ ID NO: 8311950 - DNA, 22 bp, Homo sapiens
cacatgtagtaagcaggcaatg

SEQ ID NO: 8311951 - DNA, 20 bp, Homo sapiens
cacaggctatatgagagcca

SEQ ID NO: 8311952 - DNA, 18 bp, Homo sapiens
cacaggctcccagtgagg

SEQ ID NO: 8311953 - DNA, 22 bp, Homo sapiens
cacaggctccggccttgcagcc

SEQ ID NO: 8311954 - DNA, 22 bp, Homo sapiens
agcaggctaagggacctgttta

SEQ ID NO: 8311955 - DNA, 22 bp, Homo sapiens
cactggggaaaacaggcttctt

SEQ ID NO: 8311956 - DNA, 22 bp, Homo sapiens
cactgggcgtgtcctgggtgag

SEQ ID NO: 8311957 - DNA, 22 bp, Homo sapiens
cactggggtgggcctggtagag

SEQ ID NO: 8311958 - DNA, 22 bp, Homo sapiens
agccaaagatcagtgtgcaagt

SEQ ID NO: 8311959 - DNA, 22 bp, Homo sapiens
cagaaagacctgggctcaagag

SEQ ID NO: 8311960 - DNA, 22 bp, Homo sapiens
cactgcacttcagcctgggtga

SEQ ID NO: 8311961 - DNA, 22 bp, Homo sapiens
agcatttatttcttagaaattg

SEQ ID NO: 8311962 - DNA, 22 bp, Homo sapiens
agcatttatgactaatgtaaaa

SEQ ID NO: 8311963 - DNA, 22 bp, Homo sapiens
agcatttaggagaatttgagaa

SEQ ID NO: 8311964 - DNA, 22 bp, Homo sapiens
agcatttagttagtaaatgttt

SEQ ID NO: 8311965 - DNA, 22 bp, Homo sapiens
cactgcactccagcccgggcaa

SEQ ID NO: 8311966 - DNA, 22 bp, Homo sapiens
cactgcactccatcctgggaaa

SEQ ID NO: 8311967 - DNA, 22 bp, Homo sapiens
atcctgggaagctgacattgaa

SEQ ID NO: 8311968 - DNA, 22 bp, Homo sapiens
agaagctgcctacatgaccagc

SEQ ID NO: 8311969 - DNA, 20 bp, Homo sapiens
agaagctgatactgatggaa

SEQ ID NO: 8311970 - DNA, 22 bp, Homo sapiens
agaagctgacagatgcagcagg

SEQ ID NO: 8311971 - DNA, 21 bp, Homo sapiens
agaagcctgggtggaggtggg

SEQ ID NO: 8311972 - DNA, 22 bp, Homo sapiens
agaagccattgaagcagacctc

SEQ ID NO: 8311973 - DNA, 22 bp, Homo sapiens
agaagccatgtttagtaggatg

SEQ ID NO: 8311974 - DNA, 22 bp, Homo sapiens
agaagccattccctgtaggctc

SEQ ID NO: 8311975 - DNA, 22 bp, Homo sapiens
agaagccattccctgtaggctc

SEQ ID NO: 8311976 - DNA, 22 bp, Homo sapiens
agaaatgtttatggctgcctat

SEQ ID NO: 8311977 - DNA, 22 bp, Homo sapiens
agaaatgttgtgggttttgtta

SEQ ID NO: 8311978 - DNA, 22 bp, Homo sapiens
agaagcagttattttttgcaca

SEQ ID NO: 8311979 - DNA, 22 bp, Homo sapiens
agaaatgggccttgggacacaa

SEQ ID NO: 8311980 - DNA, 22 bp, Homo sapiens
agaaatgtacgatgttatgcag

SEQ ID NO: 8311981 - DNA, 21 bp, Homo sapiens
agaaatgtatcattcttttcc

SEQ ID NO: 8311982 - DNA, 22 bp, Homo sapiens
agaaatgtatagtgaatttttc

SEQ ID NO: 8311983 - DNA, 22 bp, Homo sapiens
agaaatgtattctgtatgtttt

SEQ ID NO: 8311984 - DNA, 22 bp, Homo sapiens
agaaatgtgagccccttatcaa

SEQ ID NO: 8311985 - DNA, 22 bp, Homo sapiens
agaaatgtgaatttcatttcct

SEQ ID NO: 8311986 - DNA, 22 bp, Homo sapiens
agaaatgttacagttgttattt

SEQ ID NO: 8311987 - DNA, 22 bp, Homo sapiens
agaaatgtggatcgttttaaaa

SEQ ID NO: 8311988 - DNA, 23 bp, Homo sapiens
atcaagataatccagatgaccta

SEQ ID NO: 8311989 - DNA, 22 bp, Homo sapiens
agaaatgctcttcctgaccaga

SEQ ID NO: 8311990 - DNA, 22 bp, Homo sapiens
agaaatgcattagcacatatag

SEQ ID NO: 8311991 - DNA, 22 bp, Homo sapiens
atcaattcttaggaaaatagct

SEQ ID NO: 8311992 - DNA, 22 bp, Homo sapiens
agaaatcaatatctatatgttg

SEQ ID NO: 8311993 - DNA, 22 bp, Homo sapiens
agaaatatgctgattagatgaa

SEQ ID NO: 8311994 - DNA, 22 bp, Homo sapiens
agaaatcacaggaggcagaagg

SEQ ID NO: 8311995 - DNA, 22 bp, Homo sapiens
agaaatcagaaccctgaagttc

SEQ ID NO: 8311996 - DNA, 22 bp, Homo sapiens
agaaagaacgttggttatctta

SEQ ID NO: 8311997 - DNA, 22 bp, Homo sapiens
agaaagaacgcacttgtgctgc

SEQ ID NO: 8311998 - DNA, 17 bp, Homo sapiens
agaaagaggatccacag

SEQ ID NO: 8311999 - DNA, 17 bp, Homo sapiens
agaaagaggatccacag

SEQ ID NO: 8312000 - DNA, 22 bp, Homo sapiens
agaaacttcagctattcttttg

SEQ ID NO: 8312001 - DNA, 22 bp, Homo sapiens
ataacagagagctactgaactg

SEQ ID NO: 8312002 - DNA, 22 bp, Homo sapiens
ataaggaatgatgtatcagttt

SEQ ID NO: 8312003 - DNA, 19 bp, Homo sapiens
ataaggcaattggatttgg

SEQ ID NO: 8312004 - DNA, 22 bp, Homo sapiens
ataaggcaagctgtcagtttgt

SEQ ID NO: 8312005 - DNA, 22 bp, Homo sapiens
ataaggcacacatagatagggt

SEQ ID NO: 8312006 - DNA, 19 bp, Homo sapiens
ataaggcaggaggaaattt

SEQ ID NO: 8312007 - DNA, 22 bp, Homo sapiens
ataaggcagaaatgattctagt

SEQ ID NO: 8312008 - DNA, 22 bp, Homo sapiens
ataaggcagaaatagggaaagt

SEQ ID NO: 8312009 - DNA, 22 bp, Homo sapiens
ataaggtatgaaaagtaaatgg

SEQ ID NO: 8312010 - DNA, 20 bp, Homo sapiens
atacaaagagattgatgtat

SEQ ID NO: 8312011 - DNA, 22 bp, Homo sapiens
atacaaagacaaatctcaatct

SEQ ID NO: 8312012 - DNA, 22 bp, Homo sapiens
atacaagttgtgataatgtaaa

SEQ ID NO: 8312013 - DNA, 22 bp, Homo sapiens
ataaggcagtcccttaacaagg

SEQ ID NO: 8312014 - DNA, 22 bp, Homo sapiens
ataaggcagtgacttcatctat

SEQ ID NO: 8312015 - DNA, 22 bp, Homo sapiens
ataaggcagtcactggaatgtt

SEQ ID NO: 8312016 - DNA, 19 bp, Homo sapiens
ataaggcagtgactttttt

SEQ ID NO: 8312017 - DNA, 23 bp, Homo sapiens
ataaggcataaaggtacattgga

SEQ ID NO: 8312018 - DNA, 22 bp, Homo sapiens
ataaggcatatagtcacttttt

SEQ ID NO: 8312019 - DNA, 22 bp, Homo sapiens
ataaggcatctctcagttagca

SEQ ID NO: 8312020 - DNA, 22 bp, Homo sapiens
agttcacattccgaggtactgg

SEQ ID NO: 8312021 - DNA, 22 bp, Homo sapiens
agttcttttgtgaacatatgct

SEQ ID NO: 8312022 - DNA, 22 bp, Homo sapiens
agttctttggtcctaaccctgc

SEQ ID NO: 8312023 - DNA, 22 bp, Homo sapiens
agttgaaattagagtcctggct

SEQ ID NO: 8312024 - DNA, 22 bp, Homo sapiens
agttgcagacgcagagatgttg

SEQ ID NO: 8312025 - DNA, 22 bp, Homo sapiens
agttgcagacgcagagatgttg

SEQ ID NO: 8312026 - DNA, 22 bp, Homo sapiens
ataaatttataattgtttcctg

SEQ ID NO: 8312027 - DNA, 23 bp, Homo sapiens
agaaaagcttggacacatggcct

SEQ ID NO: 8312028 - DNA, 22 bp, Homo sapiens
agaaaaggattgatggatcaga

SEQ ID NO: 8312029 - DNA, 22 bp, Homo sapiens
agaaaagggcaggagggataca

SEQ ID NO: 8312030 - DNA, 22 bp, Homo sapiens
agaaaaggcttgaagaggtttt

SEQ ID NO: 8312031 - DNA, 23 bp, Homo sapiens
actttagataaattatgtgcaca

SEQ ID NO: 8312032 - DNA, 22 bp, Homo sapiens
atagaacagaaacagatgcaca

SEQ ID NO: 8312033 - DNA, 22 bp, Homo sapiens
agggtgcatgtttgcaagagtg

SEQ ID NO: 8312034 - DNA, 23 bp, Homo sapiens
aggtgccaactgagagctgagag

SEQ ID NO: 8312035 - DNA, 22 bp, Homo sapiens
aggtgccagatgcacagctgaa

SEQ ID NO: 8312036 - DNA, 21 bp, Homo sapiens
aggtgccaaggagaagcaggc

SEQ ID NO: 8312037 - DNA, 22 bp, Homo sapiens
aggtgccaattttcagtgaaca

SEQ ID NO: 8312038 - DNA, 18 bp, Homo sapiens
agggtcagtgtcactggc

SEQ ID NO: 8312039 - DNA, 22 bp, Homo sapiens
agggtcccgaaggagacagcaa

SEQ ID NO: 8312040 - DNA, 22 bp, Homo sapiens
agggtccatcaaggactgcaca

SEQ ID NO: 8312041 - DNA, 19 bp, Homo sapiens
agggtccagggagcggctc

SEQ ID NO: 8312042 - DNA, 22 bp, Homo sapiens
agggtgcagaaggagcctagga

SEQ ID NO: 8312043 - DNA, 22 bp, Homo sapiens
aggtggagacccagagaaggcg

SEQ ID NO: 8312044 - DNA, 22 bp, Homo sapiens
aggtggaacgttcaggtgctag

SEQ ID NO: 8312045 - DNA, 22 bp, Homo sapiens
aggtggagaagagatgggcagt

SEQ ID NO: 8312046 - DNA, 17 bp, Homo sapiens
aggtgggtggatcacct

SEQ ID NO: 8312047 - DNA, 22 bp, Homo sapiens
aggtgggttccgcggcggcccg

SEQ ID NO: 8312048 - DNA, 19 bp, Homo sapiens
aggtggtctaggctggaga

SEQ ID NO: 8312049 - DNA, 22 bp, Homo sapiens
aggtgggtatcatgagagatta

SEQ ID NO: 8312050 - DNA, 22 bp, Homo sapiens
aggtgggtcctggctctgccat

SEQ ID NO: 8312051 - DNA, 22 bp, Homo sapiens
actcacatttcatcaggccaag

SEQ ID NO: 8312052 - DNA, 22 bp, Homo sapiens
agtccaggagttgggtgacatt

SEQ ID NO: 8312053 - DNA, 22 bp, Homo sapiens
agtcctgggtgtgcaaggcaga

SEQ ID NO: 8312054 - DNA, 22 bp, Homo sapiens
agtccttcaagaaatctggaaa

SEQ ID NO: 8312055 - DNA, 22 bp, Homo sapiens
actctgggccccaggtggagct

SEQ ID NO: 8312056 - DNA, 23 bp, Homo sapiens
agtcagtgtaagtttggaatgca

SEQ ID NO: 8312057 - DNA, 22 bp, Homo sapiens
agtcagtgtagaaagcccaggc

SEQ ID NO: 8312058 - DNA, 22 bp, Homo sapiens
agtcagtggctccgagcctggt

SEQ ID NO: 8312059 - DNA, 22 bp, Homo sapiens
agtcagtgaaaactagaatgtt

SEQ ID NO: 8312060 - DNA, 22 bp, Homo sapiens
agtcagtgaaggcattgctcaa

SEQ ID NO: 8312061 - DNA, 22 bp, Homo sapiens
agtaactatgcttgagaatcag

SEQ ID NO: 8312062 - DNA, 22 bp, Homo sapiens
actcagagtttgcgttccatac

SEQ ID NO: 8312063 - DNA, 22 bp, Homo sapiens
agtgggggcagagcctctctcg

SEQ ID NO: 8312064 - DNA, 22 bp, Homo sapiens
agtgtctgaaccaccggggcat

SEQ ID NO: 8312065 - DNA, 20 bp, Homo sapiens
agtgtctggtgcagggcctc

SEQ ID NO: 8312066 - DNA, 19 bp, Homo sapiens
agtgtgtactgaaagcact

SEQ ID NO: 8312067 - DNA, 22 bp, Homo sapiens
agtgtgggttttatggagccct

SEQ ID NO: 8312068 - DNA, 22 bp, Homo sapiens
agtgtgggtgagggaggccctc

SEQ ID NO: 8312069 - DNA, 22 bp, Homo sapiens
agttacaaccatgacacaagca

SEQ ID NO: 8312070 - DNA, 22 bp, Homo sapiens
agtgggaggcggctgacgggcg

SEQ ID NO: 8312071 - DNA, 22 bp, Homo sapiens
agtggcagaagtcactgggtag

SEQ ID NO: 8312072 - DNA, 22 bp, Homo sapiens
agtggcagagcaggtgctggaa

SEQ ID NO: 8312073 - DNA, 22 bp, Homo sapiens
agtgctgaagactggctaggga

SEQ ID NO: 8312074 - DNA, 22 bp, Homo sapiens
agtgctgtcccgacaactgagg

SEQ ID NO: 8312075 - DNA, 22 bp, Homo sapiens
agtgctgtccagtttcacaggt

SEQ ID NO: 8312076 - DNA, 20 bp, Homo sapiens
agtgcaagaaagcacagctg

SEQ ID NO: 8312077 - DNA, 22 bp, Homo sapiens
accactgtatctccagcacatt

SEQ ID NO: 8312078 - DNA, 22 bp, Homo sapiens
accactgcccatggtgaaaact

SEQ ID NO: 8312079 - DNA, 22 bp, Homo sapiens
accactgcccatggtgaaaact

SEQ ID NO: 8312080 - DNA, 22 bp, Homo sapiens
accactgggcgggcagcctgct

SEQ ID NO: 8312081 - DNA, 22 bp, Homo sapiens
aggctgggaaatgtagtcttcc

SEQ ID NO: 8312082 - DNA, 22 bp, Homo sapiens
aggctgggaaatgtattccagc

SEQ ID NO: 8312083 - DNA, 22 bp, Homo sapiens
aggctgggaaacctgaagttgt

SEQ ID NO: 8312084 - DNA, 22 bp, Homo sapiens
aggctgcagaacagtcaggtgc

SEQ ID NO: 8312085 - DNA, 22 bp, Homo sapiens
aggctgctctgcgaagtcagct

SEQ ID NO: 8312086 - DNA, 22 bp, Homo sapiens
acatttctcagggagttttgct

SEQ ID NO: 8312087 - DNA, 17 bp, Homo sapiens
aggctgctgggccaggg

SEQ ID NO: 8312088 - DNA, 21 bp, Homo sapiens
aggctgctggctcagggtcct

SEQ ID NO: 8312089 - DNA, 22 bp, Homo sapiens
aggctgctggcaggcgtggacg

SEQ ID NO: 8312090 - DNA, 18 bp, Homo sapiens
acatttctctctgcgtga

SEQ ID NO: 8312091 - DNA, 18 bp, Homo sapiens
acatttctccttctgacc

SEQ ID NO: 8312092 - DNA, 22 bp, Homo sapiens
acatttctccttgcaggagtca

SEQ ID NO: 8312093 - DNA, 22 bp, Homo sapiens
aggctggcttggctctcctgtg

SEQ ID NO: 8312094 - DNA, 22 bp, Homo sapiens
acatttctcatctagtagagta

SEQ ID NO: 8312095 - DNA, 22 bp, Homo sapiens
acatttctcataggagagccac

SEQ ID NO: 8312096 - DNA, 22 bp, Homo sapiens
acatttctcaggtaagtcattt

SEQ ID NO: 8312097 - DNA, 22 bp, Homo sapiens
acatttctccctgcatgcctgc

SEQ ID NO: 8312098 - DNA, 22 bp, Homo sapiens
acatttctcattctcccctaac

SEQ ID NO: 8312099 - DNA, 22 bp, Homo sapiens
acatttctcctacttgttattt

SEQ ID NO: 8312100 - DNA, 22 bp, Homo sapiens
aggctccttgttcatcatccat

SEQ ID NO: 8312101 - DNA, 20 bp, Homo sapiens
acatgtactaatgaatacag

SEQ ID NO: 8312102 - DNA, 22 bp, Homo sapiens
acatgtcaatttagtactctta

SEQ ID NO: 8312103 - DNA, 21 bp, Homo sapiens
acatgtctctaatctcagtga

SEQ ID NO: 8312104 - DNA, 22 bp, Homo sapiens
acatgtggtcaatctgtgtagg

SEQ ID NO: 8312105 - DNA, 20 bp, Homo sapiens
aggctcagctgagctcttgg

SEQ ID NO: 8312106 - DNA, 22 bp, Homo sapiens
aggctcagctggtggtgatcgc

SEQ ID NO: 8312107 - DNA, 22 bp, Homo sapiens
aggctcaggcaggaatggcgga

SEQ ID NO: 8312108 - DNA, 22 bp, Homo sapiens
aggggagcccctggtcctggtg

SEQ ID NO: 8312109 - DNA, 22 bp, Homo sapiens
aggggagctaacaccagagccc

SEQ ID NO: 8312110 - DNA, 22 bp, Homo sapiens
aggggaggagcttttcttgcct

SEQ ID NO: 8312111 - DNA, 22 bp, Homo sapiens
aggggtgtgcatcctggaggat

SEQ ID NO: 8312112 - DNA, 23 bp, Homo sapiens
aggggtggtcagtacccgcagtg

SEQ ID NO: 8312113 - DNA, 22 bp, Homo sapiens
aggggtgatttgggacaggaca

SEQ ID NO: 8312114 - DNA, 22 bp, Homo sapiens
aggggtggagagtgttgccagt

SEQ ID NO: 8312115 - DNA, 22 bp, Homo sapiens
aggggtggcctgccttactccc

SEQ ID NO: 8312116 - DNA, 22 bp, Homo sapiens
aggggtggcctgccttactccc

SEQ ID NO: 8312117 - DNA, 22 bp, Homo sapiens
aggggtggagagtgttgccagt

SEQ ID NO: 8312118 - DNA, 22 bp, Homo sapiens
acctcccagctctgagcttggg

SEQ ID NO: 8312119 - DNA, 22 bp, Homo sapiens
aggggcctcgcaggaccgctcc

SEQ ID NO: 8312120 - DNA, 22 bp, Homo sapiens
accctttcttactcacacgctc

SEQ ID NO: 8312121 - DNA, 22 bp, Homo sapiens
aggggccattgttctgcccgct

SEQ ID NO: 8312122 - DNA, 22 bp, Homo sapiens
acctcaggatgtggacacagaa

SEQ ID NO: 8312123 - DNA, 21 bp, Homo sapiens
acctcaagcaacaaccaaggt

SEQ ID NO: 8312124 - DNA, 22 bp, Homo sapiens
agggccagcactcctggcagga

SEQ ID NO: 8312125 - DNA, 22 bp, Homo sapiens
agggccagcccataatgccaaa

SEQ ID NO: 8312126 - DNA, 22 bp, Homo sapiens
agggcctgtcagcggtgtcctg

SEQ ID NO: 8312127 - DNA, 22 bp, Homo sapiens
accagagcagactactggaggt

SEQ ID NO: 8312128 - DNA, 22 bp, Homo sapiens
accagagatggggcttctctgt

SEQ ID NO: 8312129 - DNA, 22 bp, Homo sapiens
accagagaaaacacagcaggct

SEQ ID NO: 8312130 - DNA, 22 bp, Homo sapiens
accagagcgctcaagccttccc

SEQ ID NO: 8312131 - DNA, 22 bp, Homo sapiens
agggaggatagtagtcagttta

SEQ ID NO: 8312132 - DNA, 22 bp, Homo sapiens
agggaggatctgctccttgtct

SEQ ID NO: 8312133 - DNA, 22 bp, Homo sapiens
agggcacatctgctgggaatgg

SEQ ID NO: 8312134 - DNA, 22 bp, Homo sapiens
agggcacaagactctgagcccc

SEQ ID NO: 8312135 - DNA, 22 bp, Homo sapiens
agggcacagcctaaagcctatg

SEQ ID NO: 8312136 - DNA, 22 bp, Homo sapiens
agggcaagttgagtgtgcgtgg

SEQ ID NO: 8312137 - DNA, 22 bp, Homo sapiens
agggaggtaggagcttctagct

SEQ ID NO: 8312138 - DNA, 22 bp, Homo sapiens
agggaggtctttgaggggctta

SEQ ID NO: 8312139 - DNA, 22 bp, Homo sapiens
aggactggccctgaggggaggc

SEQ ID NO: 8312140 - DNA, 22 bp, Homo sapiens
aggactggcggtcggtggggat

SEQ ID NO: 8312141 - DNA, 22 bp, Homo sapiens
aggactgggtgcagagggcatc

SEQ ID NO: 8312142 - DNA, 22 bp, Homo sapiens
acagggccattatctgttctag

SEQ ID NO: 8312143 - DNA, 22 bp, Homo sapiens
acagggccagcctgggacctgg

SEQ ID NO: 8312144 - DNA, 22 bp, Homo sapiens
acagggccaggtgagaggtgct

SEQ ID NO: 8312145 - DNA, 22 bp, Homo sapiens
acagggcctcagccagggcaga

SEQ ID NO: 8312146 - DNA, 22 bp, Homo sapiens
acagggcctcagctgattctgg

SEQ ID NO: 8312147 - DNA, 22 bp, Homo sapiens
acagggcccttgccagcacaag

SEQ ID NO: 8312148 - DNA, 19 bp, Homo sapiens
aggaaaggtggccttagca

SEQ ID NO: 8312149 - DNA, 22 bp, Homo sapiens
acagggcagtgtcttgaaaaat

SEQ ID NO: 8312150 - DNA, 22 bp, Homo sapiens
acagggcaggtggctactggtc

SEQ ID NO: 8312151 - DNA, 21 bp, Homo sapiens
acaggctctggggatgctggg

SEQ ID NO: 8312152 - DNA, 22 bp, Homo sapiens
acaggctctcagccagttggca

SEQ ID NO: 8312153 - DNA, 23 bp, Homo sapiens
acagggcattgctggcctcgagg

SEQ ID NO: 8312154 - DNA, 22 bp, Homo sapiens
acagggcatttcctctatgtgt

SEQ ID NO: 8312155 - DNA, 22 bp, Homo sapiens
acagggcatgtgcaagagacat

SEQ ID NO: 8312156 - DNA, 21 bp, Homo sapiens
acagggcatgcagctggctgt

SEQ ID NO: 8312157 - DNA, 22 bp, Homo sapiens
agcttcttgaccaagcctgtaa

SEQ ID NO: 8312158 - DNA, 20 bp, Homo sapiens
acagccagaggaggcagaca

SEQ ID NO: 8312159 - DNA, 22 bp, Homo sapiens
acagccagaggagccaggctgg

SEQ ID NO: 8312160 - DNA, 22 bp, Homo sapiens
aggacttagaacattatgtact

SEQ ID NO: 8312161 - DNA, 22 bp, Homo sapiens
aggacttcatcacctgtataaa

SEQ ID NO: 8312162 - DNA, 22 bp, Homo sapiens
acagtgaatgcccaagaaaagt

SEQ ID NO: 8312163 - DNA, 17 bp, Homo sapiens
aggaggccctggcgttt

SEQ ID NO: 8312164 - DNA, 22 bp, Homo sapiens
aggaggccgatttcagaggtcg

SEQ ID NO: 8312165 - DNA, 22 bp, Homo sapiens
aggaggcccctcctgggttgct

SEQ ID NO: 8312166 - DNA, 22 bp, Homo sapiens
aggaggccctagagctctagag

SEQ ID NO: 8312167 - DNA, 22 bp, Homo sapiens
aggcactggtccattttctgca

SEQ ID NO: 8312168 - DNA, 22 bp, Homo sapiens
aggcagaaaatagtcatccaaa

SEQ ID NO: 8312169 - DNA, 22 bp, Homo sapiens
aggcactgaaaggtggccagag

SEQ ID NO: 8312170 - DNA, 22 bp, Homo sapiens
acagtggagaaggcatgaggct

SEQ ID NO: 8312171 - DNA, 22 bp, Homo sapiens
aggcaggtgggtcacttgagtc

SEQ ID NO: 8312172 - DNA, 22 bp, Homo sapiens
aggcagcaaagaaatgatgctg

SEQ ID NO: 8312173 - DNA, 22 bp, Homo sapiens
aggcaggggagctggaagggta

SEQ ID NO: 8312174 - DNA, 22 bp, Homo sapiens
aggcagagaaaaaccagatatg

SEQ ID NO: 8312175 - DNA, 20 bp, Homo sapiens
aggcagacaaggagtctgtt

SEQ ID NO: 8312176 - DNA, 22 bp, Homo sapiens
aggcagaatgttggaaaggaag

SEQ ID NO: 8312177 - DNA, 21 bp, Homo sapiens
aggcagaaagagcccaggctg
